United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 81

SEQ ID NO: 2917503 - RNA, 20 nt, Mycobacterium avium subsp. paratuberculosis
acgucaggcccagcgaggcg

SEQ ID NO: 2917504 - RNA, 13 nt, Mycobacterium avium subsp. paratuberculosis
acgucaggccgua

SEQ ID NO: 2917505 - RNA, 19 nt, Mycobacterium avium subsp. paratuberculosis
acgucaggccguagcggcu

SEQ ID NO: 2917506 - RNA, 21 nt, Mycobacterium avium subsp. paratuberculosis
acgucaggccguagcggcucg

SEQ ID NO: 2917507 - RNA, 21 nt, Mycobacterium avium subsp. paratuberculosis
acgucaggggugccggaggcg

SEQ ID NO: 2917508 - RNA, 22 nt, Mycobacterium avium subsp. paratuberculosis
acgucaggguggccucgucggc

SEQ ID NO: 2917509 - RNA, 23 nt, Mycobacterium avium subsp. paratuberculosis
acgucaggguggccucgucggcg

SEQ ID NO: 2917510 - RNA, 19 nt, Mycobacterium avium subsp. paratuberculosis
acgucaggucgaccggcuc

SEQ ID NO: 2917511 - RNA, 20 nt, Mycobacterium avium subsp. paratuberculosis
acgucaggucgaccggcucg

SEQ ID NO: 2917512 - RNA, 21 nt, Mycobacterium avium subsp. paratuberculosis
acgucaggucgaccggcucgc

SEQ ID NO: 2917513 - RNA, 14 nt, Mycobacterium avium subsp. paratuberculosis
acgucauccggcug

SEQ ID NO: 2917514 - RNA, 15 nt, Mycobacterium avium subsp. paratuberculosis
acgucauggccagcu

SEQ ID NO: 2917515 - RNA, 23 nt, Mycobacterium avium subsp. paratuberculosis
acguccaccagcaccaggcgggu

SEQ ID NO: 2917516 - RNA, 17 nt, Mycobacterium avium subsp. paratuberculosis
acguccaccaggguggc

SEQ ID NO: 2917517 - RNA, 20 nt, Mycobacterium avium subsp. paratuberculosis
acguccaccaggguggccgc

SEQ ID NO: 2917518 - RNA, 15 nt, Mycobacterium avium subsp. paratuberculosis
acguccacgccgcgg

SEQ ID NO: 2917519 - RNA, 16 nt, Mycobacterium avium subsp. paratuberculosis
acguccacgccgcggg

SEQ ID NO: 2917520 - RNA, 17 nt, Mycobacterium avium subsp. paratuberculosis
acguccacgccgcggga

SEQ ID NO: 2917521 - RNA, 16 nt, Mycobacterium avium subsp. paratuberculosis
acguccagcccgcgcc

SEQ ID NO: 2917522 - RNA, 14 nt, Mycobacterium avium subsp. paratuberculosis
acguccagcgccgc

SEQ ID NO: 2917523 - RNA, 21 nt, Mycobacterium avium subsp. paratuberculosis
acguccagcugggcugccagc

SEQ ID NO: 2917524 - RNA, 19 nt, Mycobacterium avium subsp. paratuberculosis
acgucgauccccgcagcuc

SEQ ID NO: 2917525 - RNA, 20 nt, Mycobacterium avium subsp. paratuberculosis
acgucgauccccgcagcucc

SEQ ID NO: 2917526 - RNA, 16 nt, Mycobacterium avium subsp. paratuberculosis
acgucgaugccgaacc

SEQ ID NO: 2917527 - RNA, 20 nt, Mycobacterium avium subsp. paratuberculosis
acgucgaugccgaaccgcuc

SEQ ID NO: 2917528 - RNA, 14 nt, Mycobacterium avium subsp. paratuberculosis
acgucgaugccggc

SEQ ID NO: 2917529 - RNA, 17 nt, Mycobacterium avium subsp. paratuberculosis
acgucgaugccggccag

SEQ ID NO: 2917530 - RNA, 18 nt, Mycobacterium avium subsp. paratuberculosis
acgucgaugccggccagc

SEQ ID NO: 2917531 - RNA, 15 nt, Mycobacterium avium subsp. paratuberculosis
acgucgcagcccggg

SEQ ID NO: 2917532 - RNA, 18 nt, Mycobacterium avium subsp. paratuberculosis
acgucgcccacccggggc

SEQ ID NO: 2917533 - RNA, 11 nt, Mycobacterium avium subsp. paratuberculosis
acgucgccgau

SEQ ID NO: 2917534 - RNA, 13 nt, Mycobacterium avium subsp. paratuberculosis
acgucgccgccgc

SEQ ID NO: 2917535 - RNA, 16 nt, Mycobacterium avium subsp. paratuberculosis
acgucgccgccgcaau

SEQ ID NO: 2917536 - RNA, 13 nt, Mycobacterium avium subsp. paratuberculosis
acgucgccggccu

SEQ ID NO: 2917537 - RNA, 14 nt, Mycobacterium avium subsp. paratuberculosis
acgucgccggccug

SEQ ID NO: 2917538 - RNA, 15 nt, Mycobacterium avium subsp. paratuberculosis
acgucgccggccugc

SEQ ID NO: 2917539 - RNA, 16 nt, Mycobacterium avium subsp. paratuberculosis
acgucgccggccugcc

SEQ ID NO: 2917540 - RNA, 17 nt, Mycobacterium avium subsp. paratuberculosis
acgucgccggccugccc

SEQ ID NO: 2917541 - RNA, 22 nt, Mycobacterium avium subsp. paratuberculosis
acgucgccggccugcccgccgc

SEQ ID NO: 2917542 - RNA, 17 nt, Mycobacterium avium subsp. paratuberculosis
acgucgccggcgaccgc

SEQ ID NO: 2917543 - RNA, 22 nt, Mycobacterium avium subsp. paratuberculosis
acgucgccguucugacccuucu

SEQ ID NO: 2917544 - RNA, 13 nt, Mycobacterium avium subsp. paratuberculosis
acgucgcgcgggg

SEQ ID NO: 2917545 - RNA, 14 nt, Mycobacterium avium subsp. paratuberculosis
acgucgcgcggggu

SEQ ID NO: 2917546 - RNA, 16 nt, Mycobacterium avium subsp. paratuberculosis
acgucgcgcggggucg

SEQ ID NO: 2917547 - RNA, 18 nt, Mycobacterium avium subsp. paratuberculosis
acgucgcgcggggugacg

SEQ ID NO: 2917548 - RNA, 19 nt, Mycobacterium avium subsp. paratuberculosis
acgucgcgcggggugacgc

SEQ ID NO: 2917549 - RNA, 16 nt, Mycobacterium avium subsp. paratuberculosis
acgucgcgcugccggc

SEQ ID NO: 2917550 - RNA, 17 nt, Mycobacterium avium subsp. paratuberculosis
acgucgcgcugccggcc

SEQ ID NO: 2917551 - RNA, 20 nt, Mycobacterium avium subsp. paratuberculosis
acgucgcgcugccggcccga

SEQ ID NO: 2917552 - RNA, 22 nt, Mycobacterium avium subsp. paratuberculosis
acgucgcgggugaccggcgccg

SEQ ID NO: 2917553 - RNA, 16 nt, Mycobacterium avium subsp. paratuberculosis
acgucggacgcggccg

SEQ ID NO: 2917554 - RNA, 22 nt, Mycobacterium avium subsp. paratuberculosis
acgucggcagguugucgcugaa

SEQ ID NO: 2917555 - RNA, 12 nt, Mycobacterium avium subsp. paratuberculosis
acgucggccacg

SEQ ID NO: 2917556 - RNA, 13 nt, Mycobacterium avium subsp. paratuberculosis
acgucggccacgc

SEQ ID NO: 2917557 - RNA, 18 nt, Mycobacterium avium subsp. paratuberculosis
acgucggccacgccgggc

SEQ ID NO: 2917558 - RNA, 11 nt, Mycobacterium avium subsp. paratuberculosis
acgucggccag

SEQ ID NO: 2917559 - RNA, 14 nt, Mycobacterium avium subsp. paratuberculosis
acgucggccagcgc

SEQ ID NO: 2917560 - RNA, 15 nt, Mycobacterium avium subsp. paratuberculosis
acgucggccagcgcg

SEQ ID NO: 2917561 - RNA, 17 nt, Mycobacterium avium subsp. paratuberculosis
acgucggccagcgcgug

SEQ ID NO: 2917562 - RNA, 13 nt, Mycobacterium avium subsp. paratuberculosis
acgucggccagga

SEQ ID NO: 2917563 - RNA, 20 nt, Mycobacterium avium subsp. paratuberculosis
acgucggccgccagggccag

SEQ ID NO: 2917564 - RNA, 15 nt, Mycobacterium avium subsp. paratuberculosis
acgucggccggcugc

SEQ ID NO: 2917565 - RNA, 18 nt, Mycobacterium avium subsp. paratuberculosis
acgucggccggcugcagc

SEQ ID NO: 2917566 - RNA, 19 nt, Mycobacterium avium subsp. paratuberculosis
acgucggccggcugcagcc

SEQ ID NO: 2917567 - RNA, 23 nt, Mycobacterium avium subsp. paratuberculosis
acgucggccggcugcagccgggc

SEQ ID NO: 2917568 - RNA, 13 nt, Mycobacterium avium subsp. paratuberculosis
acgucggccgggu

SEQ ID NO: 2917569 - RNA, 13 nt, Mycobacterium avium subsp. paratuberculosis
acgucggccugca

SEQ ID NO: 2917570 - RNA, 15 nt, Mycobacterium avium subsp. paratuberculosis
acgucggccugcacg

SEQ ID NO: 2917571 - RNA, 20 nt, Mycobacterium avium subsp. paratuberculosis
acgucggccugcacgaaguc

SEQ ID NO: 2917572 - RNA, 20 nt, Mycobacterium avium subsp. paratuberculosis
acgucggcgauggcggcgug

SEQ ID NO: 2917573 - RNA, 15 nt, Mycobacterium avium subsp. paratuberculosis
acgucggcgcgcagg

SEQ ID NO: 2917574 - RNA, 20 nt, Mycobacterium avium subsp. paratuberculosis
acgucggcgcgcaggcuggc

SEQ ID NO: 2917575 - RNA, 19 nt, Mycobacterium avium subsp. paratuberculosis
acgucggcgcgcucggugc

SEQ ID NO: 2917576 - RNA, 14 nt, Mycobacterium avium subsp. paratuberculosis
acgucggcgcgguc

SEQ ID NO: 2917577 - RNA, 14 nt, Mycobacterium avium subsp. paratuberculosis
acgucggcggccgc

SEQ ID NO: 2917578 - RNA, 16 nt, Mycobacterium avium subsp. paratuberculosis
acgucggcggccgcga

SEQ ID NO: 2917579 - RNA, 12 nt, Mycobacterium avium subsp. paratuberculosis
acgucggcguca

SEQ ID NO: 2917580 - RNA, 18 nt, Mycobacterium avium subsp. paratuberculosis
acgucggcgucaucgacu

SEQ ID NO: 2917581 - RNA, 21 nt, Mycobacterium avium subsp. paratuberculosis
acgucggcuggcgugcggcgc

SEQ ID NO: 2917582 - RNA, 22 nt, Mycobacterium avium subsp. paratuberculosis
acgucggcuggcgugcggcgcg

SEQ ID NO: 2917583 - RNA, 14 nt, Mycobacterium avium subsp. paratuberculosis
acgucgggcacggu

SEQ ID NO: 2917584 - RNA, 17 nt, Mycobacterium avium subsp. paratuberculosis
acgucgggguggccggc

SEQ ID NO: 2917585 - RNA, 20 nt, Mycobacterium avium subsp. paratuberculosis
acgucgggguggccggccag

SEQ ID NO: 2917586 - RNA, 21 nt, Mycobacterium avium subsp. paratuberculosis
acgucgggguggccggccagc

SEQ ID NO: 2917587 - RNA, 22 nt, Mycobacterium avium subsp. paratuberculosis
acgucgggguggccggccagca

SEQ ID NO: 2917588 - RNA, 19 nt, Mycobacterium avium subsp. paratuberculosis
acgucggguccgaccagca

SEQ ID NO: 2917589 - RNA, 15 nt, Mycobacterium avium subsp. paratuberculosis
acgucggguucgccg

SEQ ID NO: 2917590 - RNA, 17 nt, Mycobacterium avium subsp. paratuberculosis
acgucggguucgccggu

SEQ ID NO: 2917591 - RNA, 14 nt, Mycobacterium avium subsp. paratuberculosis
acgucggugacgcc

SEQ ID NO: 2917592 - RNA, 13 nt, Mycobacterium avium subsp. paratuberculosis
acgucggugccgc

SEQ ID NO: 2917593 - RNA, 17 nt, Mycobacterium avium subsp. paratuberculosis
acgucggugccgcguuc

SEQ ID NO: 2917594 - RNA, 22 nt, Mycobacterium avium subsp. paratuberculosis
acgucgguguagucggcgaucg

SEQ ID NO: 2917595 - RNA, 15 nt, Mycobacterium avium subsp. paratuberculosis
acgucguaggccauc

SEQ ID NO: 2917596 - RNA, 17 nt, Mycobacterium avium subsp. paratuberculosis
acgucgucgacguccac

SEQ ID NO: 2917597 - RNA, 19 nt, Mycobacterium avium subsp. paratuberculosis
acgucgucgaugccgaucg

SEQ ID NO: 2917598 - RNA, 13 nt, Mycobacterium avium subsp. paratuberculosis
acgucgucgccgg

SEQ ID NO: 2917599 - RNA, 15 nt, Mycobacterium avium subsp. paratuberculosis
acgucgucgccgggg

SEQ ID NO: 2917600 - RNA, 14 nt, Mycobacterium avium subsp. paratuberculosis
acgucgucgcggcg

SEQ ID NO: 2917601 - RNA, 15 nt, Mycobacterium avium subsp. paratuberculosis
acgucgucgcggcgc

SEQ ID NO: 2917602 - RNA, 16 nt, Mycobacterium avium subsp. paratuberculosis
acgucgucgcggcgcu

SEQ ID NO: 2917603 - RNA, 16 nt, Mycobacterium avium subsp. paratuberculosis
acgucgucggacagca

SEQ ID NO: 2917604 - RNA, 14 nt, Mycobacterium avium subsp. paratuberculosis
acgucgucggccug

SEQ ID NO: 2917605 - RNA, 15 nt, Mycobacterium avium subsp. paratuberculosis
acgucgucggccugc

SEQ ID NO: 2917606 - RNA, 16 nt, Mycobacterium avium subsp. paratuberculosis
acgucgucggccugca

SEQ ID NO: 2917607 - RNA, 19 nt, Mycobacterium avium subsp. paratuberculosis
acgucgucgugcgcgggcg

SEQ ID NO: 2917608 - RNA, 23 nt, Mycobacterium avium subsp. paratuberculosis
acgucgucgugcgcgggcgaaau

SEQ ID NO: 2917609 - RNA, 16 nt, Mycobacterium avium subsp. paratuberculosis
acguggcggccgucgc

SEQ ID NO: 2917610 - RNA, 19 nt, Mycobacterium avium subsp. paratuberculosis
acguggcggcgguggcgau

SEQ ID NO: 2917611 - RNA, 21 nt, Mycobacterium avium subsp. paratuberculosis
acguggcucagcggcaggugc

SEQ ID NO: 2917612 - RNA, 16 nt, Mycobacterium avium subsp. paratuberculosis
acgugggcggccacca

SEQ ID NO: 2917613 - RNA, 19 nt, Mycobacterium avium subsp. paratuberculosis
acgugggugguggugccgu

SEQ ID NO: 2917614 - RNA, 21 nt, Mycobacterium avium subsp. paratuberculosis
acgugggugguggugccgucg

SEQ ID NO: 2917615 - RNA, 22 nt, Mycobacterium avium subsp. paratuberculosis
acgugggugguggugccgucgc

SEQ ID NO: 2917616 - RNA, 21 nt, Mycobacterium avium subsp. paratuberculosis
acguggucgagcaugcgggug

SEQ ID NO: 2917617 - RNA, 17 nt, Mycobacterium avium subsp. paratuberculosis
acguggucgggcaugcc

SEQ ID NO: 2917618 - RNA, 21 nt, Mycobacterium avium subsp. paratuberculosis
acguggucgggcaugccggcc

SEQ ID NO: 2917619 - RNA, 23 nt, Mycobacterium avium subsp. paratuberculosis
acguggucgggcaugccggccgg

SEQ ID NO: 2917620 - RNA, 13 nt, Mycobacterium avium subsp. paratuberculosis
acguggugcaccg

SEQ ID NO: 2917621 - RNA, 14 nt, Mycobacterium avium subsp. paratuberculosis
acguggugcaccgc

SEQ ID NO: 2917622 - RNA, 15 nt, Mycobacterium avium subsp. paratuberculosis
acguggugcaccgcc

SEQ ID NO: 2917623 - RNA, 15 nt, Mycobacterium avium subsp. paratuberculosis
acgugguggaugaug

SEQ ID NO: 2917624 - RNA, 20 nt, Mycobacterium avium subsp. paratuberculosis
acgugguugcguucgccggc

SEQ ID NO: 2917625 - RNA, 12 nt, Mycobacterium avium subsp. paratuberculosis
acgugucgagca

SEQ ID NO: 2917626 - RNA, 17 nt, Mycobacterium avium subsp. paratuberculosis
acguguguaccauugcg

SEQ ID NO: 2917627 - RNA, 22 nt, Mycobacterium avium subsp. paratuberculosis
acguguguaccauugcgccggu

SEQ ID NO: 2917628 - RNA, 16 nt, Mycobacterium avium subsp. paratuberculosis
acguguucaacgcgcc

SEQ ID NO: 2917629 - RNA, 19 nt, Mycobacterium avium subsp. paratuberculosis
acguguucgggaucggcgc

SEQ ID NO: 2917630 - RNA, 16 nt, Mycobacterium avium subsp. paratuberculosis
acguguucucacggcg

SEQ ID NO: 2917631 - RNA, 17 nt, Mycobacterium avium subsp. paratuberculosis
acguguucucacggcga

SEQ ID NO: 2917632 - RNA, 22 nt, Mycobacterium avium subsp. paratuberculosis
acguucaccaccggagcggcgg

SEQ ID NO: 2917633 - RNA, 19 nt, Mycobacterium avium subsp. paratuberculosis
acguucagcgacuugccgc

SEQ ID NO: 2917634 - RNA, 18 nt, Mycobacterium avium subsp. paratuberculosis
acguuccagccgugcugg

SEQ ID NO: 2917635 - RNA, 19 nt, Mycobacterium avium subsp. paratuberculosis
acguuccuggugggcgaau

SEQ ID NO: 2917636 - RNA, 14 nt, Mycobacterium avium subsp. paratuberculosis
acguucgagucggc

SEQ ID NO: 2917637 - RNA, 14 nt, Mycobacterium avium subsp. paratuberculosis
acguucgccgccag

SEQ ID NO: 2917638 - RNA, 17 nt, Mycobacterium avium subsp. paratuberculosis
acguugaccgcgaaggu

SEQ ID NO: 2917639 - RNA, 20 nt, Mycobacterium avium subsp. paratuberculosis
acguugagcccggaccggcc

SEQ ID NO: 2917640 - RNA, 20 nt, Mycobacterium avium subsp. paratuberculosis
acguugaggcggcggcgggc

SEQ ID NO: 2917641 - RNA, 23 nt, Mycobacterium avium subsp. paratuberculosis
acguugaggcggcggcgggccag

SEQ ID NO: 2917642 - RNA, 18 nt, Mycobacterium avium subsp. paratuberculosis
acguugaucaugucgaug

SEQ ID NO: 2917643 - RNA, 20 nt, Mycobacterium avium subsp. paratuberculosis
acguugaugccgcccagcag

SEQ ID NO: 2917644 - RNA, 14 nt, Mycobacterium avium subsp. paratuberculosis
acguugcccaggaa

SEQ ID NO: 2917645 - RNA, 17 nt, Mycobacterium avium subsp. paratuberculosis
acguugccgcacaccgc

SEQ ID NO: 2917646 - RNA, 18 nt, Mycobacterium avium subsp. paratuberculosis
acguugccgcacaccgcg

SEQ ID NO: 2917647 - RNA, 22 nt, Mycobacterium avium subsp. paratuberculosis
acguugccgcacaccgcgcaga

SEQ ID NO: 2917648 - RNA, 23 nt, Mycobacterium avium subsp. paratuberculosis
acguugcgcaucagcgccaccag

SEQ ID NO: 2917649 - RNA, 14 nt, Mycobacterium avium subsp. paratuberculosis
acguugcgcccggc

SEQ ID NO: 2917650 - RNA, 15 nt, Mycobacterium avium subsp. paratuberculosis
acguugcgcggccgc

SEQ ID NO: 2917651 - RNA, 16 nt, Mycobacterium avium subsp. paratuberculosis
acguugcgcggccgca

SEQ ID NO: 2917652 - RNA, 17 nt, Mycobacterium avium subsp. paratuberculosis
acguugcgcggccgcau

SEQ ID NO: 2917653 - RNA, 15 nt, Mycobacterium avium subsp. paratuberculosis
acguuggccagcacc

SEQ ID NO: 2917654 - RNA, 14 nt, Mycobacterium avium subsp. paratuberculosis
acguuggcggccag

SEQ ID NO: 2917655 - RNA, 17 nt, Mycobacterium avium subsp. paratuberculosis
acguuggcggccagcgc

SEQ ID NO: 2917656 - RNA, 22 nt, Mycobacterium avium subsp. paratuberculosis
acguuggggugguuguugaagu

SEQ ID NO: 2917657 - RNA, 11 nt, Mycobacterium avium subsp. paratuberculosis
acguuggugau

SEQ ID NO: 2917658 - RNA, 16 nt, Mycobacterium avium subsp. paratuberculosis
acguugucgcccgggu

SEQ ID NO: 2917659 - RNA, 14 nt, Mycobacterium avium subsp. paratuberculosis
acguugucgcggcc

SEQ ID NO: 2917660 - RNA, 16 nt, Mycobacterium avium subsp. paratuberculosis
acguugucgcggccca

SEQ ID NO: 2917661 - RNA, 18 nt, Mycobacterium avium subsp. paratuberculosis
acguugucgcggcccagc

SEQ ID NO: 2917662 - RNA, 19 nt, Mycobacterium avium subsp. paratuberculosis
acuaauccccccgcgccgc

SEQ ID NO: 2917663 - RNA, 22 nt, Mycobacterium avium subsp. paratuberculosis
acuacgcacccgacacgccgau

SEQ ID NO: 2917664 - RNA, 17 nt, Mycobacterium avium subsp. paratuberculosis
acuagcuucacgcucgg

SEQ ID NO: 2917665 - RNA, 15 nt, Mycobacterium avium subsp. paratuberculosis
acuagguccggcgcg

SEQ ID NO: 2917666 - RNA, 17 nt, Mycobacterium avium subsp. paratuberculosis
acuagguccggcgcgac

SEQ ID NO: 2917667 - RNA, 22 nt, Mycobacterium avium subsp. paratuberculosis
acucaaaccgggccugcgcgcc

SEQ ID NO: 2917668 - RNA, 16 nt, Mycobacterium avium subsp. paratuberculosis
acucaccgguggccgc

SEQ ID NO: 2917669 - RNA, 15 nt, Mycobacterium avium subsp. paratuberculosis
acucaccggugguga

SEQ ID NO: 2917670 - RNA, 14 nt, Mycobacterium avium subsp. paratuberculosis
acucacuaucgaca

SEQ ID NO: 2917671 - RNA, 21 nt, Mycobacterium avium subsp. paratuberculosis
acucagagcagcgccugcugc

SEQ ID NO: 2917672 - RNA, 13 nt, Mycobacterium avium subsp. paratuberculosis
acucagcccggcc

SEQ ID NO: 2917673 - RNA, 18 nt, Mycobacterium avium subsp. paratuberculosis
acucagcccggcccagcc

SEQ ID NO: 2917674 - RNA, 17 nt, Mycobacterium avium subsp. paratuberculosis
acucaggagugguaggg

SEQ ID NO: 2917675 - RNA, 22 nt, Mycobacterium avium subsp. paratuberculosis
acucaggagugguagggcuccg

SEQ ID NO: 2917676 - RNA, 17 nt, Mycobacterium avium subsp. paratuberculosis
acucaguccucgccgag

SEQ ID NO: 2917677 - RNA, 19 nt, Mycobacterium avium subsp. paratuberculosis
acucaugggcccggcccgu

SEQ ID NO: 2917678 - RNA, 22 nt, Mycobacterium avium subsp. paratuberculosis
acucaugggcccggcccgucag

SEQ ID NO: 2917679 - RNA, 15 nt, Mycobacterium avium subsp. paratuberculosis
acuccaauacggccc

SEQ ID NO: 2917680 - RNA, 16 nt, Mycobacterium avium subsp. paratuberculosis
acuccaauacggcccg

SEQ ID NO: 2917681 - RNA, 20 nt, Mycobacterium avium subsp. paratuberculosis
acuccaauacggcccggcga

SEQ ID NO: 2917682 - RNA, 13 nt, Mycobacterium avium subsp. paratuberculosis
acuccaccaccug

SEQ ID NO: 2917683 - RNA, 21 nt, Mycobacterium avium subsp. paratuberculosis
acuccaccaccuggccggcca

SEQ ID NO: 2917684 - RNA, 23 nt, Mycobacterium avium subsp. paratuberculosis
acuccacccugccgaccugcgcg

SEQ ID NO: 2917685 - RNA, 13 nt, Mycobacterium avium subsp. paratuberculosis
acuccaccgccac

SEQ ID NO: 2917686 - RNA, 16 nt, Mycobacterium avium subsp. paratuberculosis
acuccaccgccaccgc

SEQ ID NO: 2917687 - RNA, 15 nt, Mycobacterium avium subsp. paratuberculosis
acuccaccgcccgga

SEQ ID NO: 2917688 - RNA, 11 nt, Mycobacterium avium subsp. paratuberculosis
acuccagcacc

SEQ ID NO: 2917689 - RNA, 16 nt, Mycobacterium avium subsp. paratuberculosis
acuccagcaccggcgc

SEQ ID NO: 2917690 - RNA, 12 nt, Mycobacterium avium subsp. paratuberculosis
acuccagcagcg

SEQ ID NO: 2917691 - RNA, 20 nt, Mycobacterium avium subsp. paratuberculosis
acuccagcagcgccagcacc

SEQ ID NO: 2917692 - RNA, 19 nt, Mycobacterium avium subsp. paratuberculosis
acuccagcagcgccuugcc

SEQ ID NO: 2917693 - RNA, 13 nt, Mycobacterium avium subsp. paratuberculosis
acuccagcgcgau

SEQ ID NO: 2917694 - RNA, 11 nt, Mycobacterium avium subsp. paratuberculosis
acucggcgccg

SEQ ID NO: 2917695 - RNA, 13 nt, Mycobacterium avium subsp. paratuberculosis
acucggcgccgcc

SEQ ID NO: 2917696 - RNA, 14 nt, Mycobacterium avium subsp. paratuberculosis
acucggcgccgccg

SEQ ID NO: 2917697 - RNA, 12 nt, Mycobacterium avium subsp. paratuberculosis
acucggcggcgg

SEQ ID NO: 2917698 - RNA, 15 nt, Mycobacterium avium subsp. paratuberculosis
acucggcggcgggca

SEQ ID NO: 2917699 - RNA, 19 nt, Mycobacterium avium subsp. paratuberculosis
acucgggcaacgcgccggc

SEQ ID NO: 2917700 - RNA, 13 nt, Mycobacterium avium subsp. paratuberculosis
acucgggcccgag

SEQ ID NO: 2917701 - RNA, 15 nt, Mycobacterium avium subsp. paratuberculosis
acucgggcggccgcg

SEQ ID NO: 2917702 - RNA, 18 nt, Mycobacterium avium subsp. paratuberculosis
acucgggcucgucguugc

SEQ ID NO: 2917703 - RNA, 23 nt, Mycobacterium avium subsp. paratuberculosis
acucgggcucgucguugcgcagc

SEQ ID NO: 2917704 - RNA, 21 nt, Mycobacterium avium subsp. paratuberculosis
acucgggguugacccggccgg

SEQ ID NO: 2917705 - RNA, 16 nt, Mycobacterium avium subsp. paratuberculosis
acucggucaccucguc

SEQ ID NO: 2917706 - RNA, 18 nt, Mycobacterium avium subsp. paratuberculosis
acucggucaccucgucga

SEQ ID NO: 2917707 - RNA, 19 nt, Mycobacterium avium subsp. paratuberculosis
acucggugaugccggccag

SEQ ID NO: 2917708 - RNA, 16 nt, Mycobacterium avium subsp. paratuberculosis
acucgguguagagcac

SEQ ID NO: 2917709 - RNA, 18 nt, Mycobacterium avium subsp. paratuberculosis
acucgguguagagcaccu

SEQ ID NO: 2917710 - RNA, 14 nt, Mycobacterium avium subsp. paratuberculosis
acucgguguggccc

SEQ ID NO: 2917711 - RNA, 13 nt, Mycobacterium avium subsp. paratuberculosis
acucguccaccga

SEQ ID NO: 2917712 - RNA, 21 nt, Mycobacterium avium subsp. paratuberculosis
acucguccaugcuggugccgc

SEQ ID NO: 2917713 - RNA, 18 nt, Mycobacterium avium subsp. paratuberculosis
acucguccucccgguagc

SEQ ID NO: 2917714 - RNA, 13 nt, Mycobacterium avium subsp. paratuberculosis
acucgucgaucga

SEQ ID NO: 2917715 - RNA, 16 nt, Mycobacterium avium subsp. paratuberculosis
acucgucuugcagccg

SEQ ID NO: 2917716 - RNA, 14 nt, Mycobacterium avium subsp. paratuberculosis
acucgugcggcgcc

SEQ ID NO: 2917717 - RNA, 22 nt, Mycobacterium avium subsp. paratuberculosis
acucgugcggcgccgcccggcg

SEQ ID NO: 2917718 - RNA, 15 nt, Mycobacterium avium subsp. paratuberculosis
acucgugggccacca

SEQ ID NO: 2917719 - RNA, 17 nt, Mycobacterium avium subsp. paratuberculosis
acucguuggggccacca

SEQ ID NO: 2917720 - RNA, 22 nt, Mycobacterium avium subsp. paratuberculosis
acucucgcggcaaggcgcagaa

SEQ ID NO: 2917721 - RNA, 20 nt, Mycobacterium avium subsp. paratuberculosis
acucuggcgugacgcucgac

SEQ ID NO: 2917722 - RNA, 23 nt, Mycobacterium avium subsp. paratuberculosis
acucuuccaggacaacgcagguu

SEQ ID NO: 2917723 - RNA, 14 nt, Mycobacterium avium subsp. paratuberculosis
acucuucuuccugc

SEQ ID NO: 2917724 - RNA, 13 nt, Mycobacterium avium subsp. paratuberculosis
acugaaagccgag

SEQ ID NO: 2917725 - RNA, 14 nt, Mycobacterium avium subsp. paratuberculosis
acugaagcuucaag

SEQ ID NO: 2917726 - RNA, 15 nt, Mycobacterium avium subsp. paratuberculosis
acugacccgcacgaa

SEQ ID NO: 2917727 - RNA, 18 nt, Mycobacterium avium subsp. paratuberculosis
acugagcccggcgacgaa

SEQ ID NO: 2917728 - RNA, 15 nt, Mycobacterium avium subsp. paratuberculosis
acugagcgcccgguc

SEQ ID NO: 2917729 - RNA, 16 nt, Mycobacterium avium subsp. paratuberculosis
acugagucaagccggc

SEQ ID NO: 2917730 - RNA, 13 nt, Mycobacterium avium subsp. paratuberculosis
acugaucaccgcg

SEQ ID NO: 2917731 - RNA, 14 nt, Mycobacterium avium subsp. paratuberculosis
acugaucaccgcgc

SEQ ID NO: 2917732 - RNA, 22 nt, Mycobacterium avium subsp. paratuberculosis
acugaucaccgcgcucggcgac

SEQ ID NO: 2917733 - RNA, 19 nt, Mycobacterium avium subsp. paratuberculosis
acugauccgucaucucguc

SEQ ID NO: 2917734 - RNA, 16 nt, Mycobacterium avium subsp. paratuberculosis
acugaugaagccgccg

SEQ ID NO: 2917735 - RNA, 20 nt, Mycobacterium avium subsp. paratuberculosis
acugaugaagccgccgacgg

SEQ ID NO: 2917736 - RNA, 20 nt, Mycobacterium avium subsp. paratuberculosis
acugaugcccucgccgguca

SEQ ID NO: 2917737 - RNA, 16 nt, Mycobacterium avium subsp. paratuberculosis
acugcaccagcacgac

SEQ ID NO: 2917738 - RNA, 15 nt, Mycobacterium avium subsp. paratuberculosis
acugcaccagcggcg

SEQ ID NO: 2917739 - RNA, 17 nt, Mycobacterium avium subsp. paratuberculosis
acugcacggccucgguc

SEQ ID NO: 2917740 - RNA, 24 nt, Mycobacterium avium subsp. paratuberculosis
acugcagauaggacccggcgagcg

SEQ ID NO: 2917741 - RNA, 12 nt, Mycobacterium avium subsp. paratuberculosis
acugcaggaaca

SEQ ID NO: 2917742 - RNA, 13 nt, Mycobacterium avium subsp. paratuberculosis
acugcaggaacaa

SEQ ID NO: 2917743 - RNA, 13 nt, Mycobacterium avium subsp. paratuberculosis
acugcaggugacg

SEQ ID NO: 2917744 - RNA, 14 nt, Mycobacterium avium subsp. paratuberculosis
acugcaucgccagc

SEQ ID NO: 2917745 - RNA, 18 nt, Mycobacterium avium subsp. paratuberculosis
acugcaucgccagcacau

SEQ ID NO: 2917746 - RNA, 12 nt, Mycobacterium avium subsp. paratuberculosis
acugcaucucga

SEQ ID NO: 2917747 - RNA, 20 nt, Mycobacterium avium subsp. paratuberculosis
acugcaucucgaccuggguc

SEQ ID NO: 2917748 - RNA, 19 nt, Mycobacterium avium subsp. paratuberculosis
acugcauuucggacggcga

SEQ ID NO: 2917749 - RNA, 23 nt, Mycobacterium avium subsp. paratuberculosis
acugccaagacguccgcgucggc

SEQ ID NO: 2917750 - RNA, 20 nt, Mycobacterium avium subsp. paratuberculosis
acugccaucccucguucagc

SEQ ID NO: 2917751 - RNA, 23 nt, Mycobacterium avium subsp. paratuberculosis
acugcccaaugaucugggccgcc

SEQ ID NO: 2917752 - RNA, 13 nt, Mycobacterium avium subsp. paratuberculosis
acugcccagccau

SEQ ID NO: 2917753 - RNA, 19 nt, Mycobacterium avium subsp. paratuberculosis
acugccccgcuccuccucg

SEQ ID NO: 2917754 - RNA, 22 nt, Mycobacterium avium subsp. paratuberculosis
acugccccgcuccuccucgcgc

SEQ ID NO: 2917755 - RNA, 16 nt, Mycobacterium avium subsp. paratuberculosis
acugcccgaccgcgcc

SEQ ID NO: 2917756 - RNA, 20 nt, Mycobacterium avium subsp. paratuberculosis
acugcccguagucggcggcg

SEQ ID NO: 2917757 - RNA, 21 nt, Mycobacterium avium subsp. paratuberculosis
acugcccguagucggcggcga

SEQ ID NO: 2917758 - RNA, 15 nt, Mycobacterium avium subsp. paratuberculosis
acugccgagcaucag

SEQ ID NO: 2917759 - RNA, 14 nt, Mycobacterium avium subsp. paratuberculosis
acugccgaugcuga

SEQ ID NO: 2917760 - RNA, 20 nt, Mycobacterium avium subsp. paratuberculosis
acugccggcauaggccagca

SEQ ID NO: 2917761 - RNA, 22 nt, Mycobacterium avium subsp. paratuberculosis
acugccggcauaggccagcacc

SEQ ID NO: 2917762 - RNA, 14 nt, Mycobacterium avium subsp. paratuberculosis
acugccggcgacgg

SEQ ID NO: 2917763 - RNA, 16 nt, Mycobacterium avium subsp. paratuberculosis
acugccugacccggcc

SEQ ID NO: 2917764 - RNA, 21 nt, Mycobacterium avium subsp. paratuberculosis
acugcgaucgccgacgccagc

SEQ ID NO: 2917765 - RNA, 16 nt, Mycobacterium avium subsp. paratuberculosis
acugcgcaaccacuga

SEQ ID NO: 2917766 - RNA, 14 nt, Mycobacterium avium subsp. paratuberculosis
acugcgcaccgcca

SEQ ID NO: 2917767 - RNA, 16 nt, Mycobacterium avium subsp. paratuberculosis
acugcgcaccgccagc

SEQ ID NO: 2917768 - RNA, 22 nt, Mycobacterium avium subsp. paratuberculosis
acugcgcaccgccagcaccgac

SEQ ID NO: 2917769 - RNA, 20 nt, Mycobacterium avium subsp. paratuberculosis
acugcgccaauacacuucgg

SEQ ID NO: 2917770 - RNA, 11 nt, Mycobacterium avium subsp. paratuberculosis
acugcgccggg

SEQ ID NO: 2917771 - RNA, 19 nt, Mycobacterium avium subsp. paratuberculosis
acugcgccggggccgcggc

SEQ ID NO: 2917772 - RNA, 20 nt, Mycobacterium avium subsp. paratuberculosis
acugcgcgaccaaacgcagc

SEQ ID NO: 2917773 - RNA, 18 nt, Mycobacterium avium subsp. paratuberculosis
acugcgcgcccgagcauu

SEQ ID NO: 2917774 - RNA, 16 nt, Mycobacterium avium subsp. paratuberculosis
acugcgcggccggcgu

SEQ ID NO: 2917775 - RNA, 18 nt, Mycobacterium avium subsp. paratuberculosis
acugcgguaugccaagcc

SEQ ID NO: 2917776 - RNA, 15 nt, Mycobacterium avium subsp. paratuberculosis
acugcguggccgugu

SEQ ID NO: 2917777 - RNA, 15 nt, Mycobacterium avium subsp. paratuberculosis
acugcucgaccagcc

SEQ ID NO: 2917778 - RNA, 13 nt, Mycobacterium avium subsp. paratuberculosis
acugcugcccgcg

SEQ ID NO: 2917779 - RNA, 14 nt, Mycobacterium avium subsp. paratuberculosis
acuucuacggcggg

SEQ ID NO: 2917780 - RNA, 21 nt, Mycobacterium avium subsp. paratuberculosis
acuucuacggcgggccggcgc

SEQ ID NO: 2917781 - RNA, 15 nt, Mycobacterium avium subsp. paratuberculosis
acuucuggcgcugcu

SEQ ID NO: 2917782 - RNA, 22 nt, Mycobacterium avium subsp. paratuberculosis
acuucugguugacgccgaugcg

SEQ ID NO: 2917783 - RNA, 13 nt, Mycobacterium avium subsp. paratuberculosis
acuugaaggaggc

SEQ ID NO: 2917784 - RNA, 15 nt, Mycobacterium avium subsp. paratuberculosis
acuugaccagcagcu

SEQ ID NO: 2917785 - RNA, 17 nt, Mycobacterium avium subsp. paratuberculosis
acuugaccgggcuccag

SEQ ID NO: 2917786 - RNA, 19 nt, Mycobacterium avium subsp. paratuberculosis
acuugaucagcucgcggau

SEQ ID NO: 2917787 - RNA, 21 nt, Mycobacterium avium subsp. paratuberculosis
acuugaugacgcacgucggca

SEQ ID NO: 2917788 - RNA, 17 nt, Mycobacterium avium subsp. paratuberculosis
acuugaugcugcccggc

SEQ ID NO: 2917789 - RNA, 14 nt, Mycobacterium avium subsp. paratuberculosis
acuugcccagauug

SEQ ID NO: 2917790 - RNA, 19 nt, Mycobacterium avium subsp. paratuberculosis
acuugcccagauugcggcc

SEQ ID NO: 2917791 - RNA, 18 nt, Mycobacterium avium subsp. paratuberculosis
acuugccgccggcgcagu

SEQ ID NO: 2917792 - RNA, 22 nt, Mycobacterium avium subsp. paratuberculosis
acuugcgcgccgugacgccgau

SEQ ID NO: 2917793 - RNA, 14 nt, Mycobacterium avium subsp. paratuberculosis
acuugcggccgcga

SEQ ID NO: 2917794 - RNA, 15 nt, Mycobacterium avium subsp. paratuberculosis
acuugcggccgcgac

SEQ ID NO: 2917795 - RNA, 19 nt, Mycobacterium avium subsp. paratuberculosis
acuugcggccgcgacgcgc

SEQ ID NO: 2917796 - RNA, 16 nt, Mycobacterium avium subsp. paratuberculosis
acuugcguugcgcggc

SEQ ID NO: 2917797 - RNA, 14 nt, Mycobacterium avium subsp. paratuberculosis
acuugcuggcgcug

SEQ ID NO: 2917798 - RNA, 18 nt, Mycobacterium avium subsp. paratuberculosis
acuuguggaaggcgccgg

SEQ ID NO: 2917799 - RNA, 19 nt, Mycobacterium avium subsp. paratuberculosis
acuuguggaaggcgccggc

SEQ ID NO: 2917800 - RNA, 16 nt, Mycobacterium avium subsp. paratuberculosis
acuuugccguuccagc

SEQ ID NO: 2917801 - RNA, 23 nt, Mycobacterium avium subsp. paratuberculosis
agaaaagcgaccagcgcgccggc

SEQ ID NO: 2917802 - RNA, 15 nt, Mycobacterium avium subsp. paratuberculosis
agaaaugggccaggu

SEQ ID NO: 2917803 - RNA, 16 nt, Mycobacterium avium subsp. paratuberculosis
agaacaccaccgccag

SEQ ID NO: 2917804 - RNA, 23 nt, Mycobacterium avium subsp. paratuberculosis
agaacaccacgguguagcggcgg

SEQ ID NO: 2917805 - RNA, 20 nt, Mycobacterium avium subsp. paratuberculosis
agaacaccccgaccgacgcg

SEQ ID NO: 2917806 - RNA, 22 nt, Mycobacterium avium subsp. paratuberculosis
agaacaccgaauuguccagcag

SEQ ID NO: 2917807 - RNA, 17 nt, Mycobacterium avium subsp. paratuberculosis
agaacacgccccggcgg

SEQ ID NO: 2917808 - RNA, 19 nt, Mycobacterium avium subsp. paratuberculosis
agaacacguuucggcccuc

SEQ ID NO: 2917809 - RNA, 17 nt, Mycobacterium avium subsp. paratuberculosis
agaacaggccgagcgcg

SEQ ID NO: 2917810 - RNA, 22 nt, Mycobacterium avium subsp. paratuberculosis
agaacagguaggacaccgaacc

SEQ ID NO: 2917811 - RNA, 21 nt, Mycobacterium avium subsp. paratuberculosis
agaacaggugcggcaacccga

SEQ ID NO: 2917812 - RNA, 15 nt, Mycobacterium avium subsp. paratuberculosis
agaacaguucgacgu

SEQ ID NO: 2917813 - RNA, 23 nt, Mycobacterium avium subsp. paratuberculosis
agaacaucagccccuuguagguc

SEQ ID NO: 2917814 - RNA, 18 nt, Mycobacterium avium subsp. paratuberculosis
agaaccagcaccgccgcg

SEQ ID NO: 2917815 - RNA, 21 nt, Mycobacterium avium subsp. paratuberculosis
agaaccagcaccgccgcggcc

SEQ ID NO: 2917816 - RNA, 18 nt, Mycobacterium avium subsp. paratuberculosis
agaaccauuugcccagca

SEQ ID NO: 2917817 - RNA, 17 nt, Mycobacterium avium subsp. paratuberculosis
agaacccgaacgcgucg

SEQ ID NO: 2917818 - RNA, 20 nt, Mycobacterium avium subsp. paratuberculosis
agaaccgcucgauggcgccg

SEQ ID NO: 2917819 - RNA, 21 nt, Mycobacterium avium subsp. paratuberculosis
agaaccgcucgauggcgccga

SEQ ID NO: 2917820 - RNA, 21 nt, Mycobacterium avium subsp. paratuberculosis
agaaccgcucggcggcgccgu

SEQ ID NO: 2917821 - RNA, 17 nt, Mycobacterium avium subsp. paratuberculosis
agaaccggcaacacagc

SEQ ID NO: 2917822 - RNA, 21 nt, Mycobacterium avium subsp. paratuberculosis
agaaccggcaggacgggggcc

SEQ ID NO: 2917823 - RNA, 16 nt, Mycobacterium avium subsp. paratuberculosis
agaaccggggccagca

SEQ ID NO: 2917824 - RNA, 18 nt, Mycobacterium avium subsp. paratuberculosis
agaaccggggccagcacg

SEQ ID NO: 2917825 - RNA, 13 nt, Mycobacterium avium subsp. paratuberculosis
agaacgacgccac

SEQ ID NO: 2917826 - RNA, 17 nt, Mycobacterium avium subsp. paratuberculosis
agaacgcgucccacauc

SEQ ID NO: 2917827 - RNA, 18 nt, Mycobacterium avium subsp. paratuberculosis
agaacggaauucagugag

SEQ ID NO: 2917828 - RNA, 21 nt, Mycobacterium avium subsp. paratuberculosis
agaacucaauaguguguuugg

SEQ ID NO: 2917829 - RNA, 21 nt, Mycobacterium avium subsp. paratuberculosis
agaacucggcggcgguuucuu

SEQ ID NO: 2917830 - RNA, 12 nt, Mycobacterium avium subsp. paratuberculosis
agaacucgggau

SEQ ID NO: 2917831 - RNA, 15 nt, Mycobacterium avium subsp. paratuberculosis
agaacucgucgccac

SEQ ID NO: 2917832 - RNA, 22 nt, Mycobacterium avium subsp. paratuberculosis
agaacuucaucuggaacauggc

SEQ ID NO: 2917833 - RNA, 19 nt, Mycobacterium avium subsp. paratuberculosis
agaacuucuccgccggcag

SEQ ID NO: 2917834 - RNA, 20 nt, Mycobacterium avium subsp. paratuberculosis
agaagaccugguugccgccc

SEQ ID NO: 2917835 - RNA, 23 nt, Mycobacterium avium subsp. paratuberculosis
agaagaccugguugccgcccucg

SEQ ID NO: 2917836 - RNA, 20 nt, Mycobacterium avium subsp. paratuberculosis
agaagaucugccggugccgc

SEQ ID NO: 2917837 - RNA, 16 nt, Mycobacterium avium subsp. paratuberculosis
agaagaugggcgccga

SEQ ID NO: 2917838 - RNA, 20 nt, Mycobacterium avium subsp. paratuberculosis
agaagauguugcggcggccg

SEQ ID NO: 2917839 - RNA, 22 nt, Mycobacterium avium subsp. paratuberculosis
agaagauguugcggcggccggc

SEQ ID NO: 2917840 - RNA, 16 nt, Mycobacterium avium subsp. paratuberculosis
agaagcgcgcauagag

SEQ ID NO: 2917841 - RNA, 14 nt, Mycobacterium avium subsp. paratuberculosis
agaaggacgccucg

SEQ ID NO: 2917842 - RNA, 11 nt, Mycobacterium avium subsp. paratuberculosis
agaaggccgcc

SEQ ID NO: 2917843 - RNA, 21 nt, Mycobacterium avium subsp. paratuberculosis
agaaggcgaacgggcuggcca

SEQ ID NO: 2917844 - RNA, 22 nt, Mycobacterium avium subsp. paratuberculosis
agaaggcgaacgggcuggccag

SEQ ID NO: 2917845 - RNA, 22 nt, Mycobacterium avium subsp. paratuberculosis
agaagggcgaauccaaggagaa

SEQ ID NO: 2917846 - RNA, 22 nt, Mycobacterium avium subsp. paratuberculosis
agaagucgcccgcguugcggcg

SEQ ID NO: 2917847 - RNA, 23 nt, Mycobacterium avium subsp. paratuberculosis
agaagucgcccgcguugcggcgc

SEQ ID NO: 2917848 - RNA, 14 nt, Mycobacterium avium subsp. paratuberculosis
agaagucgccgacg

SEQ ID NO: 2917849 - RNA, 22 nt, Mycobacterium avium subsp. paratuberculosis
agaagucgcucagcgucuugga

SEQ ID NO: 2917850 - RNA, 18 nt, Mycobacterium avium subsp. paratuberculosis
agacacaaaagcgcccga

SEQ ID NO: 2917851 - RNA, 15 nt, Mycobacterium avium subsp. paratuberculosis
agacacccucgcgca

SEQ ID NO: 2917852 - RNA, 18 nt, Mycobacterium avium subsp. paratuberculosis
agacacgaauacccuucg

SEQ ID NO: 2917853 - RNA, 22 nt, Mycobacterium avium subsp. paratuberculosis
agacacgaauacccuucggccg

SEQ ID NO: 2917854 - RNA, 14 nt, Mycobacterium avium subsp. paratuberculosis
agacacgcgccggc

SEQ ID NO: 2917855 - RNA, 15 nt, Mycobacterium avium subsp. paratuberculosis
agacacgcgccggcg

SEQ ID NO: 2917856 - RNA, 14 nt, Mycobacterium avium subsp. paratuberculosis
agacacgcucacgc

SEQ ID NO: 2917857 - RNA, 13 nt, Mycobacterium avium subsp. paratuberculosis
agacaggccggcc

SEQ ID NO: 2917858 - RNA, 19 nt, Mycobacterium avium subsp. paratuberculosis
agaccaggucggccuucag

SEQ ID NO: 2917859 - RNA, 15 nt, Mycobacterium avium subsp. paratuberculosis
agaccauggcgcggc

SEQ ID NO: 2917860 - RNA, 21 nt, Mycobacterium avium subsp. paratuberculosis
agacccacagcugccggccgu

SEQ ID NO: 2917861 - RNA, 12 nt, Mycobacterium avium subsp. paratuberculosis
agacccagcagc

SEQ ID NO: 2917862 - RNA, 15 nt, Mycobacterium avium subsp. paratuberculosis
agacccccagcagcg

SEQ ID NO: 2917863 - RNA, 14 nt, Mycobacterium avium subsp. paratuberculosis
agacugccgagcau

SEQ ID NO: 2917864 - RNA, 15 nt, Mycobacterium avium subsp. paratuberculosis
agacugcgcaccgcc

SEQ ID NO: 2917865 - RNA, 17 nt, Mycobacterium avium subsp. paratuberculosis
agacugcgcaccgccag

SEQ ID NO: 2917866 - RNA, 13 nt, Mycobacterium avium subsp. paratuberculosis
agagcaccgcgcu

SEQ ID NO: 2917867 - RNA, 15 nt, Mycobacterium avium subsp. paratuberculosis
agagcaccgcgcuca

SEQ ID NO: 2917868 - RNA, 16 nt, Mycobacterium avium subsp. paratuberculosis
agagcagcgccugcug

SEQ ID NO: 2917869 - RNA, 23 nt, Mycobacterium avium subsp. paratuberculosis
agagcagcgccugcugccaggac

SEQ ID NO: 2917870 - RNA, 21 nt, Mycobacterium avium subsp. paratuberculosis
agagcaggaccgagccgcgcg

SEQ ID NO: 2917871 - RNA, 17 nt, Mycobacterium avium subsp. paratuberculosis
agagccgguagaucagc

SEQ ID NO: 2917872 - RNA, 20 nt, Mycobacterium avium subsp. paratuberculosis
agagccgguagaucagcgcc

SEQ ID NO: 2917873 - RNA, 20 nt, Mycobacterium avium subsp. paratuberculosis
agagccguuuggcgccgccc

SEQ ID NO: 2917874 - RNA, 21 nt, Mycobacterium avium subsp. paratuberculosis
agagccguuuggcgccgccca

SEQ ID NO: 2917875 - RNA, 19 nt, Mycobacterium avium subsp. paratuberculosis
agagcgccggacucgaaga

SEQ ID NO: 2917876 - RNA, 19 nt, Mycobacterium avium subsp. paratuberculosis
agagcgcgaaaaccagcac

SEQ ID NO: 2917877 - RNA, 12 nt, Mycobacterium avium subsp. paratuberculosis
agagcgcgggca

SEQ ID NO: 2917878 - RNA, 17 nt, Mycobacterium avium subsp. paratuberculosis
agagcgcgggcaccguc

SEQ ID NO: 2917879 - RNA, 22 nt, Mycobacterium avium subsp. paratuberculosis
agagcggcacgaucggcagcgc

SEQ ID NO: 2917880 - RNA, 17 nt, Mycobacterium avium subsp. paratuberculosis
agagcgggauccccacc

SEQ ID NO: 2917881 - RNA, 22 nt, Mycobacterium avium subsp. paratuberculosis
agagcggugacaucgccaccug

SEQ ID NO: 2917882 - RNA, 17 nt, Mycobacterium avium subsp. paratuberculosis
agagcuacggacgcauc

SEQ ID NO: 2917883 - RNA, 22 nt, Mycobacterium avium subsp. paratuberculosis
agagcugcugaugcggacacca

SEQ ID NO: 2917884 - RNA, 20 nt, Mycobacterium avium subsp. paratuberculosis
agagcugcugccgccgcagc

SEQ ID NO: 2917885 - RNA, 17 nt, Mycobacterium avium subsp. paratuberculosis
agagcuggugggccauc

SEQ ID NO: 2917886 - RNA, 15 nt, Mycobacterium avium subsp. paratuberculosis
agagcuucaugcccu

SEQ ID NO: 2917887 - RNA, 15 nt, Mycobacterium avium subsp. paratuberculosis
agagcuugccgcgga

SEQ ID NO: 2917888 - RNA, 19 nt, Mycobacterium avium subsp. paratuberculosis
agaggcggcgaccgcgacg

SEQ ID NO: 2917889 - RNA, 13 nt, Mycobacterium avium subsp. paratuberculosis
agaggcgggcacu

SEQ ID NO: 2917890 - RNA, 13 nt, Mycobacterium avium subsp. paratuberculosis
agaggcuguccag

SEQ ID NO: 2917891 - RNA, 15 nt, Mycobacterium avium subsp. paratuberculosis
agaggcuguccagca

SEQ ID NO: 2917892 - RNA, 15 nt, Mycobacterium avium subsp. paratuberculosis
agaggugcagcgggc

SEQ ID NO: 2917893 - RNA, 15 nt, Mycobacterium avium subsp. paratuberculosis
agaggugcucgacgg

SEQ ID NO: 2917894 - RNA, 13 nt, Mycobacterium avium subsp. paratuberculosis
agagucgcuggcg

SEQ ID NO: 2917895 - RNA, 12 nt, Mycobacterium avium subsp. paratuberculosis
agagugcaacua

SEQ ID NO: 2917896 - RNA, 20 nt, Mycobacterium avium subsp. paratuberculosis
agagugcaacuagcgacggc

SEQ ID NO: 2917897 - RNA, 15 nt, Mycobacterium avium subsp. paratuberculosis
agauaccggccagca

SEQ ID NO: 2917898 - RNA, 19 nt, Mycobacterium avium subsp. paratuberculosis
agauacggucgcaccgcgg

SEQ ID NO: 2917899 - RNA, 13 nt, Mycobacterium avium subsp. paratuberculosis
agauacuccucgg

SEQ ID NO: 2917900 - RNA, 15 nt, Mycobacterium avium subsp. paratuberculosis
agauaggagacagcc

SEQ ID NO: 2917901 - RNA, 21 nt, Mycobacterium avium subsp. paratuberculosis
agauaggcggcgacggcgucg

SEQ ID NO: 2917902 - RNA, 15 nt, Mycobacterium avium subsp. paratuberculosis
agaucaacaccgcgc

SEQ ID NO: 2917903 - RNA, 16 nt, Mycobacterium avium subsp. paratuberculosis
agaucaacagccgccc

SEQ ID NO: 2917904 - RNA, 19 nt, Mycobacterium avium subsp. paratuberculosis
agaucaauucugcugcccg

SEQ ID NO: 2917905 - RNA, 15 nt, Mycobacterium avium subsp. paratuberculosis
agaucacagcgcccu

SEQ ID NO: 2917906 - RNA, 16 nt, Mycobacterium avium subsp. paratuberculosis
agaucaccacgguggc

SEQ ID NO: 2917907 - RNA, 18 nt, Mycobacterium avium subsp. paratuberculosis
agaucaccggcaccccca

SEQ ID NO: 2917908 - RNA, 12 nt, Mycobacterium avium subsp. paratuberculosis
agaucacggcgu

SEQ ID NO: 2917909 - RNA, 13 nt, Mycobacterium avium subsp. paratuberculosis
agaucagcaccag

SEQ ID NO: 2917910 - RNA, 14 nt, Mycobacterium avium subsp. paratuberculosis
agaucagcaccagg

SEQ ID NO: 2917911 - RNA, 15 nt, Mycobacterium avium subsp. paratuberculosis
agaucagcaccaggu

SEQ ID NO: 2917912 - RNA, 21 nt, Mycobacterium avium subsp. paratuberculosis
agaucagcaccagguggcccg

SEQ ID NO: 2917913 - RNA, 16 nt, Mycobacterium avium subsp. paratuberculosis
agaucagcaccgggug

SEQ ID NO: 2917914 - RNA, 21 nt, Mycobacterium avium subsp. paratuberculosis
agaucagcaccguccacagcc

SEQ ID NO: 2917915 - RNA, 20 nt, Mycobacterium avium subsp. paratuberculosis
agaucagcaggcccucggcc

SEQ ID NO: 2917916 - RNA, 21 nt, Mycobacterium avium subsp. paratuberculosis
agaucagcaggcccucggcca

SEQ ID NO: 2917917 - RNA, 23 nt, Mycobacterium avium subsp. paratuberculosis
agaucagcaggcccucggccagc

SEQ ID NO: 2917918 - RNA, 12 nt, Mycobacterium avium subsp. paratuberculosis
agaucagcgcca

SEQ ID NO: 2917919 - RNA, 14 nt, Mycobacterium avium subsp. paratuberculosis
agaucagcgccagc

SEQ ID NO: 2917920 - RNA, 14 nt, Mycobacterium avium subsp. paratuberculosis
agaucagcgcgucg

SEQ ID NO: 2917921 - RNA, 16 nt, Mycobacterium avium subsp. paratuberculosis
agaucagcguggucag

SEQ ID NO: 2917922 - RNA, 17 nt, Mycobacterium avium subsp. paratuberculosis
agaucagcguggucagc

SEQ ID NO: 2917923 - RNA, 21 nt, Mycobacterium avium subsp. paratuberculosis
agaucagggugcucagccgca

SEQ ID NO: 2917924 - RNA, 13 nt, Mycobacterium avium subsp. paratuberculosis
agaucaucccggc

SEQ ID NO: 2917925 - RNA, 14 nt, Mycobacterium avium subsp. paratuberculosis
agaucaucccggcc

SEQ ID NO: 2917926 - RNA, 17 nt, Mycobacterium avium subsp. paratuberculosis
agaucauuugaccgcac

SEQ ID NO: 2917927 - RNA, 13 nt, Mycobacterium avium subsp. paratuberculosis
agauccaccgcgc

SEQ ID NO: 2917928 - RNA, 14 nt, Mycobacterium avium subsp. paratuberculosis
agauccaccgcgcg

SEQ ID NO: 2917929 - RNA, 13 nt, Mycobacterium avium subsp. paratuberculosis
agaucccgccggc

SEQ ID NO: 2917930 - RNA, 20 nt, Mycobacterium avium subsp. paratuberculosis
agaucccgccggcggccacg

SEQ ID NO: 2917931 - RNA, 18 nt, Mycobacterium avium subsp. paratuberculosis
agaucccguaggucgccu

SEQ ID NO: 2917932 - RNA, 19 nt, Mycobacterium avium subsp. paratuberculosis
agaucccguaggucgccuc

SEQ ID NO: 2917933 - RNA, 13 nt, Mycobacterium avium subsp. paratuberculosis
agaucgaaaugac

SEQ ID NO: 2917934 - RNA, 14 nt, Mycobacterium avium subsp. paratuberculosis
agaucgacagggcg

SEQ ID NO: 2917935 - RNA, 15 nt, Mycobacterium avium subsp. paratuberculosis
agaucgacgccgacc

SEQ ID NO: 2917936 - RNA, 15 nt, Mycobacterium avium subsp. paratuberculosis
agaucgacgccgcgg

SEQ ID NO: 2917937 - RNA, 17 nt, Mycobacterium avium subsp. paratuberculosis
agaucgacgcugaccag

SEQ ID NO: 2917938 - RNA, 17 nt, Mycobacterium avium subsp. paratuberculosis
agaucgagaucagggcg

SEQ ID NO: 2917939 - RNA, 21 nt, Mycobacterium avium subsp. paratuberculosis
agaucgagcugggcccgcgca

SEQ ID NO: 2917940 - RNA, 16 nt, Mycobacterium avium subsp. paratuberculosis
agaucgaggccagcgc

SEQ ID NO: 2917941 - RNA, 18 nt, Mycobacterium avium subsp. paratuberculosis
agaucgcagcggugacac

SEQ ID NO: 2917942 - RNA, 17 nt, Mycobacterium avium subsp. paratuberculosis
agaucgccagcaccggc

SEQ ID NO: 2917943 - RNA, 14 nt, Mycobacterium avium subsp. paratuberculosis
agaucgccagcgcc

SEQ ID NO: 2917944 - RNA, 16 nt, Mycobacterium avium subsp. paratuberculosis
agaucgcccgccgcga

SEQ ID NO: 2917945 - RNA, 17 nt, Mycobacterium avium subsp. paratuberculosis
agaucgcccgggcggcg

SEQ ID NO: 2917946 - RNA, 18 nt, Mycobacterium avium subsp. paratuberculosis
agaucgcccgggcggcgg

SEQ ID NO: 2917947 - RNA, 19 nt, Mycobacterium avium subsp. paratuberculosis
agaucgccuggcagcugcc

SEQ ID NO: 2917948 - RNA, 19 nt, Mycobacterium avium subsp. paratuberculosis
agcaacaccagcuggaugg

SEQ ID NO: 2917949 - RNA, 13 nt, Mycobacterium avium subsp. paratuberculosis
agcaacagcagcg

SEQ ID NO: 2917950 - RNA, 21 nt, Mycobacterium avium subsp. paratuberculosis
agcaacauccugguccggcgc

SEQ ID NO: 2917951 - RNA, 20 nt, Mycobacterium avium subsp. paratuberculosis
agcaaccccgcggugcacga

SEQ ID NO: 2917952 - RNA, 19 nt, Mycobacterium avium subsp. paratuberculosis
agcaaccgcaccuugcgcc

SEQ ID NO: 2917953 - RNA, 16 nt, Mycobacterium avium subsp. paratuberculosis
agcaaccgccguggca

SEQ ID NO: 2917954 - RNA, 22 nt, Mycobacterium avium subsp. paratuberculosis
agcaaccgccguggcagggcca

SEQ ID NO: 2917955 - RNA, 22 nt, Mycobacterium avium subsp. paratuberculosis
agcaaccggaauggcagcagcc

SEQ ID NO: 2917956 - RNA, 13 nt, Mycobacterium avium subsp. paratuberculosis
agcaaccgggaua

SEQ ID NO: 2917957 - RNA, 18 nt, Mycobacterium avium subsp. paratuberculosis
agcaacgacccggccacc

SEQ ID NO: 2917958 - RNA, 21 nt, Mycobacterium avium subsp. paratuberculosis
agcaacgacccggccaccgcc

SEQ ID NO: 2917959 - RNA, 21 nt, Mycobacterium avium subsp. paratuberculosis
agcaacgcgguguuggcggcg

SEQ ID NO: 2917960 - RNA, 15 nt, Mycobacterium avium subsp. paratuberculosis
agcaacggccgcagc

SEQ ID NO: 2917961 - RNA, 14 nt, Mycobacterium avium subsp. paratuberculosis
agcaacggcggcgg

SEQ ID NO: 2917962 - RNA, 22 nt, Mycobacterium avium subsp. paratuberculosis
agcaacgguacgugcgccggcg

SEQ ID NO: 2917963 - RNA, 13 nt, Mycobacterium avium subsp. paratuberculosis
agcaacuggguga

SEQ ID NO: 2917964 - RNA, 21 nt, Mycobacterium avium subsp. paratuberculosis
agcaagcaguccccgccuucg

SEQ ID NO: 2917965 - RNA, 19 nt, Mycobacterium avium subsp. paratuberculosis
agcaaggucgucgcggcca

SEQ ID NO: 2917966 - RNA, 19 nt, Mycobacterium avium subsp. paratuberculosis
agcaagucggcggugaugc

SEQ ID NO: 2917967 - RNA, 19 nt, Mycobacterium avium subsp. paratuberculosis
agcaauucggugacggcgu

SEQ ID NO: 2917968 - RNA, 13 nt, Mycobacterium avium subsp. paratuberculosis
agcaauugacgcc

SEQ ID NO: 2917969 - RNA, 19 nt, Mycobacterium avium subsp. paratuberculosis
agcacaaaagggcccaugc

SEQ ID NO: 2917970 - RNA, 22 nt, Mycobacterium avium subsp. paratuberculosis
agcacacacaggucgcccggcu

SEQ ID NO: 2917971 - RNA, 14 nt, Mycobacterium avium subsp. paratuberculosis
agcacacccagcga

SEQ ID NO: 2917972 - RNA, 16 nt, Mycobacterium avium subsp. paratuberculosis
agcacacccagcgagc

SEQ ID NO: 2917973 - RNA, 14 nt, Mycobacterium avium subsp. paratuberculosis
agcacacccucacc

SEQ ID NO: 2917974 - RNA, 18 nt, Mycobacterium avium subsp. paratuberculosis
agcacaccgucgcccgcc

SEQ ID NO: 2917975 - RNA, 17 nt, Mycobacterium avium subsp. paratuberculosis
agcacaccguucccacc

SEQ ID NO: 2917976 - RNA, 23 nt, Mycobacterium avium subsp. paratuberculosis
agcacacgaucucguagguggcc

SEQ ID NO: 2917977 - RNA, 15 nt, Mycobacterium avium subsp. paratuberculosis
agcacauagcgcagc

SEQ ID NO: 2917978 - RNA, 15 nt, Mycobacterium avium subsp. paratuberculosis
agcacauccagcccu

SEQ ID NO: 2917979 - RNA, 16 nt, Mycobacterium avium subsp. paratuberculosis
agcacaucggcguuca

SEQ ID NO: 2917980 - RNA, 18 nt, Mycobacterium avium subsp. paratuberculosis
agcaccaccaacagcagc

SEQ ID NO: 2917981 - RNA, 14 nt, Mycobacterium avium subsp. paratuberculosis
agcaccaccaggcc

SEQ ID NO: 2917982 - RNA, 13 nt, Mycobacterium avium subsp. paratuberculosis
agcaccacccggg

SEQ ID NO: 2917983 - RNA, 20 nt, Mycobacterium avium subsp. paratuberculosis
agcaccacccggguguugga

SEQ ID NO: 2917984 - RNA, 10 nt, Mycobacterium avium subsp. paratuberculosis
agcaccaccg

SEQ ID NO: 2917985 - RNA, 14 nt, Mycobacterium avium subsp. paratuberculosis
agcaccaccgcgag

SEQ ID NO: 2917986 - RNA, 19 nt, Mycobacterium avium subsp. paratuberculosis
agcaccaccgcgagcgggu

SEQ ID NO: 2917987 - RNA, 18 nt, Mycobacterium avium subsp. paratuberculosis
agcaccaccgucaccgcc

SEQ ID NO: 2917988 - RNA, 17 nt, Mycobacterium avium subsp. paratuberculosis
agcaccacggcccgcgc

SEQ ID NO: 2917989 - RNA, 23 nt, Mycobacterium avium subsp. paratuberculosis
agcaccacggcccgcgccccggc

SEQ ID NO: 2917990 - RNA, 23 nt, Mycobacterium avium subsp. paratuberculosis
agcaccacggugaucucgccgag

SEQ ID NO: 2917991 - RNA, 22 nt, Mycobacterium avium subsp. paratuberculosis
agcaccacguugcgcccggcca

SEQ ID NO: 2917992 - RNA, 17 nt, Mycobacterium avium subsp. paratuberculosis
agcaccacuuccagcac

SEQ ID NO: 2917993 - RNA, 18 nt, Mycobacterium avium subsp. paratuberculosis
agcaccacuuccagcacc

SEQ ID NO: 2917994 - RNA, 18 nt, Mycobacterium avium subsp. paratuberculosis
agcaccagaugcaccucg

SEQ ID NO: 2917995 - RNA, 16 nt, Mycobacterium avium subsp. paratuberculosis
agcaccagcaccaccg

SEQ ID NO: 2917996 - RNA, 17 nt, Mycobacterium avium subsp. paratuberculosis
agcaccagcaccaccgu

SEQ ID NO: 2917997 - RNA, 16 nt, Mycobacterium avium subsp. paratuberculosis
agcaccagcacggcga

SEQ ID NO: 2917998 - RNA, 13 nt, Mycobacterium avium subsp. paratuberculosis
agcaccagcagcc

SEQ ID NO: 2917999 - RNA, 15 nt, Mycobacterium avium subsp. paratuberculosis
agcaccagcagccgg

SEQ ID NO: 2918000 - RNA, 12 nt, Mycobacterium avium subsp. paratuberculosis
agcaccagcccg

SEQ ID NO: 2918001 - RNA, 14 nt, Mycobacterium avium subsp. paratuberculosis
agcaccagcccgau

SEQ ID NO: 2918002 - RNA, 18 nt, Mycobacterium avium subsp. paratuberculosis
agcaccagcccggccagc

SEQ ID NO: 2918003 - RNA, 14 nt, Mycobacterium avium subsp. paratuberculosis
agcaccagcgccgc

SEQ ID NO: 2918004 - RNA, 15 nt, Mycobacterium avium subsp. paratuberculosis
agcaccagcgccgcg

SEQ ID NO: 2918005 - RNA, 16 nt, Mycobacterium avium subsp. paratuberculosis
agcaccagcgccgcga

SEQ ID NO: 2918006 - RNA, 18 nt, Mycobacterium avium subsp. paratuberculosis
agcaccagcgccgcgaug

SEQ ID NO: 2918007 - RNA, 13 nt, Mycobacterium avium subsp. paratuberculosis
agcaccagcgcgc

SEQ ID NO: 2918008 - RNA, 13 nt, Mycobacterium avium subsp. paratuberculosis
agcaccagcggca

SEQ ID NO: 2918009 - RNA, 19 nt, Mycobacterium avium subsp. paratuberculosis
agcaccagcggcaccaggu

SEQ ID NO: 2918010 - RNA, 22 nt, Mycobacterium avium subsp. paratuberculosis
agcaccagcguggccggcaggu

SEQ ID NO: 2918011 - RNA, 21 nt, Mycobacterium avium subsp. paratuberculosis
agcaccaggaaggcgaccgcg

SEQ ID NO: 2918012 - RNA, 17 nt, Mycobacterium avium subsp. paratuberculosis
agcaccaggcccuccug

SEQ ID NO: 2918013 - RNA, 19 nt, Mycobacterium avium subsp. paratuberculosis
agcaccaggcccucgccgc

SEQ ID NO: 2918014 - RNA, 22 nt, Mycobacterium avium subsp. paratuberculosis
agcaccaggcccucgccgcggu

SEQ ID NO: 2918015 - RNA, 15 nt, Mycobacterium avium subsp. paratuberculosis
agcaccaggcgcacc

SEQ ID NO: 2918016 - RNA, 22 nt, Mycobacterium avium subsp. paratuberculosis
agcaccaggcgcaccagcugau

SEQ ID NO: 2918017 - RNA, 20 nt, Mycobacterium avium subsp. paratuberculosis
agcaccaggcugaccagcgc

SEQ ID NO: 2918018 - RNA, 15 nt, Mycobacterium avium subsp. paratuberculosis
agcaccagggucuuc

SEQ ID NO: 2918019 - RNA, 21 nt, Mycobacterium avium subsp. paratuberculosis
agcaccagggucuucagcccg

SEQ ID NO: 2918020 - RNA, 23 nt, Mycobacterium avium subsp. paratuberculosis
agcaccaggucguugccggugcc

SEQ ID NO: 2918021 - RNA, 20 nt, Mycobacterium avium subsp. paratuberculosis
agcaccagguugucgccgcg

SEQ ID NO: 2918022 - RNA, 22 nt, Mycobacterium avium subsp. paratuberculosis
agcaccagguugucgccgcgcc

SEQ ID NO: 2918023 - RNA, 24 nt, Mycobacterium avium subsp. paratuberculosis
agcaccagguugucgccgcgccag

SEQ ID NO: 2918024 - RNA, 13 nt, Mycobacterium avium subsp. paratuberculosis
agcaccauccgcg

SEQ ID NO: 2918025 - RNA, 14 nt, Mycobacterium avium subsp. paratuberculosis
agcaccauccgcgc

SEQ ID NO: 2918026 - RNA, 20 nt, Mycobacterium avium subsp. paratuberculosis
agcaccaugaucaggcccca

SEQ ID NO: 2918027 - RNA, 17 nt, Mycobacterium avium subsp. paratuberculosis
agcacccagcacagcga

SEQ ID NO: 2918028 - RNA, 14 nt, Mycobacterium avium subsp. paratuberculosis
agcacccaggugcu

SEQ ID NO: 2918029 - RNA, 16 nt, Mycobacterium avium subsp. paratuberculosis
agcacccccucggcgc

SEQ ID NO: 2918030 - RNA, 18 nt, Mycobacterium avium subsp. paratuberculosis
agcacccccucggcgccg

SEQ ID NO: 2918031 - RNA, 20 nt, Mycobacterium avium subsp. paratuberculosis
agcacccccucggcgccggu

SEQ ID NO: 2918032 - RNA, 21 nt, Mycobacterium avium subsp. paratuberculosis
agcaccggggucugcacgaug

SEQ ID NO: 2918033 - RNA, 18 nt, Mycobacterium avium subsp. paratuberculosis
agcaccgggugauaccgg

SEQ ID NO: 2918034 - RNA, 23 nt, Mycobacterium avium subsp. paratuberculosis
agcaccgggugauaccggcccag

SEQ ID NO: 2918035 - RNA, 14 nt, Mycobacterium avium subsp. paratuberculosis
agcaccgucaccgc

SEQ ID NO: 2918036 - RNA, 16 nt, Mycobacterium avium subsp. paratuberculosis
agcaccgucaccgccu

SEQ ID NO: 2918037 - RNA, 18 nt, Mycobacterium avium subsp. paratuberculosis
agcaccgucugcgccguc

SEQ ID NO: 2918038 - RNA, 16 nt, Mycobacterium avium subsp. paratuberculosis
agcaccgugccgucgg

SEQ ID NO: 2918039 - RNA, 19 nt, Mycobacterium avium subsp. paratuberculosis
agcaccgugccgucggcgu

SEQ ID NO: 2918040 - RNA, 22 nt, Mycobacterium avium subsp. paratuberculosis
agcaccgugccgucggcgucga

SEQ ID NO: 2918041 - RNA, 23 nt, Mycobacterium avium subsp. paratuberculosis
agcaccgugccgucggcgucgac

SEQ ID NO: 2918042 - RNA, 22 nt, Mycobacterium avium subsp. paratuberculosis
agcaccgugcugauccacgccc

SEQ ID NO: 2918043 - RNA, 15 nt, Mycobacterium avium subsp. paratuberculosis
agcaccgugggcccg

SEQ ID NO: 2918044 - RNA, 20 nt, Mycobacterium avium subsp. paratuberculosis
agcaccguugugacccgcuc

SEQ ID NO: 2918045 - RNA, 21 nt, Mycobacterium avium subsp. paratuberculosis
agcaccguugugacccgcucg

SEQ ID NO: 2918046 - RNA, 15 nt, Mycobacterium avium subsp. paratuberculosis
agcaccuccgacauc

SEQ ID NO: 2918047 - RNA, 20 nt, Mycobacterium avium subsp. paratuberculosis
agcaccucgaagccgacguc

SEQ ID NO: 2918048 - RNA, 14 nt, Mycobacterium avium subsp. paratuberculosis
agcaccucgaucuu

SEQ ID NO: 2918049 - RNA, 16 nt, Mycobacterium avium subsp. paratuberculosis
agcaccucgcgcagca

SEQ ID NO: 2918050 - RNA, 21 nt, Mycobacterium avium subsp. paratuberculosis
agcaccucgcgcagcaccgau

SEQ ID NO: 2918051 - RNA, 16 nt, Mycobacterium avium subsp. paratuberculosis
agcaccucggcgacca

SEQ ID NO: 2918052 - RNA, 19 nt, Mycobacterium avium subsp. paratuberculosis
agcaccucgucgcccggcg

SEQ ID NO: 2918053 - RNA, 16 nt, Mycobacterium avium subsp. paratuberculosis
agcaccucgucgccgu

SEQ ID NO: 2918054 - RNA, 23 nt, Mycobacterium avium subsp. paratuberculosis
agcaccucuucgaaagccacccg

SEQ ID NO: 2918055 - RNA, 18 nt, Mycobacterium avium subsp. paratuberculosis
agcaccugaacggccgcg

SEQ ID NO: 2918056 - RNA, 23 nt, Mycobacterium avium subsp. paratuberculosis
agcaccugaacggccgcgcagau

SEQ ID NO: 2918057 - RNA, 20 nt, Mycobacterium avium subsp. paratuberculosis
agcaccugaccgucggccag

SEQ ID NO: 2918058 - RNA, 15 nt, Mycobacterium avium subsp. paratuberculosis
agcaccugcgcgacg

SEQ ID NO: 2918059 - RNA, 23 nt, Mycobacterium avium subsp. paratuberculosis
agcaccugcucgaugcgcgccag

SEQ ID NO: 2918060 - RNA, 16 nt, Mycobacterium avium subsp. paratuberculosis
agcaccuggauccagu

SEQ ID NO: 2918061 - RNA, 19 nt, Mycobacterium avium subsp. paratuberculosis
agcaccuggauccaguuca

SEQ ID NO: 2918062 - RNA, 13 nt, Mycobacterium avium subsp. paratuberculosis
agcaccuggccgu

SEQ ID NO: 2918063 - RNA, 16 nt, Mycobacterium avium subsp. paratuberculosis
agcaccuggccguuca

SEQ ID NO: 2918064 - RNA, 19 nt, Mycobacterium avium subsp. paratuberculosis
agcaccuggccguucaggu

SEQ ID NO: 2918065 - RNA, 21 nt, Mycobacterium avium subsp. paratuberculosis
agcaccuggccguucaggucg

SEQ ID NO: 2918066 - RNA, 18 nt, Mycobacterium avium subsp. paratuberculosis
agcaccuggcgcaccgcc

SEQ ID NO: 2918067 - RNA, 23 nt, Mycobacterium avium subsp. paratuberculosis
agcaccuggcgcaccgccgcggg

SEQ ID NO: 2918068 - RNA, 18 nt, Mycobacterium avium subsp. paratuberculosis
agcaccuuccaucgacgc

SEQ ID NO: 2918069 - RNA, 16 nt, Mycobacterium avium subsp. paratuberculosis
agcaccuucgggccga

SEQ ID NO: 2918070 - RNA, 14 nt, Mycobacterium avium subsp. paratuberculosis
agcacgaacaccac

SEQ ID NO: 2918071 - RNA, 16 nt, Mycobacterium avium subsp. paratuberculosis
agcacgaacagcagcg

SEQ ID NO: 2918072 - RNA, 17 nt, Mycobacterium avium subsp. paratuberculosis
agcacgaacgcggccgc

SEQ ID NO: 2918073 - RNA, 20 nt, Mycobacterium avium subsp. paratuberculosis
agcacgaacgcggccgccau

SEQ ID NO: 2918074 - RNA, 22 nt, Mycobacterium avium subsp. paratuberculosis
agcacgaacgcggccgccaucg

SEQ ID NO: 2918075 - RNA, 16 nt, Mycobacterium avium subsp. paratuberculosis
agcacgaaggccgccg

SEQ ID NO: 2918076 - RNA, 17 nt, Mycobacterium avium subsp. paratuberculosis
agcacgaaggccgccgg

SEQ ID NO: 2918077 - RNA, 19 nt, Mycobacterium avium subsp. paratuberculosis
agcacgaaggccgccgggu

SEQ ID NO: 2918078 - RNA, 15 nt, Mycobacterium avium subsp. paratuberculosis
agcacgacaccgacg

SEQ ID NO: 2918079 - RNA, 18 nt, Mycobacterium avium subsp. paratuberculosis
agcacgaccccgcccacg

SEQ ID NO: 2918080 - RNA, 14 nt, Mycobacterium avium subsp. paratuberculosis
agcacgaccgccag

SEQ ID NO: 2918081 - RNA, 16 nt, Mycobacterium avium subsp. paratuberculosis
agcacgaccgccagca

SEQ ID NO: 2918082 - RNA, 21 nt, Mycobacterium avium subsp. paratuberculosis
agcacgacgccgcugggcgug

SEQ ID NO: 2918083 - RNA, 15 nt, Mycobacterium avium subsp. paratuberculosis
agcacgacgucgacg

SEQ ID NO: 2918084 - RNA, 16 nt, Mycobacterium avium subsp. paratuberculosis
agcacgaucccgccgc

SEQ ID NO: 2918085 - RNA, 14 nt, Mycobacterium avium subsp. paratuberculosis
agcacgaucgagcc

SEQ ID NO: 2918086 - RNA, 16 nt, Mycobacterium avium subsp. paratuberculosis
agcacgaucgagccgg

SEQ ID NO: 2918087 - RNA, 19 nt, Mycobacterium avium subsp. paratuberculosis
agcacgaucggguagacgu

SEQ ID NO: 2918088 - RNA, 14 nt, Mycobacterium avium subsp. paratuberculosis
agcacgcagccgcg

SEQ ID NO: 2918089 - RNA, 15 nt, Mycobacterium avium subsp. paratuberculosis
agcacgcccagaucg

SEQ ID NO: 2918090 - RNA, 19 nt, Mycobacterium avium subsp. paratuberculosis
agcacgcccagaugcaggc

SEQ ID NO: 2918091 - RNA, 23 nt, Mycobacterium avium subsp. paratuberculosis
agcacgcccagcccgcgggcggc

SEQ ID NO: 2918092 - RNA, 22 nt, Mycobacterium avium subsp. paratuberculosis
agcacgcccgcgaucggcgcca

SEQ ID NO: 2918093 - RNA, 13 nt, Mycobacterium avium subsp. paratuberculosis
agcacgcccucgg

SEQ ID NO: 2918094 - RNA, 19 nt, Mycobacterium avium subsp. paratuberculosis
agcacgcccucggcuuccg

SEQ ID NO: 2918095 - RNA, 15 nt, Mycobacterium avium subsp. paratuberculosis
agcacgccgccggug

SEQ ID NO: 2918096 - RNA, 15 nt, Mycobacterium avium subsp. paratuberculosis
agcacgccgcggaag

SEQ ID NO: 2918097 - RNA, 14 nt, Mycobacterium avium subsp. paratuberculosis
agcacgccggucag

SEQ ID NO: 2918098 - RNA, 23 nt, Mycobacterium avium subsp. paratuberculosis
agcacgccguccuuggccgccag

SEQ ID NO: 2918099 - RNA, 15 nt, Mycobacterium avium subsp. paratuberculosis
agcacgccguugacc

SEQ ID NO: 2918100 - RNA, 14 nt, Mycobacterium avium subsp. paratuberculosis
agcacgcggccgcg

SEQ ID NO: 2918101 - RNA, 20 nt, Mycobacterium avium subsp. paratuberculosis
agcacgcugaagcccaccgc

SEQ ID NO: 2918102 - RNA, 20 nt, Mycobacterium avium subsp. paratuberculosis
agcacgcugaucaccacggu

SEQ ID NO: 2918103 - RNA, 14 nt, Mycobacterium avium subsp. paratuberculosis
agcacggcacgccc

SEQ ID NO: 2918104 - RNA, 20 nt, Mycobacterium avium subsp. paratuberculosis
agcacggcauagauaccggc

SEQ ID NO: 2918105 - RNA, 19 nt, Mycobacterium avium subsp. paratuberculosis
agcacggccaccagcagcg

SEQ ID NO: 2918106 - RNA, 20 nt, Mycobacterium avium subsp. paratuberculosis
agcacggccaccagcagcga

SEQ ID NO: 2918107 - RNA, 12 nt, Mycobacterium avium subsp. paratuberculosis
agcacggccacu

SEQ ID NO: 2918108 - RNA, 19 nt, Mycobacterium avium subsp. paratuberculosis
agcacggccacugccccgg

SEQ ID NO: 2918109 - RNA, 22 nt, Mycobacterium avium subsp. paratuberculosis
agcacggccacugccccggcga

SEQ ID NO: 2918110 - RNA, 16 nt, Mycobacterium avium subsp. paratuberculosis
agcacggccagccagc

SEQ ID NO: 2918111 - RNA, 21 nt, Mycobacterium avium subsp. paratuberculosis
agcacggccagccagccgccc

SEQ ID NO: 2918112 - RNA, 22 nt, Mycobacterium avium subsp. paratuberculosis
agcacggccagccagccgccca

SEQ ID NO: 2918113 - RNA, 23 nt, Mycobacterium avium subsp. paratuberculosis
agcacggccagccagccgcccag

SEQ ID NO: 2918114 - RNA, 14 nt, Mycobacterium avium subsp. paratuberculosis
agcacggccgccag

SEQ ID NO: 2918115 - RNA, 13 nt, Mycobacterium avium subsp. paratuberculosis
agcacggcggcgc

SEQ ID NO: 2918116 - RNA, 15 nt, Mycobacterium avium subsp. paratuberculosis
agcagcagccgcagc

SEQ ID NO: 2918117 - RNA, 13 nt, Mycobacterium avium subsp. paratuberculosis
agcagcagccgcg

SEQ ID NO: 2918118 - RNA, 14 nt, Mycobacterium avium subsp. paratuberculosis
agcagcagccgcgc

SEQ ID NO: 2918119 - RNA, 15 nt, Mycobacterium avium subsp. paratuberculosis
agcagcagccgcgcc

SEQ ID NO: 2918120 - RNA, 13 nt, Mycobacterium avium subsp. paratuberculosis
agcagcagcgccg

SEQ ID NO: 2918121 - RNA, 14 nt, Mycobacterium avium subsp. paratuberculosis
agcagcagcgccgc

SEQ ID NO: 2918122 - RNA, 16 nt, Mycobacterium avium subsp. paratuberculosis
agcagcagcgccgcca

SEQ ID NO: 2918123 - RNA, 13 nt, Mycobacterium avium subsp. paratuberculosis
agcagcagcgccu

SEQ ID NO: 2918124 - RNA, 12 nt, Mycobacterium avium subsp. paratuberculosis
agcagcagcgcg

SEQ ID NO: 2918125 - RNA, 14 nt, Mycobacterium avium subsp. paratuberculosis
agcagcagcgcgcg

SEQ ID NO: 2918126 - RNA, 14 nt, Mycobacterium avium subsp. paratuberculosis
agcagcagcgcggc

SEQ ID NO: 2918127 - RNA, 15 nt, Mycobacterium avium subsp. paratuberculosis
agcagcagcggcagc

SEQ ID NO: 2918128 - RNA, 16 nt, Mycobacterium avium subsp. paratuberculosis
agcagcaggucggcca

SEQ ID NO: 2918129 - RNA, 18 nt, Mycobacterium avium subsp. paratuberculosis
agcagcaucggucccagu

SEQ ID NO: 2918130 - RNA, 18 nt, Mycobacterium avium subsp. paratuberculosis
agcagcaugccgagcacc

SEQ ID NO: 2918131 - RNA, 23 nt, Mycobacterium avium subsp. paratuberculosis
agcagccacgacaccagcgucgc

SEQ ID NO: 2918132 - RNA, 17 nt, Mycobacterium avium subsp. paratuberculosis
agcagccacgccagcca

SEQ ID NO: 2918133 - RNA, 12 nt, Mycobacterium avium subsp. paratuberculosis
agcagccagcug

SEQ ID NO: 2918134 - RNA, 13 nt, Mycobacterium avium subsp. paratuberculosis
agcagccagcugg

SEQ ID NO: 2918135 - RNA, 15 nt, Mycobacterium avium subsp. paratuberculosis
agcagccaggacagc

SEQ ID NO: 2918136 - RNA, 18 nt, Mycobacterium avium subsp. paratuberculosis
agcagccagucggucaac

SEQ ID NO: 2918137 - RNA, 15 nt, Mycobacterium avium subsp. paratuberculosis
agcagccccugcacc

SEQ ID NO: 2918138 - RNA, 17 nt, Mycobacterium avium subsp. paratuberculosis
agcagccccugcaccac

SEQ ID NO: 2918139 - RNA, 19 nt, Mycobacterium avium subsp. paratuberculosis
agcagccccugcaccacga

SEQ ID NO: 2918140 - RNA, 17 nt, Mycobacterium avium subsp. paratuberculosis
agcagcccgaacagccg

SEQ ID NO: 2918141 - RNA, 16 nt, Mycobacterium avium subsp. paratuberculosis
agcagcccgaccaccu

SEQ ID NO: 2918142 - RNA, 19 nt, Mycobacterium avium subsp. paratuberculosis
agcagcccgaccaccuccc

SEQ ID NO: 2918143 - RNA, 13 nt, Mycobacterium avium subsp. paratuberculosis
agcagcccgccga

SEQ ID NO: 2918144 - RNA, 12 nt, Mycobacterium avium subsp. paratuberculosis
agcagcccggcc

SEQ ID NO: 2918145 - RNA, 15 nt, Mycobacterium avium subsp. paratuberculosis
agcagcccggccagc

SEQ ID NO: 2918146 - RNA, 12 nt, Mycobacterium avium subsp. paratuberculosis
agcagccgcagc

SEQ ID NO: 2918147 - RNA, 17 nt, Mycobacterium avium subsp. paratuberculosis
agcagccgcagcgcgcg

SEQ ID NO: 2918148 - RNA, 14 nt, Mycobacterium avium subsp. paratuberculosis
agcagccgcagcgg

SEQ ID NO: 2918149 - RNA, 16 nt, Mycobacterium avium subsp. paratuberculosis
agcagccgcagcggcg

SEQ ID NO: 2918150 - RNA, 18 nt, Mycobacterium avium subsp. paratuberculosis
agcagccgcagcggcggc

SEQ ID NO: 2918151 - RNA, 21 nt, Mycobacterium avium subsp. paratuberculosis
agcagccgccgggccacgccg

SEQ ID NO: 2918152 - RNA, 13 nt, Mycobacterium avium subsp. paratuberculosis
agcagccgcgaca

SEQ ID NO: 2918153 - RNA, 15 nt, Mycobacterium avium subsp. paratuberculosis
agcagccgcgccgac

SEQ ID NO: 2918154 - RNA, 14 nt, Mycobacterium avium subsp. paratuberculosis
agcagccgcgccgc

SEQ ID NO: 2918155 - RNA, 15 nt, Mycobacterium avium subsp. paratuberculosis
agcagccgcgccgcc

SEQ ID NO: 2918156 - RNA, 17 nt, Mycobacterium avium subsp. paratuberculosis
agcagccgcgccgccgc

SEQ ID NO: 2918157 - RNA, 19 nt, Mycobacterium avium subsp. paratuberculosis
agcagccgcgccgccgcgu

SEQ ID NO: 2918158 - RNA, 21 nt, Mycobacterium avium subsp. paratuberculosis
agcagccgcgcgagcaucacc

SEQ ID NO: 2918159 - RNA, 15 nt, Mycobacterium avium subsp. paratuberculosis
agcagccgcugcugg

SEQ ID NO: 2918160 - RNA, 15 nt, Mycobacterium avium subsp. paratuberculosis
agcagccggaaggcc

SEQ ID NO: 2918161 - RNA, 14 nt, Mycobacterium avium subsp. paratuberculosis
agcagccgggccag

SEQ ID NO: 2918162 - RNA, 18 nt, Mycobacterium avium subsp. paratuberculosis
agcagccgggccagcaac

SEQ ID NO: 2918163 - RNA, 14 nt, Mycobacterium avium subsp. paratuberculosis
agcagccgggccug

SEQ ID NO: 2918164 - RNA, 18 nt, Mycobacterium avium subsp. paratuberculosis
agcagccgggccugcggc

SEQ ID NO: 2918165 - RNA, 20 nt, Mycobacterium avium subsp. paratuberculosis
agcagccgggccugcggcgc

SEQ ID NO: 2918166 - RNA, 16 nt, Mycobacterium avium subsp. paratuberculosis
agcagccgggugccca

SEQ ID NO: 2918167 - RNA, 21 nt, Mycobacterium avium subsp. paratuberculosis
agcagccgggugcccaucugc

SEQ ID NO: 2918168 - RNA, 15 nt, Mycobacterium avium subsp. paratuberculosis
agcagccgguacagc

SEQ ID NO: 2918169 - RNA, 19 nt, Mycobacterium avium subsp. paratuberculosis
agcagccgguacagcgucu

SEQ ID NO: 2918170 - RNA, 19 nt, Mycobacterium avium subsp. paratuberculosis
agcagccugccccccuuga

SEQ ID NO: 2918171 - RNA, 15 nt, Mycobacterium avium subsp. paratuberculosis
agcagcgaacccgcc

SEQ ID NO: 2918172 - RNA, 17 nt, Mycobacterium avium subsp. paratuberculosis
agcagcgaacccgccag

SEQ ID NO: 2918173 - RNA, 19 nt, Mycobacterium avium subsp. paratuberculosis
agcagcgacaugaccaccg

SEQ ID NO: 2918174 - RNA, 20 nt, Mycobacterium avium subsp. paratuberculosis
agcagcgacaugaccaccgc

SEQ ID NO: 2918175 - RNA, 18 nt, Mycobacterium avium subsp. paratuberculosis
agcagcgacuugaccagc

SEQ ID NO: 2918176 - RNA, 18 nt, Mycobacterium avium subsp. paratuberculosis
agcagcgagaaccggcgc

SEQ ID NO: 2918177 - RNA, 19 nt, Mycobacterium avium subsp. paratuberculosis
agcagcgagaaccggcgca

SEQ ID NO: 2918178 - RNA, 15 nt, Mycobacterium avium subsp. paratuberculosis
agcagcgagaccggc

SEQ ID NO: 2918179 - RNA, 17 nt, Mycobacterium avium subsp. paratuberculosis
agcagcgaggccucgcc

SEQ ID NO: 2918180 - RNA, 19 nt, Mycobacterium avium subsp. paratuberculosis
agcagcgaggccucgccgc

SEQ ID NO: 2918181 - RNA, 13 nt, Mycobacterium avium subsp. paratuberculosis
agcagcgaggcgu

SEQ ID NO: 2918182 - RNA, 20 nt, Mycobacterium avium subsp. paratuberculosis
agcagcgcaagcugauucgg

SEQ ID NO: 2918183 - RNA, 14 nt, Mycobacterium avium subsp. paratuberculosis
agcagcgccagcac

SEQ ID NO: 2918184 - RNA, 15 nt, Mycobacterium avium subsp. paratuberculosis
agcagcgccagcacc

SEQ ID NO: 2918185 - RNA, 18 nt, Mycobacterium avium subsp. paratuberculosis
agcagcgccagcaccgcc

SEQ ID NO: 2918186 - RNA, 19 nt, Mycobacterium avium subsp. paratuberculosis
agcagcgccagcaccgccu

SEQ ID NO: 2918187 - RNA, 20 nt, Mycobacterium avium subsp. paratuberculosis
agcagcgccagcaccgccug

SEQ ID NO: 2918188 - RNA, 15 nt, Mycobacterium avium subsp. paratuberculosis
agcagcgcccaccgc

SEQ ID NO: 2918189 - RNA, 19 nt, Mycobacterium avium subsp. paratuberculosis
agcagcgcccaccgcucgu

SEQ ID NO: 2918190 - RNA, 20 nt, Mycobacterium avium subsp. paratuberculosis
agcagcgcccaccgcucguc

SEQ ID NO: 2918191 - RNA, 21 nt, Mycobacterium avium subsp. paratuberculosis
agcagcgcccaccgcucgucg

SEQ ID NO: 2918192 - RNA, 13 nt, Mycobacterium avium subsp. paratuberculosis
agcagcgcccggg

SEQ ID NO: 2918193 - RNA, 12 nt, Mycobacterium avium subsp. paratuberculosis
agcagcgccgcg

SEQ ID NO: 2918194 - RNA, 12 nt, Mycobacterium avium subsp. paratuberculosis
agcagcgccggc

SEQ ID NO: 2918195 - RNA, 12 nt, Mycobacterium avium subsp. paratuberculosis
agcagcgccucg

SEQ ID NO: 2918196 - RNA, 14 nt, Mycobacterium avium subsp. paratuberculosis
agcagcgccucgcu

SEQ ID NO: 2918197 - RNA, 23 nt, Mycobacterium avium subsp. paratuberculosis
agcagcgccucgcuaaucgccgc

SEQ ID NO: 2918198 - RNA, 14 nt, Mycobacterium avium subsp. paratuberculosis
agcagcgcgccgac

SEQ ID NO: 2918199 - RNA, 13 nt, Mycobacterium avium subsp. paratuberculosis
agcagcgcgccgc

SEQ ID NO: 2918200 - RNA, 15 nt, Mycobacterium avium subsp. paratuberculosis
agcagcgcgccgcgc

SEQ ID NO: 2918201 - RNA, 12 nt, Mycobacterium avium subsp. paratuberculosis
agcagcgcgcgc

SEQ ID NO: 2918202 - RNA, 12 nt, Mycobacterium avium subsp. paratuberculosis
agcagggcggcg

SEQ ID NO: 2918203 - RNA, 18 nt, Mycobacterium avium subsp. paratuberculosis
agcagguaaaccagcagc

SEQ ID NO: 2918204 - RNA, 19 nt, Mycobacterium avium subsp. paratuberculosis
agcagguaaaccagcagcg

SEQ ID NO: 2918205 - RNA, 19 nt, Mycobacterium avium subsp. paratuberculosis
agcagguagaagccgcgac

SEQ ID NO: 2918206 - RNA, 15 nt, Mycobacterium avium subsp. paratuberculosis
agcagguagaucgcc

SEQ ID NO: 2918207 - RNA, 19 nt, Mycobacterium avium subsp. paratuberculosis
agcagguagcggcugaccg

SEQ ID NO: 2918208 - RNA, 14 nt, Mycobacterium avium subsp. paratuberculosis
agcagguccgccgg

SEQ ID NO: 2918209 - RNA, 16 nt, Mycobacterium avium subsp. paratuberculosis
agcagguccgccggug

SEQ ID NO: 2918210 - RNA, 18 nt, Mycobacterium avium subsp. paratuberculosis
agcagguccgccggugcc

SEQ ID NO: 2918211 - RNA, 22 nt, Mycobacterium avium subsp. paratuberculosis
agcagguccgccggugccagca

SEQ ID NO: 2918212 - RNA, 20 nt, Mycobacterium avium subsp. paratuberculosis
agcagguccucgaucgacac

SEQ ID NO: 2918213 - RNA, 18 nt, Mycobacterium avium subsp. paratuberculosis
agcaggucgaaggcggcc

SEQ ID NO: 2918214 - RNA, 20 nt, Mycobacterium avium subsp. paratuberculosis
agcaggucgaaggcggccgc

SEQ ID NO: 2918215 - RNA, 14 nt, Mycobacterium avium subsp. paratuberculosis
agcaggucggccag

SEQ ID NO: 2918216 - RNA, 17 nt, Mycobacterium avium subsp. paratuberculosis
agcaggucggccagcug

SEQ ID NO: 2918217 - RNA, 13 nt, Mycobacterium avium subsp. paratuberculosis
agcaggucggcgu

SEQ ID NO: 2918218 - RNA, 15 nt, Mycobacterium avium subsp. paratuberculosis
agcaggucgucgacg

SEQ ID NO: 2918219 - RNA, 16 nt, Mycobacterium avium subsp. paratuberculosis
agcaggucgucgacgu

SEQ ID NO: 2918220 - RNA, 21 nt, Mycobacterium avium subsp. paratuberculosis
agcaggucgucgacguccucg

SEQ ID NO: 2918221 - RNA, 16 nt, Mycobacterium avium subsp. paratuberculosis
agcaggucgucgauca

SEQ ID NO: 2918222 - RNA, 20 nt, Mycobacterium avium subsp. paratuberculosis
agcaggucgucgaucagggc

SEQ ID NO: 2918223 - RNA, 16 nt, Mycobacterium avium subsp. paratuberculosis
agcaggugcaccaccc

SEQ ID NO: 2918224 - RNA, 17 nt, Mycobacterium avium subsp. paratuberculosis
agcaggugcaucgccac

SEQ ID NO: 2918225 - RNA, 13 nt, Mycobacterium avium subsp. paratuberculosis
agcaggugcgcca

SEQ ID NO: 2918226 - RNA, 16 nt, Mycobacterium avium subsp. paratuberculosis
agcaggugcgccagau

SEQ ID NO: 2918227 - RNA, 21 nt, Mycobacterium avium subsp. paratuberculosis
agcaggugcgccagaucgcug

SEQ ID NO: 2918228 - RNA, 14 nt, Mycobacterium avium subsp. paratuberculosis
agcagguugcggug

SEQ ID NO: 2918229 - RNA, 21 nt, Mycobacterium avium subsp. paratuberculosis
agcagguugcgguguugcgca

SEQ ID NO: 2918230 - RNA, 23 nt, Mycobacterium avium subsp. paratuberculosis
agcagguugcgguguugcgcagc

SEQ ID NO: 2918231 - RNA, 20 nt, Mycobacterium avium subsp. paratuberculosis
agcagguuguagucggcgcc

SEQ ID NO: 2918232 - RNA, 21 nt, Mycobacterium avium subsp. paratuberculosis
agcagguuguagucggcgccg

SEQ ID NO: 2918233 - RNA, 22 nt, Mycobacterium avium subsp. paratuberculosis
agcagguuguagucggcgccga

SEQ ID NO: 2918234 - RNA, 15 nt, Mycobacterium avium subsp. paratuberculosis
agcaguagacgccgc

SEQ ID NO: 2918235 - RNA, 17 nt, Mycobacterium avium subsp. paratuberculosis
agcaguaugcccgccgc

SEQ ID NO: 2918236 - RNA, 18 nt, Mycobacterium avium subsp. paratuberculosis
agcaguaugcccgccgcu

SEQ ID NO: 2918237 - RNA, 22 nt, Mycobacterium avium subsp. paratuberculosis
agcaguaugcccgccgcugacg

SEQ ID NO: 2918238 - RNA, 13 nt, Mycobacterium avium subsp. paratuberculosis
agcaguccccgcc

SEQ ID NO: 2918239 - RNA, 16 nt, Mycobacterium avium subsp. paratuberculosis
agcagucccucgauca

SEQ ID NO: 2918240 - RNA, 14 nt, Mycobacterium avium subsp. paratuberculosis
agcaguccggcggu

SEQ ID NO: 2918241 - RNA, 13 nt, Mycobacterium avium subsp. paratuberculosis
agcagucggccug

SEQ ID NO: 2918242 - RNA, 14 nt, Mycobacterium avium subsp. paratuberculosis
agcagucggccugc

SEQ ID NO: 2918243 - RNA, 15 nt, Mycobacterium avium subsp. paratuberculosis
agcagucggccugca

SEQ ID NO: 2918244 - RNA, 17 nt, Mycobacterium avium subsp. paratuberculosis
agcagucggccugcagc

SEQ ID NO: 2918245 - RNA, 19 nt, Mycobacterium avium subsp. paratuberculosis
agcagucggccugcagcuc

SEQ ID NO: 2918246 - RNA, 18 nt, Mycobacterium avium subsp. paratuberculosis
agcagucgugacgcggcg

SEQ ID NO: 2918247 - RNA, 19 nt, Mycobacterium avium subsp. paratuberculosis
agcagucgugacgcggcgu

SEQ ID NO: 2918248 - RNA, 21 nt, Mycobacterium avium subsp. paratuberculosis
agcagucgugacgcggcgucg

SEQ ID NO: 2918249 - RNA, 13 nt, Mycobacterium avium subsp. paratuberculosis
agcagugcaucgc

SEQ ID NO: 2918250 - RNA, 23 nt, Mycobacterium avium subsp. paratuberculosis
agcagugcaucgcugccguccac

SEQ ID NO: 2918251 - RNA, 14 nt, Mycobacterium avium subsp. paratuberculosis
agcagugccaccac

SEQ ID NO: 2918252 - RNA, 16 nt, Mycobacterium avium subsp. paratuberculosis
agcagugccaccacca

SEQ ID NO: 2918253 - RNA, 17 nt, Mycobacterium avium subsp. paratuberculosis
agcagugccaccaccac

SEQ ID NO: 2918254 - RNA, 20 nt, Mycobacterium avium subsp. paratuberculosis
agcaguucgaugcgcucggc

SEQ ID NO: 2918255 - RNA, 16 nt, Mycobacterium avium subsp. paratuberculosis
agcaguucguccacgc

SEQ ID NO: 2918256 - RNA, 20 nt, Mycobacterium avium subsp. paratuberculosis
agcaguucguccacgcuggc

SEQ ID NO: 2918257 - RNA, 19 nt, Mycobacterium avium subsp. paratuberculosis
agcaguuuguccugcucgg

SEQ ID NO: 2918258 - RNA, 23 nt, Mycobacterium avium subsp. paratuberculosis
agcaguuuguccugcucggcgac

SEQ ID NO: 2918259 - RNA, 23 nt, Mycobacterium avium subsp. paratuberculosis
agcaucaccgucaucucgguggu

SEQ ID NO: 2918260 - RNA, 16 nt, Mycobacterium avium subsp. paratuberculosis
agcaucagcugccguc

SEQ ID NO: 2918261 - RNA, 15 nt, Mycobacterium avium subsp. paratuberculosis
agcaucauugagccg

SEQ ID NO: 2918262 - RNA, 16 nt, Mycobacterium avium subsp. paratuberculosis
agcaucauugagccgc

SEQ ID NO: 2918263 - RNA, 14 nt, Mycobacterium avium subsp. paratuberculosis
agcauccagguggc

SEQ ID NO: 2918264 - RNA, 21 nt, Mycobacterium avium subsp. paratuberculosis
agcauccgcaccagguaggug

SEQ ID NO: 2918265 - RNA, 15 nt, Mycobacterium avium subsp. paratuberculosis
agcauccgcuggugc

SEQ ID NO: 2918266 - RNA, 19 nt, Mycobacterium avium subsp. paratuberculosis
agcauccgcuggugcgcgc

SEQ ID NO: 2918267 - RNA, 23 nt, Mycobacterium avium subsp. paratuberculosis
agcauccggcgcacggcgcccag

SEQ ID NO: 2918268 - RNA, 13 nt, Mycobacterium avium subsp. paratuberculosis
agcauccggugcc

SEQ ID NO: 2918269 - RNA, 15 nt, Mycobacterium avium subsp. paratuberculosis
agcauccggugccga

SEQ ID NO: 2918270 - RNA, 16 nt, Mycobacterium avium subsp. paratuberculosis
agcaucggaugccggg

SEQ ID NO: 2918271 - RNA, 19 nt, Mycobacterium avium subsp. paratuberculosis
agcaucgggacgccugccg

SEQ ID NO: 2918272 - RNA, 12 nt, Mycobacterium avium subsp. paratuberculosis
agcaucgggcgc

SEQ ID NO: 2918273 - RNA, 13 nt, Mycobacterium avium subsp. paratuberculosis
agcaucgggcgca

SEQ ID NO: 2918274 - RNA, 21 nt, Mycobacterium avium subsp. paratuberculosis
agcaucggguugccggcggcc

SEQ ID NO: 2918275 - RNA, 13 nt, Mycobacterium avium subsp. paratuberculosis
agcaucucggcga

SEQ ID NO: 2918276 - RNA, 17 nt, Mycobacterium avium subsp. paratuberculosis
agcaucucggugccguc

SEQ ID NO: 2918277 - RNA, 19 nt, Mycobacterium avium subsp. paratuberculosis
agcaucucuugaugcagcg

SEQ ID NO: 2918278 - RNA, 16 nt, Mycobacterium avium subsp. paratuberculosis
agcaugaucaccgcca

SEQ ID NO: 2918279 - RNA, 20 nt, Mycobacterium avium subsp. paratuberculosis
agcaugaucaccgccagcgc

SEQ ID NO: 2918280 - RNA, 23 nt, Mycobacterium avium subsp. paratuberculosis
agcaugaucaccgccagcgcgcc

SEQ ID NO: 2918281 - RNA, 18 nt, Mycobacterium avium subsp. paratuberculosis
agcaugcccacgccgucg

SEQ ID NO: 2918282 - RNA, 20 nt, Mycobacterium avium subsp. paratuberculosis
agcaugcccacgccgucgac

SEQ ID NO: 2918283 - RNA, 16 nt, Mycobacterium avium subsp. paratuberculosis
agcaugccgagcaccu

SEQ ID NO: 2918284 - RNA, 12 nt, Mycobacterium avium subsp. paratuberculosis
agcaugcgggug

SEQ ID NO: 2918285 - RNA, 13 nt, Mycobacterium avium subsp. paratuberculosis
agcauggcccaca

SEQ ID NO: 2918286 - RNA, 20 nt, Mycobacterium avium subsp. paratuberculosis
agcauggcgaucaccccggc

SEQ ID NO: 2918287 - RNA, 15 nt, Mycobacterium avium subsp. paratuberculosis
agcccaggcccagca

SEQ ID NO: 2918288 - RNA, 17 nt, Mycobacterium avium subsp. paratuberculosis
agcccaggcccagcagc

SEQ ID NO: 2918289 - RNA, 18 nt, Mycobacterium avium subsp. paratuberculosis
agcccaggcccagcagca

SEQ ID NO: 2918290 - RNA, 23 nt, Mycobacterium avium subsp. paratuberculosis
agcccaggcccagcagcaccgcg

SEQ ID NO: 2918291 - RNA, 17 nt, Mycobacterium avium subsp. paratuberculosis
agcccaggcccggcacc

SEQ ID NO: 2918292 - RNA, 13 nt, Mycobacterium avium subsp. paratuberculosis
agcccaucagcac

SEQ ID NO: 2918293 - RNA, 16 nt, Mycobacterium avium subsp. paratuberculosis
agcccaucagcacgcc

SEQ ID NO: 2918294 - RNA, 20 nt, Mycobacterium avium subsp. paratuberculosis
agcccaucagcacgcccucg

SEQ ID NO: 2918295 - RNA, 21 nt, Mycobacterium avium subsp. paratuberculosis
agcccaucccgauccgcgccg

SEQ ID NO: 2918296 - RNA, 17 nt, Mycobacterium avium subsp. paratuberculosis
agcccauguccagguac

SEQ ID NO: 2918297 - RNA, 22 nt, Mycobacterium avium subsp. paratuberculosis
agcccauguccagguacgcgac

SEQ ID NO: 2918298 - RNA, 14 nt, Mycobacterium avium subsp. paratuberculosis
agcccaugucgccg

SEQ ID NO: 2918299 - RNA, 16 nt, Mycobacterium avium subsp. paratuberculosis
agcccaugucgccggu

SEQ ID NO: 2918300 - RNA, 19 nt, Mycobacterium avium subsp. paratuberculosis
agcccaugucgccggugcu

SEQ ID NO: 2918301 - RNA, 13 nt, Mycobacterium avium subsp. paratuberculosis
agccccaccaccg

SEQ ID NO: 2918302 - RNA, 15 nt, Mycobacterium avium subsp. paratuberculosis
agccccaccaccgcc

SEQ ID NO: 2918303 - RNA, 23 nt, Mycobacterium avium subsp. paratuberculosis
agccccaccaccgccaccagcgc

SEQ ID NO: 2918304 - RNA, 14 nt, Mycobacterium avium subsp. paratuberculosis
agccccaccggcca

SEQ ID NO: 2918305 - RNA, 13 nt, Mycobacterium avium subsp. paratuberculosis
agccccagcacga

SEQ ID NO: 2918306 - RNA, 20 nt, Mycobacterium avium subsp. paratuberculosis
agccccaggaggcacuggcg

SEQ ID NO: 2918307 - RNA, 16 nt, Mycobacterium avium subsp. paratuberculosis
agccccaggcccgguu

SEQ ID NO: 2918308 - RNA, 13 nt, Mycobacterium avium subsp. paratuberculosis
agcccccaccuga

SEQ ID NO: 2918309 - RNA, 13 nt, Mycobacterium avium subsp. paratuberculosis
agcccccagcucu

SEQ ID NO: 2918310 - RNA, 19 nt, Mycobacterium avium subsp. paratuberculosis
agccccgccaggcggcgac

SEQ ID NO: 2918311 - RNA, 21 nt, Mycobacterium avium subsp. paratuberculosis
agccccgccgggguccgcaac

SEQ ID NO: 2918312 - RNA, 21 nt, Mycobacterium avium subsp. paratuberculosis
agccccgcgacacgccgcgca

SEQ ID NO: 2918313 - RNA, 22 nt, Mycobacterium avium subsp. paratuberculosis
agccccgggaaccagcccaggu

SEQ ID NO: 2918314 - RNA, 18 nt, Mycobacterium avium subsp. paratuberculosis
agccccgguuccaaccac

SEQ ID NO: 2918315 - RNA, 16 nt, Mycobacterium avium subsp. paratuberculosis
agccccucccaccacg

SEQ ID NO: 2918316 - RNA, 20 nt, Mycobacterium avium subsp. paratuberculosis
agccccucgacguccaggcc

SEQ ID NO: 2918317 - RNA, 21 nt, Mycobacterium avium subsp. paratuberculosis
agccccucgccgggcgucacu

SEQ ID NO: 2918318 - RNA, 13 nt, Mycobacterium avium subsp. paratuberculosis
agccccucggggc

SEQ ID NO: 2918319 - RNA, 15 nt, Mycobacterium avium subsp. paratuberculosis
agccccucggggcug

SEQ ID NO: 2918320 - RNA, 22 nt, Mycobacterium avium subsp. paratuberculosis
agccccucggggcugcgcggcu

SEQ ID NO: 2918321 - RNA, 17 nt, Mycobacterium avium subsp. paratuberculosis
agccccucguccaggug

SEQ ID NO: 2918322 - RNA, 16 nt, Mycobacterium avium subsp. paratuberculosis
agccccuuaccggccg

SEQ ID NO: 2918323 - RNA, 18 nt, Mycobacterium avium subsp. paratuberculosis
agcccgaacacgggcggc

SEQ ID NO: 2918324 - RNA, 19 nt, Mycobacterium avium subsp. paratuberculosis
agcccgaacagccgggcca

SEQ ID NO: 2918325 - RNA, 20 nt, Mycobacterium avium subsp. paratuberculosis
agcccgaacagccgggcggc

SEQ ID NO: 2918326 - RNA, 21 nt, Mycobacterium avium subsp. paratuberculosis
agcccgaacagcuugccgauc

SEQ ID NO: 2918327 - RNA, 13 nt, Mycobacterium avium subsp. paratuberculosis
agcccgacccggc

SEQ ID NO: 2918328 - RNA, 18 nt, Mycobacterium avium subsp. paratuberculosis
agcccgacggcagcaccg

SEQ ID NO: 2918329 - RNA, 20 nt, Mycobacterium avium subsp. paratuberculosis
agcccgacggcagcaccgcc

SEQ ID NO: 2918330 - RNA, 22 nt, Mycobacterium avium subsp. paratuberculosis
agcccgacggcagcaccgccga

SEQ ID NO: 2918331 - RNA, 15 nt, Mycobacterium avium subsp. paratuberculosis
agcccgagaucgacg

SEQ ID NO: 2918332 - RNA, 15 nt, Mycobacterium avium subsp. paratuberculosis
agcccgagcaccagc

SEQ ID NO: 2918333 - RNA, 16 nt, Mycobacterium avium subsp. paratuberculosis
agcccgagcaccagcg

SEQ ID NO: 2918334 - RNA, 19 nt, Mycobacterium avium subsp. paratuberculosis
agcccgagcgucacgccag

SEQ ID NO: 2918335 - RNA, 21 nt, Mycobacterium avium subsp. paratuberculosis
agcccgaucacccccgacacc

SEQ ID NO: 2918336 - RNA, 19 nt, Mycobacterium avium subsp. paratuberculosis
agcccgaucgccagcgccc

SEQ ID NO: 2918337 - RNA, 18 nt, Mycobacterium avium subsp. paratuberculosis
agcccgaugccgccgagg

SEQ ID NO: 2918338 - RNA, 15 nt, Mycobacterium avium subsp. paratuberculosis
agcccgaugcuggcc

SEQ ID NO: 2918339 - RNA, 16 nt, Mycobacterium avium subsp. paratuberculosis
agcccgaugcuggcca

SEQ ID NO: 2918340 - RNA, 19 nt, Mycobacterium avium subsp. paratuberculosis
agcccgaugcuggccaucg

SEQ ID NO: 2918341 - RNA, 21 nt, Mycobacterium avium subsp. paratuberculosis
agcccgaugcuggccaucgcc

SEQ ID NO: 2918342 - RNA, 17 nt, Mycobacterium avium subsp. paratuberculosis
agcccgcaaaucagccg

SEQ ID NO: 2918343 - RNA, 21 nt, Mycobacterium avium subsp. paratuberculosis
agcccgcaaaucagccgagcc

SEQ ID NO: 2918344 - RNA, 17 nt, Mycobacterium avium subsp. paratuberculosis
agcccgcagcgaacgcg

SEQ ID NO: 2918345 - RNA, 14 nt, Mycobacterium avium subsp. paratuberculosis
agcccgcccagcgc

SEQ ID NO: 2918346 - RNA, 17 nt, Mycobacterium avium subsp. paratuberculosis
agcccgcccagcgccac

SEQ ID NO: 2918347 - RNA, 19 nt, Mycobacterium avium subsp. paratuberculosis
agcccgccgaaccagaucg

SEQ ID NO: 2918348 - RNA, 16 nt, Mycobacterium avium subsp. paratuberculosis
agcccgccgaccaccu

SEQ ID NO: 2918349 - RNA, 19 nt, Mycobacterium avium subsp. paratuberculosis
agcccgccgaccaccuugc

SEQ ID NO: 2918350 - RNA, 15 nt, Mycobacterium avium subsp. paratuberculosis
agcccgccgauggac

SEQ ID NO: 2918351 - RNA, 12 nt, Mycobacterium avium subsp. paratuberculosis
agcccgccgcgg

SEQ ID NO: 2918352 - RNA, 14 nt, Mycobacterium avium subsp. paratuberculosis
agcccgccgcggcg

SEQ ID NO: 2918353 - RNA, 16 nt, Mycobacterium avium subsp. paratuberculosis
agcccgccgcggcgac

SEQ ID NO: 2918354 - RNA, 18 nt, Mycobacterium avium subsp. paratuberculosis
agcccgccgcggcgaccg

SEQ ID NO: 2918355 - RNA, 15 nt, Mycobacterium avium subsp. paratuberculosis
agcccgccggcggcg

SEQ ID NO: 2918356 - RNA, 16 nt, Mycobacterium avium subsp. paratuberculosis
agcccgccggcggcga

SEQ ID NO: 2918357 - RNA, 15 nt, Mycobacterium avium subsp. paratuberculosis
agcccgccggcgggu

SEQ ID NO: 2918358 - RNA, 23 nt, Mycobacterium avium subsp. paratuberculosis
agcccgccgggaugcgccaccga

SEQ ID NO: 2918359 - RNA, 24 nt, Mycobacterium avium subsp. paratuberculosis
agcccgccgggaugcgccaccgac

SEQ ID NO: 2918360 - RNA, 12 nt, Mycobacterium avium subsp. paratuberculosis
agcccgccgggc

SEQ ID NO: 2918361 - RNA, 19 nt, Mycobacterium avium subsp. paratuberculosis
agcccgccgggcugaccgu

SEQ ID NO: 2918362 - RNA, 14 nt, Mycobacterium avium subsp. paratuberculosis
agcccgccgucggc

SEQ ID NO: 2918363 - RNA, 15 nt, Mycobacterium avium subsp. paratuberculosis
agcccgcgccagcuc

SEQ ID NO: 2918364 - RNA, 20 nt, Mycobacterium avium subsp. paratuberculosis
agcccgcgccagcucggcgg

SEQ ID NO: 2918365 - RNA, 15 nt, Mycobacterium avium subsp. paratuberculosis
agcccgcgccgagca

SEQ ID NO: 2918366 - RNA, 22 nt, Mycobacterium avium subsp. paratuberculosis
agcccgcgcgagcgcagcgcca

SEQ ID NO: 2918367 - RNA, 17 nt, Mycobacterium avium subsp. paratuberculosis
agcccgcggcagccagc

SEQ ID NO: 2918368 - RNA, 16 nt, Mycobacterium avium subsp. paratuberculosis
agcccgcguccagcag

SEQ ID NO: 2918369 - RNA, 15 nt, Mycobacterium avium subsp. paratuberculosis
agcccgcucagagcu

SEQ ID NO: 2918370 - RNA, 21 nt, Mycobacterium avium subsp. paratuberculosis
agcccgcucagagcugcaccg

SEQ ID NO: 2918371 - RNA, 19 nt, Mycobacterium avium subsp. paratuberculosis
agcccgcugaccaggccga

SEQ ID NO: 2918372 - RNA, 21 nt, Mycobacterium avium subsp. paratuberculosis
agcccuugcagcacaccggca

SEQ ID NO: 2918373 - RNA, 17 nt, Mycobacterium avium subsp. paratuberculosis
agcccuuuggcggccag

SEQ ID NO: 2918374 - RNA, 15 nt, Mycobacterium avium subsp. paratuberculosis
agccgaacgcgcugu

SEQ ID NO: 2918375 - RNA, 16 nt, Mycobacterium avium subsp. paratuberculosis
agccgaagaucaccgc

SEQ ID NO: 2918376 - RNA, 19 nt, Mycobacterium avium subsp. paratuberculosis
agccgaagaucaccgcguc

SEQ ID NO: 2918377 - RNA, 20 nt, Mycobacterium avium subsp. paratuberculosis
agccgaagaucaccgcgucg

SEQ ID NO: 2918378 - RNA, 22 nt, Mycobacterium avium subsp. paratuberculosis
agccgaagaucaccgcgucggc

SEQ ID NO: 2918379 - RNA, 23 nt, Mycobacterium avium subsp. paratuberculosis
agccgaagccgccguccccgcgc

SEQ ID NO: 2918380 - RNA, 13 nt, Mycobacterium avium subsp. paratuberculosis
agccgaagccggc

SEQ ID NO: 2918381 - RNA, 17 nt, Mycobacterium avium subsp. paratuberculosis
agccgaagccggcgcag

SEQ ID NO: 2918382 - RNA, 19 nt, Mycobacterium avium subsp. paratuberculosis
agccgaaguauccggucag

SEQ ID NO: 2918383 - RNA, 22 nt, Mycobacterium avium subsp. paratuberculosis
agccgaaguuggcgucgggcac

SEQ ID NO: 2918384 - RNA, 23 nt, Mycobacterium avium subsp. paratuberculosis
agccgaaguuggcgucgggcacc

SEQ ID NO: 2918385 - RNA, 16 nt, Mycobacterium avium subsp. paratuberculosis
agccgacaccgggucc

SEQ ID NO: 2918386 - RNA, 13 nt, Mycobacterium avium subsp. paratuberculosis
agccgacagucgc

SEQ ID NO: 2918387 - RNA, 18 nt, Mycobacterium avium subsp. paratuberculosis
agccgaccaacgggcggc

SEQ ID NO: 2918388 - RNA, 19 nt, Mycobacterium avium subsp. paratuberculosis
agccgaccaacgggcggcg

SEQ ID NO: 2918389 - RNA, 20 nt, Mycobacterium avium subsp. paratuberculosis
agccgaccaacgggcggcgg

SEQ ID NO: 2918390 - RNA, 14 nt, Mycobacterium avium subsp. paratuberculosis
agccgaccagcgcg

SEQ ID NO: 2918391 - RNA, 16 nt, Mycobacterium avium subsp. paratuberculosis
agccgaccagcgcgau

SEQ ID NO: 2918392 - RNA, 21 nt, Mycobacterium avium subsp. paratuberculosis
agccgaccagcggucgggugc

SEQ ID NO: 2918393 - RNA, 16 nt, Mycobacterium avium subsp. paratuberculosis
agccgaccgacccggc

SEQ ID NO: 2918394 - RNA, 17 nt, Mycobacterium avium subsp. paratuberculosis
agccgaccgacccggcc

SEQ ID NO: 2918395 - RNA, 20 nt, Mycobacterium avium subsp. paratuberculosis
agccgaccgacccggccagc

SEQ ID NO: 2918396 - RNA, 13 nt, Mycobacterium avium subsp. paratuberculosis
agccgaccucggc

SEQ ID NO: 2918397 - RNA, 15 nt, Mycobacterium avium subsp. paratuberculosis
agccgaccucggcga

SEQ ID NO: 2918398 - RNA, 16 nt, Mycobacterium avium subsp. paratuberculosis
agccgaccucggcgac

SEQ ID NO: 2918399 - RNA, 18 nt, Mycobacterium avium subsp. paratuberculosis
agccgaccucggcgacga

SEQ ID NO: 2918400 - RNA, 18 nt, Mycobacterium avium subsp. paratuberculosis
agccgaccuugacccagg

SEQ ID NO: 2918401 - RNA, 20 nt, Mycobacterium avium subsp. paratuberculosis
agccgaccuugacccaggcc

SEQ ID NO: 2918402 - RNA, 20 nt, Mycobacterium avium subsp. paratuberculosis
agccgacgucgaccagguag

SEQ ID NO: 2918403 - RNA, 17 nt, Mycobacterium avium subsp. paratuberculosis
agccgacgugcccgauc

SEQ ID NO: 2918404 - RNA, 20 nt, Mycobacterium avium subsp. paratuberculosis
agccgacgugcccgaucucg

SEQ ID NO: 2918405 - RNA, 19 nt, Mycobacterium avium subsp. paratuberculosis
agccgagacugaugguggc

SEQ ID NO: 2918406 - RNA, 14 nt, Mycobacterium avium subsp. paratuberculosis
agccgagaucgacc

SEQ ID NO: 2918407 - RNA, 19 nt, Mycobacterium avium subsp. paratuberculosis
agccgagaucgacccgcuc

SEQ ID NO: 2918408 - RNA, 23 nt, Mycobacterium avium subsp. paratuberculosis
agccgagaucgacccgcuccgac

SEQ ID NO: 2918409 - RNA, 15 nt, Mycobacterium avium subsp. paratuberculosis
agccgagcaccaggc

SEQ ID NO: 2918410 - RNA, 16 nt, Mycobacterium avium subsp. paratuberculosis
agccgagcaccaggcg

SEQ ID NO: 2918411 - RNA, 18 nt, Mycobacterium avium subsp. paratuberculosis
agccgagcaccaggcgca

SEQ ID NO: 2918412 - RNA, 22 nt, Mycobacterium avium subsp. paratuberculosis
agccgagcaccaggcgcaccag

SEQ ID NO: 2918413 - RNA, 17 nt, Mycobacterium avium subsp. paratuberculosis
agccgagcaccggcagc

SEQ ID NO: 2918414 - RNA, 20 nt, Mycobacterium avium subsp. paratuberculosis
agccgagcaccggcagcacc

SEQ ID NO: 2918415 - RNA, 17 nt, Mycobacterium avium subsp. paratuberculosis
agccgagcaccgggcug

SEQ ID NO: 2918416 - RNA, 16 nt, Mycobacterium avium subsp. paratuberculosis
agccgagccgacccgg

SEQ ID NO: 2918417 - RNA, 17 nt, Mycobacterium avium subsp. paratuberculosis
agccgagccgacccggg

SEQ ID NO: 2918418 - RNA, 19 nt, Mycobacterium avium subsp. paratuberculosis
agccgagccgacccgggcu

SEQ ID NO: 2918419 - RNA, 13 nt, Mycobacterium avium subsp. paratuberculosis
agccgagccgggc

SEQ ID NO: 2918420 - RNA, 15 nt, Mycobacterium avium subsp. paratuberculosis
agccgagccgggcca

SEQ ID NO: 2918421 - RNA, 16 nt, Mycobacterium avium subsp. paratuberculosis
agccgagccgggccag

SEQ ID NO: 2918422 - RNA, 14 nt, Mycobacterium avium subsp. paratuberculosis
agccgagcggcgcc

SEQ ID NO: 2918423 - RNA, 22 nt, Mycobacterium avium subsp. paratuberculosis
agccgagcgguccaacgggcuc

SEQ ID NO: 2918424 - RNA, 22 nt, Mycobacterium avium subsp. paratuberculosis
agccgaggcagaaaugcaggcc

SEQ ID NO: 2918425 - RNA, 17 nt, Mycobacterium avium subsp. paratuberculosis
agccgaggccgauggcg

SEQ ID NO: 2918426 - RNA, 15 nt, Mycobacterium avium subsp. paratuberculosis
agccgaggucgccga

SEQ ID NO: 2918427 - RNA, 22 nt, Mycobacterium avium subsp. paratuberculosis
agccgaggucgccgacgccguc

SEQ ID NO: 2918428 - RNA, 19 nt, Mycobacterium avium subsp. paratuberculosis
agccgaggucgcggcggcc

SEQ ID NO: 2918429 - RNA, 19 nt, Mycobacterium avium subsp. paratuberculosis
agccgaguuugcggugauc

SEQ ID NO: 2918430 - RNA, 14 nt, Mycobacterium avium subsp. paratuberculosis
agccgaucaccggc

SEQ ID NO: 2918431 - RNA, 15 nt, Mycobacterium avium subsp. paratuberculosis
agccgaucaccggcg

SEQ ID NO: 2918432 - RNA, 23 nt, Mycobacterium avium subsp. paratuberculosis
agccgaucaccggcgcguuggcc

SEQ ID NO: 2918433 - RNA, 13 nt, Mycobacterium avium subsp. paratuberculosis
agccgaucgccuc

SEQ ID NO: 2918434 - RNA, 18 nt, Mycobacterium avium subsp. paratuberculosis
agccgaucgccuccguca

SEQ ID NO: 2918435 - RNA, 22 nt, Mycobacterium avium subsp. paratuberculosis
agccgaucgccuccgucagcgc

SEQ ID NO: 2918436 - RNA, 14 nt, Mycobacterium avium subsp. paratuberculosis
agccgaucgcggcg

SEQ ID NO: 2918437 - RNA, 15 nt, Mycobacterium avium subsp. paratuberculosis
agccgaucgcggcga

SEQ ID NO: 2918438 - RNA, 16 nt, Mycobacterium avium subsp. paratuberculosis
agccgaucgcggcgau

SEQ ID NO: 2918439 - RNA, 18 nt, Mycobacterium avium subsp. paratuberculosis
agccgaucgcggcgauca

SEQ ID NO: 2918440 - RNA, 14 nt, Mycobacterium avium subsp. paratuberculosis
agccgaucgcggug

SEQ ID NO: 2918441 - RNA, 21 nt, Mycobacterium avium subsp. paratuberculosis
agccgaugaugaaaccggcca

SEQ ID NO: 2918442 - RNA, 17 nt, Mycobacterium avium subsp. paratuberculosis
agccgaugcgcccgcgc

SEQ ID NO: 2918443 - RNA, 19 nt, Mycobacterium avium subsp. paratuberculosis
agccgaugcgcccgcgcca

SEQ ID NO: 2918444 - RNA, 22 nt, Mycobacterium avium subsp. paratuberculosis
agccgaugcgcccgcgccaccc

SEQ ID NO: 2918445 - RNA, 14 nt, Mycobacterium avium subsp. paratuberculosis
agccgaugucgucg

SEQ ID NO: 2918446 - RNA, 15 nt, Mycobacterium avium subsp. paratuberculosis
agccgaugucgucga

SEQ ID NO: 2918447 - RNA, 21 nt, Mycobacterium avium subsp. paratuberculosis
agccgauugucgcugcgaggc

SEQ ID NO: 2918448 - RNA, 18 nt, Mycobacterium avium subsp. paratuberculosis
agccgcaacacggccucg

SEQ ID NO: 2918449 - RNA, 19 nt, Mycobacterium avium subsp. paratuberculosis
agccgcaacacggccucga

SEQ ID NO: 2918450 - RNA, 13 nt, Mycobacterium avium subsp. paratuberculosis
agccgcacaacau

SEQ ID NO: 2918451 - RNA, 15 nt, Mycobacterium avium subsp. paratuberculosis
agccgcacaccgcgg

SEQ ID NO: 2918452 - RNA, 16 nt, Mycobacterium avium subsp. paratuberculosis
agccgcacaccgcggc

SEQ ID NO: 2918453 - RNA, 19 nt, Mycobacterium avium subsp. paratuberculosis
agccgcacaccgcggcggc

SEQ ID NO: 2918454 - RNA, 23 nt, Mycobacterium avium subsp. paratuberculosis
agccgcacaccgcggcggcgucg

SEQ ID NO: 2918455 - RNA, 15 nt, Mycobacterium avium subsp. paratuberculosis
agccgcaccagaucg

SEQ ID NO: 2918456 - RNA, 17 nt, Mycobacterium avium subsp. paratuberculosis
agccgcgcggccgccuc

SEQ ID NO: 2918457 - RNA, 19 nt, Mycobacterium avium subsp. paratuberculosis
agccgcgcggccgccuccg

SEQ ID NO: 2918458 - RNA, 15 nt, Mycobacterium avium subsp. paratuberculosis
agccgcgcggccggc

SEQ ID NO: 2918459 - RNA, 17 nt, Mycobacterium avium subsp. paratuberculosis
agccgcgcggccggcca

SEQ ID NO: 2918460 - RNA, 21 nt, Mycobacterium avium subsp. paratuberculosis
agccgcgcggccggccacgcu

SEQ ID NO: 2918461 - RNA, 15 nt, Mycobacterium avium subsp. paratuberculosis
agccgcgcggcgucg

SEQ ID NO: 2918462 - RNA, 19 nt, Mycobacterium avium subsp. paratuberculosis
agccgcgcggcgucggccg

SEQ ID NO: 2918463 - RNA, 23 nt, Mycobacterium avium subsp. paratuberculosis
agccgcgcggcgucggccgggcu

SEQ ID NO: 2918464 - RNA, 23 nt, Mycobacterium avium subsp. paratuberculosis
agccgcgcgugcagccgggcggc

SEQ ID NO: 2918465 - RNA, 17 nt, Mycobacterium avium subsp. paratuberculosis
agccgcggacggccagc

SEQ ID NO: 2918466 - RNA, 19 nt, Mycobacterium avium subsp. paratuberculosis
agccgcggacggccagccc

SEQ ID NO: 2918467 - RNA, 14 nt, Mycobacterium avium subsp. paratuberculosis
agccgcggacggcg

SEQ ID NO: 2918468 - RNA, 14 nt, Mycobacterium avium subsp. paratuberculosis
agccgcggauggcc

SEQ ID NO: 2918469 - RNA, 16 nt, Mycobacterium avium subsp. paratuberculosis
agccgcggauggccuc

SEQ ID NO: 2918470 - RNA, 17 nt, Mycobacterium avium subsp. paratuberculosis
agccgcggauggccucg

SEQ ID NO: 2918471 - RNA, 13 nt, Mycobacterium avium subsp. paratuberculosis
agccgcggcccgc

SEQ ID NO: 2918472 - RNA, 12 nt, Mycobacterium avium subsp. paratuberculosis
agccgcggcucg

SEQ ID NO: 2918473 - RNA, 20 nt, Mycobacterium avium subsp. paratuberculosis
agccgcggcucgauggacgc

SEQ ID NO: 2918474 - RNA, 16 nt, Mycobacterium avium subsp. paratuberculosis
agccgcgguggcggug

SEQ ID NO: 2918475 - RNA, 17 nt, Mycobacterium avium subsp. paratuberculosis
agccgcgguggcggugu

SEQ ID NO: 2918476 - RNA, 20 nt, Mycobacterium avium subsp. paratuberculosis
agccgcgguucuuguccucg

SEQ ID NO: 2918477 - RNA, 13 nt, Mycobacterium avium subsp. paratuberculosis
agccgcgucacgu

SEQ ID NO: 2918478 - RNA, 18 nt, Mycobacterium avium subsp. paratuberculosis
agccgcucacacagccgc

SEQ ID NO: 2918479 - RNA, 14 nt, Mycobacterium avium subsp. paratuberculosis
agccgcuccaccgc

SEQ ID NO: 2918480 - RNA, 15 nt, Mycobacterium avium subsp. paratuberculosis
agccgcuccaccgcg

SEQ ID NO: 2918481 - RNA, 17 nt, Mycobacterium avium subsp. paratuberculosis
agccgcuccaccgcguc

SEQ ID NO: 2918482 - RNA, 17 nt, Mycobacterium avium subsp. paratuberculosis
agccgcucccggcgcag

SEQ ID NO: 2918483 - RNA, 19 nt, Mycobacterium avium subsp. paratuberculosis
agccgcuccggcccgagca

SEQ ID NO: 2918484 - RNA, 16 nt, Mycobacterium avium subsp. paratuberculosis
agccgcuccucguuga

SEQ ID NO: 2918485 - RNA, 18 nt, Mycobacterium avium subsp. paratuberculosis
agccgcucgcccagcgcg

SEQ ID NO: 2918486 - RNA, 18 nt, Mycobacterium avium subsp. paratuberculosis
agccgcucgcgcaccggg

SEQ ID NO: 2918487 - RNA, 22 nt, Mycobacterium avium subsp. paratuberculosis
agccgcugacgauggcgaccgc

SEQ ID NO: 2918488 - RNA, 21 nt, Mycobacterium avium subsp. paratuberculosis
agccgcugagcuucugcccgg

SEQ ID NO: 2918489 - RNA, 11 nt, Mycobacterium avium subsp. paratuberculosis
agccgcugcag

SEQ ID NO: 2918490 - RNA, 13 nt, Mycobacterium avium subsp. paratuberculosis
agccgcugcagcg

SEQ ID NO: 2918491 - RNA, 15 nt, Mycobacterium avium subsp. paratuberculosis
agccgcugcagcgcc

SEQ ID NO: 2918492 - RNA, 21 nt, Mycobacterium avium subsp. paratuberculosis
agccgcugcagcgccgcccgc

SEQ ID NO: 2918493 - RNA, 23 nt, Mycobacterium avium subsp. paratuberculosis
agccgcugcagcgccgcccgcac

SEQ ID NO: 2918494 - RNA, 14 nt, Mycobacterium avium subsp. paratuberculosis
agccgcugccgcac

SEQ ID NO: 2918495 - RNA, 20 nt, Mycobacterium avium subsp. paratuberculosis
agccgcugccguucgccggu

SEQ ID NO: 2918496 - RNA, 18 nt, Mycobacterium avium subsp. paratuberculosis
agccgcugcgacaggucg

SEQ ID NO: 2918497 - RNA, 21 nt, Mycobacterium avium subsp. paratuberculosis
agccgcugcugggugccgcgu

SEQ ID NO: 2918498 - RNA, 15 nt, Mycobacterium avium subsp. paratuberculosis
agccgcuggccgcgc

SEQ ID NO: 2918499 - RNA, 17 nt, Mycobacterium avium subsp. paratuberculosis
agccgcuggccgcgcca

SEQ ID NO: 2918500 - RNA, 21 nt, Mycobacterium avium subsp. paratuberculosis
agccgcuggccgcgccacagc

SEQ ID NO: 2918501 - RNA, 13 nt, Mycobacterium avium subsp. paratuberculosis
agccgcuuggccg

SEQ ID NO: 2918502 - RNA, 17 nt, Mycobacterium avium subsp. paratuberculosis
agccgcuuggccgggcg

SEQ ID NO: 2918503 - RNA, 23 nt, Mycobacterium avium subsp. paratuberculosis
agccgcuuggcgcgccgcaccuc

SEQ ID NO: 2918504 - RNA, 17 nt, Mycobacterium avium subsp. paratuberculosis
agccgcuugguggcgcc

SEQ ID NO: 2918505 - RNA, 18 nt, Mycobacterium avium subsp. paratuberculosis
agccgcuugguggcgccg

SEQ ID NO: 2918506 - RNA, 20 nt, Mycobacterium avium subsp. paratuberculosis
agccggaaggccaaggccag

SEQ ID NO: 2918507 - RNA, 22 nt, Mycobacterium avium subsp. paratuberculosis
agccggaaggccaaggccagca

SEQ ID NO: 2918508 - RNA, 23 nt, Mycobacterium avium subsp. paratuberculosis
agccggaaggccaaggccagcaa

SEQ ID NO: 2918509 - RNA, 14 nt, Mycobacterium avium subsp. paratuberculosis
agccggacagcggg

SEQ ID NO: 2918510 - RNA, 20 nt, Mycobacterium avium subsp. paratuberculosis
agccggacaucucccgcacc

SEQ ID NO: 2918511 - RNA, 18 nt, Mycobacterium avium subsp. paratuberculosis
agccggacccauucgucg

SEQ ID NO: 2918512 - RNA, 17 nt, Mycobacterium avium subsp. paratuberculosis
agccggaccgcuugacg

SEQ ID NO: 2918513 - RNA, 23 nt, Mycobacterium avium subsp. paratuberculosis
agccggaccgcuugacgccgccg

SEQ ID NO: 2918514 - RNA, 20 nt, Mycobacterium avium subsp. paratuberculosis
agccggagaacuaucugguc

SEQ ID NO: 2918515 - RNA, 23 nt, Mycobacterium avium subsp. paratuberculosis
agccggagccuugcuggcggccu

SEQ ID NO: 2918516 - RNA, 19 nt, Mycobacterium avium subsp. paratuberculosis
agccggaucaccuggugcu

SEQ ID NO: 2918517 - RNA, 13 nt, Mycobacterium avium subsp. paratuberculosis
agccggaucagcg

SEQ ID NO: 2918518 - RNA, 14 nt, Mycobacterium avium subsp. paratuberculosis
agccggaucucguc

SEQ ID NO: 2918519 - RNA, 19 nt, Mycobacterium avium subsp. paratuberculosis
agccggaucucgucgggca

SEQ ID NO: 2918520 - RNA, 21 nt, Mycobacterium avium subsp. paratuberculosis
agccggaucucgucgggcacc

SEQ ID NO: 2918521 - RNA, 14 nt, Mycobacterium avium subsp. paratuberculosis
agccggaugcggcc

SEQ ID NO: 2918522 - RNA, 16 nt, Mycobacterium avium subsp. paratuberculosis
agccggaugcggccga

SEQ ID NO: 2918523 - RNA, 21 nt, Mycobacterium avium subsp. paratuberculosis
agccggaugcggccgaagucc

SEQ ID NO: 2918524 - RNA, 20 nt, Mycobacterium avium subsp. paratuberculosis
agccggauguccuacggcgg

SEQ ID NO: 2918525 - RNA, 20 nt, Mycobacterium avium subsp. paratuberculosis
agccggcacgcgcgccggag

SEQ ID NO: 2918526 - RNA, 18 nt, Mycobacterium avium subsp. paratuberculosis
agccggcacggccggccg

SEQ ID NO: 2918527 - RNA, 21 nt, Mycobacterium avium subsp. paratuberculosis
agccggcagcauucgccgggg

SEQ ID NO: 2918528 - RNA, 23 nt, Mycobacterium avium subsp. paratuberculosis
agccggccaacagcagcgccgcg

SEQ ID NO: 2918529 - RNA, 13 nt, Mycobacterium avium subsp. paratuberculosis
agccggccaccgc

SEQ ID NO: 2918530 - RNA, 14 nt, Mycobacterium avium subsp. paratuberculosis
agccggccaccgcc

SEQ ID NO: 2918531 - RNA, 17 nt, Mycobacterium avium subsp. paratuberculosis
agccggccaccgcccca

SEQ ID NO: 2918532 - RNA, 13 nt, Mycobacterium avium subsp. paratuberculosis
agccggccaccuc

SEQ ID NO: 2918533 - RNA, 12 nt, Mycobacterium avium subsp. paratuberculosis
agccggccagca

SEQ ID NO: 2918534 - RNA, 13 nt, Mycobacterium avium subsp. paratuberculosis
agccggccagcag

SEQ ID NO: 2918535 - RNA, 14 nt, Mycobacterium avium subsp. paratuberculosis
agccggccagcagc

SEQ ID NO: 2918536 - RNA, 15 nt, Mycobacterium avium subsp. paratuberculosis
agccggccagcagcg

SEQ ID NO: 2918537 - RNA, 16 nt, Mycobacterium avium subsp. paratuberculosis
agccggccagcgucgc

SEQ ID NO: 2918538 - RNA, 13 nt, Mycobacterium avium subsp. paratuberculosis
agccggccaggcc

SEQ ID NO: 2918539 - RNA, 20 nt, Mycobacterium avium subsp. paratuberculosis
agccggccaggcccagccca

SEQ ID NO: 2918540 - RNA, 14 nt, Mycobacterium avium subsp. paratuberculosis
agccggccaguucc

SEQ ID NO: 2918541 - RNA, 16 nt, Mycobacterium avium subsp. paratuberculosis
agccgggcggccagcg

SEQ ID NO: 2918542 - RNA, 17 nt, Mycobacterium avium subsp. paratuberculosis
agccgggcggccagcgu

SEQ ID NO: 2918543 - RNA, 13 nt, Mycobacterium avium subsp. paratuberculosis
agccgggcggccu

SEQ ID NO: 2918544 - RNA, 14 nt, Mycobacterium avium subsp. paratuberculosis
agccgggcggccuc

SEQ ID NO: 2918545 - RNA, 15 nt, Mycobacterium avium subsp. paratuberculosis
agccgggcggccucg

SEQ ID NO: 2918546 - RNA, 13 nt, Mycobacterium avium subsp. paratuberculosis
agccgggcggcgc

SEQ ID NO: 2918547 - RNA, 14 nt, Mycobacterium avium subsp. paratuberculosis
agccgggcggcggc

SEQ ID NO: 2918548 - RNA, 16 nt, Mycobacterium avium subsp. paratuberculosis
agccgggcggugaugg

SEQ ID NO: 2918549 - RNA, 12 nt, Mycobacterium avium subsp. paratuberculosis
agccgggcucga

SEQ ID NO: 2918550 - RNA, 13 nt, Mycobacterium avium subsp. paratuberculosis
agccgggcucgag

SEQ ID NO: 2918551 - RNA, 13 nt, Mycobacterium avium subsp. paratuberculosis
agccggggacggu

SEQ ID NO: 2918552 - RNA, 17 nt, Mycobacterium avium subsp. paratuberculosis
agccggggacggugcag

SEQ ID NO: 2918553 - RNA, 19 nt, Mycobacterium avium subsp. paratuberculosis
agccggggacggugcagcc

SEQ ID NO: 2918554 - RNA, 20 nt, Mycobacterium avium subsp. paratuberculosis
agccggggacggugcagccg

SEQ ID NO: 2918555 - RNA, 21 nt, Mycobacterium avium subsp. paratuberculosis
agccggggacggugcagccgg

SEQ ID NO: 2918556 - RNA, 22 nt, Mycobacterium avium subsp. paratuberculosis
agccggggacggugcagccggg

SEQ ID NO: 2918557 - RNA, 16 nt, Mycobacterium avium subsp. paratuberculosis
agccggggcagcugcu

SEQ ID NO: 2918558 - RNA, 20 nt, Mycobacterium avium subsp. paratuberculosis
agccgggggaucaccucauc

SEQ ID NO: 2918559 - RNA, 22 nt, Mycobacterium avium subsp. paratuberculosis
agccgggggaucaccucaucgc

SEQ ID NO: 2918560 - RNA, 17 nt, Mycobacterium avium subsp. paratuberculosis
agccgggggcggugcag

SEQ ID NO: 2918561 - RNA, 19 nt, Mycobacterium avium subsp. paratuberculosis
agccgggggcggugcagcc

SEQ ID NO: 2918562 - RNA, 21 nt, Mycobacterium avium subsp. paratuberculosis
agccgggggcggugcagccgg

SEQ ID NO: 2918563 - RNA, 23 nt, Mycobacterium avium subsp. paratuberculosis
agccgggggcggugcagccgggu

SEQ ID NO: 2918564 - RNA, 22 nt, Mycobacterium avium subsp. paratuberculosis
agccgggggucggcuuccagau

SEQ ID NO: 2918565 - RNA, 19 nt, Mycobacterium avium subsp. paratuberculosis
agccgggguagggcggcgg

SEQ ID NO: 2918566 - RNA, 16 nt, Mycobacterium avium subsp. paratuberculosis
agccggggugcccggg

SEQ ID NO: 2918567 - RNA, 18 nt, Mycobacterium avium subsp. paratuberculosis
agccggguagcgccgccg

SEQ ID NO: 2918568 - RNA, 22 nt, Mycobacterium avium subsp. paratuberculosis
agccgggucaguucgcggcgca

SEQ ID NO: 2918569 - RNA, 23 nt, Mycobacterium avium subsp. paratuberculosis
agccgggucaguucgcggcgcac

SEQ ID NO: 2918570 - RNA, 16 nt, Mycobacterium avium subsp. paratuberculosis
agccgggugaacccga

SEQ ID NO: 2918571 - RNA, 17 nt, Mycobacterium avium subsp. paratuberculosis
agccgggugaacccgac

SEQ ID NO: 2918572 - RNA, 18 nt, Mycobacterium avium subsp. paratuberculosis
agccgggugaacccgacg

SEQ ID NO: 2918573 - RNA, 16 nt, Mycobacterium avium subsp. paratuberculosis
agccgggugcccaucu

SEQ ID NO: 2918574 - RNA, 23 nt, Mycobacterium avium subsp. paratuberculosis
agccgggugcgggccagcagccg

SEQ ID NO: 2918575 - RNA, 13 nt, Mycobacterium avium subsp. paratuberculosis
agccgggugcggu

SEQ ID NO: 2918576 - RNA, 14 nt, Mycobacterium avium subsp. paratuberculosis
agccgggugcggug

SEQ ID NO: 2918577 - RNA, 17 nt, Mycobacterium avium subsp. paratuberculosis
agccggguggcccgcgc

SEQ ID NO: 2918578 - RNA, 13 nt, Mycobacterium avium subsp. paratuberculosis
agccgggugggcg

SEQ ID NO: 2918579 - RNA, 17 nt, Mycobacterium avium subsp. paratuberculosis
agccgguacggaucgcc

SEQ ID NO: 2918580 - RNA, 15 nt, Mycobacterium avium subsp. paratuberculosis
agccgguagaucagc

SEQ ID NO: 2918581 - RNA, 16 nt, Mycobacterium avium subsp. paratuberculosis
agccgguagaucagcg

SEQ ID NO: 2918582 - RNA, 23 nt, Mycobacterium avium subsp. paratuberculosis
agccgguaugcgaucgcgucgaa

SEQ ID NO: 2918583 - RNA, 17 nt, Mycobacterium avium subsp. paratuberculosis
agccggucauaggccgc

SEQ ID NO: 2918584 - RNA, 16 nt, Mycobacterium avium subsp. paratuberculosis
agccgguccaugugcc

SEQ ID NO: 2918585 - RNA, 21 nt, Mycobacterium avium subsp. paratuberculosis
agccgguccaugugccgcauc

SEQ ID NO: 2918586 - RNA, 14 nt, Mycobacterium avium subsp. paratuberculosis
agccgguccgacca

SEQ ID NO: 2918587 - RNA, 15 nt, Mycobacterium avium subsp. paratuberculosis
agccgguccgaccgc

SEQ ID NO: 2918588 - RNA, 23 nt, Mycobacterium avium subsp. paratuberculosis
agccgguccgaccgccaccaccc

SEQ ID NO: 2918589 - RNA, 17 nt, Mycobacterium avium subsp. paratuberculosis
agccgguccgacggcug

SEQ ID NO: 2918590 - RNA, 16 nt, Mycobacterium avium subsp. paratuberculosis
agccgguccggcggca

SEQ ID NO: 2918591 - RNA, 18 nt, Mycobacterium avium subsp. paratuberculosis
agccgguccggcggcacc

SEQ ID NO: 2918592 - RNA, 22 nt, Mycobacterium avium subsp. paratuberculosis
agccgguccggcggcaccaccc

SEQ ID NO: 2918593 - RNA, 14 nt, Mycobacterium avium subsp. paratuberculosis
agccgguccuggcc

SEQ ID NO: 2918594 - RNA, 23 nt, Mycobacterium avium subsp. paratuberculosis
agccgguccugggccuccggcgg

SEQ ID NO: 2918595 - RNA, 16 nt, Mycobacterium avium subsp. paratuberculosis
agccgguccuuggccu

SEQ ID NO: 2918596 - RNA, 18 nt, Mycobacterium avium subsp. paratuberculosis
agccggucgaacgccagc

SEQ ID NO: 2918597 - RNA, 13 nt, Mycobacterium avium subsp. paratuberculosis
agccggucgacga

SEQ ID NO: 2918598 - RNA, 19 nt, Mycobacterium avium subsp. paratuberculosis
agccggucgaggucgccga

SEQ ID NO: 2918599 - RNA, 20 nt, Mycobacterium avium subsp. paratuberculosis
agccggucgaggucgccgac

SEQ ID NO: 2918600 - RNA, 18 nt, Mycobacterium avium subsp. paratuberculosis
agccggucgccgggccgg

SEQ ID NO: 2918601 - RNA, 19 nt, Mycobacterium avium subsp. paratuberculosis
agccggucgccgggccggc

SEQ ID NO: 2918602 - RNA, 17 nt, Mycobacterium avium subsp. paratuberculosis
agccggucgcgcaucgc

SEQ ID NO: 2918603 - RNA, 16 nt, Mycobacterium avium subsp. paratuberculosis
agccggucggcccgcu

SEQ ID NO: 2918604 - RNA, 18 nt, Mycobacterium avium subsp. paratuberculosis
agccggucggcccgcucc

SEQ ID NO: 2918605 - RNA, 16 nt, Mycobacterium avium subsp. paratuberculosis
agccggucgggaucga

SEQ ID NO: 2918606 - RNA, 19 nt, Mycobacterium avium subsp. paratuberculosis
agccggucgugcgacuccu

SEQ ID NO: 2918607 - RNA, 21 nt, Mycobacterium avium subsp. paratuberculosis
agccggucuuggacagcagca

SEQ ID NO: 2918608 - RNA, 21 nt, Mycobacterium avium subsp. paratuberculosis
agccggucuugggcucggcgc

SEQ ID NO: 2918609 - RNA, 19 nt, Mycobacterium avium subsp. paratuberculosis
agccggugaucgcggcgcu

SEQ ID NO: 2918610 - RNA, 19 nt, Mycobacterium avium subsp. paratuberculosis
agccggugaugacgucgcc

SEQ ID NO: 2918611 - RNA, 13 nt, Mycobacterium avium subsp. paratuberculosis
agccggugcacca

SEQ ID NO: 2918612 - RNA, 15 nt, Mycobacterium avium subsp. paratuberculosis
agccggugcccaucg

SEQ ID NO: 2918613 - RNA, 16 nt, Mycobacterium avium subsp. paratuberculosis
agccggugcccaucgc

SEQ ID NO: 2918614 - RNA, 18 nt, Mycobacterium avium subsp. paratuberculosis
agccggugccgaggcagu

SEQ ID NO: 2918615 - RNA, 18 nt, Mycobacterium avium subsp. paratuberculosis
agccggugcgagccgcug

SEQ ID NO: 2918616 - RNA, 16 nt, Mycobacterium avium subsp. paratuberculosis
agccggugcggucggc

SEQ ID NO: 2918617 - RNA, 18 nt, Mycobacterium avium subsp. paratuberculosis
agccggugcggucggcgu

SEQ ID NO: 2918618 - RNA, 19 nt, Mycobacterium avium subsp. paratuberculosis
agccggugcggucggcguc

SEQ ID NO: 2918619 - RNA, 20 nt, Mycobacterium avium subsp. paratuberculosis
agccggugcggucggcgucg

SEQ ID NO: 2918620 - RNA, 18 nt, Mycobacterium avium subsp. paratuberculosis
agccggugcugacccggu

SEQ ID NO: 2918621 - RNA, 13 nt, Mycobacterium avium subsp. paratuberculosis
agccgguggcagc

SEQ ID NO: 2918622 - RNA, 16 nt, Mycobacterium avium subsp. paratuberculosis
agccgguggcagcccg

SEQ ID NO: 2918623 - RNA, 19 nt, Mycobacterium avium subsp. paratuberculosis
agccgguggcagcccggcu

SEQ ID NO: 2918624 - RNA, 20 nt, Mycobacterium avium subsp. paratuberculosis
agccgguggcagcccggcua

SEQ ID NO: 2918625 - RNA, 17 nt, Mycobacterium avium subsp. paratuberculosis
agccgguggcggccacg

SEQ ID NO: 2918626 - RNA, 19 nt, Mycobacterium avium subsp. paratuberculosis
agccugccuccacgucacc

SEQ ID NO: 2918627 - RNA, 13 nt, Mycobacterium avium subsp. paratuberculosis
agccugcggccug

SEQ ID NO: 2918628 - RNA, 17 nt, Mycobacterium avium subsp. paratuberculosis
agccugcggugaugcgc

SEQ ID NO: 2918629 - RNA, 21 nt, Mycobacterium avium subsp. paratuberculosis
agccugcggugaugcgcggcg

SEQ ID NO: 2918630 - RNA, 12 nt, Mycobacterium avium subsp. paratuberculosis
agccuggcacga

SEQ ID NO: 2918631 - RNA, 19 nt, Mycobacterium avium subsp. paratuberculosis
agccuggcacgacgccgcc

SEQ ID NO: 2918632 - RNA, 22 nt, Mycobacterium avium subsp. paratuberculosis
agccuggcacgacgccgccgag

SEQ ID NO: 2918633 - RNA, 23 nt, Mycobacterium avium subsp. paratuberculosis
agccuggcacgacgccgccgagg

SEQ ID NO: 2918634 - RNA, 12 nt, Mycobacterium avium subsp. paratuberculosis
agccuggcgcgc

SEQ ID NO: 2918635 - RNA, 18 nt, Mycobacterium avium subsp. paratuberculosis
agccuggugauccucguc

SEQ ID NO: 2918636 - RNA, 13 nt, Mycobacterium avium subsp. paratuberculosis
agccuguuggcca

SEQ ID NO: 2918637 - RNA, 19 nt, Mycobacterium avium subsp. paratuberculosis
agccuguuggccagauacu

SEQ ID NO: 2918638 - RNA, 18 nt, Mycobacterium avium subsp. paratuberculosis
agccuucuucgccgcaac

SEQ ID NO: 2918639 - RNA, 18 nt, Mycobacterium avium subsp. paratuberculosis
agccuucuucgccgcagc

SEQ ID NO: 2918640 - RNA, 19 nt, Mycobacterium avium subsp. paratuberculosis
agccuucuucgccggggcc

SEQ ID NO: 2918641 - RNA, 18 nt, Mycobacterium avium subsp. paratuberculosis
agccuucuugaccgcagc

SEQ ID NO: 2918642 - RNA, 20 nt, Mycobacterium avium subsp. paratuberculosis
agccuucuugaccgcagccu

SEQ ID NO: 2918643 - RNA, 15 nt, Mycobacterium avium subsp. paratuberculosis
agccuugcuggcggc

SEQ ID NO: 2918644 - RNA, 18 nt, Mycobacterium avium subsp. paratuberculosis
agccuugcuggcggccuu

SEQ ID NO: 2918645 - RNA, 19 nt, Mycobacterium avium subsp. paratuberculosis
agccuugcuggcggccuuc

SEQ ID NO: 2918646 - RNA, 16 nt, Mycobacterium avium subsp. paratuberculosis
agccuuggucgcggcc

SEQ ID NO: 2918647 - RNA, 18 nt, Mycobacterium avium subsp. paratuberculosis
agccuuggucgcggccuu

SEQ ID NO: 2918648 - RNA, 21 nt, Mycobacterium avium subsp. paratuberculosis
agccuuggucgcggccuugcg

SEQ ID NO: 2918649 - RNA, 22 nt, Mycobacterium avium subsp. paratuberculosis
agccuuuccacaucugcuugau

SEQ ID NO: 2918650 - RNA, 21 nt, Mycobacterium avium subsp. paratuberculosis
agccuuugccgugcucggcgg

SEQ ID NO: 2918651 - RNA, 21 nt, Mycobacterium avium subsp. paratuberculosis
agcgaaagacguugaugcgau

SEQ ID NO: 2918652 - RNA, 16 nt, Mycobacterium avium subsp. paratuberculosis
agcgaacacgugcagc

SEQ ID NO: 2918653 - RNA, 18 nt, Mycobacterium avium subsp. paratuberculosis
agcgaacccgccagggcg

SEQ ID NO: 2918654 - RNA, 13 nt, Mycobacterium avium subsp. paratuberculosis
agcgaacgcggcu

SEQ ID NO: 2918655 - RNA, 23 nt, Mycobacterium avium subsp. paratuberculosis
agcgaacugccggcauaggccag

SEQ ID NO: 2918656 - RNA, 21 nt, Mycobacterium avium subsp. paratuberculosis
agcgaagccgugacccgccgu

SEQ ID NO: 2918657 - RNA, 14 nt, Mycobacterium avium subsp. paratuberculosis
agcgaaggugccgc

SEQ ID NO: 2918658 - RNA, 20 nt, Mycobacterium avium subsp. paratuberculosis
agcgaauccgggugucgacg

SEQ ID NO: 2918659 - RNA, 16 nt, Mycobacterium avium subsp. paratuberculosis
agcgacaacagcacga

SEQ ID NO: 2918660 - RNA, 18 nt, Mycobacterium avium subsp. paratuberculosis
agcgacaacggcccccac

SEQ ID NO: 2918661 - RNA, 16 nt, Mycobacterium avium subsp. paratuberculosis
agcgacaacgggccgc

SEQ ID NO: 2918662 - RNA, 23 nt, Mycobacterium avium subsp. paratuberculosis
agcgacaacguggugugcaccag

SEQ ID NO: 2918663 - RNA, 16 nt, Mycobacterium avium subsp. paratuberculosis
agcgacaaucggcucg

SEQ ID NO: 2918664 - RNA, 15 nt, Mycobacterium avium subsp. paratuberculosis
agcgacaccaggucg

SEQ ID NO: 2918665 - RNA, 13 nt, Mycobacterium avium subsp. paratuberculosis
agcgacagcaccc

SEQ ID NO: 2918666 - RNA, 15 nt, Mycobacterium avium subsp. paratuberculosis
agcgacagcgcgucg

SEQ ID NO: 2918667 - RNA, 18 nt, Mycobacterium avium subsp. paratuberculosis
agcgacagcgcgucggcc

SEQ ID NO: 2918668 - RNA, 22 nt, Mycobacterium avium subsp. paratuberculosis
agcgacagggugccgaacagcg

SEQ ID NO: 2918669 - RNA, 16 nt, Mycobacterium avium subsp. paratuberculosis
agcgacaugaccaccg

SEQ ID NO: 2918670 - RNA, 17 nt, Mycobacterium avium subsp. paratuberculosis
agcgacaugaccaccgc

SEQ ID NO: 2918671 - RNA, 13 nt, Mycobacterium avium subsp. paratuberculosis
agcgaccagcgcg

SEQ ID NO: 2918672 - RNA, 14 nt, Mycobacterium avium subsp. paratuberculosis
agcgaccagcgcgc

SEQ ID NO: 2918673 - RNA, 22 nt, Mycobacterium avium subsp. paratuberculosis
agcgaccagcgcgccggccagc

SEQ ID NO: 2918674 - RNA, 17 nt, Mycobacterium avium subsp. paratuberculosis
agcgaccugguccaccg

SEQ ID NO: 2918675 - RNA, 22 nt, Mycobacterium avium subsp. paratuberculosis
agcgaccugguccaccgcggcg

SEQ ID NO: 2918676 - RNA, 17 nt, Mycobacterium avium subsp. paratuberculosis
agcgacgaggugaugcc

SEQ ID NO: 2918677 - RNA, 20 nt, Mycobacterium avium subsp. paratuberculosis
agcgacgccacggggcugcg

SEQ ID NO: 2918678 - RNA, 12 nt, Mycobacterium avium subsp. paratuberculosis
agcgacgccagc

SEQ ID NO: 2918679 - RNA, 22 nt, Mycobacterium avium subsp. paratuberculosis
agcgacgccagcggcagcgcca

SEQ ID NO: 2918680 - RNA, 13 nt, Mycobacterium avium subsp. paratuberculosis
agcgacgcccaga

SEQ ID NO: 2918681 - RNA, 19 nt, Mycobacterium avium subsp. paratuberculosis
agcgacggaucggccgcgu

SEQ ID NO: 2918682 - RNA, 22 nt, Mycobacterium avium subsp. paratuberculosis
agcgacggcccgccggagccga

SEQ ID NO: 2918683 - RNA, 16 nt, Mycobacterium avium subsp. paratuberculosis
agcgacgggccgggca

SEQ ID NO: 2918684 - RNA, 23 nt, Mycobacterium avium subsp. paratuberculosis
agcgacgggccgggcacgucgac

SEQ ID NO: 2918685 - RNA, 22 nt, Mycobacterium avium subsp. paratuberculosis
agcgacgucaggucgaccggcu

SEQ ID NO: 2918686 - RNA, 17 nt, Mycobacterium avium subsp. paratuberculosis
agcgacuccagcgcgau

SEQ ID NO: 2918687 - RNA, 15 nt, Mycobacterium avium subsp. paratuberculosis
agcgacucgaccccg

SEQ ID NO: 2918688 - RNA, 19 nt, Mycobacterium avium subsp. paratuberculosis
agcgacucgaccccgccca

SEQ ID NO: 2918689 - RNA, 14 nt, Mycobacterium avium subsp. paratuberculosis
agcgacucggccag

SEQ ID NO: 2918690 - RNA, 16 nt, Mycobacterium avium subsp. paratuberculosis
agcgacucggccagga

SEQ ID NO: 2918691 - RNA, 14 nt, Mycobacterium avium subsp. paratuberculosis
agcgacucgggcag

SEQ ID NO: 2918692 - RNA, 15 nt, Mycobacterium avium subsp. paratuberculosis
agcgacucguuggcc

SEQ ID NO: 2918693 - RNA, 19 nt, Mycobacterium avium subsp. paratuberculosis
agcgacucguuggccggcu

SEQ ID NO: 2918694 - RNA, 13 nt, Mycobacterium avium subsp. paratuberculosis
agcgacuugacca

SEQ ID NO: 2918695 - RNA, 17 nt, Mycobacterium avium subsp. paratuberculosis
agcgacuugaccagcag

SEQ ID NO: 2918696 - RNA, 19 nt, Mycobacterium avium subsp. paratuberculosis
agcgacuugaccagcagcu

SEQ ID NO: 2918697 - RNA, 16 nt, Mycobacterium avium subsp. paratuberculosis
agcgacuugccgccgg

SEQ ID NO: 2918698 - RNA, 17 nt, Mycobacterium avium subsp. paratuberculosis
agcgacuugccgccggc

SEQ ID NO: 2918699 - RNA, 15 nt, Mycobacterium avium subsp. paratuberculosis
agcgagaaccggcgc

SEQ ID NO: 2918700 - RNA, 19 nt, Mycobacterium avium subsp. paratuberculosis
agcgagaagucgccgacgc

SEQ ID NO: 2918701 - RNA, 20 nt, Mycobacterium avium subsp. paratuberculosis
agcgagaagucgcucagcgu

SEQ ID NO: 2918702 - RNA, 21 nt, Mycobacterium avium subsp. paratuberculosis
agcgagaccgcuugcggcuca

SEQ ID NO: 2918703 - RNA, 16 nt, Mycobacterium avium subsp. paratuberculosis
agcgagaccggcacgg

SEQ ID NO: 2918704 - RNA, 12 nt, Mycobacterium avium subsp. paratuberculosis
agcgagaccucc

SEQ ID NO: 2918705 - RNA, 21 nt, Mycobacterium avium subsp. paratuberculosis
agcgagaccucccggcgccac

SEQ ID NO: 2918706 - RNA, 17 nt, Mycobacterium avium subsp. paratuberculosis
agcgagacgaccaggau

SEQ ID NO: 2918707 - RNA, 18 nt, Mycobacterium avium subsp. paratuberculosis
agcgagacgaccaggaug

SEQ ID NO: 2918708 - RNA, 22 nt, Mycobacterium avium subsp. paratuberculosis
agcgagacgaccaggaugccca

SEQ ID NO: 2918709 - RNA, 21 nt, Mycobacterium avium subsp. paratuberculosis
agcgagaucccgguucccggc

SEQ ID NO: 2918710 - RNA, 17 nt, Mycobacterium avium subsp. paratuberculosis
agcgcaucggucaccag

SEQ ID NO: 2918711 - RNA, 16 nt, Mycobacterium avium subsp. paratuberculosis
agcgcaucguugccgg

SEQ ID NO: 2918712 - RNA, 19 nt, Mycobacterium avium subsp. paratuberculosis
agcgcaucguugccggcgg

SEQ ID NO: 2918713 - RNA, 22 nt, Mycobacterium avium subsp. paratuberculosis
agcgcaucguugccggcggcga

SEQ ID NO: 2918714 - RNA, 20 nt, Mycobacterium avium subsp. paratuberculosis
agcgcaugaugcccaggccc

SEQ ID NO: 2918715 - RNA, 22 nt, Mycobacterium avium subsp. paratuberculosis
agcgcaugaugcccaggcccac

SEQ ID NO: 2918716 - RNA, 17 nt, Mycobacterium avium subsp. paratuberculosis
agcgccaacauggcgca

SEQ ID NO: 2918717 - RNA, 16 nt, Mycobacterium avium subsp. paratuberculosis
agcgccacaucagcuc

SEQ ID NO: 2918718 - RNA, 18 nt, Mycobacterium avium subsp. paratuberculosis
agcgccacaucagcucgg

SEQ ID NO: 2918719 - RNA, 15 nt, Mycobacterium avium subsp. paratuberculosis
agcgccaccagcacc

SEQ ID NO: 2918720 - RNA, 19 nt, Mycobacterium avium subsp. paratuberculosis
agcgccaccagcaccggga

SEQ ID NO: 2918721 - RNA, 20 nt, Mycobacterium avium subsp. paratuberculosis
agcgccaccccgaacccggc

SEQ ID NO: 2918722 - RNA, 21 nt, Mycobacterium avium subsp. paratuberculosis
agcgccaccccgaacccggcc

SEQ ID NO: 2918723 - RNA, 22 nt, Mycobacterium avium subsp. paratuberculosis
agcgccaccccgaacccggcca

SEQ ID NO: 2918724 - RNA, 21 nt, Mycobacterium avium subsp. paratuberculosis
agcgccacgcucaugcccgcc

SEQ ID NO: 2918725 - RNA, 16 nt, Mycobacterium avium subsp. paratuberculosis
agcgccacggggcgcc

SEQ ID NO: 2918726 - RNA, 21 nt, Mycobacterium avium subsp. paratuberculosis
agcgccacggggcgccgcugc

SEQ ID NO: 2918727 - RNA, 21 nt, Mycobacterium avium subsp. paratuberculosis
agcgccacgguggcggucagg

SEQ ID NO: 2918728 - RNA, 13 nt, Mycobacterium avium subsp. paratuberculosis
agcgccacuggcu

SEQ ID NO: 2918729 - RNA, 20 nt, Mycobacterium avium subsp. paratuberculosis
agcgccagcaacacccagcc

SEQ ID NO: 2918730 - RNA, 21 nt, Mycobacterium avium subsp. paratuberculosis
agcgccagcaacacccagccg

SEQ ID NO: 2918731 - RNA, 17 nt, Mycobacterium avium subsp. paratuberculosis
agcgccagcaccgccug

SEQ ID NO: 2918732 - RNA, 16 nt, Mycobacterium avium subsp. paratuberculosis
agcgccagcaccgggc

SEQ ID NO: 2918733 - RNA, 14 nt, Mycobacterium avium subsp. paratuberculosis
agcgccagcacggc

SEQ ID NO: 2918734 - RNA, 17 nt, Mycobacterium avium subsp. paratuberculosis
agcgccagcacggccac

SEQ ID NO: 2918735 - RNA, 22 nt, Mycobacterium avium subsp. paratuberculosis
agcgccagcacggccaccagca

SEQ ID NO: 2918736 - RNA, 16 nt, Mycobacterium avium subsp. paratuberculosis
agcgccagcagcggca

SEQ ID NO: 2918737 - RNA, 17 nt, Mycobacterium avium subsp. paratuberculosis
agcgccagcagcggcac

SEQ ID NO: 2918738 - RNA, 14 nt, Mycobacterium avium subsp. paratuberculosis
agcgccagcgagug

SEQ ID NO: 2918739 - RNA, 15 nt, Mycobacterium avium subsp. paratuberculosis
agcgccagcgccagc

SEQ ID NO: 2918740 - RNA, 18 nt, Mycobacterium avium subsp. paratuberculosis
agcgccagcgccagcgug

SEQ ID NO: 2918741 - RNA, 12 nt, Mycobacterium avium subsp. paratuberculosis
agcgccagcgcg

SEQ ID NO: 2918742 - RNA, 14 nt, Mycobacterium avium subsp. paratuberculosis
agcgccagcgcgcc

SEQ ID NO: 2918743 - RNA, 17 nt, Mycobacterium avium subsp. paratuberculosis
agcgccagcgcgcccgc

SEQ ID NO: 2918744 - RNA, 13 nt, Mycobacterium avium subsp. paratuberculosis
agcgccagcgcgg

SEQ ID NO: 2918745 - RNA, 22 nt, Mycobacterium avium subsp. paratuberculosis
agcgccagcgcggugcccagcc

SEQ ID NO: 2918746 - RNA, 18 nt, Mycobacterium avium subsp. paratuberculosis
agcgccagcggcuugccg

SEQ ID NO: 2918747 - RNA, 17 nt, Mycobacterium avium subsp. paratuberculosis
agcgccagcguggccag

SEQ ID NO: 2918748 - RNA, 18 nt, Mycobacterium avium subsp. paratuberculosis
agcgccagcguggccagc

SEQ ID NO: 2918749 - RNA, 19 nt, Mycobacterium avium subsp. paratuberculosis
agcgccagcguggccagca

SEQ ID NO: 2918750 - RNA, 22 nt, Mycobacterium avium subsp. paratuberculosis
agcgccaggacgaaaaccagga

SEQ ID NO: 2918751 - RNA, 23 nt, Mycobacterium avium subsp. paratuberculosis
agcgccaggccauggcgcaccgc

SEQ ID NO: 2918752 - RNA, 18 nt, Mycobacterium avium subsp. paratuberculosis
agcgccagggugccccgc

SEQ ID NO: 2918753 - RNA, 19 nt, Mycobacterium avium subsp. paratuberculosis
agcgccagggugccccgca

SEQ ID NO: 2918754 - RNA, 13 nt, Mycobacterium avium subsp. paratuberculosis
agcgccagucgcg

SEQ ID NO: 2918755 - RNA, 13 nt, Mycobacterium avium subsp. paratuberculosis
agcgccaugccgc

SEQ ID NO: 2918756 - RNA, 16 nt, Mycobacterium avium subsp. paratuberculosis
agcgccaugccgccga

SEQ ID NO: 2918757 - RNA, 13 nt, Mycobacterium avium subsp. paratuberculosis
agcgcccaccgcu

SEQ ID NO: 2918758 - RNA, 14 nt, Mycobacterium avium subsp. paratuberculosis
agcgcccagccgag

SEQ ID NO: 2918759 - RNA, 12 nt, Mycobacterium avium subsp. paratuberculosis
agcgcccaggcg

SEQ ID NO: 2918760 - RNA, 14 nt, Mycobacterium avium subsp. paratuberculosis
agcgcccaggcgug

SEQ ID NO: 2918761 - RNA, 21 nt, Mycobacterium avium subsp. paratuberculosis
agcgccccagggccucggcga

SEQ ID NO: 2918762 - RNA, 22 nt, Mycobacterium avium subsp. paratuberculosis
agcgccccagggccucggcgac

SEQ ID NO: 2918763 - RNA, 15 nt, Mycobacterium avium subsp. paratuberculosis
agcgcccccagcggg

SEQ ID NO: 2918764 - RNA, 18 nt, Mycobacterium avium subsp. paratuberculosis
agcgcccccgacaggccc

SEQ ID NO: 2918765 - RNA, 23 nt, Mycobacterium avium subsp. paratuberculosis
agcgcccccgaggagacgucggc

SEQ ID NO: 2918766 - RNA, 13 nt, Mycobacterium avium subsp. paratuberculosis
agcgccccgccgg

SEQ ID NO: 2918767 - RNA, 18 nt, Mycobacterium avium subsp. paratuberculosis
agcgccccgccgggggag

SEQ ID NO: 2918768 - RNA, 14 nt, Mycobacterium avium subsp. paratuberculosis
agcgcccgauuccc

SEQ ID NO: 2918769 - RNA, 21 nt, Mycobacterium avium subsp. paratuberculosis
agcgcccgauuccccggcgug

SEQ ID NO: 2918770 - RNA, 19 nt, Mycobacterium avium subsp. paratuberculosis
agcgcccgauucgcggcca

SEQ ID NO: 2918771 - RNA, 15 nt, Mycobacterium avium subsp. paratuberculosis
agcgcccgcccggcc

SEQ ID NO: 2918772 - RNA, 19 nt, Mycobacterium avium subsp. paratuberculosis
agcgcccgcccggcccggc

SEQ ID NO: 2918773 - RNA, 20 nt, Mycobacterium avium subsp. paratuberculosis
agcgcccgcccggcccggcg

SEQ ID NO: 2918774 - RNA, 11 nt, Mycobacterium avium subsp. paratuberculosis
agcgcccgcgc

SEQ ID NO: 2918775 - RNA, 14 nt, Mycobacterium avium subsp. paratuberculosis
agcgcccgcgcgcu

SEQ ID NO: 2918776 - RNA, 14 nt, Mycobacterium avium subsp. paratuberculosis
agcgcccgcgcggg

SEQ ID NO: 2918777 - RNA, 21 nt, Mycobacterium avium subsp. paratuberculosis
agcgcccgcgggugcagccgg

SEQ ID NO: 2918778 - RNA, 23 nt, Mycobacterium avium subsp. paratuberculosis
agcgcccgcuugauggcggcgcg

SEQ ID NO: 2918779 - RNA, 13 nt, Mycobacterium avium subsp. paratuberculosis
agcgcccggcagc

SEQ ID NO: 2918780 - RNA, 19 nt, Mycobacterium avium subsp. paratuberculosis
agcgcccggccagccggcc

SEQ ID NO: 2918781 - RNA, 21 nt, Mycobacterium avium subsp. paratuberculosis
agcgcccggccagccggccgc

SEQ ID NO: 2918782 - RNA, 14 nt, Mycobacterium avium subsp. paratuberculosis
agcgcccggcgauc

SEQ ID NO: 2918783 - RNA, 16 nt, Mycobacterium avium subsp. paratuberculosis
agcgcccgggccagga

SEQ ID NO: 2918784 - RNA, 22 nt, Mycobacterium avium subsp. paratuberculosis
agcgcccggucgaggucggcca

SEQ ID NO: 2918785 - RNA, 18 nt, Mycobacterium avium subsp. paratuberculosis
agcgccgagaucgcggug

SEQ ID NO: 2918786 - RNA, 19 nt, Mycobacterium avium subsp. paratuberculosis
agcgccgagcacggcucgu

SEQ ID NO: 2918787 - RNA, 18 nt, Mycobacterium avium subsp. paratuberculosis
agcgccgaggccagcacg

SEQ ID NO: 2918788 - RNA, 20 nt, Mycobacterium avium subsp. paratuberculosis
agcgccgaggccagcacgcc

SEQ ID NO: 2918789 - RNA, 21 nt, Mycobacterium avium subsp. paratuberculosis
agcgccgcaacggcucccagg

SEQ ID NO: 2918790 - RNA, 18 nt, Mycobacterium avium subsp. paratuberculosis
agcgccgccaaccagguc

SEQ ID NO: 2918791 - RNA, 20 nt, Mycobacterium avium subsp. paratuberculosis
agcgccgccaaccaggucgc

SEQ ID NO: 2918792 - RNA, 13 nt, Mycobacterium avium subsp. paratuberculosis
agcgccgccaccg

SEQ ID NO: 2918793 - RNA, 15 nt, Mycobacterium avium subsp. paratuberculosis
agcgccgccaccggc

SEQ ID NO: 2918794 - RNA, 21 nt, Mycobacterium avium subsp. paratuberculosis
agcgcgacaucgccggcgacc

SEQ ID NO: 2918795 - RNA, 14 nt, Mycobacterium avium subsp. paratuberculosis
agcgcgaccagccc

SEQ ID NO: 2918796 - RNA, 17 nt, Mycobacterium avium subsp. paratuberculosis
agcgcgaccagcccggc

SEQ ID NO: 2918797 - RNA, 18 nt, Mycobacterium avium subsp. paratuberculosis
agcgcgaccagcccggcc

SEQ ID NO: 2918798 - RNA, 19 nt, Mycobacterium avium subsp. paratuberculosis
agcgcgaccagcccggccg

SEQ ID NO: 2918799 - RNA, 16 nt, Mycobacterium avium subsp. paratuberculosis
agcgcgaccccuacgg

SEQ ID NO: 2918800 - RNA, 22 nt, Mycobacterium avium subsp. paratuberculosis
agcgcgaccucgguggugcuga

SEQ ID NO: 2918801 - RNA, 20 nt, Mycobacterium avium subsp. paratuberculosis
agcgcgacgaacagcaccgc

SEQ ID NO: 2918802 - RNA, 21 nt, Mycobacterium avium subsp. paratuberculosis
agcgcgacgaacagcaccgcc

SEQ ID NO: 2918803 - RNA, 16 nt, Mycobacterium avium subsp. paratuberculosis
agcgcgacgccgacgc

SEQ ID NO: 2918804 - RNA, 20 nt, Mycobacterium avium subsp. paratuberculosis
agcgcgacgccgacgcccag

SEQ ID NO: 2918805 - RNA, 21 nt, Mycobacterium avium subsp. paratuberculosis
agcgcgacgccgacgcccagc

SEQ ID NO: 2918806 - RNA, 16 nt, Mycobacterium avium subsp. paratuberculosis
agcgcgacgcgcaugc

SEQ ID NO: 2918807 - RNA, 17 nt, Mycobacterium avium subsp. paratuberculosis
agcgcgacgcgcaugcc

SEQ ID NO: 2918808 - RNA, 21 nt, Mycobacterium avium subsp. paratuberculosis
agcgcgacgcgcaugcccugg

SEQ ID NO: 2918809 - RNA, 13 nt, Mycobacterium avium subsp. paratuberculosis
agcgcgacggccu

SEQ ID NO: 2918810 - RNA, 16 nt, Mycobacterium avium subsp. paratuberculosis
agcgcgacgggcaccc

SEQ ID NO: 2918811 - RNA, 18 nt, Mycobacterium avium subsp. paratuberculosis
agcgcgacgggcacccgc

SEQ ID NO: 2918812 - RNA, 14 nt, Mycobacterium avium subsp. paratuberculosis
agcgcgacgucgac

SEQ ID NO: 2918813 - RNA, 16 nt, Mycobacterium avium subsp. paratuberculosis
agcgcgacgugccggc

SEQ ID NO: 2918814 - RNA, 20 nt, Mycobacterium avium subsp. paratuberculosis
agcgcgacgugccggcgaug

SEQ ID NO: 2918815 - RNA, 21 nt, Mycobacterium avium subsp. paratuberculosis
agcgcgaggcgcaguagccga

SEQ ID NO: 2918816 - RNA, 22 nt, Mycobacterium avium subsp. paratuberculosis
agcgcgaggcgcaguagccgac

SEQ ID NO: 2918817 - RNA, 18 nt, Mycobacterium avium subsp. paratuberculosis
agcgcgagguccuugcgg

SEQ ID NO: 2918818 - RNA, 14 nt, Mycobacterium avium subsp. paratuberculosis
agcgcgaucaacgg

SEQ ID NO: 2918819 - RNA, 23 nt, Mycobacterium avium subsp. paratuberculosis
agcgcgaucaacgggucgagcac

SEQ ID NO: 2918820 - RNA, 19 nt, Mycobacterium avium subsp. paratuberculosis
agcgcgauccggggggcgg

SEQ ID NO: 2918821 - RNA, 14 nt, Mycobacterium avium subsp. paratuberculosis
agcgcgaugccggc

SEQ ID NO: 2918822 - RNA, 15 nt, Mycobacterium avium subsp. paratuberculosis
agcgcgaugccggcc

SEQ ID NO: 2918823 - RNA, 17 nt, Mycobacterium avium subsp. paratuberculosis
agcgcgaugccggccag

SEQ ID NO: 2918824 - RNA, 19 nt, Mycobacterium avium subsp. paratuberculosis
agcgcgaugccggccaggc

SEQ ID NO: 2918825 - RNA, 21 nt, Mycobacterium avium subsp. paratuberculosis
agcgcgauguccgacagcccg

SEQ ID NO: 2918826 - RNA, 15 nt, Mycobacterium avium subsp. paratuberculosis
agcgcgcacagcgcc

SEQ ID NO: 2918827 - RNA, 16 nt, Mycobacterium avium subsp. paratuberculosis
agcgcgcacgcggaca

SEQ ID NO: 2918828 - RNA, 20 nt, Mycobacterium avium subsp. paratuberculosis
agcgcgcagaacaccaccgc

SEQ ID NO: 2918829 - RNA, 12 nt, Mycobacterium avium subsp. paratuberculosis
agcgcgcaucgc

SEQ ID NO: 2918830 - RNA, 22 nt, Mycobacterium avium subsp. paratuberculosis
agcgcgcaucgcgggccaccgg

SEQ ID NO: 2918831 - RNA, 23 nt, Mycobacterium avium subsp. paratuberculosis
agcgcgcaucgcgggccaccggc

SEQ ID NO: 2918832 - RNA, 12 nt, Mycobacterium avium subsp. paratuberculosis
agcgcgcccagg

SEQ ID NO: 2918833 - RNA, 17 nt, Mycobacterium avium subsp. paratuberculosis
agcgcgcccaggcccga

SEQ ID NO: 2918834 - RNA, 20 nt, Mycobacterium avium subsp. paratuberculosis
agcgcgccccagugcaggca

SEQ ID NO: 2918835 - RNA, 13 nt, Mycobacterium avium subsp. paratuberculosis
agcgcgcccgacg

SEQ ID NO: 2918836 - RNA, 15 nt, Mycobacterium avium subsp. paratuberculosis
agcgcgcccugaggc

SEQ ID NO: 2918837 - RNA, 13 nt, Mycobacterium avium subsp. paratuberculosis
agcgcgccgaaca

SEQ ID NO: 2918838 - RNA, 15 nt, Mycobacterium avium subsp. paratuberculosis
agcgcgccgaccacg

SEQ ID NO: 2918839 - RNA, 16 nt, Mycobacterium avium subsp. paratuberculosis
agcgcgccgaccacgg

SEQ ID NO: 2918840 - RNA, 11 nt, Mycobacterium avium subsp. paratuberculosis
agcgcgccgag

SEQ ID NO: 2918841 - RNA, 17 nt, Mycobacterium avium subsp. paratuberculosis
agcgcgccgagcagcug

SEQ ID NO: 2918842 - RNA, 13 nt, Mycobacterium avium subsp. paratuberculosis
agcgcgccgaucg

SEQ ID NO: 2918843 - RNA, 17 nt, Mycobacterium avium subsp. paratuberculosis
agcgcgccgaucgccca

SEQ ID NO: 2918844 - RNA, 21 nt, Mycobacterium avium subsp. paratuberculosis
agcgcgccgcacagccggcgg

SEQ ID NO: 2918845 - RNA, 17 nt, Mycobacterium avium subsp. paratuberculosis
agcgcgccgcccagcgg

SEQ ID NO: 2918846 - RNA, 14 nt, Mycobacterium avium subsp. paratuberculosis
agcgcgccgccgau

SEQ ID NO: 2918847 - RNA, 16 nt, Mycobacterium avium subsp. paratuberculosis
agcgcgccgccgaugu

SEQ ID NO: 2918848 - RNA, 16 nt, Mycobacterium avium subsp. paratuberculosis
agcgcgccgccgccgc

SEQ ID NO: 2918849 - RNA, 16 nt, Mycobacterium avium subsp. paratuberculosis
agcgcgccgcgcuggc

SEQ ID NO: 2918850 - RNA, 12 nt, Mycobacterium avium subsp. paratuberculosis
agcgcgccggcc

SEQ ID NO: 2918851 - RNA, 14 nt, Mycobacterium avium subsp. paratuberculosis
agcgcgccggccag

SEQ ID NO: 2918852 - RNA, 19 nt, Mycobacterium avium subsp. paratuberculosis
agcgcgccggccagcagca

SEQ ID NO: 2918853 - RNA, 14 nt, Mycobacterium avium subsp. paratuberculosis
agcgcgccggcccg

SEQ ID NO: 2918854 - RNA, 13 nt, Mycobacterium avium subsp. paratuberculosis
agcgcgccggccg

SEQ ID NO: 2918855 - RNA, 15 nt, Mycobacterium avium subsp. paratuberculosis
agcgcgccggccggc

SEQ ID NO: 2918856 - RNA, 16 nt, Mycobacterium avium subsp. paratuberculosis
agcgcgccggccggca

SEQ ID NO: 2918857 - RNA, 15 nt, Mycobacterium avium subsp. paratuberculosis
agcgcgcgaccgcga

SEQ ID NO: 2918858 - RNA, 21 nt, Mycobacterium avium subsp. paratuberculosis
agcgcgcgaccgcgaugcgac

SEQ ID NO: 2918859 - RNA, 20 nt, Mycobacterium avium subsp. paratuberculosis
agcgcgcgaucagcgccguc

SEQ ID NO: 2918860 - RNA, 14 nt, Mycobacterium avium subsp. paratuberculosis
agcgcgcgaucgcc

SEQ ID NO: 2918861 - RNA, 17 nt, Mycobacterium avium subsp. paratuberculosis
agcgcgcgaucgccggu

SEQ ID NO: 2918862 - RNA, 18 nt, Mycobacterium avium subsp. paratuberculosis
agcgcgcgaucgccggug

SEQ ID NO: 2918863 - RNA, 12 nt, Mycobacterium avium subsp. paratuberculosis
agcgcgcgcagc

SEQ ID NO: 2918864 - RNA, 15 nt, Mycobacterium avium subsp. paratuberculosis
agcgcgcgcagcgcu

SEQ ID NO: 2918865 - RNA, 18 nt, Mycobacterium avium subsp. paratuberculosis
agcgcgcgcucggucagc

SEQ ID NO: 2918866 - RNA, 13 nt, Mycobacterium avium subsp. paratuberculosis
agcgcgcggccca

SEQ ID NO: 2918867 - RNA, 21 nt, Mycobacterium avium subsp. paratuberculosis
agcgcgcggcccagcgucaac

SEQ ID NO: 2918868 - RNA, 23 nt, Mycobacterium avium subsp. paratuberculosis
agcgcgcggcgcagaugaccggc

SEQ ID NO: 2918869 - RNA, 18 nt, Mycobacterium avium subsp. paratuberculosis
agcgcgcgggagcgcugg

SEQ ID NO: 2918870 - RNA, 18 nt, Mycobacterium avium subsp. paratuberculosis
agcgcgcgggcgcgcgcc

SEQ ID NO: 2918871 - RNA, 15 nt, Mycobacterium avium subsp. paratuberculosis
agcgcgcgggcgucc

SEQ ID NO: 2918872 - RNA, 16 nt, Mycobacterium avium subsp. paratuberculosis
agcgcgcgggcguccu

SEQ ID NO: 2918873 - RNA, 20 nt, Mycobacterium avium subsp. paratuberculosis
agcgcgcgggcguccucguc

SEQ ID NO: 2918874 - RNA, 13 nt, Mycobacterium avium subsp. paratuberculosis
agcgcgcggguga

SEQ ID NO: 2918875 - RNA, 20 nt, Mycobacterium avium subsp. paratuberculosis
agcgcgcggugcgccagcgc

SEQ ID NO: 2918876 - RNA, 15 nt, Mycobacterium avium subsp. paratuberculosis
agcgcgcucaaccgc

SEQ ID NO: 2918877 - RNA, 19 nt, Mycobacterium avium subsp. paratuberculosis
agcgcgcucaaccgcccag

SEQ ID NO: 2918878 - RNA, 20 nt, Mycobacterium avium subsp. paratuberculosis
agcgcgcucaaccgcccagc

SEQ ID NO: 2918879 - RNA, 15 nt, Mycobacterium avium subsp. paratuberculosis
agcggcaccgucacc

SEQ ID NO: 2918880 - RNA, 22 nt, Mycobacterium avium subsp. paratuberculosis
agcggcaccuuggugagcaccg

SEQ ID NO: 2918881 - RNA, 23 nt, Mycobacterium avium subsp. paratuberculosis
agcggcaccuuggugagcaccgc

SEQ ID NO: 2918882 - RNA, 18 nt, Mycobacterium avium subsp. paratuberculosis
agcggcacgaucggcagc

SEQ ID NO: 2918883 - RNA, 21 nt, Mycobacterium avium subsp. paratuberculosis
agcggcacgaucggcagcgcc

SEQ ID NO: 2918884 - RNA, 22 nt, Mycobacterium avium subsp. paratuberculosis
agcggcacgaucggcagcgcca

SEQ ID NO: 2918885 - RNA, 15 nt, Mycobacterium avium subsp. paratuberculosis
agcggcacgggcacc

SEQ ID NO: 2918886 - RNA, 17 nt, Mycobacterium avium subsp. paratuberculosis
agcggcagaccguccgg

SEQ ID NO: 2918887 - RNA, 12 nt, Mycobacterium avium subsp. paratuberculosis
agcggcagcagc

SEQ ID NO: 2918888 - RNA, 18 nt, Mycobacterium avium subsp. paratuberculosis
agcggcagcagcaccagc

SEQ ID NO: 2918889 - RNA, 15 nt, Mycobacterium avium subsp. paratuberculosis
agcggcagccacggc

SEQ ID NO: 2918890 - RNA, 16 nt, Mycobacterium avium subsp. paratuberculosis
agcggcagccacggca

SEQ ID NO: 2918891 - RNA, 16 nt, Mycobacterium avium subsp. paratuberculosis
agcggcagcgacagcg

SEQ ID NO: 2918892 - RNA, 19 nt, Mycobacterium avium subsp. paratuberculosis
agcggcagcgacagcgcgu

SEQ ID NO: 2918893 - RNA, 15 nt, Mycobacterium avium subsp. paratuberculosis
agcggcagcggcguc

SEQ ID NO: 2918894 - RNA, 14 nt, Mycobacterium avium subsp. paratuberculosis
agcggcagcgucgc

SEQ ID NO: 2918895 - RNA, 15 nt, Mycobacterium avium subsp. paratuberculosis
agcggcagcgucgcc

SEQ ID NO: 2918896 - RNA, 18 nt, Mycobacterium avium subsp. paratuberculosis
agcggcagcgucgccagc

SEQ ID NO: 2918897 - RNA, 20 nt, Mycobacterium avium subsp. paratuberculosis
agcggcagcgucgccagccg

SEQ ID NO: 2918898 - RNA, 21 nt, Mycobacterium avium subsp. paratuberculosis
agcggcagcgucgccagccgc

SEQ ID NO: 2918899 - RNA, 17 nt, Mycobacterium avium subsp. paratuberculosis
agcggcagcgucgggcu

SEQ ID NO: 2918900 - RNA, 13 nt, Mycobacterium avium subsp. paratuberculosis
agcggcagguccc

SEQ ID NO: 2918901 - RNA, 22 nt, Mycobacterium avium subsp. paratuberculosis
agcggcaggucccaggccagga

SEQ ID NO: 2918902 - RNA, 22 nt, Mycobacterium avium subsp. paratuberculosis
agcggcaucgaggaccggcgcc

SEQ ID NO: 2918903 - RNA, 18 nt, Mycobacterium avium subsp. paratuberculosis
agcggcaucgccgccaag

SEQ ID NO: 2918904 - RNA, 18 nt, Mycobacterium avium subsp. paratuberculosis
agcggcaugcccccgaug

SEQ ID NO: 2918905 - RNA, 17 nt, Mycobacterium avium subsp. paratuberculosis
agcggcauggcgaugac

SEQ ID NO: 2918906 - RNA, 13 nt, Mycobacterium avium subsp. paratuberculosis
agcggccacaccg

SEQ ID NO: 2918907 - RNA, 15 nt, Mycobacterium avium subsp. paratuberculosis
agcggccacaccggg

SEQ ID NO: 2918908 - RNA, 22 nt, Mycobacterium avium subsp. paratuberculosis
agcggccacaccggggccaggu

SEQ ID NO: 2918909 - RNA, 13 nt, Mycobacterium avium subsp. paratuberculosis
agcggccagcccg

SEQ ID NO: 2918910 - RNA, 21 nt, Mycobacterium avium subsp. paratuberculosis
agcggccagcccgcggcagcc

SEQ ID NO: 2918911 - RNA, 22 nt, Mycobacterium avium subsp. paratuberculosis
agcggccagcccgcggcagcca

SEQ ID NO: 2918912 - RNA, 13 nt, Mycobacterium avium subsp. paratuberculosis
agcggccaucgcc

SEQ ID NO: 2918913 - RNA, 19 nt, Mycobacterium avium subsp. paratuberculosis
agcggccaucgccgccauc

SEQ ID NO: 2918914 - RNA, 13 nt, Mycobacterium avium subsp. paratuberculosis
agcggcccaccgc

SEQ ID NO: 2918915 - RNA, 12 nt, Mycobacterium avium subsp. paratuberculosis
agcggcccagcu

SEQ ID NO: 2918916 - RNA, 19 nt, Mycobacterium avium subsp. paratuberculosis
agcggcccagcucggugau

SEQ ID NO: 2918917 - RNA, 12 nt, Mycobacterium avium subsp. paratuberculosis
agcggcccaggu

SEQ ID NO: 2918918 - RNA, 22 nt, Mycobacterium avium subsp. paratuberculosis
agcggcccagguucuccggccc

SEQ ID NO: 2918919 - RNA, 13 nt, Mycobacterium avium subsp. paratuberculosis
agcggccccacgu

SEQ ID NO: 2918920 - RNA, 15 nt, Mycobacterium avium subsp. paratuberculosis
agcggccccccgcac

SEQ ID NO: 2918921 - RNA, 20 nt, Mycobacterium avium subsp. paratuberculosis
agcggccccccgcacaccgg

SEQ ID NO: 2918922 - RNA, 21 nt, Mycobacterium avium subsp. paratuberculosis
agcggccccccgcacaccggc

SEQ ID NO: 2918923 - RNA, 23 nt, Mycobacterium avium subsp. paratuberculosis
agcggccccccgcacaccggcca

SEQ ID NO: 2918924 - RNA, 12 nt, Mycobacterium avium subsp. paratuberculosis
agcggccccggc

SEQ ID NO: 2918925 - RNA, 20 nt, Mycobacterium avium subsp. paratuberculosis
agcggcccgaaaacgcccgg

SEQ ID NO: 2918926 - RNA, 17 nt, Mycobacterium avium subsp. paratuberculosis
agcggcccgaucaccag

SEQ ID NO: 2918927 - RNA, 16 nt, Mycobacterium avium subsp. paratuberculosis
agcggcccgaucaccg

SEQ ID NO: 2918928 - RNA, 16 nt, Mycobacterium avium subsp. paratuberculosis
agcggcccgcaccgau

SEQ ID NO: 2918929 - RNA, 14 nt, Mycobacterium avium subsp. paratuberculosis
agcggcccgucgcc

SEQ ID NO: 2918930 - RNA, 21 nt, Mycobacterium avium subsp. paratuberculosis
agcggcccgucgccgaucagc

SEQ ID NO: 2918931 - RNA, 17 nt, Mycobacterium avium subsp. paratuberculosis
agcggcccucccccgag

SEQ ID NO: 2918932 - RNA, 21 nt, Mycobacterium avium subsp. paratuberculosis
agcggcccuguucgccgucgc

SEQ ID NO: 2918933 - RNA, 22 nt, Mycobacterium avium subsp. paratuberculosis
agcggccgaucauggucggcga

SEQ ID NO: 2918934 - RNA, 19 nt, Mycobacterium avium subsp. paratuberculosis
agcggccgcaaucggcgcc

SEQ ID NO: 2918935 - RNA, 20 nt, Mycobacterium avium subsp. paratuberculosis
agcggccgcaaucggcgccg

SEQ ID NO: 2918936 - RNA, 23 nt, Mycobacterium avium subsp. paratuberculosis
agcggccgcaaucggcgccggcu

SEQ ID NO: 2918937 - RNA, 15 nt, Mycobacterium avium subsp. paratuberculosis
agcggccgcacgcga

SEQ ID NO: 2918938 - RNA, 20 nt, Mycobacterium avium subsp. paratuberculosis
agcggccgcagcgcaucgcc

SEQ ID NO: 2918939 - RNA, 23 nt, Mycobacterium avium subsp. paratuberculosis
agcggccgcagcgcaucgccggc

SEQ ID NO: 2918940 - RNA, 15 nt, Mycobacterium avium subsp. paratuberculosis
agcggccgcagcgcg

SEQ ID NO: 2918941 - RNA, 12 nt, Mycobacterium avium subsp. paratuberculosis
agcggccgcgga

SEQ ID NO: 2918942 - RNA, 15 nt, Mycobacterium avium subsp. paratuberculosis
agcggccggcgcagc

SEQ ID NO: 2918943 - RNA, 17 nt, Mycobacterium avium subsp. paratuberculosis
agcggccggcgcagccg

SEQ ID NO: 2918944 - RNA, 14 nt, Mycobacterium avium subsp. paratuberculosis
agcggccguccacc

SEQ ID NO: 2918945 - RNA, 15 nt, Mycobacterium avium subsp. paratuberculosis
agcggccgucgccgg

SEQ ID NO: 2918946 - RNA, 19 nt, Mycobacterium avium subsp. paratuberculosis
agcggccuaggacgccgcc

SEQ ID NO: 2918947 - RNA, 18 nt, Mycobacterium avium subsp. paratuberculosis
agcggccuaugcgcccgg

SEQ ID NO: 2918948 - RNA, 20 nt, Mycobacterium avium subsp. paratuberculosis
agcggccuaugcgcccggga

SEQ ID NO: 2918949 - RNA, 17 nt, Mycobacterium avium subsp. paratuberculosis
agcggcgacagcggccu

SEQ ID NO: 2918950 - RNA, 23 nt, Mycobacterium avium subsp. paratuberculosis
agcggcgaccuugcggcgcgaug

SEQ ID NO: 2918951 - RNA, 19 nt, Mycobacterium avium subsp. paratuberculosis
agcggcgacuccagcagcg

SEQ ID NO: 2918952 - RNA, 21 nt, Mycobacterium avium subsp. paratuberculosis
agcggcgacuccagcagcgcc

SEQ ID NO: 2918953 - RNA, 21 nt, Mycobacterium avium subsp. paratuberculosis
agcggcgcaccgugucgucgc

SEQ ID NO: 2918954 - RNA, 20 nt, Mycobacterium avium subsp. paratuberculosis
agcggcgcacgcagugccgc

SEQ ID NO: 2918955 - RNA, 21 nt, Mycobacterium avium subsp. paratuberculosis
agcggcgcacgcagugccgca

SEQ ID NO: 2918956 - RNA, 16 nt, Mycobacterium avium subsp. paratuberculosis
agcggcgccaccggga

SEQ ID NO: 2918957 - RNA, 14 nt, Mycobacterium avium subsp. paratuberculosis
agcggcgccacgug

SEQ ID NO: 2918958 - RNA, 13 nt, Mycobacterium avium subsp. paratuberculosis
agcggcgccaggu

SEQ ID NO: 2918959 - RNA, 20 nt, Mycobacterium avium subsp. paratuberculosis
agcggcgcccacggccacca

SEQ ID NO: 2918960 - RNA, 21 nt, Mycobacterium avium subsp. paratuberculosis
agcggcgccgcagcucguugu

SEQ ID NO: 2918961 - RNA, 13 nt, Mycobacterium avium subsp. paratuberculosis
agcggcgccggga

SEQ ID NO: 2918962 - RNA, 21 nt, Mycobacterium avium subsp. paratuberculosis
agcggcgccgggaucggcagc

SEQ ID NO: 2918963 - RNA, 19 nt, Mycobacterium avium subsp. paratuberculosis
agcgggccgugccgccaua

SEQ ID NO: 2918964 - RNA, 18 nt, Mycobacterium avium subsp. paratuberculosis
agcgggccguugccgguc

SEQ ID NO: 2918965 - RNA, 17 nt, Mycobacterium avium subsp. paratuberculosis
agcgggcgaacgaccgg

SEQ ID NO: 2918966 - RNA, 11 nt, Mycobacterium avium subsp. paratuberculosis
agcgggcgacg

SEQ ID NO: 2918967 - RNA, 12 nt, Mycobacterium avium subsp. paratuberculosis
agcgggcgacgu

SEQ ID NO: 2918968 - RNA, 12 nt, Mycobacterium avium subsp. paratuberculosis
agcgggcgcgca

SEQ ID NO: 2918969 - RNA, 14 nt, Mycobacterium avium subsp. paratuberculosis
agcgggcgcgcagc

SEQ ID NO: 2918970 - RNA, 17 nt, Mycobacterium avium subsp. paratuberculosis
agcgggcggccagccgc

SEQ ID NO: 2918971 - RNA, 21 nt, Mycobacterium avium subsp. paratuberculosis
agcgggcggccccgggcgcug

SEQ ID NO: 2918972 - RNA, 20 nt, Mycobacterium avium subsp. paratuberculosis
agcgggcggcgaacaccagc

SEQ ID NO: 2918973 - RNA, 22 nt, Mycobacterium avium subsp. paratuberculosis
agcgggcggcgaacaccagcac

SEQ ID NO: 2918974 - RNA, 12 nt, Mycobacterium avium subsp. paratuberculosis
agcgggcggcgg

SEQ ID NO: 2918975 - RNA, 17 nt, Mycobacterium avium subsp. paratuberculosis
agcgggcuaggcucggc

SEQ ID NO: 2918976 - RNA, 24 nt, Mycobacterium avium subsp. paratuberculosis
agcgggcuaggcucggcagccggc

SEQ ID NO: 2918977 - RNA, 14 nt, Mycobacterium avium subsp. paratuberculosis
agcgggcuggcgua

SEQ ID NO: 2918978 - RNA, 16 nt, Mycobacterium avium subsp. paratuberculosis
agcgggcugucggcgc

SEQ ID NO: 2918979 - RNA, 20 nt, Mycobacterium avium subsp. paratuberculosis
agcgggcugugccggcgggu

SEQ ID NO: 2918980 - RNA, 23 nt, Mycobacterium avium subsp. paratuberculosis
agcgggcugugccggcgggucag

SEQ ID NO: 2918981 - RNA, 17 nt, Mycobacterium avium subsp. paratuberculosis
agcggggaggcccagcc

SEQ ID NO: 2918982 - RNA, 23 nt, Mycobacterium avium subsp. paratuberculosis
agcggggaggcccagcccgccgc

SEQ ID NO: 2918983 - RNA, 17 nt, Mycobacterium avium subsp. paratuberculosis
agcggggcaagcagcgg

SEQ ID NO: 2918984 - RNA, 23 nt, Mycobacterium avium subsp. paratuberculosis
agcggggcaagcagcggcagcca

SEQ ID NO: 2918985 - RNA, 21 nt, Mycobacterium avium subsp. paratuberculosis
agcggggcgcuguccuggucg

SEQ ID NO: 2918986 - RNA, 18 nt, Mycobacterium avium subsp. paratuberculosis
agcggggcguccagcgag

SEQ ID NO: 2918987 - RNA, 18 nt, Mycobacterium avium subsp. paratuberculosis
agcggggugagcaccgcg

SEQ ID NO: 2918988 - RNA, 13 nt, Mycobacterium avium subsp. paratuberculosis
agcggggugagcu

SEQ ID NO: 2918989 - RNA, 21 nt, Mycobacterium avium subsp. paratuberculosis
agcggguaaccgcagccgggu

SEQ ID NO: 2918990 - RNA, 23 nt, Mycobacterium avium subsp. paratuberculosis
agcggguaaccgcagccgggugc

SEQ ID NO: 2918991 - RNA, 17 nt, Mycobacterium avium subsp. paratuberculosis
agcggguccagccgccg

SEQ ID NO: 2918992 - RNA, 18 nt, Mycobacterium avium subsp. paratuberculosis
agcggguccagccgccgg

SEQ ID NO: 2918993 - RNA, 19 nt, Mycobacterium avium subsp. paratuberculosis
agcggguccagccgccggc

SEQ ID NO: 2918994 - RNA, 20 nt, Mycobacterium avium subsp. paratuberculosis
agcggguccagccgccggcg

SEQ ID NO: 2918995 - RNA, 16 nt, Mycobacterium avium subsp. paratuberculosis
agcggguccgccccga

SEQ ID NO: 2918996 - RNA, 18 nt, Mycobacterium avium subsp. paratuberculosis
agcggguccgccccgaga

SEQ ID NO: 2918997 - RNA, 23 nt, Mycobacterium avium subsp. paratuberculosis
agcgggucgauggcgacggggug

SEQ ID NO: 2918998 - RNA, 16 nt, Mycobacterium avium subsp. paratuberculosis
agcgggucggccggcg

SEQ ID NO: 2918999 - RNA, 18 nt, Mycobacterium avium subsp. paratuberculosis
agcgggucggccggcggg

SEQ ID NO: 2919000 - RNA, 20 nt, Mycobacterium avium subsp. paratuberculosis
agcgggucgucgggccgggg

SEQ ID NO: 2919001 - RNA, 22 nt, Mycobacterium avium subsp. paratuberculosis
agcgggucgucgggccggggaa

SEQ ID NO: 2919002 - RNA, 20 nt, Mycobacterium avium subsp. paratuberculosis
agcgggucgugcaucggcgc

SEQ ID NO: 2919003 - RNA, 16 nt, Mycobacterium avium subsp. paratuberculosis
agcgggugaaucgaca

SEQ ID NO: 2919004 - RNA, 20 nt, Mycobacterium avium subsp. paratuberculosis
agcgggugaaucgacaccgc

SEQ ID NO: 2919005 - RNA, 22 nt, Mycobacterium avium subsp. paratuberculosis
agcgggugaaucgacaccgcac

SEQ ID NO: 2919006 - RNA, 17 nt, Mycobacterium avium subsp. paratuberculosis
agcggguugccgcuggc

SEQ ID NO: 2919007 - RNA, 22 nt, Mycobacterium avium subsp. paratuberculosis
agcggguugucgucgucggcga

SEQ ID NO: 2919008 - RNA, 17 nt, Mycobacterium avium subsp. paratuberculosis
agcggguuuggccgcgg

SEQ ID NO: 2919009 - RNA, 22 nt, Mycobacterium avium subsp. paratuberculosis
agcgguauccgaucaucagggc

SEQ ID NO: 2919010 - RNA, 20 nt, Mycobacterium avium subsp. paratuberculosis
agcggucauugaugccccgg

SEQ ID NO: 2919011 - RNA, 14 nt, Mycobacterium avium subsp. paratuberculosis
agcgguccaacggg

SEQ ID NO: 2919012 - RNA, 13 nt, Mycobacterium avium subsp. paratuberculosis
agcgguccagcgu

SEQ ID NO: 2919013 - RNA, 22 nt, Mycobacterium avium subsp. paratuberculosis
agcgguccagcgugaacgugug

SEQ ID NO: 2919014 - RNA, 18 nt, Mycobacterium avium subsp. paratuberculosis
agcgguccauccagcgcc

SEQ ID NO: 2919015 - RNA, 23 nt, Mycobacterium avium subsp. paratuberculosis
agcgguccauccagcgccgcagc

SEQ ID NO: 2919016 - RNA, 16 nt, Mycobacterium avium subsp. paratuberculosis
agcggucgccccagaa

SEQ ID NO: 2919017 - RNA, 21 nt, Mycobacterium avium subsp. paratuberculosis
agcggucgcggaaccggccgg

SEQ ID NO: 2919018 - RNA, 14 nt, Mycobacterium avium subsp. paratuberculosis
agcggucgggugcg

SEQ ID NO: 2919019 - RNA, 18 nt, Mycobacterium avium subsp. paratuberculosis
agcggugacaucgccacc

SEQ ID NO: 2919020 - RNA, 22 nt, Mycobacterium avium subsp. paratuberculosis
agcggugacaucgccaccugga

SEQ ID NO: 2919021 - RNA, 20 nt, Mycobacterium avium subsp. paratuberculosis
agcggugaccucgagcaccg

SEQ ID NO: 2919022 - RNA, 19 nt, Mycobacterium avium subsp. paratuberculosis
agcggugaucgcgucaacc

SEQ ID NO: 2919023 - RNA, 17 nt, Mycobacterium avium subsp. paratuberculosis
agcggugcaccaccgug

SEQ ID NO: 2919024 - RNA, 13 nt, Mycobacterium avium subsp. paratuberculosis
agcggugcagccc

SEQ ID NO: 2919025 - RNA, 22 nt, Mycobacterium avium subsp. paratuberculosis
agcggugcagccccgcacugaa

SEQ ID NO: 2919026 - RNA, 12 nt, Mycobacterium avium subsp. paratuberculosis
agcgguggccac

SEQ ID NO: 2919027 - RNA, 23 nt, Mycobacterium avium subsp. paratuberculosis
agcgguggcguucacaguaggcg

SEQ ID NO: 2919028 - RNA, 20 nt, Mycobacterium avium subsp. paratuberculosis
agcgguuccagaccggcggc

SEQ ID NO: 2919029 - RNA, 17 nt, Mycobacterium avium subsp. paratuberculosis
agcgguucgaucucguc

SEQ ID NO: 2919030 - RNA, 21 nt, Mycobacterium avium subsp. paratuberculosis
agcgguucggcgacgcuggug

SEQ ID NO: 2919031 - RNA, 23 nt, Mycobacterium avium subsp. paratuberculosis
agcgguucggcgacgcugguggc

SEQ ID NO: 2919032 - RNA, 18 nt, Mycobacterium avium subsp. paratuberculosis
agcgguuggcccuucgac

SEQ ID NO: 2919033 - RNA, 22 nt, Mycobacterium avium subsp. paratuberculosis
agcgguuuggauggcccgccag

SEQ ID NO: 2919034 - RNA, 23 nt, Mycobacterium avium subsp. paratuberculosis
agcgguuuggauggcccgccaga

SEQ ID NO: 2919035 - RNA, 19 nt, Mycobacterium avium subsp. paratuberculosis
agcguacccaggucggcgu

SEQ ID NO: 2919036 - RNA, 23 nt, Mycobacterium avium subsp. paratuberculosis
agcguagaacauccacggcaugg

SEQ ID NO: 2919037 - RNA, 15 nt, Mycobacterium avium subsp. paratuberculosis
agcguauccggccag

SEQ ID NO: 2919038 - RNA, 18 nt, Mycobacterium avium subsp. paratuberculosis
agcguauccggccagccg

SEQ ID NO: 2919039 - RNA, 14 nt, Mycobacterium avium subsp. paratuberculosis
agcgucaacucguc

SEQ ID NO: 2919040 - RNA, 23 nt, Mycobacterium avium subsp. paratuberculosis
agcgucaccaaugcgccggcggc

SEQ ID NO: 2919041 - RNA, 21 nt, Mycobacterium avium subsp. paratuberculosis
agcgucaccuucaccacggcc

SEQ ID NO: 2919042 - RNA, 16 nt, Mycobacterium avium subsp. paratuberculosis
agcgucacgccgcgcc

SEQ ID NO: 2919043 - RNA, 18 nt, Mycobacterium avium subsp. paratuberculosis
agcgucacgccgcgcccg

SEQ ID NO: 2919044 - RNA, 19 nt, Mycobacterium avium subsp. paratuberculosis
agcgucacgccgcgcccgu

SEQ ID NO: 2919045 - RNA, 20 nt, Mycobacterium avium subsp. paratuberculosis
agcgucacgccgcgcccguc

SEQ ID NO: 2919046 - RNA, 22 nt, Mycobacterium avium subsp. paratuberculosis
agcgucacgccgcgcccgucga

SEQ ID NO: 2919047 - RNA, 16 nt, Mycobacterium avium subsp. paratuberculosis
agcgugacagucgacc

SEQ ID NO: 2919048 - RNA, 17 nt, Mycobacterium avium subsp. paratuberculosis
agcgugacagucgaccu

SEQ ID NO: 2919049 - RNA, 15 nt, Mycobacterium avium subsp. paratuberculosis
agcgugacgcccggc

SEQ ID NO: 2919050 - RNA, 23 nt, Mycobacterium avium subsp. paratuberculosis
agcgugacgcccggcgccggcgg

SEQ ID NO: 2919051 - RNA, 16 nt, Mycobacterium avium subsp. paratuberculosis
agcgugacgccgggcc

SEQ ID NO: 2919052 - RNA, 21 nt, Mycobacterium avium subsp. paratuberculosis
agcgugacgccgggccgccgc

SEQ ID NO: 2919053 - RNA, 20 nt, Mycobacterium avium subsp. paratuberculosis
agcgugacgcucgcguggcc

SEQ ID NO: 2919054 - RNA, 20 nt, Mycobacterium avium subsp. paratuberculosis
agcgugcacacccgcagcga

SEQ ID NO: 2919055 - RNA, 14 nt, Mycobacterium avium subsp. paratuberculosis
agcgugcccgcgcc

SEQ ID NO: 2919056 - RNA, 17 nt, Mycobacterium avium subsp. paratuberculosis
agcgugcccgcgcccac

SEQ ID NO: 2919057 - RNA, 18 nt, Mycobacterium avium subsp. paratuberculosis
agcgugcccgcgcccacc

SEQ ID NO: 2919058 - RNA, 21 nt, Mycobacterium avium subsp. paratuberculosis
agcgugcccgcgcccaccugg

SEQ ID NO: 2919059 - RNA, 20 nt, Mycobacterium avium subsp. paratuberculosis
agcgugccgcgcaccaccuc

SEQ ID NO: 2919060 - RNA, 16 nt, Mycobacterium avium subsp. paratuberculosis
agcgugccguccagcu

SEQ ID NO: 2919061 - RNA, 23 nt, Mycobacterium avium subsp. paratuberculosis
agcgugccguccagcuccgccga

SEQ ID NO: 2919062 - RNA, 15 nt, Mycobacterium avium subsp. paratuberculosis
agcgugcgcggcugg

SEQ ID NO: 2919063 - RNA, 12 nt, Mycobacterium avium subsp. paratuberculosis
agcgugcugacg

SEQ ID NO: 2919064 - RNA, 18 nt, Mycobacterium avium subsp. paratuberculosis
agcgugcugccggacacc

SEQ ID NO: 2919065 - RNA, 14 nt, Mycobacterium avium subsp. paratuberculosis
agcguggacaccgc

SEQ ID NO: 2919066 - RNA, 17 nt, Mycobacterium avium subsp. paratuberculosis
agcguggacaccgcacc

SEQ ID NO: 2919067 - RNA, 19 nt, Mycobacterium avium subsp. paratuberculosis
agcguggacaccgcaccca

SEQ ID NO: 2919068 - RNA, 22 nt, Mycobacterium avium subsp. paratuberculosis
agcguggcagcggucggcggcu

SEQ ID NO: 2919069 - RNA, 13 nt, Mycobacterium avium subsp. paratuberculosis
agcguggccagca

SEQ ID NO: 2919070 - RNA, 18 nt, Mycobacterium avium subsp. paratuberculosis
agcguggcgaacgcgacc

SEQ ID NO: 2919071 - RNA, 16 nt, Mycobacterium avium subsp. paratuberculosis
agcguggcgcgccccg

SEQ ID NO: 2919072 - RNA, 17 nt, Mycobacterium avium subsp. paratuberculosis
agcguggcgcgccccgg

SEQ ID NO: 2919073 - RNA, 21 nt, Mycobacterium avium subsp. paratuberculosis
agcguggcgcgccccggcccg

SEQ ID NO: 2919074 - RNA, 22 nt, Mycobacterium avium subsp. paratuberculosis
agcgugggauccgaggguucgg

SEQ ID NO: 2919075 - RNA, 18 nt, Mycobacterium avium subsp. paratuberculosis
agcgugggcaccggcacc

SEQ ID NO: 2919076 - RNA, 14 nt, Mycobacterium avium subsp. paratuberculosis
agcgugggggccau

SEQ ID NO: 2919077 - RNA, 22 nt, Mycobacterium avium subsp. paratuberculosis
agcguggguucgaaucccaucg

SEQ ID NO: 2919078 - RNA, 23 nt, Mycobacterium avium subsp. paratuberculosis
agcgugguccagcacgugcccag

SEQ ID NO: 2919079 - RNA, 23 nt, Mycobacterium avium subsp. paratuberculosis
agcguggucuccuggccgccgug

SEQ ID NO: 2919080 - RNA, 16 nt, Mycobacterium avium subsp. paratuberculosis
agcguggugcgcccgu

SEQ ID NO: 2919081 - RNA, 23 nt, Mycobacterium avium subsp. paratuberculosis
agcguggugcgcccgucgguggg

SEQ ID NO: 2919082 - RNA, 19 nt, Mycobacterium avium subsp. paratuberculosis
agcgugucggcgaucgcgc

SEQ ID NO: 2919083 - RNA, 22 nt, Mycobacterium avium subsp. paratuberculosis
agcguguugagcucgcggcgca

SEQ ID NO: 2919084 - RNA, 18 nt, Mycobacterium avium subsp. paratuberculosis
agcguucacgucgaucac

SEQ ID NO: 2919085 - RNA, 20 nt, Mycobacterium avium subsp. paratuberculosis
agcguuccagcacccggccc

SEQ ID NO: 2919086 - RNA, 21 nt, Mycobacterium avium subsp. paratuberculosis
agcguuccagguucagcccgg

SEQ ID NO: 2919087 - RNA, 14 nt, Mycobacterium avium subsp. paratuberculosis
agcguuccgccguc

SEQ ID NO: 2919088 - RNA, 14 nt, Mycobacterium avium subsp. paratuberculosis
agcguuccggcggc

SEQ ID NO: 2919089 - RNA, 15 nt, Mycobacterium avium subsp. paratuberculosis
agcguuccggcggcc

SEQ ID NO: 2919090 - RNA, 16 nt, Mycobacterium avium subsp. paratuberculosis
agcguuccggcggccg

SEQ ID NO: 2919091 - RNA, 18 nt, Mycobacterium avium subsp. paratuberculosis
agcguuccgucggcgagu

SEQ ID NO: 2919092 - RNA, 20 nt, Mycobacterium avium subsp. paratuberculosis
agcguucguagaaccggccc

SEQ ID NO: 2919093 - RNA, 16 nt, Mycobacterium avium subsp. paratuberculosis
agcguucgucgccggu

SEQ ID NO: 2919094 - RNA, 17 nt, Mycobacterium avium subsp. paratuberculosis
agcguucuccacccgcc

SEQ ID NO: 2919095 - RNA, 18 nt, Mycobacterium avium subsp. paratuberculosis
agcguucuccacccgccc

SEQ ID NO: 2919096 - RNA, 21 nt, Mycobacterium avium subsp. paratuberculosis
agcguugccgcgcgcccgcgg

SEQ ID NO: 2919097 - RNA, 22 nt, Mycobacterium avium subsp. paratuberculosis
agcguugccgcgcgcccgcggc

SEQ ID NO: 2919098 - RNA, 18 nt, Mycobacterium avium subsp. paratuberculosis
agcguugccggccgaagu

SEQ ID NO: 2919099 - RNA, 17 nt, Mycobacterium avium subsp. paratuberculosis
agcguugcgccagcagg

SEQ ID NO: 2919100 - RNA, 19 nt, Mycobacterium avium subsp. paratuberculosis
agcguuuccagcgccggca

SEQ ID NO: 2919101 - RNA, 20 nt, Mycobacterium avium subsp. paratuberculosis
agcguuuccuggugcaccag

SEQ ID NO: 2919102 - RNA, 22 nt, Mycobacterium avium subsp. paratuberculosis
agcguuuccuggugcaccaggu

SEQ ID NO: 2919103 - RNA, 16 nt, Mycobacterium avium subsp. paratuberculosis
agcuaaaccccacggc

SEQ ID NO: 2919104 - RNA, 13 nt, Mycobacterium avium subsp. paratuberculosis
agcuaacgccagc

SEQ ID NO: 2919105 - RNA, 12 nt, Mycobacterium avium subsp. paratuberculosis
agcuacggacgc

SEQ ID NO: 2919106 - RNA, 18 nt, Mycobacterium avium subsp. paratuberculosis
agcuagcccagaacugcu

SEQ ID NO: 2919107 - RNA, 18 nt, Mycobacterium avium subsp. paratuberculosis
agcuagcuucacgcucgg

SEQ ID NO: 2919108 - RNA, 16 nt, Mycobacterium avium subsp. paratuberculosis
agcuaggccagcagcg

SEQ ID NO: 2919109 - RNA, 15 nt, Mycobacterium avium subsp. paratuberculosis
agcuaggucguggcg

SEQ ID NO: 2919110 - RNA, 22 nt, Mycobacterium avium subsp. paratuberculosis
agcuaggucguggcgccgagga

SEQ ID NO: 2919111 - RNA, 16 nt, Mycobacterium avium subsp. paratuberculosis
agcuaguuucacgcuc

SEQ ID NO: 2919112 - RNA, 17 nt, Mycobacterium avium subsp. paratuberculosis
agcuaguuucacgcucg

SEQ ID NO: 2919113 - RNA, 12 nt, Mycobacterium avium subsp. paratuberculosis
agcuaucagcuc

SEQ ID NO: 2919114 - RNA, 13 nt, Mycobacterium avium subsp. paratuberculosis
agcuaucagcucg

SEQ ID NO: 2919115 - RNA, 15 nt, Mycobacterium avium subsp. paratuberculosis
agcuaucagcucgcg

SEQ ID NO: 2919116 - RNA, 16 nt, Mycobacterium avium subsp. paratuberculosis
agcucaccggccaggg

SEQ ID NO: 2919117 - RNA, 21 nt, Mycobacterium avium subsp. paratuberculosis
agcucaccggccagggccgcc

SEQ ID NO: 2919118 - RNA, 21 nt, Mycobacterium avium subsp. paratuberculosis
agcucaccgggcucggucacc

SEQ ID NO: 2919119 - RNA, 17 nt, Mycobacterium avium subsp. paratuberculosis
agcucacggugucggcg

SEQ ID NO: 2919120 - RNA, 18 nt, Mycobacterium avium subsp. paratuberculosis
agcucagacugccgagca

SEQ ID NO: 2919121 - RNA, 15 nt, Mycobacterium avium subsp. paratuberculosis
agcucagccacgccg

SEQ ID NO: 2919122 - RNA, 17 nt, Mycobacterium avium subsp. paratuberculosis
agcucagccgccuggcg

SEQ ID NO: 2919123 - RNA, 20 nt, Mycobacterium avium subsp. paratuberculosis
agcucagcugcugcgcggcg

SEQ ID NO: 2919124 - RNA, 22 nt, Mycobacterium avium subsp. paratuberculosis
agcucagcugcugcgcggcggc

SEQ ID NO: 2919125 - RNA, 17 nt, Mycobacterium avium subsp. paratuberculosis
agcucaggugcgacgcc

SEQ ID NO: 2919126 - RNA, 21 nt, Mycobacterium avium subsp. paratuberculosis
agcucaggugcgacgcccacu

SEQ ID NO: 2919127 - RNA, 16 nt, Mycobacterium avium subsp. paratuberculosis
agcucauacagcggcg

SEQ ID NO: 2919128 - RNA, 14 nt, Mycobacterium avium subsp. paratuberculosis
agcucaucaccggc

SEQ ID NO: 2919129 - RNA, 17 nt, Mycobacterium avium subsp. paratuberculosis
agcucaucaccggcgcg

SEQ ID NO: 2919130 - RNA, 16 nt, Mycobacterium avium subsp. paratuberculosis
agcucaucgaggucga

SEQ ID NO: 2919131 - RNA, 13 nt, Mycobacterium avium subsp. paratuberculosis
agcucgcgucgac

SEQ ID NO: 2919132 - RNA, 15 nt, Mycobacterium avium subsp. paratuberculosis
agcucgcgucgacgu

SEQ ID NO: 2919133 - RNA, 16 nt, Mycobacterium avium subsp. paratuberculosis
agcucgcgucgacguc

SEQ ID NO: 2919134 - RNA, 18 nt, Mycobacterium avium subsp. paratuberculosis
agcucgcugagcgggacg

SEQ ID NO: 2919135 - RNA, 17 nt, Mycobacterium avium subsp. paratuberculosis
agcucgcugaucagcuc

SEQ ID NO: 2919136 - RNA, 15 nt, Mycobacterium avium subsp. paratuberculosis
agcucggaguaggcg

SEQ ID NO: 2919137 - RNA, 20 nt, Mycobacterium avium subsp. paratuberculosis
agcucggccaccagcgcccg

SEQ ID NO: 2919138 - RNA, 22 nt, Mycobacterium avium subsp. paratuberculosis
agcucggccaccagcgcccgcc

SEQ ID NO: 2919139 - RNA, 23 nt, Mycobacterium avium subsp. paratuberculosis
agcucggccaccagcgcccgccc

SEQ ID NO: 2919140 - RNA, 15 nt, Mycobacterium avium subsp. paratuberculosis
agcucggcccgcugc

SEQ ID NO: 2919141 - RNA, 21 nt, Mycobacterium avium subsp. paratuberculosis
agcucggcccgcugcgcggcc

SEQ ID NO: 2919142 - RNA, 17 nt, Mycobacterium avium subsp. paratuberculosis
agcucggccuugagccg

SEQ ID NO: 2919143 - RNA, 14 nt, Mycobacterium avium subsp. paratuberculosis
agcucggcggcccg

SEQ ID NO: 2919144 - RNA, 15 nt, Mycobacterium avium subsp. paratuberculosis
agcucggcggcccgc

SEQ ID NO: 2919145 - RNA, 18 nt, Mycobacterium avium subsp. paratuberculosis
agcucggcggcccgccgg

SEQ ID NO: 2919146 - RNA, 15 nt, Mycobacterium avium subsp. paratuberculosis
agcucggcggccggg

SEQ ID NO: 2919147 - RNA, 16 nt, Mycobacterium avium subsp. paratuberculosis
agcucggcguggucga

SEQ ID NO: 2919148 - RNA, 17 nt, Mycobacterium avium subsp. paratuberculosis
agcucgggcagcccgcc

SEQ ID NO: 2919149 - RNA, 22 nt, Mycobacterium avium subsp. paratuberculosis
agcucgggcgcgaacagcgccg

SEQ ID NO: 2919150 - RNA, 22 nt, Mycobacterium avium subsp. paratuberculosis
agcucgggguaguucagcgcgc

SEQ ID NO: 2919151 - RNA, 15 nt, Mycobacterium avium subsp. paratuberculosis
agcucggggucggcg

SEQ ID NO: 2919152 - RNA, 18 nt, Mycobacterium avium subsp. paratuberculosis
agcucggggucggcgucg

SEQ ID NO: 2919153 - RNA, 15 nt, Mycobacterium avium subsp. paratuberculosis
agcucggucaccagc

SEQ ID NO: 2919154 - RNA, 16 nt, Mycobacterium avium subsp. paratuberculosis
agcucggucaccagcg

SEQ ID NO: 2919155 - RNA, 22 nt, Mycobacterium avium subsp. paratuberculosis
agcucggucaccagcggcccgc

SEQ ID NO: 2919156 - RNA, 23 nt, Mycobacterium avium subsp. paratuberculosis
agcucggucaccagcggcccgcu

SEQ ID NO: 2919157 - RNA, 12 nt, Mycobacterium avium subsp. paratuberculosis
agcucggucgcg

SEQ ID NO: 2919158 - RNA, 19 nt, Mycobacterium avium subsp. paratuberculosis
agcucggugaucugcacca

SEQ ID NO: 2919159 - RNA, 20 nt, Mycobacterium avium subsp. paratuberculosis
agcucggugaucugcaccag

SEQ ID NO: 2919160 - RNA, 22 nt, Mycobacterium avium subsp. paratuberculosis
agcucggugaugaucgccgggu

SEQ ID NO: 2919161 - RNA, 18 nt, Mycobacterium avium subsp. paratuberculosis
agcucggugcgcauggcg

SEQ ID NO: 2919162 - RNA, 21 nt, Mycobacterium avium subsp. paratuberculosis
agcucgguggcgucggcggcc

SEQ ID NO: 2919163 - RNA, 23 nt, Mycobacterium avium subsp. paratuberculosis
agcucgguggcgucggcggccug

SEQ ID NO: 2919164 - RNA, 21 nt, Mycobacterium avium subsp. paratuberculosis
agcucgucagcgcgggccagc

SEQ ID NO: 2919165 - RNA, 23 nt, Mycobacterium avium subsp. paratuberculosis
agcucguccagcgugccgcgcac

SEQ ID NO: 2919166 - RNA, 17 nt, Mycobacterium avium subsp. paratuberculosis
agcucgucgagccggcc

SEQ ID NO: 2919167 - RNA, 22 nt, Mycobacterium avium subsp. paratuberculosis
agcucgucggguguggcgccgu

SEQ ID NO: 2919168 - RNA, 23 nt, Mycobacterium avium subsp. paratuberculosis
agcucgucggguguggcgccgug

SEQ ID NO: 2919169 - RNA, 16 nt, Mycobacterium avium subsp. paratuberculosis
agcucgugauggucca

SEQ ID NO: 2919170 - RNA, 21 nt, Mycobacterium avium subsp. paratuberculosis
agcucgugaugguccagcacc

SEQ ID NO: 2919171 - RNA, 20 nt, Mycobacterium avium subsp. paratuberculosis
agcucgugcagcuguuccug

SEQ ID NO: 2919172 - RNA, 20 nt, Mycobacterium avium subsp. paratuberculosis
agcucgugguagaugucgcg

SEQ ID NO: 2919173 - RNA, 16 nt, Mycobacterium avium subsp. paratuberculosis
agcucguucucggcga

SEQ ID NO: 2919174 - RNA, 20 nt, Mycobacterium avium subsp. paratuberculosis
agcucguugccggcggccag

SEQ ID NO: 2919175 - RNA, 21 nt, Mycobacterium avium subsp. paratuberculosis
agcucguugugaauccagccg

SEQ ID NO: 2919176 - RNA, 22 nt, Mycobacterium avium subsp. paratuberculosis
agcucugguuuuacacaccagc

SEQ ID NO: 2919177 - RNA, 17 nt, Mycobacterium avium subsp. paratuberculosis
agcucuucgauggccau

SEQ ID NO: 2919178 - RNA, 22 nt, Mycobacterium avium subsp. paratuberculosis
agcugaagguuguucugcucga

SEQ ID NO: 2919179 - RNA, 18 nt, Mycobacterium avium subsp. paratuberculosis
agcugaagugcacucggc

SEQ ID NO: 2919180 - RNA, 22 nt, Mycobacterium avium subsp. paratuberculosis
agcugaagugcacucggcgaug

SEQ ID NO: 2919181 - RNA, 19 nt, Mycobacterium avium subsp. paratuberculosis
agcugaaguucaccaccgc

SEQ ID NO: 2919182 - RNA, 18 nt, Mycobacterium avium subsp. paratuberculosis
agcugacacccgacgaag

SEQ ID NO: 2919183 - RNA, 13 nt, Mycobacterium avium subsp. paratuberculosis
agcugaccggcca

SEQ ID NO: 2919184 - RNA, 14 nt, Mycobacterium avium subsp. paratuberculosis
agcugaccggccac

SEQ ID NO: 2919185 - RNA, 22 nt, Mycobacterium avium subsp. paratuberculosis
agcugacgauucuugaccaccu

SEQ ID NO: 2919186 - RNA, 15 nt, Mycobacterium avium subsp. paratuberculosis
agcugacgggccggc

SEQ ID NO: 2919187 - RNA, 12 nt, Mycobacterium avium subsp. paratuberculosis
agcugagcagcc

SEQ ID NO: 2919188 - RNA, 17 nt, Mycobacterium avium subsp. paratuberculosis
agcugauagcccgccgc

SEQ ID NO: 2919189 - RNA, 23 nt, Mycobacterium avium subsp. paratuberculosis
agcugauagcccgccgcggcgac

SEQ ID NO: 2919190 - RNA, 15 nt, Mycobacterium avium subsp. paratuberculosis
agcugauagccgccc

SEQ ID NO: 2919191 - RNA, 17 nt, Mycobacterium avium subsp. paratuberculosis
agcugaucgcggccggc

SEQ ID NO: 2919192 - RNA, 21 nt, Mycobacterium avium subsp. paratuberculosis
agcugaucgcgucgacggcgc

SEQ ID NO: 2919193 - RNA, 22 nt, Mycobacterium avium subsp. paratuberculosis
agcugaucgcgucgacggcgcc

SEQ ID NO: 2919194 - RNA, 13 nt, Mycobacterium avium subsp. paratuberculosis
agcugaucggcgu

SEQ ID NO: 2919195 - RNA, 22 nt, Mycobacterium avium subsp. paratuberculosis
agcugaucggcguuggcggcgu

SEQ ID NO: 2919196 - RNA, 22 nt, Mycobacterium avium subsp. paratuberculosis
agcugauggcacccucggugcu

SEQ ID NO: 2919197 - RNA, 20 nt, Mycobacterium avium subsp. paratuberculosis
agcugauucgggaucagccg

SEQ ID NO: 2919198 - RNA, 12 nt, Mycobacterium avium subsp. paratuberculosis
agcugauuguug

SEQ ID NO: 2919199 - RNA, 17 nt, Mycobacterium avium subsp. paratuberculosis
agcugcaacgcgucggc

SEQ ID NO: 2919200 - RNA, 18 nt, Mycobacterium avium subsp. paratuberculosis
agcugcaacgcgucggcg

SEQ ID NO: 2919201 - RNA, 18 nt, Mycobacterium avium subsp. paratuberculosis
agcugcacccaccggccc

SEQ ID NO: 2919202 - RNA, 20 nt, Mycobacterium avium subsp. paratuberculosis
agcugcaccggggccggcgg

SEQ ID NO: 2919203 - RNA, 21 nt, Mycobacterium avium subsp. paratuberculosis
agcugcaccggggccggcggg

SEQ ID NO: 2919204 - RNA, 14 nt, Mycobacterium avium subsp. paratuberculosis
agcugcacgggcgu

SEQ ID NO: 2919205 - RNA, 16 nt, Mycobacterium avium subsp. paratuberculosis
agcugcagccggccgg

SEQ ID NO: 2919206 - RNA, 19 nt, Mycobacterium avium subsp. paratuberculosis
agcugcagccggccggcgg

SEQ ID NO: 2919207 - RNA, 15 nt, Mycobacterium avium subsp. paratuberculosis
agcugcagcgacugc

SEQ ID NO: 2919208 - RNA, 22 nt, Mycobacterium avium subsp. paratuberculosis
agcugcagcuccucggcggccu

SEQ ID NO: 2919209 - RNA, 22 nt, Mycobacterium avium subsp. paratuberculosis
agcugcaggcuggucugguggg

SEQ ID NO: 2919210 - RNA, 11 nt, Mycobacterium avium subsp. paratuberculosis
agcugccccuu

SEQ ID NO: 2919211 - RNA, 14 nt, Mycobacterium avium subsp. paratuberculosis
agcugccccuucgc

SEQ ID NO: 2919212 - RNA, 16 nt, Mycobacterium avium subsp. paratuberculosis
agcugcccgucggagg

SEQ ID NO: 2919213 - RNA, 20 nt, Mycobacterium avium subsp. paratuberculosis
agcugcccgucggaggacaa

SEQ ID NO: 2919214 - RNA, 19 nt, Mycobacterium avium subsp. paratuberculosis
agcugcccugaagcugggc

SEQ ID NO: 2919215 - RNA, 18 nt, Mycobacterium avium subsp. paratuberculosis
agcuucugcccggccagc

SEQ ID NO: 2919216 - RNA, 19 nt, Mycobacterium avium subsp. paratuberculosis
agcuucugcccggccagca

SEQ ID NO: 2919217 - RNA, 14 nt, Mycobacterium avium subsp. paratuberculosis
agcuucuugcugcc

SEQ ID NO: 2919218 - RNA, 15 nt, Mycobacterium avium subsp. paratuberculosis
agcuucuugcugccg

SEQ ID NO: 2919219 - RNA, 19 nt, Mycobacterium avium subsp. paratuberculosis
agcuucuugcugccgucgg

SEQ ID NO: 2919220 - RNA, 14 nt, Mycobacterium avium subsp. paratuberculosis
agcuugacgucggu

SEQ ID NO: 2919221 - RNA, 17 nt, Mycobacterium avium subsp. paratuberculosis
agcuugacgucggucag

SEQ ID NO: 2919222 - RNA, 21 nt, Mycobacterium avium subsp. paratuberculosis
agcuugacgucggucagcauc

SEQ ID NO: 2919223 - RNA, 22 nt, Mycobacterium avium subsp. paratuberculosis
agcuugcucuucaggaacccga

SEQ ID NO: 2919224 - RNA, 14 nt, Mycobacterium avium subsp. paratuberculosis
agcuuggcgcccuu

SEQ ID NO: 2919225 - RNA, 17 nt, Mycobacterium avium subsp. paratuberculosis
agcuugggagacuucca

SEQ ID NO: 2919226 - RNA, 18 nt, Mycobacterium avium subsp. paratuberculosis
agcuugggagacuuccac

SEQ ID NO: 2919227 - RNA, 19 nt, Mycobacterium avium subsp. paratuberculosis
agcuugucguagcggcgcc

SEQ ID NO: 2919228 - RNA, 13 nt, Mycobacterium avium subsp. paratuberculosis
aggaacaaccgca

SEQ ID NO: 2919229 - RNA, 21 nt, Mycobacterium avium subsp. paratuberculosis
aggaaccacaccccggccacc

SEQ ID NO: 2919230 - RNA, 20 nt, Mycobacterium avium subsp. paratuberculosis
aggaaccggcagccggcgua

SEQ ID NO: 2919231 - RNA, 22 nt, Mycobacterium avium subsp. paratuberculosis
aggaaccgggucagcaccacca

SEQ ID NO: 2919232 - RNA, 17 nt, Mycobacterium avium subsp. paratuberculosis
aggaacggcacccgcag

SEQ ID NO: 2919233 - RNA, 14 nt, Mycobacterium avium subsp. paratuberculosis
aggaacggcgccau

SEQ ID NO: 2919234 - RNA, 22 nt, Mycobacterium avium subsp. paratuberculosis
aggaacucagcgcccaggauga

SEQ ID NO: 2919235 - RNA, 23 nt, Mycobacterium avium subsp. paratuberculosis
aggaacucagcgcccaggaugac

SEQ ID NO: 2919236 - RNA, 16 nt, Mycobacterium avium subsp. paratuberculosis
aggaacuccagcagcu

SEQ ID NO: 2919237 - RNA, 18 nt, Mycobacterium avium subsp. paratuberculosis
aggaacuccagcagcugu

SEQ ID NO: 2919238 - RNA, 12 nt, Mycobacterium avium subsp. paratuberculosis
aggaacugcagc

SEQ ID NO: 2919239 - RNA, 18 nt, Mycobacterium avium subsp. paratuberculosis
aggaacugcagcgacugg

SEQ ID NO: 2919240 - RNA, 18 nt, Mycobacterium avium subsp. paratuberculosis
aggaacuggucgaacagc

SEQ ID NO: 2919241 - RNA, 22 nt, Mycobacterium avium subsp. paratuberculosis
aggaacuggucgaacagcgcgc

SEQ ID NO: 2919242 - RNA, 17 nt, Mycobacterium avium subsp. paratuberculosis
aggaagaacccggcgug

SEQ ID NO: 2919243 - RNA, 22 nt, Mycobacterium avium subsp. paratuberculosis
aggaagacguaggcggccagca

SEQ ID NO: 2919244 - RNA, 17 nt, Mycobacterium avium subsp. paratuberculosis
aggaagccagccguccc

SEQ ID NO: 2919245 - RNA, 14 nt, Mycobacterium avium subsp. paratuberculosis
aggaaggagguggu

SEQ ID NO: 2919246 - RNA, 19 nt, Mycobacterium avium subsp. paratuberculosis
aggaaggccaguucgacga

SEQ ID NO: 2919247 - RNA, 17 nt, Mycobacterium avium subsp. paratuberculosis
aggaaguacaccaccgc

SEQ ID NO: 2919248 - RNA, 13 nt, Mycobacterium avium subsp. paratuberculosis
aggaaguccggcg

SEQ ID NO: 2919249 - RNA, 14 nt, Mycobacterium avium subsp. paratuberculosis
aggaauucgccgac

SEQ ID NO: 2919250 - RNA, 21 nt, Mycobacterium avium subsp. paratuberculosis
aggaauuugcggcccggcucg

SEQ ID NO: 2919251 - RNA, 13 nt, Mycobacterium avium subsp. paratuberculosis
aggacaccacggu

SEQ ID NO: 2919252 - RNA, 21 nt, Mycobacterium avium subsp. paratuberculosis
aggacaccacgguggcgucca

SEQ ID NO: 2919253 - RNA, 13 nt, Mycobacterium avium subsp. paratuberculosis
aggacaccccggc

SEQ ID NO: 2919254 - RNA, 15 nt, Mycobacterium avium subsp. paratuberculosis
aggacaccccggcga

SEQ ID NO: 2919255 - RNA, 17 nt, Mycobacterium avium subsp. paratuberculosis
aggacaccccggcgaug

SEQ ID NO: 2919256 - RNA, 22 nt, Mycobacterium avium subsp. paratuberculosis
aggacaccccggcgaugaccgg

SEQ ID NO: 2919257 - RNA, 23 nt, Mycobacterium avium subsp. paratuberculosis
aggacaccccggcgaugaccggg

SEQ ID NO: 2919258 - RNA, 13 nt, Mycobacterium avium subsp. paratuberculosis
aggacagcaccgc

SEQ ID NO: 2919259 - RNA, 20 nt, Mycobacterium avium subsp. paratuberculosis
aggacagcaccgccaucgcg

SEQ ID NO: 2919260 - RNA, 23 nt, Mycobacterium avium subsp. paratuberculosis
aggacagcaccgccaucgcggcg

SEQ ID NO: 2919261 - RNA, 12 nt, Mycobacterium avium subsp. paratuberculosis
aggacagcagcc

SEQ ID NO: 2919262 - RNA, 14 nt, Mycobacterium avium subsp. paratuberculosis
aggacagcgcggug

SEQ ID NO: 2919263 - RNA, 14 nt, Mycobacterium avium subsp. paratuberculosis
aggacagcgucagc

SEQ ID NO: 2919264 - RNA, 20 nt, Mycobacterium avium subsp. paratuberculosis
aggacaggucgcgguagcgc

SEQ ID NO: 2919265 - RNA, 16 nt, Mycobacterium avium subsp. paratuberculosis
aggaccagcgggucga

SEQ ID NO: 2919266 - RNA, 21 nt, Mycobacterium avium subsp. paratuberculosis
aggacccggugcccaccgucu

SEQ ID NO: 2919267 - RNA, 15 nt, Mycobacterium avium subsp. paratuberculosis
aggaccgagccgcgc

SEQ ID NO: 2919268 - RNA, 16 nt, Mycobacterium avium subsp. paratuberculosis
aggaccgagccgcgcg

SEQ ID NO: 2919269 - RNA, 18 nt, Mycobacterium avium subsp. paratuberculosis
aggaccgagccgcgcgcc

SEQ ID NO: 2919270 - RNA, 12 nt, Mycobacterium avium subsp. paratuberculosis
aggaccgcgcgc

SEQ ID NO: 2919271 - RNA, 22 nt, Mycobacterium avium subsp. paratuberculosis
aggaccggaugaaggacuggcc

SEQ ID NO: 2919272 - RNA, 13 nt, Mycobacterium avium subsp. paratuberculosis
aggaccggcgccg

SEQ ID NO: 2919273 - RNA, 17 nt, Mycobacterium avium subsp. paratuberculosis
aggaccggcgccggccg

SEQ ID NO: 2919274 - RNA, 21 nt, Mycobacterium avium subsp. paratuberculosis
aggaccuugucgggccgcggg

SEQ ID NO: 2919275 - RNA, 23 nt, Mycobacterium avium subsp. paratuberculosis
aggaccuugucgggccgcgggcc

SEQ ID NO: 2919276 - RNA, 17 nt, Mycobacterium avium subsp. paratuberculosis
aggacgaaaaccaggaa

SEQ ID NO: 2919277 - RNA, 13 nt, Mycobacterium avium subsp. paratuberculosis
aggacgaggcgag

SEQ ID NO: 2919278 - RNA, 22 nt, Mycobacterium avium subsp. paratuberculosis
aggacgaggcgaguaaggccga

SEQ ID NO: 2919279 - RNA, 14 nt, Mycobacterium avium subsp. paratuberculosis
aggacgaugcgcgc

SEQ ID NO: 2919280 - RNA, 15 nt, Mycobacterium avium subsp. paratuberculosis
aggacgcccggcgag

SEQ ID NO: 2919281 - RNA, 17 nt, Mycobacterium avium subsp. paratuberculosis
aggacgccucgcgcagc

SEQ ID NO: 2919282 - RNA, 20 nt, Mycobacterium avium subsp. paratuberculosis
aggacgccucgcgcagcgcg

SEQ ID NO: 2919283 - RNA, 23 nt, Mycobacterium avium subsp. paratuberculosis
aggacgcgcccggcgacgcggcg

SEQ ID NO: 2919284 - RNA, 14 nt, Mycobacterium avium subsp. paratuberculosis
aggacggcgcggug

SEQ ID NO: 2919285 - RNA, 17 nt, Mycobacterium avium subsp. paratuberculosis
aggacggcgcgguggcg

SEQ ID NO: 2919286 - RNA, 12 nt, Mycobacterium avium subsp. paratuberculosis
aggacgggcgug

SEQ ID NO: 2919287 - RNA, 12 nt, Mycobacterium avium subsp. paratuberculosis
aggacgguggcc

SEQ ID NO: 2919288 - RNA, 19 nt, Mycobacterium avium subsp. paratuberculosis
aggacgguuucugccggcc

SEQ ID NO: 2919289 - RNA, 22 nt, Mycobacterium avium subsp. paratuberculosis
aggacgguuucugccggccgcc

SEQ ID NO: 2919290 - RNA, 23 nt, Mycobacterium avium subsp. paratuberculosis
aggacgguuucugccggccgccg

SEQ ID NO: 2919291 - RNA, 20 nt, Mycobacterium avium subsp. paratuberculosis
aggacgucaggccggucagc

SEQ ID NO: 2919292 - RNA, 17 nt, Mycobacterium avium subsp. paratuberculosis
aggacgucgucgacguc

SEQ ID NO: 2919293 - RNA, 15 nt, Mycobacterium avium subsp. paratuberculosis
aggacgugcucugcc

SEQ ID NO: 2919294 - RNA, 20 nt, Mycobacterium avium subsp. paratuberculosis
aggacguugaggcggcggcg

SEQ ID NO: 2919295 - RNA, 19 nt, Mycobacterium avium subsp. paratuberculosis
aggacuccaguugacggcg

SEQ ID NO: 2919296 - RNA, 14 nt, Mycobacterium avium subsp. paratuberculosis
aggacuggcccacg

SEQ ID NO: 2919297 - RNA, 13 nt, Mycobacterium avium subsp. paratuberculosis
aggagaaggccgc

SEQ ID NO: 2919298 - RNA, 18 nt, Mycobacterium avium subsp. paratuberculosis
aggagacgucggccgggu

SEQ ID NO: 2919299 - RNA, 14 nt, Mycobacterium avium subsp. paratuberculosis
aggagaucggcgcg

SEQ ID NO: 2919300 - RNA, 22 nt, Mycobacterium avium subsp. paratuberculosis
aggccagcaaccggaauggcag

SEQ ID NO: 2919301 - RNA, 22 nt, Mycobacterium avium subsp. paratuberculosis
aggccagcaccuggcgcaccgc

SEQ ID NO: 2919302 - RNA, 23 nt, Mycobacterium avium subsp. paratuberculosis
aggccagcaccuggcgcaccgcc

SEQ ID NO: 2919303 - RNA, 15 nt, Mycobacterium avium subsp. paratuberculosis
aggccagcacgcagg

SEQ ID NO: 2919304 - RNA, 15 nt, Mycobacterium avium subsp. paratuberculosis
aggccagcacgccgg

SEQ ID NO: 2919305 - RNA, 17 nt, Mycobacterium avium subsp. paratuberculosis
aggccagcagcgcggcg

SEQ ID NO: 2919306 - RNA, 12 nt, Mycobacterium avium subsp. paratuberculosis
aggccagcgcga

SEQ ID NO: 2919307 - RNA, 16 nt, Mycobacterium avium subsp. paratuberculosis
aggccagcgcgaucgc

SEQ ID NO: 2919308 - RNA, 21 nt, Mycobacterium avium subsp. paratuberculosis
aggccagcuccucggggauga

SEQ ID NO: 2919309 - RNA, 15 nt, Mycobacterium avium subsp. paratuberculosis
aggccagcugcaccg

SEQ ID NO: 2919310 - RNA, 15 nt, Mycobacterium avium subsp. paratuberculosis
aggccagggcccgca

SEQ ID NO: 2919311 - RNA, 21 nt, Mycobacterium avium subsp. paratuberculosis
aggccaggugcacgccgagca

SEQ ID NO: 2919312 - RNA, 19 nt, Mycobacterium avium subsp. paratuberculosis
aggccaggugcagcugcau

SEQ ID NO: 2919313 - RNA, 21 nt, Mycobacterium avium subsp. paratuberculosis
aggccaucagcccggcguccu

SEQ ID NO: 2919314 - RNA, 22 nt, Mycobacterium avium subsp. paratuberculosis
aggccaugaucgaaaggacggg

SEQ ID NO: 2919315 - RNA, 21 nt, Mycobacterium avium subsp. paratuberculosis
aggccauggcgcaccgcggcc

SEQ ID NO: 2919316 - RNA, 14 nt, Mycobacterium avium subsp. paratuberculosis
aggcccacccacuc

SEQ ID NO: 2919317 - RNA, 11 nt, Mycobacterium avium subsp. paratuberculosis
aggcccaccgc

SEQ ID NO: 2919318 - RNA, 11 nt, Mycobacterium avium subsp. paratuberculosis
aggcccaccgu

SEQ ID NO: 2919319 - RNA, 13 nt, Mycobacterium avium subsp. paratuberculosis
aggcccagcagca

SEQ ID NO: 2919320 - RNA, 19 nt, Mycobacterium avium subsp. paratuberculosis
aggcccagcagcaccgcga

SEQ ID NO: 2919321 - RNA, 12 nt, Mycobacterium avium subsp. paratuberculosis
aggcccagccca

SEQ ID NO: 2919322 - RNA, 14 nt, Mycobacterium avium subsp. paratuberculosis
aggcccagcccacc

SEQ ID NO: 2919323 - RNA, 16 nt, Mycobacterium avium subsp. paratuberculosis
aggcccagcgaggcgg

SEQ ID NO: 2919324 - RNA, 12 nt, Mycobacterium avium subsp. paratuberculosis
aggcccagcgga

SEQ ID NO: 2919325 - RNA, 16 nt, Mycobacterium avium subsp. paratuberculosis
aggcccaguccugcag

SEQ ID NO: 2919326 - RNA, 18 nt, Mycobacterium avium subsp. paratuberculosis
aggcccaucgcggucagc

SEQ ID NO: 2919327 - RNA, 23 nt, Mycobacterium avium subsp. paratuberculosis
aggccccggauccgucgccccgc

SEQ ID NO: 2919328 - RNA, 14 nt, Mycobacterium avium subsp. paratuberculosis
aggccccggcgcgc

SEQ ID NO: 2919329 - RNA, 16 nt, Mycobacterium avium subsp. paratuberculosis
aggccccggcgcgcgu

SEQ ID NO: 2919330 - RNA, 21 nt, Mycobacterium avium subsp. paratuberculosis
aggccccguucgguggccacc

SEQ ID NO: 2919331 - RNA, 22 nt, Mycobacterium avium subsp. paratuberculosis
aggccccguucgguggccaccg

SEQ ID NO: 2919332 - RNA, 23 nt, Mycobacterium avium subsp. paratuberculosis
aggccccguucgguggccaccgc

SEQ ID NO: 2919333 - RNA, 22 nt, Mycobacterium avium subsp. paratuberculosis
aggcccgagcccgacggcagca

SEQ ID NO: 2919334 - RNA, 15 nt, Mycobacterium avium subsp. paratuberculosis
aggcccgcaagaugu

SEQ ID NO: 2919335 - RNA, 17 nt, Mycobacterium avium subsp. paratuberculosis
aggcccggacggccacc

SEQ ID NO: 2919336 - RNA, 23 nt, Mycobacterium avium subsp. paratuberculosis
aggcccggcgugggccgcagcgc

SEQ ID NO: 2919337 - RNA, 18 nt, Mycobacterium avium subsp. paratuberculosis
aggcccucaucgucgacc

SEQ ID NO: 2919338 - RNA, 13 nt, Mycobacterium avium subsp. paratuberculosis
aggcccucgacgu

SEQ ID NO: 2919339 - RNA, 23 nt, Mycobacterium avium subsp. paratuberculosis
aggcccucgacguaguccggcca

SEQ ID NO: 2919340 - RNA, 13 nt, Mycobacterium avium subsp. paratuberculosis
aggcccucgccgc

SEQ ID NO: 2919341 - RNA, 21 nt, Mycobacterium avium subsp. paratuberculosis
aggcccucggccagccaggcc

SEQ ID NO: 2919342 - RNA, 23 nt, Mycobacterium avium subsp. paratuberculosis
aggcccucggccagccaggccgu

SEQ ID NO: 2919343 - RNA, 13 nt, Mycobacterium avium subsp. paratuberculosis
aggcccugccagc

SEQ ID NO: 2919344 - RNA, 15 nt, Mycobacterium avium subsp. paratuberculosis
aggcccugccagcgc

SEQ ID NO: 2919345 - RNA, 19 nt, Mycobacterium avium subsp. paratuberculosis
aggcccugcugcagcgcga

SEQ ID NO: 2919346 - RNA, 17 nt, Mycobacterium avium subsp. paratuberculosis
aggcccuugccccacca

SEQ ID NO: 2919347 - RNA, 20 nt, Mycobacterium avium subsp. paratuberculosis
aggcccuugccccaccaccg

SEQ ID NO: 2919348 - RNA, 22 nt, Mycobacterium avium subsp. paratuberculosis
aggcccuugccccaccaccgcc

SEQ ID NO: 2919349 - RNA, 15 nt, Mycobacterium avium subsp. paratuberculosis
aggccgaacagcagc

SEQ ID NO: 2919350 - RNA, 17 nt, Mycobacterium avium subsp. paratuberculosis
aggccgaacagcagcga

SEQ ID NO: 2919351 - RNA, 18 nt, Mycobacterium avium subsp. paratuberculosis
aggccgaaccgcagccgg

SEQ ID NO: 2919352 - RNA, 23 nt, Mycobacterium avium subsp. paratuberculosis
aggccgaagaacgacuggcggcg

SEQ ID NO: 2919353 - RNA, 19 nt, Mycobacterium avium subsp. paratuberculosis
aggccgacagguagcaggc

SEQ ID NO: 2919354 - RNA, 14 nt, Mycobacterium avium subsp. paratuberculosis
aggccgacgccggc

SEQ ID NO: 2919355 - RNA, 19 nt, Mycobacterium avium subsp. paratuberculosis
aggccgacgccggccacca

SEQ ID NO: 2919356 - RNA, 15 nt, Mycobacterium avium subsp. paratuberculosis
aggccgacgcuggcc

SEQ ID NO: 2919357 - RNA, 23 nt, Mycobacterium avium subsp. paratuberculosis
aggccgacgugcuuggccagcuc

SEQ ID NO: 2919358 - RNA, 14 nt, Mycobacterium avium subsp. paratuberculosis
aggccgacguggag

SEQ ID NO: 2919359 - RNA, 23 nt, Mycobacterium avium subsp. paratuberculosis
aggccgacuggugauagaucauc

SEQ ID NO: 2919360 - RNA, 24 nt, Mycobacterium avium subsp. paratuberculosis
aggccgagcgcaagggccgacauc

SEQ ID NO: 2919361 - RNA, 14 nt, Mycobacterium avium subsp. paratuberculosis
aggccgagcgcgcu

SEQ ID NO: 2919362 - RNA, 20 nt, Mycobacterium avium subsp. paratuberculosis
aggccgaggcugucggaggc

SEQ ID NO: 2919363 - RNA, 23 nt, Mycobacterium avium subsp. paratuberculosis
aggccgaggucggucgcggcauc

SEQ ID NO: 2919364 - RNA, 19 nt, Mycobacterium avium subsp. paratuberculosis
aggccgaugaugaugccgc

SEQ ID NO: 2919365 - RNA, 21 nt, Mycobacterium avium subsp. paratuberculosis
aggccgauggcgcccagcguc

SEQ ID NO: 2919366 - RNA, 19 nt, Mycobacterium avium subsp. paratuberculosis
aggccgccagccgcgucuu

SEQ ID NO: 2919367 - RNA, 21 nt, Mycobacterium avium subsp. paratuberculosis
aggccgccagcucguccagcg

SEQ ID NO: 2919368 - RNA, 15 nt, Mycobacterium avium subsp. paratuberculosis
aggccgccccggccg

SEQ ID NO: 2919369 - RNA, 17 nt, Mycobacterium avium subsp. paratuberculosis
aggccgccccggccgcg

SEQ ID NO: 2919370 - RNA, 18 nt, Mycobacterium avium subsp. paratuberculosis
aggccgccccggccgcgc

SEQ ID NO: 2919371 - RNA, 21 nt, Mycobacterium avium subsp. paratuberculosis
aggccgccccggccgcgcacc

SEQ ID NO: 2919372 - RNA, 16 nt, Mycobacterium avium subsp. paratuberculosis
aggccgcccgacccgu

SEQ ID NO: 2919373 - RNA, 21 nt, Mycobacterium avium subsp. paratuberculosis
aggccgcccgcuccugcaggc

SEQ ID NO: 2919374 - RNA, 12 nt, Mycobacterium avium subsp. paratuberculosis
aggccgcccggc

SEQ ID NO: 2919375 - RNA, 13 nt, Mycobacterium avium subsp. paratuberculosis
aggccgcccggcc

SEQ ID NO: 2919376 - RNA, 14 nt, Mycobacterium avium subsp. paratuberculosis
aggccgcccggccc

SEQ ID NO: 2919377 - RNA, 18 nt, Mycobacterium avium subsp. paratuberculosis
aggccgccgacgacggcg

SEQ ID NO: 2919378 - RNA, 10 nt, Mycobacterium avium subsp. paratuberculosis
aggccgccgc

SEQ ID NO: 2919379 - RNA, 14 nt, Mycobacterium avium subsp. paratuberculosis
aggccgccgccacc

SEQ ID NO: 2919380 - RNA, 16 nt, Mycobacterium avium subsp. paratuberculosis
aggccgccgccaccgu

SEQ ID NO: 2919381 - RNA, 14 nt, Mycobacterium avium subsp. paratuberculosis
aggccgccgcgacc

SEQ ID NO: 2919382 - RNA, 17 nt, Mycobacterium avium subsp. paratuberculosis
aggccgccgggccgccg

SEQ ID NO: 2919383 - RNA, 20 nt, Mycobacterium avium subsp. paratuberculosis
aggccgccugcccgggcgcc

SEQ ID NO: 2919384 - RNA, 16 nt, Mycobacterium avium subsp. paratuberculosis
aggcgaacauggcggc

SEQ ID NO: 2919385 - RNA, 19 nt, Mycobacterium avium subsp. paratuberculosis
aggcgaacauggcggccag

SEQ ID NO: 2919386 - RNA, 20 nt, Mycobacterium avium subsp. paratuberculosis
aggcgaacauggcggccagc

SEQ ID NO: 2919387 - RNA, 15 nt, Mycobacterium avium subsp. paratuberculosis
aggcgaagagcggca

SEQ ID NO: 2919388 - RNA, 16 nt, Mycobacterium avium subsp. paratuberculosis
aggcgaagagcggcac

SEQ ID NO: 2919389 - RNA, 17 nt, Mycobacterium avium subsp. paratuberculosis
aggcgaaggucagaucg

SEQ ID NO: 2919390 - RNA, 19 nt, Mycobacterium avium subsp. paratuberculosis
aggcgaagguggcgucggc

SEQ ID NO: 2919391 - RNA, 19 nt, Mycobacterium avium subsp. paratuberculosis
aggcgaaguuggucaccac

SEQ ID NO: 2919392 - RNA, 16 nt, Mycobacterium avium subsp. paratuberculosis
aggcgaauaagggggu

SEQ ID NO: 2919393 - RNA, 19 nt, Mycobacterium avium subsp. paratuberculosis
aggcgaccacaccgccggc

SEQ ID NO: 2919394 - RNA, 23 nt, Mycobacterium avium subsp. paratuberculosis
aggcgaccacaccgccggccacg

SEQ ID NO: 2919395 - RNA, 19 nt, Mycobacterium avium subsp. paratuberculosis
aggcgaccaugcccagcag

SEQ ID NO: 2919396 - RNA, 23 nt, Mycobacterium avium subsp. paratuberculosis
aggcgaccaugcccagcaguccg

SEQ ID NO: 2919397 - RNA, 16 nt, Mycobacterium avium subsp. paratuberculosis
aggcgacccccggugu

SEQ ID NO: 2919398 - RNA, 13 nt, Mycobacterium avium subsp. paratuberculosis
aggcgaccggccc

SEQ ID NO: 2919399 - RNA, 17 nt, Mycobacterium avium subsp. paratuberculosis
aggcgacuguccaggcc

SEQ ID NO: 2919400 - RNA, 19 nt, Mycobacterium avium subsp. paratuberculosis
aggcgacuguccaggccga

SEQ ID NO: 2919401 - RNA, 17 nt, Mycobacterium avium subsp. paratuberculosis
aggcgagcacggcacgc

SEQ ID NO: 2919402 - RNA, 21 nt, Mycobacterium avium subsp. paratuberculosis
aggcgagcacggcacgcccgu

SEQ ID NO: 2919403 - RNA, 18 nt, Mycobacterium avium subsp. paratuberculosis
aggcgagccgacagucgc

SEQ ID NO: 2919404 - RNA, 19 nt, Mycobacterium avium subsp. paratuberculosis
aggcgagccgacagucgcg

SEQ ID NO: 2919405 - RNA, 15 nt, Mycobacterium avium subsp. paratuberculosis
aggcgaggaccgaga

SEQ ID NO: 2919406 - RNA, 22 nt, Mycobacterium avium subsp. paratuberculosis
aggcgaguaaggccgaggcgag

SEQ ID NO: 2919407 - RNA, 14 nt, Mycobacterium avium subsp. paratuberculosis
aggcgagugaggac

SEQ ID NO: 2919408 - RNA, 17 nt, Mycobacterium avium subsp. paratuberculosis
aggcgaguuaugccguc

SEQ ID NO: 2919409 - RNA, 21 nt, Mycobacterium avium subsp. paratuberculosis
aggcgaucaucgccccggaga

SEQ ID NO: 2919410 - RNA, 14 nt, Mycobacterium avium subsp. paratuberculosis
aggcgaucgcggcc

SEQ ID NO: 2919411 - RNA, 15 nt, Mycobacterium avium subsp. paratuberculosis
aggcgaucgggaaca

SEQ ID NO: 2919412 - RNA, 15 nt, Mycobacterium avium subsp. paratuberculosis
aggcgaucucgccga

SEQ ID NO: 2919413 - RNA, 13 nt, Mycobacterium avium subsp. paratuberculosis
aggcgaugcccag

SEQ ID NO: 2919414 - RNA, 14 nt, Mycobacterium avium subsp. paratuberculosis
aggcgaugcccagc

SEQ ID NO: 2919415 - RNA, 15 nt, Mycobacterium avium subsp. paratuberculosis
aggcgaugccgccga

SEQ ID NO: 2919416 - RNA, 16 nt, Mycobacterium avium subsp. paratuberculosis
aggcgauggcgucggc

SEQ ID NO: 2919417 - RNA, 19 nt, Mycobacterium avium subsp. paratuberculosis
aggcgauggcgucggccag

SEQ ID NO: 2919418 - RNA, 20 nt, Mycobacterium avium subsp. paratuberculosis
aggcgauggcgucggccagc

SEQ ID NO: 2919419 - RNA, 15 nt, Mycobacterium avium subsp. paratuberculosis
aggcgauggugccgg

SEQ ID NO: 2919420 - RNA, 19 nt, Mycobacterium avium subsp. paratuberculosis
aggcgauggugccggccau

SEQ ID NO: 2919421 - RNA, 14 nt, Mycobacterium avium subsp. paratuberculosis
aggcgaugucgacg

SEQ ID NO: 2919422 - RNA, 15 nt, Mycobacterium avium subsp. paratuberculosis
aggcgaugucgacgu

SEQ ID NO: 2919423 - RNA, 16 nt, Mycobacterium avium subsp. paratuberculosis
aggcgaugucgacgug

SEQ ID NO: 2919424 - RNA, 22 nt, Mycobacterium avium subsp. paratuberculosis
aggcgaugucgacgugggcgcc

SEQ ID NO: 2919425 - RNA, 15 nt, Mycobacterium avium subsp. paratuberculosis
aggcgcaacaccgga

SEQ ID NO: 2919426 - RNA, 14 nt, Mycobacterium avium subsp. paratuberculosis
aggcgcaacagcac

SEQ ID NO: 2919427 - RNA, 13 nt, Mycobacterium avium subsp. paratuberculosis
aggcgcaccacca

SEQ ID NO: 2919428 - RNA, 15 nt, Mycobacterium avium subsp. paratuberculosis
aggcgcaccagcuga

SEQ ID NO: 2919429 - RNA, 14 nt, Mycobacterium avium subsp. paratuberculosis
aggcgcaccgccac

SEQ ID NO: 2919430 - RNA, 15 nt, Mycobacterium avium subsp. paratuberculosis
aggcgcaccgccacc

SEQ ID NO: 2919431 - RNA, 14 nt, Mycobacterium avium subsp. paratuberculosis
aggcgcaccgccgg

SEQ ID NO: 2919432 - RNA, 13 nt, Mycobacterium avium subsp. paratuberculosis
aggcgcagccagc

SEQ ID NO: 2919433 - RNA, 18 nt, Mycobacterium avium subsp. paratuberculosis
aggcgcaugccagaccac

SEQ ID NO: 2919434 - RNA, 17 nt, Mycobacterium avium subsp. paratuberculosis
aggcgccacaacugguc

SEQ ID NO: 2919435 - RNA, 13 nt, Mycobacterium avium subsp. paratuberculosis
aggcgccacagca

SEQ ID NO: 2919436 - RNA, 14 nt, Mycobacterium avium subsp. paratuberculosis
aggcgccacagcag

SEQ ID NO: 2919437 - RNA, 14 nt, Mycobacterium avium subsp. paratuberculosis
aggcgcccagcacc

SEQ ID NO: 2919438 - RNA, 15 nt, Mycobacterium avium subsp. paratuberculosis
aggcgcccaggauca

SEQ ID NO: 2919439 - RNA, 15 nt, Mycobacterium avium subsp. paratuberculosis
aggcgccccagcucc

SEQ ID NO: 2919440 - RNA, 14 nt, Mycobacterium avium subsp. paratuberculosis
aggcgccggccagc

SEQ ID NO: 2919441 - RNA, 15 nt, Mycobacterium avium subsp. paratuberculosis
aggcgccggccagca

SEQ ID NO: 2919442 - RNA, 13 nt, Mycobacterium avium subsp. paratuberculosis
aggcgccggcgcg

SEQ ID NO: 2919443 - RNA, 14 nt, Mycobacterium avium subsp. paratuberculosis
aggcgccggcgcgg

SEQ ID NO: 2919444 - RNA, 15 nt, Mycobacterium avium subsp. paratuberculosis
aggcgccggcgcggg

SEQ ID NO: 2919445 - RNA, 16 nt, Mycobacterium avium subsp. paratuberculosis
aggcgccggcgcgggg

SEQ ID NO: 2919446 - RNA, 17 nt, Mycobacterium avium subsp. paratuberculosis
aggcgccgucgauggcg

SEQ ID NO: 2919447 - RNA, 12 nt, Mycobacterium avium subsp. paratuberculosis
aggcgccgucgg

SEQ ID NO: 2919448 - RNA, 22 nt, Mycobacterium avium subsp. paratuberculosis
aggcgcgcaccaucgcgaugga

SEQ ID NO: 2919449 - RNA, 21 nt, Mycobacterium avium subsp. paratuberculosis
aggcgcgcagcaggcgccggu

SEQ ID NO: 2919450 - RNA, 15 nt, Mycobacterium avium subsp. paratuberculosis
aggcgcgcagggcga

SEQ ID NO: 2919451 - RNA, 20 nt, Mycobacterium avium subsp. paratuberculosis
aggcgcgcagguagccgccg

SEQ ID NO: 2919452 - RNA, 21 nt, Mycobacterium avium subsp. paratuberculosis
aggcgcgcagguagccgccgu

SEQ ID NO: 2919453 - RNA, 14 nt, Mycobacterium avium subsp. paratuberculosis
aggcgcgccgagcg

SEQ ID NO: 2919454 - RNA, 12 nt, Mycobacterium avium subsp. paratuberculosis
aggcgcgccggu

SEQ ID NO: 2919455 - RNA, 13 nt, Mycobacterium avium subsp. paratuberculosis
aggcgcgcgcugg

SEQ ID NO: 2919456 - RNA, 10 nt, Mycobacterium avium subsp. paratuberculosis
aggcgcggcg

SEQ ID NO: 2919457 - RNA, 12 nt, Mycobacterium avium subsp. paratuberculosis
aggcgcggcgcg

SEQ ID NO: 2919458 - RNA, 12 nt, Mycobacterium avium subsp. paratuberculosis
aggcgcggggcg

SEQ ID NO: 2919459 - RNA, 14 nt, Mycobacterium avium subsp. paratuberculosis
aggcgcggggcgcg

SEQ ID NO: 2919460 - RNA, 12 nt, Mycobacterium avium subsp. paratuberculosis
aggcgcgggugu

SEQ ID NO: 2919461 - RNA, 20 nt, Mycobacterium avium subsp. paratuberculosis
aggcgcggguguugccggag

SEQ ID NO: 2919462 - RNA, 22 nt, Mycobacterium avium subsp. paratuberculosis
aggcgcggucgguggcggugcc

SEQ ID NO: 2919463 - RNA, 20 nt, Mycobacterium avium subsp. paratuberculosis
aggcgcucgcacaacccgcc

SEQ ID NO: 2919464 - RNA, 11 nt, Mycobacterium avium subsp. paratuberculosis
aggcgcucggc

SEQ ID NO: 2919465 - RNA, 14 nt, Mycobacterium avium subsp. paratuberculosis
aggcgcucggcccg

SEQ ID NO: 2919466 - RNA, 15 nt, Mycobacterium avium subsp. paratuberculosis
aggcgcucggcccgc

SEQ ID NO: 2919467 - RNA, 22 nt, Mycobacterium avium subsp. paratuberculosis
aggcgcugggugcgggcugcac

SEQ ID NO: 2919468 - RNA, 12 nt, Mycobacterium avium subsp. paratuberculosis
aggcggaaugca

SEQ ID NO: 2919469 - RNA, 23 nt, Mycobacterium avium subsp. paratuberculosis
aggcggaaugcaggaucgcggug

SEQ ID NO: 2919470 - RNA, 18 nt, Mycobacterium avium subsp. paratuberculosis
aggcugaacgucgucagc

SEQ ID NO: 2919471 - RNA, 11 nt, Mycobacterium avium subsp. paratuberculosis
aggcugaccag

SEQ ID NO: 2919472 - RNA, 16 nt, Mycobacterium avium subsp. paratuberculosis
aggcugaccagcgccu

SEQ ID NO: 2919473 - RNA, 16 nt, Mycobacterium avium subsp. paratuberculosis
aggcugacgccacgcg

SEQ ID NO: 2919474 - RNA, 14 nt, Mycobacterium avium subsp. paratuberculosis
aggcugacgcgacc

SEQ ID NO: 2919475 - RNA, 20 nt, Mycobacterium avium subsp. paratuberculosis
aggcugacgcgaccgcgcgg

SEQ ID NO: 2919476 - RNA, 15 nt, Mycobacterium avium subsp. paratuberculosis
aggcugaucucggcg

SEQ ID NO: 2919477 - RNA, 16 nt, Mycobacterium avium subsp. paratuberculosis
aggcugaucucggcgg

SEQ ID NO: 2919478 - RNA, 17 nt, Mycobacterium avium subsp. paratuberculosis
aggcugaucucggcggu

SEQ ID NO: 2919479 - RNA, 20 nt, Mycobacterium avium subsp. paratuberculosis
aggcugaucuggaugcggcc

SEQ ID NO: 2919480 - RNA, 13 nt, Mycobacterium avium subsp. paratuberculosis
aggcugccgcugc

SEQ ID NO: 2919481 - RNA, 16 nt, Mycobacterium avium subsp. paratuberculosis
aggcugccgcugcgcc

SEQ ID NO: 2919482 - RNA, 14 nt, Mycobacterium avium subsp. paratuberculosis
aggcuggcaucguc

SEQ ID NO: 2919483 - RNA, 18 nt, Mycobacterium avium subsp. paratuberculosis
aggcuggcaucgucggcg

SEQ ID NO: 2919484 - RNA, 20 nt, Mycobacterium avium subsp. paratuberculosis
aggcuggcaucgucggcgcc

SEQ ID NO: 2919485 - RNA, 23 nt, Mycobacterium avium subsp. paratuberculosis
aggcuggcaucgucggcgccggc

SEQ ID NO: 2919486 - RNA, 17 nt, Mycobacterium avium subsp. paratuberculosis
aggcuggccagcucggc

SEQ ID NO: 2919487 - RNA, 18 nt, Mycobacterium avium subsp. paratuberculosis
aggcuggccaggcuggcg

SEQ ID NO: 2919488 - RNA, 12 nt, Mycobacterium avium subsp. paratuberculosis
aggcuggcggcg

SEQ ID NO: 2919489 - RNA, 23 nt, Mycobacterium avium subsp. paratuberculosis
aggcuggcggcgaucaccgccgc

SEQ ID NO: 2919490 - RNA, 12 nt, Mycobacterium avium subsp. paratuberculosis
aggcuggguugc

SEQ ID NO: 2919491 - RNA, 19 nt, Mycobacterium avium subsp. paratuberculosis
aggcuggucuggugggugu

SEQ ID NO: 2919492 - RNA, 20 nt, Mycobacterium avium subsp. paratuberculosis
aggcugugggccagcagcgu

SEQ ID NO: 2919493 - RNA, 12 nt, Mycobacterium avium subsp. paratuberculosis
aggcuuggcccg

SEQ ID NO: 2919494 - RNA, 19 nt, Mycobacterium avium subsp. paratuberculosis
aggcuuggcccgccgccgg

SEQ ID NO: 2919495 - RNA, 20 nt, Mycobacterium avium subsp. paratuberculosis
aggcuuggcccgccgccggc

SEQ ID NO: 2919496 - RNA, 21 nt, Mycobacterium avium subsp. paratuberculosis
aggcuuggcccgccgccggcg

SEQ ID NO: 2919497 - RNA, 13 nt, Mycobacterium avium subsp. paratuberculosis
agggaaaggcagc

SEQ ID NO: 2919498 - RNA, 17 nt, Mycobacterium avium subsp. paratuberculosis
agggaaaggcagcagcc

SEQ ID NO: 2919499 - RNA, 18 nt, Mycobacterium avium subsp. paratuberculosis
agggacaugccgagcagc

SEQ ID NO: 2919500 - RNA, 15 nt, Mycobacterium avium subsp. paratuberculosis
agggaccaguggugg

SEQ ID NO: 2919501 - RNA, 14 nt, Mycobacterium avium subsp. paratuberculosis
agggaccuccagcg

SEQ ID NO: 2919502 - RNA, 16 nt, Mycobacterium avium subsp. paratuberculosis
agggacugcgccgggg

SEQ ID NO: 2919503 - RNA, 17 nt, Mycobacterium avium subsp. paratuberculosis
agggacugcgccggggc

SEQ ID NO: 2919504 - RNA, 19 nt, Mycobacterium avium subsp. paratuberculosis
agggacugcgccggggccg

SEQ ID NO: 2919505 - RNA, 16 nt, Mycobacterium avium subsp. paratuberculosis
agggagccgacgaaga

SEQ ID NO: 2919506 - RNA, 17 nt, Mycobacterium avium subsp. paratuberculosis
agggaggacagcaccgc

SEQ ID NO: 2919507 - RNA, 19 nt, Mycobacterium avium subsp. paratuberculosis
agggcagauaggcggcgac

SEQ ID NO: 2919508 - RNA, 12 nt, Mycobacterium avium subsp. paratuberculosis
agggcagccaca

SEQ ID NO: 2919509 - RNA, 14 nt, Mycobacterium avium subsp. paratuberculosis
agggcagccagccc

SEQ ID NO: 2919510 - RNA, 16 nt, Mycobacterium avium subsp. paratuberculosis
agggcagcgccucggc

SEQ ID NO: 2919511 - RNA, 21 nt, Mycobacterium avium subsp. paratuberculosis
agggcagcgccucggcgggcc

SEQ ID NO: 2919512 - RNA, 15 nt, Mycobacterium avium subsp. paratuberculosis
agggcagcgucccgu

SEQ ID NO: 2919513 - RNA, 19 nt, Mycobacterium avium subsp. paratuberculosis
agggcagcgucccgucggc

SEQ ID NO: 2919514 - RNA, 18 nt, Mycobacterium avium subsp. paratuberculosis
agggcagggucgcggagc

SEQ ID NO: 2919515 - RNA, 19 nt, Mycobacterium avium subsp. paratuberculosis
agggcaucgggucguagag

SEQ ID NO: 2919516 - RNA, 21 nt, Mycobacterium avium subsp. paratuberculosis
agggcaucucccgcgcgcagg

SEQ ID NO: 2919517 - RNA, 13 nt, Mycobacterium avium subsp. paratuberculosis
agggccaccacgc

SEQ ID NO: 2919518 - RNA, 17 nt, Mycobacterium avium subsp. paratuberculosis
agggccaccacgccagc

SEQ ID NO: 2919519 - RNA, 16 nt, Mycobacterium avium subsp. paratuberculosis
agggccaccgcguaga

SEQ ID NO: 2919520 - RNA, 14 nt, Mycobacterium avium subsp. paratuberculosis
agggccaccggcuc

SEQ ID NO: 2919521 - RNA, 17 nt, Mycobacterium avium subsp. paratuberculosis
agggccaccgucagggu

SEQ ID NO: 2919522 - RNA, 17 nt, Mycobacterium avium subsp. paratuberculosis
agggccagcaacaccag

SEQ ID NO: 2919523 - RNA, 16 nt, Mycobacterium avium subsp. paratuberculosis
agggccagcaccauga

SEQ ID NO: 2919524 - RNA, 13 nt, Mycobacterium avium subsp. paratuberculosis
agggccagcagcc

SEQ ID NO: 2919525 - RNA, 19 nt, Mycobacterium avium subsp. paratuberculosis
agggccagcagucgugacg

SEQ ID NO: 2919526 - RNA, 22 nt, Mycobacterium avium subsp. paratuberculosis
agggccagguucaggcccgcgc

SEQ ID NO: 2919527 - RNA, 19 nt, Mycobacterium avium subsp. paratuberculosis
agggccauccggccggcga

SEQ ID NO: 2919528 - RNA, 18 nt, Mycobacterium avium subsp. paratuberculosis
agggcccacgcucgacgc

SEQ ID NO: 2919529 - RNA, 14 nt, Mycobacterium avium subsp. paratuberculosis
agggcccaugccgc

SEQ ID NO: 2919530 - RNA, 16 nt, Mycobacterium avium subsp. paratuberculosis
agggcccaugccgcca

SEQ ID NO: 2919531 - RNA, 17 nt, Mycobacterium avium subsp. paratuberculosis
agggccccggcaucgac

SEQ ID NO: 2919532 - RNA, 20 nt, Mycobacterium avium subsp. paratuberculosis
agggccccguuggugcggug

SEQ ID NO: 2919533 - RNA, 16 nt, Mycobacterium avium subsp. paratuberculosis
agggcccgcagccgcu

SEQ ID NO: 2919534 - RNA, 20 nt, Mycobacterium avium subsp. paratuberculosis
agggcccgcagccgcuggcc

SEQ ID NO: 2919535 - RNA, 22 nt, Mycobacterium avium subsp. paratuberculosis
agggccgaaaaaccugcggugc

SEQ ID NO: 2919536 - RNA, 11 nt, Mycobacterium avium subsp. paratuberculosis
agggccgccgc

SEQ ID NO: 2919537 - RNA, 14 nt, Mycobacterium avium subsp. paratuberculosis
agggccgccgcaua

SEQ ID NO: 2919538 - RNA, 15 nt, Mycobacterium avium subsp. paratuberculosis
agggccgccgcugga

SEQ ID NO: 2919539 - RNA, 16 nt, Mycobacterium avium subsp. paratuberculosis
agggccgcggccgccg

SEQ ID NO: 2919540 - RNA, 20 nt, Mycobacterium avium subsp. paratuberculosis
agggccgcggccgccgcgac

SEQ ID NO: 2919541 - RNA, 19 nt, Mycobacterium avium subsp. paratuberculosis
agggccgggcgcuggccgu

SEQ ID NO: 2919542 - RNA, 13 nt, Mycobacterium avium subsp. paratuberculosis
agggccgggcgug

SEQ ID NO: 2919543 - RNA, 21 nt, Mycobacterium avium subsp. paratuberculosis
agggccgggcgugcccggcgc

SEQ ID NO: 2919544 - RNA, 22 nt, Mycobacterium avium subsp. paratuberculosis
agggccgggcgugcccggcgca

SEQ ID NO: 2919545 - RNA, 15 nt, Mycobacterium avium subsp. paratuberculosis
agggccucgccguug

SEQ ID NO: 2919546 - RNA, 15 nt, Mycobacterium avium subsp. paratuberculosis
agggccucggcgacc

SEQ ID NO: 2919547 - RNA, 23 nt, Mycobacterium avium subsp. paratuberculosis
agggccucgucgucgucgagcac

SEQ ID NO: 2919548 - RNA, 18 nt, Mycobacterium avium subsp. paratuberculosis
agggcgaacuugcuggcc

SEQ ID NO: 2919549 - RNA, 16 nt, Mycobacterium avium subsp. paratuberculosis
agggcgaccaccacgg

SEQ ID NO: 2919550 - RNA, 13 nt, Mycobacterium avium subsp. paratuberculosis
agggcgaccgccg

SEQ ID NO: 2919551 - RNA, 16 nt, Mycobacterium avium subsp. paratuberculosis
agggcgaccgccgcgu

SEQ ID NO: 2919552 - RNA, 15 nt, Mycobacterium avium subsp. paratuberculosis
agggcgacgccgcgg

SEQ ID NO: 2919553 - RNA, 16 nt, Mycobacterium avium subsp. paratuberculosis
agggcgacgccgcgga

SEQ ID NO: 2919554 - RNA, 13 nt, Mycobacterium avium subsp. paratuberculosis
agggcgacggcgg

SEQ ID NO: 2919555 - RNA, 15 nt, Mycobacterium avium subsp. paratuberculosis
agggugccggccacc

SEQ ID NO: 2919556 - RNA, 17 nt, Mycobacterium avium subsp. paratuberculosis
agggugccggccaccgg

SEQ ID NO: 2919557 - RNA, 18 nt, Mycobacterium avium subsp. paratuberculosis
agggugccggccaccggc

SEQ ID NO: 2919558 - RNA, 11 nt, Mycobacterium avium subsp. paratuberculosis
agggugcgccg

SEQ ID NO: 2919559 - RNA, 16 nt, Mycobacterium avium subsp. paratuberculosis
agggugcgcuggccga

SEQ ID NO: 2919560 - RNA, 12 nt, Mycobacterium avium subsp. paratuberculosis
agggugcucagc

SEQ ID NO: 2919561 - RNA, 14 nt, Mycobacterium avium subsp. paratuberculosis
agggugcucagccg

SEQ ID NO: 2919562 - RNA, 19 nt, Mycobacterium avium subsp. paratuberculosis
aggguggccagcacgcugc

SEQ ID NO: 2919563 - RNA, 15 nt, Mycobacterium avium subsp. paratuberculosis
aggguggccgccacc

SEQ ID NO: 2919564 - RNA, 18 nt, Mycobacterium avium subsp. paratuberculosis
aggguggccgccaccagg

SEQ ID NO: 2919565 - RNA, 16 nt, Mycobacterium avium subsp. paratuberculosis
aggguggucagcgucu

SEQ ID NO: 2919566 - RNA, 20 nt, Mycobacterium avium subsp. paratuberculosis
aggguggucagcgucucggc

SEQ ID NO: 2919567 - RNA, 21 nt, Mycobacterium avium subsp. paratuberculosis
aggguggugcccccgcccggc

SEQ ID NO: 2919568 - RNA, 13 nt, Mycobacterium avium subsp. paratuberculosis
agggugucccagc

SEQ ID NO: 2919569 - RNA, 13 nt, Mycobacterium avium subsp. paratuberculosis
agggugucgaaca

SEQ ID NO: 2919570 - RNA, 15 nt, Mycobacterium avium subsp. paratuberculosis
agggugucggcgggg

SEQ ID NO: 2919571 - RNA, 20 nt, Mycobacterium avium subsp. paratuberculosis
aggguucgguggccccgggc

SEQ ID NO: 2919572 - RNA, 15 nt, Mycobacterium avium subsp. paratuberculosis
aggguucucgcggcg

SEQ ID NO: 2919573 - RNA, 19 nt, Mycobacterium avium subsp. paratuberculosis
aggguucucgcggcggccg

SEQ ID NO: 2919574 - RNA, 13 nt, Mycobacterium avium subsp. paratuberculosis
aggguugccgcac

SEQ ID NO: 2919575 - RNA, 20 nt, Mycobacterium avium subsp. paratuberculosis
aggguuugggcgugcggccg

SEQ ID NO: 2919576 - RNA, 15 nt, Mycobacterium avium subsp. paratuberculosis
aggguuuucacgucg

SEQ ID NO: 2919577 - RNA, 21 nt, Mycobacterium avium subsp. paratuberculosis
aggguuuugcggaucggggcg

SEQ ID NO: 2919578 - RNA, 14 nt, Mycobacterium avium subsp. paratuberculosis
agguaaaccagcag

SEQ ID NO: 2919579 - RNA, 19 nt, Mycobacterium avium subsp. paratuberculosis
agguacacguagcggucca

SEQ ID NO: 2919580 - RNA, 22 nt, Mycobacterium avium subsp. paratuberculosis
agguacacguagcgguccagcg

SEQ ID NO: 2919581 - RNA, 15 nt, Mycobacterium avium subsp. paratuberculosis
agguaccggcgggcg

SEQ ID NO: 2919582 - RNA, 22 nt, Mycobacterium avium subsp. paratuberculosis
agguacgcggcguugccgccgg

SEQ ID NO: 2919583 - RNA, 19 nt, Mycobacterium avium subsp. paratuberculosis
agguacugggcguggucgc

SEQ ID NO: 2919584 - RNA, 14 nt, Mycobacterium avium subsp. paratuberculosis
agguagaggcuguc

SEQ ID NO: 2919585 - RNA, 21 nt, Mycobacterium avium subsp. paratuberculosis
agguagaggcuguccagcagc

SEQ ID NO: 2919586 - RNA, 19 nt, Mycobacterium avium subsp. paratuberculosis
agguagauucccaugucgc

SEQ ID NO: 2919587 - RNA, 15 nt, Mycobacterium avium subsp. paratuberculosis
agguagccgaggucg

SEQ ID NO: 2919588 - RNA, 22 nt, Mycobacterium avium subsp. paratuberculosis
agguagccgccguagccggcgg

SEQ ID NO: 2919589 - RNA, 15 nt, Mycobacterium avium subsp. paratuberculosis
agguagcgcagcccg

SEQ ID NO: 2919590 - RNA, 14 nt, Mycobacterium avium subsp. paratuberculosis
agguaggccaccgg

SEQ ID NO: 2919591 - RNA, 18 nt, Mycobacterium avium subsp. paratuberculosis
agguaggcgagaucaaca

SEQ ID NO: 2919592 - RNA, 14 nt, Mycobacterium avium subsp. paratuberculosis
agguaguagcgcgc

SEQ ID NO: 2919593 - RNA, 15 nt, Mycobacterium avium subsp. paratuberculosis
agguaguagcgcgcc

SEQ ID NO: 2919594 - RNA, 17 nt, Mycobacterium avium subsp. paratuberculosis
agguaguagcgcgccgg

SEQ ID NO: 2919595 - RNA, 20 nt, Mycobacterium avium subsp. paratuberculosis
agguagucccgcgccuggcg

SEQ ID NO: 2919596 - RNA, 13 nt, Mycobacterium avium subsp. paratuberculosis
agguagucgcgca

SEQ ID NO: 2919597 - RNA, 14 nt, Mycobacterium avium subsp. paratuberculosis
agguagucggccca

SEQ ID NO: 2919598 - RNA, 22 nt, Mycobacterium avium subsp. paratuberculosis
agguagucggcccaggccaaca

SEQ ID NO: 2919599 - RNA, 16 nt, Mycobacterium avium subsp. paratuberculosis
agguagugcgcgaugg

SEQ ID NO: 2919600 - RNA, 13 nt, Mycobacterium avium subsp. paratuberculosis
agguagugguggg

SEQ ID NO: 2919601 - RNA, 12 nt, Mycobacterium avium subsp. paratuberculosis
agguaucucuga

SEQ ID NO: 2919602 - RNA, 20 nt, Mycobacterium avium subsp. paratuberculosis
agguauucaucgcggccgcc

SEQ ID NO: 2919603 - RNA, 21 nt, Mycobacterium avium subsp. paratuberculosis
agguauucgcgggaggacagc

SEQ ID NO: 2919604 - RNA, 13 nt, Mycobacterium avium subsp. paratuberculosis
agguauucgucga

SEQ ID NO: 2919605 - RNA, 18 nt, Mycobacterium avium subsp. paratuberculosis
agguauuuggugaccugc

SEQ ID NO: 2919606 - RNA, 14 nt, Mycobacterium avium subsp. paratuberculosis
aggucaccgcggga

SEQ ID NO: 2919607 - RNA, 20 nt, Mycobacterium avium subsp. paratuberculosis
aggucagcagggugacgucg

SEQ ID NO: 2919608 - RNA, 17 nt, Mycobacterium avium subsp. paratuberculosis
aggucagcggcccgauc

SEQ ID NO: 2919609 - RNA, 22 nt, Mycobacterium avium subsp. paratuberculosis
aggucagcggcccgaucaccag

SEQ ID NO: 2919610 - RNA, 15 nt, Mycobacterium avium subsp. paratuberculosis
aggucauagggcucg

SEQ ID NO: 2919611 - RNA, 23 nt, Mycobacterium avium subsp. paratuberculosis
aggucaucgagccgagcaccggc

SEQ ID NO: 2919612 - RNA, 21 nt, Mycobacterium avium subsp. paratuberculosis
aggucauggcgaccgcgacgg

SEQ ID NO: 2919613 - RNA, 18 nt, Mycobacterium avium subsp. paratuberculosis
aggucaugguggcggcgc

SEQ ID NO: 2919614 - RNA, 21 nt, Mycobacterium avium subsp. paratuberculosis
agguccaccaggugaccggcc

SEQ ID NO: 2919615 - RNA, 14 nt, Mycobacterium avium subsp. paratuberculosis
agguccaccccgcc

SEQ ID NO: 2919616 - RNA, 22 nt, Mycobacterium avium subsp. paratuberculosis
agguccacccgccccgccgcgg

SEQ ID NO: 2919617 - RNA, 18 nt, Mycobacterium avium subsp. paratuberculosis
agguccaccguugucucg

SEQ ID NO: 2919618 - RNA, 23 nt, Mycobacterium avium subsp. paratuberculosis
agguccaccguugucucggcgcc

SEQ ID NO: 2919619 - RNA, 19 nt, Mycobacterium avium subsp. paratuberculosis
agguccagcguccgggcgu

SEQ ID NO: 2919620 - RNA, 21 nt, Mycobacterium avium subsp. paratuberculosis
agguccagcguccgggcguag

SEQ ID NO: 2919621 - RNA, 14 nt, Mycobacterium avium subsp. paratuberculosis
aggucccaggcgug

SEQ ID NO: 2919622 - RNA, 22 nt, Mycobacterium avium subsp. paratuberculosis
aggucccaggcguggucggcgc

SEQ ID NO: 2919623 - RNA, 20 nt, Mycobacterium avium subsp. paratuberculosis
agguccgccggugccagcaa

SEQ ID NO: 2919624 - RNA, 14 nt, Mycobacterium avium subsp. paratuberculosis
agguccgcgguggu

SEQ ID NO: 2919625 - RNA, 18 nt, Mycobacterium avium subsp. paratuberculosis
agguccgcggugguggug

SEQ ID NO: 2919626 - RNA, 17 nt, Mycobacterium avium subsp. paratuberculosis
agguccggcagcgcgcc

SEQ ID NO: 2919627 - RNA, 15 nt, Mycobacterium avium subsp. paratuberculosis
agguccggcgcgacc

SEQ ID NO: 2919628 - RNA, 17 nt, Mycobacterium avium subsp. paratuberculosis
agguccgggaacagcga

SEQ ID NO: 2919629 - RNA, 19 nt, Mycobacterium avium subsp. paratuberculosis
agguccgggaacagcgacu

SEQ ID NO: 2919630 - RNA, 23 nt, Mycobacterium avium subsp. paratuberculosis
agguccguggugaucgccgcgga

SEQ ID NO: 2919631 - RNA, 14 nt, Mycobacterium avium subsp. paratuberculosis
agguccucgaccuc

SEQ ID NO: 2919632 - RNA, 23 nt, Mycobacterium avium subsp. paratuberculosis
agguccucgaccucuucggcgcc

SEQ ID NO: 2919633 - RNA, 15 nt, Mycobacterium avium subsp. paratuberculosis
agguccucgcuggcg

SEQ ID NO: 2919634 - RNA, 22 nt, Mycobacterium avium subsp. paratuberculosis
agguccuucaacuugcgcgacg

SEQ ID NO: 2919635 - RNA, 14 nt, Mycobacterium avium subsp. paratuberculosis
aggucgaaggcggc

SEQ ID NO: 2919636 - RNA, 21 nt, Mycobacterium avium subsp. paratuberculosis
aggucgaaggcggccgcgagc

SEQ ID NO: 2919637 - RNA, 14 nt, Mycobacterium avium subsp. paratuberculosis
aggucgaagggcau

SEQ ID NO: 2919638 - RNA, 14 nt, Mycobacterium avium subsp. paratuberculosis
aggucgaccaucug

SEQ ID NO: 2919639 - RNA, 20 nt, Mycobacterium avium subsp. paratuberculosis
aggucgaccgcgcaccggcg

SEQ ID NO: 2919640 - RNA, 17 nt, Mycobacterium avium subsp. paratuberculosis
aggugaccaucgggucg

SEQ ID NO: 2919641 - RNA, 23 nt, Mycobacterium avium subsp. paratuberculosis
aggugaccaucgggucgucggcg

SEQ ID NO: 2919642 - RNA, 13 nt, Mycobacterium avium subsp. paratuberculosis
aggugaccggccu

SEQ ID NO: 2919643 - RNA, 14 nt, Mycobacterium avium subsp. paratuberculosis
aggugaccggccug

SEQ ID NO: 2919644 - RNA, 22 nt, Mycobacterium avium subsp. paratuberculosis
aggugaccggcgaggugcgcca

SEQ ID NO: 2919645 - RNA, 18 nt, Mycobacterium avium subsp. paratuberculosis
aggugaccucgagcagcg

SEQ ID NO: 2919646 - RNA, 15 nt, Mycobacterium avium subsp. paratuberculosis
aggugacgucgccga

SEQ ID NO: 2919647 - RNA, 16 nt, Mycobacterium avium subsp. paratuberculosis
aggugacgucgccgau

SEQ ID NO: 2919648 - RNA, 19 nt, Mycobacterium avium subsp. paratuberculosis
aggugacgucgcgccgcuc

SEQ ID NO: 2919649 - RNA, 23 nt, Mycobacterium avium subsp. paratuberculosis
aggugacgucgcgccgcucggcc

SEQ ID NO: 2919650 - RNA, 19 nt, Mycobacterium avium subsp. paratuberculosis
aggugagcaacgccagcgc

SEQ ID NO: 2919651 - RNA, 20 nt, Mycobacterium avium subsp. paratuberculosis
aggugagcaacgccagcgcg

SEQ ID NO: 2919652 - RNA, 13 nt, Mycobacterium avium subsp. paratuberculosis
aggugagccgggu

SEQ ID NO: 2919653 - RNA, 14 nt, Mycobacterium avium subsp. paratuberculosis
aggugagccgggug

SEQ ID NO: 2919654 - RNA, 15 nt, Mycobacterium avium subsp. paratuberculosis
aggugaucgccagcc

SEQ ID NO: 2919655 - RNA, 19 nt, Mycobacterium avium subsp. paratuberculosis
aggugaucgcgaacgcgcc

SEQ ID NO: 2919656 - RNA, 16 nt, Mycobacterium avium subsp. paratuberculosis
aggugaucguguuguu

SEQ ID NO: 2919657 - RNA, 24 nt, Mycobacterium avium subsp. paratuberculosis
aggugaugaaaaccgggcccucgu

SEQ ID NO: 2919658 - RNA, 18 nt, Mycobacterium avium subsp. paratuberculosis
aggugaugccguccagca

SEQ ID NO: 2919659 - RNA, 14 nt, Mycobacterium avium subsp. paratuberculosis
aggugauggcccgc

SEQ ID NO: 2919660 - RNA, 23 nt, Mycobacterium avium subsp. paratuberculosis
aggugauguuggccgcgacgccg

SEQ ID NO: 2919661 - RNA, 18 nt, Mycobacterium avium subsp. paratuberculosis
aggugauucgcgcggcgc

SEQ ID NO: 2919662 - RNA, 14 nt, Mycobacterium avium subsp. paratuberculosis
aggugcaccaccca

SEQ ID NO: 2919663 - RNA, 15 nt, Mycobacterium avium subsp. paratuberculosis
aggugcaccacccag

SEQ ID NO: 2919664 - RNA, 21 nt, Mycobacterium avium subsp. paratuberculosis
aggugcaccacccaggccacc

SEQ ID NO: 2919665 - RNA, 16 nt, Mycobacterium avium subsp. paratuberculosis
aggugcacccgcggcg

SEQ ID NO: 2919666 - RNA, 15 nt, Mycobacterium avium subsp. paratuberculosis
aggugcacgcccaga

SEQ ID NO: 2919667 - RNA, 19 nt, Mycobacterium avium subsp. paratuberculosis
aggugcacgccgagcagca

SEQ ID NO: 2919668 - RNA, 18 nt, Mycobacterium avium subsp. paratuberculosis
aggugcagcgggcuggcg

SEQ ID NO: 2919669 - RNA, 21 nt, Mycobacterium avium subsp. paratuberculosis
aggugcagcgugguccagcac

SEQ ID NO: 2919670 - RNA, 19 nt, Mycobacterium avium subsp. paratuberculosis
aggugcauccagucggcgc

SEQ ID NO: 2919671 - RNA, 23 nt, Mycobacterium avium subsp. paratuberculosis
aggugcauccagucggcgccgau

SEQ ID NO: 2919672 - RNA, 15 nt, Mycobacterium avium subsp. paratuberculosis
aggugcaucgccacc

SEQ ID NO: 2919673 - RNA, 17 nt, Mycobacterium avium subsp. paratuberculosis
aggugcaucgccaccgu

SEQ ID NO: 2919674 - RNA, 16 nt, Mycobacterium avium subsp. paratuberculosis
aggugcccgagcugau

SEQ ID NO: 2919675 - RNA, 23 nt, Mycobacterium avium subsp. paratuberculosis
aggugcccgagcugaucgcggcc

SEQ ID NO: 2919676 - RNA, 21 nt, Mycobacterium avium subsp. paratuberculosis
aggugcccgggucgugcggcg

SEQ ID NO: 2919677 - RNA, 12 nt, Mycobacterium avium subsp. paratuberculosis
aggugcccuccu

SEQ ID NO: 2919678 - RNA, 18 nt, Mycobacterium avium subsp. paratuberculosis
aggugcccuccucgccgg

SEQ ID NO: 2919679 - RNA, 15 nt, Mycobacterium avium subsp. paratuberculosis
aggugccgcgcagca

SEQ ID NO: 2919680 - RNA, 18 nt, Mycobacterium avium subsp. paratuberculosis
aggugccgcgcagcaccg

SEQ ID NO: 2919681 - RNA, 15 nt, Mycobacterium avium subsp. paratuberculosis
aggugccgcgcggca

SEQ ID NO: 2919682 - RNA, 15 nt, Mycobacterium avium subsp. paratuberculosis
aggugccggccgcga

SEQ ID NO: 2919683 - RNA, 16 nt, Mycobacterium avium subsp. paratuberculosis
aggugcgccgccgcgu

SEQ ID NO: 2919684 - RNA, 15 nt, Mycobacterium avium subsp. paratuberculosis
aggugcgccgcucgu

SEQ ID NO: 2919685 - RNA, 16 nt, Mycobacterium avium subsp. paratuberculosis
aggugcgccggauucg

SEQ ID NO: 2919686 - RNA, 17 nt, Mycobacterium avium subsp. paratuberculosis
aggugcgcggucagcgc

SEQ ID NO: 2919687 - RNA, 13 nt, Mycobacterium avium subsp. paratuberculosis
aggugcggcaacc

SEQ ID NO: 2919688 - RNA, 21 nt, Mycobacterium avium subsp. paratuberculosis
aggugcgggucucgaaccggg

SEQ ID NO: 2919689 - RNA, 17 nt, Mycobacterium avium subsp. paratuberculosis
aggugcucgacggcacc

SEQ ID NO: 2919690 - RNA, 20 nt, Mycobacterium avium subsp. paratuberculosis
aggugcucgacggcacccgg

SEQ ID NO: 2919691 - RNA, 16 nt, Mycobacterium avium subsp. paratuberculosis
aggugcucgccggcgc

SEQ ID NO: 2919692 - RNA, 21 nt, Mycobacterium avium subsp. paratuberculosis
aggugcucgccggcgcggaac

SEQ ID NO: 2919693 - RNA, 20 nt, Mycobacterium avium subsp. paratuberculosis
aggugcugaaugaacgaccu

SEQ ID NO: 2919694 - RNA, 15 nt, Mycobacterium avium subsp. paratuberculosis
aggugcugucgucgc

SEQ ID NO: 2919695 - RNA, 20 nt, Mycobacterium avium subsp. paratuberculosis
aggugcugucgucgcccuga

SEQ ID NO: 2919696 - RNA, 15 nt, Mycobacterium avium subsp. paratuberculosis
aggugcuuggucagc

SEQ ID NO: 2919697 - RNA, 19 nt, Mycobacterium avium subsp. paratuberculosis
agguggacgagcagccgca

SEQ ID NO: 2919698 - RNA, 21 nt, Mycobacterium avium subsp. paratuberculosis
agguggaugcgagccagcugc

SEQ ID NO: 2919699 - RNA, 19 nt, Mycobacterium avium subsp. paratuberculosis
agguggauugucggccgcc

SEQ ID NO: 2919700 - RNA, 22 nt, Mycobacterium avium subsp. paratuberculosis
agguggccagcacgaucgggua

SEQ ID NO: 2919701 - RNA, 15 nt, Mycobacterium avium subsp. paratuberculosis
agguggccagccggg

SEQ ID NO: 2919702 - RNA, 23 nt, Mycobacterium avium subsp. paratuberculosis
agguggccaugggguugaccuug

SEQ ID NO: 2919703 - RNA, 16 nt, Mycobacterium avium subsp. paratuberculosis
agguggcccagccgcu

SEQ ID NO: 2919704 - RNA, 14 nt, Mycobacterium avium subsp. paratuberculosis
agguggcccgccac

SEQ ID NO: 2919705 - RNA, 17 nt, Mycobacterium avium subsp. paratuberculosis
agguggcccgccacgug

SEQ ID NO: 2919706 - RNA, 15 nt, Mycobacterium avium subsp. paratuberculosis
agguggccgaucagc

SEQ ID NO: 2919707 - RNA, 13 nt, Mycobacterium avium subsp. paratuberculosis
agguggccgccag

SEQ ID NO: 2919708 - RNA, 14 nt, Mycobacterium avium subsp. paratuberculosis
agguggcgaccacc

SEQ ID NO: 2919709 - RNA, 15 nt, Mycobacterium avium subsp. paratuberculosis
agguggcgaccaccg

SEQ ID NO: 2919710 - RNA, 12 nt, Mycobacterium avium subsp. paratuberculosis
agguggcgcccg

SEQ ID NO: 2919711 - RNA, 15 nt, Mycobacterium avium subsp. paratuberculosis
agguggcgcccggag

SEQ ID NO: 2919712 - RNA, 18 nt, Mycobacterium avium subsp. paratuberculosis
agguggcgccgguaggcg

SEQ ID NO: 2919713 - RNA, 14 nt, Mycobacterium avium subsp. paratuberculosis
agguggcgccuccg

SEQ ID NO: 2919714 - RNA, 21 nt, Mycobacterium avium subsp. paratuberculosis
agguggcgccuccgcccgggu

SEQ ID NO: 2919715 - RNA, 18 nt, Mycobacterium avium subsp. paratuberculosis
agguggcguagucgucga

SEQ ID NO: 2919716 - RNA, 20 nt, Mycobacterium avium subsp. paratuberculosis
agguggcguagucgucgauc

SEQ ID NO: 2919717 - RNA, 20 nt, Mycobacterium avium subsp. paratuberculosis
agguggcgucggcgucgaac

SEQ ID NO: 2919718 - RNA, 17 nt, Mycobacterium avium subsp. paratuberculosis
aggugggcaccagcugc

SEQ ID NO: 2919719 - RNA, 13 nt, Mycobacterium avium subsp. paratuberculosis
aggugggcagcgc

SEQ ID NO: 2919720 - RNA, 19 nt, Mycobacterium avium subsp. paratuberculosis
aggugggcagcgcggccag

SEQ ID NO: 2919721 - RNA, 12 nt, Mycobacterium avium subsp. paratuberculosis
aggugggcgcgc

SEQ ID NO: 2919722 - RNA, 19 nt, Mycobacterium avium subsp. paratuberculosis
aggugggcgcgcagcacca

SEQ ID NO: 2919723 - RNA, 17 nt, Mycobacterium avium subsp. paratuberculosis
aggugggcggccaccac

SEQ ID NO: 2919724 - RNA, 13 nt, Mycobacterium avium subsp. paratuberculosis
aggugggcggugc

SEQ ID NO: 2919725 - RNA, 17 nt, Mycobacterium avium subsp. paratuberculosis
aguccccgguucaccag

SEQ ID NO: 2919726 - RNA, 21 nt, Mycobacterium avium subsp. paratuberculosis
agucccgcgccuggcgcaggg

SEQ ID NO: 2919727 - RNA, 15 nt, Mycobacterium avium subsp. paratuberculosis
agucccgcgcggcgc

SEQ ID NO: 2919728 - RNA, 16 nt, Mycobacterium avium subsp. paratuberculosis
agucccgcgcggcgca

SEQ ID NO: 2919729 - RNA, 18 nt, Mycobacterium avium subsp. paratuberculosis
agucccggcgcaccaggc

SEQ ID NO: 2919730 - RNA, 20 nt, Mycobacterium avium subsp. paratuberculosis
aguccgacgagucgacgcug

SEQ ID NO: 2919731 - RNA, 14 nt, Mycobacterium avium subsp. paratuberculosis
aguccgacgauccg

SEQ ID NO: 2919732 - RNA, 17 nt, Mycobacterium avium subsp. paratuberculosis
aguccgccagggugccg

SEQ ID NO: 2919733 - RNA, 21 nt, Mycobacterium avium subsp. paratuberculosis
aguccgccagggugccgcugc

SEQ ID NO: 2919734 - RNA, 13 nt, Mycobacterium avium subsp. paratuberculosis
aguccgccccgau

SEQ ID NO: 2919735 - RNA, 15 nt, Mycobacterium avium subsp. paratuberculosis
aguccgccgacagcg

SEQ ID NO: 2919736 - RNA, 18 nt, Mycobacterium avium subsp. paratuberculosis
aguccgccgacagcggga

SEQ ID NO: 2919737 - RNA, 13 nt, Mycobacterium avium subsp. paratuberculosis
aguccgccgccgg

SEQ ID NO: 2919738 - RNA, 16 nt, Mycobacterium avium subsp. paratuberculosis
aguccgccgccgggcc

SEQ ID NO: 2919739 - RNA, 14 nt, Mycobacterium avium subsp. paratuberculosis
aguccgccggagac

SEQ ID NO: 2919740 - RNA, 13 nt, Mycobacterium avium subsp. paratuberculosis
aguccgcgccggu

SEQ ID NO: 2919741 - RNA, 17 nt, Mycobacterium avium subsp. paratuberculosis
aguccggacacggccag

SEQ ID NO: 2919742 - RNA, 22 nt, Mycobacterium avium subsp. paratuberculosis
aguccggacacggccagcgccg

SEQ ID NO: 2919743 - RNA, 14 nt, Mycobacterium avium subsp. paratuberculosis
aguccggcagcagc

SEQ ID NO: 2919744 - RNA, 15 nt, Mycobacterium avium subsp. paratuberculosis
aguccggcagcagcg

SEQ ID NO: 2919745 - RNA, 22 nt, Mycobacterium avium subsp. paratuberculosis
aguccggccagcguuugagcac

SEQ ID NO: 2919746 - RNA, 17 nt, Mycobacterium avium subsp. paratuberculosis
aguccggccaggucgcc

SEQ ID NO: 2919747 - RNA, 21 nt, Mycobacterium avium subsp. paratuberculosis
aguccggccaggucgccgcgc

SEQ ID NO: 2919748 - RNA, 20 nt, Mycobacterium avium subsp. paratuberculosis
aguccggccgugaugcgccg

SEQ ID NO: 2919749 - RNA, 15 nt, Mycobacterium avium subsp. paratuberculosis
aguccggcgcccggc

SEQ ID NO: 2919750 - RNA, 20 nt, Mycobacterium avium subsp. paratuberculosis
aguccggcggucagcaccgu

SEQ ID NO: 2919751 - RNA, 15 nt, Mycobacterium avium subsp. paratuberculosis
aguccgggccgccgg

SEQ ID NO: 2919752 - RNA, 16 nt, Mycobacterium avium subsp. paratuberculosis
aguccgggccgccggc

SEQ ID NO: 2919753 - RNA, 21 nt, Mycobacterium avium subsp. paratuberculosis
aguccuccgucgagucggcca

SEQ ID NO: 2919754 - RNA, 20 nt, Mycobacterium avium subsp. paratuberculosis
aguccucgcgguugcgggug

SEQ ID NO: 2919755 - RNA, 23 nt, Mycobacterium avium subsp. paratuberculosis
aguccucgcgguugcggguggcg

SEQ ID NO: 2919756 - RNA, 18 nt, Mycobacterium avium subsp. paratuberculosis
aguccucgguggccaccu

SEQ ID NO: 2919757 - RNA, 18 nt, Mycobacterium avium subsp. paratuberculosis
aguccuugaccuugggca

SEQ ID NO: 2919758 - RNA, 17 nt, Mycobacterium avium subsp. paratuberculosis
aguccuuguggcccagg

SEQ ID NO: 2919759 - RNA, 20 nt, Mycobacterium avium subsp. paratuberculosis
agucgaagaugucgcggcgc

SEQ ID NO: 2919760 - RNA, 19 nt, Mycobacterium avium subsp. paratuberculosis
agucgaagccguggcaggc

SEQ ID NO: 2919761 - RNA, 14 nt, Mycobacterium avium subsp. paratuberculosis
agucgaagcggugc

SEQ ID NO: 2919762 - RNA, 24 nt, Mycobacterium avium subsp. paratuberculosis
agucgaagcggugcaccaccgugc

SEQ ID NO: 2919763 - RNA, 14 nt, Mycobacterium avium subsp. paratuberculosis
agucgaccacccgc

SEQ ID NO: 2919764 - RNA, 21 nt, Mycobacterium avium subsp. paratuberculosis
agucgaccgggaucguguggc

SEQ ID NO: 2919765 - RNA, 22 nt, Mycobacterium avium subsp. paratuberculosis
agucgaccgggaucguguggcc

SEQ ID NO: 2919766 - RNA, 23 nt, Mycobacterium avium subsp. paratuberculosis
agucgaccggggcgccccgcugg

SEQ ID NO: 2919767 - RNA, 13 nt, Mycobacterium avium subsp. paratuberculosis
agucgacgcugug

SEQ ID NO: 2919768 - RNA, 12 nt, Mycobacterium avium subsp. paratuberculosis
agucgacggcgg

SEQ ID NO: 2919769 - RNA, 14 nt, Mycobacterium avium subsp. paratuberculosis
agucgagcaccgcg

SEQ ID NO: 2919770 - RNA, 17 nt, Mycobacterium avium subsp. paratuberculosis
agucgagcaccgcgacc

SEQ ID NO: 2919771 - RNA, 20 nt, Mycobacterium avium subsp. paratuberculosis
agucgagguugaugccgacg

SEQ ID NO: 2919772 - RNA, 16 nt, Mycobacterium avium subsp. paratuberculosis
agucgaucgccagcgc

SEQ ID NO: 2919773 - RNA, 15 nt, Mycobacterium avium subsp. paratuberculosis
agucgaugaccucgc

SEQ ID NO: 2919774 - RNA, 20 nt, Mycobacterium avium subsp. paratuberculosis
agucgaugaccucgcgcccg

SEQ ID NO: 2919775 - RNA, 22 nt, Mycobacterium avium subsp. paratuberculosis
agucgaugcccgcguccugcag

SEQ ID NO: 2919776 - RNA, 16 nt, Mycobacterium avium subsp. paratuberculosis
agucgauggccucguc

SEQ ID NO: 2919777 - RNA, 17 nt, Mycobacterium avium subsp. paratuberculosis
agucgauucaucgccga

SEQ ID NO: 2919778 - RNA, 18 nt, Mycobacterium avium subsp. paratuberculosis
agucgauucaucgccgaa

SEQ ID NO: 2919779 - RNA, 17 nt, Mycobacterium avium subsp. paratuberculosis
agucgauugccgcggcc

SEQ ID NO: 2919780 - RNA, 21 nt, Mycobacterium avium subsp. paratuberculosis
agucgauugccgcggccgcgu

SEQ ID NO: 2919781 - RNA, 15 nt, Mycobacterium avium subsp. paratuberculosis
agucgcaggccccgg

SEQ ID NO: 2919782 - RNA, 17 nt, Mycobacterium avium subsp. paratuberculosis
agucgcccagcagcccg

SEQ ID NO: 2919783 - RNA, 20 nt, Mycobacterium avium subsp. paratuberculosis
agucgcccagcagcccggcc

SEQ ID NO: 2919784 - RNA, 21 nt, Mycobacterium avium subsp. paratuberculosis
agucgcccgcguugcggcgca

SEQ ID NO: 2919785 - RNA, 12 nt, Mycobacterium avium subsp. paratuberculosis
agucgccgcccg

SEQ ID NO: 2919786 - RNA, 22 nt, Mycobacterium avium subsp. paratuberculosis
agucgccgccgcgcaccgcgcg

SEQ ID NO: 2919787 - RNA, 15 nt, Mycobacterium avium subsp. paratuberculosis
agucgccggccucca

SEQ ID NO: 2919788 - RNA, 23 nt, Mycobacterium avium subsp. paratuberculosis
agucgccgguguagaucggcuca

SEQ ID NO: 2919789 - RNA, 17 nt, Mycobacterium avium subsp. paratuberculosis
agucgcgcaccauccgc

SEQ ID NO: 2919790 - RNA, 15 nt, Mycobacterium avium subsp. paratuberculosis
agucgcgcagcugcg

SEQ ID NO: 2919791 - RNA, 17 nt, Mycobacterium avium subsp. paratuberculosis
agucgcgcagcugcgcc

SEQ ID NO: 2919792 - RNA, 19 nt, Mycobacterium avium subsp. paratuberculosis
agucgcgcagcugcgccgc

SEQ ID NO: 2919793 - RNA, 13 nt, Mycobacterium avium subsp. paratuberculosis
agucgcgccgagg

SEQ ID NO: 2919794 - RNA, 22 nt, Mycobacterium avium subsp. paratuberculosis
agucgcgccgcgucgcgccgcc

SEQ ID NO: 2919795 - RNA, 15 nt, Mycobacterium avium subsp. paratuberculosis
agucgcggaucauga

SEQ ID NO: 2919796 - RNA, 16 nt, Mycobacterium avium subsp. paratuberculosis
agucgcggaugcgggc

SEQ ID NO: 2919797 - RNA, 20 nt, Mycobacterium avium subsp. paratuberculosis
agucgcggaugcgggcgcug

SEQ ID NO: 2919798 - RNA, 22 nt, Mycobacterium avium subsp. paratuberculosis
agucgcggaugcgggcgcugcc

SEQ ID NO: 2919799 - RNA, 15 nt, Mycobacterium avium subsp. paratuberculosis
agucgcgggcagccg

SEQ ID NO: 2919800 - RNA, 18 nt, Mycobacterium avium subsp. paratuberculosis
agucgcgggcgagccgac

SEQ ID NO: 2919801 - RNA, 23 nt, Mycobacterium avium subsp. paratuberculosis
agucgcgggcgagccgacagucg

SEQ ID NO: 2919802 - RNA, 19 nt, Mycobacterium avium subsp. paratuberculosis
agucgcgggcggggcgccg

SEQ ID NO: 2919803 - RNA, 13 nt, Mycobacterium avium subsp. paratuberculosis
agucgcucggcgg

SEQ ID NO: 2919804 - RNA, 14 nt, Mycobacterium avium subsp. paratuberculosis
agucgcucggcggc

SEQ ID NO: 2919805 - RNA, 16 nt, Mycobacterium avium subsp. paratuberculosis
agucgcucggcggcga

SEQ ID NO: 2919806 - RNA, 23 nt, Mycobacterium avium subsp. paratuberculosis
agucgcucggcggcgacgguguc

SEQ ID NO: 2919807 - RNA, 20 nt, Mycobacterium avium subsp. paratuberculosis
agucgcugaggcugcgggug

SEQ ID NO: 2919808 - RNA, 17 nt, Mycobacterium avium subsp. paratuberculosis
agucgcugcagcauuuc

SEQ ID NO: 2919809 - RNA, 18 nt, Mycobacterium avium subsp. paratuberculosis
agugccggcgcaccgcgu

SEQ ID NO: 2919810 - RNA, 16 nt, Mycobacterium avium subsp. paratuberculosis
agugccgggccagcug

SEQ ID NO: 2919811 - RNA, 16 nt, Mycobacterium avium subsp. paratuberculosis
agugccgguccagccg

SEQ ID NO: 2919812 - RNA, 20 nt, Mycobacterium avium subsp. paratuberculosis
agugccgguccagccgccgc

SEQ ID NO: 2919813 - RNA, 19 nt, Mycobacterium avium subsp. paratuberculosis
agugccguugagcguggac

SEQ ID NO: 2919814 - RNA, 20 nt, Mycobacterium avium subsp. paratuberculosis
agugcgagaaaaucgcccgc

SEQ ID NO: 2919815 - RNA, 14 nt, Mycobacterium avium subsp. paratuberculosis
agugcgaucgccgu

SEQ ID NO: 2919816 - RNA, 20 nt, Mycobacterium avium subsp. paratuberculosis
agugcgaucgccgugagauc

SEQ ID NO: 2919817 - RNA, 12 nt, Mycobacterium avium subsp. paratuberculosis
agugcgcaggcg

SEQ ID NO: 2919818 - RNA, 18 nt, Mycobacterium avium subsp. paratuberculosis
agugcgcaggcggcgcgc

SEQ ID NO: 2919819 - RNA, 18 nt, Mycobacterium avium subsp. paratuberculosis
agugcgccgugcagcacg

SEQ ID NO: 2919820 - RNA, 22 nt, Mycobacterium avium subsp. paratuberculosis
agugcgcgauggcgugccggcg

SEQ ID NO: 2919821 - RNA, 16 nt, Mycobacterium avium subsp. paratuberculosis
agugcggcccacccgg

SEQ ID NO: 2919822 - RNA, 14 nt, Mycobacterium avium subsp. paratuberculosis
agugcggcgcggug

SEQ ID NO: 2919823 - RNA, 23 nt, Mycobacterium avium subsp. paratuberculosis
agugcgggcaucggcuggucggc

SEQ ID NO: 2919824 - RNA, 19 nt, Mycobacterium avium subsp. paratuberculosis
agugcggucgguucaucca

SEQ ID NO: 2919825 - RNA, 20 nt, Mycobacterium avium subsp. paratuberculosis
agugcggucgguucauccac

SEQ ID NO: 2919826 - RNA, 19 nt, Mycobacterium avium subsp. paratuberculosis
agugcgugaccugcugggc

SEQ ID NO: 2919827 - RNA, 17 nt, Mycobacterium avium subsp. paratuberculosis
agugcuacugccgacgc

SEQ ID NO: 2919828 - RNA, 19 nt, Mycobacterium avium subsp. paratuberculosis
agugcucgaacgcgccgau

SEQ ID NO: 2919829 - RNA, 16 nt, Mycobacterium avium subsp. paratuberculosis
agugcucgauggccag

SEQ ID NO: 2919830 - RNA, 19 nt, Mycobacterium avium subsp. paratuberculosis
agugcucggcgucccgcgc

SEQ ID NO: 2919831 - RNA, 21 nt, Mycobacterium avium subsp. paratuberculosis
agugcuucuugaagaaccggg

SEQ ID NO: 2919832 - RNA, 21 nt, Mycobacterium avium subsp. paratuberculosis
agugcuugcccugguacgcgc

SEQ ID NO: 2919833 - RNA, 23 nt, Mycobacterium avium subsp. paratuberculosis
agugcuugcccugguacgcgccg

SEQ ID NO: 2919834 - RNA, 21 nt, Mycobacterium avium subsp. paratuberculosis
agugcuugggcacguacgcgc

SEQ ID NO: 2919835 - RNA, 16 nt, Mycobacterium avium subsp. paratuberculosis
aguggaagucagcgcg

SEQ ID NO: 2919836 - RNA, 16 nt, Mycobacterium avium subsp. paratuberculosis
aguggacaugcagccg

SEQ ID NO: 2919837 - RNA, 19 nt, Mycobacterium avium subsp. paratuberculosis
aguggacaugcagccgccg

SEQ ID NO: 2919838 - RNA, 22 nt, Mycobacterium avium subsp. paratuberculosis
aguggacaugcagccgccgcgg

SEQ ID NO: 2919839 - RNA, 18 nt, Mycobacterium avium subsp. paratuberculosis
aguggccggcguccaggc

SEQ ID NO: 2919840 - RNA, 15 nt, Mycobacterium avium subsp. paratuberculosis
aguggcgugcggccu

SEQ ID NO: 2919841 - RNA, 19 nt, Mycobacterium avium subsp. paratuberculosis
aguggcgugcggccucggc

SEQ ID NO: 2919842 - RNA, 22 nt, Mycobacterium avium subsp. paratuberculosis
aguggcugcacgucacgggcca

SEQ ID NO: 2919843 - RNA, 23 nt, Mycobacterium avium subsp. paratuberculosis
aguggcugcacgucacgggccag

SEQ ID NO: 2919844 - RNA, 12 nt, Mycobacterium avium subsp. paratuberculosis
agugggccauca

SEQ ID NO: 2919845 - RNA, 15 nt, Mycobacterium avium subsp. paratuberculosis
agugggucggcggcu

SEQ ID NO: 2919846 - RNA, 19 nt, Mycobacterium avium subsp. paratuberculosis
agugguaccggguggccgu

SEQ ID NO: 2919847 - RNA, 14 nt, Mycobacterium avium subsp. paratuberculosis
agugguccaccgcc

SEQ ID NO: 2919848 - RNA, 18 nt, Mycobacterium avium subsp. paratuberculosis
agugguccaccgccgcgc

SEQ ID NO: 2919849 - RNA, 15 nt, Mycobacterium avium subsp. paratuberculosis
aguggucggccgccc

SEQ ID NO: 2919850 - RNA, 15 nt, Mycobacterium avium subsp. paratuberculosis
aguggucgucgucga

SEQ ID NO: 2919851 - RNA, 13 nt, Mycobacterium avium subsp. paratuberculosis
aguggugcaggug

SEQ ID NO: 2919852 - RNA, 22 nt, Mycobacterium avium subsp. paratuberculosis
agugguugagcagcagaccgcc

SEQ ID NO: 2919853 - RNA, 15 nt, Mycobacterium avium subsp. paratuberculosis
agugucguggcgugc

SEQ ID NO: 2919854 - RNA, 17 nt, Mycobacterium avium subsp. paratuberculosis
agugucguggcgugccg

SEQ ID NO: 2919855 - RNA, 13 nt, Mycobacterium avium subsp. paratuberculosis
aguucaccaccgc

SEQ ID NO: 2919856 - RNA, 18 nt, Mycobacterium avium subsp. paratuberculosis
aguucaccaccgcgcugc

SEQ ID NO: 2919857 - RNA, 15 nt, Mycobacterium avium subsp. paratuberculosis
aguucagaagucgcc

SEQ ID NO: 2919858 - RNA, 14 nt, Mycobacterium avium subsp. paratuberculosis
aguucagcagccgg

SEQ ID NO: 2919859 - RNA, 16 nt, Mycobacterium avium subsp. paratuberculosis
aguucagcagccggca

SEQ ID NO: 2919860 - RNA, 15 nt, Mycobacterium avium subsp. paratuberculosis
aguucagcgucgaug

SEQ ID NO: 2919861 - RNA, 19 nt, Mycobacterium avium subsp. paratuberculosis
aguucaucguggaauccuu

SEQ ID NO: 2919862 - RNA, 12 nt, Mycobacterium avium subsp. paratuberculosis
aguuccagccga

SEQ ID NO: 2919863 - RNA, 17 nt, Mycobacterium avium subsp. paratuberculosis
aguucccggccagcgca

SEQ ID NO: 2919864 - RNA, 22 nt, Mycobacterium avium subsp. paratuberculosis
aguuccgacaucagugcgggca

SEQ ID NO: 2919865 - RNA, 17 nt, Mycobacterium avium subsp. paratuberculosis
aguuccucgugcgugcg

SEQ ID NO: 2919866 - RNA, 13 nt, Mycobacterium avium subsp. paratuberculosis
aguuccugcaugc

SEQ ID NO: 2919867 - RNA, 23 nt, Mycobacterium avium subsp. paratuberculosis
aguuccugcgaccgccgccgcga

SEQ ID NO: 2919868 - RNA, 17 nt, Mycobacterium avium subsp. paratuberculosis
aguuccuugcgcagcac

SEQ ID NO: 2919869 - RNA, 20 nt, Mycobacterium avium subsp. paratuberculosis
aguucgaccggcaccagcag

SEQ ID NO: 2919870 - RNA, 16 nt, Mycobacterium avium subsp. paratuberculosis
aguucgaccucgguga

SEQ ID NO: 2919871 - RNA, 18 nt, Mycobacterium avium subsp. paratuberculosis
aguucgacguagcccgcc

SEQ ID NO: 2919872 - RNA, 17 nt, Mycobacterium avium subsp. paratuberculosis
aguucgagcgccgcggc

SEQ ID NO: 2919873 - RNA, 22 nt, Mycobacterium avium subsp. paratuberculosis
aguucgagguaggcgagaucaa

SEQ ID NO: 2919874 - RNA, 16 nt, Mycobacterium avium subsp. paratuberculosis
aguucgaucagcagcu

SEQ ID NO: 2919875 - RNA, 22 nt, Mycobacterium avium subsp. paratuberculosis
aguucgcaccccaccgacagcc

SEQ ID NO: 2919876 - RNA, 13 nt, Mycobacterium avium subsp. paratuberculosis
aguucgccaccac

SEQ ID NO: 2919877 - RNA, 13 nt, Mycobacterium avium subsp. paratuberculosis
aguucgccgccgc

SEQ ID NO: 2919878 - RNA, 14 nt, Mycobacterium avium subsp. paratuberculosis
aguucgccgccgcc

SEQ ID NO: 2919879 - RNA, 18 nt, Mycobacterium avium subsp. paratuberculosis
aguucgccgccgccagca

SEQ ID NO: 2919880 - RNA, 14 nt, Mycobacterium avium subsp. paratuberculosis
aguucgccgucgac

SEQ ID NO: 2919881 - RNA, 21 nt, Mycobacterium avium subsp. paratuberculosis
aguucgccgucgacggugauc

SEQ ID NO: 2919882 - RNA, 17 nt, Mycobacterium avium subsp. paratuberculosis
aguucgcggcgcagcac

SEQ ID NO: 2919883 - RNA, 19 nt, Mycobacterium avium subsp. paratuberculosis
aguucgcuggcggggcgug

SEQ ID NO: 2919884 - RNA, 20 nt, Mycobacterium avium subsp. paratuberculosis
aguucggcaucccggagaac

SEQ ID NO: 2919885 - RNA, 14 nt, Mycobacterium avium subsp. paratuberculosis
aguucggccaccgc

SEQ ID NO: 2919886 - RNA, 11 nt, Mycobacterium avium subsp. paratuberculosis
aguucggccag

SEQ ID NO: 2919887 - RNA, 22 nt, Mycobacterium avium subsp. paratuberculosis
aguucggccagaucggccaggu

SEQ ID NO: 2919888 - RNA, 16 nt, Mycobacterium avium subsp. paratuberculosis
aguucggccagcgcgg

SEQ ID NO: 2919889 - RNA, 21 nt, Mycobacterium avium subsp. paratuberculosis
aguucggugaacugcagcccg

SEQ ID NO: 2919890 - RNA, 16 nt, Mycobacterium avium subsp. paratuberculosis
aguucguccacgcugg

SEQ ID NO: 2919891 - RNA, 14 nt, Mycobacterium avium subsp. paratuberculosis
aguucgucggccgu

SEQ ID NO: 2919892 - RNA, 12 nt, Mycobacterium avium subsp. paratuberculosis
aguucucgccgu

SEQ ID NO: 2919893 - RNA, 19 nt, Mycobacterium avium subsp. paratuberculosis
aguucucgccgugcagcac

SEQ ID NO: 2919894 - RNA, 22 nt, Mycobacterium avium subsp. paratuberculosis
auaucccgauuuuuuccgcucu

SEQ ID NO: 2919895 - RNA, 16 nt, Mycobacterium avium subsp. paratuberculosis
auaucgcaccggcgcc

SEQ ID NO: 2919896 - RNA, 13 nt, Mycobacterium avium subsp. paratuberculosis
auaugacgccggc

SEQ ID NO: 2919897 - RNA, 23 nt, Mycobacterium avium subsp. paratuberculosis
auauggcccuccacggugcgcac

SEQ ID NO: 2919898 - RNA, 12 nt, Mycobacterium avium subsp. paratuberculosis
auauucgcgaug

SEQ ID NO: 2919899 - RNA, 15 nt, Mycobacterium avium subsp. paratuberculosis
aucaaaucccgcagc

SEQ ID NO: 2919900 - RNA, 18 nt, Mycobacterium avium subsp. paratuberculosis
aucaacaccaacgacagc

SEQ ID NO: 2919901 - RNA, 14 nt, Mycobacterium avium subsp. paratuberculosis
aucaacaccgccag

SEQ ID NO: 2919902 - RNA, 18 nt, Mycobacterium avium subsp. paratuberculosis
aucaacaccgccagcacc

SEQ ID NO: 2919903 - RNA, 19 nt, Mycobacterium avium subsp. paratuberculosis
aucaacaggauuccgggga

SEQ ID NO: 2919904 - RNA, 15 nt, Mycobacterium avium subsp. paratuberculosis
aucaacaggcccagc

SEQ ID NO: 2919905 - RNA, 16 nt, Mycobacterium avium subsp. paratuberculosis
aucaacaggcccagca

SEQ ID NO: 2919906 - RNA, 18 nt, Mycobacterium avium subsp. paratuberculosis
aucaacaggcccagcagc

SEQ ID NO: 2919907 - RNA, 14 nt, Mycobacterium avium subsp. paratuberculosis
aucaaccacaccag

SEQ ID NO: 2919908 - RNA, 20 nt, Mycobacterium avium subsp. paratuberculosis
aucaaccgauuucggccagc

SEQ ID NO: 2919909 - RNA, 13 nt, Mycobacterium avium subsp. paratuberculosis
aucaacgcgccga

SEQ ID NO: 2919910 - RNA, 14 nt, Mycobacterium avium subsp. paratuberculosis
aucaacgcgccgaa

SEQ ID NO: 2919911 - RNA, 22 nt, Mycobacterium avium subsp. paratuberculosis
aucaacggcuugaugaugcugu

SEQ ID NO: 2919912 - RNA, 15 nt, Mycobacterium avium subsp. paratuberculosis
aucaacgggucgagc

SEQ ID NO: 2919913 - RNA, 18 nt, Mycobacterium avium subsp. paratuberculosis
aucaacugcaccagcggc

SEQ ID NO: 2919914 - RNA, 20 nt, Mycobacterium avium subsp. paratuberculosis
aucaaugcgggauucgcgca

SEQ ID NO: 2919915 - RNA, 14 nt, Mycobacterium avium subsp. paratuberculosis
aucaauucgaagcc

SEQ ID NO: 2919916 - RNA, 14 nt, Mycobacterium avium subsp. paratuberculosis
aucacacgcgcgcc

SEQ ID NO: 2919917 - RNA, 19 nt, Mycobacterium avium subsp. paratuberculosis
aucaccaaauagccgucgg

SEQ ID NO: 2919918 - RNA, 14 nt, Mycobacterium avium subsp. paratuberculosis
aucaccaccgccgc

SEQ ID NO: 2919919 - RNA, 15 nt, Mycobacterium avium subsp. paratuberculosis
aucaccacggucagg

SEQ ID NO: 2919920 - RNA, 21 nt, Mycobacterium avium subsp. paratuberculosis
aucaccacggucagggccagc

SEQ ID NO: 2919921 - RNA, 22 nt, Mycobacterium avium subsp. paratuberculosis
aucaccacggucagggccagca

SEQ ID NO: 2919922 - RNA, 18 nt, Mycobacterium avium subsp. paratuberculosis
aucaccacgguggccgcg

SEQ ID NO: 2919923 - RNA, 13 nt, Mycobacterium avium subsp. paratuberculosis
aucaccagaccgg

SEQ ID NO: 2919924 - RNA, 12 nt, Mycobacterium avium subsp. paratuberculosis
aucaccagcaga

SEQ ID NO: 2919925 - RNA, 19 nt, Mycobacterium avium subsp. paratuberculosis
aucaccaucacgucgcgcu

SEQ ID NO: 2919926 - RNA, 16 nt, Mycobacterium avium subsp. paratuberculosis
aucacccacggccaca

SEQ ID NO: 2919927 - RNA, 13 nt, Mycobacterium avium subsp. paratuberculosis
aucaccccgaagc

SEQ ID NO: 2919928 - RNA, 16 nt, Mycobacterium avium subsp. paratuberculosis
aucaccccggcgacgg

SEQ ID NO: 2919929 - RNA, 18 nt, Mycobacterium avium subsp. paratuberculosis
aucacccgccggguggcc

SEQ ID NO: 2919930 - RNA, 16 nt, Mycobacterium avium subsp. paratuberculosis
aucacccucggcgucc

SEQ ID NO: 2919931 - RNA, 19 nt, Mycobacterium avium subsp. paratuberculosis
aucaccgagauggccacca

SEQ ID NO: 2919932 - RNA, 20 nt, Mycobacterium avium subsp. paratuberculosis
aucaccgccagcgcgccgau

SEQ ID NO: 2919933 - RNA, 23 nt, Mycobacterium avium subsp. paratuberculosis
aucaccgccccgacgaucgcgcc

SEQ ID NO: 2919934 - RNA, 14 nt, Mycobacterium avium subsp. paratuberculosis
aucaccgccgaggg

SEQ ID NO: 2919935 - RNA, 15 nt, Mycobacterium avium subsp. paratuberculosis
aucaccgccgcggcg

SEQ ID NO: 2919936 - RNA, 19 nt, Mycobacterium avium subsp. paratuberculosis
aucaccgcgggcgcgccgu

SEQ ID NO: 2919937 - RNA, 13 nt, Mycobacterium avium subsp. paratuberculosis
aucaccgcggugu

SEQ ID NO: 2919938 - RNA, 14 nt, Mycobacterium avium subsp. paratuberculosis
aucaccggaccggc

SEQ ID NO: 2919939 - RNA, 20 nt, Mycobacterium avium subsp. paratuberculosis
aucaccggcagcagcgcguc

SEQ ID NO: 2919940 - RNA, 21 nt, Mycobacterium avium subsp. paratuberculosis
aucaccggcagcagcgcgucg

SEQ ID NO: 2919941 - RNA, 15 nt, Mycobacterium avium subsp. paratuberculosis
aucaccggcuugccg

SEQ ID NO: 2919942 - RNA, 13 nt, Mycobacterium avium subsp. paratuberculosis
aucaccgggacac

SEQ ID NO: 2919943 - RNA, 21 nt, Mycobacterium avium subsp. paratuberculosis
aucaccgggacgggggugccg

SEQ ID NO: 2919944 - RNA, 21 nt, Mycobacterium avium subsp. paratuberculosis
aucaccgggcggccguggucg

SEQ ID NO: 2919945 - RNA, 21 nt, Mycobacterium avium subsp. paratuberculosis
aucaccucaucgcccagccgg

SEQ ID NO: 2919946 - RNA, 19 nt, Mycobacterium avium subsp. paratuberculosis
aucaccuccuuggccaggc

SEQ ID NO: 2919947 - RNA, 19 nt, Mycobacterium avium subsp. paratuberculosis
aucaccucgaacuugaccg

SEQ ID NO: 2919948 - RNA, 22 nt, Mycobacterium avium subsp. paratuberculosis
aucaccucgauggccgggaagu

SEQ ID NO: 2919949 - RNA, 13 nt, Mycobacterium avium subsp. paratuberculosis
aucaccugcgggc

SEQ ID NO: 2919950 - RNA, 19 nt, Mycobacterium avium subsp. paratuberculosis
aucaccugggagaacucga

SEQ ID NO: 2919951 - RNA, 18 nt, Mycobacterium avium subsp. paratuberculosis
aucaccuggugcucgcgc

SEQ ID NO: 2919952 - RNA, 18 nt, Mycobacterium avium subsp. paratuberculosis
aucaccuucugcgcgccg

SEQ ID NO: 2919953 - RNA, 19 nt, Mycobacterium avium subsp. paratuberculosis
aucaccuugcccugcgugc

SEQ ID NO: 2919954 - RNA, 23 nt, Mycobacterium avium subsp. paratuberculosis
aucaccuugcggccggcggcguc

SEQ ID NO: 2919955 - RNA, 19 nt, Mycobacterium avium subsp. paratuberculosis
aucaccuuguugcgggcgu

SEQ ID NO: 2919956 - RNA, 16 nt, Mycobacterium avium subsp. paratuberculosis
aucacgccccaggcgc

SEQ ID NO: 2919957 - RNA, 17 nt, Mycobacterium avium subsp. paratuberculosis
aucacgccgccggggcg

SEQ ID NO: 2919958 - RNA, 15 nt, Mycobacterium avium subsp. paratuberculosis
aucacgguggccgcc

SEQ ID NO: 2919959 - RNA, 17 nt, Mycobacterium avium subsp. paratuberculosis
aucacgguggccgccac

SEQ ID NO: 2919960 - RNA, 19 nt, Mycobacterium avium subsp. paratuberculosis
aucacgguggccgccacca

SEQ ID NO: 2919961 - RNA, 20 nt, Mycobacterium avium subsp. paratuberculosis
aucacgucccgcucgaucug

SEQ ID NO: 2919962 - RNA, 15 nt, Mycobacterium avium subsp. paratuberculosis
aucacgucggcgagc

SEQ ID NO: 2919963 - RNA, 13 nt, Mycobacterium avium subsp. paratuberculosis
aucacgucggcgu

SEQ ID NO: 2919964 - RNA, 16 nt, Mycobacterium avium subsp. paratuberculosis
aucacgugcuggcgcu

SEQ ID NO: 2919965 - RNA, 19 nt, Mycobacterium avium subsp. paratuberculosis
aucacguguccgucgccgg

SEQ ID NO: 2919966 - RNA, 21 nt, Mycobacterium avium subsp. paratuberculosis
aucacguucaccugacgcauc

SEQ ID NO: 2919967 - RNA, 17 nt, Mycobacterium avium subsp. paratuberculosis
aucacguugucgcggcc

SEQ ID NO: 2919968 - RNA, 22 nt, Mycobacterium avium subsp. paratuberculosis
aucacguugucgcggcccagca

SEQ ID NO: 2919969 - RNA, 15 nt, Mycobacterium avium subsp. paratuberculosis
aucagaacgcccgca

SEQ ID NO: 2919970 - RNA, 22 nt, Mycobacterium avium subsp. paratuberculosis
aucagaacgcccgcaacuccac

SEQ ID NO: 2919971 - RNA, 18 nt, Mycobacterium avium subsp. paratuberculosis
aucagaugcucgucgguc

SEQ ID NO: 2919972 - RNA, 20 nt, Mycobacterium avium subsp. paratuberculosis
aucagaugcucgucggucag

SEQ ID NO: 2919973 - RNA, 13 nt, Mycobacterium avium subsp. paratuberculosis
aucagcaccaggu

SEQ ID NO: 2919974 - RNA, 21 nt, Mycobacterium avium subsp. paratuberculosis
aucagcaccagguggcccgac

SEQ ID NO: 2919975 - RNA, 12 nt, Mycobacterium avium subsp. paratuberculosis
aucagcaccgaa

SEQ ID NO: 2919976 - RNA, 14 nt, Mycobacterium avium subsp. paratuberculosis
aucagcaccgacgc

SEQ ID NO: 2919977 - RNA, 20 nt, Mycobacterium avium subsp. paratuberculosis
aucagcaccgacgcggcgac

SEQ ID NO: 2919978 - RNA, 14 nt, Mycobacterium avium subsp. paratuberculosis
aucagcaccgccac

SEQ ID NO: 2919979 - RNA, 21 nt, Mycobacterium avium subsp. paratuberculosis
aucagggcggcgcgcgccagc

SEQ ID NO: 2919980 - RNA, 20 nt, Mycobacterium avium subsp. paratuberculosis
aucagggcguugaucacgau

SEQ ID NO: 2919981 - RNA, 19 nt, Mycobacterium avium subsp. paratuberculosis
aucagguccuugcgcgccg

SEQ ID NO: 2919982 - RNA, 17 nt, Mycobacterium avium subsp. paratuberculosis
aucaggucgccgaucca

SEQ ID NO: 2919983 - RNA, 24 nt, Mycobacterium avium subsp. paratuberculosis
aucaggucgccgauccagccgucg

SEQ ID NO: 2919984 - RNA, 21 nt, Mycobacterium avium subsp. paratuberculosis
aucaggucggugccgcggcgc

SEQ ID NO: 2919985 - RNA, 16 nt, Mycobacterium avium subsp. paratuberculosis
aucaggugcagcgugg

SEQ ID NO: 2919986 - RNA, 14 nt, Mycobacterium avium subsp. paratuberculosis
aucagugaccgcac

SEQ ID NO: 2919987 - RNA, 14 nt, Mycobacterium avium subsp. paratuberculosis
aucagugccgcgcc

SEQ ID NO: 2919988 - RNA, 14 nt, Mycobacterium avium subsp. paratuberculosis
aucagugcgggcau

SEQ ID NO: 2919989 - RNA, 16 nt, Mycobacterium avium subsp. paratuberculosis
aucagugcgggcaucg

SEQ ID NO: 2919990 - RNA, 20 nt, Mycobacterium avium subsp. paratuberculosis
aucaucaccaccgccgccga

SEQ ID NO: 2919991 - RNA, 21 nt, Mycobacterium avium subsp. paratuberculosis
aucaucaccaccgccgccgac

SEQ ID NO: 2919992 - RNA, 17 nt, Mycobacterium avium subsp. paratuberculosis
aucauccaggugaacag

SEQ ID NO: 2919993 - RNA, 20 nt, Mycobacterium avium subsp. paratuberculosis
aucauccaggugaacagcag

SEQ ID NO: 2919994 - RNA, 15 nt, Mycobacterium avium subsp. paratuberculosis
aucaucccggccacc

SEQ ID NO: 2919995 - RNA, 22 nt, Mycobacterium avium subsp. paratuberculosis
aucaucccggccaccccgcaga

SEQ ID NO: 2919996 - RNA, 13 nt, Mycobacterium avium subsp. paratuberculosis
aucauccggcggg

SEQ ID NO: 2919997 - RNA, 19 nt, Mycobacterium avium subsp. paratuberculosis
aucaucggcacgccggggc

SEQ ID NO: 2919998 - RNA, 13 nt, Mycobacterium avium subsp. paratuberculosis
aucaucuccaccc

SEQ ID NO: 2919999 - RNA, 13 nt, Mycobacterium avium subsp. paratuberculosis
aucaugccgccca

SEQ ID NO: 2920000 - RNA, 20 nt, Mycobacterium avium subsp. paratuberculosis
aucaugcguuugccgucgag

SEQ ID NO: 2920001 - RNA, 18 nt, Mycobacterium avium subsp. paratuberculosis
aucauggcgcugcgcgac

SEQ ID NO: 2920002 - RNA, 15 nt, Mycobacterium avium subsp. paratuberculosis
aucauggucggcgac

SEQ ID NO: 2920003 - RNA, 17 nt, Mycobacterium avium subsp. paratuberculosis
aucaugucguugaugcc

SEQ ID NO: 2920004 - RNA, 13 nt, Mycobacterium avium subsp. paratuberculosis
aucauugagccgc

SEQ ID NO: 2920005 - RNA, 19 nt, Mycobacterium avium subsp. paratuberculosis
aucauuugaccgcacaugc

SEQ ID NO: 2920006 - RNA, 23 nt, Mycobacterium avium subsp. paratuberculosis
auccaaggagaaggccgcgcgca

SEQ ID NO: 2920007 - RNA, 20 nt, Mycobacterium avium subsp. paratuberculosis
auccacacaggaccagcacu

SEQ ID NO: 2920008 - RNA, 14 nt, Mycobacterium avium subsp. paratuberculosis
auccacagcgcgaa

SEQ ID NO: 2920009 - RNA, 11 nt, Mycobacterium avium subsp. paratuberculosis
auccacagcgg

SEQ ID NO: 2920010 - RNA, 15 nt, Mycobacterium avium subsp. paratuberculosis
auccacagcgguucg

SEQ ID NO: 2920011 - RNA, 15 nt, Mycobacterium avium subsp. paratuberculosis
auccacgaugccggg

SEQ ID NO: 2920012 - RNA, 16 nt, Mycobacterium avium subsp. paratuberculosis
auccacgccuccggca

SEQ ID NO: 2920013 - RNA, 20 nt, Mycobacterium avium subsp. paratuberculosis
auccacgcggugauccagag

SEQ ID NO: 2920014 - RNA, 22 nt, Mycobacterium avium subsp. paratuberculosis
auccacgcggugauccagagca

SEQ ID NO: 2920015 - RNA, 14 nt, Mycobacterium avium subsp. paratuberculosis
auccacggcgaccc

SEQ ID NO: 2920016 - RNA, 14 nt, Mycobacterium avium subsp. paratuberculosis
auccacuccagcac

SEQ ID NO: 2920017 - RNA, 14 nt, Mycobacterium avium subsp. paratuberculosis
auccacucggccac

SEQ ID NO: 2920018 - RNA, 16 nt, Mycobacterium avium subsp. paratuberculosis
auccacucggccacca

SEQ ID NO: 2920019 - RNA, 19 nt, Mycobacterium avium subsp. paratuberculosis
auccacucgggccagccca

SEQ ID NO: 2920020 - RNA, 15 nt, Mycobacterium avium subsp. paratuberculosis
auccagaacagccag

SEQ ID NO: 2920021 - RNA, 18 nt, Mycobacterium avium subsp. paratuberculosis
auccagacguugaucuug

SEQ ID NO: 2920022 - RNA, 13 nt, Mycobacterium avium subsp. paratuberculosis
auccagaugccca

SEQ ID NO: 2920023 - RNA, 15 nt, Mycobacterium avium subsp. paratuberculosis
auccagaugccgggu

SEQ ID NO: 2920024 - RNA, 13 nt, Mycobacterium avium subsp. paratuberculosis
auccagcaccgcc

SEQ ID NO: 2920025 - RNA, 19 nt, Mycobacterium avium subsp. paratuberculosis
auccagcaccgccacgucu

SEQ ID NO: 2920026 - RNA, 14 nt, Mycobacterium avium subsp. paratuberculosis
auccagcagcgccu

SEQ ID NO: 2920027 - RNA, 18 nt, Mycobacterium avium subsp. paratuberculosis
auccagcagcgccucggc

SEQ ID NO: 2920028 - RNA, 14 nt, Mycobacterium avium subsp. paratuberculosis
auccagcagcgcgg

SEQ ID NO: 2920029 - RNA, 16 nt, Mycobacterium avium subsp. paratuberculosis
auccagcagcgcgguu

SEQ ID NO: 2920030 - RNA, 12 nt, Mycobacterium avium subsp. paratuberculosis
auccagcccugc

SEQ ID NO: 2920031 - RNA, 20 nt, Mycobacterium avium subsp. paratuberculosis
auccagcccugcucggccag

SEQ ID NO: 2920032 - RNA, 15 nt, Mycobacterium avium subsp. paratuberculosis
auccagcgccgcagc

SEQ ID NO: 2920033 - RNA, 17 nt, Mycobacterium avium subsp. paratuberculosis
auccagcgccgccaacc

SEQ ID NO: 2920034 - RNA, 12 nt, Mycobacterium avium subsp. paratuberculosis
auccagcgcgcc

SEQ ID NO: 2920035 - RNA, 15 nt, Mycobacterium avium subsp. paratuberculosis
auccagcgcgccgcu

SEQ ID NO: 2920036 - RNA, 13 nt, Mycobacterium avium subsp. paratuberculosis
auccagcgcuggc

SEQ ID NO: 2920037 - RNA, 13 nt, Mycobacterium avium subsp. paratuberculosis
auccagcggcggc

SEQ ID NO: 2920038 - RNA, 23 nt, Mycobacterium avium subsp. paratuberculosis
auccaggaacggcacccgcagcu

SEQ ID NO: 2920039 - RNA, 16 nt, Mycobacterium avium subsp. paratuberculosis
auccaggaccgcgcgc

SEQ ID NO: 2920040 - RNA, 20 nt, Mycobacterium avium subsp. paratuberculosis
auccaggaccgcgcgccggc

SEQ ID NO: 2920041 - RNA, 22 nt, Mycobacterium avium subsp. paratuberculosis
auccaggccagcaccuggcgca

SEQ ID NO: 2920042 - RNA, 17 nt, Mycobacterium avium subsp. paratuberculosis
auccaggugaacagcag

SEQ ID NO: 2920043 - RNA, 14 nt, Mycobacterium avium subsp. paratuberculosis
auccagguggcgcc

SEQ ID NO: 2920044 - RNA, 21 nt, Mycobacterium avium subsp. paratuberculosis
auccagguggcgccuccgccc

SEQ ID NO: 2920045 - RNA, 17 nt, Mycobacterium avium subsp. paratuberculosis
auccagguggggcacgg

SEQ ID NO: 2920046 - RNA, 14 nt, Mycobacterium avium subsp. paratuberculosis
auccagucggcgcc

SEQ ID NO: 2920047 - RNA, 17 nt, Mycobacterium avium subsp. paratuberculosis
auccagucggcgccgau

SEQ ID NO: 2920048 - RNA, 16 nt, Mycobacterium avium subsp. paratuberculosis
auccagugcaguucga

SEQ ID NO: 2920049 - RNA, 13 nt, Mycobacterium avium subsp. paratuberculosis
auccaguuccagu

SEQ ID NO: 2920050 - RNA, 17 nt, Mycobacterium avium subsp. paratuberculosis
auccauucgguuucccc

SEQ ID NO: 2920051 - RNA, 18 nt, Mycobacterium avium subsp. paratuberculosis
auccauucgguuuccccu

SEQ ID NO: 2920052 - RNA, 19 nt, Mycobacterium avium subsp. paratuberculosis
auccauucgguuuccccuu

SEQ ID NO: 2920053 - RNA, 19 nt, Mycobacterium avium subsp. paratuberculosis
auccauugcgacuugcgcg

SEQ ID NO: 2920054 - RNA, 18 nt, Mycobacterium avium subsp. paratuberculosis
auccauuucggugaauuc

SEQ ID NO: 2920055 - RNA, 22 nt, Mycobacterium avium subsp. paratuberculosis
aucccacauucggcgaaccagg

SEQ ID NO: 2920056 - RNA, 12 nt, Mycobacterium avium subsp. paratuberculosis
aucccaccacga

SEQ ID NO: 2920057 - RNA, 13 nt, Mycobacterium avium subsp. paratuberculosis
aucccaccaugag

SEQ ID NO: 2920058 - RNA, 14 nt, Mycobacterium avium subsp. paratuberculosis
aucccacccgcaac

SEQ ID NO: 2920059 - RNA, 15 nt, Mycobacterium avium subsp. paratuberculosis
aucccagacccagca

SEQ ID NO: 2920060 - RNA, 22 nt, Mycobacterium avium subsp. paratuberculosis
aucccagacccagcaucgccgc

SEQ ID NO: 2920061 - RNA, 22 nt, Mycobacterium avium subsp. paratuberculosis
aucccaggaacgcgcccggcgg

SEQ ID NO: 2920062 - RNA, 18 nt, Mycobacterium avium subsp. paratuberculosis
aucccaucagugcggccc

SEQ ID NO: 2920063 - RNA, 20 nt, Mycobacterium avium subsp. paratuberculosis
aucccauguagagcgggauc

SEQ ID NO: 2920064 - RNA, 16 nt, Mycobacterium avium subsp. paratuberculosis
auccccaccgugacgu

SEQ ID NO: 2920065 - RNA, 13 nt, Mycobacterium avium subsp. paratuberculosis
auccccagcggca

SEQ ID NO: 2920066 - RNA, 22 nt, Mycobacterium avium subsp. paratuberculosis
auccccagcggcacgaucucga

SEQ ID NO: 2920067 - RNA, 15 nt, Mycobacterium avium subsp. paratuberculosis
auccccaucucgagc

SEQ ID NO: 2920068 - RNA, 23 nt, Mycobacterium avium subsp. paratuberculosis
aucccccgaaaccauugcaccgc

SEQ ID NO: 2920069 - RNA, 15 nt, Mycobacterium avium subsp. paratuberculosis
aucccccgacccgcc

SEQ ID NO: 2920070 - RNA, 13 nt, Mycobacterium avium subsp. paratuberculosis
aucccccgcagcu

SEQ ID NO: 2920071 - RNA, 16 nt, Mycobacterium avium subsp. paratuberculosis
aucccccgcagcuucu

SEQ ID NO: 2920072 - RNA, 20 nt, Mycobacterium avium subsp. paratuberculosis
auccccgcagcucccccggc

SEQ ID NO: 2920073 - RNA, 14 nt, Mycobacterium avium subsp. paratuberculosis
auccccgcgguucg

SEQ ID NO: 2920074 - RNA, 16 nt, Mycobacterium avium subsp. paratuberculosis
auccccgcguuggcca

SEQ ID NO: 2920075 - RNA, 20 nt, Mycobacterium avium subsp. paratuberculosis
auccccucacuccagcggcg

SEQ ID NO: 2920076 - RNA, 12 nt, Mycobacterium avium subsp. paratuberculosis
auccccuggccg

SEQ ID NO: 2920077 - RNA, 13 nt, Mycobacterium avium subsp. paratuberculosis
auccccuggccga

SEQ ID NO: 2920078 - RNA, 19 nt, Mycobacterium avium subsp. paratuberculosis
auccccuggccgaaggugg

SEQ ID NO: 2920079 - RNA, 15 nt, Mycobacterium avium subsp. paratuberculosis
aucccgaaaccgucg

SEQ ID NO: 2920080 - RNA, 16 nt, Mycobacterium avium subsp. paratuberculosis
aucccgaaaccgucga

SEQ ID NO: 2920081 - RNA, 17 nt, Mycobacterium avium subsp. paratuberculosis
aucccgaaaccgucgac

SEQ ID NO: 2920082 - RNA, 18 nt, Mycobacterium avium subsp. paratuberculosis
aucccgaaaccgucgacc

SEQ ID NO: 2920083 - RNA, 14 nt, Mycobacterium avium subsp. paratuberculosis
aucccgaacugccg

SEQ ID NO: 2920084 - RNA, 17 nt, Mycobacterium avium subsp. paratuberculosis
aucccgaacugccgcgc

SEQ ID NO: 2920085 - RNA, 15 nt, Mycobacterium avium subsp. paratuberculosis
aucccgaggaugccg

SEQ ID NO: 2920086 - RNA, 19 nt, Mycobacterium avium subsp. paratuberculosis
aucccgaggaugccgccca

SEQ ID NO: 2920087 - RNA, 21 nt, Mycobacterium avium subsp. paratuberculosis
aucccgaggaugccgcccacc

SEQ ID NO: 2920088 - RNA, 23 nt, Mycobacterium avium subsp. paratuberculosis
aucccgaggaugccgcccaccac

SEQ ID NO: 2920089 - RNA, 17 nt, Mycobacterium avium subsp. paratuberculosis
aucccgauccgcgccgc

SEQ ID NO: 2920090 - RNA, 14 nt, Mycobacterium avium subsp. paratuberculosis
aucccgaugccgcg

SEQ ID NO: 2920091 - RNA, 17 nt, Mycobacterium avium subsp. paratuberculosis
aucccgaugccgcgcag

SEQ ID NO: 2920092 - RNA, 19 nt, Mycobacterium avium subsp. paratuberculosis
aucccgcaauugcgccagc

SEQ ID NO: 2920093 - RNA, 23 nt, Mycobacterium avium subsp. paratuberculosis
aucccgcaauugcgccagcagca

SEQ ID NO: 2920094 - RNA, 14 nt, Mycobacterium avium subsp. paratuberculosis
aucccgcaccgccc

SEQ ID NO: 2920095 - RNA, 18 nt, Mycobacterium avium subsp. paratuberculosis
aucccgcaccgccccgca

SEQ ID NO: 2920096 - RNA, 15 nt, Mycobacterium avium subsp. paratuberculosis
aucccgcagccgcga

SEQ ID NO: 2920097 - RNA, 16 nt, Mycobacterium avium subsp. paratuberculosis
aucccgcagccgcgac

SEQ ID NO: 2920098 - RNA, 12 nt, Mycobacterium avium subsp. paratuberculosis
aucccgcagcuc

SEQ ID NO: 2920099 - RNA, 13 nt, Mycobacterium avium subsp. paratuberculosis
aucccgcagcucg

SEQ ID NO: 2920100 - RNA, 11 nt, Mycobacterium avium subsp. paratuberculosis
aucccgccgac

SEQ ID NO: 2920101 - RNA, 14 nt, Mycobacterium avium subsp. paratuberculosis
aucccgccgccgaa

SEQ ID NO: 2920102 - RNA, 19 nt, Mycobacterium avium subsp. paratuberculosis
aucccgccggcggccacga

SEQ ID NO: 2920103 - RNA, 16 nt, Mycobacterium avium subsp. paratuberculosis
aucccgccucggcgga

SEQ ID NO: 2920104 - RNA, 14 nt, Mycobacterium avium subsp. paratuberculosis
aucccgcgggucgc

SEQ ID NO: 2920105 - RNA, 19 nt, Mycobacterium avium subsp. paratuberculosis
aucccggccaccccgcaga

SEQ ID NO: 2920106 - RNA, 23 nt, Mycobacterium avium subsp. paratuberculosis
aucccggccacgucgaugccgaa

SEQ ID NO: 2920107 - RNA, 13 nt, Mycobacterium avium subsp. paratuberculosis
aucccggccagca

SEQ ID NO: 2920108 - RNA, 18 nt, Mycobacterium avium subsp. paratuberculosis
aucccggccagcacccgc

SEQ ID NO: 2920109 - RNA, 13 nt, Mycobacterium avium subsp. paratuberculosis
aucccggcgagca

SEQ ID NO: 2920110 - RNA, 12 nt, Mycobacterium avium subsp. paratuberculosis
aucccgggccgu

SEQ ID NO: 2920111 - RNA, 15 nt, Mycobacterium avium subsp. paratuberculosis
aucccggggcgcgcu

SEQ ID NO: 2920112 - RNA, 21 nt, Mycobacterium avium subsp. paratuberculosis
aucccgguggacgcgauggcg

SEQ ID NO: 2920113 - RNA, 17 nt, Mycobacterium avium subsp. paratuberculosis
aucccgguucccggcac

SEQ ID NO: 2920114 - RNA, 19 nt, Mycobacterium avium subsp. paratuberculosis
aucccgguucccggcacca

SEQ ID NO: 2920115 - RNA, 21 nt, Mycobacterium avium subsp. paratuberculosis
aucccgguucccggcaccacc

SEQ ID NO: 2920116 - RNA, 17 nt, Mycobacterium avium subsp. paratuberculosis
aucccguacucgaugcc

SEQ ID NO: 2920117 - RNA, 16 nt, Mycobacterium avium subsp. paratuberculosis
aucccguagccguaga

SEQ ID NO: 2920118 - RNA, 19 nt, Mycobacterium avium subsp. paratuberculosis
aucccgucgucggcgccgc

SEQ ID NO: 2920119 - RNA, 23 nt, Mycobacterium avium subsp. paratuberculosis
aucccgucgucggcgccgcgccg

SEQ ID NO: 2920120 - RNA, 22 nt, Mycobacterium avium subsp. paratuberculosis
aucccguugcgcaugacggccu

SEQ ID NO: 2920121 - RNA, 22 nt, Mycobacterium avium subsp. paratuberculosis
aucccguugcgccgcaacggcg

SEQ ID NO: 2920122 - RNA, 18 nt, Mycobacterium avium subsp. paratuberculosis
aucccuccggcaggccgc

SEQ ID NO: 2920123 - RNA, 21 nt, Mycobacterium avium subsp. paratuberculosis
aucccuggugaccgacgacgu

SEQ ID NO: 2920124 - RNA, 15 nt, Mycobacterium avium subsp. paratuberculosis
aucccuugccgccga

SEQ ID NO: 2920125 - RNA, 14 nt, Mycobacterium avium subsp. paratuberculosis
auccgacaccgccu

SEQ ID NO: 2920126 - RNA, 17 nt, Mycobacterium avium subsp. paratuberculosis
auccgaguuggccggca

SEQ ID NO: 2920127 - RNA, 15 nt, Mycobacterium avium subsp. paratuberculosis
auccgaucagcagca

SEQ ID NO: 2920128 - RNA, 19 nt, Mycobacterium avium subsp. paratuberculosis
auccgaucagcagcaccug

SEQ ID NO: 2920129 - RNA, 15 nt, Mycobacterium avium subsp. paratuberculosis
auccgaucgcggccc

SEQ ID NO: 2920130 - RNA, 21 nt, Mycobacterium avium subsp. paratuberculosis
auccgaucgcggcccccugau

SEQ ID NO: 2920131 - RNA, 19 nt, Mycobacterium avium subsp. paratuberculosis
auccgaucugcucgaugcg

SEQ ID NO: 2920132 - RNA, 16 nt, Mycobacterium avium subsp. paratuberculosis
auccgaugacgcugcc

SEQ ID NO: 2920133 - RNA, 14 nt, Mycobacterium avium subsp. paratuberculosis
auccgauugcggcg

SEQ ID NO: 2920134 - RNA, 16 nt, Mycobacterium avium subsp. paratuberculosis
auccgauugcggcgca

SEQ ID NO: 2920135 - RNA, 22 nt, Mycobacterium avium subsp. paratuberculosis
auccgcaccgagaccaugccgc

SEQ ID NO: 2920136 - RNA, 12 nt, Mycobacterium avium subsp. paratuberculosis
auccgcaccgga

SEQ ID NO: 2920137 - RNA, 20 nt, Mycobacterium avium subsp. paratuberculosis
auccgcaccggacgcagcga

SEQ ID NO: 2920138 - RNA, 15 nt, Mycobacterium avium subsp. paratuberculosis
auccgcagccgcugc

SEQ ID NO: 2920139 - RNA, 17 nt, Mycobacterium avium subsp. paratuberculosis
auccgcaggaugccgau

SEQ ID NO: 2920140 - RNA, 13 nt, Mycobacterium avium subsp. paratuberculosis
auccgcccggccc

SEQ ID NO: 2920141 - RNA, 22 nt, Mycobacterium avium subsp. paratuberculosis
auccgccggcgaagcucgacga

SEQ ID NO: 2920142 - RNA, 16 nt, Mycobacterium avium subsp. paratuberculosis
auccgccgggcggcgu

SEQ ID NO: 2920143 - RNA, 17 nt, Mycobacterium avium subsp. paratuberculosis
auccgccgggcggcguc

SEQ ID NO: 2920144 - RNA, 14 nt, Mycobacterium avium subsp. paratuberculosis
auccgccgucgacc

SEQ ID NO: 2920145 - RNA, 22 nt, Mycobacterium avium subsp. paratuberculosis
auccgccguugaccggugcgcc

SEQ ID NO: 2920146 - RNA, 20 nt, Mycobacterium avium subsp. paratuberculosis
auccgcgacgacaccaccgu

SEQ ID NO: 2920147 - RNA, 18 nt, Mycobacterium avium subsp. paratuberculosis
auccgcgacgccagcacc

SEQ ID NO: 2920148 - RNA, 19 nt, Mycobacterium avium subsp. paratuberculosis
auccgcgacgccagcaccu

SEQ ID NO: 2920149 - RNA, 19 nt, Mycobacterium avium subsp. paratuberculosis
aucgacgccaugggcccag

SEQ ID NO: 2920150 - RNA, 15 nt, Mycobacterium avium subsp. paratuberculosis
aucgacgccgacauc

SEQ ID NO: 2920151 - RNA, 14 nt, Mycobacterium avium subsp. paratuberculosis
aucgacgccgcggu

SEQ ID NO: 2920152 - RNA, 13 nt, Mycobacterium avium subsp. paratuberculosis
aucgacgcgaccu

SEQ ID NO: 2920153 - RNA, 22 nt, Mycobacterium avium subsp. paratuberculosis
aucgacgucaccaccgggucgu

SEQ ID NO: 2920154 - RNA, 21 nt, Mycobacterium avium subsp. paratuberculosis
aucgacgucagcucccccgac

SEQ ID NO: 2920155 - RNA, 21 nt, Mycobacterium avium subsp. paratuberculosis
aucgacuccagcaccggcgcc

SEQ ID NO: 2920156 - RNA, 19 nt, Mycobacterium avium subsp. paratuberculosis
aucgacugcgacacccgcu

SEQ ID NO: 2920157 - RNA, 17 nt, Mycobacterium avium subsp. paratuberculosis
aucgacuugccgccgca

SEQ ID NO: 2920158 - RNA, 19 nt, Mycobacterium avium subsp. paratuberculosis
aucgagaccaugucggcca

SEQ ID NO: 2920159 - RNA, 19 nt, Mycobacterium avium subsp. paratuberculosis
aucgagaucagggcgcgca

SEQ ID NO: 2920160 - RNA, 14 nt, Mycobacterium avium subsp. paratuberculosis
aucgagaugccggg

SEQ ID NO: 2920161 - RNA, 16 nt, Mycobacterium avium subsp. paratuberculosis
aucgagaugccgggaa

SEQ ID NO: 2920162 - RNA, 14 nt, Mycobacterium avium subsp. paratuberculosis
aucgagcaccagca

SEQ ID NO: 2920163 - RNA, 15 nt, Mycobacterium avium subsp. paratuberculosis
aucgagcaccagcaa

SEQ ID NO: 2920164 - RNA, 23 nt, Mycobacterium avium subsp. paratuberculosis
aucgagcaccagcaacaccaggg

SEQ ID NO: 2920165 - RNA, 17 nt, Mycobacterium avium subsp. paratuberculosis
aucgagcccaccgcgcc

SEQ ID NO: 2920166 - RNA, 13 nt, Mycobacterium avium subsp. paratuberculosis
aucgagccgagca

SEQ ID NO: 2920167 - RNA, 19 nt, Mycobacterium avium subsp. paratuberculosis
aucgagccgagcaccggca

SEQ ID NO: 2920168 - RNA, 21 nt, Mycobacterium avium subsp. paratuberculosis
aucgagccgagcaccggcagc

SEQ ID NO: 2920169 - RNA, 21 nt, Mycobacterium avium subsp. paratuberculosis
aucgagccgccugcgcgccgu

SEQ ID NO: 2920170 - RNA, 23 nt, Mycobacterium avium subsp. paratuberculosis
aucgagccgccugcgcgccgucg

SEQ ID NO: 2920171 - RNA, 16 nt, Mycobacterium avium subsp. paratuberculosis
aucgagccgcggcccg

SEQ ID NO: 2920172 - RNA, 20 nt, Mycobacterium avium subsp. paratuberculosis
aucgagccgguacggcucgu

SEQ ID NO: 2920173 - RNA, 17 nt, Mycobacterium avium subsp. paratuberculosis
aucgagcgcaccgccca

SEQ ID NO: 2920174 - RNA, 12 nt, Mycobacterium avium subsp. paratuberculosis
aucgagcgcgcu

SEQ ID NO: 2920175 - RNA, 16 nt, Mycobacterium avium subsp. paratuberculosis
aucgagcucgcagucg

SEQ ID NO: 2920176 - RNA, 21 nt, Mycobacterium avium subsp. paratuberculosis
aucgagcugggcccgcgcauc

SEQ ID NO: 2920177 - RNA, 13 nt, Mycobacterium avium subsp. paratuberculosis
aucgaggacaccg

SEQ ID NO: 2920178 - RNA, 15 nt, Mycobacterium avium subsp. paratuberculosis
aucgaggacaccgcg

SEQ ID NO: 2920179 - RNA, 19 nt, Mycobacterium avium subsp. paratuberculosis
aucgaggaccggcgccggc

SEQ ID NO: 2920180 - RNA, 21 nt, Mycobacterium avium subsp. paratuberculosis
aucgaggaccggcgccggccg

SEQ ID NO: 2920181 - RNA, 22 nt, Mycobacterium avium subsp. paratuberculosis
aucgaggaucucccggguggcc

SEQ ID NO: 2920182 - RNA, 14 nt, Mycobacterium avium subsp. paratuberculosis
aucgaggccagcgc

SEQ ID NO: 2920183 - RNA, 17 nt, Mycobacterium avium subsp. paratuberculosis
aucgaggccagcgcgau

SEQ ID NO: 2920184 - RNA, 15 nt, Mycobacterium avium subsp. paratuberculosis
aucgagggcgcgcag

SEQ ID NO: 2920185 - RNA, 16 nt, Mycobacterium avium subsp. paratuberculosis
aucgagggcgcgcagc

SEQ ID NO: 2920186 - RNA, 21 nt, Mycobacterium avium subsp. paratuberculosis
aucgagguaggccaccggguc

SEQ ID NO: 2920187 - RNA, 17 nt, Mycobacterium avium subsp. paratuberculosis
aucgaggucgaaccacg

SEQ ID NO: 2920188 - RNA, 21 nt, Mycobacterium avium subsp. paratuberculosis
aucgaggugauguuggccgcg

SEQ ID NO: 2920189 - RNA, 23 nt, Mycobacterium avium subsp. paratuberculosis
aucgaggugauguuggccgcgac

SEQ ID NO: 2920190 - RNA, 15 nt, Mycobacterium avium subsp. paratuberculosis
aucgaguaggcccag

SEQ ID NO: 2920191 - RNA, 19 nt, Mycobacterium avium subsp. paratuberculosis
aucgaguaguccgggauga

SEQ ID NO: 2920192 - RNA, 17 nt, Mycobacterium avium subsp. paratuberculosis
aucgagucccgcgcggc

SEQ ID NO: 2920193 - RNA, 18 nt, Mycobacterium avium subsp. paratuberculosis
aucgagucccgcgcggcg

SEQ ID NO: 2920194 - RNA, 19 nt, Mycobacterium avium subsp. paratuberculosis
aucgagucccgcgcggcgc

SEQ ID NO: 2920195 - RNA, 15 nt, Mycobacterium avium subsp. paratuberculosis
aucgaucaucgccuc

SEQ ID NO: 2920196 - RNA, 18 nt, Mycobacterium avium subsp. paratuberculosis
aucgaucccgucggccau

SEQ ID NO: 2920197 - RNA, 21 nt, Mycobacterium avium subsp. paratuberculosis
aucgaucccuuggcggcggcc

SEQ ID NO: 2920198 - RNA, 22 nt, Mycobacterium avium subsp. paratuberculosis
aucgaucccuuggcggcggcca

SEQ ID NO: 2920199 - RNA, 23 nt, Mycobacterium avium subsp. paratuberculosis
aucgaucccuuggcggcggccag

SEQ ID NO: 2920200 - RNA, 20 nt, Mycobacterium avium subsp. paratuberculosis
aucgaugaauccgcgcagca

SEQ ID NO: 2920201 - RNA, 18 nt, Mycobacterium avium subsp. paratuberculosis
aucgaugccggcaaccgc

SEQ ID NO: 2920202 - RNA, 21 nt, Mycobacterium avium subsp. paratuberculosis
aucgauggcgggcgcgccggc

SEQ ID NO: 2920203 - RNA, 14 nt, Mycobacterium avium subsp. paratuberculosis
aucgcacagauacg

SEQ ID NO: 2920204 - RNA, 16 nt, Mycobacterium avium subsp. paratuberculosis
aucgcacccaucccca

SEQ ID NO: 2920205 - RNA, 14 nt, Mycobacterium avium subsp. paratuberculosis
aucgcaccgcgagc

SEQ ID NO: 2920206 - RNA, 12 nt, Mycobacterium avium subsp. paratuberculosis
aucgcaccggcg

SEQ ID NO: 2920207 - RNA, 14 nt, Mycobacterium avium subsp. paratuberculosis
aucgcaccggcgcc

SEQ ID NO: 2920208 - RNA, 16 nt, Mycobacterium avium subsp. paratuberculosis
aucgcagcgcgcggcg

SEQ ID NO: 2920209 - RNA, 17 nt, Mycobacterium avium subsp. paratuberculosis
aucgcagcgcgcggcgc

SEQ ID NO: 2920210 - RNA, 13 nt, Mycobacterium avium subsp. paratuberculosis
aucgccaacgcgc

SEQ ID NO: 2920211 - RNA, 23 nt, Mycobacterium avium subsp. paratuberculosis
aucgccaccgagaucaugccggc

SEQ ID NO: 2920212 - RNA, 21 nt, Mycobacterium avium subsp. paratuberculosis
aucgccaccuggaagcgcauc

SEQ ID NO: 2920213 - RNA, 16 nt, Mycobacterium avium subsp. paratuberculosis
aucgccacgccgacca

SEQ ID NO: 2920214 - RNA, 14 nt, Mycobacterium avium subsp. paratuberculosis
aucgccagcaacga

SEQ ID NO: 2920215 - RNA, 23 nt, Mycobacterium avium subsp. paratuberculosis
aucgccagcaacgacccggccac

SEQ ID NO: 2920216 - RNA, 15 nt, Mycobacterium avium subsp. paratuberculosis
aucgccagcacauag

SEQ ID NO: 2920217 - RNA, 18 nt, Mycobacterium avium subsp. paratuberculosis
aucgccagcacauagcgc

SEQ ID NO: 2920218 - RNA, 20 nt, Mycobacterium avium subsp. paratuberculosis
aucgccagcaccggcgcgcc

SEQ ID NO: 2920219 - RNA, 12 nt, Mycobacterium avium subsp. paratuberculosis
aucgccagcacg

SEQ ID NO: 2920220 - RNA, 11 nt, Mycobacterium avium subsp. paratuberculosis
aucgccagccc

SEQ ID NO: 2920221 - RNA, 17 nt, Mycobacterium avium subsp. paratuberculosis
aucgccagcccggcgua

SEQ ID NO: 2920222 - RNA, 21 nt, Mycobacterium avium subsp. paratuberculosis
aucgccagcccggcguacagc

SEQ ID NO: 2920223 - RNA, 23 nt, Mycobacterium avium subsp. paratuberculosis
aucgccagcgcccccagcggggc

SEQ ID NO: 2920224 - RNA, 13 nt, Mycobacterium avium subsp. paratuberculosis
aucgccagcgcgc

SEQ ID NO: 2920225 - RNA, 22 nt, Mycobacterium avium subsp. paratuberculosis
aucgccagcgcggugucgacgu

SEQ ID NO: 2920226 - RNA, 13 nt, Mycobacterium avium subsp. paratuberculosis
aucgccaggaacc

SEQ ID NO: 2920227 - RNA, 20 nt, Mycobacterium avium subsp. paratuberculosis
aucgccaggaaccacacccc

SEQ ID NO: 2920228 - RNA, 23 nt, Mycobacterium avium subsp. paratuberculosis
aucgccaggaaccacaccccggc

SEQ ID NO: 2920229 - RNA, 11 nt, Mycobacterium avium subsp. paratuberculosis
aucgccaggcg

SEQ ID NO: 2920230 - RNA, 20 nt, Mycobacterium avium subsp. paratuberculosis
aucgccaggcguugcaccgc

SEQ ID NO: 2920231 - RNA, 17 nt, Mycobacterium avium subsp. paratuberculosis
aucgccaguccggcgcc

SEQ ID NO: 2920232 - RNA, 19 nt, Mycobacterium avium subsp. paratuberculosis
aucgccaguccggcgccga

SEQ ID NO: 2920233 - RNA, 22 nt, Mycobacterium avium subsp. paratuberculosis
aucgcgagggccguugcggcca

SEQ ID NO: 2920234 - RNA, 23 nt, Mycobacterium avium subsp. paratuberculosis
aucgcgauccgggcgccggccgg

SEQ ID NO: 2920235 - RNA, 14 nt, Mycobacterium avium subsp. paratuberculosis
aucgcgaucgccga

SEQ ID NO: 2920236 - RNA, 16 nt, Mycobacterium avium subsp. paratuberculosis
aucgcgaucgccgauc

SEQ ID NO: 2920237 - RNA, 15 nt, Mycobacterium avium subsp. paratuberculosis
aucgcgauggaagcg

SEQ ID NO: 2920238 - RNA, 17 nt, Mycobacterium avium subsp. paratuberculosis
aucgcgauggaagcgcc

SEQ ID NO: 2920239 - RNA, 20 nt, Mycobacterium avium subsp. paratuberculosis
aucgcgauggaagcgcccgc

SEQ ID NO: 2920240 - RNA, 14 nt, Mycobacterium avium subsp. paratuberculosis
aucgcgcaccaggg

SEQ ID NO: 2920241 - RNA, 23 nt, Mycobacterium avium subsp. paratuberculosis
aucgcgcaccagggccugcagca

SEQ ID NO: 2920242 - RNA, 14 nt, Mycobacterium avium subsp. paratuberculosis
aucgcgcagccgcg

SEQ ID NO: 2920243 - RNA, 21 nt, Mycobacterium avium subsp. paratuberculosis
aucgcgccgaucugaccgagc

SEQ ID NO: 2920244 - RNA, 11 nt, Mycobacterium avium subsp. paratuberculosis
aucgcgccgca

SEQ ID NO: 2920245 - RNA, 13 nt, Mycobacterium avium subsp. paratuberculosis
aucgcgccggccg

SEQ ID NO: 2920246 - RNA, 14 nt, Mycobacterium avium subsp. paratuberculosis
aucgcgccggccgc

SEQ ID NO: 2920247 - RNA, 19 nt, Mycobacterium avium subsp. paratuberculosis
aucgcgccggccgccgcga

SEQ ID NO: 2920248 - RNA, 17 nt, Mycobacterium avium subsp. paratuberculosis
aucgcgccugcaccggc

SEQ ID NO: 2920249 - RNA, 15 nt, Mycobacterium avium subsp. paratuberculosis
aucgcgcgcggcggc

SEQ ID NO: 2920250 - RNA, 18 nt, Mycobacterium avium subsp. paratuberculosis
aucgcgcgcggcggccac

SEQ ID NO: 2920251 - RNA, 20 nt, Mycobacterium avium subsp. paratuberculosis
aucgcgcugaccaggccguc

SEQ ID NO: 2920252 - RNA, 19 nt, Mycobacterium avium subsp. paratuberculosis
aucgcggaucgaacagggc

SEQ ID NO: 2920253 - RNA, 15 nt, Mycobacterium avium subsp. paratuberculosis
aucgcggcccacccg

SEQ ID NO: 2920254 - RNA, 23 nt, Mycobacterium avium subsp. paratuberculosis
aucgcggcccacccgcagggcgc

SEQ ID NO: 2920255 - RNA, 19 nt, Mycobacterium avium subsp. paratuberculosis
aucgcggcccccacgcagc

SEQ ID NO: 2920256 - RNA, 23 nt, Mycobacterium avium subsp. paratuberculosis
aucgcggcccccugaucggccgc

SEQ ID NO: 2920257 - RNA, 14 nt, Mycobacterium avium subsp. paratuberculosis
aucgcggccgcccg

SEQ ID NO: 2920258 - RNA, 15 nt, Mycobacterium avium subsp. paratuberculosis
aucgcggccgcccgg

SEQ ID NO: 2920259 - RNA, 20 nt, Mycobacterium avium subsp. paratuberculosis
aucgcggcgaacaacgccac

SEQ ID NO: 2920260 - RNA, 15 nt, Mycobacterium avium subsp. paratuberculosis
aucgcggcgagcagc

SEQ ID NO: 2920261 - RNA, 16 nt, Mycobacterium avium subsp. paratuberculosis
aucgcggcgagcagcg

SEQ ID NO: 2920262 - RNA, 17 nt, Mycobacterium avium subsp. paratuberculosis
aucgcggcgagcagcgc

SEQ ID NO: 2920263 - RNA, 20 nt, Mycobacterium avium subsp. paratuberculosis
aucgcggcgagcagcgcgau

SEQ ID NO: 2920264 - RNA, 12 nt, Mycobacterium avium subsp. paratuberculosis
aucgcggcgauc

SEQ ID NO: 2920265 - RNA, 14 nt, Mycobacterium avium subsp. paratuberculosis
aucgcggcgauggu

SEQ ID NO: 2920266 - RNA, 14 nt, Mycobacterium avium subsp. paratuberculosis
aucgcggcgcugcc

SEQ ID NO: 2920267 - RNA, 19 nt, Mycobacterium avium subsp. paratuberculosis
aucgcggcgcugccgccgg

SEQ ID NO: 2920268 - RNA, 19 nt, Mycobacterium avium subsp. paratuberculosis
aucgcggcggacagcacgu

SEQ ID NO: 2920269 - RNA, 12 nt, Mycobacterium avium subsp. paratuberculosis
aucgcggcggcg

SEQ ID NO: 2920270 - RNA, 13 nt, Mycobacterium avium subsp. paratuberculosis
aucgcggcggcgu

SEQ ID NO: 2920271 - RNA, 14 nt, Mycobacterium avium subsp. paratuberculosis
aucgcggcggucag

SEQ ID NO: 2920272 - RNA, 15 nt, Mycobacterium avium subsp. paratuberculosis
aucgcggcggucagg

SEQ ID NO: 2920273 - RNA, 19 nt, Mycobacterium avium subsp. paratuberculosis
aucgcggcguuguggccac

SEQ ID NO: 2920274 - RNA, 17 nt, Mycobacterium avium subsp. paratuberculosis
aucgcgggaucggccgg

SEQ ID NO: 2920275 - RNA, 17 nt, Mycobacterium avium subsp. paratuberculosis
aucgcgggccaccggcg

SEQ ID NO: 2920276 - RNA, 17 nt, Mycobacterium avium subsp. paratuberculosis
aucgcgggcgacccgcu

SEQ ID NO: 2920277 - RNA, 14 nt, Mycobacterium avium subsp. paratuberculosis
aucgcgggugacgg

SEQ ID NO: 2920278 - RNA, 15 nt, Mycobacterium avium subsp. paratuberculosis
aucgcgguagcgcuc

SEQ ID NO: 2920279 - RNA, 15 nt, Mycobacterium avium subsp. paratuberculosis
aucgcgguccaggau

SEQ ID NO: 2920280 - RNA, 13 nt, Mycobacterium avium subsp. paratuberculosis
aucgcggugacgc

SEQ ID NO: 2920281 - RNA, 19 nt, Mycobacterium avium subsp. paratuberculosis
aucgcggugacgcgccggc

SEQ ID NO: 2920282 - RNA, 21 nt, Mycobacterium avium subsp. paratuberculosis
aucgcggugacgcgccggccc

SEQ ID NO: 2920283 - RNA, 14 nt, Mycobacterium avium subsp. paratuberculosis
aucgcgguggccgu

SEQ ID NO: 2920284 - RNA, 17 nt, Mycobacterium avium subsp. paratuberculosis
aucgcgguggcgcccgc

SEQ ID NO: 2920285 - RNA, 16 nt, Mycobacterium avium subsp. paratuberculosis
aucgcguagcgccggu

SEQ ID NO: 2920286 - RNA, 19 nt, Mycobacterium avium subsp. paratuberculosis
aucgcguaggguucgccga

SEQ ID NO: 2920287 - RNA, 20 nt, Mycobacterium avium subsp. paratuberculosis
aucgcguaggguucgccgau

SEQ ID NO: 2920288 - RNA, 20 nt, Mycobacterium avium subsp. paratuberculosis
aucgcguaguccagcacggc

SEQ ID NO: 2920289 - RNA, 18 nt, Mycobacterium avium subsp. paratuberculosis
aucgcgucgacgauggcg

SEQ ID NO: 2920290 - RNA, 13 nt, Mycobacterium avium subsp. paratuberculosis
aucgcgucgacgg

SEQ ID NO: 2920291 - RNA, 17 nt, Mycobacterium avium subsp. paratuberculosis
aucgcgucgacggcgcc

SEQ ID NO: 2920292 - RNA, 23 nt, Mycobacterium avium subsp. paratuberculosis
aucgcgucggaauacagcagcug

SEQ ID NO: 2920293 - RNA, 19 nt, Mycobacterium avium subsp. paratuberculosis
aucgcgucggugucgccga

SEQ ID NO: 2920294 - RNA, 20 nt, Mycobacterium avium subsp. paratuberculosis
aucgcgugccgaccagccga

SEQ ID NO: 2920295 - RNA, 15 nt, Mycobacterium avium subsp. paratuberculosis
aucgcguuagcaagg

SEQ ID NO: 2920296 - RNA, 19 nt, Mycobacterium avium subsp. paratuberculosis
aucgcugaugcgcaacagc

SEQ ID NO: 2920297 - RNA, 16 nt, Mycobacterium avium subsp. paratuberculosis
aucgcugccacguaca

SEQ ID NO: 2920298 - RNA, 22 nt, Mycobacterium avium subsp. paratuberculosis
aucgcugcgcccgccgccacca

SEQ ID NO: 2920299 - RNA, 22 nt, Mycobacterium avium subsp. paratuberculosis
aucgcuggggugcccaccagca

SEQ ID NO: 2920300 - RNA, 16 nt, Mycobacterium avium subsp. paratuberculosis
aucgcugguggccgac

SEQ ID NO: 2920301 - RNA, 20 nt, Mycobacterium avium subsp. paratuberculosis
aucgcugguggccgacgugc

SEQ ID NO: 2920302 - RNA, 18 nt, Mycobacterium avium subsp. paratuberculosis
aucgcugguggugagaau

SEQ ID NO: 2920303 - RNA, 13 nt, Mycobacterium avium subsp. paratuberculosis
aucgcugugcgaa

SEQ ID NO: 2920304 - RNA, 14 nt, Mycobacterium avium subsp. paratuberculosis
aucgcuucggccag

SEQ ID NO: 2920305 - RNA, 20 nt, Mycobacterium avium subsp. paratuberculosis
aucgcuucggccagcgcguc

SEQ ID NO: 2920306 - RNA, 14 nt, Mycobacterium avium subsp. paratuberculosis
aucgcuugaccacc

SEQ ID NO: 2920307 - RNA, 20 nt, Mycobacterium avium subsp. paratuberculosis
aucgcuugaccaccgaccgg

SEQ ID NO: 2920308 - RNA, 20 nt, Mycobacterium avium subsp. paratuberculosis
aucgcuugcgccgcagcggu

SEQ ID NO: 2920309 - RNA, 15 nt, Mycobacterium avium subsp. paratuberculosis
aucggacaucggcag

SEQ ID NO: 2920310 - RNA, 14 nt, Mycobacterium avium subsp. paratuberculosis
aucggacccagccc

SEQ ID NO: 2920311 - RNA, 16 nt, Mycobacterium avium subsp. paratuberculosis
aucggacccagcccga

SEQ ID NO: 2920312 - RNA, 16 nt, Mycobacterium avium subsp. paratuberculosis
aucggacccagcccgg

SEQ ID NO: 2920313 - RNA, 18 nt, Mycobacterium avium subsp. paratuberculosis
aucggacccagcccggcg

SEQ ID NO: 2920314 - RNA, 21 nt, Mycobacterium avium subsp. paratuberculosis
aucggagguugauggccagaa

SEQ ID NO: 2920315 - RNA, 16 nt, Mycobacterium avium subsp. paratuberculosis
aucggauccgccugcc

SEQ ID NO: 2920316 - RNA, 21 nt, Mycobacterium avium subsp. paratuberculosis
aucggaugccggggcagcacc

SEQ ID NO: 2920317 - RNA, 21 nt, Mycobacterium avium subsp. paratuberculosis
aucggauggugcccaccgggc

SEQ ID NO: 2920318 - RNA, 17 nt, Mycobacterium avium subsp. paratuberculosis
aucggcugcgggccagc

SEQ ID NO: 2920319 - RNA, 15 nt, Mycobacterium avium subsp. paratuberculosis
aucggcuggucggcg

SEQ ID NO: 2920320 - RNA, 17 nt, Mycobacterium avium subsp. paratuberculosis
aucggcuggucggcggc

SEQ ID NO: 2920321 - RNA, 23 nt, Mycobacterium avium subsp. paratuberculosis
aucggcuuggggaagccggccag

SEQ ID NO: 2920322 - RNA, 18 nt, Mycobacterium avium subsp. paratuberculosis
aucggcuuggugggcgcc

SEQ ID NO: 2920323 - RNA, 22 nt, Mycobacterium avium subsp. paratuberculosis
aucgggaacggguagugcacgg

SEQ ID NO: 2920324 - RNA, 22 nt, Mycobacterium avium subsp. paratuberculosis
aucgggaaguccuccgucgagu

SEQ ID NO: 2920325 - RNA, 17 nt, Mycobacterium avium subsp. paratuberculosis
aucgggacgccacggcg

SEQ ID NO: 2920326 - RNA, 15 nt, Mycobacterium avium subsp. paratuberculosis
aucgggcccagcagc

SEQ ID NO: 2920327 - RNA, 17 nt, Mycobacterium avium subsp. paratuberculosis
aucgggcccagcagccu

SEQ ID NO: 2920328 - RNA, 15 nt, Mycobacterium avium subsp. paratuberculosis
aucgggcccgacgac

SEQ ID NO: 2920329 - RNA, 22 nt, Mycobacterium avium subsp. paratuberculosis
aucgggcgcagaaaaaggccgc

SEQ ID NO: 2920330 - RNA, 20 nt, Mycobacterium avium subsp. paratuberculosis
aucgggcgcagguccacccg

SEQ ID NO: 2920331 - RNA, 20 nt, Mycobacterium avium subsp. paratuberculosis
aucgggcguggcgucgguga

SEQ ID NO: 2920332 - RNA, 18 nt, Mycobacterium avium subsp. paratuberculosis
aucgggcuggguccgauu

SEQ ID NO: 2920333 - RNA, 17 nt, Mycobacterium avium subsp. paratuberculosis
aucggggcgcagcccgg

SEQ ID NO: 2920334 - RNA, 19 nt, Mycobacterium avium subsp. paratuberculosis
aucggggcgcagcccggcg

SEQ ID NO: 2920335 - RNA, 22 nt, Mycobacterium avium subsp. paratuberculosis
aucgggguggacgcgaccaggc

SEQ ID NO: 2920336 - RNA, 21 nt, Mycobacterium avium subsp. paratuberculosis
aucggguaacccuccggcgcc

SEQ ID NO: 2920337 - RNA, 17 nt, Mycobacterium avium subsp. paratuberculosis
aucgggucaccggccga

SEQ ID NO: 2920338 - RNA, 19 nt, Mycobacterium avium subsp. paratuberculosis
aucgggucaccggccgagc

SEQ ID NO: 2920339 - RNA, 17 nt, Mycobacterium avium subsp. paratuberculosis
aucggguccagcgccga

SEQ ID NO: 2920340 - RNA, 17 nt, Mycobacterium avium subsp. paratuberculosis
aucgggucccagaugcg

SEQ ID NO: 2920341 - RNA, 20 nt, Mycobacterium avium subsp. paratuberculosis
aucgggucguagagcgcgaa

SEQ ID NO: 2920342 - RNA, 18 nt, Mycobacterium avium subsp. paratuberculosis
aucgggugagacggccag

SEQ ID NO: 2920343 - RNA, 20 nt, Mycobacterium avium subsp. paratuberculosis
aucgggugagacggccagca

SEQ ID NO: 2920344 - RNA, 21 nt, Mycobacterium avium subsp. paratuberculosis
aucgggugagacggccagcag

SEQ ID NO: 2920345 - RNA, 15 nt, Mycobacterium avium subsp. paratuberculosis
aucggugaacccgcc

SEQ ID NO: 2920346 - RNA, 17 nt, Mycobacterium avium subsp. paratuberculosis
aucggugaagccgacgc

SEQ ID NO: 2920347 - RNA, 12 nt, Mycobacterium avium subsp. paratuberculosis
aucggugaagcg

SEQ ID NO: 2920348 - RNA, 21 nt, Mycobacterium avium subsp. paratuberculosis
aucggugaccgucgccgacca

SEQ ID NO: 2920349 - RNA, 21 nt, Mycobacterium avium subsp. paratuberculosis
aucggugcggaaggcccccgg

SEQ ID NO: 2920350 - RNA, 15 nt, Mycobacterium avium subsp. paratuberculosis
aucgguggcaccccg

SEQ ID NO: 2920351 - RNA, 20 nt, Mycobacterium avium subsp. paratuberculosis
aucgguggcaccccgcgccg

SEQ ID NO: 2920352 - RNA, 21 nt, Mycobacterium avium subsp. paratuberculosis
aucgguggcaccccgcgccgg

SEQ ID NO: 2920353 - RNA, 22 nt, Mycobacterium avium subsp. paratuberculosis
aucgguggcaccccgcgccggg

SEQ ID NO: 2920354 - RNA, 19 nt, Mycobacterium avium subsp. paratuberculosis
aucgguguagcccggugcc

SEQ ID NO: 2920355 - RNA, 19 nt, Mycobacterium avium subsp. paratuberculosis
aucgucaacaugcugcacg

SEQ ID NO: 2920356 - RNA, 23 nt, Mycobacterium avium subsp. paratuberculosis
aucgucaccgaccccucggcggc

SEQ ID NO: 2920357 - RNA, 21 nt, Mycobacterium avium subsp. paratuberculosis
aucgucaccucgagcacucgc

SEQ ID NO: 2920358 - RNA, 18 nt, Mycobacterium avium subsp. paratuberculosis
aucgucaugccuuggccg

SEQ ID NO: 2920359 - RNA, 23 nt, Mycobacterium avium subsp. paratuberculosis
aucguccgaggccccgccagaua

SEQ ID NO: 2920360 - RNA, 15 nt, Mycobacterium avium subsp. paratuberculosis
aucguccggcgccac

SEQ ID NO: 2920361 - RNA, 16 nt, Mycobacterium avium subsp. paratuberculosis
aucguccucgcgccgu

SEQ ID NO: 2920362 - RNA, 21 nt, Mycobacterium avium subsp. paratuberculosis
aucgucgaacucgggcccgag

SEQ ID NO: 2920363 - RNA, 24 nt, Mycobacterium avium subsp. paratuberculosis
aucgucgcgcccaggaacgcgccg

SEQ ID NO: 2920364 - RNA, 18 nt, Mycobacterium avium subsp. paratuberculosis
aucgucggcacugcccgc

SEQ ID NO: 2920365 - RNA, 20 nt, Mycobacterium avium subsp. paratuberculosis
aucgucggcacugcccgcau

SEQ ID NO: 2920366 - RNA, 21 nt, Mycobacterium avium subsp. paratuberculosis
aucgucggcacugcccgcauc

SEQ ID NO: 2920367 - RNA, 17 nt, Mycobacterium avium subsp. paratuberculosis
aucgucggcagcgacgc

SEQ ID NO: 2920368 - RNA, 14 nt, Mycobacterium avium subsp. paratuberculosis
aucgucggccacgc

SEQ ID NO: 2920369 - RNA, 16 nt, Mycobacterium avium subsp. paratuberculosis
aucgucggccacgcuc

SEQ ID NO: 2920370 - RNA, 15 nt, Mycobacterium avium subsp. paratuberculosis
aucgucggcgccggc

SEQ ID NO: 2920371 - RNA, 23 nt, Mycobacterium avium subsp. paratuberculosis
aucgucggcucguguccgaugac

SEQ ID NO: 2920372 - RNA, 16 nt, Mycobacterium avium subsp. paratuberculosis
aucgucgggcaccagc

SEQ ID NO: 2920373 - RNA, 17 nt, Mycobacterium avium subsp. paratuberculosis
aucgucgggcaccagca

SEQ ID NO: 2920374 - RNA, 13 nt, Mycobacterium avium subsp. paratuberculosis
aucgucgggccgg

SEQ ID NO: 2920375 - RNA, 19 nt, Mycobacterium avium subsp. paratuberculosis
aucgucgucccgucggcgc

SEQ ID NO: 2920376 - RNA, 14 nt, Mycobacterium avium subsp. paratuberculosis
aucgucucggccag

SEQ ID NO: 2920377 - RNA, 19 nt, Mycobacterium avium subsp. paratuberculosis
aucgucucggccagccggu

SEQ ID NO: 2920378 - RNA, 16 nt, Mycobacterium avium subsp. paratuberculosis
aucgucucggccgcgg

SEQ ID NO: 2920379 - RNA, 17 nt, Mycobacterium avium subsp. paratuberculosis
aucgucucggccgcggu

SEQ ID NO: 2920380 - RNA, 16 nt, Mycobacterium avium subsp. paratuberculosis
aucgucuugaccgccc

SEQ ID NO: 2920381 - RNA, 18 nt, Mycobacterium avium subsp. paratuberculosis
aucgucuugaccgcccgg

SEQ ID NO: 2920382 - RNA, 15 nt, Mycobacterium avium subsp. paratuberculosis
aucgucuugcggccc

SEQ ID NO: 2920383 - RNA, 16 nt, Mycobacterium avium subsp. paratuberculosis
aucgugaauucggccg

SEQ ID NO: 2920384 - RNA, 18 nt, Mycobacterium avium subsp. paratuberculosis
aucgugaauucggccggg

SEQ ID NO: 2920385 - RNA, 14 nt, Mycobacterium avium subsp. paratuberculosis
aucgugaucgccca

SEQ ID NO: 2920386 - RNA, 18 nt, Mycobacterium avium subsp. paratuberculosis
aucguggaauccuuccuc

SEQ ID NO: 2920387 - RNA, 14 nt, Mycobacterium avium subsp. paratuberculosis
aucguggccgcgua

SEQ ID NO: 2920388 - RNA, 16 nt, Mycobacterium avium subsp. paratuberculosis
aucguggccgcguaga

SEQ ID NO: 2920389 - RNA, 20 nt, Mycobacterium avium subsp. paratuberculosis
aucguggcuuucggcgccaa

SEQ ID NO: 2920390 - RNA, 20 nt, Mycobacterium avium subsp. paratuberculosis
aucgugggcgccgucgccgc

SEQ ID NO: 2920391 - RNA, 16 nt, Mycobacterium avium subsp. paratuberculosis
aucguguccagcaugu

SEQ ID NO: 2920392 - RNA, 17 nt, Mycobacterium avium subsp. paratuberculosis
aucguguccgcgccggc

SEQ ID NO: 2920393 - RNA, 22 nt, Mycobacterium avium subsp. paratuberculosis
aucgugucgaucgucuacucca

SEQ ID NO: 2920394 - RNA, 23 nt, Mycobacterium avium subsp. paratuberculosis
aucguguggccgcccucgcugcc

SEQ ID NO: 2920395 - RNA, 18 nt, Mycobacterium avium subsp. paratuberculosis
aucgugugggcgcccgcg

SEQ ID NO: 2920396 - RNA, 16 nt, Mycobacterium avium subsp. paratuberculosis
aucguguuaccgaucu

SEQ ID NO: 2920397 - RNA, 17 nt, Mycobacterium avium subsp. paratuberculosis
aucguucccugcgcggc

SEQ ID NO: 2920398 - RNA, 21 nt, Mycobacterium avium subsp. paratuberculosis
aucguucccugcgcggcgaug

SEQ ID NO: 2920399 - RNA, 13 nt, Mycobacterium avium subsp. paratuberculosis
aucucaccggcgg

SEQ ID NO: 2920400 - RNA, 16 nt, Mycobacterium avium subsp. paratuberculosis
aucucaccggcggcgg

SEQ ID NO: 2920401 - RNA, 17 nt, Mycobacterium avium subsp. paratuberculosis
aucucaccggcggcggc

SEQ ID NO: 2920402 - RNA, 19 nt, Mycobacterium avium subsp. paratuberculosis
aucuggcgguuggacaggc

SEQ ID NO: 2920403 - RNA, 18 nt, Mycobacterium avium subsp. paratuberculosis
aucuggcuggugauggcc

SEQ ID NO: 2920404 - RNA, 13 nt, Mycobacterium avium subsp. paratuberculosis
aucugggccagga

SEQ ID NO: 2920405 - RNA, 13 nt, Mycobacterium avium subsp. paratuberculosis
aucugggccgcca

SEQ ID NO: 2920406 - RNA, 15 nt, Mycobacterium avium subsp. paratuberculosis
aucugggccgccaac

SEQ ID NO: 2920407 - RNA, 15 nt, Mycobacterium avium subsp. paratuberculosis
aucugggcggcggga

SEQ ID NO: 2920408 - RNA, 21 nt, Mycobacterium avium subsp. paratuberculosis
aucugggugagcgacaccagg

SEQ ID NO: 2920409 - RNA, 15 nt, Mycobacterium avium subsp. paratuberculosis
aucugggugccgcgg

SEQ ID NO: 2920410 - RNA, 23 nt, Mycobacterium avium subsp. paratuberculosis
aucuggguuugggucaucgacuc

SEQ ID NO: 2920411 - RNA, 15 nt, Mycobacterium avium subsp. paratuberculosis
aucugguccagcgug

SEQ ID NO: 2920412 - RNA, 17 nt, Mycobacterium avium subsp. paratuberculosis
aucugguucaccgccac

SEQ ID NO: 2920413 - RNA, 18 nt, Mycobacterium avium subsp. paratuberculosis
aucugguuccacagcugc

SEQ ID NO: 2920414 - RNA, 19 nt, Mycobacterium avium subsp. paratuberculosis
aucugguuccacagcugca

SEQ ID NO: 2920415 - RNA, 15 nt, Mycobacterium avium subsp. paratuberculosis
aucugguugaaccgg

SEQ ID NO: 2920416 - RNA, 15 nt, Mycobacterium avium subsp. paratuberculosis
aucuguucggcggcg

SEQ ID NO: 2920417 - RNA, 16 nt, Mycobacterium avium subsp. paratuberculosis
aucuguucggcggcga

SEQ ID NO: 2920418 - RNA, 22 nt, Mycobacterium avium subsp. paratuberculosis
aucuguucggcggcgauccggc

SEQ ID NO: 2920419 - RNA, 20 nt, Mycobacterium avium subsp. paratuberculosis
aucuucacgaagugcccggc

SEQ ID NO: 2920420 - RNA, 20 nt, Mycobacterium avium subsp. paratuberculosis
aucuucacgugcgcggcguc

SEQ ID NO: 2920421 - RNA, 21 nt, Mycobacterium avium subsp. paratuberculosis
aucuucgagacacgcgccggc

SEQ ID NO: 2920422 - RNA, 21 nt, Mycobacterium avium subsp. paratuberculosis
aucuucgccuccgggaaggcg

SEQ ID NO: 2920423 - RNA, 16 nt, Mycobacterium avium subsp. paratuberculosis
aucuucggcgggaugu

SEQ ID NO: 2920424 - RNA, 14 nt, Mycobacterium avium subsp. paratuberculosis
aucuucuccccgcc

SEQ ID NO: 2920425 - RNA, 17 nt, Mycobacterium avium subsp. paratuberculosis
aucuucuccgcggccgc

SEQ ID NO: 2920426 - RNA, 14 nt, Mycobacterium avium subsp. paratuberculosis
aucuucucgcugcu

SEQ ID NO: 2920427 - RNA, 13 nt, Mycobacterium avium subsp. paratuberculosis
aucuugaccaggg

SEQ ID NO: 2920428 - RNA, 15 nt, Mycobacterium avium subsp. paratuberculosis
aucuugaccaggguu

SEQ ID NO: 2920429 - RNA, 13 nt, Mycobacterium avium subsp. paratuberculosis
aucuugacggcga

SEQ ID NO: 2920430 - RNA, 22 nt, Mycobacterium avium subsp. paratuberculosis
aucuugaucugggugccgcggu

SEQ ID NO: 2920431 - RNA, 15 nt, Mycobacterium avium subsp. paratuberculosis
aucuugccgucggcc

SEQ ID NO: 2920432 - RNA, 20 nt, Mycobacterium avium subsp. paratuberculosis
aucuugccgucggccgccga

SEQ ID NO: 2920433 - RNA, 12 nt, Mycobacterium avium subsp. paratuberculosis
aucuuggccagc

SEQ ID NO: 2920434 - RNA, 20 nt, Mycobacterium avium subsp. paratuberculosis
aucuuggccagcagcguggg

SEQ ID NO: 2920435 - RNA, 19 nt, Mycobacterium avium subsp. paratuberculosis
aucuuggccuccaccggca

SEQ ID NO: 2920436 - RNA, 22 nt, Mycobacterium avium subsp. paratuberculosis
aucuuggcgagcugaccggcca

SEQ ID NO: 2920437 - RNA, 13 nt, Mycobacterium avium subsp. paratuberculosis
aucuuggucuugg

SEQ ID NO: 2920438 - RNA, 18 nt, Mycobacterium avium subsp. paratuberculosis
aucuugugccagccgaag

SEQ ID NO: 2920439 - RNA, 19 nt, Mycobacterium avium subsp. paratuberculosis
aucuuguuguuggugccgc

SEQ ID NO: 2920440 - RNA, 19 nt, Mycobacterium avium subsp. paratuberculosis
aucuuugcauacagcaggc

SEQ ID NO: 2920441 - RNA, 20 nt, Mycobacterium avium subsp. paratuberculosis
augaaaccggccagcagcag

SEQ ID NO: 2920442 - RNA, 19 nt, Mycobacterium avium subsp. paratuberculosis
augaaauccgggaccggcg

SEQ ID NO: 2920443 - RNA, 22 nt, Mycobacterium avium subsp. paratuberculosis
augaaauccgggaccggcguca

SEQ ID NO: 2920444 - RNA, 15 nt, Mycobacterium avium subsp. paratuberculosis
augaacaugcccugc

SEQ ID NO: 2920445 - RNA, 16 nt, Mycobacterium avium subsp. paratuberculosis
augaacaugcccugca

SEQ ID NO: 2920446 - RNA, 12 nt, Mycobacterium avium subsp. paratuberculosis
augaacgaccug

SEQ ID NO: 2920447 - RNA, 14 nt, Mycobacterium avium subsp. paratuberculosis
augaacgcggccag

SEQ ID NO: 2920448 - RNA, 15 nt, Mycobacterium avium subsp. paratuberculosis
augaacggcagcucg

SEQ ID NO: 2920449 - RNA, 22 nt, Mycobacterium avium subsp. paratuberculosis
augaagaauuccaugucgucga

SEQ ID NO: 2920450 - RNA, 14 nt, Mycobacterium avium subsp. paratuberculosis
augaagaccuggcc

SEQ ID NO: 2920451 - RNA, 18 nt, Mycobacterium avium subsp. paratuberculosis
augaagccccggaccgga

SEQ ID NO: 2920452 - RNA, 21 nt, Mycobacterium avium subsp. paratuberculosis
augaagccgccgacgguggcc

SEQ ID NO: 2920453 - RNA, 19 nt, Mycobacterium avium subsp. paratuberculosis
augaagccguugccgccgc

SEQ ID NO: 2920454 - RNA, 13 nt, Mycobacterium avium subsp. paratuberculosis
augaagugcgcca

SEQ ID NO: 2920455 - RNA, 13 nt, Mycobacterium avium subsp. paratuberculosis
augaccacccucg

SEQ ID NO: 2920456 - RNA, 23 nt, Mycobacterium avium subsp. paratuberculosis
augaccaggucgccggcggccga

SEQ ID NO: 2920457 - RNA, 19 nt, Mycobacterium avium subsp. paratuberculosis
augaccgcgucggcgccgu

SEQ ID NO: 2920458 - RNA, 13 nt, Mycobacterium avium subsp. paratuberculosis
augaccggcccgg

SEQ ID NO: 2920459 - RNA, 17 nt, Mycobacterium avium subsp. paratuberculosis
augaccggccugcagcg

SEQ ID NO: 2920460 - RNA, 17 nt, Mycobacterium avium subsp. paratuberculosis
augaccuucugaucggg

SEQ ID NO: 2920461 - RNA, 22 nt, Mycobacterium avium subsp. paratuberculosis
augacgacggucaccggcaggc

SEQ ID NO: 2920462 - RNA, 13 nt, Mycobacterium avium subsp. paratuberculosis
augacgcacgucg

SEQ ID NO: 2920463 - RNA, 22 nt, Mycobacterium avium subsp. paratuberculosis
augacggccguacgcgguucgu

SEQ ID NO: 2920464 - RNA, 16 nt, Mycobacterium avium subsp. paratuberculosis
augacggccugcacca

SEQ ID NO: 2920465 - RNA, 14 nt, Mycobacterium avium subsp. paratuberculosis
augacggcggcggu

SEQ ID NO: 2920466 - RNA, 21 nt, Mycobacterium avium subsp. paratuberculosis
augacggcggcggugccgcag

SEQ ID NO: 2920467 - RNA, 22 nt, Mycobacterium avium subsp. paratuberculosis
augacggcggcggugccgcagg

SEQ ID NO: 2920468 - RNA, 22 nt, Mycobacterium avium subsp. paratuberculosis
augacggucugcaccgggauga

SEQ ID NO: 2920469 - RNA, 21 nt, Mycobacterium avium subsp. paratuberculosis
augacguccaccaggguggcc

SEQ ID NO: 2920470 - RNA, 21 nt, Mycobacterium avium subsp. paratuberculosis
augacgucgcgcugccggccc

SEQ ID NO: 2920471 - RNA, 12 nt, Mycobacterium avium subsp. paratuberculosis
augacuaauccc

SEQ ID NO: 2920472 - RNA, 15 nt, Mycobacterium avium subsp. paratuberculosis
augagcccuccagcu

SEQ ID NO: 2920473 - RNA, 16 nt, Mycobacterium avium subsp. paratuberculosis
augagccucagcgcgc

SEQ ID NO: 2920474 - RNA, 22 nt, Mycobacterium avium subsp. paratuberculosis
augagcgagaugaucagccgcc

SEQ ID NO: 2920475 - RNA, 17 nt, Mycobacterium avium subsp. paratuberculosis
augagcugggcggcgcg

SEQ ID NO: 2920476 - RNA, 17 nt, Mycobacterium avium subsp. paratuberculosis
augagcuggugcagcga

SEQ ID NO: 2920477 - RNA, 19 nt, Mycobacterium avium subsp. paratuberculosis
augaggucgcgaccgccgg

SEQ ID NO: 2920478 - RNA, 14 nt, Mycobacterium avium subsp. paratuberculosis
augaucacaccgcu

SEQ ID NO: 2920479 - RNA, 20 nt, Mycobacterium avium subsp. paratuberculosis
augaucagcgccguggcccg

SEQ ID NO: 2920480 - RNA, 13 nt, Mycobacterium avium subsp. paratuberculosis
augauccgcggcg

SEQ ID NO: 2920481 - RNA, 12 nt, Mycobacterium avium subsp. paratuberculosis
augaucggcagg

SEQ ID NO: 2920482 - RNA, 18 nt, Mycobacterium avium subsp. paratuberculosis
augaucucguugcggcgc

SEQ ID NO: 2920483 - RNA, 23 nt, Mycobacterium avium subsp. paratuberculosis
augaucugguuccacagcugcag

SEQ ID NO: 2920484 - RNA, 20 nt, Mycobacterium avium subsp. paratuberculosis
augaucuugaugucggggcg

SEQ ID NO: 2920485 - RNA, 22 nt, Mycobacterium avium subsp. paratuberculosis
augaugaaaccggccagcagca

SEQ ID NO: 2920486 - RNA, 23 nt, Mycobacterium avium subsp. paratuberculosis
augaugaaaccggccagcagcag

SEQ ID NO: 2920487 - RNA, 19 nt, Mycobacterium avium subsp. paratuberculosis
augccgaacgucaccaaca

SEQ ID NO: 2920488 - RNA, 16 nt, Mycobacterium avium subsp. paratuberculosis
augccgaagccguuga

SEQ ID NO: 2920489 - RNA, 16 nt, Mycobacterium avium subsp. paratuberculosis
augccgacaccccaca

SEQ ID NO: 2920490 - RNA, 19 nt, Mycobacterium avium subsp. paratuberculosis
augccgacaccccacaccg

SEQ ID NO: 2920491 - RNA, 17 nt, Mycobacterium avium subsp. paratuberculosis
augccgacccgcugcag

SEQ ID NO: 2920492 - RNA, 20 nt, Mycobacterium avium subsp. paratuberculosis
augccgaccgacagccgcac

SEQ ID NO: 2920493 - RNA, 13 nt, Mycobacterium avium subsp. paratuberculosis
augccgagcaccu

SEQ ID NO: 2920494 - RNA, 13 nt, Mycobacterium avium subsp. paratuberculosis
augccgagcagca

SEQ ID NO: 2920495 - RNA, 18 nt, Mycobacterium avium subsp. paratuberculosis
augccgagcagcaccgcg

SEQ ID NO: 2920496 - RNA, 20 nt, Mycobacterium avium subsp. paratuberculosis
augccgagcagcaccgcgac

SEQ ID NO: 2920497 - RNA, 21 nt, Mycobacterium avium subsp. paratuberculosis
augccgagcagcaccgcgacc

SEQ ID NO: 2920498 - RNA, 15 nt, Mycobacterium avium subsp. paratuberculosis
augccgagcagcucg

SEQ ID NO: 2920499 - RNA, 17 nt, Mycobacterium avium subsp. paratuberculosis
augccgagcagcucggc

SEQ ID NO: 2920500 - RNA, 18 nt, Mycobacterium avium subsp. paratuberculosis
augccgagcagcucggcg

SEQ ID NO: 2920501 - RNA, 20 nt, Mycobacterium avium subsp. paratuberculosis
augccgagcagcucggcggc

SEQ ID NO: 2920502 - RNA, 21 nt, Mycobacterium avium subsp. paratuberculosis
augccgagcccuuugcgcugc

SEQ ID NO: 2920503 - RNA, 20 nt, Mycobacterium avium subsp. paratuberculosis
augccgagccgcuugguggc

SEQ ID NO: 2920504 - RNA, 16 nt, Mycobacterium avium subsp. paratuberculosis
augccgaggcacagca

SEQ ID NO: 2920505 - RNA, 19 nt, Mycobacterium avium subsp. paratuberculosis
augccgaggcacagcagca

SEQ ID NO: 2920506 - RNA, 15 nt, Mycobacterium avium subsp. paratuberculosis
augccgaugcccauc

SEQ ID NO: 2920507 - RNA, 16 nt, Mycobacterium avium subsp. paratuberculosis
augccgcccaccaccg

SEQ ID NO: 2920508 - RNA, 13 nt, Mycobacterium avium subsp. paratuberculosis
augccgcccagca

SEQ ID NO: 2920509 - RNA, 12 nt, Mycobacterium avium subsp. paratuberculosis
augccgcccauc

SEQ ID NO: 2920510 - RNA, 17 nt, Mycobacterium avium subsp. paratuberculosis
augccgcccaucagcag

SEQ ID NO: 2920511 - RNA, 19 nt, Mycobacterium avium subsp. paratuberculosis
augccgcccaucagcagga

SEQ ID NO: 2920512 - RNA, 16 nt, Mycobacterium avium subsp. paratuberculosis
augccgcccgggccgu

SEQ ID NO: 2920513 - RNA, 19 nt, Mycobacterium avium subsp. paratuberculosis
augccgcccgggccguauc

SEQ ID NO: 2920514 - RNA, 21 nt, Mycobacterium avium subsp. paratuberculosis
augccgcccuugcucgcggcg

SEQ ID NO: 2920515 - RNA, 10 nt, Mycobacterium avium subsp. paratuberculosis
augccgccga

SEQ ID NO: 2920516 - RNA, 19 nt, Mycobacterium avium subsp. paratuberculosis
augccgccgaagcccgaca

SEQ ID NO: 2920517 - RNA, 19 nt, Mycobacterium avium subsp. paratuberculosis
augccgccgaagcggcgca

SEQ ID NO: 2920518 - RNA, 16 nt, Mycobacterium avium subsp. paratuberculosis
augccgccgaccgccg

SEQ ID NO: 2920519 - RNA, 13 nt, Mycobacterium avium subsp. paratuberculosis
augccgccgacga

SEQ ID NO: 2920520 - RNA, 15 nt, Mycobacterium avium subsp. paratuberculosis
augccgccgacgaug

SEQ ID NO: 2920521 - RNA, 19 nt, Mycobacterium avium subsp. paratuberculosis
augccgccgagggccagca

SEQ ID NO: 2920522 - RNA, 22 nt, Mycobacterium avium subsp. paratuberculosis
augccgccgagggccagcagcc

SEQ ID NO: 2920523 - RNA, 23 nt, Mycobacterium avium subsp. paratuberculosis
augccgccgagggccagcagcca

SEQ ID NO: 2920524 - RNA, 16 nt, Mycobacterium avium subsp. paratuberculosis
augccgccgcgacgau

SEQ ID NO: 2920525 - RNA, 21 nt, Mycobacterium avium subsp. paratuberculosis
augccgccgcgacgaugccgg

SEQ ID NO: 2920526 - RNA, 22 nt, Mycobacterium avium subsp. paratuberculosis
augccgccgcgacgaugccggc

SEQ ID NO: 2920527 - RNA, 10 nt, Mycobacterium avium subsp. paratuberculosis
augccgccgg

SEQ ID NO: 2920528 - RNA, 14 nt, Mycobacterium avium subsp. paratuberculosis
augccgcgcaggcc

SEQ ID NO: 2920529 - RNA, 20 nt, Mycobacterium avium subsp. paratuberculosis
augccgcgcaggccguccag

SEQ ID NO: 2920530 - RNA, 22 nt, Mycobacterium avium subsp. paratuberculosis
augccgcgcaggccguccagca

SEQ ID NO: 2920531 - RNA, 14 nt, Mycobacterium avium subsp. paratuberculosis
augccgcgcggcgc

SEQ ID NO: 2920532 - RNA, 15 nt, Mycobacterium avium subsp. paratuberculosis
augccgcgcucgaac

SEQ ID NO: 2920533 - RNA, 13 nt, Mycobacterium avium subsp. paratuberculosis
augccgcgcucgu

SEQ ID NO: 2920534 - RNA, 16 nt, Mycobacterium avium subsp. paratuberculosis
augccgcgcugcgccg

SEQ ID NO: 2920535 - RNA, 22 nt, Mycobacterium avium subsp. paratuberculosis
augccgcgcuugguggcgacga

SEQ ID NO: 2920536 - RNA, 23 nt, Mycobacterium avium subsp. paratuberculosis
augccgcgcuugguggcgacgaa

SEQ ID NO: 2920537 - RNA, 15 nt, Mycobacterium avium subsp. paratuberculosis
augccgcgggccagc

SEQ ID NO: 2920538 - RNA, 16 nt, Mycobacterium avium subsp. paratuberculosis
augccgcguuccacgc

SEQ ID NO: 2920539 - RNA, 20 nt, Mycobacterium avium subsp. paratuberculosis
augccgcuuuccaaccaggc

SEQ ID NO: 2920540 - RNA, 21 nt, Mycobacterium avium subsp. paratuberculosis
augccggaaaaguucggcggg

SEQ ID NO: 2920541 - RNA, 22 nt, Mycobacterium avium subsp. paratuberculosis
augccggaaaaguucggcgggg

SEQ ID NO: 2920542 - RNA, 19 nt, Mycobacterium avium subsp. paratuberculosis
augccggacuugaugcugc

SEQ ID NO: 2920543 - RNA, 12 nt, Mycobacterium avium subsp. paratuberculosis
augccggagaug

SEQ ID NO: 2920544 - RNA, 11 nt, Mycobacterium avium subsp. paratuberculosis
augccggaucg

SEQ ID NO: 2920545 - RNA, 15 nt, Mycobacterium avium subsp. paratuberculosis
augccggaucgggac

SEQ ID NO: 2920546 - RNA, 20 nt, Mycobacterium avium subsp. paratuberculosis
augccggcaaccgcugcggu

SEQ ID NO: 2920547 - RNA, 17 nt, Mycobacterium avium subsp. paratuberculosis
augccggcauccucggc

SEQ ID NO: 2920548 - RNA, 14 nt, Mycobacterium avium subsp. paratuberculosis
augccggccagccg

SEQ ID NO: 2920549 - RNA, 17 nt, Mycobacterium avium subsp. paratuberculosis
augccggccagccgcgc

SEQ ID NO: 2920550 - RNA, 19 nt, Mycobacterium avium subsp. paratuberculosis
augccggccagccgcgcga

SEQ ID NO: 2920551 - RNA, 19 nt, Mycobacterium avium subsp. paratuberculosis
augccggccagcggccagc

SEQ ID NO: 2920552 - RNA, 16 nt, Mycobacterium avium subsp. paratuberculosis
augccggccaggcaca

SEQ ID NO: 2920553 - RNA, 13 nt, Mycobacterium avium subsp. paratuberculosis
augccggccgcgu

SEQ ID NO: 2920554 - RNA, 15 nt, Mycobacterium avium subsp. paratuberculosis
augccggccgcguac

SEQ ID NO: 2920555 - RNA, 12 nt, Mycobacterium avium subsp. paratuberculosis
augccggccggc

SEQ ID NO: 2920556 - RNA, 20 nt, Mycobacterium avium subsp. paratuberculosis
augccggccuggcccagccg

SEQ ID NO: 2920557 - RNA, 21 nt, Mycobacterium avium subsp. paratuberculosis
augccggccuucucgcgcacc

SEQ ID NO: 2920558 - RNA, 20 nt, Mycobacterium avium subsp. paratuberculosis
augccggcgaacucgcggcg

SEQ ID NO: 2920559 - RNA, 18 nt, Mycobacterium avium subsp. paratuberculosis
augccggcgauccgcgcg

SEQ ID NO: 2920560 - RNA, 21 nt, Mycobacterium avium subsp. paratuberculosis
augccggcgauccgcgcggcg

SEQ ID NO: 2920561 - RNA, 16 nt, Mycobacterium avium subsp. paratuberculosis
augccggcgcccagcg

SEQ ID NO: 2920562 - RNA, 17 nt, Mycobacterium avium subsp. paratuberculosis
augccggcgcccagcgg

SEQ ID NO: 2920563 - RNA, 20 nt, Mycobacterium avium subsp. paratuberculosis
augccggcgcccagcggcga

SEQ ID NO: 2920564 - RNA, 13 nt, Mycobacterium avium subsp. paratuberculosis
augccggcgccga

SEQ ID NO: 2920565 - RNA, 14 nt, Mycobacterium avium subsp. paratuberculosis
augccggcgccgau

SEQ ID NO: 2920566 - RNA, 22 nt, Mycobacterium avium subsp. paratuberculosis
augccggcggacagccccgagc

SEQ ID NO: 2920567 - RNA, 12 nt, Mycobacterium avium subsp. paratuberculosis
augccggcggua

SEQ ID NO: 2920568 - RNA, 19 nt, Mycobacterium avium subsp. paratuberculosis
augccggcgguaccgccga

SEQ ID NO: 2920569 - RNA, 21 nt, Mycobacterium avium subsp. paratuberculosis
augccggcgguaccgccgauc

SEQ ID NO: 2920570 - RNA, 14 nt, Mycobacterium avium subsp. paratuberculosis
augccggcgguguc

SEQ ID NO: 2920571 - RNA, 22 nt, Mycobacterium avium subsp. paratuberculosis
augccggcgguguccacgaugc

SEQ ID NO: 2920572 - RNA, 23 nt, Mycobacterium avium subsp. paratuberculosis
augcggccgacuuggucagcccg

SEQ ID NO: 2920573 - RNA, 13 nt, Mycobacterium avium subsp. paratuberculosis
augcggccgucgg

SEQ ID NO: 2920574 - RNA, 16 nt, Mycobacterium avium subsp. paratuberculosis
augcggcucccaccgu

SEQ ID NO: 2920575 - RNA, 16 nt, Mycobacterium avium subsp. paratuberculosis
augcggcugccggcca

SEQ ID NO: 2920576 - RNA, 17 nt, Mycobacterium avium subsp. paratuberculosis
augcggcugccggccaa

SEQ ID NO: 2920577 - RNA, 22 nt, Mycobacterium avium subsp. paratuberculosis
augcggcugccggccaaggcaa

SEQ ID NO: 2920578 - RNA, 12 nt, Mycobacterium avium subsp. paratuberculosis
augcggcugggu

SEQ ID NO: 2920579 - RNA, 13 nt, Mycobacterium avium subsp. paratuberculosis
augcgggccaccg

SEQ ID NO: 2920580 - RNA, 13 nt, Mycobacterium avium subsp. paratuberculosis
augcgggccagga

SEQ ID NO: 2920581 - RNA, 21 nt, Mycobacterium avium subsp. paratuberculosis
augcgggcccgcaacuguucg

SEQ ID NO: 2920582 - RNA, 18 nt, Mycobacterium avium subsp. paratuberculosis
augcgggcgauggcgggc

SEQ ID NO: 2920583 - RNA, 13 nt, Mycobacterium avium subsp. paratuberculosis
augcggggccggc

SEQ ID NO: 2920584 - RNA, 14 nt, Mycobacterium avium subsp. paratuberculosis
augcggggccggcg

SEQ ID NO: 2920585 - RNA, 16 nt, Mycobacterium avium subsp. paratuberculosis
augcggggcggcggga

SEQ ID NO: 2920586 - RNA, 18 nt, Mycobacterium avium subsp. paratuberculosis
augcgguccucgagcugg

SEQ ID NO: 2920587 - RNA, 22 nt, Mycobacterium avium subsp. paratuberculosis
augcggucgaugagcuggugca

SEQ ID NO: 2920588 - RNA, 13 nt, Mycobacterium avium subsp. paratuberculosis
augcggucggcgc

SEQ ID NO: 2920589 - RNA, 16 nt, Mycobacterium avium subsp. paratuberculosis
augcggucgucgccca

SEQ ID NO: 2920590 - RNA, 16 nt, Mycobacterium avium subsp. paratuberculosis
augcggugccgggcca

SEQ ID NO: 2920591 - RNA, 20 nt, Mycobacterium avium subsp. paratuberculosis
augcggugcugccgugccga

SEQ ID NO: 2920592 - RNA, 22 nt, Mycobacterium avium subsp. paratuberculosis
augcgguggucgaacacggcgc

SEQ ID NO: 2920593 - RNA, 13 nt, Mycobacterium avium subsp. paratuberculosis
augcggugguggg

SEQ ID NO: 2920594 - RNA, 14 nt, Mycobacterium avium subsp. paratuberculosis
augcgucaugccgg

SEQ ID NO: 2920595 - RNA, 17 nt, Mycobacterium avium subsp. paratuberculosis
augcgucaugccggaga

SEQ ID NO: 2920596 - RNA, 20 nt, Mycobacterium avium subsp. paratuberculosis
augcgucccguuggcgccgg

SEQ ID NO: 2920597 - RNA, 15 nt, Mycobacterium avium subsp. paratuberculosis
augcgucgcggcggc

SEQ ID NO: 2920598 - RNA, 18 nt, Mycobacterium avium subsp. paratuberculosis
augcgucgcggcggcgcu

SEQ ID NO: 2920599 - RNA, 13 nt, Mycobacterium avium subsp. paratuberculosis
augcguuccaggu

SEQ ID NO: 2920600 - RNA, 14 nt, Mycobacterium avium subsp. paratuberculosis
augcguucggccgc

SEQ ID NO: 2920601 - RNA, 17 nt, Mycobacterium avium subsp. paratuberculosis
augcguucggccgcagc

SEQ ID NO: 2920602 - RNA, 16 nt, Mycobacterium avium subsp. paratuberculosis
augcguugcgccagca

SEQ ID NO: 2920603 - RNA, 16 nt, Mycobacterium avium subsp. paratuberculosis
augcguuugccgucga

SEQ ID NO: 2920604 - RNA, 14 nt, Mycobacterium avium subsp. paratuberculosis
augcucaggaugau

SEQ ID NO: 2920605 - RNA, 15 nt, Mycobacterium avium subsp. paratuberculosis
augcucgucggucag

SEQ ID NO: 2920606 - RNA, 11 nt, Mycobacterium avium subsp. paratuberculosis
augcucuugcg

SEQ ID NO: 2920607 - RNA, 13 nt, Mycobacterium avium subsp. paratuberculosis
augcugauacccg

SEQ ID NO: 2920608 - RNA, 21 nt, Mycobacterium avium subsp. paratuberculosis
augcugauacccgcgcggcgc

SEQ ID NO: 2920609 - RNA, 22 nt, Mycobacterium avium subsp. paratuberculosis
augcugcaacggcuggcgcagg

SEQ ID NO: 2920610 - RNA, 13 nt, Mycobacterium avium subsp. paratuberculosis
augcugccgccgg

SEQ ID NO: 2920611 - RNA, 20 nt, Mycobacterium avium subsp. paratuberculosis
augcugcgcaacaccucggc

SEQ ID NO: 2920612 - RNA, 19 nt, Mycobacterium avium subsp. paratuberculosis
augcugcgggucagcagcu

SEQ ID NO: 2920613 - RNA, 20 nt, Mycobacterium avium subsp. paratuberculosis
augcuggccaucgccgagcc

SEQ ID NO: 2920614 - RNA, 16 nt, Mycobacterium avium subsp. paratuberculosis
augcuggggucggcca

SEQ ID NO: 2920615 - RNA, 18 nt, Mycobacterium avium subsp. paratuberculosis
augcuggggucggccagc

SEQ ID NO: 2920616 - RNA, 23 nt, Mycobacterium avium subsp. paratuberculosis
augcuggugacgccgcuguccuc

SEQ ID NO: 2920617 - RNA, 17 nt, Mycobacterium avium subsp. paratuberculosis
augcugucgcgggucug

SEQ ID NO: 2920618 - RNA, 23 nt, Mycobacterium avium subsp. paratuberculosis
augcugugcgcuugggucgccgg

SEQ ID NO: 2920619 - RNA, 17 nt, Mycobacterium avium subsp. paratuberculosis
augcuuggucgcggcgu

SEQ ID NO: 2920620 - RNA, 13 nt, Mycobacterium avium subsp. paratuberculosis
auggaaggugcug

SEQ ID NO: 2920621 - RNA, 17 nt, Mycobacterium avium subsp. paratuberculosis
auggaaugugccugcgg

SEQ ID NO: 2920622 - RNA, 20 nt, Mycobacterium avium subsp. paratuberculosis
auggaaugugccugcgggcc

SEQ ID NO: 2920623 - RNA, 14 nt, Mycobacterium avium subsp. paratuberculosis
auggacacgcccug

SEQ ID NO: 2920624 - RNA, 19 nt, Mycobacterium avium subsp. paratuberculosis
auggacaggcacucgccca

SEQ ID NO: 2920625 - RNA, 16 nt, Mycobacterium avium subsp. paratuberculosis
auggacagggcgacau

SEQ ID NO: 2920626 - RNA, 22 nt, Mycobacterium avium subsp. paratuberculosis
auggacagggcgacaucggcac

SEQ ID NO: 2920627 - RNA, 19 nt, Mycobacterium avium subsp. paratuberculosis
auggacgaagugcccgccu

SEQ ID NO: 2920628 - RNA, 18 nt, Mycobacterium avium subsp. paratuberculosis
auggacguccagcggccc

SEQ ID NO: 2920629 - RNA, 18 nt, Mycobacterium avium subsp. paratuberculosis
auggagaaaauccagaac

SEQ ID NO: 2920630 - RNA, 21 nt, Mycobacterium avium subsp. paratuberculosis
auggagaaaauccagaacagc

SEQ ID NO: 2920631 - RNA, 22 nt, Mycobacterium avium subsp. paratuberculosis
auggagcgcgacgggcugcugc

SEQ ID NO: 2920632 - RNA, 23 nt, Mycobacterium avium subsp. paratuberculosis
auggagcgcgacgggcugcugca

SEQ ID NO: 2920633 - RNA, 18 nt, Mycobacterium avium subsp. paratuberculosis
auggcaauacgccucgca

SEQ ID NO: 2920634 - RNA, 12 nt, Mycobacterium avium subsp. paratuberculosis
auggcagcagcc

SEQ ID NO: 2920635 - RNA, 11 nt, Mycobacterium avium subsp. paratuberculosis
auggcaucgcc

SEQ ID NO: 2920636 - RNA, 19 nt, Mycobacterium avium subsp. paratuberculosis
auggccaccaucaggccgg

SEQ ID NO: 2920637 - RNA, 13 nt, Mycobacterium avium subsp. paratuberculosis
auggccagcacca

SEQ ID NO: 2920638 - RNA, 16 nt, Mycobacterium avium subsp. paratuberculosis
auggccagcagguaga

SEQ ID NO: 2920639 - RNA, 16 nt, Mycobacterium avium subsp. paratuberculosis
auggccagcgcggcgu

SEQ ID NO: 2920640 - RNA, 17 nt, Mycobacterium avium subsp. paratuberculosis
auggccagcgcggcguc

SEQ ID NO: 2920641 - RNA, 15 nt, Mycobacterium avium subsp. paratuberculosis
auggccagcgcgucg

SEQ ID NO: 2920642 - RNA, 19 nt, Mycobacterium avium subsp. paratuberculosis
auggccagcucgucgcgga

SEQ ID NO: 2920643 - RNA, 13 nt, Mycobacterium avium subsp. paratuberculosis
auggccaggaacg

SEQ ID NO: 2920644 - RNA, 18 nt, Mycobacterium avium subsp. paratuberculosis
auggcccaggccgcgguc

SEQ ID NO: 2920645 - RNA, 15 nt, Mycobacterium avium subsp. paratuberculosis
auggcccgcugcgcc

SEQ ID NO: 2920646 - RNA, 17 nt, Mycobacterium avium subsp. paratuberculosis
auggcccggaccgccgc

SEQ ID NO: 2920647 - RNA, 19 nt, Mycobacterium avium subsp. paratuberculosis
auggcccggaccgccgcgg

SEQ ID NO: 2920648 - RNA, 23 nt, Mycobacterium avium subsp. paratuberculosis
auggcccggaccgccgcggcggc

SEQ ID NO: 2920649 - RNA, 19 nt, Mycobacterium avium subsp. paratuberculosis
auggcccgggccacacccg

SEQ ID NO: 2920650 - RNA, 11 nt, Mycobacterium avium subsp. paratuberculosis
auggccgccgc

SEQ ID NO: 2920651 - RNA, 16 nt, Mycobacterium avium subsp. paratuberculosis
auggccgccgcaggcg

SEQ ID NO: 2920652 - RNA, 15 nt, Mycobacterium avium subsp. paratuberculosis
auggccgcgccgccg

SEQ ID NO: 2920653 - RNA, 16 nt, Mycobacterium avium subsp. paratuberculosis
auggccgcgccgccgc

SEQ ID NO: 2920654 - RNA, 21 nt, Mycobacterium avium subsp. paratuberculosis
auggccgcgccguagcggccc

SEQ ID NO: 2920655 - RNA, 15 nt, Mycobacterium avium subsp. paratuberculosis
auggccgcuucgggg

SEQ ID NO: 2920656 - RNA, 13 nt, Mycobacterium avium subsp. paratuberculosis
auggccggccggg

SEQ ID NO: 2920657 - RNA, 19 nt, Mycobacterium avium subsp. paratuberculosis
auggucaccggggugccgc

SEQ ID NO: 2920658 - RNA, 14 nt, Mycobacterium avium subsp. paratuberculosis
auggucaccguguc

SEQ ID NO: 2920659 - RNA, 14 nt, Mycobacterium avium subsp. paratuberculosis
auggucagccgcac

SEQ ID NO: 2920660 - RNA, 14 nt, Mycobacterium avium subsp. paratuberculosis
augguccagcaccg

SEQ ID NO: 2920661 - RNA, 17 nt, Mycobacterium avium subsp. paratuberculosis
augguccugcaccgagu

SEQ ID NO: 2920662 - RNA, 17 nt, Mycobacterium avium subsp. paratuberculosis
auggucgagccgcaguc

SEQ ID NO: 2920663 - RNA, 23 nt, Mycobacterium avium subsp. paratuberculosis
auggucgagggcguucgcggugg

SEQ ID NO: 2920664 - RNA, 20 nt, Mycobacterium avium subsp. paratuberculosis
auggucgccgacgguggcga

SEQ ID NO: 2920665 - RNA, 22 nt, Mycobacterium avium subsp. paratuberculosis
auggucgccgacgguggcgaag

SEQ ID NO: 2920666 - RNA, 13 nt, Mycobacterium avium subsp. paratuberculosis
auggucgccugcu

SEQ ID NO: 2920667 - RNA, 17 nt, Mycobacterium avium subsp. paratuberculosis
auggucgcgccgcggcg

SEQ ID NO: 2920668 - RNA, 16 nt, Mycobacterium avium subsp. paratuberculosis
auggucggcgacgccg

SEQ ID NO: 2920669 - RNA, 21 nt, Mycobacterium avium subsp. paratuberculosis
auggucgggacgucggcgcgc

SEQ ID NO: 2920670 - RNA, 22 nt, Mycobacterium avium subsp. paratuberculosis
auggucgggacgucggcgcgcu

SEQ ID NO: 2920671 - RNA, 23 nt, Mycobacterium avium subsp. paratuberculosis
auggucgucggguuggccagggc

SEQ ID NO: 2920672 - RNA, 13 nt, Mycobacterium avium subsp. paratuberculosis
auggucgucgucg

SEQ ID NO: 2920673 - RNA, 22 nt, Mycobacterium avium subsp. paratuberculosis
auggucucgcugaucucgacgg

SEQ ID NO: 2920674 - RNA, 13 nt, Mycobacterium avium subsp. paratuberculosis
auggucugcccgc

SEQ ID NO: 2920675 - RNA, 15 nt, Mycobacterium avium subsp. paratuberculosis
auggucuugccgcug

SEQ ID NO: 2920676 - RNA, 16 nt, Mycobacterium avium subsp. paratuberculosis
auggucuugccgcuga

SEQ ID NO: 2920677 - RNA, 19 nt, Mycobacterium avium subsp. paratuberculosis
auggugaaaucguccaucg

SEQ ID NO: 2920678 - RNA, 22 nt, Mycobacterium avium subsp. paratuberculosis
auggugaacuccgucucgccgu

SEQ ID NO: 2920679 - RNA, 14 nt, Mycobacterium avium subsp. paratuberculosis
auggugaaggcgaa

SEQ ID NO: 2920680 - RNA, 19 nt, Mycobacterium avium subsp. paratuberculosis
auggugaaggugcccuccu

SEQ ID NO: 2920681 - RNA, 21 nt, Mycobacterium avium subsp. paratuberculosis
auggugaaggugcccuccucg

SEQ ID NO: 2920682 - RNA, 11 nt, Mycobacterium avium subsp. paratuberculosis
auggugaaguu

SEQ ID NO: 2920683 - RNA, 22 nt, Mycobacterium avium subsp. paratuberculosis
auggugaaguugccggucaggc

SEQ ID NO: 2920684 - RNA, 16 nt, Mycobacterium avium subsp. paratuberculosis
auggugaccagcgccc

SEQ ID NO: 2920685 - RNA, 13 nt, Mycobacterium avium subsp. paratuberculosis
auggugacggccg

SEQ ID NO: 2920686 - RNA, 14 nt, Mycobacterium avium subsp. paratuberculosis
auggugacggccgu

SEQ ID NO: 2920687 - RNA, 13 nt, Mycobacterium avium subsp. paratuberculosis
auggugaucgacc

SEQ ID NO: 2920688 - RNA, 20 nt, Mycobacterium avium subsp. paratuberculosis
auggugaucucgccgcggug

SEQ ID NO: 2920689 - RNA, 23 nt, Mycobacterium avium subsp. paratuberculosis
auggugcccaccgggcagccgca

SEQ ID NO: 2920690 - RNA, 19 nt, Mycobacterium avium subsp. paratuberculosis
auggugcccuucgaguugc

SEQ ID NO: 2920691 - RNA, 16 nt, Mycobacterium avium subsp. paratuberculosis
auggugccggccaugc

SEQ ID NO: 2920692 - RNA, 12 nt, Mycobacterium avium subsp. paratuberculosis
auggugcugccc

SEQ ID NO: 2920693 - RNA, 15 nt, Mycobacterium avium subsp. paratuberculosis
augguggccgucggc

SEQ ID NO: 2920694 - RNA, 16 nt, Mycobacterium avium subsp. paratuberculosis
augguggcgcugccga

SEQ ID NO: 2920695 - RNA, 18 nt, Mycobacterium avium subsp. paratuberculosis
augguggcgcugccgagc

SEQ ID NO: 2920696 - RNA, 19 nt, Mycobacterium avium subsp. paratuberculosis
augguggcgcugccgagca

SEQ ID NO: 2920697 - RNA, 20 nt, Mycobacterium avium subsp. paratuberculosis
augguggcgcugccgagcac

SEQ ID NO: 2920698 - RNA, 14 nt, Mycobacterium avium subsp. paratuberculosis
augguggcggccac

SEQ ID NO: 2920699 - RNA, 14 nt, Mycobacterium avium subsp. paratuberculosis
augguggcggcgcc

SEQ ID NO: 2920700 - RNA, 18 nt, Mycobacterium avium subsp. paratuberculosis
augguggcggcgccggau

SEQ ID NO: 2920701 - RNA, 16 nt, Mycobacterium avium subsp. paratuberculosis
auggugggcagccggc

SEQ ID NO: 2920702 - RNA, 17 nt, Mycobacterium avium subsp. paratuberculosis
auggugggcagccggca

SEQ ID NO: 2920703 - RNA, 13 nt, Mycobacterium avium subsp. paratuberculosis
auggugguaccga

SEQ ID NO: 2920704 - RNA, 15 nt, Mycobacterium avium subsp. paratuberculosis
auggugguaccgacc

SEQ ID NO: 2920705 - RNA, 14 nt, Mycobacterium avium subsp. paratuberculosis
augguggucgccgu

SEQ ID NO: 2920706 - RNA, 18 nt, Mycobacterium avium subsp. paratuberculosis
augguguaguccugcuuc

SEQ ID NO: 2920707 - RNA, 19 nt, Mycobacterium avium subsp. paratuberculosis
auggugucaggaucgccgg

SEQ ID NO: 2920708 - RNA, 14 nt, Mycobacterium avium subsp. paratuberculosis
auggugucccauuc

SEQ ID NO: 2920709 - RNA, 22 nt, Mycobacterium avium subsp. paratuberculosis
auggugucccauucgugguugc

SEQ ID NO: 2920710 - RNA, 14 nt, Mycobacterium avium subsp. paratuberculosis
augguuuccacugc

SEQ ID NO: 2920711 - RNA, 23 nt, Mycobacterium avium subsp. paratuberculosis
auguaagcgaauaccaucaaccc

SEQ ID NO: 2920712 - RNA, 13 nt, Mycobacterium avium subsp. paratuberculosis
auguacaggauca

SEQ ID NO: 2920713 - RNA, 13 nt, Mycobacterium avium subsp. paratuberculosis
auguagcagcgcg

SEQ ID NO: 2920714 - RNA, 15 nt, Mycobacterium avium subsp. paratuberculosis
auguagcagcgcggc

SEQ ID NO: 2920715 - RNA, 13 nt, Mycobacterium avium subsp. paratuberculosis
auguagccgggcu

SEQ ID NO: 2920716 - RNA, 17 nt, Mycobacterium avium subsp. paratuberculosis
auguaguucagcagccg

SEQ ID NO: 2920717 - RNA, 19 nt, Mycobacterium avium subsp. paratuberculosis
auguaguucagcagccggc

SEQ ID NO: 2920718 - RNA, 22 nt, Mycobacterium avium subsp. paratuberculosis
augucacccguuugaggcgagc

SEQ ID NO: 2920719 - RNA, 14 nt, Mycobacterium avium subsp. paratuberculosis
augucacggcgggu

SEQ ID NO: 2920720 - RNA, 16 nt, Mycobacterium avium subsp. paratuberculosis
augucacgguccaggu

SEQ ID NO: 2920721 - RNA, 18 nt, Mycobacterium avium subsp. paratuberculosis
augucacgguccaggucc

SEQ ID NO: 2920722 - RNA, 16 nt, Mycobacterium avium subsp. paratuberculosis
auguccaggccgucga

SEQ ID NO: 2920723 - RNA, 16 nt, Mycobacterium avium subsp. paratuberculosis
auguccgccggccggu

SEQ ID NO: 2920724 - RNA, 21 nt, Mycobacterium avium subsp. paratuberculosis
auguccggcaggcucagcagc

SEQ ID NO: 2920725 - RNA, 17 nt, Mycobacterium avium subsp. paratuberculosis
auguccggggugagcag

SEQ ID NO: 2920726 - RNA, 16 nt, Mycobacterium avium subsp. paratuberculosis
auguccuacggcgggu

SEQ ID NO: 2920727 - RNA, 15 nt, Mycobacterium avium subsp. paratuberculosis
augucgaaccccacg

SEQ ID NO: 2920728 - RNA, 17 nt, Mycobacterium avium subsp. paratuberculosis
augucgaagaagcggcc

SEQ ID NO: 2920729 - RNA, 14 nt, Mycobacterium avium subsp. paratuberculosis
augucgaccaccgg

SEQ ID NO: 2920730 - RNA, 17 nt, Mycobacterium avium subsp. paratuberculosis
augucgaccaccgggua

SEQ ID NO: 2920731 - RNA, 16 nt, Mycobacterium avium subsp. paratuberculosis
augucgacccgcggcg

SEQ ID NO: 2920732 - RNA, 14 nt, Mycobacterium avium subsp. paratuberculosis
augucgaccucggc

SEQ ID NO: 2920733 - RNA, 13 nt, Mycobacterium avium subsp. paratuberculosis
augucgacgcuga

SEQ ID NO: 2920734 - RNA, 18 nt, Mycobacterium avium subsp. paratuberculosis
augucgacgucgucgacc

SEQ ID NO: 2920735 - RNA, 16 nt, Mycobacterium avium subsp. paratuberculosis
augucgaugacggcgg

SEQ ID NO: 2920736 - RNA, 17 nt, Mycobacterium avium subsp. paratuberculosis
augucgaugacggcggc

SEQ ID NO: 2920737 - RNA, 20 nt, Mycobacterium avium subsp. paratuberculosis
augucgaugacggcggcgcc

SEQ ID NO: 2920738 - RNA, 16 nt, Mycobacterium avium subsp. paratuberculosis
augucgaugccgagcc

SEQ ID NO: 2920739 - RNA, 17 nt, Mycobacterium avium subsp. paratuberculosis
augucgcccggcgcggc

SEQ ID NO: 2920740 - RNA, 15 nt, Mycobacterium avium subsp. paratuberculosis
augucgcccggcggc

SEQ ID NO: 2920741 - RNA, 21 nt, Mycobacterium avium subsp. paratuberculosis
augucgcccggcggcaccgag

SEQ ID NO: 2920742 - RNA, 15 nt, Mycobacterium avium subsp. paratuberculosis
auuccggugugccga

SEQ ID NO: 2920743 - RNA, 14 nt, Mycobacterium avium subsp. paratuberculosis
auuccucagcgccc

SEQ ID NO: 2920744 - RNA, 13 nt, Mycobacterium avium subsp. paratuberculosis
auuccucggccag

SEQ ID NO: 2920745 - RNA, 17 nt, Mycobacterium avium subsp. paratuberculosis
auucgaucaaaucccgc

SEQ ID NO: 2920746 - RNA, 14 nt, Mycobacterium avium subsp. paratuberculosis
auucgcccaccccg

SEQ ID NO: 2920747 - RNA, 16 nt, Mycobacterium avium subsp. paratuberculosis
auucgcccaccccggc

SEQ ID NO: 2920748 - RNA, 16 nt, Mycobacterium avium subsp. paratuberculosis
auucgccggggcacca

SEQ ID NO: 2920749 - RNA, 17 nt, Mycobacterium avium subsp. paratuberculosis
auucgccggggcaccau

SEQ ID NO: 2920750 - RNA, 22 nt, Mycobacterium avium subsp. paratuberculosis
auucgccgucgugguggccgcg

SEQ ID NO: 2920751 - RNA, 15 nt, Mycobacterium avium subsp. paratuberculosis
auucgcgcggcgccc

SEQ ID NO: 2920752 - RNA, 15 nt, Mycobacterium avium subsp. paratuberculosis
auucgcggcggcgcc

SEQ ID NO: 2920753 - RNA, 21 nt, Mycobacterium avium subsp. paratuberculosis
auucgcgggugcgcucgacgg

SEQ ID NO: 2920754 - RNA, 16 nt, Mycobacterium avium subsp. paratuberculosis
auucggacggcccacg

SEQ ID NO: 2920755 - RNA, 21 nt, Mycobacterium avium subsp. paratuberculosis
auucggagaccaggucggccu

SEQ ID NO: 2920756 - RNA, 14 nt, Mycobacterium avium subsp. paratuberculosis
auucggccgggucc

SEQ ID NO: 2920757 - RNA, 12 nt, Mycobacterium avium subsp. paratuberculosis
auucggcgacgc

SEQ ID NO: 2920758 - RNA, 11 nt, Mycobacterium avium subsp. paratuberculosis
auucggcgccg

SEQ ID NO: 2920759 - RNA, 15 nt, Mycobacterium avium subsp. paratuberculosis
auucggcgccgcgac

SEQ ID NO: 2920760 - RNA, 22 nt, Mycobacterium avium subsp. paratuberculosis
auucggcuucguaacacccucg

SEQ ID NO: 2920761 - RNA, 14 nt, Mycobacterium avium subsp. paratuberculosis
auucgggccagcgc

SEQ ID NO: 2920762 - RNA, 14 nt, Mycobacterium avium subsp. paratuberculosis
auucgggccgccgc

SEQ ID NO: 2920763 - RNA, 21 nt, Mycobacterium avium subsp. paratuberculosis
auucgggccgccgcgcgggua

SEQ ID NO: 2920764 - RNA, 22 nt, Mycobacterium avium subsp. paratuberculosis
auucgggccugaccaaggacaa

SEQ ID NO: 2920765 - RNA, 22 nt, Mycobacterium avium subsp. paratuberculosis
auucggguggcgucgccgccgg

SEQ ID NO: 2920766 - RNA, 23 nt, Mycobacterium avium subsp. paratuberculosis
auucgguaccagggcagcgccuc

SEQ ID NO: 2920767 - RNA, 22 nt, Mycobacterium avium subsp. paratuberculosis
auucgguggcgauggugcugcc

SEQ ID NO: 2920768 - RNA, 15 nt, Mycobacterium avium subsp. paratuberculosis
auucgguuuccccuu

SEQ ID NO: 2920769 - RNA, 20 nt, Mycobacterium avium subsp. paratuberculosis
auucgguuuccccuuuggcg

SEQ ID NO: 2920770 - RNA, 15 nt, Mycobacterium avium subsp. paratuberculosis
auucgucgucggccu

SEQ ID NO: 2920771 - RNA, 14 nt, Mycobacterium avium subsp. paratuberculosis
auucucagacgaaa

SEQ ID NO: 2920772 - RNA, 17 nt, Mycobacterium avium subsp. paratuberculosis
auucucagcagcgggcc

SEQ ID NO: 2920773 - RNA, 17 nt, Mycobacterium avium subsp. paratuberculosis
auucucgcugcggcgca

SEQ ID NO: 2920774 - RNA, 15 nt, Mycobacterium avium subsp. paratuberculosis
auucugcugcccgac

SEQ ID NO: 2920775 - RNA, 19 nt, Mycobacterium avium subsp. paratuberculosis
auucuguugccggacaccu

SEQ ID NO: 2920776 - RNA, 19 nt, Mycobacterium avium subsp. paratuberculosis
auucuguugucggcucgcc

SEQ ID NO: 2920777 - RNA, 16 nt, Mycobacterium avium subsp. paratuberculosis
auucuugaccaccuug

SEQ ID NO: 2920778 - RNA, 15 nt, Mycobacterium avium subsp. paratuberculosis
auugaacgccgccaa

SEQ ID NO: 2920779 - RNA, 19 nt, Mycobacterium avium subsp. paratuberculosis
auugaacgccgccaacagg

SEQ ID NO: 2920780 - RNA, 15 nt, Mycobacterium avium subsp. paratuberculosis
auugaauucgaccac

SEQ ID NO: 2920781 - RNA, 14 nt, Mycobacterium avium subsp. paratuberculosis
auugaccagcacgu

SEQ ID NO: 2920782 - RNA, 13 nt, Mycobacterium avium subsp. paratuberculosis
auugaccauccgg

SEQ ID NO: 2920783 - RNA, 15 nt, Mycobacterium avium subsp. paratuberculosis
auugcaccaccgucu

SEQ ID NO: 2920784 - RNA, 17 nt, Mycobacterium avium subsp. paratuberculosis
auugccagaaaucgccg

SEQ ID NO: 2920785 - RNA, 22 nt, Mycobacterium avium subsp. paratuberculosis
auugccagcuucgggcgcgcgc

SEQ ID NO: 2920786 - RNA, 17 nt, Mycobacterium avium subsp. paratuberculosis
auugcccaucgccacgc

SEQ ID NO: 2920787 - RNA, 23 nt, Mycobacterium avium subsp. paratuberculosis
auugcccgacuccucacaccucg

SEQ ID NO: 2920788 - RNA, 19 nt, Mycobacterium avium subsp. paratuberculosis
auugcccuuggacaccugc

SEQ ID NO: 2920789 - RNA, 14 nt, Mycobacterium avium subsp. paratuberculosis
auugccgagcaccc

SEQ ID NO: 2920790 - RNA, 12 nt, Mycobacterium avium subsp. paratuberculosis
auugccgcgccg

SEQ ID NO: 2920791 - RNA, 15 nt, Mycobacterium avium subsp. paratuberculosis
auugccgggcaccag

SEQ ID NO: 2920792 - RNA, 18 nt, Mycobacterium avium subsp. paratuberculosis
auugccuugcuccacacu

SEQ ID NO: 2920793 - RNA, 22 nt, Mycobacterium avium subsp. paratuberculosis
auugccuugcuccacacuggcu

SEQ ID NO: 2920794 - RNA, 18 nt, Mycobacterium avium subsp. paratuberculosis
auugcgacuugcgcgccg

SEQ ID NO: 2920795 - RNA, 15 nt, Mycobacterium avium subsp. paratuberculosis
auugcgagcaggccg

SEQ ID NO: 2920796 - RNA, 13 nt, Mycobacterium avium subsp. paratuberculosis
auugcgagccggu

SEQ ID NO: 2920797 - RNA, 17 nt, Mycobacterium avium subsp. paratuberculosis
auugcgauacgacggga

SEQ ID NO: 2920798 - RNA, 15 nt, Mycobacterium avium subsp. paratuberculosis
auugcgccagcagca

SEQ ID NO: 2920799 - RNA, 22 nt, Mycobacterium avium subsp. paratuberculosis
auugcgccagcagcaacgcggu

SEQ ID NO: 2920800 - RNA, 17 nt, Mycobacterium avium subsp. paratuberculosis
auugcgcccgccgaaca

SEQ ID NO: 2920801 - RNA, 14 nt, Mycobacterium avium subsp. paratuberculosis
auugcgccggucgu

SEQ ID NO: 2920802 - RNA, 14 nt, Mycobacterium avium subsp. paratuberculosis
auugcgcggcgccg

SEQ ID NO: 2920803 - RNA, 15 nt, Mycobacterium avium subsp. paratuberculosis
auugcgcggcgccgg

SEQ ID NO: 2920804 - RNA, 20 nt, Mycobacterium avium subsp. paratuberculosis
auugcgcuugucagcggccu

SEQ ID NO: 2920805 - RNA, 14 nt, Mycobacterium avium subsp. paratuberculosis
auugcggaucuugg

SEQ ID NO: 2920806 - RNA, 22 nt, Mycobacterium avium subsp. paratuberculosis
auugcggcccuugcggccgauc

SEQ ID NO: 2920807 - RNA, 17 nt, Mycobacterium avium subsp. paratuberculosis
auugcgugcccggccag

SEQ ID NO: 2920808 - RNA, 16 nt, Mycobacterium avium subsp. paratuberculosis
auugcuuuuugaccac

SEQ ID NO: 2920809 - RNA, 20 nt, Mycobacterium avium subsp. paratuberculosis
auugcuuuuugaccaccggc

SEQ ID NO: 2920810 - RNA, 16 nt, Mycobacterium avium subsp. paratuberculosis
auuggacagcggcgcg

SEQ ID NO: 2920811 - RNA, 14 nt, Mycobacterium avium subsp. paratuberculosis
auuggacgacacca

SEQ ID NO: 2920812 - RNA, 16 nt, Mycobacterium avium subsp. paratuberculosis
auuggcaccggaccgc

SEQ ID NO: 2920813 - RNA, 17 nt, Mycobacterium avium subsp. paratuberculosis
auuggccgagccgggcg

SEQ ID NO: 2920814 - RNA, 16 nt, Mycobacterium avium subsp. paratuberculosis
auuggccgcgcgcagg

SEQ ID NO: 2920815 - RNA, 22 nt, Mycobacterium avium subsp. paratuberculosis
auuggccgcgcgcaggcgcuga

SEQ ID NO: 2920816 - RNA, 20 nt, Mycobacterium avium subsp. paratuberculosis
auuggcgccacugccgccgc

SEQ ID NO: 2920817 - RNA, 22 nt, Mycobacterium avium subsp. paratuberculosis
auuggguugcggugcuugcuga

SEQ ID NO: 2920818 - RNA, 19 nt, Mycobacterium avium subsp. paratuberculosis
auugguggcccggucguac

SEQ ID NO: 2920819 - RNA, 11 nt, Mycobacterium avium subsp. paratuberculosis
auugucaucau

SEQ ID NO: 2920820 - RNA, 20 nt, Mycobacterium avium subsp. paratuberculosis
auugucgcugcgaggcgggc

SEQ ID NO: 2920821 - RNA, 14 nt, Mycobacterium avium subsp. paratuberculosis
auugucggccgccc

SEQ ID NO: 2920822 - RNA, 21 nt, Mycobacterium avium subsp. paratuberculosis
auuuaugaugccaguuuuugg

SEQ ID NO: 2920823 - RNA, 17 nt, Mycobacterium avium subsp. paratuberculosis
auuucaaggggccgggc

SEQ ID NO: 2920824 - RNA, 16 nt, Mycobacterium avium subsp. paratuberculosis
auuucaagguggacga

SEQ ID NO: 2920825 - RNA, 12 nt, Mycobacterium avium subsp. paratuberculosis
auuucagcagcg

SEQ ID NO: 2920826 - RNA, 17 nt, Mycobacterium avium subsp. paratuberculosis
auuuccagguccgggaa

SEQ ID NO: 2920827 - RNA, 20 nt, Mycobacterium avium subsp. paratuberculosis
caacagcauuucgcgcggca

SEQ ID NO: 2920828 - RNA, 12 nt, Mycobacterium avium subsp. paratuberculosis
caacagccgccc

SEQ ID NO: 2920829 - RNA, 13 nt, Mycobacterium avium subsp. paratuberculosis
caacagccgcccc

SEQ ID NO: 2920830 - RNA, 17 nt, Mycobacterium avium subsp. paratuberculosis
caacagccgccccgauc

SEQ ID NO: 2920831 - RNA, 13 nt, Mycobacterium avium subsp. paratuberculosis
caacagcgccgag

SEQ ID NO: 2920832 - RNA, 22 nt, Mycobacterium avium subsp. paratuberculosis
caacagcgcgccggccggcacg

SEQ ID NO: 2920833 - RNA, 14 nt, Mycobacterium avium subsp. paratuberculosis
caacagcggcccga

SEQ ID NO: 2920834 - RNA, 22 nt, Mycobacterium avium subsp. paratuberculosis
caacagcgucucgacggcgccg

SEQ ID NO: 2920835 - RNA, 23 nt, Mycobacterium avium subsp. paratuberculosis
caacagcgucucgacggcgccga

SEQ ID NO: 2920836 - RNA, 17 nt, Mycobacterium avium subsp. paratuberculosis
caacagcgugcacaccc

SEQ ID NO: 2920837 - RNA, 19 nt, Mycobacterium avium subsp. paratuberculosis
caacaggauuccggggaac

SEQ ID NO: 2920838 - RNA, 14 nt, Mycobacterium avium subsp. paratuberculosis
caacaggcccagca

SEQ ID NO: 2920839 - RNA, 16 nt, Mycobacterium avium subsp. paratuberculosis
caacaggcccagcagc

SEQ ID NO: 2920840 - RNA, 22 nt, Mycobacterium avium subsp. paratuberculosis
caacaggcccagcagcgcaccg

SEQ ID NO: 2920841 - RNA, 16 nt, Mycobacterium avium subsp. paratuberculosis
caacagggccaccgcg

SEQ ID NO: 2920842 - RNA, 19 nt, Mycobacterium avium subsp. paratuberculosis
caacagggccgcgcgggcg

SEQ ID NO: 2920843 - RNA, 15 nt, Mycobacterium avium subsp. paratuberculosis
caacaggucggcgug

SEQ ID NO: 2920844 - RNA, 19 nt, Mycobacterium avium subsp. paratuberculosis
caacaggucggcgugcagc

SEQ ID NO: 2920845 - RNA, 19 nt, Mycobacterium avium subsp. paratuberculosis
caacagguuucgcucgucg

SEQ ID NO: 2920846 - RNA, 20 nt, Mycobacterium avium subsp. paratuberculosis
caacagguuucgcucgucgg

SEQ ID NO: 2920847 - RNA, 22 nt, Mycobacterium avium subsp. paratuberculosis
caacagguuucgcucgucggcg

SEQ ID NO: 2920848 - RNA, 17 nt, Mycobacterium avium subsp. paratuberculosis
caacagugcgcaggcgg

SEQ ID NO: 2920849 - RNA, 18 nt, Mycobacterium avium subsp. paratuberculosis
caacagugcgcaggcggc

SEQ ID NO: 2920850 - RNA, 20 nt, Mycobacterium avium subsp. paratuberculosis
caacagugcgcaggcggcgc

SEQ ID NO: 2920851 - RNA, 22 nt, Mycobacterium avium subsp. paratuberculosis
caacauccgcgacgacaccacc

SEQ ID NO: 2920852 - RNA, 24 nt, Mycobacterium avium subsp. paratuberculosis
caacauccgcgacgacaccaccgu

SEQ ID NO: 2920853 - RNA, 19 nt, Mycobacterium avium subsp. paratuberculosis
caacauccugguccggcgc

SEQ ID NO: 2920854 - RNA, 20 nt, Mycobacterium avium subsp. paratuberculosis
caacauccugguccggcgcc

SEQ ID NO: 2920855 - RNA, 14 nt, Mycobacterium avium subsp. paratuberculosis
caacaucgacgugc

SEQ ID NO: 2920856 - RNA, 15 nt, Mycobacterium avium subsp. paratuberculosis
caacaucgacgugcc

SEQ ID NO: 2920857 - RNA, 16 nt, Mycobacterium avium subsp. paratuberculosis
caacaugaucggcgcg

SEQ ID NO: 2920858 - RNA, 22 nt, Mycobacterium avium subsp. paratuberculosis
caacaugauuccgccgggcggc

SEQ ID NO: 2920859 - RNA, 15 nt, Mycobacterium avium subsp. paratuberculosis
caacaugucccgggc

SEQ ID NO: 2920860 - RNA, 17 nt, Mycobacterium avium subsp. paratuberculosis
caacaugucccgggcac

SEQ ID NO: 2920861 - RNA, 13 nt, Mycobacterium avium subsp. paratuberculosis
caaccaacucgcg

SEQ ID NO: 2920862 - RNA, 19 nt, Mycobacterium avium subsp. paratuberculosis
caaccacagcggcgcauga

SEQ ID NO: 2920863 - RNA, 18 nt, Mycobacterium avium subsp. paratuberculosis
caaccaccguggccccag

SEQ ID NO: 2920864 - RNA, 21 nt, Mycobacterium avium subsp. paratuberculosis
caaccaccguggccccagcca

SEQ ID NO: 2920865 - RNA, 20 nt, Mycobacterium avium subsp. paratuberculosis
caaccacugauccgucaucu

SEQ ID NO: 2920866 - RNA, 16 nt, Mycobacterium avium subsp. paratuberculosis
caaccacuugaagccg

SEQ ID NO: 2920867 - RNA, 20 nt, Mycobacterium avium subsp. paratuberculosis
caaccacuugaagccgguga

SEQ ID NO: 2920868 - RNA, 19 nt, Mycobacterium avium subsp. paratuberculosis
caaccaggccuuccgcaac

SEQ ID NO: 2920869 - RNA, 17 nt, Mycobacterium avium subsp. paratuberculosis
caaccaggcgcucgucg

SEQ ID NO: 2920870 - RNA, 14 nt, Mycobacterium avium subsp. paratuberculosis
caaccaggucgcgg

SEQ ID NO: 2920871 - RNA, 22 nt, Mycobacterium avium subsp. paratuberculosis
caaccagugcacgcucggcggg

SEQ ID NO: 2920872 - RNA, 23 nt, Mycobacterium avium subsp. paratuberculosis
caaccagugcacgcucggcgggg

SEQ ID NO: 2920873 - RNA, 16 nt, Mycobacterium avium subsp. paratuberculosis
caaccccgcgcgcggg

SEQ ID NO: 2920874 - RNA, 19 nt, Mycobacterium avium subsp. paratuberculosis
caaccccgcgcgcgggcca

SEQ ID NO: 2920875 - RNA, 22 nt, Mycobacterium avium subsp. paratuberculosis
caaccccgcgcgcgggccagcg

SEQ ID NO: 2920876 - RNA, 15 nt, Mycobacterium avium subsp. paratuberculosis
caaccccgcggugca

SEQ ID NO: 2920877 - RNA, 12 nt, Mycobacterium avium subsp. paratuberculosis
caaccccgggcg

SEQ ID NO: 2920878 - RNA, 15 nt, Mycobacterium avium subsp. paratuberculosis
caaccccgggcggcu

SEQ ID NO: 2920879 - RNA, 17 nt, Mycobacterium avium subsp. paratuberculosis
caacccgaaagccccca

SEQ ID NO: 2920880 - RNA, 21 nt, Mycobacterium avium subsp. paratuberculosis
caacccgaaagcccccagcuc

SEQ ID NO: 2920881 - RNA, 16 nt, Mycobacterium avium subsp. paratuberculosis
caacccgaccucgucg

SEQ ID NO: 2920882 - RNA, 14 nt, Mycobacterium avium subsp. paratuberculosis
caacccgagcaccg

SEQ ID NO: 2920883 - RNA, 11 nt, Mycobacterium avium subsp. paratuberculosis
caacccggaca

SEQ ID NO: 2920884 - RNA, 13 nt, Mycobacterium avium subsp. paratuberculosis
caacccggacagc

SEQ ID NO: 2920885 - RNA, 20 nt, Mycobacterium avium subsp. paratuberculosis
caacccggacagcgcgacgc

SEQ ID NO: 2920886 - RNA, 13 nt, Mycobacterium avium subsp. paratuberculosis
caacccgggcgcc

SEQ ID NO: 2920887 - RNA, 15 nt, Mycobacterium avium subsp. paratuberculosis
caacccgucgcgggu

SEQ ID NO: 2920888 - RNA, 17 nt, Mycobacterium avium subsp. paratuberculosis
caacccgucgcggguca

SEQ ID NO: 2920889 - RNA, 19 nt, Mycobacterium avium subsp. paratuberculosis
caaccgagucgcugcagca

SEQ ID NO: 2920890 - RNA, 18 nt, Mycobacterium avium subsp. paratuberculosis
caaccgauguggacgaug

SEQ ID NO: 2920891 - RNA, 21 nt, Mycobacterium avium subsp. paratuberculosis
caaccgauuucggccagccgg

SEQ ID NO: 2920892 - RNA, 22 nt, Mycobacterium avium subsp. paratuberculosis
caaccgauuucggccagccggg

SEQ ID NO: 2920893 - RNA, 18 nt, Mycobacterium avium subsp. paratuberculosis
caaccgcauucggccgcc

SEQ ID NO: 2920894 - RNA, 16 nt, Mycobacterium avium subsp. paratuberculosis
caaccgccacgacgcg

SEQ ID NO: 2920895 - RNA, 15 nt, Mycobacterium avium subsp. paratuberculosis
caaccgcccagcggc

SEQ ID NO: 2920896 - RNA, 16 nt, Mycobacterium avium subsp. paratuberculosis
caaccgcccagcggcu

SEQ ID NO: 2920897 - RNA, 17 nt, Mycobacterium avium subsp. paratuberculosis
caaccgcccggcgccga

SEQ ID NO: 2920898 - RNA, 12 nt, Mycobacterium avium subsp. paratuberculosis
caaccgccggca

SEQ ID NO: 2920899 - RNA, 17 nt, Mycobacterium avium subsp. paratuberculosis
caaccgcggacuggcca

SEQ ID NO: 2920900 - RNA, 22 nt, Mycobacterium avium subsp. paratuberculosis
caaccgcggacuggccaccgcg

SEQ ID NO: 2920901 - RNA, 13 nt, Mycobacterium avium subsp. paratuberculosis
caaccgcucggcg

SEQ ID NO: 2920902 - RNA, 14 nt, Mycobacterium avium subsp. paratuberculosis
caaccgcucggcga

SEQ ID NO: 2920903 - RNA, 19 nt, Mycobacterium avium subsp. paratuberculosis
caaccgcucggcgaucugg

SEQ ID NO: 2920904 - RNA, 20 nt, Mycobacterium avium subsp. paratuberculosis
caaccgcugcugcugcccgc

SEQ ID NO: 2920905 - RNA, 20 nt, Mycobacterium avium subsp. paratuberculosis
caaccggaauggcagcagcc

SEQ ID NO: 2920906 - RNA, 21 nt, Mycobacterium avium subsp. paratuberculosis
caaccggaauggcagcagccg

SEQ ID NO: 2920907 - RNA, 23 nt, Mycobacterium avium subsp. paratuberculosis
caaccggaauggcagcagccgga

SEQ ID NO: 2920908 - RNA, 12 nt, Mycobacterium avium subsp. paratuberculosis
caaccggaucgg

SEQ ID NO: 2920909 - RNA, 15 nt, Mycobacterium avium subsp. paratuberculosis
caaccggccccgagc

SEQ ID NO: 2920910 - RNA, 12 nt, Mycobacterium avium subsp. paratuberculosis
caaccggcggcu

SEQ ID NO: 2920911 - RNA, 21 nt, Mycobacterium avium subsp. paratuberculosis
caaccggcggcugggcagccg

SEQ ID NO: 2920912 - RNA, 16 nt, Mycobacterium avium subsp. paratuberculosis
caacggccggcgccgc

SEQ ID NO: 2920913 - RNA, 13 nt, Mycobacterium avium subsp. paratuberculosis
caacggcggaccg

SEQ ID NO: 2920914 - RNA, 14 nt, Mycobacterium avium subsp. paratuberculosis
caacggcggaccgg

SEQ ID NO: 2920915 - RNA, 17 nt, Mycobacterium avium subsp. paratuberculosis
caacggcggaccggcgg

SEQ ID NO: 2920916 - RNA, 18 nt, Mycobacterium avium subsp. paratuberculosis
caacggcggaccggcggc

SEQ ID NO: 2920917 - RNA, 13 nt, Mycobacterium avium subsp. paratuberculosis
caacggcggcggc

SEQ ID NO: 2920918 - RNA, 23 nt, Mycobacterium avium subsp. paratuberculosis
caacggcggucgugcggcugccc

SEQ ID NO: 2920919 - RNA, 22 nt, Mycobacterium avium subsp. paratuberculosis
caacggcgucgacacccgggcg

SEQ ID NO: 2920920 - RNA, 12 nt, Mycobacterium avium subsp. paratuberculosis
caacggcucgcc

SEQ ID NO: 2920921 - RNA, 16 nt, Mycobacterium avium subsp. paratuberculosis
caacggcucgccgcgc

SEQ ID NO: 2920922 - RNA, 20 nt, Mycobacterium avium subsp. paratuberculosis
caacggcucggucaagccgg

SEQ ID NO: 2920923 - RNA, 22 nt, Mycobacterium avium subsp. paratuberculosis
caacggcucggucaagccggcc

SEQ ID NO: 2920924 - RNA, 15 nt, Mycobacterium avium subsp. paratuberculosis
caacggcuggcgcag

SEQ ID NO: 2920925 - RNA, 17 nt, Mycobacterium avium subsp. paratuberculosis
caacgggaagagcggcg

SEQ ID NO: 2920926 - RNA, 18 nt, Mycobacterium avium subsp. paratuberculosis
caacgggauggcucagcg

SEQ ID NO: 2920927 - RNA, 23 nt, Mycobacterium avium subsp. paratuberculosis
caacgggauggcucagcgcaccg

SEQ ID NO: 2920928 - RNA, 23 nt, Mycobacterium avium subsp. paratuberculosis
caacgggccgcagccgcgcggcc

SEQ ID NO: 2920929 - RNA, 13 nt, Mycobacterium avium subsp. paratuberculosis
caacgggcggcgg

SEQ ID NO: 2920930 - RNA, 22 nt, Mycobacterium avium subsp. paratuberculosis
caacgggcggcggaucagcacc

SEQ ID NO: 2920931 - RNA, 17 nt, Mycobacterium avium subsp. paratuberculosis
caacgggcucagcacca

SEQ ID NO: 2920932 - RNA, 22 nt, Mycobacterium avium subsp. paratuberculosis
caacggucgggaucugcgguga

SEQ ID NO: 2920933 - RNA, 15 nt, Mycobacterium avium subsp. paratuberculosis
caacggugaucgaca

SEQ ID NO: 2920934 - RNA, 15 nt, Mycobacterium avium subsp. paratuberculosis
caacggugguggcga

SEQ ID NO: 2920935 - RNA, 20 nt, Mycobacterium avium subsp. paratuberculosis
caacgguucggccgcucggg

SEQ ID NO: 2920936 - RNA, 20 nt, Mycobacterium avium subsp. paratuberculosis
caacgucucugucgucgacc

SEQ ID NO: 2920937 - RNA, 20 nt, Mycobacterium avium subsp. paratuberculosis
caacgucuggccaccgaagc

SEQ ID NO: 2920938 - RNA, 23 nt, Mycobacterium avium subsp. paratuberculosis
caacgugaugccguggucggcga

SEQ ID NO: 2920939 - RNA, 16 nt, Mycobacterium avium subsp. paratuberculosis
caacgugccacaggcc

SEQ ID NO: 2920940 - RNA, 20 nt, Mycobacterium avium subsp. paratuberculosis
caacgugccacaggccgaac

SEQ ID NO: 2920941 - RNA, 23 nt, Mycobacterium avium subsp. paratuberculosis
caacgugccacaggccgaacagc

SEQ ID NO: 2920942 - RNA, 16 nt, Mycobacterium avium subsp. paratuberculosis
caacguguacucggcg

SEQ ID NO: 2920943 - RNA, 18 nt, Mycobacterium avium subsp. paratuberculosis
caacguguacucggcguc

SEQ ID NO: 2920944 - RNA, 23 nt, Mycobacterium avium subsp. paratuberculosis
caacguguacucggcgucgccga

SEQ ID NO: 2920945 - RNA, 22 nt, Mycobacterium avium subsp. paratuberculosis
caacgugucgagcacgucgacg

SEQ ID NO: 2920946 - RNA, 15 nt, Mycobacterium avium subsp. paratuberculosis
caacuacgagcagca

SEQ ID NO: 2920947 - RNA, 18 nt, Mycobacterium avium subsp. paratuberculosis
caacuacgagcagcaaga

SEQ ID NO: 2920948 - RNA, 20 nt, Mycobacterium avium subsp. paratuberculosis
caacucaguccucgccgaga

SEQ ID NO: 2920949 - RNA, 18 nt, Mycobacterium avium subsp. paratuberculosis
caacucaugggcccggcc

SEQ ID NO: 2920950 - RNA, 15 nt, Mycobacterium avium subsp. paratuberculosis
caacuccaccgcccg

SEQ ID NO: 2920951 - RNA, 13 nt, Mycobacterium avium subsp. paratuberculosis
caacuccggcggc

SEQ ID NO: 2920952 - RNA, 17 nt, Mycobacterium avium subsp. paratuberculosis
caacucgaagcugcgcc

SEQ ID NO: 2920953 - RNA, 19 nt, Mycobacterium avium subsp. paratuberculosis
caacucgaccugcccgggc

SEQ ID NO: 2920954 - RNA, 21 nt, Mycobacterium avium subsp. paratuberculosis
caacucgaccugcccgggccc

SEQ ID NO: 2920955 - RNA, 20 nt, Mycobacterium avium subsp. paratuberculosis
caacucgacguucggcgggc

SEQ ID NO: 2920956 - RNA, 16 nt, Mycobacterium avium subsp. paratuberculosis
caacucgccggagcgc

SEQ ID NO: 2920957 - RNA, 18 nt, Mycobacterium avium subsp. paratuberculosis
caacucgcgaggccgcca

SEQ ID NO: 2920958 - RNA, 12 nt, Mycobacterium avium subsp. paratuberculosis
caacucgcgaug

SEQ ID NO: 2920959 - RNA, 20 nt, Mycobacterium avium subsp. paratuberculosis
caacucgcgcucccggcgcc

SEQ ID NO: 2920960 - RNA, 22 nt, Mycobacterium avium subsp. paratuberculosis
caacucgcgcucccggcgccgc

SEQ ID NO: 2920961 - RNA, 23 nt, Mycobacterium avium subsp. paratuberculosis
caacucgcgcucccggcgccgcc

SEQ ID NO: 2920962 - RNA, 14 nt, Mycobacterium avium subsp. paratuberculosis
caacucgggcucgu

SEQ ID NO: 2920963 - RNA, 17 nt, Mycobacterium avium subsp. paratuberculosis
caacucgggcucgucgu

SEQ ID NO: 2920964 - RNA, 19 nt, Mycobacterium avium subsp. paratuberculosis
caacucguccaccagcucg

SEQ ID NO: 2920965 - RNA, 22 nt, Mycobacterium avium subsp. paratuberculosis
caacucguccagcgucgcggcc

SEQ ID NO: 2920966 - RNA, 14 nt, Mycobacterium avium subsp. paratuberculosis
caacucgucggcga

SEQ ID NO: 2920967 - RNA, 19 nt, Mycobacterium avium subsp. paratuberculosis
caacugaauuccuggccgg

SEQ ID NO: 2920968 - RNA, 22 nt, Mycobacterium avium subsp. paratuberculosis
caacugaauuccuggccggugc

SEQ ID NO: 2920969 - RNA, 21 nt, Mycobacterium avium subsp. paratuberculosis
caacugaccgauggccgcccg

SEQ ID NO: 2920970 - RNA, 19 nt, Mycobacterium avium subsp. paratuberculosis
caacugaucgagcucggcc

SEQ ID NO: 2920971 - RNA, 15 nt, Mycobacterium avium subsp. paratuberculosis
caacugcaccagcgg

SEQ ID NO: 2920972 - RNA, 15 nt, Mycobacterium avium subsp. paratuberculosis
caacugcaucgccag

SEQ ID NO: 2920973 - RNA, 21 nt, Mycobacterium avium subsp. paratuberculosis
caacugcauuucggacggcga

SEQ ID NO: 2920974 - RNA, 23 nt, Mycobacterium avium subsp. paratuberculosis
caacugcauuucggacggcgacg

SEQ ID NO: 2920975 - RNA, 15 nt, Mycobacterium avium subsp. paratuberculosis
caacugccgacgguc

SEQ ID NO: 2920976 - RNA, 19 nt, Mycobacterium avium subsp. paratuberculosis
caacugcucgaccagcccc

SEQ ID NO: 2920977 - RNA, 21 nt, Mycobacterium avium subsp. paratuberculosis
caacugcucgaccagcccccg

SEQ ID NO: 2920978 - RNA, 15 nt, Mycobacterium avium subsp. paratuberculosis
caacuggcaacgcgu

SEQ ID NO: 2920979 - RNA, 11 nt, Mycobacterium avium subsp. paratuberculosis
caacuggccgc

SEQ ID NO: 2920980 - RNA, 13 nt, Mycobacterium avium subsp. paratuberculosis
caacuggccggga

SEQ ID NO: 2920981 - RNA, 20 nt, Mycobacterium avium subsp. paratuberculosis
caacugggcggccugcaccc

SEQ ID NO: 2920982 - RNA, 16 nt, Mycobacterium avium subsp. paratuberculosis
caacuggucgugcagc

SEQ ID NO: 2920983 - RNA, 20 nt, Mycobacterium avium subsp. paratuberculosis
caacuggucgugcagcaccg

SEQ ID NO: 2920984 - RNA, 16 nt, Mycobacterium avium subsp. paratuberculosis
caacuggucgugcucg

SEQ ID NO: 2920985 - RNA, 21 nt, Mycobacterium avium subsp. paratuberculosis
caacuguucgcggcuggccgc

SEQ ID NO: 2920986 - RNA, 21 nt, Mycobacterium avium subsp. paratuberculosis
caacuugaucagcucgcggau

SEQ ID NO: 2920987 - RNA, 14 nt, Mycobacterium avium subsp. paratuberculosis
caacuugcgcgacg

SEQ ID NO: 2920988 - RNA, 16 nt, Mycobacterium avium subsp. paratuberculosis
caagaacgaaaagaug

SEQ ID NO: 2920989 - RNA, 22 nt, Mycobacterium avium subsp. paratuberculosis
caagaagggcgaauccaaggag

SEQ ID NO: 2920990 - RNA, 16 nt, Mycobacterium avium subsp. paratuberculosis
caagaaguuuccccac

SEQ ID NO: 2920991 - RNA, 22 nt, Mycobacterium avium subsp. paratuberculosis
caagacaauucgcugccccggc

SEQ ID NO: 2920992 - RNA, 20 nt, Mycobacterium avium subsp. paratuberculosis
caagacccgcgucaucgggc

SEQ ID NO: 2920993 - RNA, 20 nt, Mycobacterium avium subsp. paratuberculosis
caagaccgcggucaccgguc

SEQ ID NO: 2920994 - RNA, 16 nt, Mycobacterium avium subsp. paratuberculosis
caagacguccgcgucg

SEQ ID NO: 2920995 - RNA, 21 nt, Mycobacterium avium subsp. paratuberculosis
caagacguccgcgucggcgcc

SEQ ID NO: 2920996 - RNA, 22 nt, Mycobacterium avium subsp. paratuberculosis
caaucucgggcaccccugccgc

SEQ ID NO: 2920997 - RNA, 13 nt, Mycobacterium avium subsp. paratuberculosis
caaucuucuccgc

SEQ ID NO: 2920998 - RNA, 17 nt, Mycobacterium avium subsp. paratuberculosis
caaucuucuccgcggcc

SEQ ID NO: 2920999 - RNA, 21 nt, Mycobacterium avium subsp. paratuberculosis
caaucuucuccgcggccgcgc

SEQ ID NO: 2921000 - RNA, 22 nt, Mycobacterium avium subsp. paratuberculosis
caaucuucuccgcggccgcgcg

SEQ ID NO: 2921001 - RNA, 17 nt, Mycobacterium avium subsp. paratuberculosis
caaugaccggcaccagc

SEQ ID NO: 2921002 - RNA, 20 nt, Mycobacterium avium subsp. paratuberculosis
caaugaccggcaccagcagg

SEQ ID NO: 2921003 - RNA, 22 nt, Mycobacterium avium subsp. paratuberculosis
caaugauggucagccgcaccag

SEQ ID NO: 2921004 - RNA, 14 nt, Mycobacterium avium subsp. paratuberculosis
caaugccgcagccg

SEQ ID NO: 2921005 - RNA, 17 nt, Mycobacterium avium subsp. paratuberculosis
caaugccgcagccgauc

SEQ ID NO: 2921006 - RNA, 20 nt, Mycobacterium avium subsp. paratuberculosis
caaugccgcagccgaucucg

SEQ ID NO: 2921007 - RNA, 19 nt, Mycobacterium avium subsp. paratuberculosis
caaugccgccgcgacgaug

SEQ ID NO: 2921008 - RNA, 16 nt, Mycobacterium avium subsp. paratuberculosis
caaugccggaucggga

SEQ ID NO: 2921009 - RNA, 20 nt, Mycobacterium avium subsp. paratuberculosis
caaugccuuugccguggcgg

SEQ ID NO: 2921010 - RNA, 18 nt, Mycobacterium avium subsp. paratuberculosis
caaugcgccggcggccgc

SEQ ID NO: 2921011 - RNA, 17 nt, Mycobacterium avium subsp. paratuberculosis
caauggauccgaucagc

SEQ ID NO: 2921012 - RNA, 21 nt, Mycobacterium avium subsp. paratuberculosis
caauggauccgaucagcagca

SEQ ID NO: 2921013 - RNA, 16 nt, Mycobacterium avium subsp. paratuberculosis
caaugguguagcucag

SEQ ID NO: 2921014 - RNA, 20 nt, Mycobacterium avium subsp. paratuberculosis
caaugguugcggcgggccgc

SEQ ID NO: 2921015 - RNA, 22 nt, Mycobacterium avium subsp. paratuberculosis
caaugguuuucgucgaucagca

SEQ ID NO: 2921016 - RNA, 14 nt, Mycobacterium avium subsp. paratuberculosis
caaugucacggcgg

SEQ ID NO: 2921017 - RNA, 20 nt, Mycobacterium avium subsp. paratuberculosis
caauuccucagcccggcagc

SEQ ID NO: 2921018 - RNA, 16 nt, Mycobacterium avium subsp. paratuberculosis
caauucgacugcgaug

SEQ ID NO: 2921019 - RNA, 14 nt, Mycobacterium avium subsp. paratuberculosis
caauucugcugccc

SEQ ID NO: 2921020 - RNA, 15 nt, Mycobacterium avium subsp. paratuberculosis
caauugacgccgaca

SEQ ID NO: 2921021 - RNA, 21 nt, Mycobacterium avium subsp. paratuberculosis
caauugacguaaccguccagu

SEQ ID NO: 2921022 - RNA, 13 nt, Mycobacterium avium subsp. paratuberculosis
caauugccacagc

SEQ ID NO: 2921023 - RNA, 16 nt, Mycobacterium avium subsp. paratuberculosis
caauugcgccagcagc

SEQ ID NO: 2921024 - RNA, 22 nt, Mycobacterium avium subsp. paratuberculosis
caauuucguucguccaaacucc

SEQ ID NO: 2921025 - RNA, 20 nt, Mycobacterium avium subsp. paratuberculosis
cacaaacagcgcggccggaa

SEQ ID NO: 2921026 - RNA, 12 nt, Mycobacterium avium subsp. paratuberculosis
cacaaaggccga

SEQ ID NO: 2921027 - RNA, 20 nt, Mycobacterium avium subsp. paratuberculosis
cacaacagguucgacagcga

SEQ ID NO: 2921028 - RNA, 22 nt, Mycobacterium avium subsp. paratuberculosis
cacaacaugauucguucgugag

SEQ ID NO: 2921029 - RNA, 18 nt, Mycobacterium avium subsp. paratuberculosis
cacaacaugucccgggca

SEQ ID NO: 2921030 - RNA, 21 nt, Mycobacterium avium subsp. paratuberculosis
cacaacaugucccgggcacgc

SEQ ID NO: 2921031 - RNA, 16 nt, Mycobacterium avium subsp. paratuberculosis
cacaacccggacagcg

SEQ ID NO: 2921032 - RNA, 19 nt, Mycobacterium avium subsp. paratuberculosis
cacaacccggacagcgcga

SEQ ID NO: 2921033 - RNA, 16 nt, Mycobacterium avium subsp. paratuberculosis
cacaaccgggccaacg

SEQ ID NO: 2921034 - RNA, 14 nt, Mycobacterium avium subsp. paratuberculosis
cacaacgccuccga

SEQ ID NO: 2921035 - RNA, 22 nt, Mycobacterium avium subsp. paratuberculosis
cacaacgucucugucgucgacc

SEQ ID NO: 2921036 - RNA, 17 nt, Mycobacterium avium subsp. paratuberculosis
cacaagcgaggucacca

SEQ ID NO: 2921037 - RNA, 20 nt, Mycobacterium avium subsp. paratuberculosis
cacaagggccaccgggccga

SEQ ID NO: 2921038 - RNA, 23 nt, Mycobacterium avium subsp. paratuberculosis
cacaagggccaccgggccgagga

SEQ ID NO: 2921039 - RNA, 17 nt, Mycobacterium avium subsp. paratuberculosis
cacacagccgcuuggcg

SEQ ID NO: 2921040 - RNA, 16 nt, Mycobacterium avium subsp. paratuberculosis
cacacaggaccagcac

SEQ ID NO: 2921041 - RNA, 13 nt, Mycobacterium avium subsp. paratuberculosis
cacacaggucgcc

SEQ ID NO: 2921042 - RNA, 20 nt, Mycobacterium avium subsp. paratuberculosis
cacacaggucgcccggcucg

SEQ ID NO: 2921043 - RNA, 21 nt, Mycobacterium avium subsp. paratuberculosis
cacacaggucgcccggcucgc

SEQ ID NO: 2921044 - RNA, 12 nt, Mycobacterium avium subsp. paratuberculosis
cacaccaccacg

SEQ ID NO: 2921045 - RNA, 15 nt, Mycobacterium avium subsp. paratuberculosis
cacaccaccacgcga

SEQ ID NO: 2921046 - RNA, 13 nt, Mycobacterium avium subsp. paratuberculosis
cacaccaccacgu

SEQ ID NO: 2921047 - RNA, 13 nt, Mycobacterium avium subsp. paratuberculosis
cacaccaccagcg

SEQ ID NO: 2921048 - RNA, 15 nt, Mycobacterium avium subsp. paratuberculosis
cacaccaccagcgag

SEQ ID NO: 2921049 - RNA, 11 nt, Mycobacterium avium subsp. paratuberculosis
cacaccaccau

SEQ ID NO: 2921050 - RNA, 12 nt, Mycobacterium avium subsp. paratuberculosis
cacaccaccaug

SEQ ID NO: 2921051 - RNA, 18 nt, Mycobacterium avium subsp. paratuberculosis
cacaccaccgacgcgucg

SEQ ID NO: 2921052 - RNA, 14 nt, Mycobacterium avium subsp. paratuberculosis
cacaccagcguucg

SEQ ID NO: 2921053 - RNA, 13 nt, Mycobacterium avium subsp. paratuberculosis
cacacccagcgag

SEQ ID NO: 2921054 - RNA, 19 nt, Mycobacterium avium subsp. paratuberculosis
cacacccagcgagccgaug

SEQ ID NO: 2921055 - RNA, 16 nt, Mycobacterium avium subsp. paratuberculosis
cacaccccggccacca

SEQ ID NO: 2921056 - RNA, 20 nt, Mycobacterium avium subsp. paratuberculosis
cacaccccggccaccagggc

SEQ ID NO: 2921057 - RNA, 15 nt, Mycobacterium avium subsp. paratuberculosis
cacacccgcacgcug

SEQ ID NO: 2921058 - RNA, 18 nt, Mycobacterium avium subsp. paratuberculosis
cacacccgcacgcugucg

SEQ ID NO: 2921059 - RNA, 16 nt, Mycobacterium avium subsp. paratuberculosis
cacacccgcagcgacc

SEQ ID NO: 2921060 - RNA, 14 nt, Mycobacterium avium subsp. paratuberculosis
cacacccgcggccg

SEQ ID NO: 2921061 - RNA, 15 nt, Mycobacterium avium subsp. paratuberculosis
cacacccgcggccgc

SEQ ID NO: 2921062 - RNA, 16 nt, Mycobacterium avium subsp. paratuberculosis
cacacccgcggccgcu

SEQ ID NO: 2921063 - RNA, 22 nt, Mycobacterium avium subsp. paratuberculosis
cacacccgcggccgcugcgccc

SEQ ID NO: 2921064 - RNA, 13 nt, Mycobacterium avium subsp. paratuberculosis
cacacccggugcg

SEQ ID NO: 2921065 - RNA, 13 nt, Mycobacterium avium subsp. paratuberculosis
cacaccgacaccg

SEQ ID NO: 2921066 - RNA, 14 nt, Mycobacterium avium subsp. paratuberculosis
cacaccgacauguc

SEQ ID NO: 2921067 - RNA, 16 nt, Mycobacterium avium subsp. paratuberculosis
cacaccgagcgagcgc

SEQ ID NO: 2921068 - RNA, 16 nt, Mycobacterium avium subsp. paratuberculosis
cacaccgaucagcaug

SEQ ID NO: 2921069 - RNA, 18 nt, Mycobacterium avium subsp. paratuberculosis
cacaccgaucagcaugcc

SEQ ID NO: 2921070 - RNA, 14 nt, Mycobacterium avium subsp. paratuberculosis
cacaccgccgcggc

SEQ ID NO: 2921071 - RNA, 15 nt, Mycobacterium avium subsp. paratuberculosis
cacaccgccgcggcg

SEQ ID NO: 2921072 - RNA, 17 nt, Mycobacterium avium subsp. paratuberculosis
cacaccgccgcggcggu

SEQ ID NO: 2921073 - RNA, 18 nt, Mycobacterium avium subsp. paratuberculosis
cacaccgccgcggcggug

SEQ ID NO: 2921074 - RNA, 14 nt, Mycobacterium avium subsp. paratuberculosis
cacaccgccggcgc

SEQ ID NO: 2921075 - RNA, 17 nt, Mycobacterium avium subsp. paratuberculosis
cacaccgccggcgcgga

SEQ ID NO: 2921076 - RNA, 20 nt, Mycobacterium avium subsp. paratuberculosis
cacaccgccggcgcggacgg

SEQ ID NO: 2921077 - RNA, 13 nt, Mycobacterium avium subsp. paratuberculosis
cacaccgcgcaga

SEQ ID NO: 2921078 - RNA, 13 nt, Mycobacterium avium subsp. paratuberculosis
cacaccgcgcgca

SEQ ID NO: 2921079 - RNA, 13 nt, Mycobacterium avium subsp. paratuberculosis
cacaccgcggcca

SEQ ID NO: 2921080 - RNA, 19 nt, Mycobacterium avium subsp. paratuberculosis
cacaccgcggccagcgcgc

SEQ ID NO: 2921081 - RNA, 12 nt, Mycobacterium avium subsp. paratuberculosis
cacagcggcgca

SEQ ID NO: 2921082 - RNA, 13 nt, Mycobacterium avium subsp. paratuberculosis
cacagcggcgcau

SEQ ID NO: 2921083 - RNA, 19 nt, Mycobacterium avium subsp. paratuberculosis
cacagcggcggaugggugc

SEQ ID NO: 2921084 - RNA, 22 nt, Mycobacterium avium subsp. paratuberculosis
cacagcggcggaugggugcggu

SEQ ID NO: 2921085 - RNA, 16 nt, Mycobacterium avium subsp. paratuberculosis
cacagcgggaucccag

SEQ ID NO: 2921086 - RNA, 12 nt, Mycobacterium avium subsp. paratuberculosis
cacagcgggguc

SEQ ID NO: 2921087 - RNA, 19 nt, Mycobacterium avium subsp. paratuberculosis
cacagcgguaucccguugg

SEQ ID NO: 2921088 - RNA, 12 nt, Mycobacterium avium subsp. paratuberculosis
cacagcgguucg

SEQ ID NO: 2921089 - RNA, 13 nt, Mycobacterium avium subsp. paratuberculosis
cacagcgguucgg

SEQ ID NO: 2921090 - RNA, 21 nt, Mycobacterium avium subsp. paratuberculosis
cacagcgucucgaccgcggug

SEQ ID NO: 2921091 - RNA, 14 nt, Mycobacterium avium subsp. paratuberculosis
cacagcucaccugc

SEQ ID NO: 2921092 - RNA, 15 nt, Mycobacterium avium subsp. paratuberculosis
cacagcucaccugcg

SEQ ID NO: 2921093 - RNA, 23 nt, Mycobacterium avium subsp. paratuberculosis
cacagcucgggcagcgugucccg

SEQ ID NO: 2921094 - RNA, 14 nt, Mycobacterium avium subsp. paratuberculosis
cacagcugacgggc

SEQ ID NO: 2921095 - RNA, 15 nt, Mycobacterium avium subsp. paratuberculosis
cacagcugccggccg

SEQ ID NO: 2921096 - RNA, 16 nt, Mycobacterium avium subsp. paratuberculosis
cacagcugccggccgu

SEQ ID NO: 2921097 - RNA, 16 nt, Mycobacterium avium subsp. paratuberculosis
cacagcugcuggcugc

SEQ ID NO: 2921098 - RNA, 21 nt, Mycobacterium avium subsp. paratuberculosis
cacagcugcuggcugcggccc

SEQ ID NO: 2921099 - RNA, 17 nt, Mycobacterium avium subsp. paratuberculosis
cacagcuucggcgccga

SEQ ID NO: 2921100 - RNA, 22 nt, Mycobacterium avium subsp. paratuberculosis
cacagcuucggcgccgagcacg

SEQ ID NO: 2921101 - RNA, 16 nt, Mycobacterium avium subsp. paratuberculosis
cacagcuugccggagc

SEQ ID NO: 2921102 - RNA, 18 nt, Mycobacterium avium subsp. paratuberculosis
cacagcuugccggagccc

SEQ ID NO: 2921103 - RNA, 15 nt, Mycobacterium avium subsp. paratuberculosis
cacagcuugucccag

SEQ ID NO: 2921104 - RNA, 17 nt, Mycobacterium avium subsp. paratuberculosis
cacagcuuucgggcggc

SEQ ID NO: 2921105 - RNA, 19 nt, Mycobacterium avium subsp. paratuberculosis
cacagcuuucgggcggccu

SEQ ID NO: 2921106 - RNA, 14 nt, Mycobacterium avium subsp. paratuberculosis
cacaggaacgcgac

SEQ ID NO: 2921107 - RNA, 19 nt, Mycobacterium avium subsp. paratuberculosis
cacaggaacgcgacggugg

SEQ ID NO: 2921108 - RNA, 19 nt, Mycobacterium avium subsp. paratuberculosis
cacaggacguugaggcggc

SEQ ID NO: 2921109 - RNA, 21 nt, Mycobacterium avium subsp. paratuberculosis
cacaggacguugaggcggcgg

SEQ ID NO: 2921110 - RNA, 13 nt, Mycobacterium avium subsp. paratuberculosis
cacaggaugccca

SEQ ID NO: 2921111 - RNA, 14 nt, Mycobacterium avium subsp. paratuberculosis
cacaggccgccgca

SEQ ID NO: 2921112 - RNA, 20 nt, Mycobacterium avium subsp. paratuberculosis
cacaggcgaaucggcgcaca

SEQ ID NO: 2921113 - RNA, 13 nt, Mycobacterium avium subsp. paratuberculosis
cacagggcggcga

SEQ ID NO: 2921114 - RNA, 21 nt, Mycobacterium avium subsp. paratuberculosis
cacagggcggcgacacgccga

SEQ ID NO: 2921115 - RNA, 13 nt, Mycobacterium avium subsp. paratuberculosis
cacaggggcgcgu

SEQ ID NO: 2921116 - RNA, 23 nt, Mycobacterium avium subsp. paratuberculosis
cacaggggcgcguagcucagugg

SEQ ID NO: 2921117 - RNA, 15 nt, Mycobacterium avium subsp. paratuberculosis
cacagguacaggguc

SEQ ID NO: 2921118 - RNA, 13 nt, Mycobacterium avium subsp. paratuberculosis
cacaggucgaugg

SEQ ID NO: 2921119 - RNA, 14 nt, Mycobacterium avium subsp. paratuberculosis
cacaggucgcccgg

SEQ ID NO: 2921120 - RNA, 16 nt, Mycobacterium avium subsp. paratuberculosis
cacaggucgcccggcu

SEQ ID NO: 2921121 - RNA, 17 nt, Mycobacterium avium subsp. paratuberculosis
cacaggugacgacgcuc

SEQ ID NO: 2921122 - RNA, 14 nt, Mycobacterium avium subsp. paratuberculosis
cacaguaggcggcu

SEQ ID NO: 2921123 - RNA, 15 nt, Mycobacterium avium subsp. paratuberculosis
cacaguaggcggcug

SEQ ID NO: 2921124 - RNA, 20 nt, Mycobacterium avium subsp. paratuberculosis
cacaguaggcggcugucgac

SEQ ID NO: 2921125 - RNA, 23 nt, Mycobacterium avium subsp. paratuberculosis
cacaguaggcggcugucgacagg

SEQ ID NO: 2921126 - RNA, 15 nt, Mycobacterium avium subsp. paratuberculosis
cacaguccgcccagc

SEQ ID NO: 2921127 - RNA, 15 nt, Mycobacterium avium subsp. paratuberculosis
cacagucgcugggug

SEQ ID NO: 2921128 - RNA, 16 nt, Mycobacterium avium subsp. paratuberculosis
cacagucgcugggugu

SEQ ID NO: 2921129 - RNA, 16 nt, Mycobacterium avium subsp. paratuberculosis
cacagugcgucgccca

SEQ ID NO: 2921130 - RNA, 21 nt, Mycobacterium avium subsp. paratuberculosis
cacagugcgucgcccaucacc

SEQ ID NO: 2921131 - RNA, 17 nt, Mycobacterium avium subsp. paratuberculosis
cacauaacgcucccggu

SEQ ID NO: 2921132 - RNA, 23 nt, Mycobacterium avium subsp. paratuberculosis
cacauacaccgggaucggcggcg

SEQ ID NO: 2921133 - RNA, 23 nt, Mycobacterium avium subsp. paratuberculosis
cacauaccgggacaucgucgcgc

SEQ ID NO: 2921134 - RNA, 14 nt, Mycobacterium avium subsp. paratuberculosis
cacauacgcggcgg

SEQ ID NO: 2921135 - RNA, 17 nt, Mycobacterium avium subsp. paratuberculosis
cacauacgcggcggccu

SEQ ID NO: 2921136 - RNA, 19 nt, Mycobacterium avium subsp. paratuberculosis
cacauacgcggcggccugc

SEQ ID NO: 2921137 - RNA, 17 nt, Mycobacterium avium subsp. paratuberculosis
cacauagcccaucagca

SEQ ID NO: 2921138 - RNA, 17 nt, Mycobacterium avium subsp. paratuberculosis
cacaucacgguggccgc

SEQ ID NO: 2921139 - RNA, 19 nt, Mycobacterium avium subsp. paratuberculosis
cacaucacgguggccgcca

SEQ ID NO: 2921140 - RNA, 20 nt, Mycobacterium avium subsp. paratuberculosis
cacaucacgguggccgccac

SEQ ID NO: 2921141 - RNA, 16 nt, Mycobacterium avium subsp. paratuberculosis
cacaucagcucggcgg

SEQ ID NO: 2921142 - RNA, 20 nt, Mycobacterium avium subsp. paratuberculosis
cacauccgguugcaccgcga

SEQ ID NO: 2921143 - RNA, 16 nt, Mycobacterium avium subsp. paratuberculosis
cacauccgucacgccc

SEQ ID NO: 2921144 - RNA, 21 nt, Mycobacterium avium subsp. paratuberculosis
cacaucgcguuagcaaggguu

SEQ ID NO: 2921145 - RNA, 22 nt, Mycobacterium avium subsp. paratuberculosis
cacaucggagagcuugccgcgg

SEQ ID NO: 2921146 - RNA, 21 nt, Mycobacterium avium subsp. paratuberculosis
cacaucggauucgucggucac

SEQ ID NO: 2921147 - RNA, 22 nt, Mycobacterium avium subsp. paratuberculosis
cacaucggauucgucggucacc

SEQ ID NO: 2921148 - RNA, 20 nt, Mycobacterium avium subsp. paratuberculosis
cacaucgggauuggcggcca

SEQ ID NO: 2921149 - RNA, 21 nt, Mycobacterium avium subsp. paratuberculosis
cacaucgggauuggcggccaa

SEQ ID NO: 2921150 - RNA, 20 nt, Mycobacterium avium subsp. paratuberculosis
cacaucggucucgacaccgg

SEQ ID NO: 2921151 - RNA, 21 nt, Mycobacterium avium subsp. paratuberculosis
cacaucggucucgacaccggc

SEQ ID NO: 2921152 - RNA, 18 nt, Mycobacterium avium subsp. paratuberculosis
cacaucgguugcuccggc

SEQ ID NO: 2921153 - RNA, 19 nt, Mycobacterium avium subsp. paratuberculosis
cacaucgguugcuccggcg

SEQ ID NO: 2921154 - RNA, 22 nt, Mycobacterium avium subsp. paratuberculosis
cacaucgguugcuccggcgucg

SEQ ID NO: 2921155 - RNA, 16 nt, Mycobacterium avium subsp. paratuberculosis
cacaucguggcgacga

SEQ ID NO: 2921156 - RNA, 18 nt, Mycobacterium avium subsp. paratuberculosis
cacaucguggcgacgacg

SEQ ID NO: 2921157 - RNA, 22 nt, Mycobacterium avium subsp. paratuberculosis
cacaucguggcgacgacgccga

SEQ ID NO: 2921158 - RNA, 19 nt, Mycobacterium avium subsp. paratuberculosis
cacaucugccggcagaucu

SEQ ID NO: 2921159 - RNA, 13 nt, Mycobacterium avium subsp. paratuberculosis
cacaugcccgucg

SEQ ID NO: 2921160 - RNA, 17 nt, Mycobacterium avium subsp. paratuberculosis
cacaugggccacggcgc

SEQ ID NO: 2921161 - RNA, 19 nt, Mycobacterium avium subsp. paratuberculosis
cacaugggccacggcgcga

SEQ ID NO: 2921162 - RNA, 23 nt, Mycobacterium avium subsp. paratuberculosis
cacaugggccacggcgcgaggac

SEQ ID NO: 2921163 - RNA, 18 nt, Mycobacterium avium subsp. paratuberculosis
cacaugggcgcguuggcc

SEQ ID NO: 2921164 - RNA, 19 nt, Mycobacterium avium subsp. paratuberculosis
cacauguucuccucgucgc

SEQ ID NO: 2921165 - RNA, 18 nt, Mycobacterium avium subsp. paratuberculosis
caccaccgacgcgucgcg

SEQ ID NO: 2921166 - RNA, 22 nt, Mycobacterium avium subsp. paratuberculosis
caccaccgacgcgucgcggcgg

SEQ ID NO: 2921167 - RNA, 14 nt, Mycobacterium avium subsp. paratuberculosis
caccaccgagccgg

SEQ ID NO: 2921168 - RNA, 15 nt, Mycobacterium avium subsp. paratuberculosis
caccaccgagccggc

SEQ ID NO: 2921169 - RNA, 22 nt, Mycobacterium avium subsp. paratuberculosis
caccaccgagccggcgucgccg

SEQ ID NO: 2921170 - RNA, 17 nt, Mycobacterium avium subsp. paratuberculosis
caccaccgccaccagcg

SEQ ID NO: 2921171 - RNA, 19 nt, Mycobacterium avium subsp. paratuberculosis
caccaccgccaccagcgca

SEQ ID NO: 2921172 - RNA, 12 nt, Mycobacterium avium subsp. paratuberculosis
caccaccgccag

SEQ ID NO: 2921173 - RNA, 14 nt, Mycobacterium avium subsp. paratuberculosis
caccaccgccaggu

SEQ ID NO: 2921174 - RNA, 14 nt, Mycobacterium avium subsp. paratuberculosis
caccaccgcccaca

SEQ ID NO: 2921175 - RNA, 20 nt, Mycobacterium avium subsp. paratuberculosis
caccaccgcccacagcaacg

SEQ ID NO: 2921176 - RNA, 20 nt, Mycobacterium avium subsp. paratuberculosis
caccaccgcccggaccggcu

SEQ ID NO: 2921177 - RNA, 12 nt, Mycobacterium avium subsp. paratuberculosis
caccaccgccgc

SEQ ID NO: 2921178 - RNA, 13 nt, Mycobacterium avium subsp. paratuberculosis
caccaccgccgcc

SEQ ID NO: 2921179 - RNA, 15 nt, Mycobacterium avium subsp. paratuberculosis
caccaccgccggccc

SEQ ID NO: 2921180 - RNA, 13 nt, Mycobacterium avium subsp. paratuberculosis
caccaccgccggg

SEQ ID NO: 2921181 - RNA, 21 nt, Mycobacterium avium subsp. paratuberculosis
caccaccgccgucaccgccag

SEQ ID NO: 2921182 - RNA, 23 nt, Mycobacterium avium subsp. paratuberculosis
caccaccgcgccgucgucgucgg

SEQ ID NO: 2921183 - RNA, 11 nt, Mycobacterium avium subsp. paratuberculosis
caccaccgcgg

SEQ ID NO: 2921184 - RNA, 13 nt, Mycobacterium avium subsp. paratuberculosis
caccaccgcggcg

SEQ ID NO: 2921185 - RNA, 14 nt, Mycobacterium avium subsp. paratuberculosis
caccaccgcggcga

SEQ ID NO: 2921186 - RNA, 17 nt, Mycobacterium avium subsp. paratuberculosis
caccaccgcggcgauga

SEQ ID NO: 2921187 - RNA, 14 nt, Mycobacterium avium subsp. paratuberculosis
caccaccgcggcgc

SEQ ID NO: 2921188 - RNA, 15 nt, Mycobacterium avium subsp. paratuberculosis
caccaccgcggcgcc

SEQ ID NO: 2921189 - RNA, 14 nt, Mycobacterium avium subsp. paratuberculosis
caccaccgcgguga

SEQ ID NO: 2921190 - RNA, 16 nt, Mycobacterium avium subsp. paratuberculosis
caccaccgcggugagc

SEQ ID NO: 2921191 - RNA, 23 nt, Mycobacterium avium subsp. paratuberculosis
caccaccgcguugaucagcgcca

SEQ ID NO: 2921192 - RNA, 15 nt, Mycobacterium avium subsp. paratuberculosis
caccaccggagcggc

SEQ ID NO: 2921193 - RNA, 17 nt, Mycobacterium avium subsp. paratuberculosis
caccaccggagcggcgg

SEQ ID NO: 2921194 - RNA, 18 nt, Mycobacterium avium subsp. paratuberculosis
caccaccggagcggcggu

SEQ ID NO: 2921195 - RNA, 12 nt, Mycobacterium avium subsp. paratuberculosis
caccaccggcaa

SEQ ID NO: 2921196 - RNA, 19 nt, Mycobacterium avium subsp. paratuberculosis
caccaccggcaaccgccac

SEQ ID NO: 2921197 - RNA, 20 nt, Mycobacterium avium subsp. paratuberculosis
caccaccggcaaccgccacg

SEQ ID NO: 2921198 - RNA, 21 nt, Mycobacterium avium subsp. paratuberculosis
caccaccggcaaccgccacga

SEQ ID NO: 2921199 - RNA, 16 nt, Mycobacterium avium subsp. paratuberculosis
caccaccggccgcccg

SEQ ID NO: 2921200 - RNA, 19 nt, Mycobacterium avium subsp. paratuberculosis
caccaccggccgcccggcg

SEQ ID NO: 2921201 - RNA, 20 nt, Mycobacterium avium subsp. paratuberculosis
caccaccggccgcccggcga

SEQ ID NO: 2921202 - RNA, 22 nt, Mycobacterium avium subsp. paratuberculosis
caccaccggccgcccggcgagc

SEQ ID NO: 2921203 - RNA, 14 nt, Mycobacterium avium subsp. paratuberculosis
caccaccggccgcg

SEQ ID NO: 2921204 - RNA, 15 nt, Mycobacterium avium subsp. paratuberculosis
caccaccggccgcgc

SEQ ID NO: 2921205 - RNA, 12 nt, Mycobacterium avium subsp. paratuberculosis
caccaccggcuu

SEQ ID NO: 2921206 - RNA, 16 nt, Mycobacterium avium subsp. paratuberculosis
caccaccgggucgucg

SEQ ID NO: 2921207 - RNA, 19 nt, Mycobacterium avium subsp. paratuberculosis
caccaccgggucgucgcgg

SEQ ID NO: 2921208 - RNA, 17 nt, Mycobacterium avium subsp. paratuberculosis
caccaccgucaccgccg

SEQ ID NO: 2921209 - RNA, 14 nt, Mycobacterium avium subsp. paratuberculosis
caccaccgugccgu

SEQ ID NO: 2921210 - RNA, 14 nt, Mycobacterium avium subsp. paratuberculosis
caccaccgugcugg

SEQ ID NO: 2921211 - RNA, 20 nt, Mycobacterium avium subsp. paratuberculosis
caccaccgugcuggccacca

SEQ ID NO: 2921212 - RNA, 13 nt, Mycobacterium avium subsp. paratuberculosis
caccaccguggcg

SEQ ID NO: 2921213 - RNA, 14 nt, Mycobacterium avium subsp. paratuberculosis
caccaccguggcga

SEQ ID NO: 2921214 - RNA, 21 nt, Mycobacterium avium subsp. paratuberculosis
caccaccuccucgcgggcgau

SEQ ID NO: 2921215 - RNA, 23 nt, Mycobacterium avium subsp. paratuberculosis
caccaccucgugcacaugcccgu

SEQ ID NO: 2921216 - RNA, 12 nt, Mycobacterium avium subsp. paratuberculosis
caccaccucuug

SEQ ID NO: 2921217 - RNA, 21 nt, Mycobacterium avium subsp. paratuberculosis
caccaccugguccugccccgg

SEQ ID NO: 2921218 - RNA, 22 nt, Mycobacterium avium subsp. paratuberculosis
caccaccugguccugccccggg

SEQ ID NO: 2921219 - RNA, 20 nt, Mycobacterium avium subsp. paratuberculosis
caccaccuucaucgccgucg

SEQ ID NO: 2921220 - RNA, 23 nt, Mycobacterium avium subsp. paratuberculosis
caccaccuucaucgccgucgcca

SEQ ID NO: 2921221 - RNA, 17 nt, Mycobacterium avium subsp. paratuberculosis
caccaccuugucaccga

SEQ ID NO: 2921222 - RNA, 17 nt, Mycobacterium avium subsp. paratuberculosis
caccacgaaccaggcgc

SEQ ID NO: 2921223 - RNA, 19 nt, Mycobacterium avium subsp. paratuberculosis
caccacgaaccaggcgccg

SEQ ID NO: 2921224 - RNA, 22 nt, Mycobacterium avium subsp. paratuberculosis
caccacgaaccaggcgccggcc

SEQ ID NO: 2921225 - RNA, 23 nt, Mycobacterium avium subsp. paratuberculosis
caccacgaaccaggcgccggcca

SEQ ID NO: 2921226 - RNA, 14 nt, Mycobacterium avium subsp. paratuberculosis
caccacgaacgcgc

SEQ ID NO: 2921227 - RNA, 18 nt, Mycobacterium avium subsp. paratuberculosis
caccacgaacgcgccgcc

SEQ ID NO: 2921228 - RNA, 13 nt, Mycobacterium avium subsp. paratuberculosis
caccacgaacgcu

SEQ ID NO: 2921229 - RNA, 17 nt, Mycobacterium avium subsp. paratuberculosis
caccacgaacgcugcca

SEQ ID NO: 2921230 - RNA, 18 nt, Mycobacterium avium subsp. paratuberculosis
caccacgaacgcugccag

SEQ ID NO: 2921231 - RNA, 18 nt, Mycobacterium avium subsp. paratuberculosis
caccacgaagcgggcggc

SEQ ID NO: 2921232 - RNA, 19 nt, Mycobacterium avium subsp. paratuberculosis
caccacgaagcgggcggcg

SEQ ID NO: 2921233 - RNA, 17 nt, Mycobacterium avium subsp. paratuberculosis
caccacgaccagugccc

SEQ ID NO: 2921234 - RNA, 13 nt, Mycobacterium avium subsp. paratuberculosis
caccacgaccucc

SEQ ID NO: 2921235 - RNA, 17 nt, Mycobacterium avium subsp. paratuberculosis
caccacgacgccgggcg

SEQ ID NO: 2921236 - RNA, 18 nt, Mycobacterium avium subsp. paratuberculosis
caccacgacgccgggcgc

SEQ ID NO: 2921237 - RNA, 13 nt, Mycobacterium avium subsp. paratuberculosis
caccacgacgucg

SEQ ID NO: 2921238 - RNA, 16 nt, Mycobacterium avium subsp. paratuberculosis
caccacgagcagccga

SEQ ID NO: 2921239 - RNA, 18 nt, Mycobacterium avium subsp. paratuberculosis
caccacgaggaccagcau

SEQ ID NO: 2921240 - RNA, 19 nt, Mycobacterium avium subsp. paratuberculosis
caccacgaucagcgcgucg

SEQ ID NO: 2921241 - RNA, 22 nt, Mycobacterium avium subsp. paratuberculosis
caccacgaugaagccgugcccg

SEQ ID NO: 2921242 - RNA, 23 nt, Mycobacterium avium subsp. paratuberculosis
caccacgcccgacgacgacgucg

SEQ ID NO: 2921243 - RNA, 13 nt, Mycobacterium avium subsp. paratuberculosis
caccacgccgacg

SEQ ID NO: 2921244 - RNA, 15 nt, Mycobacterium avium subsp. paratuberculosis
caccacgccgacgug

SEQ ID NO: 2921245 - RNA, 19 nt, Mycobacterium avium subsp. paratuberculosis
caccacgccgagcaccugg

SEQ ID NO: 2921246 - RNA, 22 nt, Mycobacterium avium subsp. paratuberculosis
caccacgccgagcaccuggccg

SEQ ID NO: 2921247 - RNA, 20 nt, Mycobacterium avium subsp. paratuberculosis
caccacgcuguagggccacc

SEQ ID NO: 2921248 - RNA, 22 nt, Mycobacterium avium subsp. paratuberculosis
caccacgcuguagggccaccac

SEQ ID NO: 2921249 - RNA, 16 nt, Mycobacterium avium subsp. paratuberculosis
caccacggcaccgccg

SEQ ID NO: 2921250 - RNA, 20 nt, Mycobacterium avium subsp. paratuberculosis
caccagcagccgcagcgcgc

SEQ ID NO: 2921251 - RNA, 21 nt, Mycobacterium avium subsp. paratuberculosis
caccagcagccgcagcgcgcg

SEQ ID NO: 2921252 - RNA, 11 nt, Mycobacterium avium subsp. paratuberculosis
caccagcagcg

SEQ ID NO: 2921253 - RNA, 16 nt, Mycobacterium avium subsp. paratuberculosis
caccagcagcgcgacg

SEQ ID NO: 2921254 - RNA, 22 nt, Mycobacterium avium subsp. paratuberculosis
caccagcagcgcgacgccgacg

SEQ ID NO: 2921255 - RNA, 10 nt, Mycobacterium avium subsp. paratuberculosis
caccagcagg

SEQ ID NO: 2921256 - RNA, 17 nt, Mycobacterium avium subsp. paratuberculosis
caccagcaggccccguu

SEQ ID NO: 2921257 - RNA, 17 nt, Mycobacterium avium subsp. paratuberculosis
caccagcaggucgaucu

SEQ ID NO: 2921258 - RNA, 23 nt, Mycobacterium avium subsp. paratuberculosis
caccagcauggcgaucaccccgg

SEQ ID NO: 2921259 - RNA, 14 nt, Mycobacterium avium subsp. paratuberculosis
caccagccacaccg

SEQ ID NO: 2921260 - RNA, 19 nt, Mycobacterium avium subsp. paratuberculosis
caccagccacaccgccgcg

SEQ ID NO: 2921261 - RNA, 19 nt, Mycobacterium avium subsp. paratuberculosis
caccagcccgaugccgccg

SEQ ID NO: 2921262 - RNA, 22 nt, Mycobacterium avium subsp. paratuberculosis
caccagcccgaugccgccgagg

SEQ ID NO: 2921263 - RNA, 13 nt, Mycobacterium avium subsp. paratuberculosis
caccagcccggcc

SEQ ID NO: 2921264 - RNA, 16 nt, Mycobacterium avium subsp. paratuberculosis
caccagcccggccagc

SEQ ID NO: 2921265 - RNA, 19 nt, Mycobacterium avium subsp. paratuberculosis
caccagcccggccagcggc

SEQ ID NO: 2921266 - RNA, 20 nt, Mycobacterium avium subsp. paratuberculosis
caccagcccggccagcggca

SEQ ID NO: 2921267 - RNA, 16 nt, Mycobacterium avium subsp. paratuberculosis
caccagccgagaucga

SEQ ID NO: 2921268 - RNA, 17 nt, Mycobacterium avium subsp. paratuberculosis
caccagccgcaggugcu

SEQ ID NO: 2921269 - RNA, 13 nt, Mycobacterium avium subsp. paratuberculosis
caccagccggccg

SEQ ID NO: 2921270 - RNA, 14 nt, Mycobacterium avium subsp. paratuberculosis
caccagccggccgg

SEQ ID NO: 2921271 - RNA, 15 nt, Mycobacterium avium subsp. paratuberculosis
caccagccggccggc

SEQ ID NO: 2921272 - RNA, 16 nt, Mycobacterium avium subsp. paratuberculosis
caccagccggccggcg

SEQ ID NO: 2921273 - RNA, 14 nt, Mycobacterium avium subsp. paratuberculosis
caccagcgaggucu

SEQ ID NO: 2921274 - RNA, 17 nt, Mycobacterium avium subsp. paratuberculosis
caccagcgauccggcgc

SEQ ID NO: 2921275 - RNA, 18 nt, Mycobacterium avium subsp. paratuberculosis
caccagcgauccggcgcg

SEQ ID NO: 2921276 - RNA, 13 nt, Mycobacterium avium subsp. paratuberculosis
caccagcgcacac

SEQ ID NO: 2921277 - RNA, 16 nt, Mycobacterium avium subsp. paratuberculosis
caccagcgcccgcccg

SEQ ID NO: 2921278 - RNA, 16 nt, Mycobacterium avium subsp. paratuberculosis
caccagcgccugggcg

SEQ ID NO: 2921279 - RNA, 22 nt, Mycobacterium avium subsp. paratuberculosis
caccagcgccugggcguacagc

SEQ ID NO: 2921280 - RNA, 18 nt, Mycobacterium avium subsp. paratuberculosis
caccagcgcgcacgcgga

SEQ ID NO: 2921281 - RNA, 12 nt, Mycobacterium avium subsp. paratuberculosis
caccagcgcgga

SEQ ID NO: 2921282 - RNA, 16 nt, Mycobacterium avium subsp. paratuberculosis
caccagcgcggacacc

SEQ ID NO: 2921283 - RNA, 19 nt, Mycobacterium avium subsp. paratuberculosis
caccagcgcggacaccagg

SEQ ID NO: 2921284 - RNA, 20 nt, Mycobacterium avium subsp. paratuberculosis
caccagcgcggacaccaggu

SEQ ID NO: 2921285 - RNA, 16 nt, Mycobacterium avium subsp. paratuberculosis
caccagcgcggccacc

SEQ ID NO: 2921286 - RNA, 19 nt, Mycobacterium avium subsp. paratuberculosis
caccagcgcggccaccacc

SEQ ID NO: 2921287 - RNA, 14 nt, Mycobacterium avium subsp. paratuberculosis
caccagcgcgguca

SEQ ID NO: 2921288 - RNA, 13 nt, Mycobacterium avium subsp. paratuberculosis
caccagcgcggug

SEQ ID NO: 2921289 - RNA, 16 nt, Mycobacterium avium subsp. paratuberculosis
caccagcgcggugaug

SEQ ID NO: 2921290 - RNA, 19 nt, Mycobacterium avium subsp. paratuberculosis
caccagcgcuuucgcgcac

SEQ ID NO: 2921291 - RNA, 13 nt, Mycobacterium avium subsp. paratuberculosis
caccagcggcacc

SEQ ID NO: 2921292 - RNA, 16 nt, Mycobacterium avium subsp. paratuberculosis
caccagcggcaccagg

SEQ ID NO: 2921293 - RNA, 18 nt, Mycobacterium avium subsp. paratuberculosis
caccagcggcaccaggua

SEQ ID NO: 2921294 - RNA, 15 nt, Mycobacterium avium subsp. paratuberculosis
caccagcggcaucgc

SEQ ID NO: 2921295 - RNA, 20 nt, Mycobacterium avium subsp. paratuberculosis
caccagcggcaucgccgcca

SEQ ID NO: 2921296 - RNA, 20 nt, Mycobacterium avium subsp. paratuberculosis
caccagcggccgucgccggg

SEQ ID NO: 2921297 - RNA, 20 nt, Mycobacterium avium subsp. paratuberculosis
caccagcggcgcccacggcc

SEQ ID NO: 2921298 - RNA, 13 nt, Mycobacterium avium subsp. paratuberculosis
caccagcggcgcg

SEQ ID NO: 2921299 - RNA, 16 nt, Mycobacterium avium subsp. paratuberculosis
caccagcggcgcgucg

SEQ ID NO: 2921300 - RNA, 23 nt, Mycobacterium avium subsp. paratuberculosis
caccagcggcgcgucgcugggca

SEQ ID NO: 2921301 - RNA, 22 nt, Mycobacterium avium subsp. paratuberculosis
caccagcggcugcagcagaugc

SEQ ID NO: 2921302 - RNA, 13 nt, Mycobacterium avium subsp. paratuberculosis
caccagcggggug

SEQ ID NO: 2921303 - RNA, 13 nt, Mycobacterium avium subsp. paratuberculosis
caccagcggucgg

SEQ ID NO: 2921304 - RNA, 15 nt, Mycobacterium avium subsp. paratuberculosis
caccagcggucggcg

SEQ ID NO: 2921305 - RNA, 20 nt, Mycobacterium avium subsp. paratuberculosis
caccagcggucggcgguucg

SEQ ID NO: 2921306 - RNA, 14 nt, Mycobacterium avium subsp. paratuberculosis
caccagcgucgacg

SEQ ID NO: 2921307 - RNA, 13 nt, Mycobacterium avium subsp. paratuberculosis
caccagcgucgcg

SEQ ID NO: 2921308 - RNA, 14 nt, Mycobacterium avium subsp. paratuberculosis
caccagcgugcugc

SEQ ID NO: 2921309 - RNA, 17 nt, Mycobacterium avium subsp. paratuberculosis
caccagcgugcugccgg

SEQ ID NO: 2921310 - RNA, 14 nt, Mycobacterium avium subsp. paratuberculosis
caccagcguggccg

SEQ ID NO: 2921311 - RNA, 22 nt, Mycobacterium avium subsp. paratuberculosis
caccagcguggccggcagguug

SEQ ID NO: 2921312 - RNA, 19 nt, Mycobacterium avium subsp. paratuberculosis
caccagcguggugcgcccg

SEQ ID NO: 2921313 - RNA, 22 nt, Mycobacterium avium subsp. paratuberculosis
caccagcguggugcgcccgucg

SEQ ID NO: 2921314 - RNA, 18 nt, Mycobacterium avium subsp. paratuberculosis
caccagcguguagacggu

SEQ ID NO: 2921315 - RNA, 19 nt, Mycobacterium avium subsp. paratuberculosis
caccagcguguggcccugc

SEQ ID NO: 2921316 - RNA, 20 nt, Mycobacterium avium subsp. paratuberculosis
caccagcguguugagcucgc

SEQ ID NO: 2921317 - RNA, 16 nt, Mycobacterium avium subsp. paratuberculosis
caccagcguuccagca

SEQ ID NO: 2921318 - RNA, 18 nt, Mycobacterium avium subsp. paratuberculosis
caccagcguucgucgccg

SEQ ID NO: 2921319 - RNA, 18 nt, Mycobacterium avium subsp. paratuberculosis
caccagcucgaggccgcg

SEQ ID NO: 2921320 - RNA, 20 nt, Mycobacterium avium subsp. paratuberculosis
caccagcucgaggccgcggg

SEQ ID NO: 2921321 - RNA, 23 nt, Mycobacterium avium subsp. paratuberculosis
caccagcucgaggccgcgggcgu

SEQ ID NO: 2921322 - RNA, 22 nt, Mycobacterium avium subsp. paratuberculosis
caccagcucgccgauguggcgg

SEQ ID NO: 2921323 - RNA, 15 nt, Mycobacterium avium subsp. paratuberculosis
caccagcucggcgcu

SEQ ID NO: 2921324 - RNA, 16 nt, Mycobacterium avium subsp. paratuberculosis
caccagcucggcgcug

SEQ ID NO: 2921325 - RNA, 22 nt, Mycobacterium avium subsp. paratuberculosis
caccagcucggcgcugucggcg

SEQ ID NO: 2921326 - RNA, 18 nt, Mycobacterium avium subsp. paratuberculosis
caccagcucgucgccgac

SEQ ID NO: 2921327 - RNA, 19 nt, Mycobacterium avium subsp. paratuberculosis
caccagcucgucgccgacc

SEQ ID NO: 2921328 - RNA, 23 nt, Mycobacterium avium subsp. paratuberculosis
caccagcugauucgcgguggcga

SEQ ID NO: 2921329 - RNA, 13 nt, Mycobacterium avium subsp. paratuberculosis
caccagcugcgga

SEQ ID NO: 2921330 - RNA, 17 nt, Mycobacterium avium subsp. paratuberculosis
caccagcuggauggcgc

SEQ ID NO: 2921331 - RNA, 20 nt, Mycobacterium avium subsp. paratuberculosis
caccagcuggauggcgccca

SEQ ID NO: 2921332 - RNA, 20 nt, Mycobacterium avium subsp. paratuberculosis
caccagcugggaggcgcaca

SEQ ID NO: 2921333 - RNA, 14 nt, Mycobacterium avium subsp. paratuberculosis
caccaggaaggcga

SEQ ID NO: 2921334 - RNA, 15 nt, Mycobacterium avium subsp. paratuberculosis
caccaggaaggcgac

SEQ ID NO: 2921335 - RNA, 14 nt, Mycobacterium avium subsp. paratuberculosis
caccaucagcaccg

SEQ ID NO: 2921336 - RNA, 14 nt, Mycobacterium avium subsp. paratuberculosis
caccaucaggccgg

SEQ ID NO: 2921337 - RNA, 15 nt, Mycobacterium avium subsp. paratuberculosis
caccaucaggccggc

SEQ ID NO: 2921338 - RNA, 17 nt, Mycobacterium avium subsp. paratuberculosis
caccaucaggccggccu

SEQ ID NO: 2921339 - RNA, 14 nt, Mycobacterium avium subsp. paratuberculosis
caccauccagugca

SEQ ID NO: 2921340 - RNA, 19 nt, Mycobacterium avium subsp. paratuberculosis
caccauccagugcaguucg

SEQ ID NO: 2921341 - RNA, 15 nt, Mycobacterium avium subsp. paratuberculosis
caccaucccgccgcc

SEQ ID NO: 2921342 - RNA, 16 nt, Mycobacterium avium subsp. paratuberculosis
caccaucccgccgccg

SEQ ID NO: 2921343 - RNA, 15 nt, Mycobacterium avium subsp. paratuberculosis
caccauccgcgacgc

SEQ ID NO: 2921344 - RNA, 23 nt, Mycobacterium avium subsp. paratuberculosis
caccauccgcgacgccagcaccu

SEQ ID NO: 2921345 - RNA, 12 nt, Mycobacterium avium subsp. paratuberculosis
caccauccgcgc

SEQ ID NO: 2921346 - RNA, 13 nt, Mycobacterium avium subsp. paratuberculosis
caccauccgcgcg

SEQ ID NO: 2921347 - RNA, 14 nt, Mycobacterium avium subsp. paratuberculosis
caccauccgcgcga

SEQ ID NO: 2921348 - RNA, 21 nt, Mycobacterium avium subsp. paratuberculosis
caccauccgcgcgagcgcgcu

SEQ ID NO: 2921349 - RNA, 20 nt, Mycobacterium avium subsp. paratuberculosis
caccaucgcuuuccggucag

SEQ ID NO: 2921350 - RNA, 13 nt, Mycobacterium avium subsp. paratuberculosis
caccaucggggug

SEQ ID NO: 2921351 - RNA, 18 nt, Mycobacterium avium subsp. paratuberculosis
caccaucggggugaccgu

SEQ ID NO: 2921352 - RNA, 15 nt, Mycobacterium avium subsp. paratuberculosis
caccaucuccgcggc

SEQ ID NO: 2921353 - RNA, 16 nt, Mycobacterium avium subsp. paratuberculosis
caccaugagcagaccg

SEQ ID NO: 2921354 - RNA, 22 nt, Mycobacterium avium subsp. paratuberculosis
caccaugaucagcgccguggcc

SEQ ID NO: 2921355 - RNA, 19 nt, Mycobacterium avium subsp. paratuberculosis
caccaugauguagcggcgg

SEQ ID NO: 2921356 - RNA, 11 nt, Mycobacterium avium subsp. paratuberculosis
caccaugccgg

SEQ ID NO: 2921357 - RNA, 14 nt, Mycobacterium avium subsp. paratuberculosis
caccaugccggcgu

SEQ ID NO: 2921358 - RNA, 16 nt, Mycobacterium avium subsp. paratuberculosis
caccaugccggcgucc

SEQ ID NO: 2921359 - RNA, 20 nt, Mycobacterium avium subsp. paratuberculosis
caccauggcuuccgccgaga

SEQ ID NO: 2921360 - RNA, 16 nt, Mycobacterium avium subsp. paratuberculosis
caccaugggcgggacg

SEQ ID NO: 2921361 - RNA, 14 nt, Mycobacterium avium subsp. paratuberculosis
caccaugucggcgu

SEQ ID NO: 2921362 - RNA, 21 nt, Mycobacterium avium subsp. paratuberculosis
caccaugucggcgucgccgag

SEQ ID NO: 2921363 - RNA, 23 nt, Mycobacterium avium subsp. paratuberculosis
caccaugucggcgucgccgagcc

SEQ ID NO: 2921364 - RNA, 22 nt, Mycobacterium avium subsp. paratuberculosis
caccaugucguugacgcugggc

SEQ ID NO: 2921365 - RNA, 18 nt, Mycobacterium avium subsp. paratuberculosis
cacccaaaaaggcgcggg

SEQ ID NO: 2921366 - RNA, 20 nt, Mycobacterium avium subsp. paratuberculosis
cacccaaaaaggcgcgggug

SEQ ID NO: 2921367 - RNA, 18 nt, Mycobacterium avium subsp. paratuberculosis
cacccaccggcccagccg

SEQ ID NO: 2921368 - RNA, 13 nt, Mycobacterium avium subsp. paratuberculosis
cacccaccggcgc

SEQ ID NO: 2921369 - RNA, 12 nt, Mycobacterium avium subsp. paratuberculosis
cacccacgccag

SEQ ID NO: 2921370 - RNA, 18 nt, Mycobacterium avium subsp. paratuberculosis
cacccacgccagccgggu

SEQ ID NO: 2921371 - RNA, 13 nt, Mycobacterium avium subsp. paratuberculosis
cacccacggccac

SEQ ID NO: 2921372 - RNA, 15 nt, Mycobacterium avium subsp. paratuberculosis
cacccacucccagcc

SEQ ID NO: 2921373 - RNA, 15 nt, Mycobacterium avium subsp. paratuberculosis
cacccacucggacag

SEQ ID NO: 2921374 - RNA, 22 nt, Mycobacterium avium subsp. paratuberculosis
cacccacuggcggccggccgcg

SEQ ID NO: 2921375 - RNA, 22 nt, Mycobacterium avium subsp. paratuberculosis
cacccagacguguggcacccgg

SEQ ID NO: 2921376 - RNA, 23 nt, Mycobacterium avium subsp. paratuberculosis
cacccagacguguggcacccggg

SEQ ID NO: 2921377 - RNA, 23 nt, Mycobacterium avium subsp. paratuberculosis
cacccagaucgcccgggcggcgg

SEQ ID NO: 2921378 - RNA, 16 nt, Mycobacterium avium subsp. paratuberculosis
cacccagaugcccagc

SEQ ID NO: 2921379 - RNA, 17 nt, Mycobacterium avium subsp. paratuberculosis
cacccagaugcccagcg

SEQ ID NO: 2921380 - RNA, 20 nt, Mycobacterium avium subsp. paratuberculosis
cacccagaugcccagcggca

SEQ ID NO: 2921381 - RNA, 23 nt, Mycobacterium avium subsp. paratuberculosis
cacccagcgagaccgcuugcggc

SEQ ID NO: 2921382 - RNA, 14 nt, Mycobacterium avium subsp. paratuberculosis
cacccagcgagccg

SEQ ID NO: 2921383 - RNA, 18 nt, Mycobacterium avium subsp. paratuberculosis
cacccagcgagccgauga

SEQ ID NO: 2921384 - RNA, 15 nt, Mycobacterium avium subsp. paratuberculosis
cacccagcgagcuca

SEQ ID NO: 2921385 - RNA, 15 nt, Mycobacterium avium subsp. paratuberculosis
cacccagcgccagga

SEQ ID NO: 2921386 - RNA, 13 nt, Mycobacterium avium subsp. paratuberculosis
cacccagcgggcg

SEQ ID NO: 2921387 - RNA, 14 nt, Mycobacterium avium subsp. paratuberculosis
cacccagcgggcga

SEQ ID NO: 2921388 - RNA, 16 nt, Mycobacterium avium subsp. paratuberculosis
cacccagcgggcgacg

SEQ ID NO: 2921389 - RNA, 18 nt, Mycobacterium avium subsp. paratuberculosis
cacccagcgggcgacguc

SEQ ID NO: 2921390 - RNA, 22 nt, Mycobacterium avium subsp. paratuberculosis
cacccagcgggcgacgucgggg

SEQ ID NO: 2921391 - RNA, 21 nt, Mycobacterium avium subsp. paratuberculosis
cacccaggaaaaccagcgacg

SEQ ID NO: 2921392 - RNA, 14 nt, Mycobacterium avium subsp. paratuberculosis
cacccaggucaccg

SEQ ID NO: 2921393 - RNA, 20 nt, Mycobacterium avium subsp. paratuberculosis
cacccaggucaugguggcgg

SEQ ID NO: 2921394 - RNA, 21 nt, Mycobacterium avium subsp. paratuberculosis
cacccaggucaugguggcggc

SEQ ID NO: 2921395 - RNA, 23 nt, Mycobacterium avium subsp. paratuberculosis
cacccaggucaugguggcggcgc

SEQ ID NO: 2921396 - RNA, 22 nt, Mycobacterium avium subsp. paratuberculosis
cacccaggucuuccggaugccg

SEQ ID NO: 2921397 - RNA, 15 nt, Mycobacterium avium subsp. paratuberculosis
cacccaggugcugcc

SEQ ID NO: 2921398 - RNA, 18 nt, Mycobacterium avium subsp. paratuberculosis
cacccagguguccggccc

SEQ ID NO: 2921399 - RNA, 21 nt, Mycobacterium avium subsp. paratuberculosis
cacccagguugucaaggguuu

SEQ ID NO: 2921400 - RNA, 14 nt, Mycobacterium avium subsp. paratuberculosis
cacccauccccagg

SEQ ID NO: 2921401 - RNA, 17 nt, Mycobacterium avium subsp. paratuberculosis
cacccaugauggugggc

SEQ ID NO: 2921402 - RNA, 15 nt, Mycobacterium avium subsp. paratuberculosis
caccccacaccgucc

SEQ ID NO: 2921403 - RNA, 13 nt, Mycobacterium avium subsp. paratuberculosis
caccccacccgcg

SEQ ID NO: 2921404 - RNA, 14 nt, Mycobacterium avium subsp. paratuberculosis
caccccacccgcgc

SEQ ID NO: 2921405 - RNA, 16 nt, Mycobacterium avium subsp. paratuberculosis
caccccacccgcgcga

SEQ ID NO: 2921406 - RNA, 13 nt, Mycobacterium avium subsp. paratuberculosis
caccccaccgaca

SEQ ID NO: 2921407 - RNA, 15 nt, Mycobacterium avium subsp. paratuberculosis
caccccagcgcgacc

SEQ ID NO: 2921408 - RNA, 15 nt, Mycobacterium avium subsp. paratuberculosis
caccccaggcgaugc

SEQ ID NO: 2921409 - RNA, 17 nt, Mycobacterium avium subsp. paratuberculosis
caccccaggcgaugccg

SEQ ID NO: 2921410 - RNA, 20 nt, Mycobacterium avium subsp. paratuberculosis
caccccaggcgaugccgccg

SEQ ID NO: 2921411 - RNA, 14 nt, Mycobacterium avium subsp. paratuberculosis
caccccaucggcca

SEQ ID NO: 2921412 - RNA, 14 nt, Mycobacterium avium subsp. paratuberculosis
cacccccagcccgc

SEQ ID NO: 2921413 - RNA, 19 nt, Mycobacterium avium subsp. paratuberculosis
cacccccagcccgccgggc

SEQ ID NO: 2921414 - RNA, 14 nt, Mycobacterium avium subsp. paratuberculosis
cacccccagcucga

SEQ ID NO: 2921415 - RNA, 20 nt, Mycobacterium avium subsp. paratuberculosis
caccccccaguuucccgucg

SEQ ID NO: 2921416 - RNA, 13 nt, Mycobacterium avium subsp. paratuberculosis
cacccccgauccg

SEQ ID NO: 2921417 - RNA, 22 nt, Mycobacterium avium subsp. paratuberculosis
cacccccgcgcugcccagcgcg

SEQ ID NO: 2921418 - RNA, 20 nt, Mycobacterium avium subsp. paratuberculosis
cacccccggggccuccagcc

SEQ ID NO: 2921419 - RNA, 16 nt, Mycobacterium avium subsp. paratuberculosis
cacccccuacgccgug

SEQ ID NO: 2921420 - RNA, 14 nt, Mycobacterium avium subsp. paratuberculosis
cacccgcacgcccg

SEQ ID NO: 2921421 - RNA, 15 nt, Mycobacterium avium subsp. paratuberculosis
cacccgcacgcccgg

SEQ ID NO: 2921422 - RNA, 15 nt, Mycobacterium avium subsp. paratuberculosis
cacccgcacggucgc

SEQ ID NO: 2921423 - RNA, 17 nt, Mycobacterium avium subsp. paratuberculosis
cacccgcacggucgcgg

SEQ ID NO: 2921424 - RNA, 19 nt, Mycobacterium avium subsp. paratuberculosis
cacccgcacgugcgcgccg

SEQ ID NO: 2921425 - RNA, 13 nt, Mycobacterium avium subsp. paratuberculosis
cacccgcagcccg

SEQ ID NO: 2921426 - RNA, 14 nt, Mycobacterium avium subsp. paratuberculosis
cacccgcagcccga

SEQ ID NO: 2921427 - RNA, 20 nt, Mycobacterium avium subsp. paratuberculosis
cacccgcagccgcgagucga

SEQ ID NO: 2921428 - RNA, 17 nt, Mycobacterium avium subsp. paratuberculosis
cacccgcagcgaccgcg

SEQ ID NO: 2921429 - RNA, 17 nt, Mycobacterium avium subsp. paratuberculosis
cacccgcagcgcggcgg

SEQ ID NO: 2921430 - RNA, 13 nt, Mycobacterium avium subsp. paratuberculosis
cacccgcagcucc

SEQ ID NO: 2921431 - RNA, 17 nt, Mycobacterium avium subsp. paratuberculosis
cacccgcagcuccagcg

SEQ ID NO: 2921432 - RNA, 16 nt, Mycobacterium avium subsp. paratuberculosis
cacccgcagcucgccg

SEQ ID NO: 2921433 - RNA, 17 nt, Mycobacterium avium subsp. paratuberculosis
cacccgcagcucgccga

SEQ ID NO: 2921434 - RNA, 20 nt, Mycobacterium avium subsp. paratuberculosis
cacccgcagcucgccgagcg

SEQ ID NO: 2921435 - RNA, 20 nt, Mycobacterium avium subsp. paratuberculosis
cacccgcaucaacugcacca

SEQ ID NO: 2921436 - RNA, 23 nt, Mycobacterium avium subsp. paratuberculosis
cacccgcaucaacugcaccagcg

SEQ ID NO: 2921437 - RNA, 16 nt, Mycobacterium avium subsp. paratuberculosis
cacccgcaugcugauc

SEQ ID NO: 2921438 - RNA, 14 nt, Mycobacterium avium subsp. paratuberculosis
cacccgccccgccg

SEQ ID NO: 2921439 - RNA, 15 nt, Mycobacterium avium subsp. paratuberculosis
cacccgccccgccgc

SEQ ID NO: 2921440 - RNA, 20 nt, Mycobacterium avium subsp. paratuberculosis
cacccgccccgccgcggcca

SEQ ID NO: 2921441 - RNA, 13 nt, Mycobacterium avium subsp. paratuberculosis
cacccgcccggac

SEQ ID NO: 2921442 - RNA, 15 nt, Mycobacterium avium subsp. paratuberculosis
cacccgcccggacgc

SEQ ID NO: 2921443 - RNA, 16 nt, Mycobacterium avium subsp. paratuberculosis
cacccgcccggacgcg

SEQ ID NO: 2921444 - RNA, 13 nt, Mycobacterium avium subsp. paratuberculosis
cacccgcgaucgg

SEQ ID NO: 2921445 - RNA, 18 nt, Mycobacterium avium subsp. paratuberculosis
cacccgcgcacgcucgcg

SEQ ID NO: 2921446 - RNA, 14 nt, Mycobacterium avium subsp. paratuberculosis
cacccgcgcccgca

SEQ ID NO: 2921447 - RNA, 13 nt, Mycobacterium avium subsp. paratuberculosis
cacccgcgccggc

SEQ ID NO: 2921448 - RNA, 14 nt, Mycobacterium avium subsp. paratuberculosis
cacccgcgccucca

SEQ ID NO: 2921449 - RNA, 13 nt, Mycobacterium avium subsp. paratuberculosis
cacccgcgcgaca

SEQ ID NO: 2921450 - RNA, 22 nt, Mycobacterium avium subsp. paratuberculosis
cacccgcgcgacaucaccgcgg

SEQ ID NO: 2921451 - RNA, 18 nt, Mycobacterium avium subsp. paratuberculosis
cacccgcgcggugcccgg

SEQ ID NO: 2921452 - RNA, 12 nt, Mycobacterium avium subsp. paratuberculosis
cacccgcggaac

SEQ ID NO: 2921453 - RNA, 17 nt, Mycobacterium avium subsp. paratuberculosis
cacccgcggaacgcuca

SEQ ID NO: 2921454 - RNA, 14 nt, Mycobacterium avium subsp. paratuberculosis
cacccgcggccgcu

SEQ ID NO: 2921455 - RNA, 17 nt, Mycobacterium avium subsp. paratuberculosis
cacccgcggccggccca

SEQ ID NO: 2921456 - RNA, 20 nt, Mycobacterium avium subsp. paratuberculosis
cacccgcggccggcccagcg

SEQ ID NO: 2921457 - RNA, 13 nt, Mycobacterium avium subsp. paratuberculosis
cacccgcggcgcg

SEQ ID NO: 2921458 - RNA, 17 nt, Mycobacterium avium subsp. paratuberculosis
cacccgcggcgcgauga

SEQ ID NO: 2921459 - RNA, 17 nt, Mycobacterium avium subsp. paratuberculosis
cacccgcgggucgucgg

SEQ ID NO: 2921460 - RNA, 16 nt, Mycobacterium avium subsp. paratuberculosis
cacccgcuccaccgaa

SEQ ID NO: 2921461 - RNA, 14 nt, Mycobacterium avium subsp. paratuberculosis
cacccgcuccucgc

SEQ ID NO: 2921462 - RNA, 17 nt, Mycobacterium avium subsp. paratuberculosis
cacccgcucgccgauga

SEQ ID NO: 2921463 - RNA, 17 nt, Mycobacterium avium subsp. paratuberculosis
cacccgcucgcgggccc

SEQ ID NO: 2921464 - RNA, 13 nt, Mycobacterium avium subsp. paratuberculosis
cacccgcucggcg

SEQ ID NO: 2921465 - RNA, 16 nt, Mycobacterium avium subsp. paratuberculosis
cacccgcugauccagc

SEQ ID NO: 2921466 - RNA, 22 nt, Mycobacterium avium subsp. paratuberculosis
cacccgcugauccagcagcgcc

SEQ ID NO: 2921467 - RNA, 13 nt, Mycobacterium avium subsp. paratuberculosis
cacccgcugcacc

SEQ ID NO: 2921468 - RNA, 14 nt, Mycobacterium avium subsp. paratuberculosis
cacccgcugcacca

SEQ ID NO: 2921469 - RNA, 18 nt, Mycobacterium avium subsp. paratuberculosis
cacccgcugcaccagccc

SEQ ID NO: 2921470 - RNA, 16 nt, Mycobacterium avium subsp. paratuberculosis
cacccgcugcucgacc

SEQ ID NO: 2921471 - RNA, 19 nt, Mycobacterium avium subsp. paratuberculosis
cacccgcugcucgaccucg

SEQ ID NO: 2921472 - RNA, 22 nt, Mycobacterium avium subsp. paratuberculosis
cacccgcugcucgaccucggcg

SEQ ID NO: 2921473 - RNA, 22 nt, Mycobacterium avium subsp. paratuberculosis
cacccgcuuuugccgucggugc

SEQ ID NO: 2921474 - RNA, 21 nt, Mycobacterium avium subsp. paratuberculosis
cacccggacgaugacccagcc

SEQ ID NO: 2921475 - RNA, 22 nt, Mycobacterium avium subsp. paratuberculosis
cacccggacgaugacccagccc

SEQ ID NO: 2921476 - RNA, 20 nt, Mycobacterium avium subsp. paratuberculosis
cacccggacgugaucgcggu

SEQ ID NO: 2921477 - RNA, 22 nt, Mycobacterium avium subsp. paratuberculosis
cacccggacgugaucgcggugg

SEQ ID NO: 2921478 - RNA, 16 nt, Mycobacterium avium subsp. paratuberculosis
cacccggauggucugc

SEQ ID NO: 2921479 - RNA, 20 nt, Mycobacterium avium subsp. paratuberculosis
cacccggauggucugcagcg

SEQ ID NO: 2921480 - RNA, 18 nt, Mycobacterium avium subsp. paratuberculosis
cacccggaugucgugcgg

SEQ ID NO: 2921481 - RNA, 15 nt, Mycobacterium avium subsp. paratuberculosis
cacccggccacgccg

SEQ ID NO: 2921482 - RNA, 17 nt, Mycobacterium avium subsp. paratuberculosis
cacccggccacgccggg

SEQ ID NO: 2921483 - RNA, 15 nt, Mycobacterium avium subsp. paratuberculosis
cacccggcccaccac

SEQ ID NO: 2921484 - RNA, 21 nt, Mycobacterium avium subsp. paratuberculosis
cacccggcccaccaccgccuc

SEQ ID NO: 2921485 - RNA, 14 nt, Mycobacterium avium subsp. paratuberculosis
cacccggcccaccg

SEQ ID NO: 2921486 - RNA, 17 nt, Mycobacterium avium subsp. paratuberculosis
cacccggcccaccggcc

SEQ ID NO: 2921487 - RNA, 21 nt, Mycobacterium avium subsp. paratuberculosis
cacccggcccaccggcccggc

SEQ ID NO: 2921488 - RNA, 22 nt, Mycobacterium avium subsp. paratuberculosis
cacccggcccaccggcccggcg

SEQ ID NO: 2921489 - RNA, 14 nt, Mycobacterium avium subsp. paratuberculosis
cacccggcccccga

SEQ ID NO: 2921490 - RNA, 23 nt, Mycobacterium avium subsp. paratuberculosis
cacccggcccccugaggagacga

SEQ ID NO: 2921491 - RNA, 13 nt, Mycobacterium avium subsp. paratuberculosis
cacccggccggcg

SEQ ID NO: 2921492 - RNA, 22 nt, Mycobacterium avium subsp. paratuberculosis
cacccggcgauuaggucggugg

SEQ ID NO: 2921493 - RNA, 16 nt, Mycobacterium avium subsp. paratuberculosis
cacccggcgcggccgc

SEQ ID NO: 2921494 - RNA, 14 nt, Mycobacterium avium subsp. paratuberculosis
cacccggcggcacc

SEQ ID NO: 2921495 - RNA, 19 nt, Mycobacterium avium subsp. paratuberculosis
cacccggcggcaccgcggc

SEQ ID NO: 2921496 - RNA, 21 nt, Mycobacterium avium subsp. paratuberculosis
cacccggcggcaccgcggcuc

SEQ ID NO: 2921497 - RNA, 17 nt, Mycobacterium avium subsp. paratuberculosis
cacccggcgggccagau

SEQ ID NO: 2921498 - RNA, 18 nt, Mycobacterium avium subsp. paratuberculosis
cacccggcgggccagaug

SEQ ID NO: 2921499 - RNA, 12 nt, Mycobacterium avium subsp. paratuberculosis
cacccggcgggg

SEQ ID NO: 2921500 - RNA, 19 nt, Mycobacterium avium subsp. paratuberculosis
cacccggcggggacccgac

SEQ ID NO: 2921501 - RNA, 22 nt, Mycobacterium avium subsp. paratuberculosis
cacccggcuggccgcacaccug

SEQ ID NO: 2921502 - RNA, 22 nt, Mycobacterium avium subsp. paratuberculosis
cacccggcuucgcugcgccggc

SEQ ID NO: 2921503 - RNA, 23 nt, Mycobacterium avium subsp. paratuberculosis
cacccggcuucgcugcgccggcg

SEQ ID NO: 2921504 - RNA, 17 nt, Mycobacterium avium subsp. paratuberculosis
cacccgggcagcuuccg

SEQ ID NO: 2921505 - RNA, 17 nt, Mycobacterium avium subsp. paratuberculosis
caccgaagccgacgucg

SEQ ID NO: 2921506 - RNA, 19 nt, Mycobacterium avium subsp. paratuberculosis
caccgaagccgacgucgac

SEQ ID NO: 2921507 - RNA, 14 nt, Mycobacterium avium subsp. paratuberculosis
caccgaaguccgcc

SEQ ID NO: 2921508 - RNA, 16 nt, Mycobacterium avium subsp. paratuberculosis
caccgaaguccgccag

SEQ ID NO: 2921509 - RNA, 17 nt, Mycobacterium avium subsp. paratuberculosis
caccgaaguccgccagg

SEQ ID NO: 2921510 - RNA, 21 nt, Mycobacterium avium subsp. paratuberculosis
caccgaaucacccacggccac

SEQ ID NO: 2921511 - RNA, 17 nt, Mycobacterium avium subsp. paratuberculosis
caccgaaucgccgagcu

SEQ ID NO: 2921512 - RNA, 18 nt, Mycobacterium avium subsp. paratuberculosis
caccgaauuguccagcag

SEQ ID NO: 2921513 - RNA, 18 nt, Mycobacterium avium subsp. paratuberculosis
caccgacaagggccgggc

SEQ ID NO: 2921514 - RNA, 20 nt, Mycobacterium avium subsp. paratuberculosis
caccgacaagggccgggcgc

SEQ ID NO: 2921515 - RNA, 15 nt, Mycobacterium avium subsp. paratuberculosis
caccgacaccaccgg

SEQ ID NO: 2921516 - RNA, 16 nt, Mycobacterium avium subsp. paratuberculosis
caccgacaccaccggc

SEQ ID NO: 2921517 - RNA, 17 nt, Mycobacterium avium subsp. paratuberculosis
caccgacaccaccggcc

SEQ ID NO: 2921518 - RNA, 20 nt, Mycobacterium avium subsp. paratuberculosis
caccgacaccaccggccgcc

SEQ ID NO: 2921519 - RNA, 13 nt, Mycobacterium avium subsp. paratuberculosis
caccgacaccccg

SEQ ID NO: 2921520 - RNA, 18 nt, Mycobacterium avium subsp. paratuberculosis
caccgacaccccgaugcg

SEQ ID NO: 2921521 - RNA, 14 nt, Mycobacterium avium subsp. paratuberculosis
caccgacaccggcc

SEQ ID NO: 2921522 - RNA, 16 nt, Mycobacterium avium subsp. paratuberculosis
caccgacaccggccgg

SEQ ID NO: 2921523 - RNA, 18 nt, Mycobacterium avium subsp. paratuberculosis
caccgacaccggccggga

SEQ ID NO: 2921524 - RNA, 14 nt, Mycobacterium avium subsp. paratuberculosis
caccgacagcaccc

SEQ ID NO: 2921525 - RNA, 15 nt, Mycobacterium avium subsp. paratuberculosis
caccgacagcacccg

SEQ ID NO: 2921526 - RNA, 20 nt, Mycobacterium avium subsp. paratuberculosis
caccgacagcacccggcccc

SEQ ID NO: 2921527 - RNA, 17 nt, Mycobacterium avium subsp. paratuberculosis
caccgacagggccagcg

SEQ ID NO: 2921528 - RNA, 20 nt, Mycobacterium avium subsp. paratuberculosis
caccgacagggccagcgcca

SEQ ID NO: 2921529 - RNA, 21 nt, Mycobacterium avium subsp. paratuberculosis
caccgacagggccagcgccau

SEQ ID NO: 2921530 - RNA, 13 nt, Mycobacterium avium subsp. paratuberculosis
caccgacaggucg

SEQ ID NO: 2921531 - RNA, 19 nt, Mycobacterium avium subsp. paratuberculosis
caccgacaggucgaagggc

SEQ ID NO: 2921532 - RNA, 21 nt, Mycobacterium avium subsp. paratuberculosis
caccgacaggucgaagggcau

SEQ ID NO: 2921533 - RNA, 17 nt, Mycobacterium avium subsp. paratuberculosis
caccgacaugucgccgg

SEQ ID NO: 2921534 - RNA, 16 nt, Mycobacterium avium subsp. paratuberculosis
caccgaccagcgggau

SEQ ID NO: 2921535 - RNA, 18 nt, Mycobacterium avium subsp. paratuberculosis
caccgaccccucggcggc

SEQ ID NO: 2921536 - RNA, 22 nt, Mycobacterium avium subsp. paratuberculosis
caccgaccccucggcggccguc

SEQ ID NO: 2921537 - RNA, 14 nt, Mycobacterium avium subsp. paratuberculosis
caccgaccccugca

SEQ ID NO: 2921538 - RNA, 21 nt, Mycobacterium avium subsp. paratuberculosis
caccgacgaccaucagcgccc

SEQ ID NO: 2921539 - RNA, 18 nt, Mycobacterium avium subsp. paratuberculosis
caccgacgaccucggugu

SEQ ID NO: 2921540 - RNA, 15 nt, Mycobacterium avium subsp. paratuberculosis
caccgacgccacguc

SEQ ID NO: 2921541 - RNA, 16 nt, Mycobacterium avium subsp. paratuberculosis
caccgacgccacgucg

SEQ ID NO: 2921542 - RNA, 14 nt, Mycobacterium avium subsp. paratuberculosis
caccgacgccagcg

SEQ ID NO: 2921543 - RNA, 17 nt, Mycobacterium avium subsp. paratuberculosis
caccgacgccagcgggc

SEQ ID NO: 2921544 - RNA, 16 nt, Mycobacterium avium subsp. paratuberculosis
caccgacgcggcgacc

SEQ ID NO: 2921545 - RNA, 17 nt, Mycobacterium avium subsp. paratuberculosis
caccgacgcggcgacca

SEQ ID NO: 2921546 - RNA, 22 nt, Mycobacterium avium subsp. paratuberculosis
caccgacgcggcgaccaccacc

SEQ ID NO: 2921547 - RNA, 14 nt, Mycobacterium avium subsp. paratuberculosis
caccgacgcggcgg

SEQ ID NO: 2921548 - RNA, 18 nt, Mycobacterium avium subsp. paratuberculosis
caccgacgcggcggccga

SEQ ID NO: 2921549 - RNA, 18 nt, Mycobacterium avium subsp. paratuberculosis
caccgacgcgucgcggcg

SEQ ID NO: 2921550 - RNA, 20 nt, Mycobacterium avium subsp. paratuberculosis
caccgacgcgucgcggcggg

SEQ ID NO: 2921551 - RNA, 23 nt, Mycobacterium avium subsp. paratuberculosis
caccgacgcucgccaccccgcgc

SEQ ID NO: 2921552 - RNA, 18 nt, Mycobacterium avium subsp. paratuberculosis
caccgacggagccgagca

SEQ ID NO: 2921553 - RNA, 19 nt, Mycobacterium avium subsp. paratuberculosis
caccgacggagccgagcac

SEQ ID NO: 2921554 - RNA, 21 nt, Mycobacterium avium subsp. paratuberculosis
caccgacggagccgagcacca

SEQ ID NO: 2921555 - RNA, 12 nt, Mycobacterium avium subsp. paratuberculosis
caccgacggccg

SEQ ID NO: 2921556 - RNA, 13 nt, Mycobacterium avium subsp. paratuberculosis
caccgacggccgc

SEQ ID NO: 2921557 - RNA, 14 nt, Mycobacterium avium subsp. paratuberculosis
caccgacggccgca

SEQ ID NO: 2921558 - RNA, 15 nt, Mycobacterium avium subsp. paratuberculosis
caccgacggccgcac

SEQ ID NO: 2921559 - RNA, 16 nt, Mycobacterium avium subsp. paratuberculosis
caccgacggccgcacc

SEQ ID NO: 2921560 - RNA, 19 nt, Mycobacterium avium subsp. paratuberculosis
caccgacggccgcacccca

SEQ ID NO: 2921561 - RNA, 20 nt, Mycobacterium avium subsp. paratuberculosis
caccgacuccuccggcccga

SEQ ID NO: 2921562 - RNA, 16 nt, Mycobacterium avium subsp. paratuberculosis
caccgacugcggcgcu

SEQ ID NO: 2921563 - RNA, 21 nt, Mycobacterium avium subsp. paratuberculosis
caccgacuguuugaugccguc

SEQ ID NO: 2921564 - RNA, 16 nt, Mycobacterium avium subsp. paratuberculosis
caccgacuucauggcg

SEQ ID NO: 2921565 - RNA, 22 nt, Mycobacterium avium subsp. paratuberculosis
caccgagaacagaugccggugc

SEQ ID NO: 2921566 - RNA, 16 nt, Mycobacterium avium subsp. paratuberculosis
caccgagaccaugccg

SEQ ID NO: 2921567 - RNA, 20 nt, Mycobacterium avium subsp. paratuberculosis
caccgagaccaugccgccga

SEQ ID NO: 2921568 - RNA, 21 nt, Mycobacterium avium subsp. paratuberculosis
caccgagaccaugccgccgaa

SEQ ID NO: 2921569 - RNA, 19 nt, Mycobacterium avium subsp. paratuberculosis
caccgagaucaugccggcg

SEQ ID NO: 2921570 - RNA, 21 nt, Mycobacterium avium subsp. paratuberculosis
caccgagaucaugccggcgaa

SEQ ID NO: 2921571 - RNA, 17 nt, Mycobacterium avium subsp. paratuberculosis
caccgagaucucgucga

SEQ ID NO: 2921572 - RNA, 21 nt, Mycobacterium avium subsp. paratuberculosis
caccgagauguaucugcggac

SEQ ID NO: 2921573 - RNA, 22 nt, Mycobacterium avium subsp. paratuberculosis
caccgagauguaucugcggacc

SEQ ID NO: 2921574 - RNA, 23 nt, Mycobacterium avium subsp. paratuberculosis
caccgagcccguucagugaccag

SEQ ID NO: 2921575 - RNA, 14 nt, Mycobacterium avium subsp. paratuberculosis
caccgagccggcgg

SEQ ID NO: 2921576 - RNA, 15 nt, Mycobacterium avium subsp. paratuberculosis
caccgagccggcggc

SEQ ID NO: 2921577 - RNA, 17 nt, Mycobacterium avium subsp. paratuberculosis
caccgagccggcggcgu

SEQ ID NO: 2921578 - RNA, 18 nt, Mycobacterium avium subsp. paratuberculosis
caccgagccggcggcguu

SEQ ID NO: 2921579 - RNA, 15 nt, Mycobacterium avium subsp. paratuberculosis
caccgagccggggcu

SEQ ID NO: 2921580 - RNA, 19 nt, Mycobacterium avium subsp. paratuberculosis
caccgagccggggcugggc

SEQ ID NO: 2921581 - RNA, 20 nt, Mycobacterium avium subsp. paratuberculosis
caccgagccggugccgccca

SEQ ID NO: 2921582 - RNA, 23 nt, Mycobacterium avium subsp. paratuberculosis
caccgagccugggauugccgggc

SEQ ID NO: 2921583 - RNA, 15 nt, Mycobacterium avium subsp. paratuberculosis
caccgagcggccguc

SEQ ID NO: 2921584 - RNA, 17 nt, Mycobacterium avium subsp. paratuberculosis
caccgagcggccgucca

SEQ ID NO: 2921585 - RNA, 23 nt, Mycobacterium avium subsp. paratuberculosis
caccgagcgggguguggcugucg

SEQ ID NO: 2921586 - RNA, 20 nt, Mycobacterium avium subsp. paratuberculosis
caccgagcgucacgcuggcg

SEQ ID NO: 2921587 - RNA, 17 nt, Mycobacterium avium subsp. paratuberculosis
caccgagcucauggugu

SEQ ID NO: 2921588 - RNA, 18 nt, Mycobacterium avium subsp. paratuberculosis
caccgagcugggccggcg

SEQ ID NO: 2921589 - RNA, 17 nt, Mycobacterium avium subsp. paratuberculosis
caccgcgaucgccgacg

SEQ ID NO: 2921590 - RNA, 21 nt, Mycobacterium avium subsp. paratuberculosis
caccgcgaucgccgacgucgg

SEQ ID NO: 2921591 - RNA, 17 nt, Mycobacterium avium subsp. paratuberculosis
caccgcgaucugcucgg

SEQ ID NO: 2921592 - RNA, 19 nt, Mycobacterium avium subsp. paratuberculosis
caccgcgaucugcucggug

SEQ ID NO: 2921593 - RNA, 23 nt, Mycobacterium avium subsp. paratuberculosis
caccgcgaucugcucggugucga

SEQ ID NO: 2921594 - RNA, 16 nt, Mycobacterium avium subsp. paratuberculosis
caccgcgaucuugccc

SEQ ID NO: 2921595 - RNA, 23 nt, Mycobacterium avium subsp. paratuberculosis
caccgcgaucuugcccucguaga

SEQ ID NO: 2921596 - RNA, 16 nt, Mycobacterium avium subsp. paratuberculosis
caccgcgaugauggcg

SEQ ID NO: 2921597 - RNA, 22 nt, Mycobacterium avium subsp. paratuberculosis
caccgcgaugauggcgucgacg

SEQ ID NO: 2921598 - RNA, 20 nt, Mycobacterium avium subsp. paratuberculosis
caccgcgauggcccgcgcga

SEQ ID NO: 2921599 - RNA, 21 nt, Mycobacterium avium subsp. paratuberculosis
caccgcgauggcccgcgcgau

SEQ ID NO: 2921600 - RNA, 19 nt, Mycobacterium avium subsp. paratuberculosis
caccgcgcaaccgggccgc

SEQ ID NO: 2921601 - RNA, 20 nt, Mycobacterium avium subsp. paratuberculosis
caccgcgcaaccgggccgca

SEQ ID NO: 2921602 - RNA, 22 nt, Mycobacterium avium subsp. paratuberculosis
caccgcgcaaccgggccgcacc

SEQ ID NO: 2921603 - RNA, 15 nt, Mycobacterium avium subsp. paratuberculosis
caccgcgcagaaccg

SEQ ID NO: 2921604 - RNA, 20 nt, Mycobacterium avium subsp. paratuberculosis
caccgcgcagaaccgcaccc

SEQ ID NO: 2921605 - RNA, 22 nt, Mycobacterium avium subsp. paratuberculosis
caccgcgcagaaccgcaccccg

SEQ ID NO: 2921606 - RNA, 23 nt, Mycobacterium avium subsp. paratuberculosis
caccgcgcagaaccgcaccccgu

SEQ ID NO: 2921607 - RNA, 14 nt, Mycobacterium avium subsp. paratuberculosis
caccgcgcccagcc

SEQ ID NO: 2921608 - RNA, 21 nt, Mycobacterium avium subsp. paratuberculosis
caccgcgcccagccccagcac

SEQ ID NO: 2921609 - RNA, 17 nt, Mycobacterium avium subsp. paratuberculosis
caccgcgccccggcgca

SEQ ID NO: 2921610 - RNA, 22 nt, Mycobacterium avium subsp. paratuberculosis
caccgcgccccggcgcagcgcc

SEQ ID NO: 2921611 - RNA, 15 nt, Mycobacterium avium subsp. paratuberculosis
caccgcgcccgcccc

SEQ ID NO: 2921612 - RNA, 13 nt, Mycobacterium avium subsp. paratuberculosis
caccgcgccggcg

SEQ ID NO: 2921613 - RNA, 14 nt, Mycobacterium avium subsp. paratuberculosis
caccgcgccggcgg

SEQ ID NO: 2921614 - RNA, 15 nt, Mycobacterium avium subsp. paratuberculosis
caccgcgccggcggc

SEQ ID NO: 2921615 - RNA, 16 nt, Mycobacterium avium subsp. paratuberculosis
caccgcgccggcggcg

SEQ ID NO: 2921616 - RNA, 24 nt, Mycobacterium avium subsp. paratuberculosis
caccgcgccggcggcggcgguccg

SEQ ID NO: 2921617 - RNA, 12 nt, Mycobacterium avium subsp. paratuberculosis
caccgcgccggg

SEQ ID NO: 2921618 - RNA, 15 nt, Mycobacterium avium subsp. paratuberculosis
caccgcgccgggcac

SEQ ID NO: 2921619 - RNA, 16 nt, Mycobacterium avium subsp. paratuberculosis
caccgcgccgggcacc

SEQ ID NO: 2921620 - RNA, 17 nt, Mycobacterium avium subsp. paratuberculosis
caccgcgccgggcacca

SEQ ID NO: 2921621 - RNA, 20 nt, Mycobacterium avium subsp. paratuberculosis
caccgcgccgggcaccacca

SEQ ID NO: 2921622 - RNA, 13 nt, Mycobacterium avium subsp. paratuberculosis
caccgcgccgucg

SEQ ID NO: 2921623 - RNA, 23 nt, Mycobacterium avium subsp. paratuberculosis
caccgcgccgucgucgagcacca

SEQ ID NO: 2921624 - RNA, 14 nt, Mycobacterium avium subsp. paratuberculosis
caccgcgccgucuu

SEQ ID NO: 2921625 - RNA, 21 nt, Mycobacterium avium subsp. paratuberculosis
caccgcgccgugggcgucacg

SEQ ID NO: 2921626 - RNA, 15 nt, Mycobacterium avium subsp. paratuberculosis
caccgcgcgaagucc

SEQ ID NO: 2921627 - RNA, 22 nt, Mycobacterium avium subsp. paratuberculosis
caccgcgcgaagucccacugcc

SEQ ID NO: 2921628 - RNA, 17 nt, Mycobacterium avium subsp. paratuberculosis
caccgcgcgcaccacgu

SEQ ID NO: 2921629 - RNA, 13 nt, Mycobacterium avium subsp. paratuberculosis
caccgcgcgcagg

SEQ ID NO: 2921630 - RNA, 22 nt, Mycobacterium avium subsp. paratuberculosis
caccgcgcgcaggccccggcgc

SEQ ID NO: 2921631 - RNA, 12 nt, Mycobacterium avium subsp. paratuberculosis
caccgcgcgcca

SEQ ID NO: 2921632 - RNA, 13 nt, Mycobacterium avium subsp. paratuberculosis
caccgcgcgcugc

SEQ ID NO: 2921633 - RNA, 15 nt, Mycobacterium avium subsp. paratuberculosis
caccgcgcgcugccg

SEQ ID NO: 2921634 - RNA, 19 nt, Mycobacterium avium subsp. paratuberculosis
caccgcgcgcugccgcgcc

SEQ ID NO: 2921635 - RNA, 20 nt, Mycobacterium avium subsp. paratuberculosis
caccgcgcgcugccgcgccc

SEQ ID NO: 2921636 - RNA, 22 nt, Mycobacterium avium subsp. paratuberculosis
caccgcgcgcugccgcgccccg

SEQ ID NO: 2921637 - RNA, 13 nt, Mycobacterium avium subsp. paratuberculosis
caccgcgcggcca

SEQ ID NO: 2921638 - RNA, 16 nt, Mycobacterium avium subsp. paratuberculosis
caccgcgcggccagcg

SEQ ID NO: 2921639 - RNA, 17 nt, Mycobacterium avium subsp. paratuberculosis
caccgcgcggccagcgg

SEQ ID NO: 2921640 - RNA, 21 nt, Mycobacterium avium subsp. paratuberculosis
caccgcgcggccagcggcgcc

SEQ ID NO: 2921641 - RNA, 22 nt, Mycobacterium avium subsp. paratuberculosis
caccgcgcggccagcggcgccg

SEQ ID NO: 2921642 - RNA, 13 nt, Mycobacterium avium subsp. paratuberculosis
caccgcgcggcgc

SEQ ID NO: 2921643 - RNA, 19 nt, Mycobacterium avium subsp. paratuberculosis
caccgcgcggcgcaguucg

SEQ ID NO: 2921644 - RNA, 15 nt, Mycobacterium avium subsp. paratuberculosis
caccgcgcggcggug

SEQ ID NO: 2921645 - RNA, 21 nt, Mycobacterium avium subsp. paratuberculosis
caccgcgcggcggugcucgcg

SEQ ID NO: 2921646 - RNA, 14 nt, Mycobacterium avium subsp. paratuberculosis
caccgcgcggugca

SEQ ID NO: 2921647 - RNA, 14 nt, Mycobacterium avium subsp. paratuberculosis
caccgcgcuccugc

SEQ ID NO: 2921648 - RNA, 15 nt, Mycobacterium avium subsp. paratuberculosis
caccgcgcuccugcc

SEQ ID NO: 2921649 - RNA, 14 nt, Mycobacterium avium subsp. paratuberculosis
caccgcgcucggcg

SEQ ID NO: 2921650 - RNA, 15 nt, Mycobacterium avium subsp. paratuberculosis
caccgcgcucggcga

SEQ ID NO: 2921651 - RNA, 16 nt, Mycobacterium avium subsp. paratuberculosis
caccgcgcucggcgac

SEQ ID NO: 2921652 - RNA, 18 nt, Mycobacterium avium subsp. paratuberculosis
caccgcgcucggcgacga

SEQ ID NO: 2921653 - RNA, 17 nt, Mycobacterium avium subsp. paratuberculosis
caccgcgcugcgcgcgu

SEQ ID NO: 2921654 - RNA, 17 nt, Mycobacterium avium subsp. paratuberculosis
caccgcgcuugccgcga

SEQ ID NO: 2921655 - RNA, 14 nt, Mycobacterium avium subsp. paratuberculosis
caccgcggaccacc

SEQ ID NO: 2921656 - RNA, 20 nt, Mycobacterium avium subsp. paratuberculosis
caccgcggaccaccgcgugc

SEQ ID NO: 2921657 - RNA, 20 nt, Mycobacterium avium subsp. paratuberculosis
caccgcggauuccagcgcgu

SEQ ID NO: 2921658 - RNA, 21 nt, Mycobacterium avium subsp. paratuberculosis
caccgcggccaacccgggcgc

SEQ ID NO: 2921659 - RNA, 14 nt, Mycobacterium avium subsp. paratuberculosis
caccgcggccacca

SEQ ID NO: 2921660 - RNA, 20 nt, Mycobacterium avium subsp. paratuberculosis
caccgcggccaccaccgcca

SEQ ID NO: 2921661 - RNA, 16 nt, Mycobacterium avium subsp. paratuberculosis
caccgcggccaccugg

SEQ ID NO: 2921662 - RNA, 17 nt, Mycobacterium avium subsp. paratuberculosis
caccgcggccaccuggg

SEQ ID NO: 2921663 - RNA, 16 nt, Mycobacterium avium subsp. paratuberculosis
caccgcggccagcgcg

SEQ ID NO: 2921664 - RNA, 21 nt, Mycobacterium avium subsp. paratuberculosis
caccgcggccagcgcgcgggc

SEQ ID NO: 2921665 - RNA, 14 nt, Mycobacterium avium subsp. paratuberculosis
caccgcggccagcu

SEQ ID NO: 2921666 - RNA, 18 nt, Mycobacterium avium subsp. paratuberculosis
caccgcggccagcugcga

SEQ ID NO: 2921667 - RNA, 19 nt, Mycobacterium avium subsp. paratuberculosis
caccgcggccagcugcgac

SEQ ID NO: 2921668 - RNA, 23 nt, Mycobacterium avium subsp. paratuberculosis
caccgcggccagcugcgacagca

SEQ ID NO: 2921669 - RNA, 15 nt, Mycobacterium avium subsp. paratuberculosis
caccgcggccucggc

SEQ ID NO: 2921670 - RNA, 20 nt, Mycobacterium avium subsp. paratuberculosis
caccgcggcgacgucgugca

SEQ ID NO: 2921671 - RNA, 14 nt, Mycobacterium avium subsp. paratuberculosis
caccgcggcgaucg

SEQ ID NO: 2921672 - RNA, 13 nt, Mycobacterium avium subsp. paratuberculosis
caccgcggcgaug

SEQ ID NO: 2921673 - RNA, 12 nt, Mycobacterium avium subsp. paratuberculosis
caccgcugucgg

SEQ ID NO: 2921674 - RNA, 17 nt, Mycobacterium avium subsp. paratuberculosis
caccgcugucgguguga

SEQ ID NO: 2921675 - RNA, 17 nt, Mycobacterium avium subsp. paratuberculosis
caccgcuguggacaggu

SEQ ID NO: 2921676 - RNA, 19 nt, Mycobacterium avium subsp. paratuberculosis
caccgcuguggacaggucg

SEQ ID NO: 2921677 - RNA, 21 nt, Mycobacterium avium subsp. paratuberculosis
caccgcuguggacaggucgau

SEQ ID NO: 2921678 - RNA, 19 nt, Mycobacterium avium subsp. paratuberculosis
caccgcuuugugaggcgcg

SEQ ID NO: 2921679 - RNA, 21 nt, Mycobacterium avium subsp. paratuberculosis
caccgcuuugugaggcgcgcc

SEQ ID NO: 2921680 - RNA, 22 nt, Mycobacterium avium subsp. paratuberculosis
caccgcuuugugaggcgcgccg

SEQ ID NO: 2921681 - RNA, 14 nt, Mycobacterium avium subsp. paratuberculosis
caccggaccgccga

SEQ ID NO: 2921682 - RNA, 15 nt, Mycobacterium avium subsp. paratuberculosis
caccggaccgccgag

SEQ ID NO: 2921683 - RNA, 20 nt, Mycobacterium avium subsp. paratuberculosis
caccggaccggccagcagcc

SEQ ID NO: 2921684 - RNA, 23 nt, Mycobacterium avium subsp. paratuberculosis
caccggaccggccagcagccgcu

SEQ ID NO: 2921685 - RNA, 21 nt, Mycobacterium avium subsp. paratuberculosis
caccggacgcagcgaucggcg

SEQ ID NO: 2921686 - RNA, 23 nt, Mycobacterium avium subsp. paratuberculosis
caccggacgcagcgaucggcggc

SEQ ID NO: 2921687 - RNA, 22 nt, Mycobacterium avium subsp. paratuberculosis
caccggagccuuggucgcggcc

SEQ ID NO: 2921688 - RNA, 14 nt, Mycobacterium avium subsp. paratuberculosis
caccggagcggcgg

SEQ ID NO: 2921689 - RNA, 13 nt, Mycobacterium avium subsp. paratuberculosis
caccggaucggcu

SEQ ID NO: 2921690 - RNA, 17 nt, Mycobacterium avium subsp. paratuberculosis
caccggaugcaccggca

SEQ ID NO: 2921691 - RNA, 15 nt, Mycobacterium avium subsp. paratuberculosis
caccggaugcucacc

SEQ ID NO: 2921692 - RNA, 21 nt, Mycobacterium avium subsp. paratuberculosis
caccggaugcucaccggucag

SEQ ID NO: 2921693 - RNA, 16 nt, Mycobacterium avium subsp. paratuberculosis
caccggauggcgcccg

SEQ ID NO: 2921694 - RNA, 23 nt, Mycobacterium avium subsp. paratuberculosis
caccggauggcgcccggcagccg

SEQ ID NO: 2921695 - RNA, 20 nt, Mycobacterium avium subsp. paratuberculosis
caccggauucggcuccugcc

SEQ ID NO: 2921696 - RNA, 20 nt, Mycobacterium avium subsp. paratuberculosis
caccggauuucgccagugcc

SEQ ID NO: 2921697 - RNA, 17 nt, Mycobacterium avium subsp. paratuberculosis
caccggcaaccgccacg

SEQ ID NO: 2921698 - RNA, 21 nt, Mycobacterium avium subsp. paratuberculosis
caccggcaaccgccacgacgc

SEQ ID NO: 2921699 - RNA, 18 nt, Mycobacterium avium subsp. paratuberculosis
caccggcaaggugccguc

SEQ ID NO: 2921700 - RNA, 16 nt, Mycobacterium avium subsp. paratuberculosis
caccggcaaucgggac

SEQ ID NO: 2921701 - RNA, 17 nt, Mycobacterium avium subsp. paratuberculosis
caccggcaaucgggacg

SEQ ID NO: 2921702 - RNA, 21 nt, Mycobacterium avium subsp. paratuberculosis
caccggcaaucgggacgccac

SEQ ID NO: 2921703 - RNA, 22 nt, Mycobacterium avium subsp. paratuberculosis
caccggcaaucgggacgccacg

SEQ ID NO: 2921704 - RNA, 14 nt, Mycobacterium avium subsp. paratuberculosis
caccggcaccacga

SEQ ID NO: 2921705 - RNA, 16 nt, Mycobacterium avium subsp. paratuberculosis
caccggcaccgccagc

SEQ ID NO: 2921706 - RNA, 18 nt, Mycobacterium avium subsp. paratuberculosis
caccggcaccgccagcca

SEQ ID NO: 2921707 - RNA, 14 nt, Mycobacterium avium subsp. paratuberculosis
caccggcaccgccc

SEQ ID NO: 2921708 - RNA, 16 nt, Mycobacterium avium subsp. paratuberculosis
caccggcaccgccccc

SEQ ID NO: 2921709 - RNA, 13 nt, Mycobacterium avium subsp. paratuberculosis
caccggcaccgcg

SEQ ID NO: 2921710 - RNA, 14 nt, Mycobacterium avium subsp. paratuberculosis
caccggcaccgcgg

SEQ ID NO: 2921711 - RNA, 17 nt, Mycobacterium avium subsp. paratuberculosis
caccggcaccgcggcga

SEQ ID NO: 2921712 - RNA, 19 nt, Mycobacterium avium subsp. paratuberculosis
caccggcaccgcggcgaug

SEQ ID NO: 2921713 - RNA, 17 nt, Mycobacterium avium subsp. paratuberculosis
caccggcacgaucgucg

SEQ ID NO: 2921714 - RNA, 16 nt, Mycobacterium avium subsp. paratuberculosis
caccggcacggcaccg

SEQ ID NO: 2921715 - RNA, 18 nt, Mycobacterium avium subsp. paratuberculosis
caccggcacggcaccgcg

SEQ ID NO: 2921716 - RNA, 19 nt, Mycobacterium avium subsp. paratuberculosis
caccggcacggcaccgcga

SEQ ID NO: 2921717 - RNA, 13 nt, Mycobacterium avium subsp. paratuberculosis
caccggcacgucg

SEQ ID NO: 2921718 - RNA, 17 nt, Mycobacterium avium subsp. paratuberculosis
caccggcacgucgagcu

SEQ ID NO: 2921719 - RNA, 19 nt, Mycobacterium avium subsp. paratuberculosis
caccggcacgucggccacg

SEQ ID NO: 2921720 - RNA, 20 nt, Mycobacterium avium subsp. paratuberculosis
caccggcacgucggccacgc

SEQ ID NO: 2921721 - RNA, 17 nt, Mycobacterium avium subsp. paratuberculosis
caccggcacgugcgggu

SEQ ID NO: 2921722 - RNA, 14 nt, Mycobacterium avium subsp. paratuberculosis
caccggcagcaccg

SEQ ID NO: 2921723 - RNA, 16 nt, Mycobacterium avium subsp. paratuberculosis
caccggcagcaccgcc

SEQ ID NO: 2921724 - RNA, 17 nt, Mycobacterium avium subsp. paratuberculosis
caccggcagcaccgccg

SEQ ID NO: 2921725 - RNA, 19 nt, Mycobacterium avium subsp. paratuberculosis
caccggcagcaccgccgag

SEQ ID NO: 2921726 - RNA, 21 nt, Mycobacterium avium subsp. paratuberculosis
caccggcagcaccgccgagcc

SEQ ID NO: 2921727 - RNA, 17 nt, Mycobacterium avium subsp. paratuberculosis
caccggcagcagcgcgu

SEQ ID NO: 2921728 - RNA, 15 nt, Mycobacterium avium subsp. paratuberculosis
caccggcagccagau

SEQ ID NO: 2921729 - RNA, 16 nt, Mycobacterium avium subsp. paratuberculosis
caccggcagccagaug

SEQ ID NO: 2921730 - RNA, 17 nt, Mycobacterium avium subsp. paratuberculosis
caccggcagccgcagcg

SEQ ID NO: 2921731 - RNA, 14 nt, Mycobacterium avium subsp. paratuberculosis
caccggcagcgcca

SEQ ID NO: 2921732 - RNA, 18 nt, Mycobacterium avium subsp. paratuberculosis
caccggcagugaucggcg

SEQ ID NO: 2921733 - RNA, 17 nt, Mycobacterium avium subsp. paratuberculosis
caccggcaucgguggca

SEQ ID NO: 2921734 - RNA, 22 nt, Mycobacterium avium subsp. paratuberculosis
caccggcauucguguggcgcac

SEQ ID NO: 2921735 - RNA, 18 nt, Mycobacterium avium subsp. paratuberculosis
caccggccagggccgccg

SEQ ID NO: 2921736 - RNA, 19 nt, Mycobacterium avium subsp. paratuberculosis
caccggccagggccgccgc

SEQ ID NO: 2921737 - RNA, 23 nt, Mycobacterium avium subsp. paratuberculosis
caccggccagggccgccgcauac

SEQ ID NO: 2921738 - RNA, 18 nt, Mycobacterium avium subsp. paratuberculosis
caccggccauccgcugcg

SEQ ID NO: 2921739 - RNA, 14 nt, Mycobacterium avium subsp. paratuberculosis
caccggcccagccg

SEQ ID NO: 2921740 - RNA, 17 nt, Mycobacterium avium subsp. paratuberculosis
caccggcccagccggcg

SEQ ID NO: 2921741 - RNA, 21 nt, Mycobacterium avium subsp. paratuberculosis
caccggcccagccggcggugc

SEQ ID NO: 2921742 - RNA, 22 nt, Mycobacterium avium subsp. paratuberculosis
caccggcccagccggcggugca

SEQ ID NO: 2921743 - RNA, 14 nt, Mycobacterium avium subsp. paratuberculosis
caccggcccggccg

SEQ ID NO: 2921744 - RNA, 15 nt, Mycobacterium avium subsp. paratuberculosis
caccggcccggccgg

SEQ ID NO: 2921745 - RNA, 16 nt, Mycobacterium avium subsp. paratuberculosis
caccggcccggccggc

SEQ ID NO: 2921746 - RNA, 18 nt, Mycobacterium avium subsp. paratuberculosis
caccggcccggccggcgc

SEQ ID NO: 2921747 - RNA, 19 nt, Mycobacterium avium subsp. paratuberculosis
caccggcccggccggcgcg

SEQ ID NO: 2921748 - RNA, 20 nt, Mycobacterium avium subsp. paratuberculosis
caccggcccggccggcgcga

SEQ ID NO: 2921749 - RNA, 23 nt, Mycobacterium avium subsp. paratuberculosis
caccggcccggccggcgcgacca

SEQ ID NO: 2921750 - RNA, 14 nt, Mycobacterium avium subsp. paratuberculosis
caccggcccggcgg

SEQ ID NO: 2921751 - RNA, 13 nt, Mycobacterium avium subsp. paratuberculosis
caccggccgaccg

SEQ ID NO: 2921752 - RNA, 13 nt, Mycobacterium avium subsp. paratuberculosis
caccggccgagcc

SEQ ID NO: 2921753 - RNA, 18 nt, Mycobacterium avium subsp. paratuberculosis
caccggccgagccgaugc

SEQ ID NO: 2921754 - RNA, 18 nt, Mycobacterium avium subsp. paratuberculosis
caccggccgauggcccag

SEQ ID NO: 2921755 - RNA, 13 nt, Mycobacterium avium subsp. paratuberculosis
caccggccgcgcg

SEQ ID NO: 2921756 - RNA, 15 nt, Mycobacterium avium subsp. paratuberculosis
caccggccggccccg

SEQ ID NO: 2921757 - RNA, 19 nt, Mycobacterium avium subsp. paratuberculosis
caccgggcccagcucggug

SEQ ID NO: 2921758 - RNA, 20 nt, Mycobacterium avium subsp. paratuberculosis
caccgggcccagcucgguga

SEQ ID NO: 2921759 - RNA, 15 nt, Mycobacterium avium subsp. paratuberculosis
caccgggcccgcccg

SEQ ID NO: 2921760 - RNA, 19 nt, Mycobacterium avium subsp. paratuberculosis
caccgggccgaaggcggcg

SEQ ID NO: 2921761 - RNA, 20 nt, Mycobacterium avium subsp. paratuberculosis
caccgggccgaaggcggcgc

SEQ ID NO: 2921762 - RNA, 13 nt, Mycobacterium avium subsp. paratuberculosis
caccgggccgagg

SEQ ID NO: 2921763 - RNA, 12 nt, Mycobacterium avium subsp. paratuberculosis
caccgggcgucg

SEQ ID NO: 2921764 - RNA, 16 nt, Mycobacterium avium subsp. paratuberculosis
caccgggcgucggcgg

SEQ ID NO: 2921765 - RNA, 14 nt, Mycobacterium avium subsp. paratuberculosis
caccgggcgucggg

SEQ ID NO: 2921766 - RNA, 16 nt, Mycobacterium avium subsp. paratuberculosis
caccgggcgucggggc

SEQ ID NO: 2921767 - RNA, 22 nt, Mycobacterium avium subsp. paratuberculosis
caccgggcguggcuugaucgca

SEQ ID NO: 2921768 - RNA, 14 nt, Mycobacterium avium subsp. paratuberculosis
caccgggcugucgg

SEQ ID NO: 2921769 - RNA, 14 nt, Mycobacterium avium subsp. paratuberculosis
caccggggccaggu

SEQ ID NO: 2921770 - RNA, 16 nt, Mycobacterium avium subsp. paratuberculosis
caccggggccggcggg

SEQ ID NO: 2921771 - RNA, 18 nt, Mycobacterium avium subsp. paratuberculosis
caccggggccggcggggg

SEQ ID NO: 2921772 - RNA, 17 nt, Mycobacterium avium subsp. paratuberculosis
caccggggucaccuugg

SEQ ID NO: 2921773 - RNA, 13 nt, Mycobacterium avium subsp. paratuberculosis
caccggggucugc

SEQ ID NO: 2921774 - RNA, 13 nt, Mycobacterium avium subsp. paratuberculosis
caccggggugccg

SEQ ID NO: 2921775 - RNA, 18 nt, Mycobacterium avium subsp. paratuberculosis
caccggguacaccggcuc

SEQ ID NO: 2921776 - RNA, 19 nt, Mycobacterium avium subsp. paratuberculosis
caccggguacaccggcucg

SEQ ID NO: 2921777 - RNA, 12 nt, Mycobacterium avium subsp. paratuberculosis
caccgggucccc

SEQ ID NO: 2921778 - RNA, 21 nt, Mycobacterium avium subsp. paratuberculosis
caccgggucccccgccgaccg

SEQ ID NO: 2921779 - RNA, 23 nt, Mycobacterium avium subsp. paratuberculosis
caccgggucccccgccgaccggu

SEQ ID NO: 2921780 - RNA, 14 nt, Mycobacterium avium subsp. paratuberculosis
caccgggucguccg

SEQ ID NO: 2921781 - RNA, 14 nt, Mycobacterium avium subsp. paratuberculosis
caccgggucgucgc

SEQ ID NO: 2921782 - RNA, 19 nt, Mycobacterium avium subsp. paratuberculosis
caccgggucgucgcggaac

SEQ ID NO: 2921783 - RNA, 21 nt, Mycobacterium avium subsp. paratuberculosis
caccgggucgucgcggaaccg

SEQ ID NO: 2921784 - RNA, 20 nt, Mycobacterium avium subsp. paratuberculosis
caccgggugauaccggccca

SEQ ID NO: 2921785 - RNA, 22 nt, Mycobacterium avium subsp. paratuberculosis
caccgggugauaccggcccagc

SEQ ID NO: 2921786 - RNA, 18 nt, Mycobacterium avium subsp. paratuberculosis
caccgggugaugucgccg

SEQ ID NO: 2921787 - RNA, 19 nt, Mycobacterium avium subsp. paratuberculosis
caccgggugaugucgccga

SEQ ID NO: 2921788 - RNA, 21 nt, Mycobacterium avium subsp. paratuberculosis
caccgggugaugucgccgacc

SEQ ID NO: 2921789 - RNA, 16 nt, Mycobacterium avium subsp. paratuberculosis
caccgggugcguccag

SEQ ID NO: 2921790 - RNA, 23 nt, Mycobacterium avium subsp. paratuberculosis
caccgggugcguccagaccggcc

SEQ ID NO: 2921791 - RNA, 17 nt, Mycobacterium avium subsp. paratuberculosis
caccgggugggccgacc

SEQ ID NO: 2921792 - RNA, 17 nt, Mycobacterium avium subsp. paratuberculosis
caccggucagcuggugc

SEQ ID NO: 2921793 - RNA, 15 nt, Mycobacterium avium subsp. paratuberculosis
caccggucgacgacg

SEQ ID NO: 2921794 - RNA, 16 nt, Mycobacterium avium subsp. paratuberculosis
caccggucggugccca

SEQ ID NO: 2921795 - RNA, 14 nt, Mycobacterium avium subsp. paratuberculosis
caccggucuccggc

SEQ ID NO: 2921796 - RNA, 18 nt, Mycobacterium avium subsp. paratuberculosis
caccggugaacgggucaa

SEQ ID NO: 2921797 - RNA, 17 nt, Mycobacterium avium subsp. paratuberculosis
caccggugacgaccggc

SEQ ID NO: 2921798 - RNA, 18 nt, Mycobacterium avium subsp. paratuberculosis
caccggugacgaccggca

SEQ ID NO: 2921799 - RNA, 19 nt, Mycobacterium avium subsp. paratuberculosis
caccggugcaccgcgcgca

SEQ ID NO: 2921800 - RNA, 13 nt, Mycobacterium avium subsp. paratuberculosis
caccggugcggcg

SEQ ID NO: 2921801 - RNA, 19 nt, Mycobacterium avium subsp. paratuberculosis
caccggugcggcggugacg

SEQ ID NO: 2921802 - RNA, 16 nt, Mycobacterium avium subsp. paratuberculosis
caccggugcucuccug

SEQ ID NO: 2921803 - RNA, 20 nt, Mycobacterium avium subsp. paratuberculosis
caccggugcucuccugcuug

SEQ ID NO: 2921804 - RNA, 21 nt, Mycobacterium avium subsp. paratuberculosis
caccggugcucuccugcuuga

SEQ ID NO: 2921805 - RNA, 22 nt, Mycobacterium avium subsp. paratuberculosis
caccggugcucuccugcuugac

SEQ ID NO: 2921806 - RNA, 23 nt, Mycobacterium avium subsp. paratuberculosis
caccggugcucuccugcuugacc

SEQ ID NO: 2921807 - RNA, 16 nt, Mycobacterium avium subsp. paratuberculosis
caccgguggccgcguc

SEQ ID NO: 2921808 - RNA, 23 nt, Mycobacterium avium subsp. paratuberculosis
caccgguggccgcgucgaccagc

SEQ ID NO: 2921809 - RNA, 14 nt, Mycobacterium avium subsp. paratuberculosis
caccgguggccggg

SEQ ID NO: 2921810 - RNA, 23 nt, Mycobacterium avium subsp. paratuberculosis
caccgguggcguugcgggcgaac

SEQ ID NO: 2921811 - RNA, 23 nt, Mycobacterium avium subsp. paratuberculosis
caccgguggugagacccuggaug

SEQ ID NO: 2921812 - RNA, 17 nt, Mycobacterium avium subsp. paratuberculosis
caccggugucacgcugg

SEQ ID NO: 2921813 - RNA, 16 nt, Mycobacterium avium subsp. paratuberculosis
caccgguuugucggcg

SEQ ID NO: 2921814 - RNA, 17 nt, Mycobacterium avium subsp. paratuberculosis
caccgguuugucggcgc

SEQ ID NO: 2921815 - RNA, 18 nt, Mycobacterium avium subsp. paratuberculosis
caccgguuugucggcgcc

SEQ ID NO: 2921816 - RNA, 13 nt, Mycobacterium avium subsp. paratuberculosis
caccgucaccgac

SEQ ID NO: 2921817 - RNA, 15 nt, Mycobacterium avium subsp. paratuberculosis
caccgucaccgccuc

SEQ ID NO: 2921818 - RNA, 15 nt, Mycobacterium avium subsp. paratuberculosis
caccgucagccaggu

SEQ ID NO: 2921819 - RNA, 17 nt, Mycobacterium avium subsp. paratuberculosis
caccgucagcgucagca

SEQ ID NO: 2921820 - RNA, 23 nt, Mycobacterium avium subsp. paratuberculosis
caccgucaggguggugcccccgc

SEQ ID NO: 2921821 - RNA, 15 nt, Mycobacterium avium subsp. paratuberculosis
caccgucaucgcggc

SEQ ID NO: 2921822 - RNA, 21 nt, Mycobacterium avium subsp. paratuberculosis
caccgucaucgugugggcgcc

SEQ ID NO: 2921823 - RNA, 22 nt, Mycobacterium avium subsp. paratuberculosis
caccgucaucgugugggcgccc

SEQ ID NO: 2921824 - RNA, 21 nt, Mycobacterium avium subsp. paratuberculosis
caccgucaucucggugguggc

SEQ ID NO: 2921825 - RNA, 14 nt, Mycobacterium avium subsp. paratuberculosis
caccguccacagcc

SEQ ID NO: 2921826 - RNA, 18 nt, Mycobacterium avium subsp. paratuberculosis
caccguccacagccggcg

SEQ ID NO: 2921827 - RNA, 20 nt, Mycobacterium avium subsp. paratuberculosis
caccguccacagccggcggc

SEQ ID NO: 2921828 - RNA, 14 nt, Mycobacterium avium subsp. paratuberculosis
caccguccagcuca

SEQ ID NO: 2921829 - RNA, 15 nt, Mycobacterium avium subsp. paratuberculosis
caccguccuuguagg

SEQ ID NO: 2921830 - RNA, 18 nt, Mycobacterium avium subsp. paratuberculosis
caccgucgaagagugcga

SEQ ID NO: 2921831 - RNA, 14 nt, Mycobacterium avium subsp. paratuberculosis
caccgucgacgacg

SEQ ID NO: 2921832 - RNA, 15 nt, Mycobacterium avium subsp. paratuberculosis
caccgucgacgacga

SEQ ID NO: 2921833 - RNA, 22 nt, Mycobacterium avium subsp. paratuberculosis
caccgucgacgacgaaucccgc

SEQ ID NO: 2921834 - RNA, 20 nt, Mycobacterium avium subsp. paratuberculosis
caccgucgauggacagggcg

SEQ ID NO: 2921835 - RNA, 16 nt, Mycobacterium avium subsp. paratuberculosis
caccgucgccggcggg

SEQ ID NO: 2921836 - RNA, 15 nt, Mycobacterium avium subsp. paratuberculosis
caccgucgccggcug

SEQ ID NO: 2921837 - RNA, 22 nt, Mycobacterium avium subsp. paratuberculosis
caccgucgccggcugacugccg

SEQ ID NO: 2921838 - RNA, 13 nt, Mycobacterium avium subsp. paratuberculosis
caccgucgccgug

SEQ ID NO: 2921839 - RNA, 14 nt, Mycobacterium avium subsp. paratuberculosis
caccgucgccguga

SEQ ID NO: 2921840 - RNA, 20 nt, Mycobacterium avium subsp. paratuberculosis
caccgucgcgcacccagacg

SEQ ID NO: 2921841 - RNA, 15 nt, Mycobacterium avium subsp. paratuberculosis
caccgucggcgaucg

SEQ ID NO: 2921842 - RNA, 16 nt, Mycobacterium avium subsp. paratuberculosis
caccucgaacuugacc

SEQ ID NO: 2921843 - RNA, 22 nt, Mycobacterium avium subsp. paratuberculosis
caccucgaacuugaccgggcuc

SEQ ID NO: 2921844 - RNA, 24 nt, Mycobacterium avium subsp. paratuberculosis
caccucgaacuugaccgggcucca

SEQ ID NO: 2921845 - RNA, 18 nt, Mycobacterium avium subsp. paratuberculosis
caccucgaagccgacguc

SEQ ID NO: 2921846 - RNA, 19 nt, Mycobacterium avium subsp. paratuberculosis
caccucgaagccgacgucc

SEQ ID NO: 2921847 - RNA, 16 nt, Mycobacterium avium subsp. paratuberculosis
caccucgaagccgauc

SEQ ID NO: 2921848 - RNA, 17 nt, Mycobacterium avium subsp. paratuberculosis
caccucgaagccgaucg

SEQ ID NO: 2921849 - RNA, 17 nt, Mycobacterium avium subsp. paratuberculosis
caccucgaagggcgcca

SEQ ID NO: 2921850 - RNA, 22 nt, Mycobacterium avium subsp. paratuberculosis
caccucgaaguucuccucgccg

SEQ ID NO: 2921851 - RNA, 16 nt, Mycobacterium avium subsp. paratuberculosis
caccucgaccagaucc

SEQ ID NO: 2921852 - RNA, 19 nt, Mycobacterium avium subsp. paratuberculosis
caccucgaccgugaggccc

SEQ ID NO: 2921853 - RNA, 14 nt, Mycobacterium avium subsp. paratuberculosis
caccucgacggcgu

SEQ ID NO: 2921854 - RNA, 15 nt, Mycobacterium avium subsp. paratuberculosis
caccucgacggcgug

SEQ ID NO: 2921855 - RNA, 15 nt, Mycobacterium avium subsp. paratuberculosis
caccucgagcaaccg

SEQ ID NO: 2921856 - RNA, 16 nt, Mycobacterium avium subsp. paratuberculosis
caccucgagcaaccgc

SEQ ID NO: 2921857 - RNA, 15 nt, Mycobacterium avium subsp. paratuberculosis
caccucgagcacgcc

SEQ ID NO: 2921858 - RNA, 17 nt, Mycobacterium avium subsp. paratuberculosis
caccucgagcacgcccu

SEQ ID NO: 2921859 - RNA, 20 nt, Mycobacterium avium subsp. paratuberculosis
caccucgagcacucgcggga

SEQ ID NO: 2921860 - RNA, 13 nt, Mycobacterium avium subsp. paratuberculosis
caccucgagcuca

SEQ ID NO: 2921861 - RNA, 12 nt, Mycobacterium avium subsp. paratuberculosis
caccucgaggaa

SEQ ID NO: 2921862 - RNA, 14 nt, Mycobacterium avium subsp. paratuberculosis
caccucgaggaacu

SEQ ID NO: 2921863 - RNA, 17 nt, Mycobacterium avium subsp. paratuberculosis
caccucgaucagcggca

SEQ ID NO: 2921864 - RNA, 23 nt, Mycobacterium avium subsp. paratuberculosis
caccucgaugaccuucugaucgg

SEQ ID NO: 2921865 - RNA, 17 nt, Mycobacterium avium subsp. paratuberculosis
caccucgaugccgugcc

SEQ ID NO: 2921866 - RNA, 18 nt, Mycobacterium avium subsp. paratuberculosis
caccucgauggccgggaa

SEQ ID NO: 2921867 - RNA, 14 nt, Mycobacterium avium subsp. paratuberculosis
caccucgauggguu

SEQ ID NO: 2921868 - RNA, 15 nt, Mycobacterium avium subsp. paratuberculosis
caccucgcccggcuc

SEQ ID NO: 2921869 - RNA, 18 nt, Mycobacterium avium subsp. paratuberculosis
caccucgccgaucucgac

SEQ ID NO: 2921870 - RNA, 22 nt, Mycobacterium avium subsp. paratuberculosis
caccucgccgaucucgaccagc

SEQ ID NO: 2921871 - RNA, 15 nt, Mycobacterium avium subsp. paratuberculosis
caccucgccgcaggc

SEQ ID NO: 2921872 - RNA, 14 nt, Mycobacterium avium subsp. paratuberculosis
caccucgccggccg

SEQ ID NO: 2921873 - RNA, 16 nt, Mycobacterium avium subsp. paratuberculosis
caccucgccggccgcc

SEQ ID NO: 2921874 - RNA, 18 nt, Mycobacterium avium subsp. paratuberculosis
caccucgccggccgggcg

SEQ ID NO: 2921875 - RNA, 14 nt, Mycobacterium avium subsp. paratuberculosis
caccucgccguccu

SEQ ID NO: 2921876 - RNA, 14 nt, Mycobacterium avium subsp. paratuberculosis
caccucgccuccag

SEQ ID NO: 2921877 - RNA, 14 nt, Mycobacterium avium subsp. paratuberculosis
caccucgcgcagca

SEQ ID NO: 2921878 - RNA, 22 nt, Mycobacterium avium subsp. paratuberculosis
caccucgcgcucuugggcggcc

SEQ ID NO: 2921879 - RNA, 14 nt, Mycobacterium avium subsp. paratuberculosis
caccucgcggcagc

SEQ ID NO: 2921880 - RNA, 15 nt, Mycobacterium avium subsp. paratuberculosis
caccucgcggcagcc

SEQ ID NO: 2921881 - RNA, 17 nt, Mycobacterium avium subsp. paratuberculosis
caccucgcuacgcgagc

SEQ ID NO: 2921882 - RNA, 20 nt, Mycobacterium avium subsp. paratuberculosis
caccucgcuacgcgagcugc

SEQ ID NO: 2921883 - RNA, 21 nt, Mycobacterium avium subsp. paratuberculosis
caccucgcuacgcgagcugcu

SEQ ID NO: 2921884 - RNA, 23 nt, Mycobacterium avium subsp. paratuberculosis
caccucgcuacgcgagcugcuuc

SEQ ID NO: 2921885 - RNA, 16 nt, Mycobacterium avium subsp. paratuberculosis
caccucgcucagcccg

SEQ ID NO: 2921886 - RNA, 17 nt, Mycobacterium avium subsp. paratuberculosis
caccucgcucagcccgg

SEQ ID NO: 2921887 - RNA, 15 nt, Mycobacterium avium subsp. paratuberculosis
caccucgcugcgcga

SEQ ID NO: 2921888 - RNA, 16 nt, Mycobacterium avium subsp. paratuberculosis
caccucgcuggaaacc

SEQ ID NO: 2921889 - RNA, 19 nt, Mycobacterium avium subsp. paratuberculosis
caccucggccagcgccgcg

SEQ ID NO: 2921890 - RNA, 22 nt, Mycobacterium avium subsp. paratuberculosis
caccucggccagcgccgcgcgc

SEQ ID NO: 2921891 - RNA, 14 nt, Mycobacterium avium subsp. paratuberculosis
caccucggccaggu

SEQ ID NO: 2921892 - RNA, 22 nt, Mycobacterium avium subsp. paratuberculosis
caccucggccuugccgcuguga

SEQ ID NO: 2921893 - RNA, 22 nt, Mycobacterium avium subsp. paratuberculosis
caccucggcgaccucggggaug

SEQ ID NO: 2921894 - RNA, 13 nt, Mycobacterium avium subsp. paratuberculosis
caccucggcgacg

SEQ ID NO: 2921895 - RNA, 23 nt, Mycobacterium avium subsp. paratuberculosis
caccucggcgacgauggccaggc

SEQ ID NO: 2921896 - RNA, 15 nt, Mycobacterium avium subsp. paratuberculosis
caccucggcgacguc

SEQ ID NO: 2921897 - RNA, 16 nt, Mycobacterium avium subsp. paratuberculosis
caccucggcgacgucc

SEQ ID NO: 2921898 - RNA, 13 nt, Mycobacterium avium subsp. paratuberculosis
caccucggcgauc

SEQ ID NO: 2921899 - RNA, 18 nt, Mycobacterium avium subsp. paratuberculosis
caccucggcggcaccgcc

SEQ ID NO: 2921900 - RNA, 20 nt, Mycobacterium avium subsp. paratuberculosis
caccucggcggcaccgcccg

SEQ ID NO: 2921901 - RNA, 16 nt, Mycobacterium avium subsp. paratuberculosis
caccucggcgucggcg

SEQ ID NO: 2921902 - RNA, 18 nt, Mycobacterium avium subsp. paratuberculosis
caccucggcgucggcgcg

SEQ ID NO: 2921903 - RNA, 19 nt, Mycobacterium avium subsp. paratuberculosis
caccucggcgucggcgcgu

SEQ ID NO: 2921904 - RNA, 23 nt, Mycobacterium avium subsp. paratuberculosis
caccucggcgucggcgcgugcca

SEQ ID NO: 2921905 - RNA, 21 nt, Mycobacterium avium subsp. paratuberculosis
caccucgggauagccgagcgg

SEQ ID NO: 2921906 - RNA, 16 nt, Mycobacterium avium subsp. paratuberculosis
caccucgggcacgucc

SEQ ID NO: 2921907 - RNA, 22 nt, Mycobacterium avium subsp. paratuberculosis
caccucgggcacguccagcccg

SEQ ID NO: 2921908 - RNA, 23 nt, Mycobacterium avium subsp. paratuberculosis
caccucgggcacguccagcccgc

SEQ ID NO: 2921909 - RNA, 16 nt, Mycobacterium avium subsp. paratuberculosis
caccucgggccgggcg

SEQ ID NO: 2921910 - RNA, 18 nt, Mycobacterium avium subsp. paratuberculosis
caccucggggcguggcgg

SEQ ID NO: 2921911 - RNA, 21 nt, Mycobacterium avium subsp. paratuberculosis
caccucggugaucucaccggc

SEQ ID NO: 2921912 - RNA, 19 nt, Mycobacterium avium subsp. paratuberculosis
caccucggugaugucgacg

SEQ ID NO: 2921913 - RNA, 21 nt, Mycobacterium avium subsp. paratuberculosis
caccucggugaugucgacguc

SEQ ID NO: 2921914 - RNA, 18 nt, Mycobacterium avium subsp. paratuberculosis
caccucgguggacgccgc

SEQ ID NO: 2921915 - RNA, 19 nt, Mycobacterium avium subsp. paratuberculosis
caccucgguggacgccgcg

SEQ ID NO: 2921916 - RNA, 14 nt, Mycobacterium avium subsp. paratuberculosis
caccucgucccagc

SEQ ID NO: 2921917 - RNA, 16 nt, Mycobacterium avium subsp. paratuberculosis
caccucgucccagcgc

SEQ ID NO: 2921918 - RNA, 13 nt, Mycobacterium avium subsp. paratuberculosis
caccucgucgauc

SEQ ID NO: 2921919 - RNA, 18 nt, Mycobacterium avium subsp. paratuberculosis
caccucgucgcccggcgu

SEQ ID NO: 2921920 - RNA, 21 nt, Mycobacterium avium subsp. paratuberculosis
caccucgucgcccggcgucca

SEQ ID NO: 2921921 - RNA, 13 nt, Mycobacterium avium subsp. paratuberculosis
caccucgucgccg

SEQ ID NO: 2921922 - RNA, 17 nt, Mycobacterium avium subsp. paratuberculosis
caccucgucggcgguca

SEQ ID NO: 2921923 - RNA, 23 nt, Mycobacterium avium subsp. paratuberculosis
caccucgucggcggucaacacga

SEQ ID NO: 2921924 - RNA, 23 nt, Mycobacterium avium subsp. paratuberculosis
caccucuucgcgguccaucucca

SEQ ID NO: 2921925 - RNA, 15 nt, Mycobacterium avium subsp. paratuberculosis
caccucuucgggcag

SEQ ID NO: 2921926 - RNA, 15 nt, Mycobacterium avium subsp. paratuberculosis
caccuugcggccggc

SEQ ID NO: 2921927 - RNA, 20 nt, Mycobacterium avium subsp. paratuberculosis
caccuugcggccggcggcgu

SEQ ID NO: 2921928 - RNA, 22 nt, Mycobacterium avium subsp. paratuberculosis
caccuuggacgaaacccggcgg

SEQ ID NO: 2921929 - RNA, 16 nt, Mycobacterium avium subsp. paratuberculosis
caccuuggccggaucg

SEQ ID NO: 2921930 - RNA, 15 nt, Mycobacterium avium subsp. paratuberculosis
caccuuggccggugc

SEQ ID NO: 2921931 - RNA, 23 nt, Mycobacterium avium subsp. paratuberculosis
caccuuggccggugcgccgaccg

SEQ ID NO: 2921932 - RNA, 18 nt, Mycobacterium avium subsp. paratuberculosis
caccuuggcucggccgau

SEQ ID NO: 2921933 - RNA, 14 nt, Mycobacterium avium subsp. paratuberculosis
caccuuggugagca

SEQ ID NO: 2921934 - RNA, 20 nt, Mycobacterium avium subsp. paratuberculosis
caccuugguggccgcggccg

SEQ ID NO: 2921935 - RNA, 15 nt, Mycobacterium avium subsp. paratuberculosis
caccuugucggcgag

SEQ ID NO: 2921936 - RNA, 20 nt, Mycobacterium avium subsp. paratuberculosis
caccuugucggcgcccagga

SEQ ID NO: 2921937 - RNA, 16 nt, Mycobacterium avium subsp. paratuberculosis
caccuuucggccgcgg

SEQ ID NO: 2921938 - RNA, 19 nt, Mycobacterium avium subsp. paratuberculosis
cacgaaauaaccgcgcggc

SEQ ID NO: 2921939 - RNA, 21 nt, Mycobacterium avium subsp. paratuberculosis
cacgaaauaaccgcgcggcgc

SEQ ID NO: 2921940 - RNA, 22 nt, Mycobacterium avium subsp. paratuberculosis
cacgaaauaaccgcgcggcgcc

SEQ ID NO: 2921941 - RNA, 17 nt, Mycobacterium avium subsp. paratuberculosis
cacgaacaacugcauca

SEQ ID NO: 2921942 - RNA, 12 nt, Mycobacterium avium subsp. paratuberculosis
cacgaacaccgg

SEQ ID NO: 2921943 - RNA, 20 nt, Mycobacterium avium subsp. paratuberculosis
cacgaacaccggcgcgacca

SEQ ID NO: 2921944 - RNA, 22 nt, Mycobacterium avium subsp. paratuberculosis
cacgaacaccggcgcgaccaca

SEQ ID NO: 2921945 - RNA, 14 nt, Mycobacterium avium subsp. paratuberculosis
cacgaacagcagcg

SEQ ID NO: 2921946 - RNA, 13 nt, Mycobacterium avium subsp. paratuberculosis
cacgaaccaggcg

SEQ ID NO: 2921947 - RNA, 15 nt, Mycobacterium avium subsp. paratuberculosis
cacgaaccaggcgcc

SEQ ID NO: 2921948 - RNA, 17 nt, Mycobacterium avium subsp. paratuberculosis
cacgaacccggcggccc

SEQ ID NO: 2921949 - RNA, 23 nt, Mycobacterium avium subsp. paratuberculosis
cacgaaccgcucgaacacccggc

SEQ ID NO: 2921950 - RNA, 14 nt, Mycobacterium avium subsp. paratuberculosis
cacgaacgacgcgg

SEQ ID NO: 2921951 - RNA, 13 nt, Mycobacterium avium subsp. paratuberculosis
cacgaacgcgacg

SEQ ID NO: 2921952 - RNA, 13 nt, Mycobacterium avium subsp. paratuberculosis
cacgaacgcgccg

SEQ ID NO: 2921953 - RNA, 14 nt, Mycobacterium avium subsp. paratuberculosis
cacgaacgcgccgc

SEQ ID NO: 2921954 - RNA, 13 nt, Mycobacterium avium subsp. paratuberculosis
cacgaacgcggcc

SEQ ID NO: 2921955 - RNA, 16 nt, Mycobacterium avium subsp. paratuberculosis
cacgaacgcggccgcc

SEQ ID NO: 2921956 - RNA, 20 nt, Mycobacterium avium subsp. paratuberculosis
cacgaacgcguucgucggcg

SEQ ID NO: 2921957 - RNA, 12 nt, Mycobacterium avium subsp. paratuberculosis
cacgaacggcac

SEQ ID NO: 2921958 - RNA, 21 nt, Mycobacterium avium subsp. paratuberculosis
cacgaacggcacguugcccag

SEQ ID NO: 2921959 - RNA, 13 nt, Mycobacterium avium subsp. paratuberculosis
cacgaacggcgcc

SEQ ID NO: 2921960 - RNA, 23 nt, Mycobacterium avium subsp. paratuberculosis
cacgaacggguccuugccggcgg

SEQ ID NO: 2921961 - RNA, 16 nt, Mycobacterium avium subsp. paratuberculosis
cacgaacgucaggccg

SEQ ID NO: 2921962 - RNA, 19 nt, Mycobacterium avium subsp. paratuberculosis
cacgaacuccuugacccgg

SEQ ID NO: 2921963 - RNA, 14 nt, Mycobacterium avium subsp. paratuberculosis
cacgaacugggugc

SEQ ID NO: 2921964 - RNA, 21 nt, Mycobacterium avium subsp. paratuberculosis
cacgaagaacuugucgucguc

SEQ ID NO: 2921965 - RNA, 19 nt, Mycobacterium avium subsp. paratuberculosis
cacgaagaaggcuccgccg

SEQ ID NO: 2921966 - RNA, 22 nt, Mycobacterium avium subsp. paratuberculosis
cacgaagaaguauucgccgucg

SEQ ID NO: 2921967 - RNA, 19 nt, Mycobacterium avium subsp. paratuberculosis
cacgaagaugaucagcgcg

SEQ ID NO: 2921968 - RNA, 22 nt, Mycobacterium avium subsp. paratuberculosis
cacgaagaugaucagcgcgccc

SEQ ID NO: 2921969 - RNA, 20 nt, Mycobacterium avium subsp. paratuberculosis
cacgaagccgaacgacagca

SEQ ID NO: 2921970 - RNA, 21 nt, Mycobacterium avium subsp. paratuberculosis
cacgaagccgaacgacagcag

SEQ ID NO: 2921971 - RNA, 17 nt, Mycobacterium avium subsp. paratuberculosis
cacgaagcgggcggcga

SEQ ID NO: 2921972 - RNA, 18 nt, Mycobacterium avium subsp. paratuberculosis
cacgaagcgggcggcgaa

SEQ ID NO: 2921973 - RNA, 14 nt, Mycobacterium avium subsp. paratuberculosis
cacgaaggccgccg

SEQ ID NO: 2921974 - RNA, 22 nt, Mycobacterium avium subsp. paratuberculosis
cacgaagggcgccagcaccucg

SEQ ID NO: 2921975 - RNA, 20 nt, Mycobacterium avium subsp. paratuberculosis
cacgaaguacagcgucagca

SEQ ID NO: 2921976 - RNA, 23 nt, Mycobacterium avium subsp. paratuberculosis
cacgaagucaaaccccuuggcgu

SEQ ID NO: 2921977 - RNA, 15 nt, Mycobacterium avium subsp. paratuberculosis
cacgaagucgaccgc

SEQ ID NO: 2921978 - RNA, 21 nt, Mycobacterium avium subsp. paratuberculosis
cacgaagucguuggggauguc

SEQ ID NO: 2921979 - RNA, 23 nt, Mycobacterium avium subsp. paratuberculosis
cacgaagucguuggggaugucga

SEQ ID NO: 2921980 - RNA, 14 nt, Mycobacterium avium subsp. paratuberculosis
cacgaagugcccgg

SEQ ID NO: 2921981 - RNA, 18 nt, Mycobacterium avium subsp. paratuberculosis
cacgaagugcccggcgcc

SEQ ID NO: 2921982 - RNA, 21 nt, Mycobacterium avium subsp. paratuberculosis
cacgaaguugaucgcggcgga

SEQ ID NO: 2921983 - RNA, 23 nt, Mycobacterium avium subsp. paratuberculosis
cacgaaguugaucgcggcggaca

SEQ ID NO: 2921984 - RNA, 21 nt, Mycobacterium avium subsp. paratuberculosis
cacgaaguugguguccacccg

SEQ ID NO: 2921985 - RNA, 20 nt, Mycobacterium avium subsp. paratuberculosis
cacgaauacccuccgggcgg

SEQ ID NO: 2921986 - RNA, 16 nt, Mycobacterium avium subsp. paratuberculosis
cacgaauacccuucgg

SEQ ID NO: 2921987 - RNA, 19 nt, Mycobacterium avium subsp. paratuberculosis
cacgaauacccuucggccg

SEQ ID NO: 2921988 - RNA, 18 nt, Mycobacterium avium subsp. paratuberculosis
cacgaauugccgguggug

SEQ ID NO: 2921989 - RNA, 12 nt, Mycobacterium avium subsp. paratuberculosis
cacgacaccagc

SEQ ID NO: 2921990 - RNA, 16 nt, Mycobacterium avium subsp. paratuberculosis
cacgacaccagcgucg

SEQ ID NO: 2921991 - RNA, 23 nt, Mycobacterium avium subsp. paratuberculosis
cacgacauccccgcaaacacgag

SEQ ID NO: 2921992 - RNA, 14 nt, Mycobacterium avium subsp. paratuberculosis
cacgaccagcggca

SEQ ID NO: 2921993 - RNA, 15 nt, Mycobacterium avium subsp. paratuberculosis
cacgaccagcggcag

SEQ ID NO: 2921994 - RNA, 16 nt, Mycobacterium avium subsp. paratuberculosis
cacgaccagcggcagc

SEQ ID NO: 2921995 - RNA, 23 nt, Mycobacterium avium subsp. paratuberculosis
cacgaccaggaaguacaccaccg

SEQ ID NO: 2921996 - RNA, 18 nt, Mycobacterium avium subsp. paratuberculosis
cacgaccagugcccggcc

SEQ ID NO: 2921997 - RNA, 15 nt, Mycobacterium avium subsp. paratuberculosis
cacgaccccggcggc

SEQ ID NO: 2921998 - RNA, 20 nt, Mycobacterium avium subsp. paratuberculosis
cacgaccccggcggcaccgc

SEQ ID NO: 2921999 - RNA, 22 nt, Mycobacterium avium subsp. paratuberculosis
cacgaccccggcggcaccgccg

SEQ ID NO: 2922000 - RNA, 17 nt, Mycobacterium avium subsp. paratuberculosis
cacgaccgccagcagca

SEQ ID NO: 2922001 - RNA, 14 nt, Mycobacterium avium subsp. paratuberculosis
cacgaccggcagca

SEQ ID NO: 2922002 - RNA, 17 nt, Mycobacterium avium subsp. paratuberculosis
cacgaccggcagcaccg

SEQ ID NO: 2922003 - RNA, 20 nt, Mycobacterium avium subsp. paratuberculosis
cacgaccggcagcaccggcc

SEQ ID NO: 2922004 - RNA, 17 nt, Mycobacterium avium subsp. paratuberculosis
cacgaccucggggucgg

SEQ ID NO: 2922005 - RNA, 17 nt, Mycobacterium avium subsp. paratuberculosis
cacgaccuggcgggcca

SEQ ID NO: 2922006 - RNA, 20 nt, Mycobacterium avium subsp. paratuberculosis
cacgaccuggcgggccagcu

SEQ ID NO: 2922007 - RNA, 16 nt, Mycobacterium avium subsp. paratuberculosis
cacgacgaacaccacc

SEQ ID NO: 2922008 - RNA, 13 nt, Mycobacterium avium subsp. paratuberculosis
cacgacgaccgcg

SEQ ID NO: 2922009 - RNA, 14 nt, Mycobacterium avium subsp. paratuberculosis
cacgacgaccgcga

SEQ ID NO: 2922010 - RNA, 21 nt, Mycobacterium avium subsp. paratuberculosis
cacgaugaucgucggcagcga

SEQ ID NO: 2922011 - RNA, 22 nt, Mycobacterium avium subsp. paratuberculosis
cacgaugcccuuggccagcagu

SEQ ID NO: 2922012 - RNA, 15 nt, Mycobacterium avium subsp. paratuberculosis
cacgaugccgaccaa

SEQ ID NO: 2922013 - RNA, 16 nt, Mycobacterium avium subsp. paratuberculosis
cacgaugccgcgcucg

SEQ ID NO: 2922014 - RNA, 14 nt, Mycobacterium avium subsp. paratuberculosis
cacgaugccgggca

SEQ ID NO: 2922015 - RNA, 20 nt, Mycobacterium avium subsp. paratuberculosis
cacgaugcgcugugcgggug

SEQ ID NO: 2922016 - RNA, 16 nt, Mycobacterium avium subsp. paratuberculosis
cacgaugcggugccgg

SEQ ID NO: 2922017 - RNA, 19 nt, Mycobacterium avium subsp. paratuberculosis
cacgaugcggugccgggug

SEQ ID NO: 2922018 - RNA, 14 nt, Mycobacterium avium subsp. paratuberculosis
cacgaugcguuggu

SEQ ID NO: 2922019 - RNA, 19 nt, Mycobacterium avium subsp. paratuberculosis
cacgaugcugauacccgcg

SEQ ID NO: 2922020 - RNA, 16 nt, Mycobacterium avium subsp. paratuberculosis
cacgauggcgcggcgc

SEQ ID NO: 2922021 - RNA, 23 nt, Mycobacterium avium subsp. paratuberculosis
cacgauggcgcggcgcaccgccc

SEQ ID NO: 2922022 - RNA, 22 nt, Mycobacterium avium subsp. paratuberculosis
cacgauggcggcccagaucgcg

SEQ ID NO: 2922023 - RNA, 19 nt, Mycobacterium avium subsp. paratuberculosis
cacgauggggacgucgacg

SEQ ID NO: 2922024 - RNA, 15 nt, Mycobacterium avium subsp. paratuberculosis
cacgaugggucaggu

SEQ ID NO: 2922025 - RNA, 20 nt, Mycobacterium avium subsp. paratuberculosis
cacgaugggucaggucaacc

SEQ ID NO: 2922026 - RNA, 23 nt, Mycobacterium avium subsp. paratuberculosis
cacgaugugaugggucugcgccu

SEQ ID NO: 2922027 - RNA, 19 nt, Mycobacterium avium subsp. paratuberculosis
cacgauguugaugucgcgc

SEQ ID NO: 2922028 - RNA, 20 nt, Mycobacterium avium subsp. paratuberculosis
cacgauguugaugucgcgcg

SEQ ID NO: 2922029 - RNA, 22 nt, Mycobacterium avium subsp. paratuberculosis
cacgauguugaugucgcgcggc

SEQ ID NO: 2922030 - RNA, 23 nt, Mycobacterium avium subsp. paratuberculosis
cacgauguugaugucgcgcggcu

SEQ ID NO: 2922031 - RNA, 17 nt, Mycobacterium avium subsp. paratuberculosis
cacgcaaaaaccaugcc

SEQ ID NO: 2922032 - RNA, 12 nt, Mycobacterium avium subsp. paratuberculosis
cacgcacggcga

SEQ ID NO: 2922033 - RNA, 14 nt, Mycobacterium avium subsp. paratuberculosis
cacgcacggcgaac

SEQ ID NO: 2922034 - RNA, 20 nt, Mycobacterium avium subsp. paratuberculosis
cacgcagaacucgucgccac

SEQ ID NO: 2922035 - RNA, 22 nt, Mycobacterium avium subsp. paratuberculosis
cacgcagaucuugugccagccg

SEQ ID NO: 2922036 - RNA, 17 nt, Mycobacterium avium subsp. paratuberculosis
cacgcagccgcgcccga

SEQ ID NO: 2922037 - RNA, 14 nt, Mycobacterium avium subsp. paratuberculosis
cacgcagcggugca

SEQ ID NO: 2922038 - RNA, 21 nt, Mycobacterium avium subsp. paratuberculosis
cacgcagcggugcagccccgc

SEQ ID NO: 2922039 - RNA, 22 nt, Mycobacterium avium subsp. paratuberculosis
cacgcaggcguggcccagccgg

SEQ ID NO: 2922040 - RNA, 23 nt, Mycobacterium avium subsp. paratuberculosis
cacgcaggcguggcccagccggu

SEQ ID NO: 2922041 - RNA, 19 nt, Mycobacterium avium subsp. paratuberculosis
cacgcaggugcgccgcucg

SEQ ID NO: 2922042 - RNA, 19 nt, Mycobacterium avium subsp. paratuberculosis
cacgcagugccgcaccagc

SEQ ID NO: 2922043 - RNA, 20 nt, Mycobacterium avium subsp. paratuberculosis
cacgcagugccgcaccagca

SEQ ID NO: 2922044 - RNA, 21 nt, Mycobacterium avium subsp. paratuberculosis
cacgcagugccgcaccagcac

SEQ ID NO: 2922045 - RNA, 22 nt, Mycobacterium avium subsp. paratuberculosis
cacgcagugccgcaccagcacc

SEQ ID NO: 2922046 - RNA, 17 nt, Mycobacterium avium subsp. paratuberculosis
cacgcaguguccgaucg

SEQ ID NO: 2922047 - RNA, 23 nt, Mycobacterium avium subsp. paratuberculosis
cacgcaguguccgaucgccuccu

SEQ ID NO: 2922048 - RNA, 19 nt, Mycobacterium avium subsp. paratuberculosis
cacgcaucagggccagccg

SEQ ID NO: 2922049 - RNA, 15 nt, Mycobacterium avium subsp. paratuberculosis
cacgccacucgucga

SEQ ID NO: 2922050 - RNA, 13 nt, Mycobacterium avium subsp. paratuberculosis
cacgccagcaucg

SEQ ID NO: 2922051 - RNA, 19 nt, Mycobacterium avium subsp. paratuberculosis
cacgccagccaggcgauga

SEQ ID NO: 2922052 - RNA, 13 nt, Mycobacterium avium subsp. paratuberculosis
cacgccagccggg

SEQ ID NO: 2922053 - RNA, 16 nt, Mycobacterium avium subsp. paratuberculosis
cacgccagcgugacgc

SEQ ID NO: 2922054 - RNA, 17 nt, Mycobacterium avium subsp. paratuberculosis
cacgccagcgugacgcc

SEQ ID NO: 2922055 - RNA, 19 nt, Mycobacterium avium subsp. paratuberculosis
cacgccagcgugacgcccg

SEQ ID NO: 2922056 - RNA, 20 nt, Mycobacterium avium subsp. paratuberculosis
cacgccagcgugacgcccgg

SEQ ID NO: 2922057 - RNA, 18 nt, Mycobacterium avium subsp. paratuberculosis
cacgccagcgugacgccg

SEQ ID NO: 2922058 - RNA, 19 nt, Mycobacterium avium subsp. paratuberculosis
cacgccagcgugacgccgg

SEQ ID NO: 2922059 - RNA, 19 nt, Mycobacterium avium subsp. paratuberculosis
cacgccagcgugacgcucg

SEQ ID NO: 2922060 - RNA, 20 nt, Mycobacterium avium subsp. paratuberculosis
cacgccagcgugacgcucgg

SEQ ID NO: 2922061 - RNA, 22 nt, Mycobacterium avium subsp. paratuberculosis
cacgccagcgugacgcucgggc

SEQ ID NO: 2922062 - RNA, 21 nt, Mycobacterium avium subsp. paratuberculosis
cacgccagucauggcaguugu

SEQ ID NO: 2922063 - RNA, 19 nt, Mycobacterium avium subsp. paratuberculosis
cacgccaguguggccgcgg

SEQ ID NO: 2922064 - RNA, 22 nt, Mycobacterium avium subsp. paratuberculosis
cacgccaguguggccgcggcgg

SEQ ID NO: 2922065 - RNA, 21 nt, Mycobacterium avium subsp. paratuberculosis
cacgccaucgccucggccacc

SEQ ID NO: 2922066 - RNA, 22 nt, Mycobacterium avium subsp. paratuberculosis
cacgccaucgccucggccacca

SEQ ID NO: 2922067 - RNA, 18 nt, Mycobacterium avium subsp. paratuberculosis
cacgccaugugccggcgc

SEQ ID NO: 2922068 - RNA, 13 nt, Mycobacterium avium subsp. paratuberculosis
cacgcccagaccg

SEQ ID NO: 2922069 - RNA, 13 nt, Mycobacterium avium subsp. paratuberculosis
cacgcccagaucg

SEQ ID NO: 2922070 - RNA, 20 nt, Mycobacterium avium subsp. paratuberculosis
cacgcccagaucgccgaccc

SEQ ID NO: 2922071 - RNA, 13 nt, Mycobacterium avium subsp. paratuberculosis
cacgcccagcccg

SEQ ID NO: 2922072 - RNA, 13 nt, Mycobacterium avium subsp. paratuberculosis
cacgcccagcgcc

SEQ ID NO: 2922073 - RNA, 14 nt, Mycobacterium avium subsp. paratuberculosis
cacgcccagcgccg

SEQ ID NO: 2922074 - RNA, 19 nt, Mycobacterium avium subsp. paratuberculosis
cacgcccaugaucacaccg

SEQ ID NO: 2922075 - RNA, 13 nt, Mycobacterium avium subsp. paratuberculosis
cacgccccaggcg

SEQ ID NO: 2922076 - RNA, 15 nt, Mycobacterium avium subsp. paratuberculosis
cacgcccccgcuggc

SEQ ID NO: 2922077 - RNA, 22 nt, Mycobacterium avium subsp. paratuberculosis
cacgcccccgcuggcccggcgu

SEQ ID NO: 2922078 - RNA, 15 nt, Mycobacterium avium subsp. paratuberculosis
cacgccccgacagga

SEQ ID NO: 2922079 - RNA, 15 nt, Mycobacterium avium subsp. paratuberculosis
cacgccccggcgccg

SEQ ID NO: 2922080 - RNA, 16 nt, Mycobacterium avium subsp. paratuberculosis
cacgccccggcgccgu

SEQ ID NO: 2922081 - RNA, 15 nt, Mycobacterium avium subsp. paratuberculosis
cacgccccggcgggu

SEQ ID NO: 2922082 - RNA, 14 nt, Mycobacterium avium subsp. paratuberculosis
cacgcccgacgacg

SEQ ID NO: 2922083 - RNA, 15 nt, Mycobacterium avium subsp. paratuberculosis
cacgcccgacgacga

SEQ ID NO: 2922084 - RNA, 13 nt, Mycobacterium avium subsp. paratuberculosis
cacgcccgcagcg

SEQ ID NO: 2922085 - RNA, 19 nt, Mycobacterium avium subsp. paratuberculosis
cacgcccgcgaucggcgcc

SEQ ID NO: 2922086 - RNA, 15 nt, Mycobacterium avium subsp. paratuberculosis
cacgcccggacccgc

SEQ ID NO: 2922087 - RNA, 13 nt, Mycobacterium avium subsp. paratuberculosis
cacgcccggguac

SEQ ID NO: 2922088 - RNA, 18 nt, Mycobacterium avium subsp. paratuberculosis
cacgcccgucccugcgcg

SEQ ID NO: 2922089 - RNA, 17 nt, Mycobacterium avium subsp. paratuberculosis
cacgcccguugacgccc

SEQ ID NO: 2922090 - RNA, 23 nt, Mycobacterium avium subsp. paratuberculosis
cacgcccuagcgggccaggaugu

SEQ ID NO: 2922091 - RNA, 21 nt, Mycobacterium avium subsp. paratuberculosis
cacgcccucuucuucgagguc

SEQ ID NO: 2922092 - RNA, 13 nt, Mycobacterium avium subsp. paratuberculosis
cacgcccugcagg

SEQ ID NO: 2922093 - RNA, 23 nt, Mycobacterium avium subsp. paratuberculosis
cacgcccugcagguucugcacgu

SEQ ID NO: 2922094 - RNA, 18 nt, Mycobacterium avium subsp. paratuberculosis
cacgcgagacgagccgcc

SEQ ID NO: 2922095 - RNA, 19 nt, Mycobacterium avium subsp. paratuberculosis
cacgcgagacgagccgccg

SEQ ID NO: 2922096 - RNA, 20 nt, Mycobacterium avium subsp. paratuberculosis
cacgcgagacgagccgccgc

SEQ ID NO: 2922097 - RNA, 21 nt, Mycobacterium avium subsp. paratuberculosis
cacgcgagacgagccgccgcg

SEQ ID NO: 2922098 - RNA, 21 nt, Mycobacterium avium subsp. paratuberculosis
cacgcgaugaucagcucgcgc

SEQ ID NO: 2922099 - RNA, 22 nt, Mycobacterium avium subsp. paratuberculosis
cacgcgcagggcgaacggcgga

SEQ ID NO: 2922100 - RNA, 16 nt, Mycobacterium avium subsp. paratuberculosis
cacgcgccaaugguuu

SEQ ID NO: 2922101 - RNA, 15 nt, Mycobacterium avium subsp. paratuberculosis
cacgcgccggcgcgg

SEQ ID NO: 2922102 - RNA, 18 nt, Mycobacterium avium subsp. paratuberculosis
cacgcgcgccccgguccc

SEQ ID NO: 2922103 - RNA, 19 nt, Mycobacterium avium subsp. paratuberculosis
cacgcgcgccccggucccg

SEQ ID NO: 2922104 - RNA, 15 nt, Mycobacterium avium subsp. paratuberculosis
cacgcgcgcccggca

SEQ ID NO: 2922105 - RNA, 16 nt, Mycobacterium avium subsp. paratuberculosis
cacgcgcgcccggcac

SEQ ID NO: 2922106 - RNA, 17 nt, Mycobacterium avium subsp. paratuberculosis
cacgcgcgcccggcacc

SEQ ID NO: 2922107 - RNA, 18 nt, Mycobacterium avium subsp. paratuberculosis
cacgcgcgcccggcaccg

SEQ ID NO: 2922108 - RNA, 20 nt, Mycobacterium avium subsp. paratuberculosis
cacgcgcgcccggcaccgcg

SEQ ID NO: 2922109 - RNA, 19 nt, Mycobacterium avium subsp. paratuberculosis
cacgcgcgggucgucggcc

SEQ ID NO: 2922110 - RNA, 14 nt, Mycobacterium avium subsp. paratuberculosis
cacgcgcucagcgc

SEQ ID NO: 2922111 - RNA, 13 nt, Mycobacterium avium subsp. paratuberculosis
cacgcggacaggg

SEQ ID NO: 2922112 - RNA, 14 nt, Mycobacterium avium subsp. paratuberculosis
cacgcggaccuugg

SEQ ID NO: 2922113 - RNA, 13 nt, Mycobacterium avium subsp. paratuberculosis
cacgcggccgcgc

SEQ ID NO: 2922114 - RNA, 18 nt, Mycobacterium avium subsp. paratuberculosis
cacgcggccgcgccggcc

SEQ ID NO: 2922115 - RNA, 13 nt, Mycobacterium avium subsp. paratuberculosis
cacgcggcgcgca

SEQ ID NO: 2922116 - RNA, 19 nt, Mycobacterium avium subsp. paratuberculosis
cacgcggcgcgcaucgucg

SEQ ID NO: 2922117 - RNA, 12 nt, Mycobacterium avium subsp. paratuberculosis
cacgcggcggga

SEQ ID NO: 2922118 - RNA, 18 nt, Mycobacterium avium subsp. paratuberculosis
cacgcggcuggcccggcg

SEQ ID NO: 2922119 - RNA, 21 nt, Mycobacterium avium subsp. paratuberculosis
cacgcggcuggcccggcgcgg

SEQ ID NO: 2922120 - RNA, 22 nt, Mycobacterium avium subsp. paratuberculosis
cacgcggcuggcccggcgcggc

SEQ ID NO: 2922121 - RNA, 22 nt, Mycobacterium avium subsp. paratuberculosis
cacgcggcuucauaugacgccg

SEQ ID NO: 2922122 - RNA, 24 nt, Mycobacterium avium subsp. paratuberculosis
cacgcggcuucauaugacgccggc

SEQ ID NO: 2922123 - RNA, 22 nt, Mycobacterium avium subsp. paratuberculosis
cacgcgguccacuuccgcgcag

SEQ ID NO: 2922124 - RNA, 15 nt, Mycobacterium avium subsp. paratuberculosis
cacgcguagccgacc

SEQ ID NO: 2922125 - RNA, 18 nt, Mycobacterium avium subsp. paratuberculosis
cacgcguagccgaccaac

SEQ ID NO: 2922126 - RNA, 16 nt, Mycobacterium avium subsp. paratuberculosis
cacgcgucaggcgucg

SEQ ID NO: 2922127 - RNA, 17 nt, Mycobacterium avium subsp. paratuberculosis
cacgcgucaggcgucgu

SEQ ID NO: 2922128 - RNA, 12 nt, Mycobacterium avium subsp. paratuberculosis
cacgcguucgga

SEQ ID NO: 2922129 - RNA, 20 nt, Mycobacterium avium subsp. paratuberculosis
cacgcguucggacaccucgg

SEQ ID NO: 2922130 - RNA, 21 nt, Mycobacterium avium subsp. paratuberculosis
cacgcguucggacaccucggc

SEQ ID NO: 2922131 - RNA, 16 nt, Mycobacterium avium subsp. paratuberculosis
cacgcguugcagcgcc

SEQ ID NO: 2922132 - RNA, 17 nt, Mycobacterium avium subsp. paratuberculosis
cacgcguugcagcgccg

SEQ ID NO: 2922133 - RNA, 21 nt, Mycobacterium avium subsp. paratuberculosis
cacgcguugcagcgccgcggc

SEQ ID NO: 2922134 - RNA, 22 nt, Mycobacterium avium subsp. paratuberculosis
cacgcguugcagcgccgcggcg

SEQ ID NO: 2922135 - RNA, 16 nt, Mycobacterium avium subsp. paratuberculosis
cacgcuagcgugacgc

SEQ ID NO: 2922136 - RNA, 17 nt, Mycobacterium avium subsp. paratuberculosis
cacgcucacgcucggcc

SEQ ID NO: 2922137 - RNA, 18 nt, Mycobacterium avium subsp. paratuberculosis
cacgcucgcaggcgagcc

SEQ ID NO: 2922138 - RNA, 22 nt, Mycobacterium avium subsp. paratuberculosis
cacgcucgcaggcgagccgaca

SEQ ID NO: 2922139 - RNA, 12 nt, Mycobacterium avium subsp. paratuberculosis
cacgcucgccag

SEQ ID NO: 2922140 - RNA, 14 nt, Mycobacterium avium subsp. paratuberculosis
cacgcucgccagac

SEQ ID NO: 2922141 - RNA, 14 nt, Mycobacterium avium subsp. paratuberculosis
cacgcucgcggugc

SEQ ID NO: 2922142 - RNA, 14 nt, Mycobacterium avium subsp. paratuberculosis
cacgcucgcgugcg

SEQ ID NO: 2922143 - RNA, 11 nt, Mycobacterium avium subsp. paratuberculosis
cacgcucggca

SEQ ID NO: 2922144 - RNA, 14 nt, Mycobacterium avium subsp. paratuberculosis
cacgcucggcaggc

SEQ ID NO: 2922145 - RNA, 16 nt, Mycobacterium avium subsp. paratuberculosis
cacgcucggcaggcgg

SEQ ID NO: 2922146 - RNA, 13 nt, Mycobacterium avium subsp. paratuberculosis
cacgcucggcgag

SEQ ID NO: 2922147 - RNA, 14 nt, Mycobacterium avium subsp. paratuberculosis
cacgcucggcgagc

SEQ ID NO: 2922148 - RNA, 15 nt, Mycobacterium avium subsp. paratuberculosis
cacgcucggcgagcu

SEQ ID NO: 2922149 - RNA, 19 nt, Mycobacterium avium subsp. paratuberculosis
cacgcucggcgcaacggga

SEQ ID NO: 2922150 - RNA, 15 nt, Mycobacterium avium subsp. paratuberculosis
cacgcucggcgccga

SEQ ID NO: 2922151 - RNA, 16 nt, Mycobacterium avium subsp. paratuberculosis
cacgcucggcgccgag

SEQ ID NO: 2922152 - RNA, 17 nt, Mycobacterium avium subsp. paratuberculosis
cacgcucggcgccgagc

SEQ ID NO: 2922153 - RNA, 13 nt, Mycobacterium avium subsp. paratuberculosis
cacgcucggcgcg

SEQ ID NO: 2922154 - RNA, 19 nt, Mycobacterium avium subsp. paratuberculosis
cacgcucggcgcgacguug

SEQ ID NO: 2922155 - RNA, 14 nt, Mycobacterium avium subsp. paratuberculosis
cacgcucggcgcgc

SEQ ID NO: 2922156 - RNA, 21 nt, Mycobacterium avium subsp. paratuberculosis
cacgcucggcgcgcggggccg

SEQ ID NO: 2922157 - RNA, 13 nt, Mycobacterium avium subsp. paratuberculosis
cacgcucggcggc

SEQ ID NO: 2922158 - RNA, 16 nt, Mycobacterium avium subsp. paratuberculosis
cacgcucggcggcgcg

SEQ ID NO: 2922159 - RNA, 18 nt, Mycobacterium avium subsp. paratuberculosis
cacgcucggcggcgcgca

SEQ ID NO: 2922160 - RNA, 14 nt, Mycobacterium avium subsp. paratuberculosis
cacgcucggcgggg

SEQ ID NO: 2922161 - RNA, 18 nt, Mycobacterium avium subsp. paratuberculosis
cacgcucgggccggcgcc

SEQ ID NO: 2922162 - RNA, 20 nt, Mycobacterium avium subsp. paratuberculosis
cacgcucgggccggcgccga

SEQ ID NO: 2922163 - RNA, 16 nt, Mycobacterium avium subsp. paratuberculosis
cacgcucucgccgguc

SEQ ID NO: 2922164 - RNA, 22 nt, Mycobacterium avium subsp. paratuberculosis
cacgcucucgccggucagcacg

SEQ ID NO: 2922165 - RNA, 15 nt, Mycobacterium avium subsp. paratuberculosis
cacgcugaacggugc

SEQ ID NO: 2922166 - RNA, 18 nt, Mycobacterium avium subsp. paratuberculosis
cacgcugaacggugccgu

SEQ ID NO: 2922167 - RNA, 19 nt, Mycobacterium avium subsp. paratuberculosis
cacgcugaacggugccguc

SEQ ID NO: 2922168 - RNA, 21 nt, Mycobacterium avium subsp. paratuberculosis
cacgcugaacggugccgucac

SEQ ID NO: 2922169 - RNA, 16 nt, Mycobacterium avium subsp. paratuberculosis
cacgcugaagcacacc

SEQ ID NO: 2922170 - RNA, 12 nt, Mycobacterium avium subsp. paratuberculosis
cacgcugaagcc

SEQ ID NO: 2922171 - RNA, 16 nt, Mycobacterium avium subsp. paratuberculosis
cacgcugaagcccacc

SEQ ID NO: 2922172 - RNA, 16 nt, Mycobacterium avium subsp. paratuberculosis
cacgcugaucgaccgg

SEQ ID NO: 2922173 - RNA, 17 nt, Mycobacterium avium subsp. paratuberculosis
cacgcugauggauucgg

SEQ ID NO: 2922174 - RNA, 20 nt, Mycobacterium avium subsp. paratuberculosis
cacgcugcgccagccgucgc

SEQ ID NO: 2922175 - RNA, 15 nt, Mycobacterium avium subsp. paratuberculosis
cacgcugcgcgccga

SEQ ID NO: 2922176 - RNA, 17 nt, Mycobacterium avium subsp. paratuberculosis
cacgcugcgcgccgauc

SEQ ID NO: 2922177 - RNA, 12 nt, Mycobacterium avium subsp. paratuberculosis
cacgcuggccgg

SEQ ID NO: 2922178 - RNA, 15 nt, Mycobacterium avium subsp. paratuberculosis
cacgcuggccggcag

SEQ ID NO: 2922179 - RNA, 15 nt, Mycobacterium avium subsp. paratuberculosis
cacggccgaugcagu

SEQ ID NO: 2922180 - RNA, 19 nt, Mycobacterium avium subsp. paratuberculosis
cacggccgcaacggcgguc

SEQ ID NO: 2922181 - RNA, 12 nt, Mycobacterium avium subsp. paratuberculosis
cacggccgccag

SEQ ID NO: 2922182 - RNA, 13 nt, Mycobacterium avium subsp. paratuberculosis
cacggccgccagc

SEQ ID NO: 2922183 - RNA, 19 nt, Mycobacterium avium subsp. paratuberculosis
cacggccgccagcagcacg

SEQ ID NO: 2922184 - RNA, 14 nt, Mycobacterium avium subsp. paratuberculosis
cacggccgccagga

SEQ ID NO: 2922185 - RNA, 14 nt, Mycobacterium avium subsp. paratuberculosis
cacggccgccaggg

SEQ ID NO: 2922186 - RNA, 17 nt, Mycobacterium avium subsp. paratuberculosis
cacggccgccuccagca

SEQ ID NO: 2922187 - RNA, 19 nt, Mycobacterium avium subsp. paratuberculosis
cacggccgccuccagcacg

SEQ ID NO: 2922188 - RNA, 21 nt, Mycobacterium avium subsp. paratuberculosis
cacggccgccuccagcacguc

SEQ ID NO: 2922189 - RNA, 23 nt, Mycobacterium avium subsp. paratuberculosis
cacggccgccuccagcacgucgg

SEQ ID NO: 2922190 - RNA, 15 nt, Mycobacterium avium subsp. paratuberculosis
cacggccgcggcccg

SEQ ID NO: 2922191 - RNA, 16 nt, Mycobacterium avium subsp. paratuberculosis
cacggccgcggcccgg

SEQ ID NO: 2922192 - RNA, 18 nt, Mycobacterium avium subsp. paratuberculosis
cacggccgcggcccggcc

SEQ ID NO: 2922193 - RNA, 21 nt, Mycobacterium avium subsp. paratuberculosis
cacggccgcggcccggccacc

SEQ ID NO: 2922194 - RNA, 12 nt, Mycobacterium avium subsp. paratuberculosis
cacggccggcaa

SEQ ID NO: 2922195 - RNA, 14 nt, Mycobacterium avium subsp. paratuberculosis
cacggccggcaacg

SEQ ID NO: 2922196 - RNA, 13 nt, Mycobacterium avium subsp. paratuberculosis
cacggccggcagc

SEQ ID NO: 2922197 - RNA, 20 nt, Mycobacterium avium subsp. paratuberculosis
cacggccggcagcaucggga

SEQ ID NO: 2922198 - RNA, 22 nt, Mycobacterium avium subsp. paratuberculosis
cacggccggcagcaucgggacg

SEQ ID NO: 2922199 - RNA, 13 nt, Mycobacterium avium subsp. paratuberculosis
cacggccggccgg

SEQ ID NO: 2922200 - RNA, 14 nt, Mycobacterium avium subsp. paratuberculosis
cacggccggccggc

SEQ ID NO: 2922201 - RNA, 23 nt, Mycobacterium avium subsp. paratuberculosis
cacggccgggauuucccgggcga

SEQ ID NO: 2922202 - RNA, 14 nt, Mycobacterium avium subsp. paratuberculosis
cacggccguccagg

SEQ ID NO: 2922203 - RNA, 17 nt, Mycobacterium avium subsp. paratuberculosis
cacggccguccaggcgc

SEQ ID NO: 2922204 - RNA, 19 nt, Mycobacterium avium subsp. paratuberculosis
cacggccguccaggcgcca

SEQ ID NO: 2922205 - RNA, 15 nt, Mycobacterium avium subsp. paratuberculosis
cacggccucgaucau

SEQ ID NO: 2922206 - RNA, 18 nt, Mycobacterium avium subsp. paratuberculosis
cacggccucgaucaucac

SEQ ID NO: 2922207 - RNA, 13 nt, Mycobacterium avium subsp. paratuberculosis
cacggccucgccc

SEQ ID NO: 2922208 - RNA, 20 nt, Mycobacterium avium subsp. paratuberculosis
cacggccucgcccagcgccg

SEQ ID NO: 2922209 - RNA, 18 nt, Mycobacterium avium subsp. paratuberculosis
cacggccugcuuggucgc

SEQ ID NO: 2922210 - RNA, 19 nt, Mycobacterium avium subsp. paratuberculosis
cacggccugguacagcacc

SEQ ID NO: 2922211 - RNA, 20 nt, Mycobacterium avium subsp. paratuberculosis
cacggccugguacagcaccg

SEQ ID NO: 2922212 - RNA, 23 nt, Mycobacterium avium subsp. paratuberculosis
cacggccugguacagcaccgccg

SEQ ID NO: 2922213 - RNA, 14 nt, Mycobacterium avium subsp. paratuberculosis
cacggccuugccga

SEQ ID NO: 2922214 - RNA, 16 nt, Mycobacterium avium subsp. paratuberculosis
cacggccuugccgauc

SEQ ID NO: 2922215 - RNA, 22 nt, Mycobacterium avium subsp. paratuberculosis
cacggccuugccgaucagcugg

SEQ ID NO: 2922216 - RNA, 15 nt, Mycobacterium avium subsp. paratuberculosis
cacggcgaacaccuc

SEQ ID NO: 2922217 - RNA, 16 nt, Mycobacterium avium subsp. paratuberculosis
cacggcgaacaccucg

SEQ ID NO: 2922218 - RNA, 17 nt, Mycobacterium avium subsp. paratuberculosis
cacggcgaacaccucgg

SEQ ID NO: 2922219 - RNA, 21 nt, Mycobacterium avium subsp. paratuberculosis
cacggcgaacaccucgggauc

SEQ ID NO: 2922220 - RNA, 23 nt, Mycobacterium avium subsp. paratuberculosis
cacggcgaacaccucgggaucca

SEQ ID NO: 2922221 - RNA, 18 nt, Mycobacterium avium subsp. paratuberculosis
cacggcgaacggccgcga

SEQ ID NO: 2922222 - RNA, 22 nt, Mycobacterium avium subsp. paratuberculosis
cacggcgaauauuucgccgauc

SEQ ID NO: 2922223 - RNA, 23 nt, Mycobacterium avium subsp. paratuberculosis
cacggcgaauauuucgccgaucu

SEQ ID NO: 2922224 - RNA, 14 nt, Mycobacterium avium subsp. paratuberculosis
cacggcgaccagcg

SEQ ID NO: 2922225 - RNA, 20 nt, Mycobacterium avium subsp. paratuberculosis
cacggcgaccagcgagccca

SEQ ID NO: 2922226 - RNA, 13 nt, Mycobacterium avium subsp. paratuberculosis
cacggcgacgacc

SEQ ID NO: 2922227 - RNA, 21 nt, Mycobacterium avium subsp. paratuberculosis
cacggcgacgaccaccaggag

SEQ ID NO: 2922228 - RNA, 14 nt, Mycobacterium avium subsp. paratuberculosis
cacggcgaggaugg

SEQ ID NO: 2922229 - RNA, 19 nt, Mycobacterium avium subsp. paratuberculosis
cacggcgaggauggcgauc

SEQ ID NO: 2922230 - RNA, 20 nt, Mycobacterium avium subsp. paratuberculosis
cacggcgaggauggcgauca

SEQ ID NO: 2922231 - RNA, 21 nt, Mycobacterium avium subsp. paratuberculosis
cacggcgaggauggcgaucau

SEQ ID NO: 2922232 - RNA, 18 nt, Mycobacterium avium subsp. paratuberculosis
cacggcgauguaggacgc

SEQ ID NO: 2922233 - RNA, 24 nt, Mycobacterium avium subsp. paratuberculosis
cacggcgauguaggacgccgcacc

SEQ ID NO: 2922234 - RNA, 21 nt, Mycobacterium avium subsp. paratuberculosis
cacggcgcccagguccaccag

SEQ ID NO: 2922235 - RNA, 23 nt, Mycobacterium avium subsp. paratuberculosis
cacggcgcccucgaugcgcaccg

SEQ ID NO: 2922236 - RNA, 14 nt, Mycobacterium avium subsp. paratuberculosis
cacggcgccgugcc

SEQ ID NO: 2922237 - RNA, 18 nt, Mycobacterium avium subsp. paratuberculosis
cacggcgccgugccgcgc

SEQ ID NO: 2922238 - RNA, 19 nt, Mycobacterium avium subsp. paratuberculosis
cacggcgccgugccgcgcg

SEQ ID NO: 2922239 - RNA, 20 nt, Mycobacterium avium subsp. paratuberculosis
cacggcgccgugccgcgcgg

SEQ ID NO: 2922240 - RNA, 21 nt, Mycobacterium avium subsp. paratuberculosis
cacggcgccgugccgcgcggc

SEQ ID NO: 2922241 - RNA, 22 nt, Mycobacterium avium subsp. paratuberculosis
cacggcgccgugccgcgcggcg

SEQ ID NO: 2922242 - RNA, 15 nt, Mycobacterium avium subsp. paratuberculosis
cacggcgccgugcgc

SEQ ID NO: 2922243 - RNA, 20 nt, Mycobacterium avium subsp. paratuberculosis
cacggcgccgugcgccucga

SEQ ID NO: 2922244 - RNA, 13 nt, Mycobacterium avium subsp. paratuberculosis
cacggcgcgagga

SEQ ID NO: 2922245 - RNA, 16 nt, Mycobacterium avium subsp. paratuberculosis
cacggcgcgcaccgcg

SEQ ID NO: 2922246 - RNA, 19 nt, Mycobacterium avium subsp. paratuberculosis
cacggcgcgcaccgcgggc

SEQ ID NO: 2922247 - RNA, 13 nt, Mycobacterium avium subsp. paratuberculosis
cacggcgcugagc

SEQ ID NO: 2922248 - RNA, 14 nt, Mycobacterium avium subsp. paratuberculosis
cacggcgcugagcg

SEQ ID NO: 2922249 - RNA, 13 nt, Mycobacterium avium subsp. paratuberculosis
cacggcgcuggcg

SEQ ID NO: 2922250 - RNA, 13 nt, Mycobacterium avium subsp. paratuberculosis
cacggcggcagcg

SEQ ID NO: 2922251 - RNA, 15 nt, Mycobacterium avium subsp. paratuberculosis
cacggcggcagcgcg

SEQ ID NO: 2922252 - RNA, 22 nt, Mycobacterium avium subsp. paratuberculosis
cacggcggccgaauccggccgg

SEQ ID NO: 2922253 - RNA, 16 nt, Mycobacterium avium subsp. paratuberculosis
cacggcggcgaacgcc

SEQ ID NO: 2922254 - RNA, 13 nt, Mycobacterium avium subsp. paratuberculosis
cacggcggcgaag

SEQ ID NO: 2922255 - RNA, 12 nt, Mycobacterium avium subsp. paratuberculosis
cacggcggcgcg

SEQ ID NO: 2922256 - RNA, 13 nt, Mycobacterium avium subsp. paratuberculosis
cacggcggcgcgc

SEQ ID NO: 2922257 - RNA, 14 nt, Mycobacterium avium subsp. paratuberculosis
cacggcggcgcgca

SEQ ID NO: 2922258 - RNA, 16 nt, Mycobacterium avium subsp. paratuberculosis
cacggcggcgcgcacg

SEQ ID NO: 2922259 - RNA, 18 nt, Mycobacterium avium subsp. paratuberculosis
cacggcggcgcgggcggc

SEQ ID NO: 2922260 - RNA, 24 nt, Mycobacterium avium subsp. paratuberculosis
cacggcggggucaagcggcagacc

SEQ ID NO: 2922261 - RNA, 12 nt, Mycobacterium avium subsp. paratuberculosis
cacggcgguguc

SEQ ID NO: 2922262 - RNA, 16 nt, Mycobacterium avium subsp. paratuberculosis
cacggcggugucggcg

SEQ ID NO: 2922263 - RNA, 19 nt, Mycobacterium avium subsp. paratuberculosis
cacggcggugucggcggca

SEQ ID NO: 2922264 - RNA, 14 nt, Mycobacterium avium subsp. paratuberculosis
cacggugcgccggc

SEQ ID NO: 2922265 - RNA, 18 nt, Mycobacterium avium subsp. paratuberculosis
cacggugcgccggcagcg

SEQ ID NO: 2922266 - RNA, 18 nt, Mycobacterium avium subsp. paratuberculosis
cacggugcgcucgugacc

SEQ ID NO: 2922267 - RNA, 14 nt, Mycobacterium avium subsp. paratuberculosis
cacgguggccgcca

SEQ ID NO: 2922268 - RNA, 16 nt, Mycobacterium avium subsp. paratuberculosis
cacgguggccgccacc

SEQ ID NO: 2922269 - RNA, 17 nt, Mycobacterium avium subsp. paratuberculosis
cacgguggccgccacca

SEQ ID NO: 2922270 - RNA, 19 nt, Mycobacterium avium subsp. paratuberculosis
cacgguggccgccaccaac

SEQ ID NO: 2922271 - RNA, 15 nt, Mycobacterium avium subsp. paratuberculosis
cacgguggccgcgaa

SEQ ID NO: 2922272 - RNA, 13 nt, Mycobacterium avium subsp. paratuberculosis
cacgguggcgccg

SEQ ID NO: 2922273 - RNA, 19 nt, Mycobacterium avium subsp. paratuberculosis
cacgguggcgccggcaucg

SEQ ID NO: 2922274 - RNA, 22 nt, Mycobacterium avium subsp. paratuberculosis
cacgguggcgccggcaucgacc

SEQ ID NO: 2922275 - RNA, 13 nt, Mycobacterium avium subsp. paratuberculosis
cacggugggacgg

SEQ ID NO: 2922276 - RNA, 18 nt, Mycobacterium avium subsp. paratuberculosis
cacggugggacggcgggu

SEQ ID NO: 2922277 - RNA, 14 nt, Mycobacterium avium subsp. paratuberculosis
cacggugggcgccg

SEQ ID NO: 2922278 - RNA, 16 nt, Mycobacterium avium subsp. paratuberculosis
cacggugggcgccggg

SEQ ID NO: 2922279 - RNA, 22 nt, Mycobacterium avium subsp. paratuberculosis
cacgguggugacccgcaacucg

SEQ ID NO: 2922280 - RNA, 17 nt, Mycobacterium avium subsp. paratuberculosis
cacgguguagacgcggg

SEQ ID NO: 2922281 - RNA, 20 nt, Mycobacterium avium subsp. paratuberculosis
cacgguguagacgcgggccg

SEQ ID NO: 2922282 - RNA, 23 nt, Mycobacterium avium subsp. paratuberculosis
cacgguguagacgcgggccggca

SEQ ID NO: 2922283 - RNA, 18 nt, Mycobacterium avium subsp. paratuberculosis
cacgguguagcugcgggu

SEQ ID NO: 2922284 - RNA, 20 nt, Mycobacterium avium subsp. paratuberculosis
cacggugucgcuguaggcca

SEQ ID NO: 2922285 - RNA, 22 nt, Mycobacterium avium subsp. paratuberculosis
cacggugucgcuguaggccagc

SEQ ID NO: 2922286 - RNA, 20 nt, Mycobacterium avium subsp. paratuberculosis
cacgguguugcgcacccgcg

SEQ ID NO: 2922287 - RNA, 16 nt, Mycobacterium avium subsp. paratuberculosis
cacgguuggccggccc

SEQ ID NO: 2922288 - RNA, 20 nt, Mycobacterium avium subsp. paratuberculosis
cacgguuggccggcccgccc

SEQ ID NO: 2922289 - RNA, 19 nt, Mycobacterium avium subsp. paratuberculosis
cacgguuucgccguacagc

SEQ ID NO: 2922290 - RNA, 14 nt, Mycobacterium avium subsp. paratuberculosis
cacguacagcggcg

SEQ ID NO: 2922291 - RNA, 15 nt, Mycobacterium avium subsp. paratuberculosis
cacguacagcggcgg

SEQ ID NO: 2922292 - RNA, 18 nt, Mycobacterium avium subsp. paratuberculosis
cacguaccgguacagcga

SEQ ID NO: 2922293 - RNA, 17 nt, Mycobacterium avium subsp. paratuberculosis
cacguacgcgcugauca

SEQ ID NO: 2922294 - RNA, 14 nt, Mycobacterium avium subsp. paratuberculosis
cacguagaaggcgc

SEQ ID NO: 2922295 - RNA, 21 nt, Mycobacterium avium subsp. paratuberculosis
cacguagaaggcgccgucggu

SEQ ID NO: 2922296 - RNA, 14 nt, Mycobacterium avium subsp. paratuberculosis
cacguagacggugu

SEQ ID NO: 2922297 - RNA, 21 nt, Mycobacterium avium subsp. paratuberculosis
cacguagacggugucgcccuc

SEQ ID NO: 2922298 - RNA, 20 nt, Mycobacterium avium subsp. paratuberculosis
cacguagcagcagaccgcga

SEQ ID NO: 2922299 - RNA, 16 nt, Mycobacterium avium subsp. paratuberculosis
cacguagcccagcgcg

SEQ ID NO: 2922300 - RNA, 13 nt, Mycobacterium avium subsp. paratuberculosis
cacguagcgaucg

SEQ ID NO: 2922301 - RNA, 17 nt, Mycobacterium avium subsp. paratuberculosis
cacguagcgguccagcg

SEQ ID NO: 2922302 - RNA, 13 nt, Mycobacterium avium subsp. paratuberculosis
cacguaggcgauc

SEQ ID NO: 2922303 - RNA, 14 nt, Mycobacterium avium subsp. paratuberculosis
cacguaggcgauca

SEQ ID NO: 2922304 - RNA, 21 nt, Mycobacterium avium subsp. paratuberculosis
cacguaggcgaucagcgcgca

SEQ ID NO: 2922305 - RNA, 22 nt, Mycobacterium avium subsp. paratuberculosis
cacguaggcgaucagcgcgcac

SEQ ID NO: 2922306 - RNA, 15 nt, Mycobacterium avium subsp. paratuberculosis
cacguaggcgauguc

SEQ ID NO: 2922307 - RNA, 14 nt, Mycobacterium avium subsp. paratuberculosis
cacguaggcggcga

SEQ ID NO: 2922308 - RNA, 14 nt, Mycobacterium avium subsp. paratuberculosis
cacguaguccgacg

SEQ ID NO: 2922309 - RNA, 18 nt, Mycobacterium avium subsp. paratuberculosis
cacguaguccgacgaucc

SEQ ID NO: 2922310 - RNA, 14 nt, Mycobacterium avium subsp. paratuberculosis
cacguagucgaccg

SEQ ID NO: 2922311 - RNA, 19 nt, Mycobacterium avium subsp. paratuberculosis
cacguagucgaccgggauc

SEQ ID NO: 2922312 - RNA, 22 nt, Mycobacterium avium subsp. paratuberculosis
cacguagugcuucuugaagaac

SEQ ID NO: 2922313 - RNA, 20 nt, Mycobacterium avium subsp. paratuberculosis
cacguauccgcggucgacca

SEQ ID NO: 2922314 - RNA, 20 nt, Mycobacterium avium subsp. paratuberculosis
cacgucaccgcgcuugccgc

SEQ ID NO: 2922315 - RNA, 17 nt, Mycobacterium avium subsp. paratuberculosis
cacgucaccgcugaugc

SEQ ID NO: 2922316 - RNA, 17 nt, Mycobacterium avium subsp. paratuberculosis
cacgucauuucggucgg

SEQ ID NO: 2922317 - RNA, 14 nt, Mycobacterium avium subsp. paratuberculosis
cacguccaccagca

SEQ ID NO: 2922318 - RNA, 16 nt, Mycobacterium avium subsp. paratuberculosis
cacguccaccagcacc

SEQ ID NO: 2922319 - RNA, 16 nt, Mycobacterium avium subsp. paratuberculosis
cacguccacgccgcgg

SEQ ID NO: 2922320 - RNA, 19 nt, Mycobacterium avium subsp. paratuberculosis
cacguccacgccgcgggag

SEQ ID NO: 2922321 - RNA, 13 nt, Mycobacterium avium subsp. paratuberculosis
cacguccagcugg

SEQ ID NO: 2922322 - RNA, 16 nt, Mycobacterium avium subsp. paratuberculosis
cacguccagcugggcu

SEQ ID NO: 2922323 - RNA, 18 nt, Mycobacterium avium subsp. paratuberculosis
cacguccagcugggcugc

SEQ ID NO: 2922324 - RNA, 12 nt, Mycobacterium avium subsp. paratuberculosis
cacguccccggg

SEQ ID NO: 2922325 - RNA, 14 nt, Mycobacterium avium subsp. paratuberculosis
cacguccccgggca

SEQ ID NO: 2922326 - RNA, 22 nt, Mycobacterium avium subsp. paratuberculosis
cacguccccgggcgugccggac

SEQ ID NO: 2922327 - RNA, 15 nt, Mycobacterium avium subsp. paratuberculosis
cacguccccgugcag

SEQ ID NO: 2922328 - RNA, 19 nt, Mycobacterium avium subsp. paratuberculosis
cacguccccgugcagccgg

SEQ ID NO: 2922329 - RNA, 13 nt, Mycobacterium avium subsp. paratuberculosis
cacgucccgcccg

SEQ ID NO: 2922330 - RNA, 16 nt, Mycobacterium avium subsp. paratuberculosis
cacgucccgcccggcg

SEQ ID NO: 2922331 - RNA, 24 nt, Mycobacterium avium subsp. paratuberculosis
cacgucccgcccggcgccggccga

SEQ ID NO: 2922332 - RNA, 18 nt, Mycobacterium avium subsp. paratuberculosis
cacguccgccuccgacca

SEQ ID NO: 2922333 - RNA, 21 nt, Mycobacterium avium subsp. paratuberculosis
cacguccgccuccgaccagcc

SEQ ID NO: 2922334 - RNA, 12 nt, Mycobacterium avium subsp. paratuberculosis
cacguccgcggu

SEQ ID NO: 2922335 - RNA, 20 nt, Mycobacterium avium subsp. paratuberculosis
cacguccgcggugagcaccg

SEQ ID NO: 2922336 - RNA, 22 nt, Mycobacterium avium subsp. paratuberculosis
cacguccgcggugagcaccgga

SEQ ID NO: 2922337 - RNA, 22 nt, Mycobacterium avium subsp. paratuberculosis
cacguccggaugcggcgcccac

SEQ ID NO: 2922338 - RNA, 23 nt, Mycobacterium avium subsp. paratuberculosis
cacguccggaugcggcgcccaca

SEQ ID NO: 2922339 - RNA, 16 nt, Mycobacterium avium subsp. paratuberculosis
cacguccuagacacga

SEQ ID NO: 2922340 - RNA, 15 nt, Mycobacterium avium subsp. paratuberculosis
cacguccuggacguc

SEQ ID NO: 2922341 - RNA, 16 nt, Mycobacterium avium subsp. paratuberculosis
cacguccuggacgucg

SEQ ID NO: 2922342 - RNA, 19 nt, Mycobacterium avium subsp. paratuberculosis
cacguccuggacgucgucg

SEQ ID NO: 2922343 - RNA, 13 nt, Mycobacterium avium subsp. paratuberculosis
cacguccuggcgc

SEQ ID NO: 2922344 - RNA, 13 nt, Mycobacterium avium subsp. paratuberculosis
cacgucgaacccg

SEQ ID NO: 2922345 - RNA, 19 nt, Mycobacterium avium subsp. paratuberculosis
cacgucgaacccgaccccg

SEQ ID NO: 2922346 - RNA, 20 nt, Mycobacterium avium subsp. paratuberculosis
cacgucgaacccgaccccgg

SEQ ID NO: 2922347 - RNA, 18 nt, Mycobacterium avium subsp. paratuberculosis
cacgucgacacgccggcc

SEQ ID NO: 2922348 - RNA, 20 nt, Mycobacterium avium subsp. paratuberculosis
cacgucgacacgccggccgu

SEQ ID NO: 2922349 - RNA, 14 nt, Mycobacterium avium subsp. paratuberculosis
cacguggccgauca

SEQ ID NO: 2922350 - RNA, 19 nt, Mycobacterium avium subsp. paratuberculosis
cacguggccgaucagcugc

SEQ ID NO: 2922351 - RNA, 23 nt, Mycobacterium avium subsp. paratuberculosis
cacguggcugaccgacggcgacc

SEQ ID NO: 2922352 - RNA, 14 nt, Mycobacterium avium subsp. paratuberculosis
cacguggucgcuga

SEQ ID NO: 2922353 - RNA, 19 nt, Mycobacterium avium subsp. paratuberculosis
cacguggugaucagcaucc

SEQ ID NO: 2922354 - RNA, 21 nt, Mycobacterium avium subsp. paratuberculosis
cacguggugaucagcauccgc

SEQ ID NO: 2922355 - RNA, 16 nt, Mycobacterium avium subsp. paratuberculosis
cacguguccgacgccg

SEQ ID NO: 2922356 - RNA, 15 nt, Mycobacterium avium subsp. paratuberculosis
cacgugucggcgucg

SEQ ID NO: 2922357 - RNA, 16 nt, Mycobacterium avium subsp. paratuberculosis
cacgugucggcgucga

SEQ ID NO: 2922358 - RNA, 19 nt, Mycobacterium avium subsp. paratuberculosis
cacguguucgggaucggcg

SEQ ID NO: 2922359 - RNA, 15 nt, Mycobacterium avium subsp. paratuberculosis
cacguucaccaccgg

SEQ ID NO: 2922360 - RNA, 16 nt, Mycobacterium avium subsp. paratuberculosis
cacguucaccaccgga

SEQ ID NO: 2922361 - RNA, 19 nt, Mycobacterium avium subsp. paratuberculosis
cacguucaccaccggagcg

SEQ ID NO: 2922362 - RNA, 20 nt, Mycobacterium avium subsp. paratuberculosis
cacguucagcgacuugccgc

SEQ ID NO: 2922363 - RNA, 18 nt, Mycobacterium avium subsp. paratuberculosis
cacguucgcggucgagcg

SEQ ID NO: 2922364 - RNA, 13 nt, Mycobacterium avium subsp. paratuberculosis
cacguucggcgag

SEQ ID NO: 2922365 - RNA, 14 nt, Mycobacterium avium subsp. paratuberculosis
cacguugacguaga

SEQ ID NO: 2922366 - RNA, 22 nt, Mycobacterium avium subsp. paratuberculosis
cacguugacguagacgacgggc

SEQ ID NO: 2922367 - RNA, 17 nt, Mycobacterium avium subsp. paratuberculosis
cacguugagcccggacc

SEQ ID NO: 2922368 - RNA, 19 nt, Mycobacterium avium subsp. paratuberculosis
cacguugagcccggaccgg

SEQ ID NO: 2922369 - RNA, 21 nt, Mycobacterium avium subsp. paratuberculosis
cacguugagcccggaccggcc

SEQ ID NO: 2922370 - RNA, 21 nt, Mycobacterium avium subsp. paratuberculosis
cacguugagucccucggcgag

SEQ ID NO: 2922371 - RNA, 20 nt, Mycobacterium avium subsp. paratuberculosis
cacguugaugaucgccgauc

SEQ ID NO: 2922372 - RNA, 17 nt, Mycobacterium avium subsp. paratuberculosis
cacguugaugccgccca

SEQ ID NO: 2922373 - RNA, 23 nt, Mycobacterium avium subsp. paratuberculosis
cacguugaugccgcccagcagcg

SEQ ID NO: 2922374 - RNA, 13 nt, Mycobacterium avium subsp. paratuberculosis
cacguugcccagg

SEQ ID NO: 2922375 - RNA, 17 nt, Mycobacterium avium subsp. paratuberculosis
cacguugcgcaucagcg

SEQ ID NO: 2922376 - RNA, 13 nt, Mycobacterium avium subsp. paratuberculosis
cacguuggcggcc

SEQ ID NO: 2922377 - RNA, 18 nt, Mycobacterium avium subsp. paratuberculosis
cacguuggcggccagcgc

SEQ ID NO: 2922378 - RNA, 19 nt, Mycobacterium avium subsp. paratuberculosis
cacguuggcggccagcgcg

SEQ ID NO: 2922379 - RNA, 16 nt, Mycobacterium avium subsp. paratuberculosis
cacguugucgcggccc

SEQ ID NO: 2922380 - RNA, 22 nt, Mycobacterium avium subsp. paratuberculosis
cacguugucgcggcccagcacc

SEQ ID NO: 2922381 - RNA, 16 nt, Mycobacterium avium subsp. paratuberculosis
cacguugugggcgggc

SEQ ID NO: 2922382 - RNA, 22 nt, Mycobacterium avium subsp. paratuberculosis
cacguuucggcccuccagcacc

SEQ ID NO: 2922383 - RNA, 22 nt, Mycobacterium avium subsp. paratuberculosis
cacuacccgcgauggcacacag

SEQ ID NO: 2922384 - RNA, 23 nt, Mycobacterium avium subsp. paratuberculosis
cacuacccgcgauggcacacagc

SEQ ID NO: 2922385 - RNA, 15 nt, Mycobacterium avium subsp. paratuberculosis
cacuaccgccucgcc

SEQ ID NO: 2922386 - RNA, 19 nt, Mycobacterium avium subsp. paratuberculosis
cacucagagcagcgccugc

SEQ ID NO: 2922387 - RNA, 20 nt, Mycobacterium avium subsp. paratuberculosis
cacucagagcagcgccugcu

SEQ ID NO: 2922388 - RNA, 20 nt, Mycobacterium avium subsp. paratuberculosis
cacucaggccacaugggcca

SEQ ID NO: 2922389 - RNA, 17 nt, Mycobacterium avium subsp. paratuberculosis
cacucauguucagggug

SEQ ID NO: 2922390 - RNA, 21 nt, Mycobacterium avium subsp. paratuberculosis
cacucauguucagggugcguu

SEQ ID NO: 2922391 - RNA, 18 nt, Mycobacterium avium subsp. paratuberculosis
cacuccaauacggcccgg

SEQ ID NO: 2922392 - RNA, 19 nt, Mycobacterium avium subsp. paratuberculosis
cacuccaauacggcccggc

SEQ ID NO: 2922393 - RNA, 18 nt, Mycobacterium avium subsp. paratuberculosis
cacuccaccaccggccgc

SEQ ID NO: 2922394 - RNA, 20 nt, Mycobacterium avium subsp. paratuberculosis
cacuccaccaccggccgcgc

SEQ ID NO: 2922395 - RNA, 14 nt, Mycobacterium avium subsp. paratuberculosis
cacuccagcggcgg

SEQ ID NO: 2922396 - RNA, 16 nt, Mycobacterium avium subsp. paratuberculosis
cacuccagcggcggcc

SEQ ID NO: 2922397 - RNA, 22 nt, Mycobacterium avium subsp. paratuberculosis
cacuccaggguucucgcggcgg

SEQ ID NO: 2922398 - RNA, 13 nt, Mycobacterium avium subsp. paratuberculosis
cacucccagccgc

SEQ ID NO: 2922399 - RNA, 16 nt, Mycobacterium avium subsp. paratuberculosis
cacucccagccgccgg

SEQ ID NO: 2922400 - RNA, 17 nt, Mycobacterium avium subsp. paratuberculosis
cacucccagccgccggc

SEQ ID NO: 2922401 - RNA, 18 nt, Mycobacterium avium subsp. paratuberculosis
cacucccagccgccggcc

SEQ ID NO: 2922402 - RNA, 14 nt, Mycobacterium avium subsp. paratuberculosis
cacucccgcgcgcu

SEQ ID NO: 2922403 - RNA, 14 nt, Mycobacterium avium subsp. paratuberculosis
cacucccuuguugc

SEQ ID NO: 2922404 - RNA, 23 nt, Mycobacterium avium subsp. paratuberculosis
cacucccuuguugccgaguaccg

SEQ ID NO: 2922405 - RNA, 16 nt, Mycobacterium avium subsp. paratuberculosis
cacuccgucgcgauca

SEQ ID NO: 2922406 - RNA, 15 nt, Mycobacterium avium subsp. paratuberculosis
cacuccucgaucugg

SEQ ID NO: 2922407 - RNA, 19 nt, Mycobacterium avium subsp. paratuberculosis
cacuccugguuucgggggu

SEQ ID NO: 2922408 - RNA, 16 nt, Mycobacterium avium subsp. paratuberculosis
cacuccuugcugucgg

SEQ ID NO: 2922409 - RNA, 15 nt, Mycobacterium avium subsp. paratuberculosis
cacucgaacggcccg

SEQ ID NO: 2922410 - RNA, 20 nt, Mycobacterium avium subsp. paratuberculosis
cacucgaccuucgagccgcc

SEQ ID NO: 2922411 - RNA, 21 nt, Mycobacterium avium subsp. paratuberculosis
cacucgaccuucgagccgccg

SEQ ID NO: 2922412 - RNA, 22 nt, Mycobacterium avium subsp. paratuberculosis
cacucgaccuucgagccgccgc

SEQ ID NO: 2922413 - RNA, 21 nt, Mycobacterium avium subsp. paratuberculosis
cacucgagcguccggagaacc

SEQ ID NO: 2922414 - RNA, 16 nt, Mycobacterium avium subsp. paratuberculosis
cacucgaucagcaccg

SEQ ID NO: 2922415 - RNA, 16 nt, Mycobacterium avium subsp. paratuberculosis
cacucgauggcggcga

SEQ ID NO: 2922416 - RNA, 18 nt, Mycobacterium avium subsp. paratuberculosis
cacucgccgcgaacgacg

SEQ ID NO: 2922417 - RNA, 14 nt, Mycobacterium avium subsp. paratuberculosis
cacucgcgggacgg

SEQ ID NO: 2922418 - RNA, 21 nt, Mycobacterium avium subsp. paratuberculosis
cacucggacagguggccgauc

SEQ ID NO: 2922419 - RNA, 21 nt, Mycobacterium avium subsp. paratuberculosis
cacucggccaccaugucggcg

SEQ ID NO: 2922420 - RNA, 12 nt, Mycobacterium avium subsp. paratuberculosis
cacucggcgaug

SEQ ID NO: 2922421 - RNA, 15 nt, Mycobacterium avium subsp. paratuberculosis
cacucggcgaugcgc

SEQ ID NO: 2922422 - RNA, 22 nt, Mycobacterium avium subsp. paratuberculosis
cacucgggaaaugcgucggcag

SEQ ID NO: 2922423 - RNA, 17 nt, Mycobacterium avium subsp. paratuberculosis
cacucgggcggccgcgg

SEQ ID NO: 2922424 - RNA, 16 nt, Mycobacterium avium subsp. paratuberculosis
cacucggucaccggug

SEQ ID NO: 2922425 - RNA, 18 nt, Mycobacterium avium subsp. paratuberculosis
cacucggucaccgguguc

SEQ ID NO: 2922426 - RNA, 11 nt, Mycobacterium avium subsp. paratuberculosis
cacucgucgau

SEQ ID NO: 2922427 - RNA, 16 nt, Mycobacterium avium subsp. paratuberculosis
cacucgucgaugucga

SEQ ID NO: 2922428 - RNA, 13 nt, Mycobacterium avium subsp. paratuberculosis
cacucgucggcgg

SEQ ID NO: 2922429 - RNA, 14 nt, Mycobacterium avium subsp. paratuberculosis
cacucgucggcggu

SEQ ID NO: 2922430 - RNA, 15 nt, Mycobacterium avium subsp. paratuberculosis
cacucgucggcgguu

SEQ ID NO: 2922431 - RNA, 15 nt, Mycobacterium avium subsp. paratuberculosis
cacucgucguggcgg

SEQ ID NO: 2922432 - RNA, 18 nt, Mycobacterium avium subsp. paratuberculosis
cacucgucguggcggugc

SEQ ID NO: 2922433 - RNA, 14 nt, Mycobacterium avium subsp. paratuberculosis
cagacaggccggcc

SEQ ID NO: 2922434 - RNA, 16 nt, Mycobacterium avium subsp. paratuberculosis
cagacaggccggccgc

SEQ ID NO: 2922435 - RNA, 16 nt, Mycobacterium avium subsp. paratuberculosis
cagaccacaagggcca

SEQ ID NO: 2922436 - RNA, 22 nt, Mycobacterium avium subsp. paratuberculosis
cagaccacaagggccaccgggc

SEQ ID NO: 2922437 - RNA, 14 nt, Mycobacterium avium subsp. paratuberculosis
cagaccauggcgcg

SEQ ID NO: 2922438 - RNA, 16 nt, Mycobacterium avium subsp. paratuberculosis
cagaccauggcgcggc

SEQ ID NO: 2922439 - RNA, 18 nt, Mycobacterium avium subsp. paratuberculosis
cagaccauggcgcggcgg

SEQ ID NO: 2922440 - RNA, 13 nt, Mycobacterium avium subsp. paratuberculosis
cagacccagcagc

SEQ ID NO: 2922441 - RNA, 17 nt, Mycobacterium avium subsp. paratuberculosis
cagacccagcagcggcc

SEQ ID NO: 2922442 - RNA, 20 nt, Mycobacterium avium subsp. paratuberculosis
cagacccagcagcggccggc

SEQ ID NO: 2922443 - RNA, 14 nt, Mycobacterium avium subsp. paratuberculosis
cagacccagcaucg

SEQ ID NO: 2922444 - RNA, 15 nt, Mycobacterium avium subsp. paratuberculosis
cagacccagcaucgc

SEQ ID NO: 2922445 - RNA, 19 nt, Mycobacterium avium subsp. paratuberculosis
cagacccagcaucgccgcg

SEQ ID NO: 2922446 - RNA, 14 nt, Mycobacterium avium subsp. paratuberculosis
cagacccagcguca

SEQ ID NO: 2922447 - RNA, 14 nt, Mycobacterium avium subsp. paratuberculosis
cagaccccacaccu

SEQ ID NO: 2922448 - RNA, 17 nt, Mycobacterium avium subsp. paratuberculosis
cagaccccacaccuucg

SEQ ID NO: 2922449 - RNA, 23 nt, Mycobacterium avium subsp. paratuberculosis
cagaccccacaccuucgcggucg

SEQ ID NO: 2922450 - RNA, 16 nt, Mycobacterium avium subsp. paratuberculosis
cagacccccagcagcg

SEQ ID NO: 2922451 - RNA, 13 nt, Mycobacterium avium subsp. paratuberculosis
cagaccccggcgu

SEQ ID NO: 2922452 - RNA, 17 nt, Mycobacterium avium subsp. paratuberculosis
cagaccccggcguccag

SEQ ID NO: 2922453 - RNA, 17 nt, Mycobacterium avium subsp. paratuberculosis
cagaccccguaccagcg

SEQ ID NO: 2922454 - RNA, 19 nt, Mycobacterium avium subsp. paratuberculosis
cagaccccguaccagcgcu

SEQ ID NO: 2922455 - RNA, 16 nt, Mycobacterium avium subsp. paratuberculosis
cagacccgacaguccg

SEQ ID NO: 2922456 - RNA, 17 nt, Mycobacterium avium subsp. paratuberculosis
cagacccgacaguccga

SEQ ID NO: 2922457 - RNA, 14 nt, Mycobacterium avium subsp. paratuberculosis
cagacccgacggga

SEQ ID NO: 2922458 - RNA, 18 nt, Mycobacterium avium subsp. paratuberculosis
cagacccgacgggaacuc

SEQ ID NO: 2922459 - RNA, 16 nt, Mycobacterium avium subsp. paratuberculosis
cagaccgaacccgggc

SEQ ID NO: 2922460 - RNA, 22 nt, Mycobacterium avium subsp. paratuberculosis
cagaccgaacccgggcgcgccc

SEQ ID NO: 2922461 - RNA, 21 nt, Mycobacterium avium subsp. paratuberculosis
cagaccgaacgucacggcgag

SEQ ID NO: 2922462 - RNA, 21 nt, Mycobacterium avium subsp. paratuberculosis
cagaccgaagaucaccgcgac

SEQ ID NO: 2922463 - RNA, 12 nt, Mycobacterium avium subsp. paratuberculosis
cagaccgcgauc

SEQ ID NO: 2922464 - RNA, 19 nt, Mycobacterium avium subsp. paratuberculosis
cagaccgcgaucagcccca

SEQ ID NO: 2922465 - RNA, 16 nt, Mycobacterium avium subsp. paratuberculosis
cagaccggccggggcg

SEQ ID NO: 2922466 - RNA, 19 nt, Mycobacterium avium subsp. paratuberculosis
cagaccggccggggcgggc

SEQ ID NO: 2922467 - RNA, 21 nt, Mycobacterium avium subsp. paratuberculosis
cagaccggcgaagcuaaaccc

SEQ ID NO: 2922468 - RNA, 14 nt, Mycobacterium avium subsp. paratuberculosis
cagaccggcggcga

SEQ ID NO: 2922469 - RNA, 16 nt, Mycobacterium avium subsp. paratuberculosis
cagaccggcggcgauc

SEQ ID NO: 2922470 - RNA, 20 nt, Mycobacterium avium subsp. paratuberculosis
cagaccggcggcgaucggcg

SEQ ID NO: 2922471 - RNA, 20 nt, Mycobacterium avium subsp. paratuberculosis
cagaccggguuugaggccca

SEQ ID NO: 2922472 - RNA, 17 nt, Mycobacterium avium subsp. paratuberculosis
cagaccggugagcaccg

SEQ ID NO: 2922473 - RNA, 18 nt, Mycobacterium avium subsp. paratuberculosis
cagaccggugagcaccgg

SEQ ID NO: 2922474 - RNA, 23 nt, Mycobacterium avium subsp. paratuberculosis
cagaccggugagcaccgggaaca

SEQ ID NO: 2922475 - RNA, 14 nt, Mycobacterium avium subsp. paratuberculosis
cagaccgguggcga

SEQ ID NO: 2922476 - RNA, 19 nt, Mycobacterium avium subsp. paratuberculosis
cagaccgguugcggcgaac

SEQ ID NO: 2922477 - RNA, 22 nt, Mycobacterium avium subsp. paratuberculosis
cagaccgguugcggcgaacgcg

SEQ ID NO: 2922478 - RNA, 19 nt, Mycobacterium avium subsp. paratuberculosis
cagaccguccgguucggcg

SEQ ID NO: 2922479 - RNA, 22 nt, Mycobacterium avium subsp. paratuberculosis
cagaccguccgguucggcggca

SEQ ID NO: 2922480 - RNA, 13 nt, Mycobacterium avium subsp. paratuberculosis
cagaccguggagg

SEQ ID NO: 2922481 - RNA, 21 nt, Mycobacterium avium subsp. paratuberculosis
cagaccguggaggacgaggcc

SEQ ID NO: 2922482 - RNA, 19 nt, Mycobacterium avium subsp. paratuberculosis
cagaccgugugccagcccg

SEQ ID NO: 2922483 - RNA, 20 nt, Mycobacterium avium subsp. paratuberculosis
cagaccguucuccgaggcgu

SEQ ID NO: 2922484 - RNA, 21 nt, Mycobacterium avium subsp. paratuberculosis
cagaccucgccgacggugucc

SEQ ID NO: 2922485 - RNA, 16 nt, Mycobacterium avium subsp. paratuberculosis
cagacgaacgcggccg

SEQ ID NO: 2922486 - RNA, 18 nt, Mycobacterium avium subsp. paratuberculosis
cagacgaacgcggccgcc

SEQ ID NO: 2922487 - RNA, 18 nt, Mycobacterium avium subsp. paratuberculosis
cagacgaaguagaagauc

SEQ ID NO: 2922488 - RNA, 17 nt, Mycobacterium avium subsp. paratuberculosis
cagacgaugggccgccc

SEQ ID NO: 2922489 - RNA, 21 nt, Mycobacterium avium subsp. paratuberculosis
cagacgaugggccgcccgcug

SEQ ID NO: 2922490 - RNA, 16 nt, Mycobacterium avium subsp. paratuberculosis
cagacgaugucgucgc

SEQ ID NO: 2922491 - RNA, 16 nt, Mycobacterium avium subsp. paratuberculosis
cagacgauuugggcgg

SEQ ID NO: 2922492 - RNA, 20 nt, Mycobacterium avium subsp. paratuberculosis
cagacgauuugggcgguccg

SEQ ID NO: 2922493 - RNA, 19 nt, Mycobacterium avium subsp. paratuberculosis
cagacgcaaaagccccgcg

SEQ ID NO: 2922494 - RNA, 20 nt, Mycobacterium avium subsp. paratuberculosis
cagacgcaaaagccccgcga

SEQ ID NO: 2922495 - RNA, 19 nt, Mycobacterium avium subsp. paratuberculosis
cagacgcgaaagcacccga

SEQ ID NO: 2922496 - RNA, 20 nt, Mycobacterium avium subsp. paratuberculosis
cagacgcgaaagcacccgac

SEQ ID NO: 2922497 - RNA, 22 nt, Mycobacterium avium subsp. paratuberculosis
cagacgcgaaagcacccgacac

SEQ ID NO: 2922498 - RNA, 16 nt, Mycobacterium avium subsp. paratuberculosis
cagacgcgcaccgcca

SEQ ID NO: 2922499 - RNA, 19 nt, Mycobacterium avium subsp. paratuberculosis
cagacgcgggcgcccagca

SEQ ID NO: 2922500 - RNA, 20 nt, Mycobacterium avium subsp. paratuberculosis
cagacgguaugcccgccgcg

SEQ ID NO: 2922501 - RNA, 22 nt, Mycobacterium avium subsp. paratuberculosis
cagacgguaugcccgccgcguc

SEQ ID NO: 2922502 - RNA, 16 nt, Mycobacterium avium subsp. paratuberculosis
cagacggucuuggcgu

SEQ ID NO: 2922503 - RNA, 21 nt, Mycobacterium avium subsp. paratuberculosis
cagacgguggggcuggccgca

SEQ ID NO: 2922504 - RNA, 16 nt, Mycobacterium avium subsp. paratuberculosis
cagacgguuccaccgg

SEQ ID NO: 2922505 - RNA, 19 nt, Mycobacterium avium subsp. paratuberculosis
cagacgguuccaccggucg

SEQ ID NO: 2922506 - RNA, 15 nt, Mycobacterium avium subsp. paratuberculosis
cagacguagcaccag

SEQ ID NO: 2922507 - RNA, 22 nt, Mycobacterium avium subsp. paratuberculosis
cagacguagcaccagucggcca

SEQ ID NO: 2922508 - RNA, 13 nt, Mycobacterium avium subsp. paratuberculosis
cagacguccagcg

SEQ ID NO: 2922509 - RNA, 19 nt, Mycobacterium avium subsp. paratuberculosis
cagacguccagcgccgcca

SEQ ID NO: 2922510 - RNA, 23 nt, Mycobacterium avium subsp. paratuberculosis
cagacgucggcguacugcgcgac

SEQ ID NO: 2922511 - RNA, 19 nt, Mycobacterium avium subsp. paratuberculosis
cagacgugacgugccccuc

SEQ ID NO: 2922512 - RNA, 17 nt, Mycobacterium avium subsp. paratuberculosis
cagacguguggcacccg

SEQ ID NO: 2922513 - RNA, 18 nt, Mycobacterium avium subsp. paratuberculosis
cagacguguggcacccgg

SEQ ID NO: 2922514 - RNA, 21 nt, Mycobacterium avium subsp. paratuberculosis
cagacguuuccguccggcgac

SEQ ID NO: 2922515 - RNA, 16 nt, Mycobacterium avium subsp. paratuberculosis
cagacucacggcggca

SEQ ID NO: 2922516 - RNA, 22 nt, Mycobacterium avium subsp. paratuberculosis
cagacucacggcggcagcgcgg

SEQ ID NO: 2922517 - RNA, 18 nt, Mycobacterium avium subsp. paratuberculosis
cagaucguguccgcgccg

SEQ ID NO: 2922518 - RNA, 19 nt, Mycobacterium avium subsp. paratuberculosis
cagaucguguccgcgccgg

SEQ ID NO: 2922519 - RNA, 22 nt, Mycobacterium avium subsp. paratuberculosis
cagaucguguccgcgccggcgc

SEQ ID NO: 2922520 - RNA, 23 nt, Mycobacterium avium subsp. paratuberculosis
cagaucguugaugucgguggugu

SEQ ID NO: 2922521 - RNA, 23 nt, Mycobacterium avium subsp. paratuberculosis
cagaucguugggcaugucgccga

SEQ ID NO: 2922522 - RNA, 16 nt, Mycobacterium avium subsp. paratuberculosis
cagaucuccgccuucg

SEQ ID NO: 2922523 - RNA, 15 nt, Mycobacterium avium subsp. paratuberculosis
cagaucugucuucgc

SEQ ID NO: 2922524 - RNA, 19 nt, Mycobacterium avium subsp. paratuberculosis
cagaucugucuucgcgguc

SEQ ID NO: 2922525 - RNA, 24 nt, Mycobacterium avium subsp. paratuberculosis
cagaugaccggccugcagcgcggu

SEQ ID NO: 2922526 - RNA, 23 nt, Mycobacterium avium subsp. paratuberculosis
cagaugaugccgucacugucggc

SEQ ID NO: 2922527 - RNA, 16 nt, Mycobacterium avium subsp. paratuberculosis
cagaugcaccucgccc

SEQ ID NO: 2922528 - RNA, 23 nt, Mycobacterium avium subsp. paratuberculosis
cagaugcaccucgcccugcagcc

SEQ ID NO: 2922529 - RNA, 22 nt, Mycobacterium avium subsp. paratuberculosis
cagaugccagacgaacgcggcc

SEQ ID NO: 2922530 - RNA, 15 nt, Mycobacterium avium subsp. paratuberculosis
cagaugcccagcggc

SEQ ID NO: 2922531 - RNA, 14 nt, Mycobacterium avium subsp. paratuberculosis
cagaugcccgcccc

SEQ ID NO: 2922532 - RNA, 19 nt, Mycobacterium avium subsp. paratuberculosis
cagaugcccgccccgcccg

SEQ ID NO: 2922533 - RNA, 21 nt, Mycobacterium avium subsp. paratuberculosis
cagaugcccgccccgcccggc

SEQ ID NO: 2922534 - RNA, 22 nt, Mycobacterium avium subsp. paratuberculosis
cagaugcccgccccgcccggcg

SEQ ID NO: 2922535 - RNA, 23 nt, Mycobacterium avium subsp. paratuberculosis
cagaugcccgccccgcccggcgg

SEQ ID NO: 2922536 - RNA, 13 nt, Mycobacterium avium subsp. paratuberculosis
cagaugccgccgc

SEQ ID NO: 2922537 - RNA, 15 nt, Mycobacterium avium subsp. paratuberculosis
cagaugccgccgcca

SEQ ID NO: 2922538 - RNA, 18 nt, Mycobacterium avium subsp. paratuberculosis
cagaugccgccgccagcg

SEQ ID NO: 2922539 - RNA, 21 nt, Mycobacterium avium subsp. paratuberculosis
cagaugccgcucggcgcucca

SEQ ID NO: 2922540 - RNA, 14 nt, Mycobacterium avium subsp. paratuberculosis
cagaugccggugca

SEQ ID NO: 2922541 - RNA, 17 nt, Mycobacterium avium subsp. paratuberculosis
cagaugccugcccagcg

SEQ ID NO: 2922542 - RNA, 19 nt, Mycobacterium avium subsp. paratuberculosis
cagaugccugcccagcggc

SEQ ID NO: 2922543 - RNA, 23 nt, Mycobacterium avium subsp. paratuberculosis
cagaugccugcccagcggcacgg

SEQ ID NO: 2922544 - RNA, 16 nt, Mycobacterium avium subsp. paratuberculosis
cagaugcgccucgauc

SEQ ID NO: 2922545 - RNA, 16 nt, Mycobacterium avium subsp. paratuberculosis
cagaugcgcgucgcgg

SEQ ID NO: 2922546 - RNA, 22 nt, Mycobacterium avium subsp. paratuberculosis
cagaugcgcgucgcggcgcgga

SEQ ID NO: 2922547 - RNA, 14 nt, Mycobacterium avium subsp. paratuberculosis
cagaugcggcacca

SEQ ID NO: 2922548 - RNA, 21 nt, Mycobacterium avium subsp. paratuberculosis
cagaugcgugcgguggucggc

SEQ ID NO: 2922549 - RNA, 15 nt, Mycobacterium avium subsp. paratuberculosis
cagaugcucgucggu

SEQ ID NO: 2922550 - RNA, 14 nt, Mycobacterium avium subsp. paratuberculosis
cagauggucgccga

SEQ ID NO: 2922551 - RNA, 21 nt, Mycobacterium avium subsp. paratuberculosis
cagauggucgggacgucggcg

SEQ ID NO: 2922552 - RNA, 15 nt, Mycobacterium avium subsp. paratuberculosis
cagauggucucgauc

SEQ ID NO: 2922553 - RNA, 17 nt, Mycobacterium avium subsp. paratuberculosis
cagaugucgcguucccg

SEQ ID NO: 2922554 - RNA, 22 nt, Mycobacterium avium subsp. paratuberculosis
cagaugucgcguucccgggccc

SEQ ID NO: 2922555 - RNA, 19 nt, Mycobacterium avium subsp. paratuberculosis
cagaugucgguggccuugg

SEQ ID NO: 2922556 - RNA, 18 nt, Mycobacterium avium subsp. paratuberculosis
cagauucuucuucagccc

SEQ ID NO: 2922557 - RNA, 17 nt, Mycobacterium avium subsp. paratuberculosis
cagcaaacccagcacca

SEQ ID NO: 2922558 - RNA, 22 nt, Mycobacterium avium subsp. paratuberculosis
cagcaaacccagcaccaacagc

SEQ ID NO: 2922559 - RNA, 13 nt, Mycobacterium avium subsp. paratuberculosis
cagcaaaccgacc

SEQ ID NO: 2922560 - RNA, 15 nt, Mycobacterium avium subsp. paratuberculosis
cagcaaaccgaccgc

SEQ ID NO: 2922561 - RNA, 15 nt, Mycobacterium avium subsp. paratuberculosis
cagcaacaccagcug

SEQ ID NO: 2922562 - RNA, 16 nt, Mycobacterium avium subsp. paratuberculosis
cagcaacacccagccg

SEQ ID NO: 2922563 - RNA, 22 nt, Mycobacterium avium subsp. paratuberculosis
cagcaacaccuuucggccgcgg

SEQ ID NO: 2922564 - RNA, 16 nt, Mycobacterium avium subsp. paratuberculosis
cagcaacagcagcggc

SEQ ID NO: 2922565 - RNA, 17 nt, Mycobacterium avium subsp. paratuberculosis
cagcaacagcagcggca

SEQ ID NO: 2922566 - RNA, 17 nt, Mycobacterium avium subsp. paratuberculosis
cagcaaccccgcggugc

SEQ ID NO: 2922567 - RNA, 19 nt, Mycobacterium avium subsp. paratuberculosis
cagcaacccgaaagccccc

SEQ ID NO: 2922568 - RNA, 22 nt, Mycobacterium avium subsp. paratuberculosis
cagcaaccgcgaaaacagcgac

SEQ ID NO: 2922569 - RNA, 16 nt, Mycobacterium avium subsp. paratuberculosis
cagcaaccggaauggc

SEQ ID NO: 2922570 - RNA, 23 nt, Mycobacterium avium subsp. paratuberculosis
cagcaaccggaauggcagcagcc

SEQ ID NO: 2922571 - RNA, 14 nt, Mycobacterium avium subsp. paratuberculosis
cagcaaccggcggc

SEQ ID NO: 2922572 - RNA, 18 nt, Mycobacterium avium subsp. paratuberculosis
cagcaaccggcggcuggg

SEQ ID NO: 2922573 - RNA, 13 nt, Mycobacterium avium subsp. paratuberculosis
cagcaaccggguc

SEQ ID NO: 2922574 - RNA, 18 nt, Mycobacterium avium subsp. paratuberculosis
cagcaacgaaucucgcgu

SEQ ID NO: 2922575 - RNA, 20 nt, Mycobacterium avium subsp. paratuberculosis
cagcaacgacccggccaccg

SEQ ID NO: 2922576 - RNA, 23 nt, Mycobacterium avium subsp. paratuberculosis
cagcaacgacccggccaccgccg

SEQ ID NO: 2922577 - RNA, 14 nt, Mycobacterium avium subsp. paratuberculosis
cagcaacgccaggg

SEQ ID NO: 2922578 - RNA, 14 nt, Mycobacterium avium subsp. paratuberculosis
cagcaacggcggcg

SEQ ID NO: 2922579 - RNA, 19 nt, Mycobacterium avium subsp. paratuberculosis
cagcaacggcggcggcacc

SEQ ID NO: 2922580 - RNA, 22 nt, Mycobacterium avium subsp. paratuberculosis
cagcaacgguacgugcgccggc

SEQ ID NO: 2922581 - RNA, 22 nt, Mycobacterium avium subsp. paratuberculosis
cagcaacucgcgcucccggcgc

SEQ ID NO: 2922582 - RNA, 20 nt, Mycobacterium avium subsp. paratuberculosis
cagcaauccgcugaacgggc

SEQ ID NO: 2922583 - RNA, 23 nt, Mycobacterium avium subsp. paratuberculosis
cagcaauccgcugaacgggcagc

SEQ ID NO: 2922584 - RNA, 17 nt, Mycobacterium avium subsp. paratuberculosis
cagcaauugacgccgac

SEQ ID NO: 2922585 - RNA, 18 nt, Mycobacterium avium subsp. paratuberculosis
cagcaauugacgccgaca

SEQ ID NO: 2922586 - RNA, 13 nt, Mycobacterium avium subsp. paratuberculosis
cagcacaaaaggg

SEQ ID NO: 2922587 - RNA, 17 nt, Mycobacterium avium subsp. paratuberculosis
cagcacaaaagggccca

SEQ ID NO: 2922588 - RNA, 12 nt, Mycobacterium avium subsp. paratuberculosis
cagcacacccuc

SEQ ID NO: 2922589 - RNA, 17 nt, Mycobacterium avium subsp. paratuberculosis
cagcacacccucgaccc

SEQ ID NO: 2922590 - RNA, 14 nt, Mycobacterium avium subsp. paratuberculosis
cagcacaccggauc

SEQ ID NO: 2922591 - RNA, 14 nt, Mycobacterium avium subsp. paratuberculosis
cagcacaccggcau

SEQ ID NO: 2922592 - RNA, 18 nt, Mycobacterium avium subsp. paratuberculosis
cagcacaccuuccaccac

SEQ ID NO: 2922593 - RNA, 21 nt, Mycobacterium avium subsp. paratuberculosis
cagcacaccuuccaccaccgc

SEQ ID NO: 2922594 - RNA, 22 nt, Mycobacterium avium subsp. paratuberculosis
cagcacaccuuccaccaccgcg

SEQ ID NO: 2922595 - RNA, 15 nt, Mycobacterium avium subsp. paratuberculosis
cagcacagccgucgc

SEQ ID NO: 2922596 - RNA, 18 nt, Mycobacterium avium subsp. paratuberculosis
cagcacagccgucgcacu

SEQ ID NO: 2922597 - RNA, 15 nt, Mycobacterium avium subsp. paratuberculosis
cagcacagcgaggcg

SEQ ID NO: 2922598 - RNA, 16 nt, Mycobacterium avium subsp. paratuberculosis
cagcacagcgaggcga

SEQ ID NO: 2922599 - RNA, 18 nt, Mycobacterium avium subsp. paratuberculosis
cagcacagcgaggcgacg

SEQ ID NO: 2922600 - RNA, 15 nt, Mycobacterium avium subsp. paratuberculosis
cagcacauagcgcag

SEQ ID NO: 2922601 - RNA, 23 nt, Mycobacterium avium subsp. paratuberculosis
cagcacccggcccacgccgucgu

SEQ ID NO: 2922602 - RNA, 14 nt, Mycobacterium avium subsp. paratuberculosis
cagcacccggcccc

SEQ ID NO: 2922603 - RNA, 13 nt, Mycobacterium avium subsp. paratuberculosis
cagcacccgggcc

SEQ ID NO: 2922604 - RNA, 23 nt, Mycobacterium avium subsp. paratuberculosis
cagcacccgggccugcggcggcc

SEQ ID NO: 2922605 - RNA, 12 nt, Mycobacterium avium subsp. paratuberculosis
cagcacccgggu

SEQ ID NO: 2922606 - RNA, 15 nt, Mycobacterium avium subsp. paratuberculosis
cagcacccgggugau

SEQ ID NO: 2922607 - RNA, 22 nt, Mycobacterium avium subsp. paratuberculosis
cagcacccgggugaucaacgcg

SEQ ID NO: 2922608 - RNA, 19 nt, Mycobacterium avium subsp. paratuberculosis
cagcacccggucgccggug

SEQ ID NO: 2922609 - RNA, 14 nt, Mycobacterium avium subsp. paratuberculosis
cagcacccgguucc

SEQ ID NO: 2922610 - RNA, 21 nt, Mycobacterium avium subsp. paratuberculosis
cagcacccgguuccaccgggc

SEQ ID NO: 2922611 - RNA, 22 nt, Mycobacterium avium subsp. paratuberculosis
cagcacccgguuccaccgggcc

SEQ ID NO: 2922612 - RNA, 18 nt, Mycobacterium avium subsp. paratuberculosis
cagcaccgaaccggcggg

SEQ ID NO: 2922613 - RNA, 23 nt, Mycobacterium avium subsp. paratuberculosis
cagcaccgaaucgccgagcucga

SEQ ID NO: 2922614 - RNA, 14 nt, Mycobacterium avium subsp. paratuberculosis
cagcaccgacagcu

SEQ ID NO: 2922615 - RNA, 15 nt, Mycobacterium avium subsp. paratuberculosis
cagcaccgacgcggc

SEQ ID NO: 2922616 - RNA, 16 nt, Mycobacterium avium subsp. paratuberculosis
cagcaccgacgcggcg

SEQ ID NO: 2922617 - RNA, 17 nt, Mycobacterium avium subsp. paratuberculosis
cagcaccgacgcggcga

SEQ ID NO: 2922618 - RNA, 19 nt, Mycobacterium avium subsp. paratuberculosis
cagcaccgacgcggcgacc

SEQ ID NO: 2922619 - RNA, 20 nt, Mycobacterium avium subsp. paratuberculosis
cagcaccgacgcggcgacca

SEQ ID NO: 2922620 - RNA, 23 nt, Mycobacterium avium subsp. paratuberculosis
cagcaccgacgcggcgaccacca

SEQ ID NO: 2922621 - RNA, 16 nt, Mycobacterium avium subsp. paratuberculosis
cagcaccgacuccucc

SEQ ID NO: 2922622 - RNA, 22 nt, Mycobacterium avium subsp. paratuberculosis
cagcaccgacuccuccggcccg

SEQ ID NO: 2922623 - RNA, 23 nt, Mycobacterium avium subsp. paratuberculosis
cagcaccgaguugaucccccgaa

SEQ ID NO: 2922624 - RNA, 22 nt, Mycobacterium avium subsp. paratuberculosis
cagcaccgcaucccccucggcg

SEQ ID NO: 2922625 - RNA, 15 nt, Mycobacterium avium subsp. paratuberculosis
cagcaccgcaugggg

SEQ ID NO: 2922626 - RNA, 16 nt, Mycobacterium avium subsp. paratuberculosis
cagcaccgcauggggc

SEQ ID NO: 2922627 - RNA, 13 nt, Mycobacterium avium subsp. paratuberculosis
cagcaccgccacc

SEQ ID NO: 2922628 - RNA, 14 nt, Mycobacterium avium subsp. paratuberculosis
cagcaccgccaccg

SEQ ID NO: 2922629 - RNA, 19 nt, Mycobacterium avium subsp. paratuberculosis
cagcaccgccaccggcccg

SEQ ID NO: 2922630 - RNA, 14 nt, Mycobacterium avium subsp. paratuberculosis
cagcaccgccacgc

SEQ ID NO: 2922631 - RNA, 18 nt, Mycobacterium avium subsp. paratuberculosis
cagcaccgccacggcgac

SEQ ID NO: 2922632 - RNA, 19 nt, Mycobacterium avium subsp. paratuberculosis
cagcaccgccacggcgacg

SEQ ID NO: 2922633 - RNA, 14 nt, Mycobacterium avium subsp. paratuberculosis
cagcaccgccagca

SEQ ID NO: 2922634 - RNA, 21 nt, Mycobacterium avium subsp. paratuberculosis
cagcaccgccagcauccgcug

SEQ ID NO: 2922635 - RNA, 23 nt, Mycobacterium avium subsp. paratuberculosis
cagcaccgccagcauccgcuggu

SEQ ID NO: 2922636 - RNA, 20 nt, Mycobacterium avium subsp. paratuberculosis
cagcaccgccagcgccggca

SEQ ID NO: 2922637 - RNA, 21 nt, Mycobacterium avium subsp. paratuberculosis
cagcaccgccagcgccggcag

SEQ ID NO: 2922638 - RNA, 15 nt, Mycobacterium avium subsp. paratuberculosis
cagcaccgccaucgc

SEQ ID NO: 2922639 - RNA, 14 nt, Mycobacterium avium subsp. paratuberculosis
cagcaccgccgaca

SEQ ID NO: 2922640 - RNA, 20 nt, Mycobacterium avium subsp. paratuberculosis
cagcaccgccgacaucgccc

SEQ ID NO: 2922641 - RNA, 20 nt, Mycobacterium avium subsp. paratuberculosis
cagcaccgccgagccgucgu

SEQ ID NO: 2922642 - RNA, 13 nt, Mycobacterium avium subsp. paratuberculosis
cagcaccgccgcg

SEQ ID NO: 2922643 - RNA, 14 nt, Mycobacterium avium subsp. paratuberculosis
cagcaccgccgcgg

SEQ ID NO: 2922644 - RNA, 18 nt, Mycobacterium avium subsp. paratuberculosis
cagcaccgccgcggccgc

SEQ ID NO: 2922645 - RNA, 15 nt, Mycobacterium avium subsp. paratuberculosis
cagcaccgccgcggg

SEQ ID NO: 2922646 - RNA, 17 nt, Mycobacterium avium subsp. paratuberculosis
cagcaccgccgcgggcu

SEQ ID NO: 2922647 - RNA, 13 nt, Mycobacterium avium subsp. paratuberculosis
cagcaccgccucg

SEQ ID NO: 2922648 - RNA, 14 nt, Mycobacterium avium subsp. paratuberculosis
cagcaccgccucgg

SEQ ID NO: 2922649 - RNA, 20 nt, Mycobacterium avium subsp. paratuberculosis
cagcaccgccucggccaccu

SEQ ID NO: 2922650 - RNA, 22 nt, Mycobacterium avium subsp. paratuberculosis
cagcaccgcgaacaucgccagc

SEQ ID NO: 2922651 - RNA, 23 nt, Mycobacterium avium subsp. paratuberculosis
cagcaccgcgacccaggccgccg

SEQ ID NO: 2922652 - RNA, 16 nt, Mycobacterium avium subsp. paratuberculosis
cagcaccgcgaccggu

SEQ ID NO: 2922653 - RNA, 13 nt, Mycobacterium avium subsp. paratuberculosis
cagcaccgcgacg

SEQ ID NO: 2922654 - RNA, 15 nt, Mycobacterium avium subsp. paratuberculosis
cagcaccgcgacgau

SEQ ID NO: 2922655 - RNA, 15 nt, Mycobacterium avium subsp. paratuberculosis
cagcaccgcgcggcg

SEQ ID NO: 2922656 - RNA, 16 nt, Mycobacterium avium subsp. paratuberculosis
cagcaccgcgcggcgg

SEQ ID NO: 2922657 - RNA, 17 nt, Mycobacterium avium subsp. paratuberculosis
cagcaccgcgcggcggu

SEQ ID NO: 2922658 - RNA, 23 nt, Mycobacterium avium subsp. paratuberculosis
cagcaccgcgcggcggugcucgc

SEQ ID NO: 2922659 - RNA, 13 nt, Mycobacterium avium subsp. paratuberculosis
cagcaccgcggcc

SEQ ID NO: 2922660 - RNA, 17 nt, Mycobacterium avium subsp. paratuberculosis
cagcaccgcggccgucg

SEQ ID NO: 2922661 - RNA, 19 nt, Mycobacterium avium subsp. paratuberculosis
cagcaccgcggccgucgcg

SEQ ID NO: 2922662 - RNA, 16 nt, Mycobacterium avium subsp. paratuberculosis
cagcaccgcggcgauc

SEQ ID NO: 2922663 - RNA, 17 nt, Mycobacterium avium subsp. paratuberculosis
cagcaccgcggcgaucg

SEQ ID NO: 2922664 - RNA, 12 nt, Mycobacterium avium subsp. paratuberculosis
cagcaccgcguc

SEQ ID NO: 2922665 - RNA, 17 nt, Mycobacterium avium subsp. paratuberculosis
cagcaccgcgucggcgc

SEQ ID NO: 2922666 - RNA, 21 nt, Mycobacterium avium subsp. paratuberculosis
cagcaccgcgucggcgcuggc

SEQ ID NO: 2922667 - RNA, 14 nt, Mycobacterium avium subsp. paratuberculosis
cagcaccgcguugu

SEQ ID NO: 2922668 - RNA, 19 nt, Mycobacterium avium subsp. paratuberculosis
cagcaccggaugcucaccg

SEQ ID NO: 2922669 - RNA, 13 nt, Mycobacterium avium subsp. paratuberculosis
cagcaccggcacc

SEQ ID NO: 2922670 - RNA, 14 nt, Mycobacterium avium subsp. paratuberculosis
cagcaccggcaccg

SEQ ID NO: 2922671 - RNA, 16 nt, Mycobacterium avium subsp. paratuberculosis
cagcaccggcaccgcc

SEQ ID NO: 2922672 - RNA, 17 nt, Mycobacterium avium subsp. paratuberculosis
cagcaccggcaccgcca

SEQ ID NO: 2922673 - RNA, 20 nt, Mycobacterium avium subsp. paratuberculosis
cagcaccggcaccgcggcga

SEQ ID NO: 2922674 - RNA, 22 nt, Mycobacterium avium subsp. paratuberculosis
cagcaccggcaccgcggcgaug

SEQ ID NO: 2922675 - RNA, 13 nt, Mycobacterium avium subsp. paratuberculosis
cagcaccggcagc

SEQ ID NO: 2922676 - RNA, 14 nt, Mycobacterium avium subsp. paratuberculosis
cagcaccggcagca

SEQ ID NO: 2922677 - RNA, 13 nt, Mycobacterium avium subsp. paratuberculosis
cagcaccggcaug

SEQ ID NO: 2922678 - RNA, 15 nt, Mycobacterium avium subsp. paratuberculosis
cagcaccggccggau

SEQ ID NO: 2922679 - RNA, 12 nt, Mycobacterium avium subsp. paratuberculosis
cagcaccggcgc

SEQ ID NO: 2922680 - RNA, 14 nt, Mycobacterium avium subsp. paratuberculosis
cagcaccggcgcca

SEQ ID NO: 2922681 - RNA, 17 nt, Mycobacterium avium subsp. paratuberculosis
cagcaccggcgccauga

SEQ ID NO: 2922682 - RNA, 14 nt, Mycobacterium avium subsp. paratuberculosis
cagcaccggcgccc

SEQ ID NO: 2922683 - RNA, 14 nt, Mycobacterium avium subsp. paratuberculosis
cagcaccggcgccu

SEQ ID NO: 2922684 - RNA, 13 nt, Mycobacterium avium subsp. paratuberculosis
cagcaccggcgcg

SEQ ID NO: 2922685 - RNA, 16 nt, Mycobacterium avium subsp. paratuberculosis
cagcaccggcgcgccg

SEQ ID NO: 2922686 - RNA, 11 nt, Mycobacterium avium subsp. paratuberculosis
cagcacgccgg

SEQ ID NO: 2922687 - RNA, 12 nt, Mycobacterium avium subsp. paratuberculosis
cagcacgccggc

SEQ ID NO: 2922688 - RNA, 19 nt, Mycobacterium avium subsp. paratuberculosis
cagcacgccggccggcgug

SEQ ID NO: 2922689 - RNA, 16 nt, Mycobacterium avium subsp. paratuberculosis
cagcacgccggucagc

SEQ ID NO: 2922690 - RNA, 23 nt, Mycobacterium avium subsp. paratuberculosis
cagcacgccguccuuggccgcca

SEQ ID NO: 2922691 - RNA, 14 nt, Mycobacterium avium subsp. paratuberculosis
cagcacgccguuga

SEQ ID NO: 2922692 - RNA, 16 nt, Mycobacterium avium subsp. paratuberculosis
cagcacgccguugacc

SEQ ID NO: 2922693 - RNA, 22 nt, Mycobacterium avium subsp. paratuberculosis
cagcacgccguugaccccgacg

SEQ ID NO: 2922694 - RNA, 12 nt, Mycobacterium avium subsp. paratuberculosis
cagcacgccuuc

SEQ ID NO: 2922695 - RNA, 13 nt, Mycobacterium avium subsp. paratuberculosis
cagcacgccuucc

SEQ ID NO: 2922696 - RNA, 22 nt, Mycobacterium avium subsp. paratuberculosis
cagcacgccuuccacgaccugg

SEQ ID NO: 2922697 - RNA, 22 nt, Mycobacterium avium subsp. paratuberculosis
cagcacgcugaagcccaccgcc

SEQ ID NO: 2922698 - RNA, 24 nt, Mycobacterium avium subsp. paratuberculosis
cagcacgcugaagcccaccgccgu

SEQ ID NO: 2922699 - RNA, 19 nt, Mycobacterium avium subsp. paratuberculosis
cagcacgcugaucaccacg

SEQ ID NO: 2922700 - RNA, 20 nt, Mycobacterium avium subsp. paratuberculosis
cagcacgcugaucaccacgg

SEQ ID NO: 2922701 - RNA, 21 nt, Mycobacterium avium subsp. paratuberculosis
cagcacggaacccaaggcgga

SEQ ID NO: 2922702 - RNA, 14 nt, Mycobacterium avium subsp. paratuberculosis
cagcacggcaaugg

SEQ ID NO: 2922703 - RNA, 20 nt, Mycobacterium avium subsp. paratuberculosis
cagcacggcaaugguugcgg

SEQ ID NO: 2922704 - RNA, 22 nt, Mycobacterium avium subsp. paratuberculosis
cagcacggcauagauaccggcc

SEQ ID NO: 2922705 - RNA, 13 nt, Mycobacterium avium subsp. paratuberculosis
cagcacggcaucg

SEQ ID NO: 2922706 - RNA, 19 nt, Mycobacterium avium subsp. paratuberculosis
cagcacggcaucgauggcg

SEQ ID NO: 2922707 - RNA, 22 nt, Mycobacterium avium subsp. paratuberculosis
cagcacggcaucgauggcgggc

SEQ ID NO: 2922708 - RNA, 14 nt, Mycobacterium avium subsp. paratuberculosis
cagcacggccacca

SEQ ID NO: 2922709 - RNA, 17 nt, Mycobacterium avium subsp. paratuberculosis
cagcacggccaccagca

SEQ ID NO: 2922710 - RNA, 16 nt, Mycobacterium avium subsp. paratuberculosis
cagcacggccacugcc

SEQ ID NO: 2922711 - RNA, 21 nt, Mycobacterium avium subsp. paratuberculosis
cagcacggccacugccccggc

SEQ ID NO: 2922712 - RNA, 16 nt, Mycobacterium avium subsp. paratuberculosis
cagcacggccagccag

SEQ ID NO: 2922713 - RNA, 22 nt, Mycobacterium avium subsp. paratuberculosis
cagcacggccagccagccgccc

SEQ ID NO: 2922714 - RNA, 15 nt, Mycobacterium avium subsp. paratuberculosis
cagcacggccgcggc

SEQ ID NO: 2922715 - RNA, 17 nt, Mycobacterium avium subsp. paratuberculosis
cagcacggccgcggcca

SEQ ID NO: 2922716 - RNA, 14 nt, Mycobacterium avium subsp. paratuberculosis
cagcacggcgacca

SEQ ID NO: 2922717 - RNA, 20 nt, Mycobacterium avium subsp. paratuberculosis
cagcacggcgaccagcgagc

SEQ ID NO: 2922718 - RNA, 16 nt, Mycobacterium avium subsp. paratuberculosis
cagcacggcggcgcug

SEQ ID NO: 2922719 - RNA, 23 nt, Mycobacterium avium subsp. paratuberculosis
cagcacggcggcgugcaccgccc

SEQ ID NO: 2922720 - RNA, 16 nt, Mycobacterium avium subsp. paratuberculosis
cagcacgggcgggcag

SEQ ID NO: 2922721 - RNA, 17 nt, Mycobacterium avium subsp. paratuberculosis
cagcacgggcgggcaga

SEQ ID NO: 2922722 - RNA, 20 nt, Mycobacterium avium subsp. paratuberculosis
cagcacgggcgggcagaugg

SEQ ID NO: 2922723 - RNA, 19 nt, Mycobacterium avium subsp. paratuberculosis
cagcacggggacgcugaac

SEQ ID NO: 2922724 - RNA, 15 nt, Mycobacterium avium subsp. paratuberculosis
cagcacggucccguc

SEQ ID NO: 2922725 - RNA, 11 nt, Mycobacterium avium subsp. paratuberculosis
cagcacgguga

SEQ ID NO: 2922726 - RNA, 22 nt, Mycobacterium avium subsp. paratuberculosis
cagcacggugaugcggguguug

SEQ ID NO: 2922727 - RNA, 18 nt, Mycobacterium avium subsp. paratuberculosis
cagcacggugcguucgcg

SEQ ID NO: 2922728 - RNA, 21 nt, Mycobacterium avium subsp. paratuberculosis
cagcacgucaccgcugaugcc

SEQ ID NO: 2922729 - RNA, 22 nt, Mycobacterium avium subsp. paratuberculosis
cagcacguccccgggcaccccg

SEQ ID NO: 2922730 - RNA, 16 nt, Mycobacterium avium subsp. paratuberculosis
cagcacgucgcggccc

SEQ ID NO: 2922731 - RNA, 15 nt, Mycobacterium avium subsp. paratuberculosis
cagcacgucggggug

SEQ ID NO: 2922732 - RNA, 17 nt, Mycobacterium avium subsp. paratuberculosis
cagcacgucgggguggc

SEQ ID NO: 2922733 - RNA, 20 nt, Mycobacterium avium subsp. paratuberculosis
cagcacgucggucagcgagc

SEQ ID NO: 2922734 - RNA, 22 nt, Mycobacterium avium subsp. paratuberculosis
cagcacgucggucagcgagcgg

SEQ ID NO: 2922735 - RNA, 11 nt, Mycobacterium avium subsp. paratuberculosis
cagcacgucgu

SEQ ID NO: 2922736 - RNA, 21 nt, Mycobacterium avium subsp. paratuberculosis
cagcacgucguaggccauccu

SEQ ID NO: 2922737 - RNA, 14 nt, Mycobacterium avium subsp. paratuberculosis
cagcacgugcccag

SEQ ID NO: 2922738 - RNA, 18 nt, Mycobacterium avium subsp. paratuberculosis
cagcacgugcccagcccg

SEQ ID NO: 2922739 - RNA, 22 nt, Mycobacterium avium subsp. paratuberculosis
cagcacgugcccagcccgcgcg

SEQ ID NO: 2922740 - RNA, 23 nt, Mycobacterium avium subsp. paratuberculosis
cagcacgugcccagcccgcgcga

SEQ ID NO: 2922741 - RNA, 14 nt, Mycobacterium avium subsp. paratuberculosis
cagcacgugcccgc

SEQ ID NO: 2922742 - RNA, 22 nt, Mycobacterium avium subsp. paratuberculosis
cagcacgugcccgccgugcgcc

SEQ ID NO: 2922743 - RNA, 23 nt, Mycobacterium avium subsp. paratuberculosis
cagcacgugcccgccgugcgccc

SEQ ID NO: 2922744 - RNA, 12 nt, Mycobacterium avium subsp. paratuberculosis
cagcacguggcc

SEQ ID NO: 2922745 - RNA, 23 nt, Mycobacterium avium subsp. paratuberculosis
cagcacguguucgggaucggcgc

SEQ ID NO: 2922746 - RNA, 15 nt, Mycobacterium avium subsp. paratuberculosis
cagcacguugugcuc

SEQ ID NO: 2922747 - RNA, 22 nt, Mycobacterium avium subsp. paratuberculosis
cagcacguugugcucgucgaug

SEQ ID NO: 2922748 - RNA, 21 nt, Mycobacterium avium subsp. paratuberculosis
cagcacguugugggcgggcgc

SEQ ID NO: 2922749 - RNA, 22 nt, Mycobacterium avium subsp. paratuberculosis
cagcacguugugggcgggcgcg

SEQ ID NO: 2922750 - RNA, 20 nt, Mycobacterium avium subsp. paratuberculosis
cagcacguuguucaggucga

SEQ ID NO: 2922751 - RNA, 23 nt, Mycobacterium avium subsp. paratuberculosis
cagcacguuguucaggucgaugg

SEQ ID NO: 2922752 - RNA, 15 nt, Mycobacterium avium subsp. paratuberculosis
cagcacugagcggca

SEQ ID NO: 2922753 - RNA, 16 nt, Mycobacterium avium subsp. paratuberculosis
cagcacugagcggcag

SEQ ID NO: 2922754 - RNA, 20 nt, Mycobacterium avium subsp. paratuberculosis
cagcacugagcggcagaagu

SEQ ID NO: 2922755 - RNA, 15 nt, Mycobacterium avium subsp. paratuberculosis
cagcacuucaugguc

SEQ ID NO: 2922756 - RNA, 20 nt, Mycobacterium avium subsp. paratuberculosis
cagcagaaaauagcccagcc

SEQ ID NO: 2922757 - RNA, 17 nt, Mycobacterium avium subsp. paratuberculosis
cagcagaaccagcaccg

SEQ ID NO: 2922758 - RNA, 14 nt, Mycobacterium avium subsp. paratuberculosis
cagcagacccgacg

SEQ ID NO: 2922759 - RNA, 17 nt, Mycobacterium avium subsp. paratuberculosis
cagcagacccgacggga

SEQ ID NO: 2922760 - RNA, 14 nt, Mycobacterium avium subsp. paratuberculosis
cagcagaccgccgg

SEQ ID NO: 2922761 - RNA, 15 nt, Mycobacterium avium subsp. paratuberculosis
cagcagaccgcgauc

SEQ ID NO: 2922762 - RNA, 18 nt, Mycobacterium avium subsp. paratuberculosis
cagcagaccgcgaucagc

SEQ ID NO: 2922763 - RNA, 17 nt, Mycobacterium avium subsp. paratuberculosis
cagcagauacuccucgc

SEQ ID NO: 2922764 - RNA, 19 nt, Mycobacterium avium subsp. paratuberculosis
cagcagauacuccucgcgg

SEQ ID NO: 2922765 - RNA, 22 nt, Mycobacterium avium subsp. paratuberculosis
cagcagauacuccucgcggucu

SEQ ID NO: 2922766 - RNA, 17 nt, Mycobacterium avium subsp. paratuberculosis
cagcagauagcccagcc

SEQ ID NO: 2922767 - RNA, 19 nt, Mycobacterium avium subsp. paratuberculosis
cagcagauagcccagccag

SEQ ID NO: 2922768 - RNA, 23 nt, Mycobacterium avium subsp. paratuberculosis
cagcagauagcccagccagccgg

SEQ ID NO: 2922769 - RNA, 18 nt, Mycobacterium avium subsp. paratuberculosis
cagcagauccucagcagc

SEQ ID NO: 2922770 - RNA, 21 nt, Mycobacterium avium subsp. paratuberculosis
cagcagccgcgccgacgccca

SEQ ID NO: 2922771 - RNA, 16 nt, Mycobacterium avium subsp. paratuberculosis
cagcagccgcgccgcc

SEQ ID NO: 2922772 - RNA, 14 nt, Mycobacterium avium subsp. paratuberculosis
cagcagccgcgcga

SEQ ID NO: 2922773 - RNA, 21 nt, Mycobacterium avium subsp. paratuberculosis
cagcagccgcgcgagcaucac

SEQ ID NO: 2922774 - RNA, 18 nt, Mycobacterium avium subsp. paratuberculosis
cagcagccgcucacacag

SEQ ID NO: 2922775 - RNA, 16 nt, Mycobacterium avium subsp. paratuberculosis
cagcagccgcugcugg

SEQ ID NO: 2922776 - RNA, 17 nt, Mycobacterium avium subsp. paratuberculosis
cagcagccggaaggcca

SEQ ID NO: 2922777 - RNA, 18 nt, Mycobacterium avium subsp. paratuberculosis
cagcagccggaaggccaa

SEQ ID NO: 2922778 - RNA, 15 nt, Mycobacterium avium subsp. paratuberculosis
cagcagccggaccca

SEQ ID NO: 2922779 - RNA, 14 nt, Mycobacterium avium subsp. paratuberculosis
cagcagccggcaga

SEQ ID NO: 2922780 - RNA, 15 nt, Mycobacterium avium subsp. paratuberculosis
cagcagccgggccug

SEQ ID NO: 2922781 - RNA, 16 nt, Mycobacterium avium subsp. paratuberculosis
cagcagccgggccugc

SEQ ID NO: 2922782 - RNA, 14 nt, Mycobacterium avium subsp. paratuberculosis
cagcagccggucga

SEQ ID NO: 2922783 - RNA, 16 nt, Mycobacterium avium subsp. paratuberculosis
cagcagccggucgagg

SEQ ID NO: 2922784 - RNA, 22 nt, Mycobacterium avium subsp. paratuberculosis
cagcagccggucgaggucgccg

SEQ ID NO: 2922785 - RNA, 23 nt, Mycobacterium avium subsp. paratuberculosis
cagcagccggucgaggucgccga

SEQ ID NO: 2922786 - RNA, 16 nt, Mycobacterium avium subsp. paratuberculosis
cagcagcgaacccgcc

SEQ ID NO: 2922787 - RNA, 17 nt, Mycobacterium avium subsp. paratuberculosis
cagcagcgaacccgcca

SEQ ID NO: 2922788 - RNA, 22 nt, Mycobacterium avium subsp. paratuberculosis
cagcagcgagaaccggcgcaga

SEQ ID NO: 2922789 - RNA, 12 nt, Mycobacterium avium subsp. paratuberculosis
cagcagcgaggc

SEQ ID NO: 2922790 - RNA, 15 nt, Mycobacterium avium subsp. paratuberculosis
cagcagcgaggccuc

SEQ ID NO: 2922791 - RNA, 23 nt, Mycobacterium avium subsp. paratuberculosis
cagcagcgaggcguccagcgcgu

SEQ ID NO: 2922792 - RNA, 15 nt, Mycobacterium avium subsp. paratuberculosis
cagcagcgcaccggc

SEQ ID NO: 2922793 - RNA, 18 nt, Mycobacterium avium subsp. paratuberculosis
cagcagcgccacaaugga

SEQ ID NO: 2922794 - RNA, 13 nt, Mycobacterium avium subsp. paratuberculosis
cagcagcgccagc

SEQ ID NO: 2922795 - RNA, 17 nt, Mycobacterium avium subsp. paratuberculosis
cagcagcgccagcaccg

SEQ ID NO: 2922796 - RNA, 20 nt, Mycobacterium avium subsp. paratuberculosis
cagcagcgccagcagcggca

SEQ ID NO: 2922797 - RNA, 21 nt, Mycobacterium avium subsp. paratuberculosis
cagcagcgcccaccgcucguc

SEQ ID NO: 2922798 - RNA, 23 nt, Mycobacterium avium subsp. paratuberculosis
cagcagcgcccaccgcucgucgg

SEQ ID NO: 2922799 - RNA, 15 nt, Mycobacterium avium subsp. paratuberculosis
cagcagcgccgcgac

SEQ ID NO: 2922800 - RNA, 13 nt, Mycobacterium avium subsp. paratuberculosis
cagcagcgccgcu

SEQ ID NO: 2922801 - RNA, 17 nt, Mycobacterium avium subsp. paratuberculosis
cagcagcgccgcuucgu

SEQ ID NO: 2922802 - RNA, 14 nt, Mycobacterium avium subsp. paratuberculosis
cagcagcgccggca

SEQ ID NO: 2922803 - RNA, 14 nt, Mycobacterium avium subsp. paratuberculosis
cagcagcgccucgc

SEQ ID NO: 2922804 - RNA, 17 nt, Mycobacterium avium subsp. paratuberculosis
cagcagcgccucgccgg

SEQ ID NO: 2922805 - RNA, 20 nt, Mycobacterium avium subsp. paratuberculosis
cagcagcgccucgccgggcc

SEQ ID NO: 2922806 - RNA, 17 nt, Mycobacterium avium subsp. paratuberculosis
cagcagcgccucggcga

SEQ ID NO: 2922807 - RNA, 17 nt, Mycobacterium avium subsp. paratuberculosis
cagcagcgcgacgcauu

SEQ ID NO: 2922808 - RNA, 16 nt, Mycobacterium avium subsp. paratuberculosis
cagcagcgcgacgccg

SEQ ID NO: 2922809 - RNA, 13 nt, Mycobacterium avium subsp. paratuberculosis
cagcagcgcgccg

SEQ ID NO: 2922810 - RNA, 16 nt, Mycobacterium avium subsp. paratuberculosis
cagcagcgcgccgacc

SEQ ID NO: 2922811 - RNA, 15 nt, Mycobacterium avium subsp. paratuberculosis
cagcagcgcgccgcg

SEQ ID NO: 2922812 - RNA, 21 nt, Mycobacterium avium subsp. paratuberculosis
cagcagcgcgccgcgcuggcc

SEQ ID NO: 2922813 - RNA, 13 nt, Mycobacterium avium subsp. paratuberculosis
cagcagcgcggcg

SEQ ID NO: 2922814 - RNA, 14 nt, Mycobacterium avium subsp. paratuberculosis
cagcagcgcggcga

SEQ ID NO: 2922815 - RNA, 18 nt, Mycobacterium avium subsp. paratuberculosis
cagcagcgcggcgaucuc

SEQ ID NO: 2922816 - RNA, 22 nt, Mycobacterium avium subsp. paratuberculosis
cagcagcgcggcgaucucggcg

SEQ ID NO: 2922817 - RNA, 14 nt, Mycobacterium avium subsp. paratuberculosis
cagcagcgcggugc

SEQ ID NO: 2922818 - RNA, 17 nt, Mycobacterium avium subsp. paratuberculosis
cagcagcgcggugccga

SEQ ID NO: 2922819 - RNA, 18 nt, Mycobacterium avium subsp. paratuberculosis
cagcagcgcguaggugcg

SEQ ID NO: 2922820 - RNA, 20 nt, Mycobacterium avium subsp. paratuberculosis
cagcagcgcguaggugcggu

SEQ ID NO: 2922821 - RNA, 14 nt, Mycobacterium avium subsp. paratuberculosis
cagcagcgcgucgu

SEQ ID NO: 2922822 - RNA, 14 nt, Mycobacterium avium subsp. paratuberculosis
cagcagcggcaccc

SEQ ID NO: 2922823 - RNA, 13 nt, Mycobacterium avium subsp. paratuberculosis
cagcagcggcagc

SEQ ID NO: 2922824 - RNA, 17 nt, Mycobacterium avium subsp. paratuberculosis
cagcagcggcagcgaac

SEQ ID NO: 2922825 - RNA, 17 nt, Mycobacterium avium subsp. paratuberculosis
cagcagcggccggcgca

SEQ ID NO: 2922826 - RNA, 20 nt, Mycobacterium avium subsp. paratuberculosis
cagcagcggccggcgcagcc

SEQ ID NO: 2922827 - RNA, 19 nt, Mycobacterium avium subsp. paratuberculosis
cagcagcggcuugagcgcc

SEQ ID NO: 2922828 - RNA, 20 nt, Mycobacterium avium subsp. paratuberculosis
cagcagcggcuugagcgcca

SEQ ID NO: 2922829 - RNA, 20 nt, Mycobacterium avium subsp. paratuberculosis
cagcagcgggaucagcuccu

SEQ ID NO: 2922830 - RNA, 20 nt, Mycobacterium avium subsp. paratuberculosis
cagcagcgggcccgggcugc

SEQ ID NO: 2922831 - RNA, 13 nt, Mycobacterium avium subsp. paratuberculosis
cagcagcggggcg

SEQ ID NO: 2922832 - RNA, 17 nt, Mycobacterium avium subsp. paratuberculosis
cagcagcgucacgucga

SEQ ID NO: 2922833 - RNA, 16 nt, Mycobacterium avium subsp. paratuberculosis
cagcagcgucugcgcc

SEQ ID NO: 2922834 - RNA, 17 nt, Mycobacterium avium subsp. paratuberculosis
cagcagcgucugcgcca

SEQ ID NO: 2922835 - RNA, 21 nt, Mycobacterium avium subsp. paratuberculosis
cagcagcgucugcgccagcug

SEQ ID NO: 2922836 - RNA, 16 nt, Mycobacterium avium subsp. paratuberculosis
cagcagcgugggaucc

SEQ ID NO: 2922837 - RNA, 19 nt, Mycobacterium avium subsp. paratuberculosis
cagcagcguuccgucggcg

SEQ ID NO: 2922838 - RNA, 19 nt, Mycobacterium avium subsp. paratuberculosis
cagcagcucauacagcggc

SEQ ID NO: 2922839 - RNA, 21 nt, Mycobacterium avium subsp. paratuberculosis
cagcagcucauacagcggcgc

SEQ ID NO: 2922840 - RNA, 19 nt, Mycobacterium avium subsp. paratuberculosis
cagcagcuccaucgacgga

SEQ ID NO: 2922841 - RNA, 18 nt, Mycobacterium avium subsp. paratuberculosis
cagcagcucggcgaucac

SEQ ID NO: 2922842 - RNA, 19 nt, Mycobacterium avium subsp. paratuberculosis
cagcagcucggcgaucacc

SEQ ID NO: 2922843 - RNA, 20 nt, Mycobacterium avium subsp. paratuberculosis
cagcagcucgguggcgucgg

SEQ ID NO: 2922844 - RNA, 22 nt, Mycobacterium avium subsp. paratuberculosis
cagcagcucgguggcgucggcg

SEQ ID NO: 2922845 - RNA, 23 nt, Mycobacterium avium subsp. paratuberculosis
cagcagcucgguggcgucggcgg

SEQ ID NO: 2922846 - RNA, 16 nt, Mycobacterium avium subsp. paratuberculosis
cagcagcugcgggacc

SEQ ID NO: 2922847 - RNA, 17 nt, Mycobacterium avium subsp. paratuberculosis
cagcagcugcgggacca

SEQ ID NO: 2922848 - RNA, 14 nt, Mycobacterium avium subsp. paratuberculosis
cagcagcugcguca

SEQ ID NO: 2922849 - RNA, 21 nt, Mycobacterium avium subsp. paratuberculosis
cagcagcugcgucggcaccag

SEQ ID NO: 2922850 - RNA, 15 nt, Mycobacterium avium subsp. paratuberculosis
cagcagcugcuggcg

SEQ ID NO: 2922851 - RNA, 16 nt, Mycobacterium avium subsp. paratuberculosis
cagcagcugcuggcgu

SEQ ID NO: 2922852 - RNA, 18 nt, Mycobacterium avium subsp. paratuberculosis
cagcagcugcuggcguga

SEQ ID NO: 2922853 - RNA, 22 nt, Mycobacterium avium subsp. paratuberculosis
cagcagcuggaaauaggccggg

SEQ ID NO: 2922854 - RNA, 17 nt, Mycobacterium avium subsp. paratuberculosis
cagcagcuugacgucgg

SEQ ID NO: 2922855 - RNA, 14 nt, Mycobacterium avium subsp. paratuberculosis
cagcaggucgucga

SEQ ID NO: 2922856 - RNA, 17 nt, Mycobacterium avium subsp. paratuberculosis
cagcaggucgucgacgu

SEQ ID NO: 2922857 - RNA, 19 nt, Mycobacterium avium subsp. paratuberculosis
cagcaggucgucgacgucc

SEQ ID NO: 2922858 - RNA, 16 nt, Mycobacterium avium subsp. paratuberculosis
cagcaggucgucgauc

SEQ ID NO: 2922859 - RNA, 17 nt, Mycobacterium avium subsp. paratuberculosis
cagcaggucgucgauca

SEQ ID NO: 2922860 - RNA, 19 nt, Mycobacterium avium subsp. paratuberculosis
cagcaggugcaucgaccgg

SEQ ID NO: 2922861 - RNA, 19 nt, Mycobacterium avium subsp. paratuberculosis
cagcaggugcaucgccacc

SEQ ID NO: 2922862 - RNA, 20 nt, Mycobacterium avium subsp. paratuberculosis
cagcaggugcgccagaucgc

SEQ ID NO: 2922863 - RNA, 22 nt, Mycobacterium avium subsp. paratuberculosis
cagcagguugauccgcgcgucu

SEQ ID NO: 2922864 - RNA, 19 nt, Mycobacterium avium subsp. paratuberculosis
cagcagguugcgguguugc

SEQ ID NO: 2922865 - RNA, 21 nt, Mycobacterium avium subsp. paratuberculosis
cagcagguuguagucggcgcc

SEQ ID NO: 2922866 - RNA, 22 nt, Mycobacterium avium subsp. paratuberculosis
cagcagguuguagucggcgccg

SEQ ID NO: 2922867 - RNA, 16 nt, Mycobacterium avium subsp. paratuberculosis
cagcagucccucgauc

SEQ ID NO: 2922868 - RNA, 20 nt, Mycobacterium avium subsp. paratuberculosis
cagcaguccggcggucagca

SEQ ID NO: 2922869 - RNA, 20 nt, Mycobacterium avium subsp. paratuberculosis
cagcagucgugacgcggcgu

SEQ ID NO: 2922870 - RNA, 22 nt, Mycobacterium avium subsp. paratuberculosis
cagcagugccaacacggcggcg

SEQ ID NO: 2922871 - RNA, 16 nt, Mycobacterium avium subsp. paratuberculosis
cagcagugccaccacc

SEQ ID NO: 2922872 - RNA, 23 nt, Mycobacterium avium subsp. paratuberculosis
cagcagugccaccaccacggcca

SEQ ID NO: 2922873 - RNA, 15 nt, Mycobacterium avium subsp. paratuberculosis
cagcagugccccguc

SEQ ID NO: 2922874 - RNA, 17 nt, Mycobacterium avium subsp. paratuberculosis
cagcagugccccguccg

SEQ ID NO: 2922875 - RNA, 19 nt, Mycobacterium avium subsp. paratuberculosis
cagcagugccccguccggc

SEQ ID NO: 2922876 - RNA, 22 nt, Mycobacterium avium subsp. paratuberculosis
cagcagugccccguccggcgcc

SEQ ID NO: 2922877 - RNA, 23 nt, Mycobacterium avium subsp. paratuberculosis
cagcagugccccguccggcgcca

SEQ ID NO: 2922878 - RNA, 20 nt, Mycobacterium avium subsp. paratuberculosis
cagcaguguccagucggccg

SEQ ID NO: 2922879 - RNA, 14 nt, Mycobacterium avium subsp. paratuberculosis
cagcaguuuguccu

SEQ ID NO: 2922880 - RNA, 22 nt, Mycobacterium avium subsp. paratuberculosis
cagcaguuuguccugcucggcg

SEQ ID NO: 2922881 - RNA, 14 nt, Mycobacterium avium subsp. paratuberculosis
cagcaucacgucgg

SEQ ID NO: 2922882 - RNA, 18 nt, Mycobacterium avium subsp. paratuberculosis
cagcaucacgucggcgag

SEQ ID NO: 2922883 - RNA, 21 nt, Mycobacterium avium subsp. paratuberculosis
cagcaucauugagccgcucgc

SEQ ID NO: 2922884 - RNA, 14 nt, Mycobacterium avium subsp. paratuberculosis
cagcauccaggugg

SEQ ID NO: 2922885 - RNA, 19 nt, Mycobacterium avium subsp. paratuberculosis
cagcauccgcaacgugcgc

SEQ ID NO: 2922886 - RNA, 20 nt, Mycobacterium avium subsp. paratuberculosis
cagcauccgcuggugcgcgc

SEQ ID NO: 2922887 - RNA, 14 nt, Mycobacterium avium subsp. paratuberculosis
cagcaucgccgcga

SEQ ID NO: 2922888 - RNA, 14 nt, Mycobacterium avium subsp. paratuberculosis
cagcaucgccgcgg

SEQ ID NO: 2922889 - RNA, 24 nt, Mycobacterium avium subsp. paratuberculosis
cagcaucgccgucgucagccgggc

SEQ ID NO: 2922890 - RNA, 21 nt, Mycobacterium avium subsp. paratuberculosis
cagcaucggaugccggggcag

SEQ ID NO: 2922891 - RNA, 15 nt, Mycobacterium avium subsp. paratuberculosis
cagcaucgggacgcc

SEQ ID NO: 2922892 - RNA, 18 nt, Mycobacterium avium subsp. paratuberculosis
cagcaucgggacgccugc

SEQ ID NO: 2922893 - RNA, 22 nt, Mycobacterium avium subsp. paratuberculosis
cagcaucgggacgccugccgcc

SEQ ID NO: 2922894 - RNA, 17 nt, Mycobacterium avium subsp. paratuberculosis
cagcaucggucccaguc

SEQ ID NO: 2922895 - RNA, 19 nt, Mycobacterium avium subsp. paratuberculosis
cagcaucuccgagucggcg

SEQ ID NO: 2922896 - RNA, 20 nt, Mycobacterium avium subsp. paratuberculosis
cagcaucuccgagucggcgu

SEQ ID NO: 2922897 - RNA, 21 nt, Mycobacterium avium subsp. paratuberculosis
cagcaucuccgagucggcguc

SEQ ID NO: 2922898 - RNA, 23 nt, Mycobacterium avium subsp. paratuberculosis
cagcaucuccgagucggcgucgg

SEQ ID NO: 2922899 - RNA, 23 nt, Mycobacterium avium subsp. paratuberculosis
cagcaucucuugaugcagcgccu

SEQ ID NO: 2922900 - RNA, 21 nt, Mycobacterium avium subsp. paratuberculosis
cagcaucuuggccacgggguc

SEQ ID NO: 2922901 - RNA, 16 nt, Mycobacterium avium subsp. paratuberculosis
cagcaugaacgucacc

SEQ ID NO: 2922902 - RNA, 17 nt, Mycobacterium avium subsp. paratuberculosis
cagcaugaucaccgcca

SEQ ID NO: 2922903 - RNA, 20 nt, Mycobacterium avium subsp. paratuberculosis
cagcaugaucaccgccagcg

SEQ ID NO: 2922904 - RNA, 21 nt, Mycobacterium avium subsp. paratuberculosis
cagcaugaucaccgccagcgc

SEQ ID NO: 2922905 - RNA, 15 nt, Mycobacterium avium subsp. paratuberculosis
cagcaugcccacgcc

SEQ ID NO: 2922906 - RNA, 17 nt, Mycobacterium avium subsp. paratuberculosis
cagcaugcccacgccgu

SEQ ID NO: 2922907 - RNA, 23 nt, Mycobacterium avium subsp. paratuberculosis
cagcaugccggucauccgggcca

SEQ ID NO: 2922908 - RNA, 15 nt, Mycobacterium avium subsp. paratuberculosis
cagcaugcgaugacc

SEQ ID NO: 2922909 - RNA, 17 nt, Mycobacterium avium subsp. paratuberculosis
cagcaugcgccagagcg

SEQ ID NO: 2922910 - RNA, 18 nt, Mycobacterium avium subsp. paratuberculosis
cagcaugcgccagagcgc

SEQ ID NO: 2922911 - RNA, 20 nt, Mycobacterium avium subsp. paratuberculosis
cagcaugcgccagagcgcga

SEQ ID NO: 2922912 - RNA, 13 nt, Mycobacterium avium subsp. paratuberculosis
cagcauggcccac

SEQ ID NO: 2922913 - RNA, 23 nt, Mycobacterium avium subsp. paratuberculosis
cagcauggcgaucaccccggcga

SEQ ID NO: 2922914 - RNA, 20 nt, Mycobacterium avium subsp. paratuberculosis
cagcauggucucgcugaucu

SEQ ID NO: 2922915 - RNA, 19 nt, Mycobacterium avium subsp. paratuberculosis
cagcauguccucggggugg

SEQ ID NO: 2922916 - RNA, 14 nt, Mycobacterium avium subsp. paratuberculosis
cagcaugucgcccg

SEQ ID NO: 2922917 - RNA, 17 nt, Mycobacterium avium subsp. paratuberculosis
cagcaugucgcccgcgu

SEQ ID NO: 2922918 - RNA, 20 nt, Mycobacterium avium subsp. paratuberculosis
cagcaugucgcccgcgucgu

SEQ ID NO: 2922919 - RNA, 22 nt, Mycobacterium avium subsp. paratuberculosis
cagcaugucgcccgcgucgugg

SEQ ID NO: 2922920 - RNA, 13 nt, Mycobacterium avium subsp. paratuberculosis
cagcauguguggc

SEQ ID NO: 2922921 - RNA, 15 nt, Mycobacterium avium subsp. paratuberculosis
cagcauuuccgagcg

SEQ ID NO: 2922922 - RNA, 19 nt, Mycobacterium avium subsp. paratuberculosis
cagcauuuccgagcgacga

SEQ ID NO: 2922923 - RNA, 17 nt, Mycobacterium avium subsp. paratuberculosis
cagcauuucgcgcggca

SEQ ID NO: 2922924 - RNA, 18 nt, Mycobacterium avium subsp. paratuberculosis
cagcauuucgcgcggcau

SEQ ID NO: 2922925 - RNA, 20 nt, Mycobacterium avium subsp. paratuberculosis
cagcauuucgcgcggcaucg

SEQ ID NO: 2922926 - RNA, 16 nt, Mycobacterium avium subsp. paratuberculosis
cagccaaccgccgggg

SEQ ID NO: 2922927 - RNA, 17 nt, Mycobacterium avium subsp. paratuberculosis
cagccaaucgccgauga

SEQ ID NO: 2922928 - RNA, 20 nt, Mycobacterium avium subsp. paratuberculosis
cagccaaucgccgaugacca

SEQ ID NO: 2922929 - RNA, 12 nt, Mycobacterium avium subsp. paratuberculosis
cagccacaccgc

SEQ ID NO: 2922930 - RNA, 15 nt, Mycobacterium avium subsp. paratuberculosis
cagccacaccgccgc

SEQ ID NO: 2922931 - RNA, 16 nt, Mycobacterium avium subsp. paratuberculosis
cagccacaccgccgcg

SEQ ID NO: 2922932 - RNA, 18 nt, Mycobacterium avium subsp. paratuberculosis
cagccacaccgccgcggc

SEQ ID NO: 2922933 - RNA, 19 nt, Mycobacterium avium subsp. paratuberculosis
cagccacaccgccgcggcg

SEQ ID NO: 2922934 - RNA, 18 nt, Mycobacterium avium subsp. paratuberculosis
cagccacaccgccggcgc

SEQ ID NO: 2922935 - RNA, 15 nt, Mycobacterium avium subsp. paratuberculosis
cagccacagcucggg

SEQ ID NO: 2922936 - RNA, 18 nt, Mycobacterium avium subsp. paratuberculosis
cagccacagcucgggcag

SEQ ID NO: 2922937 - RNA, 12 nt, Mycobacterium avium subsp. paratuberculosis
cagccaccacau

SEQ ID NO: 2922938 - RNA, 17 nt, Mycobacterium avium subsp. paratuberculosis
cagccaccacaucgcug

SEQ ID NO: 2922939 - RNA, 15 nt, Mycobacterium avium subsp. paratuberculosis
cagccccaccaccgc

SEQ ID NO: 2922940 - RNA, 19 nt, Mycobacterium avium subsp. paratuberculosis
cagccccaccaccgccacc

SEQ ID NO: 2922941 - RNA, 20 nt, Mycobacterium avium subsp. paratuberculosis
cagccccaccaccgccacca

SEQ ID NO: 2922942 - RNA, 22 nt, Mycobacterium avium subsp. paratuberculosis
cagccccaccaccgccaccagc

SEQ ID NO: 2922943 - RNA, 14 nt, Mycobacterium avium subsp. paratuberculosis
cagccccaccggcc

SEQ ID NO: 2922944 - RNA, 15 nt, Mycobacterium avium subsp. paratuberculosis
cagccccaccggcca

SEQ ID NO: 2922945 - RNA, 13 nt, Mycobacterium avium subsp. paratuberculosis
cagccccagcacg

SEQ ID NO: 2922946 - RNA, 14 nt, Mycobacterium avium subsp. paratuberculosis
cagccccagcacga

SEQ ID NO: 2922947 - RNA, 17 nt, Mycobacterium avium subsp. paratuberculosis
cagccccagcacgauga

SEQ ID NO: 2922948 - RNA, 22 nt, Mycobacterium avium subsp. paratuberculosis
cagccccagcacgaugacgacc

SEQ ID NO: 2922949 - RNA, 14 nt, Mycobacterium avium subsp. paratuberculosis
cagccccagcgagc

SEQ ID NO: 2922950 - RNA, 16 nt, Mycobacterium avium subsp. paratuberculosis
cagccccaggaggcac

SEQ ID NO: 2922951 - RNA, 20 nt, Mycobacterium avium subsp. paratuberculosis
cagccccaggaggcacuggc

SEQ ID NO: 2922952 - RNA, 22 nt, Mycobacterium avium subsp. paratuberculosis
cagccccaggaggcacuggcgc

SEQ ID NO: 2922953 - RNA, 22 nt, Mycobacterium avium subsp. paratuberculosis
cagccccagggugcgccgcucg

SEQ ID NO: 2922954 - RNA, 13 nt, Mycobacterium avium subsp. paratuberculosis
cagcccccaccgc

SEQ ID NO: 2922955 - RNA, 14 nt, Mycobacterium avium subsp. paratuberculosis
cagcccccaccgcg

SEQ ID NO: 2922956 - RNA, 15 nt, Mycobacterium avium subsp. paratuberculosis
cagcccccaccgcgc

SEQ ID NO: 2922957 - RNA, 18 nt, Mycobacterium avium subsp. paratuberculosis
cagcccccaccgcgccgu

SEQ ID NO: 2922958 - RNA, 19 nt, Mycobacterium avium subsp. paratuberculosis
cagcccccaccgcgccgug

SEQ ID NO: 2922959 - RNA, 19 nt, Mycobacterium avium subsp. paratuberculosis
cagcccccacgcucggcgc

SEQ ID NO: 2922960 - RNA, 15 nt, Mycobacterium avium subsp. paratuberculosis
cagcccccgcagccc

SEQ ID NO: 2922961 - RNA, 22 nt, Mycobacterium avium subsp. paratuberculosis
cagcccccgcgggucgucgacg

SEQ ID NO: 2922962 - RNA, 16 nt, Mycobacterium avium subsp. paratuberculosis
cagccccgagccgcgg

SEQ ID NO: 2922963 - RNA, 13 nt, Mycobacterium avium subsp. paratuberculosis
cagccccgggaac

SEQ ID NO: 2922964 - RNA, 19 nt, Mycobacterium avium subsp. paratuberculosis
cagccccgggaaccagccc

SEQ ID NO: 2922965 - RNA, 19 nt, Mycobacterium avium subsp. paratuberculosis
cagccccgucggucccgac

SEQ ID NO: 2922966 - RNA, 20 nt, Mycobacterium avium subsp. paratuberculosis
cagccccgucggucccgacg

SEQ ID NO: 2922967 - RNA, 17 nt, Mycobacterium avium subsp. paratuberculosis
cagccccucgaccaccu

SEQ ID NO: 2922968 - RNA, 13 nt, Mycobacterium avium subsp. paratuberculosis
cagccccucgacg

SEQ ID NO: 2922969 - RNA, 14 nt, Mycobacterium avium subsp. paratuberculosis
cagccccucgacgu

SEQ ID NO: 2922970 - RNA, 15 nt, Mycobacterium avium subsp. paratuberculosis
cagccccucgacguc

SEQ ID NO: 2922971 - RNA, 16 nt, Mycobacterium avium subsp. paratuberculosis
cagccccucgacgucc

SEQ ID NO: 2922972 - RNA, 15 nt, Mycobacterium avium subsp. paratuberculosis
cagccccucgccggg

SEQ ID NO: 2922973 - RNA, 16 nt, Mycobacterium avium subsp. paratuberculosis
cagccccucgccgggc

SEQ ID NO: 2922974 - RNA, 17 nt, Mycobacterium avium subsp. paratuberculosis
cagccccucgccgggcg

SEQ ID NO: 2922975 - RNA, 18 nt, Mycobacterium avium subsp. paratuberculosis
cagccccucgccgggcgu

SEQ ID NO: 2922976 - RNA, 15 nt, Mycobacterium avium subsp. paratuberculosis
cagccccucggggcu

SEQ ID NO: 2922977 - RNA, 21 nt, Mycobacterium avium subsp. paratuberculosis
cagccccucggggcugcgcgg

SEQ ID NO: 2922978 - RNA, 23 nt, Mycobacterium avium subsp. paratuberculosis
cagccccucggggcugcgcggcu

SEQ ID NO: 2922979 - RNA, 13 nt, Mycobacterium avium subsp. paratuberculosis
cagccccucgucc

SEQ ID NO: 2922980 - RNA, 14 nt, Mycobacterium avium subsp. paratuberculosis
cagccccugcacca

SEQ ID NO: 2922981 - RNA, 15 nt, Mycobacterium avium subsp. paratuberculosis
cagccccugcaccac

SEQ ID NO: 2922982 - RNA, 15 nt, Mycobacterium avium subsp. paratuberculosis
cagcccgaacagccg

SEQ ID NO: 2922983 - RNA, 16 nt, Mycobacterium avium subsp. paratuberculosis
cagcccgaacagccgg

SEQ ID NO: 2922984 - RNA, 18 nt, Mycobacterium avium subsp. paratuberculosis
cagcccgaacagccgggc

SEQ ID NO: 2922985 - RNA, 17 nt, Mycobacterium avium subsp. paratuberculosis
cagcccgaccaccuccc

SEQ ID NO: 2922986 - RNA, 19 nt, Mycobacterium avium subsp. paratuberculosis
cagcccgaccaccuccccg

SEQ ID NO: 2922987 - RNA, 16 nt, Mycobacterium avium subsp. paratuberculosis
cagcccgacccggcuc

SEQ ID NO: 2922988 - RNA, 21 nt, Mycobacterium avium subsp. paratuberculosis
cagcccgaccgucgucccggu

SEQ ID NO: 2922989 - RNA, 13 nt, Mycobacterium avium subsp. paratuberculosis
cagcccgacgucc

SEQ ID NO: 2922990 - RNA, 15 nt, Mycobacterium avium subsp. paratuberculosis
cagcccgagcaccag

SEQ ID NO: 2922991 - RNA, 18 nt, Mycobacterium avium subsp. paratuberculosis
cagcccgagcaccagcgg

SEQ ID NO: 2922992 - RNA, 17 nt, Mycobacterium avium subsp. paratuberculosis
cagcccgagcacguugu

SEQ ID NO: 2922993 - RNA, 17 nt, Mycobacterium avium subsp. paratuberculosis
cagcccgagcggcauca

SEQ ID NO: 2922994 - RNA, 18 nt, Mycobacterium avium subsp. paratuberculosis
cagcccgaucacccccga

SEQ ID NO: 2922995 - RNA, 14 nt, Mycobacterium avium subsp. paratuberculosis
cagcccgaucgcca

SEQ ID NO: 2922996 - RNA, 20 nt, Mycobacterium avium subsp. paratuberculosis
cagcccgaucgccagcgccc

SEQ ID NO: 2922997 - RNA, 19 nt, Mycobacterium avium subsp. paratuberculosis
cagcccgauguuggccuca

SEQ ID NO: 2922998 - RNA, 19 nt, Mycobacterium avium subsp. paratuberculosis
cagcccgauucagccggcg

SEQ ID NO: 2922999 - RNA, 21 nt, Mycobacterium avium subsp. paratuberculosis
cagcccgauucagccggcggu

SEQ ID NO: 2923000 - RNA, 14 nt, Mycobacterium avium subsp. paratuberculosis
cagcccgcccacca

SEQ ID NO: 2923001 - RNA, 21 nt, Mycobacterium avium subsp. paratuberculosis
cagcccgcccagcgccacggu

SEQ ID NO: 2923002 - RNA, 14 nt, Mycobacterium avium subsp. paratuberculosis
cagcccgcccuggc

SEQ ID NO: 2923003 - RNA, 16 nt, Mycobacterium avium subsp. paratuberculosis
cagcccgcccuggcug

SEQ ID NO: 2923004 - RNA, 21 nt, Mycobacterium avium subsp. paratuberculosis
cagcccgcccuuggccgcgga

SEQ ID NO: 2923005 - RNA, 14 nt, Mycobacterium avium subsp. paratuberculosis
cagcccgccgacca

SEQ ID NO: 2923006 - RNA, 12 nt, Mycobacterium avium subsp. paratuberculosis
cagcccgccgcg

SEQ ID NO: 2923007 - RNA, 13 nt, Mycobacterium avium subsp. paratuberculosis
cagcccgccgcgu

SEQ ID NO: 2923008 - RNA, 14 nt, Mycobacterium avium subsp. paratuberculosis
cagcccgccgcguc

SEQ ID NO: 2923009 - RNA, 18 nt, Mycobacterium avium subsp. paratuberculosis
cagcccgccgcguccggg

SEQ ID NO: 2923010 - RNA, 14 nt, Mycobacterium avium subsp. paratuberculosis
cagcccgccgggau

SEQ ID NO: 2923011 - RNA, 15 nt, Mycobacterium avium subsp. paratuberculosis
cagcccgccgggaug

SEQ ID NO: 2923012 - RNA, 20 nt, Mycobacterium avium subsp. paratuberculosis
cagcccgccgggaugcgcca

SEQ ID NO: 2923013 - RNA, 13 nt, Mycobacterium avium subsp. paratuberculosis
cagcccgccgucg

SEQ ID NO: 2923014 - RNA, 13 nt, Mycobacterium avium subsp. paratuberculosis
cagcccgcgcaug

SEQ ID NO: 2923015 - RNA, 16 nt, Mycobacterium avium subsp. paratuberculosis
cagcccgcgccagcuc

SEQ ID NO: 2923016 - RNA, 20 nt, Mycobacterium avium subsp. paratuberculosis
cagcccgcgccagcucggcg

SEQ ID NO: 2923017 - RNA, 20 nt, Mycobacterium avium subsp. paratuberculosis
cagcccgcgccgagcaaccg

SEQ ID NO: 2923018 - RNA, 22 nt, Mycobacterium avium subsp. paratuberculosis
cagcccgcgcgagcgcagcgcc

SEQ ID NO: 2923019 - RNA, 12 nt, Mycobacterium avium subsp. paratuberculosis
cagcccgcggca

SEQ ID NO: 2923020 - RNA, 14 nt, Mycobacterium avium subsp. paratuberculosis
cagcccgcggcagc

SEQ ID NO: 2923021 - RNA, 21 nt, Mycobacterium avium subsp. paratuberculosis
cagcccgcggcagccagccug

SEQ ID NO: 2923022 - RNA, 15 nt, Mycobacterium avium subsp. paratuberculosis
cagcccgcgggcggc

SEQ ID NO: 2923023 - RNA, 15 nt, Mycobacterium avium subsp. paratuberculosis
cagcccgcgucgcgc

SEQ ID NO: 2923024 - RNA, 23 nt, Mycobacterium avium subsp. paratuberculosis
cagccgaccaguucuucgaugac

SEQ ID NO: 2923025 - RNA, 14 nt, Mycobacterium avium subsp. paratuberculosis
cagccgaccgauca

SEQ ID NO: 2923026 - RNA, 16 nt, Mycobacterium avium subsp. paratuberculosis
cagccgagacauagac

SEQ ID NO: 2923027 - RNA, 14 nt, Mycobacterium avium subsp. paratuberculosis
cagccgagccgggc

SEQ ID NO: 2923028 - RNA, 15 nt, Mycobacterium avium subsp. paratuberculosis
cagccgagccgggcc

SEQ ID NO: 2923029 - RNA, 21 nt, Mycobacterium avium subsp. paratuberculosis
cagccgagccgggccaggucc

SEQ ID NO: 2923030 - RNA, 16 nt, Mycobacterium avium subsp. paratuberculosis
cagccgagccggguca

SEQ ID NO: 2923031 - RNA, 15 nt, Mycobacterium avium subsp. paratuberculosis
cagccgaggcgcucg

SEQ ID NO: 2923032 - RNA, 19 nt, Mycobacterium avium subsp. paratuberculosis
cagccgauacaugugccga

SEQ ID NO: 2923033 - RNA, 22 nt, Mycobacterium avium subsp. paratuberculosis
cagccgaucucguagcccaccu

SEQ ID NO: 2923034 - RNA, 19 nt, Mycobacterium avium subsp. paratuberculosis
cagccgaucuggcgggcgg

SEQ ID NO: 2923035 - RNA, 23 nt, Mycobacterium avium subsp. paratuberculosis
cagccgaucuggcgggcggucca

SEQ ID NO: 2923036 - RNA, 17 nt, Mycobacterium avium subsp. paratuberculosis
cagccgaugcgcccgcg

SEQ ID NO: 2923037 - RNA, 19 nt, Mycobacterium avium subsp. paratuberculosis
cagccgaugcgcccgcgcc

SEQ ID NO: 2923038 - RNA, 19 nt, Mycobacterium avium subsp. paratuberculosis
cagccgaugucgucgaacg

SEQ ID NO: 2923039 - RNA, 22 nt, Mycobacterium avium subsp. paratuberculosis
cagccgcaacacggccucgauc

SEQ ID NO: 2923040 - RNA, 13 nt, Mycobacterium avium subsp. paratuberculosis
cagccgcacaccg

SEQ ID NO: 2923041 - RNA, 14 nt, Mycobacterium avium subsp. paratuberculosis
cagccgcacaccgc

SEQ ID NO: 2923042 - RNA, 15 nt, Mycobacterium avium subsp. paratuberculosis
cagccgcacaccgcg

SEQ ID NO: 2923043 - RNA, 13 nt, Mycobacterium avium subsp. paratuberculosis
cagccgcaccagg

SEQ ID NO: 2923044 - RNA, 13 nt, Mycobacterium avium subsp. paratuberculosis
cagccgcaccgcg

SEQ ID NO: 2923045 - RNA, 22 nt, Mycobacterium avium subsp. paratuberculosis
cagccgcaccgcgaccgucauc

SEQ ID NO: 2923046 - RNA, 14 nt, Mycobacterium avium subsp. paratuberculosis
cagccgcaccggcg

SEQ ID NO: 2923047 - RNA, 15 nt, Mycobacterium avium subsp. paratuberculosis
cagccgcaccggcgc

SEQ ID NO: 2923048 - RNA, 16 nt, Mycobacterium avium subsp. paratuberculosis
cagccgcaccggcgcc

SEQ ID NO: 2923049 - RNA, 14 nt, Mycobacterium avium subsp. paratuberculosis
cagccgcaccucgg

SEQ ID NO: 2923050 - RNA, 14 nt, Mycobacterium avium subsp. paratuberculosis
cagccgcacgaacc

SEQ ID NO: 2923051 - RNA, 16 nt, Mycobacterium avium subsp. paratuberculosis
cagccgcacgaaccgc

SEQ ID NO: 2923052 - RNA, 12 nt, Mycobacterium avium subsp. paratuberculosis
cagccgcagcag

SEQ ID NO: 2923053 - RNA, 15 nt, Mycobacterium avium subsp. paratuberculosis
cagccgcagcagccg

SEQ ID NO: 2923054 - RNA, 16 nt, Mycobacterium avium subsp. paratuberculosis
cagccgcagcagccgc

SEQ ID NO: 2923055 - RNA, 14 nt, Mycobacterium avium subsp. paratuberculosis
cagccgcagcaggc

SEQ ID NO: 2923056 - RNA, 13 nt, Mycobacterium avium subsp. paratuberculosis
cagccgcagcgcg

SEQ ID NO: 2923057 - RNA, 16 nt, Mycobacterium avium subsp. paratuberculosis
cagccgcagcggcggc

SEQ ID NO: 2923058 - RNA, 19 nt, Mycobacterium avium subsp. paratuberculosis
cagccgcaggguuucguga

SEQ ID NO: 2923059 - RNA, 18 nt, Mycobacterium avium subsp. paratuberculosis
cagccgcaggugcagcuc

SEQ ID NO: 2923060 - RNA, 23 nt, Mycobacterium avium subsp. paratuberculosis
cagccgcaggugcagcuccuuga

SEQ ID NO: 2923061 - RNA, 17 nt, Mycobacterium avium subsp. paratuberculosis
cagccgcaggugcucgc

SEQ ID NO: 2923062 - RNA, 21 nt, Mycobacterium avium subsp. paratuberculosis
cagccgcaggugcucgccggc

SEQ ID NO: 2923063 - RNA, 17 nt, Mycobacterium avium subsp. paratuberculosis
cagccgcaucaccuucu

SEQ ID NO: 2923064 - RNA, 22 nt, Mycobacterium avium subsp. paratuberculosis
cagccgcauguugugcccgacg

SEQ ID NO: 2923065 - RNA, 14 nt, Mycobacterium avium subsp. paratuberculosis
cagccgccagccgg

SEQ ID NO: 2923066 - RNA, 17 nt, Mycobacterium avium subsp. paratuberculosis
cagccgccagccgguca

SEQ ID NO: 2923067 - RNA, 14 nt, Mycobacterium avium subsp. paratuberculosis
cagccgcccagcau

SEQ ID NO: 2923068 - RNA, 22 nt, Mycobacterium avium subsp. paratuberculosis
cagccgcccagcaucgccgcga

SEQ ID NO: 2923069 - RNA, 15 nt, Mycobacterium avium subsp. paratuberculosis
cagccgcccggcgcc

SEQ ID NO: 2923070 - RNA, 19 nt, Mycobacterium avium subsp. paratuberculosis
cagccgcccggcgccccgc

SEQ ID NO: 2923071 - RNA, 20 nt, Mycobacterium avium subsp. paratuberculosis
cagccgcccggcgccccgcc

SEQ ID NO: 2923072 - RNA, 14 nt, Mycobacterium avium subsp. paratuberculosis
cagccgcccguccu

SEQ ID NO: 2923073 - RNA, 17 nt, Mycobacterium avium subsp. paratuberculosis
cagccgcccguccugga

SEQ ID NO: 2923074 - RNA, 22 nt, Mycobacterium avium subsp. paratuberculosis
cagccgcccuuguugauggugu

SEQ ID NO: 2923075 - RNA, 15 nt, Mycobacterium avium subsp. paratuberculosis
cagccgccgccgacc

SEQ ID NO: 2923076 - RNA, 16 nt, Mycobacterium avium subsp. paratuberculosis
cagccgccgccgacca

SEQ ID NO: 2923077 - RNA, 17 nt, Mycobacterium avium subsp. paratuberculosis
cagccgccgcgccaccg

SEQ ID NO: 2923078 - RNA, 20 nt, Mycobacterium avium subsp. paratuberculosis
cagccgccgcgccaccgagg

SEQ ID NO: 2923079 - RNA, 13 nt, Mycobacterium avium subsp. paratuberculosis
cagccgccgcgga

SEQ ID NO: 2923080 - RNA, 17 nt, Mycobacterium avium subsp. paratuberculosis
cagccgccgcggagcgg

SEQ ID NO: 2923081 - RNA, 23 nt, Mycobacterium avium subsp. paratuberculosis
cagccgccgcggagcggcgguca

SEQ ID NO: 2923082 - RNA, 16 nt, Mycobacterium avium subsp. paratuberculosis
cagccgccgcguggcc

SEQ ID NO: 2923083 - RNA, 22 nt, Mycobacterium avium subsp. paratuberculosis
cagccgccgcguggccucccgg

SEQ ID NO: 2923084 - RNA, 13 nt, Mycobacterium avium subsp. paratuberculosis
cagccgccggcca

SEQ ID NO: 2923085 - RNA, 13 nt, Mycobacterium avium subsp. paratuberculosis
cagccgccggcgg

SEQ ID NO: 2923086 - RNA, 13 nt, Mycobacterium avium subsp. paratuberculosis
cagccgccggcuc

SEQ ID NO: 2923087 - RNA, 15 nt, Mycobacterium avium subsp. paratuberculosis
cagccgccggcucag

SEQ ID NO: 2923088 - RNA, 18 nt, Mycobacterium avium subsp. paratuberculosis
cagccgccggcucagcgg

SEQ ID NO: 2923089 - RNA, 12 nt, Mycobacterium avium subsp. paratuberculosis
cagccgccgggc

SEQ ID NO: 2923090 - RNA, 19 nt, Mycobacterium avium subsp. paratuberculosis
cagccgccgggcuucccca

SEQ ID NO: 2923091 - RNA, 12 nt, Mycobacterium avium subsp. paratuberculosis
cagccgccgguc

SEQ ID NO: 2923092 - RNA, 15 nt, Mycobacterium avium subsp. paratuberculosis
cagccgccgucgcgc

SEQ ID NO: 2923093 - RNA, 17 nt, Mycobacterium avium subsp. paratuberculosis
cagccgccgucgcgcca

SEQ ID NO: 2923094 - RNA, 15 nt, Mycobacterium avium subsp. paratuberculosis
cagccgccuggcgaa

SEQ ID NO: 2923095 - RNA, 17 nt, Mycobacterium avium subsp. paratuberculosis
cagccgcgacacgugca

SEQ ID NO: 2923096 - RNA, 16 nt, Mycobacterium avium subsp. paratuberculosis
cagccgcgacagccgc

SEQ ID NO: 2923097 - RNA, 15 nt, Mycobacterium avium subsp. paratuberculosis
cagccgcgacggcgg

SEQ ID NO: 2923098 - RNA, 16 nt, Mycobacterium avium subsp. paratuberculosis
cagccgcgacggcggg

SEQ ID NO: 2923099 - RNA, 20 nt, Mycobacterium avium subsp. paratuberculosis
cagccgcgacggcgggucga

SEQ ID NO: 2923100 - RNA, 15 nt, Mycobacterium avium subsp. paratuberculosis
cagccgcgccaccgc

SEQ ID NO: 2923101 - RNA, 19 nt, Mycobacterium avium subsp. paratuberculosis
cagccgcgcccacccgcgc

SEQ ID NO: 2923102 - RNA, 13 nt, Mycobacterium avium subsp. paratuberculosis
cagccgcgcccga

SEQ ID NO: 2923103 - RNA, 16 nt, Mycobacterium avium subsp. paratuberculosis
cagccgcgcccgaugg

SEQ ID NO: 2923104 - RNA, 17 nt, Mycobacterium avium subsp. paratuberculosis
cagccgcgcccgaugga

SEQ ID NO: 2923105 - RNA, 12 nt, Mycobacterium avium subsp. paratuberculosis
cagccgcgccga

SEQ ID NO: 2923106 - RNA, 14 nt, Mycobacterium avium subsp. paratuberculosis
cagccgcgccgacg

SEQ ID NO: 2923107 - RNA, 16 nt, Mycobacterium avium subsp. paratuberculosis
cagccgcgccgacgcc

SEQ ID NO: 2923108 - RNA, 20 nt, Mycobacterium avium subsp. paratuberculosis
cagccgcgccgacgcccaca

SEQ ID NO: 2923109 - RNA, 23 nt, Mycobacterium avium subsp. paratuberculosis
cagccggccggcgaagccgcuca

SEQ ID NO: 2923110 - RNA, 15 nt, Mycobacterium avium subsp. paratuberculosis
cagccggccggcgga

SEQ ID NO: 2923111 - RNA, 16 nt, Mycobacterium avium subsp. paratuberculosis
cagccggccggcggac

SEQ ID NO: 2923112 - RNA, 17 nt, Mycobacterium avium subsp. paratuberculosis
cagccggccggcggacg

SEQ ID NO: 2923113 - RNA, 11 nt, Mycobacterium avium subsp. paratuberculosis
cagccggccgu

SEQ ID NO: 2923114 - RNA, 16 nt, Mycobacterium avium subsp. paratuberculosis
cagccggccguccacg

SEQ ID NO: 2923115 - RNA, 13 nt, Mycobacterium avium subsp. paratuberculosis
cagccggcgagcg

SEQ ID NO: 2923116 - RNA, 18 nt, Mycobacterium avium subsp. paratuberculosis
cagccggcgagcgcgcug

SEQ ID NO: 2923117 - RNA, 12 nt, Mycobacterium avium subsp. paratuberculosis
cagccggcgcac

SEQ ID NO: 2923118 - RNA, 21 nt, Mycobacterium avium subsp. paratuberculosis
cagccggcgcccgcaggccgc

SEQ ID NO: 2923119 - RNA, 16 nt, Mycobacterium avium subsp. paratuberculosis
cagccggcgcggugau

SEQ ID NO: 2923120 - RNA, 16 nt, Mycobacterium avium subsp. paratuberculosis
cagccggcggaucgcg

SEQ ID NO: 2923121 - RNA, 12 nt, Mycobacterium avium subsp. paratuberculosis
cagccggcggcg

SEQ ID NO: 2923122 - RNA, 14 nt, Mycobacterium avium subsp. paratuberculosis
cagccggcgggcgc

SEQ ID NO: 2923123 - RNA, 18 nt, Mycobacterium avium subsp. paratuberculosis
cagccggcgggcgcucga

SEQ ID NO: 2923124 - RNA, 19 nt, Mycobacterium avium subsp. paratuberculosis
cagccggcucagggugcgc

SEQ ID NO: 2923125 - RNA, 22 nt, Mycobacterium avium subsp. paratuberculosis
cagccggcucagggugcgcugg

SEQ ID NO: 2923126 - RNA, 19 nt, Mycobacterium avium subsp. paratuberculosis
cagccggcucuuggcgacc

SEQ ID NO: 2923127 - RNA, 20 nt, Mycobacterium avium subsp. paratuberculosis
cagccgggaaucgagggcgc

SEQ ID NO: 2923128 - RNA, 22 nt, Mycobacterium avium subsp. paratuberculosis
cagccgggaaucgagggcgcgc

SEQ ID NO: 2923129 - RNA, 13 nt, Mycobacterium avium subsp. paratuberculosis
cagccgggccagc

SEQ ID NO: 2923130 - RNA, 14 nt, Mycobacterium avium subsp. paratuberculosis
cagccgggccagca

SEQ ID NO: 2923131 - RNA, 15 nt, Mycobacterium avium subsp. paratuberculosis
cagccgggccagccc

SEQ ID NO: 2923132 - RNA, 18 nt, Mycobacterium avium subsp. paratuberculosis
cagccgggccagcccggg

SEQ ID NO: 2923133 - RNA, 16 nt, Mycobacterium avium subsp. paratuberculosis
cagccgggccgagcgc

SEQ ID NO: 2923134 - RNA, 19 nt, Mycobacterium avium subsp. paratuberculosis
cagccgggccgagcgcgcc

SEQ ID NO: 2923135 - RNA, 20 nt, Mycobacterium avium subsp. paratuberculosis
cagccgggccgagcgcgccg

SEQ ID NO: 2923136 - RNA, 12 nt, Mycobacterium avium subsp. paratuberculosis
cagccgggccgc

SEQ ID NO: 2923137 - RNA, 14 nt, Mycobacterium avium subsp. paratuberculosis
cagccgggccgccc

SEQ ID NO: 2923138 - RNA, 18 nt, Mycobacterium avium subsp. paratuberculosis
cagccgggccgcccgcgc

SEQ ID NO: 2923139 - RNA, 15 nt, Mycobacterium avium subsp. paratuberculosis
cagccgggccugcag

SEQ ID NO: 2923140 - RNA, 14 nt, Mycobacterium avium subsp. paratuberculosis
cagccgggccugcg

SEQ ID NO: 2923141 - RNA, 18 nt, Mycobacterium avium subsp. paratuberculosis
cagccgggccugcggcgc

SEQ ID NO: 2923142 - RNA, 20 nt, Mycobacterium avium subsp. paratuberculosis
cagccgggccugcggcgcgg

SEQ ID NO: 2923143 - RNA, 23 nt, Mycobacterium avium subsp. paratuberculosis
cagccgggccugcggcgcggcca

SEQ ID NO: 2923144 - RNA, 17 nt, Mycobacterium avium subsp. paratuberculosis
cagccgggcggccgggc

SEQ ID NO: 2923145 - RNA, 20 nt, Mycobacterium avium subsp. paratuberculosis
cagccgggcggccgggccgg

SEQ ID NO: 2923146 - RNA, 16 nt, Mycobacterium avium subsp. paratuberculosis
cagccgggcggccucg

SEQ ID NO: 2923147 - RNA, 15 nt, Mycobacterium avium subsp. paratuberculosis
cagccgggcggcgcc

SEQ ID NO: 2923148 - RNA, 17 nt, Mycobacterium avium subsp. paratuberculosis
cagccgggcggcgccga

SEQ ID NO: 2923149 - RNA, 18 nt, Mycobacterium avium subsp. paratuberculosis
cagccgggcggcgccgaa

SEQ ID NO: 2923150 - RNA, 23 nt, Mycobacterium avium subsp. paratuberculosis
cagccgggcggcgccgaaccggg

SEQ ID NO: 2923151 - RNA, 15 nt, Mycobacterium avium subsp. paratuberculosis
cagccgggcggcgcu

SEQ ID NO: 2923152 - RNA, 14 nt, Mycobacterium avium subsp. paratuberculosis
cagccgggcggcgg

SEQ ID NO: 2923153 - RNA, 19 nt, Mycobacterium avium subsp. paratuberculosis
cagccgggcggcggccucc

SEQ ID NO: 2923154 - RNA, 22 nt, Mycobacterium avium subsp. paratuberculosis
cagccgggcggugauggucacc

SEQ ID NO: 2923155 - RNA, 14 nt, Mycobacterium avium subsp. paratuberculosis
cagccggggcagcu

SEQ ID NO: 2923156 - RNA, 16 nt, Mycobacterium avium subsp. paratuberculosis
cagccggggcagcugc

SEQ ID NO: 2923157 - RNA, 18 nt, Mycobacterium avium subsp. paratuberculosis
cagccgggggaucaccuc

SEQ ID NO: 2923158 - RNA, 16 nt, Mycobacterium avium subsp. paratuberculosis
cagccgggggcggugc

SEQ ID NO: 2923159 - RNA, 19 nt, Mycobacterium avium subsp. paratuberculosis
cagccgggggcggugcagc

SEQ ID NO: 2923160 - RNA, 16 nt, Mycobacterium avium subsp. paratuberculosis
cagccgggggucggcu

SEQ ID NO: 2923161 - RNA, 20 nt, Mycobacterium avium subsp. paratuberculosis
cagccgggguagggcggcgg

SEQ ID NO: 2923162 - RNA, 22 nt, Mycobacterium avium subsp. paratuberculosis
cagccgggguagggcggcgggg

SEQ ID NO: 2923163 - RNA, 14 nt, Mycobacterium avium subsp. paratuberculosis
cagccggguagcgc

SEQ ID NO: 2923164 - RNA, 22 nt, Mycobacterium avium subsp. paratuberculosis
cagccgggucaguucgcggcgc

SEQ ID NO: 2923165 - RNA, 16 nt, Mycobacterium avium subsp. paratuberculosis
cagccggguccgcacc

SEQ ID NO: 2923166 - RNA, 23 nt, Mycobacterium avium subsp. paratuberculosis
cagccggguccgcacccgggccc

SEQ ID NO: 2923167 - RNA, 17 nt, Mycobacterium avium subsp. paratuberculosis
cagccgggugaacccga

SEQ ID NO: 2923168 - RNA, 23 nt, Mycobacterium avium subsp. paratuberculosis
cagccgggugaacccgacguugc

SEQ ID NO: 2923169 - RNA, 14 nt, Mycobacterium avium subsp. paratuberculosis
cagccgggugcggg

SEQ ID NO: 2923170 - RNA, 15 nt, Mycobacterium avium subsp. paratuberculosis
cagccgggugcgggc

SEQ ID NO: 2923171 - RNA, 19 nt, Mycobacterium avium subsp. paratuberculosis
cagccgggugcgggccagc

SEQ ID NO: 2923172 - RNA, 23 nt, Mycobacterium avium subsp. paratuberculosis
cagccgggugcgggccagcagcc

SEQ ID NO: 2923173 - RNA, 14 nt, Mycobacterium avium subsp. paratuberculosis
cagccgggugcggu

SEQ ID NO: 2923174 - RNA, 17 nt, Mycobacterium avium subsp. paratuberculosis
cagccgggugcggugca

SEQ ID NO: 2923175 - RNA, 21 nt, Mycobacterium avium subsp. paratuberculosis
cagccgggugcggugcagccg

SEQ ID NO: 2923176 - RNA, 21 nt, Mycobacterium avium subsp. paratuberculosis
cagccggguggcccgcccggg

SEQ ID NO: 2923177 - RNA, 23 nt, Mycobacterium avium subsp. paratuberculosis
cagccggguggcccgcgcgcuga

SEQ ID NO: 2923178 - RNA, 15 nt, Mycobacterium avium subsp. paratuberculosis
cagccgggugggcgg

SEQ ID NO: 2923179 - RNA, 19 nt, Mycobacterium avium subsp. paratuberculosis
cagccgggugggcggcaca

SEQ ID NO: 2923180 - RNA, 22 nt, Mycobacterium avium subsp. paratuberculosis
cagccgggugggcggcacaccg

SEQ ID NO: 2923181 - RNA, 23 nt, Mycobacterium avium subsp. paratuberculosis
cagccgguacagcgucugcugga

SEQ ID NO: 2923182 - RNA, 19 nt, Mycobacterium avium subsp. paratuberculosis
cagccgguacggaucgccg

SEQ ID NO: 2923183 - RNA, 19 nt, Mycobacterium avium subsp. paratuberculosis
cagccggucauaggccgcg

SEQ ID NO: 2923184 - RNA, 20 nt, Mycobacterium avium subsp. paratuberculosis
cagccggucauaggccgcgc

SEQ ID NO: 2923185 - RNA, 19 nt, Mycobacterium avium subsp. paratuberculosis
cagccggucaucgcguagu

SEQ ID NO: 2923186 - RNA, 16 nt, Mycobacterium avium subsp. paratuberculosis
cagccgguccgaccgc

SEQ ID NO: 2923187 - RNA, 18 nt, Mycobacterium avium subsp. paratuberculosis
cagccgguccgaccgcca

SEQ ID NO: 2923188 - RNA, 20 nt, Mycobacterium avium subsp. paratuberculosis
cagccgguccgaccgccacc

SEQ ID NO: 2923189 - RNA, 16 nt, Mycobacterium avium subsp. paratuberculosis
cagccgguccggcggc

SEQ ID NO: 2923190 - RNA, 17 nt, Mycobacterium avium subsp. paratuberculosis
cagccgguccggcggca

SEQ ID NO: 2923191 - RNA, 22 nt, Mycobacterium avium subsp. paratuberculosis
cagccgguccggcggcaccacc

SEQ ID NO: 2923192 - RNA, 16 nt, Mycobacterium avium subsp. paratuberculosis
cagccgguccugggcc

SEQ ID NO: 2923193 - RNA, 17 nt, Mycobacterium avium subsp. paratuberculosis
cagcgacaacgggccgc

SEQ ID NO: 2923194 - RNA, 20 nt, Mycobacterium avium subsp. paratuberculosis
cagcgacaacgggccgccuc

SEQ ID NO: 2923195 - RNA, 14 nt, Mycobacterium avium subsp. paratuberculosis
cagcgacaacgugg

SEQ ID NO: 2923196 - RNA, 21 nt, Mycobacterium avium subsp. paratuberculosis
cagcgacaaucggcucgccuc

SEQ ID NO: 2923197 - RNA, 14 nt, Mycobacterium avium subsp. paratuberculosis
cagcgacaccacgg

SEQ ID NO: 2923198 - RNA, 17 nt, Mycobacterium avium subsp. paratuberculosis
cagcgacaccacgguga

SEQ ID NO: 2923199 - RNA, 14 nt, Mycobacterium avium subsp. paratuberculosis
cagcgacagcaccc

SEQ ID NO: 2923200 - RNA, 16 nt, Mycobacterium avium subsp. paratuberculosis
cagcgacagcacccgc

SEQ ID NO: 2923201 - RNA, 18 nt, Mycobacterium avium subsp. paratuberculosis
cagcgacagcacccgcug

SEQ ID NO: 2923202 - RNA, 17 nt, Mycobacterium avium subsp. paratuberculosis
cagcgacagcagcgugg

SEQ ID NO: 2923203 - RNA, 14 nt, Mycobacterium avium subsp. paratuberculosis
cagcgacagcgcgu

SEQ ID NO: 2923204 - RNA, 16 nt, Mycobacterium avium subsp. paratuberculosis
cagcgacagcgcgucg

SEQ ID NO: 2923205 - RNA, 20 nt, Mycobacterium avium subsp. paratuberculosis
cagcgacagcgcgucggcca

SEQ ID NO: 2923206 - RNA, 16 nt, Mycobacterium avium subsp. paratuberculosis
cagcgacaugaccacc

SEQ ID NO: 2923207 - RNA, 17 nt, Mycobacterium avium subsp. paratuberculosis
cagcgacaugaccaccg

SEQ ID NO: 2923208 - RNA, 19 nt, Mycobacterium avium subsp. paratuberculosis
cagcgacaugaccaccgcg

SEQ ID NO: 2923209 - RNA, 23 nt, Mycobacterium avium subsp. paratuberculosis
cagcgacaugaccaccgcgucgg

SEQ ID NO: 2923210 - RNA, 17 nt, Mycobacterium avium subsp. paratuberculosis
cagcgaccagucggcgu

SEQ ID NO: 2923211 - RNA, 18 nt, Mycobacterium avium subsp. paratuberculosis
cagcgaccagucggcguc

SEQ ID NO: 2923212 - RNA, 19 nt, Mycobacterium avium subsp. paratuberculosis
cagcgacccgaaccggauc

SEQ ID NO: 2923213 - RNA, 17 nt, Mycobacterium avium subsp. paratuberculosis
cagcgaccgcaggucga

SEQ ID NO: 2923214 - RNA, 22 nt, Mycobacterium avium subsp. paratuberculosis
cagcgaccugguccaccgcggc

SEQ ID NO: 2923215 - RNA, 16 nt, Mycobacterium avium subsp. paratuberculosis
cagcgacgagagcgga

SEQ ID NO: 2923216 - RNA, 23 nt, Mycobacterium avium subsp. paratuberculosis
cagcgacgagagcggaucggcgg

SEQ ID NO: 2923217 - RNA, 21 nt, Mycobacterium avium subsp. paratuberculosis
cagcgacgccagcggcagcgc

SEQ ID NO: 2923218 - RNA, 23 nt, Mycobacterium avium subsp. paratuberculosis
cagcgacgccagcggcagcgcca

SEQ ID NO: 2923219 - RNA, 22 nt, Mycobacterium avium subsp. paratuberculosis
cagcgacgcccagaacgacgcg

SEQ ID NO: 2923220 - RNA, 14 nt, Mycobacterium avium subsp. paratuberculosis
cagcgacgcgguga

SEQ ID NO: 2923221 - RNA, 22 nt, Mycobacterium avium subsp. paratuberculosis
cagcgacgcggugagcgcgccg

SEQ ID NO: 2923222 - RNA, 19 nt, Mycobacterium avium subsp. paratuberculosis
cagcgacggaucggccgcg

SEQ ID NO: 2923223 - RNA, 20 nt, Mycobacterium avium subsp. paratuberculosis
cagcgacggcaggucggugc

SEQ ID NO: 2923224 - RNA, 15 nt, Mycobacterium avium subsp. paratuberculosis
cagcgacggcccgcc

SEQ ID NO: 2923225 - RNA, 17 nt, Mycobacterium avium subsp. paratuberculosis
cagcgacggcccgccgg

SEQ ID NO: 2923226 - RNA, 13 nt, Mycobacterium avium subsp. paratuberculosis
cagcgacggccgg

SEQ ID NO: 2923227 - RNA, 15 nt, Mycobacterium avium subsp. paratuberculosis
cagcgacggccgggu

SEQ ID NO: 2923228 - RNA, 16 nt, Mycobacterium avium subsp. paratuberculosis
cagcgacggccggguc

SEQ ID NO: 2923229 - RNA, 23 nt, Mycobacterium avium subsp. paratuberculosis
cagcgacggccgggucaggaaca

SEQ ID NO: 2923230 - RNA, 14 nt, Mycobacterium avium subsp. paratuberculosis
cagcgacgggccgg

SEQ ID NO: 2923231 - RNA, 15 nt, Mycobacterium avium subsp. paratuberculosis
cagcgacgggccggg

SEQ ID NO: 2923232 - RNA, 23 nt, Mycobacterium avium subsp. paratuberculosis
cagcgacgggccgggcacgucga

SEQ ID NO: 2923233 - RNA, 21 nt, Mycobacterium avium subsp. paratuberculosis
cagcgacgucaggucgaccgg

SEQ ID NO: 2923234 - RNA, 15 nt, Mycobacterium avium subsp. paratuberculosis
cagcgacgucugcgg

SEQ ID NO: 2923235 - RNA, 19 nt, Mycobacterium avium subsp. paratuberculosis
cagcgacgucugcggcucg

SEQ ID NO: 2923236 - RNA, 23 nt, Mycobacterium avium subsp. paratuberculosis
cagcgacgucugcggcucggcgc

SEQ ID NO: 2923237 - RNA, 15 nt, Mycobacterium avium subsp. paratuberculosis
cagcgacuccagcgc

SEQ ID NO: 2923238 - RNA, 17 nt, Mycobacterium avium subsp. paratuberculosis
cagcgacuccagcgcga

SEQ ID NO: 2923239 - RNA, 14 nt, Mycobacterium avium subsp. paratuberculosis
cagcgacuccuggu

SEQ ID NO: 2923240 - RNA, 21 nt, Mycobacterium avium subsp. paratuberculosis
cagcgacuccugguccucgau

SEQ ID NO: 2923241 - RNA, 22 nt, Mycobacterium avium subsp. paratuberculosis
cagcgacuccugguccucgauc

SEQ ID NO: 2923242 - RNA, 17 nt, Mycobacterium avium subsp. paratuberculosis
cagcgacucgaccccgc

SEQ ID NO: 2923243 - RNA, 20 nt, Mycobacterium avium subsp. paratuberculosis
cagcgacucgaccccgccca

SEQ ID NO: 2923244 - RNA, 23 nt, Mycobacterium avium subsp. paratuberculosis
cagcgacucgaccccgcccagcg

SEQ ID NO: 2923245 - RNA, 13 nt, Mycobacterium avium subsp. paratuberculosis
cagcgacucgggc

SEQ ID NO: 2923246 - RNA, 15 nt, Mycobacterium avium subsp. paratuberculosis
cagcgacucgggcag

SEQ ID NO: 2923247 - RNA, 16 nt, Mycobacterium avium subsp. paratuberculosis
cagcgacucgggcagg

SEQ ID NO: 2923248 - RNA, 20 nt, Mycobacterium avium subsp. paratuberculosis
cagcgacucgggcaggaugg

SEQ ID NO: 2923249 - RNA, 17 nt, Mycobacterium avium subsp. paratuberculosis
cagcgacucguuggccg

SEQ ID NO: 2923250 - RNA, 19 nt, Mycobacterium avium subsp. paratuberculosis
cagcgacucguuggccggc

SEQ ID NO: 2923251 - RNA, 17 nt, Mycobacterium avium subsp. paratuberculosis
cagcgacuggaccacca

SEQ ID NO: 2923252 - RNA, 19 nt, Mycobacterium avium subsp. paratuberculosis
cagcgacuggaccaccaug

SEQ ID NO: 2923253 - RNA, 19 nt, Mycobacterium avium subsp. paratuberculosis
cagcgacuugaccagcagc

SEQ ID NO: 2923254 - RNA, 15 nt, Mycobacterium avium subsp. paratuberculosis
cagcgacuugccgcc

SEQ ID NO: 2923255 - RNA, 16 nt, Mycobacterium avium subsp. paratuberculosis
cagcgacuugccgccg

SEQ ID NO: 2923256 - RNA, 17 nt, Mycobacterium avium subsp. paratuberculosis
cagcgacuugccgccgg

SEQ ID NO: 2923257 - RNA, 15 nt, Mycobacterium avium subsp. paratuberculosis
cagcgagaaccggcg

SEQ ID NO: 2923258 - RNA, 16 nt, Mycobacterium avium subsp. paratuberculosis
cagcgagaaccggcgc

SEQ ID NO: 2923259 - RNA, 17 nt, Mycobacterium avium subsp. paratuberculosis
cagcgagaaccggcgca

SEQ ID NO: 2923260 - RNA, 17 nt, Mycobacterium avium subsp. paratuberculosis
cagcgagaagucgccga

SEQ ID NO: 2923261 - RNA, 18 nt, Mycobacterium avium subsp. paratuberculosis
cagcgagaagucgccgac

SEQ ID NO: 2923262 - RNA, 19 nt, Mycobacterium avium subsp. paratuberculosis
cagcgagaagucgcucagc

SEQ ID NO: 2923263 - RNA, 21 nt, Mycobacterium avium subsp. paratuberculosis
cagcgagaagucgcucagcgu

SEQ ID NO: 2923264 - RNA, 13 nt, Mycobacterium avium subsp. paratuberculosis
cagcgagaccggc

SEQ ID NO: 2923265 - RNA, 14 nt, Mycobacterium avium subsp. paratuberculosis
cagcgagaccggca

SEQ ID NO: 2923266 - RNA, 15 nt, Mycobacterium avium subsp. paratuberculosis
cagcgagaccggcac

SEQ ID NO: 2923267 - RNA, 22 nt, Mycobacterium avium subsp. paratuberculosis
cagcgagaccggcacggugcac

SEQ ID NO: 2923268 - RNA, 16 nt, Mycobacterium avium subsp. paratuberculosis
cagcgagaccucccgg

SEQ ID NO: 2923269 - RNA, 17 nt, Mycobacterium avium subsp. paratuberculosis
cagcgagaccucccggc

SEQ ID NO: 2923270 - RNA, 13 nt, Mycobacterium avium subsp. paratuberculosis
cagcgagacgacc

SEQ ID NO: 2923271 - RNA, 14 nt, Mycobacterium avium subsp. paratuberculosis
cagcgagacgacca

SEQ ID NO: 2923272 - RNA, 17 nt, Mycobacterium avium subsp. paratuberculosis
cagcgagacgaccagga

SEQ ID NO: 2923273 - RNA, 14 nt, Mycobacterium avium subsp. paratuberculosis
cagcgagcacagcg

SEQ ID NO: 2923274 - RNA, 17 nt, Mycobacterium avium subsp. paratuberculosis
cagcgagcacagcggcg

SEQ ID NO: 2923275 - RNA, 19 nt, Mycobacterium avium subsp. paratuberculosis
cagcgagcacagcggcgga

SEQ ID NO: 2923276 - RNA, 18 nt, Mycobacterium avium subsp. paratuberculosis
cagcgagcaggucaccgg

SEQ ID NO: 2923277 - RNA, 14 nt, Mycobacterium avium subsp. paratuberculosis
cagcgccagcaccg

SEQ ID NO: 2923278 - RNA, 16 nt, Mycobacterium avium subsp. paratuberculosis
cagcgccagcaccgcc

SEQ ID NO: 2923279 - RNA, 21 nt, Mycobacterium avium subsp. paratuberculosis
cagcgccagcaccgccugggu

SEQ ID NO: 2923280 - RNA, 16 nt, Mycobacterium avium subsp. paratuberculosis
cagcgccagcaccggg

SEQ ID NO: 2923281 - RNA, 18 nt, Mycobacterium avium subsp. paratuberculosis
cagcgccagcaccgggcc

SEQ ID NO: 2923282 - RNA, 17 nt, Mycobacterium avium subsp. paratuberculosis
cagcgccagcacggcca

SEQ ID NO: 2923283 - RNA, 21 nt, Mycobacterium avium subsp. paratuberculosis
cagcgccagcacggccaccag

SEQ ID NO: 2923284 - RNA, 12 nt, Mycobacterium avium subsp. paratuberculosis
cagcgccagcgc

SEQ ID NO: 2923285 - RNA, 15 nt, Mycobacterium avium subsp. paratuberculosis
cagcgccagcgccag

SEQ ID NO: 2923286 - RNA, 14 nt, Mycobacterium avium subsp. paratuberculosis
cagcgccagcgcgc

SEQ ID NO: 2923287 - RNA, 13 nt, Mycobacterium avium subsp. paratuberculosis
cagcgccagcggc

SEQ ID NO: 2923288 - RNA, 13 nt, Mycobacterium avium subsp. paratuberculosis
cagcgccagcggg

SEQ ID NO: 2923289 - RNA, 15 nt, Mycobacterium avium subsp. paratuberculosis
cagcgccagcguggc

SEQ ID NO: 2923290 - RNA, 20 nt, Mycobacterium avium subsp. paratuberculosis
cagcgccagcguggccagca

SEQ ID NO: 2923291 - RNA, 24 nt, Mycobacterium avium subsp. paratuberculosis
cagcgccagcguggccagcaccgu

SEQ ID NO: 2923292 - RNA, 13 nt, Mycobacterium avium subsp. paratuberculosis
cagcgccaggugg

SEQ ID NO: 2923293 - RNA, 17 nt, Mycobacterium avium subsp. paratuberculosis
cagcgccagguggguga

SEQ ID NO: 2923294 - RNA, 19 nt, Mycobacterium avium subsp. paratuberculosis
cagcgccaggugggugaac

SEQ ID NO: 2923295 - RNA, 14 nt, Mycobacterium avium subsp. paratuberculosis
cagcgccaugccgc

SEQ ID NO: 2923296 - RNA, 17 nt, Mycobacterium avium subsp. paratuberculosis
cagcgccaugccgccga

SEQ ID NO: 2923297 - RNA, 18 nt, Mycobacterium avium subsp. paratuberculosis
cagcgccaugccgccgac

SEQ ID NO: 2923298 - RNA, 19 nt, Mycobacterium avium subsp. paratuberculosis
cagcgccaugccgccgacc

SEQ ID NO: 2923299 - RNA, 15 nt, Mycobacterium avium subsp. paratuberculosis
cagcgccaugcugcc

SEQ ID NO: 2923300 - RNA, 17 nt, Mycobacterium avium subsp. paratuberculosis
cagcgccaugcugcccu

SEQ ID NO: 2923301 - RNA, 14 nt, Mycobacterium avium subsp. paratuberculosis
cagcgcccagccga

SEQ ID NO: 2923302 - RNA, 19 nt, Mycobacterium avium subsp. paratuberculosis
cagcgcccagccgagccgg

SEQ ID NO: 2923303 - RNA, 15 nt, Mycobacterium avium subsp. paratuberculosis
cagcgcccaggauga

SEQ ID NO: 2923304 - RNA, 15 nt, Mycobacterium avium subsp. paratuberculosis
cagcgcccccagcgg

SEQ ID NO: 2923305 - RNA, 16 nt, Mycobacterium avium subsp. paratuberculosis
cagcgcccccagcggg

SEQ ID NO: 2923306 - RNA, 14 nt, Mycobacterium avium subsp. paratuberculosis
cagcgcccccgaca

SEQ ID NO: 2923307 - RNA, 20 nt, Mycobacterium avium subsp. paratuberculosis
cagcgcccccgacaggccca

SEQ ID NO: 2923308 - RNA, 19 nt, Mycobacterium avium subsp. paratuberculosis
cagcgcccccgaggagacg

SEQ ID NO: 2923309 - RNA, 18 nt, Mycobacterium avium subsp. paratuberculosis
cagcgccccgccggggga

SEQ ID NO: 2923310 - RNA, 16 nt, Mycobacterium avium subsp. paratuberculosis
cagcgcccgauucgcg

SEQ ID NO: 2923311 - RNA, 20 nt, Mycobacterium avium subsp. paratuberculosis
cagcgcccgauucgcggcca

SEQ ID NO: 2923312 - RNA, 16 nt, Mycobacterium avium subsp. paratuberculosis
cagcgcccgcccggac

SEQ ID NO: 2923313 - RNA, 15 nt, Mycobacterium avium subsp. paratuberculosis
cagcgcccgcccggc

SEQ ID NO: 2923314 - RNA, 16 nt, Mycobacterium avium subsp. paratuberculosis
cagcgcccgcccggcc

SEQ ID NO: 2923315 - RNA, 17 nt, Mycobacterium avium subsp. paratuberculosis
cagcgcccgcccggccc

SEQ ID NO: 2923316 - RNA, 19 nt, Mycobacterium avium subsp. paratuberculosis
cagcgcccgcccggcccgg

SEQ ID NO: 2923317 - RNA, 20 nt, Mycobacterium avium subsp. paratuberculosis
cagcgcccgcccggcccggc

SEQ ID NO: 2923318 - RNA, 23 nt, Mycobacterium avium subsp. paratuberculosis
cagcgcccgcccggcccggcgcg

SEQ ID NO: 2923319 - RNA, 14 nt, Mycobacterium avium subsp. paratuberculosis
cagcgcccgccgca

SEQ ID NO: 2923320 - RNA, 13 nt, Mycobacterium avium subsp. paratuberculosis
cagcgcccgcgcg

SEQ ID NO: 2923321 - RNA, 14 nt, Mycobacterium avium subsp. paratuberculosis
cagcgcccgcgcga

SEQ ID NO: 2923322 - RNA, 16 nt, Mycobacterium avium subsp. paratuberculosis
cagcgcccgcgcgauc

SEQ ID NO: 2923323 - RNA, 17 nt, Mycobacterium avium subsp. paratuberculosis
cagcgcccgcgcgaucg

SEQ ID NO: 2923324 - RNA, 18 nt, Mycobacterium avium subsp. paratuberculosis
cagcgcccgcgcgaucgg

SEQ ID NO: 2923325 - RNA, 16 nt, Mycobacterium avium subsp. paratuberculosis
cagcgcccgcgcgggc

SEQ ID NO: 2923326 - RNA, 17 nt, Mycobacterium avium subsp. paratuberculosis
cagcgcccgcgcgggcu

SEQ ID NO: 2923327 - RNA, 19 nt, Mycobacterium avium subsp. paratuberculosis
cagcgcccgcgcgggcugc

SEQ ID NO: 2923328 - RNA, 16 nt, Mycobacterium avium subsp. paratuberculosis
cagcgcccgcgcgugg

SEQ ID NO: 2923329 - RNA, 14 nt, Mycobacterium avium subsp. paratuberculosis
cagcgcccgcgggu

SEQ ID NO: 2923330 - RNA, 17 nt, Mycobacterium avium subsp. paratuberculosis
cagcgcccgcugcgcgg

SEQ ID NO: 2923331 - RNA, 19 nt, Mycobacterium avium subsp. paratuberculosis
cagcgcccggaugucgggc

SEQ ID NO: 2923332 - RNA, 13 nt, Mycobacterium avium subsp. paratuberculosis
cagcgcccggcag

SEQ ID NO: 2923333 - RNA, 14 nt, Mycobacterium avium subsp. paratuberculosis
cagcgcccggcagc

SEQ ID NO: 2923334 - RNA, 14 nt, Mycobacterium avium subsp. paratuberculosis
cagcgcccggccgu

SEQ ID NO: 2923335 - RNA, 15 nt, Mycobacterium avium subsp. paratuberculosis
cagcgcccggccgug

SEQ ID NO: 2923336 - RNA, 14 nt, Mycobacterium avium subsp. paratuberculosis
cagcgcccggcgac

SEQ ID NO: 2923337 - RNA, 15 nt, Mycobacterium avium subsp. paratuberculosis
cagcgcccggcgacc

SEQ ID NO: 2923338 - RNA, 21 nt, Mycobacterium avium subsp. paratuberculosis
cagcgcccggcgaccaccagc

SEQ ID NO: 2923339 - RNA, 14 nt, Mycobacterium avium subsp. paratuberculosis
cagcgcccgggcca

SEQ ID NO: 2923340 - RNA, 19 nt, Mycobacterium avium subsp. paratuberculosis
cagcgcccgggccaggacc

SEQ ID NO: 2923341 - RNA, 13 nt, Mycobacterium avium subsp. paratuberculosis
cagcgcccgggcg

SEQ ID NO: 2923342 - RNA, 18 nt, Mycobacterium avium subsp. paratuberculosis
cagcgcccgggcgcgugc

SEQ ID NO: 2923343 - RNA, 14 nt, Mycobacterium avium subsp. paratuberculosis
cagcgcccgggugg

SEQ ID NO: 2923344 - RNA, 22 nt, Mycobacterium avium subsp. paratuberculosis
cagcgcccguagccgcgguucg

SEQ ID NO: 2923345 - RNA, 17 nt, Mycobacterium avium subsp. paratuberculosis
cagcgccgagaccagcc

SEQ ID NO: 2923346 - RNA, 19 nt, Mycobacterium avium subsp. paratuberculosis
cagcgccgagaccagccag

SEQ ID NO: 2923347 - RNA, 21 nt, Mycobacterium avium subsp. paratuberculosis
cagcgccgagaucgcgguggc

SEQ ID NO: 2923348 - RNA, 17 nt, Mycobacterium avium subsp. paratuberculosis
cagcgccgagccgaggc

SEQ ID NO: 2923349 - RNA, 19 nt, Mycobacterium avium subsp. paratuberculosis
cagcgccgagccgaggcag

SEQ ID NO: 2923350 - RNA, 14 nt, Mycobacterium avium subsp. paratuberculosis
cagcgccgaggugc

SEQ ID NO: 2923351 - RNA, 14 nt, Mycobacterium avium subsp. paratuberculosis
cagcgccgcaacgg

SEQ ID NO: 2923352 - RNA, 14 nt, Mycobacterium avium subsp. paratuberculosis
cagcgccgccaccg

SEQ ID NO: 2923353 - RNA, 16 nt, Mycobacterium avium subsp. paratuberculosis
cagcgccgccaccggc

SEQ ID NO: 2923354 - RNA, 15 nt, Mycobacterium avium subsp. paratuberculosis
cagcgccgccacggc

SEQ ID NO: 2923355 - RNA, 21 nt, Mycobacterium avium subsp. paratuberculosis
cagcgccgccacggccaccgc

SEQ ID NO: 2923356 - RNA, 15 nt, Mycobacterium avium subsp. paratuberculosis
cagcgccgccagccg

SEQ ID NO: 2923357 - RNA, 17 nt, Mycobacterium avium subsp. paratuberculosis
cagcgccgccagccgca

SEQ ID NO: 2923358 - RNA, 18 nt, Mycobacterium avium subsp. paratuberculosis
cagcgccgccagccgcag

SEQ ID NO: 2923359 - RNA, 19 nt, Mycobacterium avium subsp. paratuberculosis
cagcgccgccagccgcagc

SEQ ID NO: 2923360 - RNA, 20 nt, Mycobacterium avium subsp. paratuberculosis
cagcgccgccagccgcagca

SEQ ID NO: 2923361 - RNA, 13 nt, Mycobacterium avium subsp. paratuberculosis
cagcgccgccauc

SEQ ID NO: 2923362 - RNA, 20 nt, Mycobacterium avium subsp. paratuberculosis
cagcgccuugggucccaucg

SEQ ID NO: 2923363 - RNA, 23 nt, Mycobacterium avium subsp. paratuberculosis
cagcgccuugggucccaucgcug

SEQ ID NO: 2923364 - RNA, 13 nt, Mycobacterium avium subsp. paratuberculosis
cagcgcgaaagca

SEQ ID NO: 2923365 - RNA, 21 nt, Mycobacterium avium subsp. paratuberculosis
cagcgcgaaauacgacgagcc

SEQ ID NO: 2923366 - RNA, 17 nt, Mycobacterium avium subsp. paratuberculosis
cagcgcgaacagcgcgg

SEQ ID NO: 2923367 - RNA, 18 nt, Mycobacterium avium subsp. paratuberculosis
cagcgcgaacagcgcggc

SEQ ID NO: 2923368 - RNA, 20 nt, Mycobacterium avium subsp. paratuberculosis
cagcgcgaacagcgcggcca

SEQ ID NO: 2923369 - RNA, 14 nt, Mycobacterium avium subsp. paratuberculosis
cagcgcgacaccgg

SEQ ID NO: 2923370 - RNA, 13 nt, Mycobacterium avium subsp. paratuberculosis
cagcgcgacagcc

SEQ ID NO: 2923371 - RNA, 14 nt, Mycobacterium avium subsp. paratuberculosis
cagcgcgacaucgc

SEQ ID NO: 2923372 - RNA, 20 nt, Mycobacterium avium subsp. paratuberculosis
cagcgcgacaucgccggcga

SEQ ID NO: 2923373 - RNA, 21 nt, Mycobacterium avium subsp. paratuberculosis
cagcgcgacaucgccggcgac

SEQ ID NO: 2923374 - RNA, 11 nt, Mycobacterium avium subsp. paratuberculosis
cagcgcgacca

SEQ ID NO: 2923375 - RNA, 15 nt, Mycobacterium avium subsp. paratuberculosis
cagcgcgaccagccc

SEQ ID NO: 2923376 - RNA, 16 nt, Mycobacterium avium subsp. paratuberculosis
cagcgcgaccagcccg

SEQ ID NO: 2923377 - RNA, 21 nt, Mycobacterium avium subsp. paratuberculosis
cagcgcgaccagcccggccgc

SEQ ID NO: 2923378 - RNA, 15 nt, Mycobacterium avium subsp. paratuberculosis
cagcgcgaccagugc

SEQ ID NO: 2923379 - RNA, 21 nt, Mycobacterium avium subsp. paratuberculosis
cagcgcgacccgcucgacgcg

SEQ ID NO: 2923380 - RNA, 15 nt, Mycobacterium avium subsp. paratuberculosis
cagcgcgaccgcccg

SEQ ID NO: 2923381 - RNA, 19 nt, Mycobacterium avium subsp. paratuberculosis
cagcgcgaccgcccgggcc

SEQ ID NO: 2923382 - RNA, 23 nt, Mycobacterium avium subsp. paratuberculosis
cagcgcgaccucgguggugcuga

SEQ ID NO: 2923383 - RNA, 12 nt, Mycobacterium avium subsp. paratuberculosis
cagcgcgacgca

SEQ ID NO: 2923384 - RNA, 18 nt, Mycobacterium avium subsp. paratuberculosis
cagcgcgacgcacgccgg

SEQ ID NO: 2923385 - RNA, 19 nt, Mycobacterium avium subsp. paratuberculosis
cagcgcgacgcacgccggc

SEQ ID NO: 2923386 - RNA, 21 nt, Mycobacterium avium subsp. paratuberculosis
cagcgcgacgcacgccggcgg

SEQ ID NO: 2923387 - RNA, 23 nt, Mycobacterium avium subsp. paratuberculosis
cagcgcgacgcacgccggcgggg

SEQ ID NO: 2923388 - RNA, 14 nt, Mycobacterium avium subsp. paratuberculosis
cagcgcgacgccga

SEQ ID NO: 2923389 - RNA, 20 nt, Mycobacterium avium subsp. paratuberculosis
cagcgcgacgccgacgccca

SEQ ID NO: 2923390 - RNA, 13 nt, Mycobacterium avium subsp. paratuberculosis
cagcgcgacgggc

SEQ ID NO: 2923391 - RNA, 18 nt, Mycobacterium avium subsp. paratuberculosis
cagcgcgacgggcacccg

SEQ ID NO: 2923392 - RNA, 20 nt, Mycobacterium avium subsp. paratuberculosis
cagcgcgacgggcacccgcg

SEQ ID NO: 2923393 - RNA, 16 nt, Mycobacterium avium subsp. paratuberculosis
cagcgcgacgucgacc

SEQ ID NO: 2923394 - RNA, 21 nt, Mycobacterium avium subsp. paratuberculosis
cagcgcgacgucgaccgcgac

SEQ ID NO: 2923395 - RNA, 13 nt, Mycobacterium avium subsp. paratuberculosis
cagcgcgacgugc

SEQ ID NO: 2923396 - RNA, 14 nt, Mycobacterium avium subsp. paratuberculosis
cagcgcgacgugcc

SEQ ID NO: 2923397 - RNA, 21 nt, Mycobacterium avium subsp. paratuberculosis
cagcgcgacgugccggcgaug

SEQ ID NO: 2923398 - RNA, 23 nt, Mycobacterium avium subsp. paratuberculosis
cagcgcgaggcgcaguagccgac

SEQ ID NO: 2923399 - RNA, 13 nt, Mycobacterium avium subsp. paratuberculosis
cagcgcgaggucg

SEQ ID NO: 2923400 - RNA, 17 nt, Mycobacterium avium subsp. paratuberculosis
cagcgcgaggucgacgg

SEQ ID NO: 2923401 - RNA, 19 nt, Mycobacterium avium subsp. paratuberculosis
cagcgcgaucaacgggucg

SEQ ID NO: 2923402 - RNA, 12 nt, Mycobacterium avium subsp. paratuberculosis
cagcgcgauccg

SEQ ID NO: 2923403 - RNA, 16 nt, Mycobacterium avium subsp. paratuberculosis
cagcgcgauccgcgcg

SEQ ID NO: 2923404 - RNA, 19 nt, Mycobacterium avium subsp. paratuberculosis
cagcgcgauccgcgcgucg

SEQ ID NO: 2923405 - RNA, 18 nt, Mycobacterium avium subsp. paratuberculosis
cagcgcgauccggggggc

SEQ ID NO: 2923406 - RNA, 13 nt, Mycobacterium avium subsp. paratuberculosis
cagcgcgaucgcc

SEQ ID NO: 2923407 - RNA, 14 nt, Mycobacterium avium subsp. paratuberculosis
cagcgcgaucgccg

SEQ ID NO: 2923408 - RNA, 19 nt, Mycobacterium avium subsp. paratuberculosis
cagcgcgaucgccgggaug

SEQ ID NO: 2923409 - RNA, 17 nt, Mycobacterium avium subsp. paratuberculosis
cagcgcgaugccggcca

SEQ ID NO: 2923410 - RNA, 23 nt, Mycobacterium avium subsp. paratuberculosis
cagcgcgaugccggccaggcaca

SEQ ID NO: 2923411 - RNA, 16 nt, Mycobacterium avium subsp. paratuberculosis
cagcgcgcaacgacga

SEQ ID NO: 2923412 - RNA, 21 nt, Mycobacterium avium subsp. paratuberculosis
cagcgcgcacaauucggucag

SEQ ID NO: 2923413 - RNA, 22 nt, Mycobacterium avium subsp. paratuberculosis
cagcgcgcacaauucggucagc

SEQ ID NO: 2923414 - RNA, 13 nt, Mycobacterium avium subsp. paratuberculosis
cagcgcgcacagc

SEQ ID NO: 2923415 - RNA, 14 nt, Mycobacterium avium subsp. paratuberculosis
cagcgcgcacagcg

SEQ ID NO: 2923416 - RNA, 23 nt, Mycobacterium avium subsp. paratuberculosis
cagcgcgcacagcgccacaccga

SEQ ID NO: 2923417 - RNA, 20 nt, Mycobacterium avium subsp. paratuberculosis
cagcgcgcacgcggacacga

SEQ ID NO: 2923418 - RNA, 14 nt, Mycobacterium avium subsp. paratuberculosis
cagcgcgcagaaca

SEQ ID NO: 2923419 - RNA, 15 nt, Mycobacterium avium subsp. paratuberculosis
cagcgcgcagaacac

SEQ ID NO: 2923420 - RNA, 17 nt, Mycobacterium avium subsp. paratuberculosis
cagcgcgcagaacacca

SEQ ID NO: 2923421 - RNA, 23 nt, Mycobacterium avium subsp. paratuberculosis
cagcgcgcagaacaccaccgcca

SEQ ID NO: 2923422 - RNA, 14 nt, Mycobacterium avium subsp. paratuberculosis
cagcgcgcccaggc

SEQ ID NO: 2923423 - RNA, 15 nt, Mycobacterium avium subsp. paratuberculosis
cagcgcgcccaggcc

SEQ ID NO: 2923424 - RNA, 17 nt, Mycobacterium avium subsp. paratuberculosis
cagcgcgcccaggcuga

SEQ ID NO: 2923425 - RNA, 20 nt, Mycobacterium avium subsp. paratuberculosis
cagcgcgcccaggcugaaca

SEQ ID NO: 2923426 - RNA, 12 nt, Mycobacterium avium subsp. paratuberculosis
cagcgcgcccca

SEQ ID NO: 2923427 - RNA, 20 nt, Mycobacterium avium subsp. paratuberculosis
cagcgcgccccagugcaggc

SEQ ID NO: 2923428 - RNA, 15 nt, Mycobacterium avium subsp. paratuberculosis
cagcgcgcccgacgg

SEQ ID NO: 2923429 - RNA, 17 nt, Mycobacterium avium subsp. paratuberculosis
cagcgcgcccgacgguc

SEQ ID NO: 2923430 - RNA, 16 nt, Mycobacterium avium subsp. paratuberculosis
cagcgcgcccgccauc

SEQ ID NO: 2923431 - RNA, 21 nt, Mycobacterium avium subsp. paratuberculosis
cagcgcgcccugaggcccggu

SEQ ID NO: 2923432 - RNA, 22 nt, Mycobacterium avium subsp. paratuberculosis
cagcgcgcccugaggcccggug

SEQ ID NO: 2923433 - RNA, 13 nt, Mycobacterium avium subsp. paratuberculosis
cagcgcgccgaac

SEQ ID NO: 2923434 - RNA, 14 nt, Mycobacterium avium subsp. paratuberculosis
cagcgcgccgaaca

SEQ ID NO: 2923435 - RNA, 13 nt, Mycobacterium avium subsp. paratuberculosis
cagcgcgccgacc

SEQ ID NO: 2923436 - RNA, 14 nt, Mycobacterium avium subsp. paratuberculosis
cagcgcgccgacca

SEQ ID NO: 2923437 - RNA, 17 nt, Mycobacterium avium subsp. paratuberculosis
cagcgcgccgaccacgg

SEQ ID NO: 2923438 - RNA, 14 nt, Mycobacterium avium subsp. paratuberculosis
cagcgcgccgaucg

SEQ ID NO: 2923439 - RNA, 14 nt, Mycobacterium avium subsp. paratuberculosis
cagcgcgccgccca

SEQ ID NO: 2923440 - RNA, 21 nt, Mycobacterium avium subsp. paratuberculosis
cagcgcgccgcccagcgguga

SEQ ID NO: 2923441 - RNA, 13 nt, Mycobacterium avium subsp. paratuberculosis
cagcgcgccgccg

SEQ ID NO: 2923442 - RNA, 16 nt, Mycobacterium avium subsp. paratuberculosis
cagcgcgccgcgcugg

SEQ ID NO: 2923443 - RNA, 14 nt, Mycobacterium avium subsp. paratuberculosis
cagcgcgccgcgga

SEQ ID NO: 2923444 - RNA, 12 nt, Mycobacterium avium subsp. paratuberculosis
cagcgcgccgcu

SEQ ID NO: 2923445 - RNA, 12 nt, Mycobacterium avium subsp. paratuberculosis
cagcgcgccggc

SEQ ID NO: 2923446 - RNA, 17 nt, Mycobacterium avium subsp. paratuberculosis
cagcgcgccggccagca

SEQ ID NO: 2923447 - RNA, 16 nt, Mycobacterium avium subsp. paratuberculosis
cagcgcggugagcagc

SEQ ID NO: 2923448 - RNA, 15 nt, Mycobacterium avium subsp. paratuberculosis
cagcgcggugcccag

SEQ ID NO: 2923449 - RNA, 18 nt, Mycobacterium avium subsp. paratuberculosis
cagcgcggugcccagcca

SEQ ID NO: 2923450 - RNA, 22 nt, Mycobacterium avium subsp. paratuberculosis
cagcgcggugcccagccaggcc

SEQ ID NO: 2923451 - RNA, 13 nt, Mycobacterium avium subsp. paratuberculosis
cagcgcggugccg

SEQ ID NO: 2923452 - RNA, 14 nt, Mycobacterium avium subsp. paratuberculosis
cagcgcggugccga

SEQ ID NO: 2923453 - RNA, 15 nt, Mycobacterium avium subsp. paratuberculosis
cagcgcggugccgac

SEQ ID NO: 2923454 - RNA, 17 nt, Mycobacterium avium subsp. paratuberculosis
cagcgcggugccgaccu

SEQ ID NO: 2923455 - RNA, 19 nt, Mycobacterium avium subsp. paratuberculosis
cagcgcggugccgaccugg

SEQ ID NO: 2923456 - RNA, 15 nt, Mycobacterium avium subsp. paratuberculosis
cagcgcggugccggu

SEQ ID NO: 2923457 - RNA, 14 nt, Mycobacterium avium subsp. paratuberculosis
cagcgcgguggcca

SEQ ID NO: 2923458 - RNA, 17 nt, Mycobacterium avium subsp. paratuberculosis
cagcgcgguggucagca

SEQ ID NO: 2923459 - RNA, 20 nt, Mycobacterium avium subsp. paratuberculosis
cagcgcgguggucagcaccg

SEQ ID NO: 2923460 - RNA, 22 nt, Mycobacterium avium subsp. paratuberculosis
cagcgcgguggucagcaccggc

SEQ ID NO: 2923461 - RNA, 24 nt, Mycobacterium avium subsp. paratuberculosis
cagcgcgguggucagcaccggcgu

SEQ ID NO: 2923462 - RNA, 22 nt, Mycobacterium avium subsp. paratuberculosis
cagcgcgguggucagcggcgcc

SEQ ID NO: 2923463 - RNA, 20 nt, Mycobacterium avium subsp. paratuberculosis
cagcgcgguguacagcgcgc

SEQ ID NO: 2923464 - RNA, 22 nt, Mycobacterium avium subsp. paratuberculosis
cagcgcgguguacagcgcgccg

SEQ ID NO: 2923465 - RNA, 23 nt, Mycobacterium avium subsp. paratuberculosis
cagcgcggugugcggcggcucgu

SEQ ID NO: 2923466 - RNA, 18 nt, Mycobacterium avium subsp. paratuberculosis
cagcgcgguuuccggcga

SEQ ID NO: 2923467 - RNA, 19 nt, Mycobacterium avium subsp. paratuberculosis
cagcgcgguuuccggcgau

SEQ ID NO: 2923468 - RNA, 17 nt, Mycobacterium avium subsp. paratuberculosis
cagcgcguacuccgaca

SEQ ID NO: 2923469 - RNA, 23 nt, Mycobacterium avium subsp. paratuberculosis
cagcgcguagagcaucaggucgg

SEQ ID NO: 2923470 - RNA, 15 nt, Mycobacterium avium subsp. paratuberculosis
cagcgcguagucggc

SEQ ID NO: 2923471 - RNA, 19 nt, Mycobacterium avium subsp. paratuberculosis
cagcgcguagucggcgucg

SEQ ID NO: 2923472 - RNA, 23 nt, Mycobacterium avium subsp. paratuberculosis
cagcgcguagucggcgucggcca

SEQ ID NO: 2923473 - RNA, 14 nt, Mycobacterium avium subsp. paratuberculosis
cagcgcguccaggu

SEQ ID NO: 2923474 - RNA, 16 nt, Mycobacterium avium subsp. paratuberculosis
cagcgcguccaggugc

SEQ ID NO: 2923475 - RNA, 17 nt, Mycobacterium avium subsp. paratuberculosis
cagcgcguccaggugcg

SEQ ID NO: 2923476 - RNA, 21 nt, Mycobacterium avium subsp. paratuberculosis
cagcgcguccaggugcgccgc

SEQ ID NO: 2923477 - RNA, 22 nt, Mycobacterium avium subsp. paratuberculosis
cagcgcguccaggugcgccgcc

SEQ ID NO: 2923478 - RNA, 23 nt, Mycobacterium avium subsp. paratuberculosis
cagcgcgucgaggucgcgcagca

SEQ ID NO: 2923479 - RNA, 18 nt, Mycobacterium avium subsp. paratuberculosis
cagcgcgucgcacagcgc

SEQ ID NO: 2923480 - RNA, 19 nt, Mycobacterium avium subsp. paratuberculosis
cagcgcgucgcacagcgcc

SEQ ID NO: 2923481 - RNA, 22 nt, Mycobacterium avium subsp. paratuberculosis
cagcgcgucgcacagcgccgcg

SEQ ID NO: 2923482 - RNA, 12 nt, Mycobacterium avium subsp. paratuberculosis
cagcgcgucgcg

SEQ ID NO: 2923483 - RNA, 13 nt, Mycobacterium avium subsp. paratuberculosis
cagcgcgucgcgc

SEQ ID NO: 2923484 - RNA, 15 nt, Mycobacterium avium subsp. paratuberculosis
cagcgcgucgcgccc

SEQ ID NO: 2923485 - RNA, 16 nt, Mycobacterium avium subsp. paratuberculosis
cagcgcgucgcgcccg

SEQ ID NO: 2923486 - RNA, 18 nt, Mycobacterium avium subsp. paratuberculosis
cagcgcgucgcgcccggc

SEQ ID NO: 2923487 - RNA, 21 nt, Mycobacterium avium subsp. paratuberculosis
cagcgcgucgcgggcccgggc

SEQ ID NO: 2923488 - RNA, 14 nt, Mycobacterium avium subsp. paratuberculosis
cagcgcgucgcugc

SEQ ID NO: 2923489 - RNA, 17 nt, Mycobacterium avium subsp. paratuberculosis
cagcgcgucgcugccgu

SEQ ID NO: 2923490 - RNA, 23 nt, Mycobacterium avium subsp. paratuberculosis
cagcgcgucggccagcaccacca

SEQ ID NO: 2923491 - RNA, 20 nt, Mycobacterium avium subsp. paratuberculosis
cagcgcgucggccagcgcgc

SEQ ID NO: 2923492 - RNA, 14 nt, Mycobacterium avium subsp. paratuberculosis
cagcgcgucggcga

SEQ ID NO: 2923493 - RNA, 15 nt, Mycobacterium avium subsp. paratuberculosis
cagcgcgucggcgac

SEQ ID NO: 2923494 - RNA, 16 nt, Mycobacterium avium subsp. paratuberculosis
cagcgcgucggcgacc

SEQ ID NO: 2923495 - RNA, 17 nt, Mycobacterium avium subsp. paratuberculosis
cagcgcgucggcgaccg

SEQ ID NO: 2923496 - RNA, 21 nt, Mycobacterium avium subsp. paratuberculosis
cagcgcgucggcgaccgcgcg

SEQ ID NO: 2923497 - RNA, 18 nt, Mycobacterium avium subsp. paratuberculosis
cagcgcgucgggcucggc

SEQ ID NO: 2923498 - RNA, 23 nt, Mycobacterium avium subsp. paratuberculosis
cagcgcgucgggcucggccgccg

SEQ ID NO: 2923499 - RNA, 17 nt, Mycobacterium avium subsp. paratuberculosis
cagcgcgucggugaugu

SEQ ID NO: 2923500 - RNA, 17 nt, Mycobacterium avium subsp. paratuberculosis
cagcgcgucgucgguca

SEQ ID NO: 2923501 - RNA, 21 nt, Mycobacterium avium subsp. paratuberculosis
cagcgcgucgugcaacucccg

SEQ ID NO: 2923502 - RNA, 17 nt, Mycobacterium avium subsp. paratuberculosis
cagcgcgugaccccggc

SEQ ID NO: 2923503 - RNA, 24 nt, Mycobacterium avium subsp. paratuberculosis
cagcgcgugaccccggcgaccagc

SEQ ID NO: 2923504 - RNA, 17 nt, Mycobacterium avium subsp. paratuberculosis
cagcgcgugaucggugc

SEQ ID NO: 2923505 - RNA, 21 nt, Mycobacterium avium subsp. paratuberculosis
cagcgcgugaucggugcccgc

SEQ ID NO: 2923506 - RNA, 19 nt, Mycobacterium avium subsp. paratuberculosis
cagcgcgugaugggugggc

SEQ ID NO: 2923507 - RNA, 23 nt, Mycobacterium avium subsp. paratuberculosis
cagcgcgugcggggugugcaggc

SEQ ID NO: 2923508 - RNA, 18 nt, Mycobacterium avium subsp. paratuberculosis
cagcgcuaaccgcgggca

SEQ ID NO: 2923509 - RNA, 22 nt, Mycobacterium avium subsp. paratuberculosis
cagcgcuaaccgcgggcaucgc

SEQ ID NO: 2923510 - RNA, 15 nt, Mycobacterium avium subsp. paratuberculosis
cagcgcuccugcagc

SEQ ID NO: 2923511 - RNA, 16 nt, Mycobacterium avium subsp. paratuberculosis
cagcgcuccugcagcg

SEQ ID NO: 2923512 - RNA, 19 nt, Mycobacterium avium subsp. paratuberculosis
cagcgcuccugcagcgcgg

SEQ ID NO: 2923513 - RNA, 20 nt, Mycobacterium avium subsp. paratuberculosis
cagcgcuccugcagcgcggc

SEQ ID NO: 2923514 - RNA, 21 nt, Mycobacterium avium subsp. paratuberculosis
cagcgcuccugcagcgcggcg

SEQ ID NO: 2923515 - RNA, 18 nt, Mycobacterium avium subsp. paratuberculosis
cagcgcucgacgaggcgg

SEQ ID NO: 2923516 - RNA, 13 nt, Mycobacterium avium subsp. paratuberculosis
cagcgcucgucgu

SEQ ID NO: 2923517 - RNA, 14 nt, Mycobacterium avium subsp. paratuberculosis
cagcgcucgucguc

SEQ ID NO: 2923518 - RNA, 15 nt, Mycobacterium avium subsp. paratuberculosis
cagcgcucgucgucg

SEQ ID NO: 2923519 - RNA, 14 nt, Mycobacterium avium subsp. paratuberculosis
cagcgcuggccggc

SEQ ID NO: 2923520 - RNA, 18 nt, Mycobacterium avium subsp. paratuberculosis
cagcgcuggccggccacc

SEQ ID NO: 2923521 - RNA, 19 nt, Mycobacterium avium subsp. paratuberculosis
cagcgcuggccggccacca

SEQ ID NO: 2923522 - RNA, 16 nt, Mycobacterium avium subsp. paratuberculosis
cagcgcugucgcgggc

SEQ ID NO: 2923523 - RNA, 22 nt, Mycobacterium avium subsp. paratuberculosis
cagcgcugucgcgggcccgcgu

SEQ ID NO: 2923524 - RNA, 17 nt, Mycobacterium avium subsp. paratuberculosis
cagcgcuuccagcgcgg

SEQ ID NO: 2923525 - RNA, 16 nt, Mycobacterium avium subsp. paratuberculosis
cagcgcuucgcgcugu

SEQ ID NO: 2923526 - RNA, 16 nt, Mycobacterium avium subsp. paratuberculosis
cagcgcuuucgcgcac

SEQ ID NO: 2923527 - RNA, 20 nt, Mycobacterium avium subsp. paratuberculosis
cagcgcuuucgcgcacgcca

SEQ ID NO: 2923528 - RNA, 17 nt, Mycobacterium avium subsp. paratuberculosis
cagcggaaacgacgucg

SEQ ID NO: 2923529 - RNA, 23 nt, Mycobacterium avium subsp. paratuberculosis
cagcggaaacgacgucgccacca

SEQ ID NO: 2923530 - RNA, 21 nt, Mycobacterium avium subsp. paratuberculosis
cagcggaaccgggggccguca

SEQ ID NO: 2923531 - RNA, 20 nt, Mycobacterium avium subsp. paratuberculosis
cagcggcgccgggucaccgg

SEQ ID NO: 2923532 - RNA, 13 nt, Mycobacterium avium subsp. paratuberculosis
cagcggcgcgccg

SEQ ID NO: 2923533 - RNA, 19 nt, Mycobacterium avium subsp. paratuberculosis
cagcggcgcgccgggcagc

SEQ ID NO: 2923534 - RNA, 13 nt, Mycobacterium avium subsp. paratuberculosis
cagcggcgcgcgc

SEQ ID NO: 2923535 - RNA, 16 nt, Mycobacterium avium subsp. paratuberculosis
cagcggcgcgcgccgc

SEQ ID NO: 2923536 - RNA, 17 nt, Mycobacterium avium subsp. paratuberculosis
cagcggcgcgcgccgca

SEQ ID NO: 2923537 - RNA, 13 nt, Mycobacterium avium subsp. paratuberculosis
cagcggcgcggcc

SEQ ID NO: 2923538 - RNA, 12 nt, Mycobacterium avium subsp. paratuberculosis
cagcggcgcggu

SEQ ID NO: 2923539 - RNA, 20 nt, Mycobacterium avium subsp. paratuberculosis
cagcggcgcgguuucggcgu

SEQ ID NO: 2923540 - RNA, 15 nt, Mycobacterium avium subsp. paratuberculosis
cagcggcgcgucgcu

SEQ ID NO: 2923541 - RNA, 13 nt, Mycobacterium avium subsp. paratuberculosis
cagcggcggccau

SEQ ID NO: 2923542 - RNA, 21 nt, Mycobacterium avium subsp. paratuberculosis
cagcggcggccauucaucgcg

SEQ ID NO: 2923543 - RNA, 13 nt, Mycobacterium avium subsp. paratuberculosis
cagcggcggccuu

SEQ ID NO: 2923544 - RNA, 18 nt, Mycobacterium avium subsp. paratuberculosis
cagcggcgggcccagcag

SEQ ID NO: 2923545 - RNA, 17 nt, Mycobacterium avium subsp. paratuberculosis
cagcggcgucacgcccu

SEQ ID NO: 2923546 - RNA, 14 nt, Mycobacterium avium subsp. paratuberculosis
cagcggcgucgucg

SEQ ID NO: 2923547 - RNA, 16 nt, Mycobacterium avium subsp. paratuberculosis
cagcggcgucgucguc

SEQ ID NO: 2923548 - RNA, 22 nt, Mycobacterium avium subsp. paratuberculosis
cagcggcgugcugcgcagcagc

SEQ ID NO: 2923549 - RNA, 17 nt, Mycobacterium avium subsp. paratuberculosis
cagcggcucgcgggugc

SEQ ID NO: 2923550 - RNA, 14 nt, Mycobacterium avium subsp. paratuberculosis
cagcggcucggccu

SEQ ID NO: 2923551 - RNA, 16 nt, Mycobacterium avium subsp. paratuberculosis
cagcggcugcagcaga

SEQ ID NO: 2923552 - RNA, 19 nt, Mycobacterium avium subsp. paratuberculosis
cagcggcugcagcagaugc

SEQ ID NO: 2923553 - RNA, 14 nt, Mycobacterium avium subsp. paratuberculosis
cagcggcugcugca

SEQ ID NO: 2923554 - RNA, 19 nt, Mycobacterium avium subsp. paratuberculosis
cagcggcugcugcagcgcc

SEQ ID NO: 2923555 - RNA, 18 nt, Mycobacterium avium subsp. paratuberculosis
cagcggcuguagcacccg

SEQ ID NO: 2923556 - RNA, 19 nt, Mycobacterium avium subsp. paratuberculosis
cagcggcuguagcacccgg

SEQ ID NO: 2923557 - RNA, 20 nt, Mycobacterium avium subsp. paratuberculosis
cagcggcuguagcacccggc

SEQ ID NO: 2923558 - RNA, 21 nt, Mycobacterium avium subsp. paratuberculosis
cagcggcuguagcacccggcc

SEQ ID NO: 2923559 - RNA, 23 nt, Mycobacterium avium subsp. paratuberculosis
cagcggcuguagcacccggccgg

SEQ ID NO: 2923560 - RNA, 22 nt, Mycobacterium avium subsp. paratuberculosis
cagcggcuugaccggcucgccg

SEQ ID NO: 2923561 - RNA, 21 nt, Mycobacterium avium subsp. paratuberculosis
cagcggcuugagccggaucgg

SEQ ID NO: 2923562 - RNA, 15 nt, Mycobacterium avium subsp. paratuberculosis
cagcggcuugagcgc

SEQ ID NO: 2923563 - RNA, 22 nt, Mycobacterium avium subsp. paratuberculosis
cagcggcuugagcgccagcgcg

SEQ ID NO: 2923564 - RNA, 24 nt, Mycobacterium avium subsp. paratuberculosis
cagcggcuugagcgccagcgcggu

SEQ ID NO: 2923565 - RNA, 21 nt, Mycobacterium avium subsp. paratuberculosis
cagcggcuuggccgugcaggg

SEQ ID NO: 2923566 - RNA, 21 nt, Mycobacterium avium subsp. paratuberculosis
cagcggcuuggucaccagcuc

SEQ ID NO: 2923567 - RNA, 22 nt, Mycobacterium avium subsp. paratuberculosis
cagcggcuuggucaccagcucg

SEQ ID NO: 2923568 - RNA, 17 nt, Mycobacterium avium subsp. paratuberculosis
cagcgggaacaccacgu

SEQ ID NO: 2923569 - RNA, 15 nt, Mycobacterium avium subsp. paratuberculosis
cagcgggaagccgag

SEQ ID NO: 2923570 - RNA, 18 nt, Mycobacterium avium subsp. paratuberculosis
cagcgggaagccgagguc

SEQ ID NO: 2923571 - RNA, 21 nt, Mycobacterium avium subsp. paratuberculosis
cagcgggauguacuugaugac

SEQ ID NO: 2923572 - RNA, 14 nt, Mycobacterium avium subsp. paratuberculosis
cagcgggauguagc

SEQ ID NO: 2923573 - RNA, 17 nt, Mycobacterium avium subsp. paratuberculosis
cagcgggauguagccgg

SEQ ID NO: 2923574 - RNA, 18 nt, Mycobacterium avium subsp. paratuberculosis
cagcgggcagagcugcug

SEQ ID NO: 2923575 - RNA, 14 nt, Mycobacterium avium subsp. paratuberculosis
cagcgggcccgggc

SEQ ID NO: 2923576 - RNA, 22 nt, Mycobacterium avium subsp. paratuberculosis
cagcgggcccgggcugcccggg

SEQ ID NO: 2923577 - RNA, 20 nt, Mycobacterium avium subsp. paratuberculosis
cagcgggccgaagaccgggc

SEQ ID NO: 2923578 - RNA, 22 nt, Mycobacterium avium subsp. paratuberculosis
cagcgggccgaagaccgggccg

SEQ ID NO: 2923579 - RNA, 23 nt, Mycobacterium avium subsp. paratuberculosis
cagcgggccgaagaccgggccga

SEQ ID NO: 2923580 - RNA, 16 nt, Mycobacterium avium subsp. paratuberculosis
cagcgggccgacagca

SEQ ID NO: 2923581 - RNA, 20 nt, Mycobacterium avium subsp. paratuberculosis
cagcgggccgacagcacgcc

SEQ ID NO: 2923582 - RNA, 21 nt, Mycobacterium avium subsp. paratuberculosis
cagcgggccgacagcacgccg

SEQ ID NO: 2923583 - RNA, 13 nt, Mycobacterium avium subsp. paratuberculosis
cagcgggccgacc

SEQ ID NO: 2923584 - RNA, 15 nt, Mycobacterium avium subsp. paratuberculosis
cagcgggccgacccg

SEQ ID NO: 2923585 - RNA, 20 nt, Mycobacterium avium subsp. paratuberculosis
cagcgggccgacccggccga

SEQ ID NO: 2923586 - RNA, 13 nt, Mycobacterium avium subsp. paratuberculosis
cagcgggccgagc

SEQ ID NO: 2923587 - RNA, 13 nt, Mycobacterium avium subsp. paratuberculosis
cagcgggccggcg

SEQ ID NO: 2923588 - RNA, 15 nt, Mycobacterium avium subsp. paratuberculosis
cagcgggccggcguc

SEQ ID NO: 2923589 - RNA, 18 nt, Mycobacterium avium subsp. paratuberculosis
cagcgggccggcgucguc

SEQ ID NO: 2923590 - RNA, 18 nt, Mycobacterium avium subsp. paratuberculosis
cagcgggccguugccggu

SEQ ID NO: 2923591 - RNA, 22 nt, Mycobacterium avium subsp. paratuberculosis
cagcgggccguugccggucccg

SEQ ID NO: 2923592 - RNA, 19 nt, Mycobacterium avium subsp. paratuberculosis
cagcgggcgcagcucgucg

SEQ ID NO: 2923593 - RNA, 13 nt, Mycobacterium avium subsp. paratuberculosis
cagcgggcggcca

SEQ ID NO: 2923594 - RNA, 19 nt, Mycobacterium avium subsp. paratuberculosis
cagcgggcggccagccgcu

SEQ ID NO: 2923595 - RNA, 11 nt, Mycobacterium avium subsp. paratuberculosis
cagcgggcugg

SEQ ID NO: 2923596 - RNA, 13 nt, Mycobacterium avium subsp. paratuberculosis
cagcgggcuggcg

SEQ ID NO: 2923597 - RNA, 15 nt, Mycobacterium avium subsp. paratuberculosis
cagcgggcuggcgua

SEQ ID NO: 2923598 - RNA, 21 nt, Mycobacterium avium subsp. paratuberculosis
cagcgggcuguccgcguggcc

SEQ ID NO: 2923599 - RNA, 18 nt, Mycobacterium avium subsp. paratuberculosis
cagcgggcugugccggcg

SEQ ID NO: 2923600 - RNA, 20 nt, Mycobacterium avium subsp. paratuberculosis
cagcggggaggcccagcccg

SEQ ID NO: 2923601 - RNA, 21 nt, Mycobacterium avium subsp. paratuberculosis
cagcggggaggcccagcccgc

SEQ ID NO: 2923602 - RNA, 19 nt, Mycobacterium avium subsp. paratuberculosis
cagcggggcaagcagcggc

SEQ ID NO: 2923603 - RNA, 18 nt, Mycobacterium avium subsp. paratuberculosis
cagcggggcgaacccggc

SEQ ID NO: 2923604 - RNA, 19 nt, Mycobacterium avium subsp. paratuberculosis
cagcggggcgaacccggcg

SEQ ID NO: 2923605 - RNA, 12 nt, Mycobacterium avium subsp. paratuberculosis
cagcggggcgac

SEQ ID NO: 2923606 - RNA, 13 nt, Mycobacterium avium subsp. paratuberculosis
cagcggggcgacc

SEQ ID NO: 2923607 - RNA, 15 nt, Mycobacterium avium subsp. paratuberculosis
cagcggggcgaccuu

SEQ ID NO: 2923608 - RNA, 17 nt, Mycobacterium avium subsp. paratuberculosis
cagcggggcgagcuggc

SEQ ID NO: 2923609 - RNA, 21 nt, Mycobacterium avium subsp. paratuberculosis
cagcggggcgagcuggccgcc

SEQ ID NO: 2923610 - RNA, 23 nt, Mycobacterium avium subsp. paratuberculosis
cagcggggcgagcuggccgccca

SEQ ID NO: 2923611 - RNA, 16 nt, Mycobacterium avium subsp. paratuberculosis
cagcggggcgcgcagg

SEQ ID NO: 2923612 - RNA, 15 nt, Mycobacterium avium subsp. paratuberculosis
cagcggggcguccag

SEQ ID NO: 2923613 - RNA, 17 nt, Mycobacterium avium subsp. paratuberculosis
cagcggggugagcaccg

SEQ ID NO: 2923614 - RNA, 22 nt, Mycobacterium avium subsp. paratuberculosis
cagcggggugagcaccgcgacc

SEQ ID NO: 2923615 - RNA, 12 nt, Mycobacterium avium subsp. paratuberculosis
cagcgucgccgc

SEQ ID NO: 2923616 - RNA, 14 nt, Mycobacterium avium subsp. paratuberculosis
cagcgucgccgccc

SEQ ID NO: 2923617 - RNA, 16 nt, Mycobacterium avium subsp. paratuberculosis
cagcgucgccgccccg

SEQ ID NO: 2923618 - RNA, 16 nt, Mycobacterium avium subsp. paratuberculosis
cagcgucgcgccgcca

SEQ ID NO: 2923619 - RNA, 20 nt, Mycobacterium avium subsp. paratuberculosis
cagcgucgcgccgccacccc

SEQ ID NO: 2923620 - RNA, 17 nt, Mycobacterium avium subsp. paratuberculosis
cagcgucggcgugcccg

SEQ ID NO: 2923621 - RNA, 22 nt, Mycobacterium avium subsp. paratuberculosis
cagcgucggcgugcccgccgac

SEQ ID NO: 2923622 - RNA, 23 nt, Mycobacterium avium subsp. paratuberculosis
cagcgucggcgugcccgccgacc

SEQ ID NO: 2923623 - RNA, 14 nt, Mycobacterium avium subsp. paratuberculosis
cagcgucgggcucg

SEQ ID NO: 2923624 - RNA, 18 nt, Mycobacterium avium subsp. paratuberculosis
cagcgucgggcucgccuc

SEQ ID NO: 2923625 - RNA, 17 nt, Mycobacterium avium subsp. paratuberculosis
cagcgucgucaggccgu

SEQ ID NO: 2923626 - RNA, 23 nt, Mycobacterium avium subsp. paratuberculosis
cagcgucucccgggugcgcgucg

SEQ ID NO: 2923627 - RNA, 18 nt, Mycobacterium avium subsp. paratuberculosis
cagcgucuccggcgggcu

SEQ ID NO: 2923628 - RNA, 18 nt, Mycobacterium avium subsp. paratuberculosis
cagcgucuccucgaccgc

SEQ ID NO: 2923629 - RNA, 16 nt, Mycobacterium avium subsp. paratuberculosis
cagcgucucgaccgcg

SEQ ID NO: 2923630 - RNA, 15 nt, Mycobacterium avium subsp. paratuberculosis
cagcgucucgacggc

SEQ ID NO: 2923631 - RNA, 18 nt, Mycobacterium avium subsp. paratuberculosis
cagcgucucgaucgacga

SEQ ID NO: 2923632 - RNA, 19 nt, Mycobacterium avium subsp. paratuberculosis
cagcgucucgccggggaac

SEQ ID NO: 2923633 - RNA, 22 nt, Mycobacterium avium subsp. paratuberculosis
cagcgucucgccggggaacacc

SEQ ID NO: 2923634 - RNA, 16 nt, Mycobacterium avium subsp. paratuberculosis
cagcgucucggcgauc

SEQ ID NO: 2923635 - RNA, 14 nt, Mycobacterium avium subsp. paratuberculosis
cagcgucucggcgg

SEQ ID NO: 2923636 - RNA, 18 nt, Mycobacterium avium subsp. paratuberculosis
cagcgucucggcggccga

SEQ ID NO: 2923637 - RNA, 16 nt, Mycobacterium avium subsp. paratuberculosis
cagcgucugcgccagc

SEQ ID NO: 2923638 - RNA, 19 nt, Mycobacterium avium subsp. paratuberculosis
cagcgucugcgccagcugg

SEQ ID NO: 2923639 - RNA, 22 nt, Mycobacterium avium subsp. paratuberculosis
cagcgucugcgccccggcgucg

SEQ ID NO: 2923640 - RNA, 17 nt, Mycobacterium avium subsp. paratuberculosis
cagcgucugcugcgcca

SEQ ID NO: 2923641 - RNA, 22 nt, Mycobacterium avium subsp. paratuberculosis
cagcgucuggcagccggccggc

SEQ ID NO: 2923642 - RNA, 20 nt, Mycobacterium avium subsp. paratuberculosis
cagcgucuucuucucgccgu

SEQ ID NO: 2923643 - RNA, 22 nt, Mycobacterium avium subsp. paratuberculosis
cagcgucuucuucucgccgucc

SEQ ID NO: 2923644 - RNA, 17 nt, Mycobacterium avium subsp. paratuberculosis
cagcgucuugacgaacu

SEQ ID NO: 2923645 - RNA, 13 nt, Mycobacterium avium subsp. paratuberculosis
cagcgucuugccc

SEQ ID NO: 2923646 - RNA, 20 nt, Mycobacterium avium subsp. paratuberculosis
cagcgucuugcccagcgggg

SEQ ID NO: 2923647 - RNA, 21 nt, Mycobacterium avium subsp. paratuberculosis
cagcgucuugcccagcggggc

SEQ ID NO: 2923648 - RNA, 20 nt, Mycobacterium avium subsp. paratuberculosis
cagcgucuuggacgcccggu

SEQ ID NO: 2923649 - RNA, 18 nt, Mycobacterium avium subsp. paratuberculosis
cagcgugaacagcgcccg

SEQ ID NO: 2923650 - RNA, 20 nt, Mycobacterium avium subsp. paratuberculosis
cagcgugaacagcgcccggc

SEQ ID NO: 2923651 - RNA, 22 nt, Mycobacterium avium subsp. paratuberculosis
cagcgugaacagcgcccggccg

SEQ ID NO: 2923652 - RNA, 20 nt, Mycobacterium avium subsp. paratuberculosis
cagcgugaacguguggguga

SEQ ID NO: 2923653 - RNA, 16 nt, Mycobacterium avium subsp. paratuberculosis
cagcgugacccugccg

SEQ ID NO: 2923654 - RNA, 18 nt, Mycobacterium avium subsp. paratuberculosis
cagcgugacccugccguc

SEQ ID NO: 2923655 - RNA, 19 nt, Mycobacterium avium subsp. paratuberculosis
cagcgugacccugccguca

SEQ ID NO: 2923656 - RNA, 21 nt, Mycobacterium avium subsp. paratuberculosis
cagcgugacccugccgucacc

SEQ ID NO: 2923657 - RNA, 17 nt, Mycobacterium avium subsp. paratuberculosis
cagcgugaccucgacgg

SEQ ID NO: 2923658 - RNA, 23 nt, Mycobacterium avium subsp. paratuberculosis
cagcgugaccucgacggugcugc

SEQ ID NO: 2923659 - RNA, 15 nt, Mycobacterium avium subsp. paratuberculosis
cagcgugacgcccgg

SEQ ID NO: 2923660 - RNA, 14 nt, Mycobacterium avium subsp. paratuberculosis
cagcgugacgccgg

SEQ ID NO: 2923661 - RNA, 16 nt, Mycobacterium avium subsp. paratuberculosis
cagcgugacgccgggc

SEQ ID NO: 2923662 - RNA, 13 nt, Mycobacterium avium subsp. paratuberculosis
cagcgugagcuca

SEQ ID NO: 2923663 - RNA, 15 nt, Mycobacterium avium subsp. paratuberculosis
cagcgugcacacccg

SEQ ID NO: 2923664 - RNA, 13 nt, Mycobacterium avium subsp. paratuberculosis
cagcgugccgcgc

SEQ ID NO: 2923665 - RNA, 20 nt, Mycobacterium avium subsp. paratuberculosis
cagcgugccgcgcaccaccu

SEQ ID NO: 2923666 - RNA, 14 nt, Mycobacterium avium subsp. paratuberculosis
cagcgugcgcggcu

SEQ ID NO: 2923667 - RNA, 17 nt, Mycobacterium avium subsp. paratuberculosis
cagcguggccagcaccg

SEQ ID NO: 2923668 - RNA, 20 nt, Mycobacterium avium subsp. paratuberculosis
cagcguggccagcaccguca

SEQ ID NO: 2923669 - RNA, 13 nt, Mycobacterium avium subsp. paratuberculosis
cagcguggccggc

SEQ ID NO: 2923670 - RNA, 15 nt, Mycobacterium avium subsp. paratuberculosis
cagcguggccggcag

SEQ ID NO: 2923671 - RNA, 16 nt, Mycobacterium avium subsp. paratuberculosis
cagcguggcgaacgcg

SEQ ID NO: 2923672 - RNA, 18 nt, Mycobacterium avium subsp. paratuberculosis
cagcguggcgcgccccgg

SEQ ID NO: 2923673 - RNA, 21 nt, Mycobacterium avium subsp. paratuberculosis
cagcguggcgcgccccggccc

SEQ ID NO: 2923674 - RNA, 15 nt, Mycobacterium avium subsp. paratuberculosis
cagcguggcgucggc

SEQ ID NO: 2923675 - RNA, 17 nt, Mycobacterium avium subsp. paratuberculosis
cagcguggcgucggcgc

SEQ ID NO: 2923676 - RNA, 19 nt, Mycobacterium avium subsp. paratuberculosis
cagcguggcgucggcgcgc

SEQ ID NO: 2923677 - RNA, 20 nt, Mycobacterium avium subsp. paratuberculosis
cagcguggcgucggcgcgca

SEQ ID NO: 2923678 - RNA, 21 nt, Mycobacterium avium subsp. paratuberculosis
cagcguggcgucggcgcgcac

SEQ ID NO: 2923679 - RNA, 14 nt, Mycobacterium avium subsp. paratuberculosis
cagcgugggcaccg

SEQ ID NO: 2923680 - RNA, 18 nt, Mycobacterium avium subsp. paratuberculosis
cagcgugggcaccggcac

SEQ ID NO: 2923681 - RNA, 19 nt, Mycobacterium avium subsp. paratuberculosis
cagcgugggcaccggcacc

SEQ ID NO: 2923682 - RNA, 22 nt, Mycobacterium avium subsp. paratuberculosis
cagcgugggcaccggcaccgcc

SEQ ID NO: 2923683 - RNA, 17 nt, Mycobacterium avium subsp. paratuberculosis
cagcgugguccagcacg

SEQ ID NO: 2923684 - RNA, 12 nt, Mycobacterium avium subsp. paratuberculosis
cagcguggucgc

SEQ ID NO: 2923685 - RNA, 17 nt, Mycobacterium avium subsp. paratuberculosis
cagcguggucgcgcagc

SEQ ID NO: 2923686 - RNA, 18 nt, Mycobacterium avium subsp. paratuberculosis
cagcguggucgcgcagca

SEQ ID NO: 2923687 - RNA, 22 nt, Mycobacterium avium subsp. paratuberculosis
cagcguggucuccuggccgccg

SEQ ID NO: 2923688 - RNA, 15 nt, Mycobacterium avium subsp. paratuberculosis
cagcguggugcgccc

SEQ ID NO: 2923689 - RNA, 16 nt, Mycobacterium avium subsp. paratuberculosis
cagcgugucccgguac

SEQ ID NO: 2923690 - RNA, 20 nt, Mycobacterium avium subsp. paratuberculosis
cagcgugucccgguacaggu

SEQ ID NO: 2923691 - RNA, 15 nt, Mycobacterium avium subsp. paratuberculosis
cagcgugucgccggg

SEQ ID NO: 2923692 - RNA, 16 nt, Mycobacterium avium subsp. paratuberculosis
cagcgugucgccgggg

SEQ ID NO: 2923693 - RNA, 14 nt, Mycobacterium avium subsp. paratuberculosis
cagcgugucggcga

SEQ ID NO: 2923694 - RNA, 17 nt, Mycobacterium avium subsp. paratuberculosis
cagcgugucggcgaucg

SEQ ID NO: 2923695 - RNA, 19 nt, Mycobacterium avium subsp. paratuberculosis
cagcgugucggcgaucgcg

SEQ ID NO: 2923696 - RNA, 22 nt, Mycobacterium avium subsp. paratuberculosis
cagcgugucggggucggcgccg

SEQ ID NO: 2923697 - RNA, 23 nt, Mycobacterium avium subsp. paratuberculosis
cagcgugugcgugguggggccga

SEQ ID NO: 2923698 - RNA, 14 nt, Mycobacterium avium subsp. paratuberculosis
cagcguguggcccu

SEQ ID NO: 2923699 - RNA, 20 nt, Mycobacterium avium subsp. paratuberculosis
cagcucgacaucggccgccu

SEQ ID NO: 2923700 - RNA, 21 nt, Mycobacterium avium subsp. paratuberculosis
cagcucgacaucggccgccuu

SEQ ID NO: 2923701 - RNA, 20 nt, Mycobacterium avium subsp. paratuberculosis
cagcucgaccagccgggucc

SEQ ID NO: 2923702 - RNA, 15 nt, Mycobacterium avium subsp. paratuberculosis
cagcucgaccgcggc

SEQ ID NO: 2923703 - RNA, 16 nt, Mycobacterium avium subsp. paratuberculosis
cagcucgaccgcggcg

SEQ ID NO: 2923704 - RNA, 17 nt, Mycobacterium avium subsp. paratuberculosis
cagcucgaccgcggcga

SEQ ID NO: 2923705 - RNA, 19 nt, Mycobacterium avium subsp. paratuberculosis
cagcucgaccgcggcgaug

SEQ ID NO: 2923706 - RNA, 16 nt, Mycobacterium avium subsp. paratuberculosis
cagcucgacgaccucg

SEQ ID NO: 2923707 - RNA, 20 nt, Mycobacterium avium subsp. paratuberculosis
cagcucgacgaccucgccga

SEQ ID NO: 2923708 - RNA, 21 nt, Mycobacterium avium subsp. paratuberculosis
cagcucgacgaccucgccgac

SEQ ID NO: 2923709 - RNA, 16 nt, Mycobacterium avium subsp. paratuberculosis
cagcucgacgacuucg

SEQ ID NO: 2923710 - RNA, 22 nt, Mycobacterium avium subsp. paratuberculosis
cagcucgacgacuucggccucg

SEQ ID NO: 2923711 - RNA, 16 nt, Mycobacterium avium subsp. paratuberculosis
cagcucgagcaucacg

SEQ ID NO: 2923712 - RNA, 19 nt, Mycobacterium avium subsp. paratuberculosis
cagcucgaggccgcgggcg

SEQ ID NO: 2923713 - RNA, 19 nt, Mycobacterium avium subsp. paratuberculosis
cagcucgaucgccgcgccc

SEQ ID NO: 2923714 - RNA, 20 nt, Mycobacterium avium subsp. paratuberculosis
cagcucgaucgccgcgccca

SEQ ID NO: 2923715 - RNA, 17 nt, Mycobacterium avium subsp. paratuberculosis
cagcucgauggugccgu

SEQ ID NO: 2923716 - RNA, 22 nt, Mycobacterium avium subsp. paratuberculosis
cagcucgauggugccgucggcg

SEQ ID NO: 2923717 - RNA, 15 nt, Mycobacterium avium subsp. paratuberculosis
cagcucgcccagcac

SEQ ID NO: 2923718 - RNA, 15 nt, Mycobacterium avium subsp. paratuberculosis
cagcucgccgagcgu

SEQ ID NO: 2923719 - RNA, 12 nt, Mycobacterium avium subsp. paratuberculosis
cagcucgccgau

SEQ ID NO: 2923720 - RNA, 13 nt, Mycobacterium avium subsp. paratuberculosis
cagcucgccgccg

SEQ ID NO: 2923721 - RNA, 13 nt, Mycobacterium avium subsp. paratuberculosis
cagcucgccggcc

SEQ ID NO: 2923722 - RNA, 15 nt, Mycobacterium avium subsp. paratuberculosis
cagcucgccggccgc

SEQ ID NO: 2923723 - RNA, 17 nt, Mycobacterium avium subsp. paratuberculosis
cagcucgccggccgcgg

SEQ ID NO: 2923724 - RNA, 16 nt, Mycobacterium avium subsp. paratuberculosis
cagcucgccggcgcgc

SEQ ID NO: 2923725 - RNA, 17 nt, Mycobacterium avium subsp. paratuberculosis
cagcucgccggcgcgca

SEQ ID NO: 2923726 - RNA, 21 nt, Mycobacterium avium subsp. paratuberculosis
cagcucgccggcgcgcagcca

SEQ ID NO: 2923727 - RNA, 14 nt, Mycobacterium avium subsp. paratuberculosis
cagcucgccggugg

SEQ ID NO: 2923728 - RNA, 17 nt, Mycobacterium avium subsp. paratuberculosis
cagcucgccgguggcgg

SEQ ID NO: 2923729 - RNA, 20 nt, Mycobacterium avium subsp. paratuberculosis
cagcucgccguccgggaaca

SEQ ID NO: 2923730 - RNA, 17 nt, Mycobacterium avium subsp. paratuberculosis
cagcucgcgaagcgcga

SEQ ID NO: 2923731 - RNA, 21 nt, Mycobacterium avium subsp. paratuberculosis
cagcucgcgaagcgcgaugcg

SEQ ID NO: 2923732 - RNA, 17 nt, Mycobacterium avium subsp. paratuberculosis
cagcucgcgcaucagcg

SEQ ID NO: 2923733 - RNA, 16 nt, Mycobacterium avium subsp. paratuberculosis
cagcucgcgcccggcc

SEQ ID NO: 2923734 - RNA, 17 nt, Mycobacterium avium subsp. paratuberculosis
cagcucgcgcccggcca

SEQ ID NO: 2923735 - RNA, 13 nt, Mycobacterium avium subsp. paratuberculosis
cagcucgcgcuga

SEQ ID NO: 2923736 - RNA, 20 nt, Mycobacterium avium subsp. paratuberculosis
cagcucgcggauccgcagcu

SEQ ID NO: 2923737 - RNA, 19 nt, Mycobacterium avium subsp. paratuberculosis
cagcucgcggauccgggcc

SEQ ID NO: 2923738 - RNA, 23 nt, Mycobacterium avium subsp. paratuberculosis
cagcucgcgggccugcucgucgg

SEQ ID NO: 2923739 - RNA, 22 nt, Mycobacterium avium subsp. paratuberculosis
cagcucgcguagcgagguguga

SEQ ID NO: 2923740 - RNA, 15 nt, Mycobacterium avium subsp. paratuberculosis
cagcucggcagcccc

SEQ ID NO: 2923741 - RNA, 16 nt, Mycobacterium avium subsp. paratuberculosis
cagcucggcagccccg

SEQ ID NO: 2923742 - RNA, 18 nt, Mycobacterium avium subsp. paratuberculosis
cagcucggcagccccguc

SEQ ID NO: 2923743 - RNA, 20 nt, Mycobacterium avium subsp. paratuberculosis
cagcucggcagccccgucgg

SEQ ID NO: 2923744 - RNA, 22 nt, Mycobacterium avium subsp. paratuberculosis
cagcucggcagccccgucgguc

SEQ ID NO: 2923745 - RNA, 17 nt, Mycobacterium avium subsp. paratuberculosis
cagcucggccauccccg

SEQ ID NO: 2923746 - RNA, 20 nt, Mycobacterium avium subsp. paratuberculosis
cagcucggccauccccgcgu

SEQ ID NO: 2923747 - RNA, 12 nt, Mycobacterium avium subsp. paratuberculosis
cagcucggcccg

SEQ ID NO: 2923748 - RNA, 15 nt, Mycobacterium avium subsp. paratuberculosis
cagcucggcccgcug

SEQ ID NO: 2923749 - RNA, 17 nt, Mycobacterium avium subsp. paratuberculosis
cagcucggcgaucaccg

SEQ ID NO: 2923750 - RNA, 19 nt, Mycobacterium avium subsp. paratuberculosis
cagcucggcgaucaccgcg

SEQ ID NO: 2923751 - RNA, 13 nt, Mycobacterium avium subsp. paratuberculosis
cagcucggcggcc

SEQ ID NO: 2923752 - RNA, 14 nt, Mycobacterium avium subsp. paratuberculosis
cagcucggcggcca

SEQ ID NO: 2923753 - RNA, 17 nt, Mycobacterium avium subsp. paratuberculosis
cagcucggcggcccgcc

SEQ ID NO: 2923754 - RNA, 18 nt, Mycobacterium avium subsp. paratuberculosis
cagcucggcggcccgccg

SEQ ID NO: 2923755 - RNA, 14 nt, Mycobacterium avium subsp. paratuberculosis
cagcucggcggccg

SEQ ID NO: 2923756 - RNA, 15 nt, Mycobacterium avium subsp. paratuberculosis
cagcucggcggccgg

SEQ ID NO: 2923757 - RNA, 18 nt, Mycobacterium avium subsp. paratuberculosis
cagcucggcggccgggug

SEQ ID NO: 2923758 - RNA, 19 nt, Mycobacterium avium subsp. paratuberculosis
cagcucggcggccucgccg

SEQ ID NO: 2923759 - RNA, 12 nt, Mycobacterium avium subsp. paratuberculosis
cagcucggcggg

SEQ ID NO: 2923760 - RNA, 22 nt, Mycobacterium avium subsp. paratuberculosis
cagcucggcguauucgucgucg

SEQ ID NO: 2923761 - RNA, 23 nt, Mycobacterium avium subsp. paratuberculosis
cagcucggcguauucgucgucgg

SEQ ID NO: 2923762 - RNA, 13 nt, Mycobacterium avium subsp. paratuberculosis
cagcucggcgugg

SEQ ID NO: 2923763 - RNA, 16 nt, Mycobacterium avium subsp. paratuberculosis
cagcucgggcagcccg

SEQ ID NO: 2923764 - RNA, 18 nt, Mycobacterium avium subsp. paratuberculosis
cagcucgggcagcccgcc

SEQ ID NO: 2923765 - RNA, 19 nt, Mycobacterium avium subsp. paratuberculosis
cagcucgggcagcccgccg

SEQ ID NO: 2923766 - RNA, 15 nt, Mycobacterium avium subsp. paratuberculosis
cagcucgggcagcgu

SEQ ID NO: 2923767 - RNA, 21 nt, Mycobacterium avium subsp. paratuberculosis
cagcucgggguaguucagcgc

SEQ ID NO: 2923768 - RNA, 13 nt, Mycobacterium avium subsp. paratuberculosis
cagcucggucacc

SEQ ID NO: 2923769 - RNA, 20 nt, Mycobacterium avium subsp. paratuberculosis
cagcucggucaccagcggcc

SEQ ID NO: 2923770 - RNA, 22 nt, Mycobacterium avium subsp. paratuberculosis
cagcucggucaccagcggcccg

SEQ ID NO: 2923771 - RNA, 17 nt, Mycobacterium avium subsp. paratuberculosis
cagcucggucagccggg

SEQ ID NO: 2923772 - RNA, 18 nt, Mycobacterium avium subsp. paratuberculosis
cagcucggucagccgggc

SEQ ID NO: 2923773 - RNA, 20 nt, Mycobacterium avium subsp. paratuberculosis
cagcucggucagccgggcgg

SEQ ID NO: 2923774 - RNA, 15 nt, Mycobacterium avium subsp. paratuberculosis
cagcucggucgcggu

SEQ ID NO: 2923775 - RNA, 18 nt, Mycobacterium avium subsp. paratuberculosis
cagcucggucgcggucgg

SEQ ID NO: 2923776 - RNA, 22 nt, Mycobacterium avium subsp. paratuberculosis
cagcucggucgcggucggcgcc

SEQ ID NO: 2923777 - RNA, 23 nt, Mycobacterium avium subsp. paratuberculosis
cagcucggucgcggucggcgccc

SEQ ID NO: 2923778 - RNA, 18 nt, Mycobacterium avium subsp. paratuberculosis
cagcucggugaucaccau

SEQ ID NO: 2923779 - RNA, 20 nt, Mycobacterium avium subsp. paratuberculosis
cagcucggugaucaccauga

SEQ ID NO: 2923780 - RNA, 20 nt, Mycobacterium avium subsp. paratuberculosis
cagcucggugaucugcacca

SEQ ID NO: 2923781 - RNA, 23 nt, Mycobacterium avium subsp. paratuberculosis
cagcucggugaugaucgccgggu

SEQ ID NO: 2923782 - RNA, 20 nt, Mycobacterium avium subsp. paratuberculosis
cagcucggugcagaccccgg

SEQ ID NO: 2923783 - RNA, 17 nt, Mycobacterium avium subsp. paratuberculosis
cagcugcgccgcgucga

SEQ ID NO: 2923784 - RNA, 15 nt, Mycobacterium avium subsp. paratuberculosis
cagcugcgcgccggc

SEQ ID NO: 2923785 - RNA, 16 nt, Mycobacterium avium subsp. paratuberculosis
cagcugcgcgccggcg

SEQ ID NO: 2923786 - RNA, 22 nt, Mycobacterium avium subsp. paratuberculosis
cagcugcgcgccggcggccgcc

SEQ ID NO: 2923787 - RNA, 20 nt, Mycobacterium avium subsp. paratuberculosis
cagcugcgcgggcgcggcca

SEQ ID NO: 2923788 - RNA, 22 nt, Mycobacterium avium subsp. paratuberculosis
cagcugcgcgggcgcggccagc

SEQ ID NO: 2923789 - RNA, 13 nt, Mycobacterium avium subsp. paratuberculosis
cagcugcgcgucg

SEQ ID NO: 2923790 - RNA, 14 nt, Mycobacterium avium subsp. paratuberculosis
cagcugcgcgucga

SEQ ID NO: 2923791 - RNA, 17 nt, Mycobacterium avium subsp. paratuberculosis
cagcugcgcgucggccg

SEQ ID NO: 2923792 - RNA, 21 nt, Mycobacterium avium subsp. paratuberculosis
cagcugcgcgucggccgcaca

SEQ ID NO: 2923793 - RNA, 21 nt, Mycobacterium avium subsp. paratuberculosis
cagcugcggaaaugcccgcgc

SEQ ID NO: 2923794 - RNA, 22 nt, Mycobacterium avium subsp. paratuberculosis
cagcugcggaaaugcccgcgcc

SEQ ID NO: 2923795 - RNA, 18 nt, Mycobacterium avium subsp. paratuberculosis
cagcugcgggaccagcgc

SEQ ID NO: 2923796 - RNA, 20 nt, Mycobacterium avium subsp. paratuberculosis
cagcugcggguugcgggcca

SEQ ID NO: 2923797 - RNA, 23 nt, Mycobacterium avium subsp. paratuberculosis
cagcugcggguugcgggccaggc

SEQ ID NO: 2923798 - RNA, 17 nt, Mycobacterium avium subsp. paratuberculosis
cagcugcgucggcacca

SEQ ID NO: 2923799 - RNA, 14 nt, Mycobacterium avium subsp. paratuberculosis
cagcugcuccgggg

SEQ ID NO: 2923800 - RNA, 20 nt, Mycobacterium avium subsp. paratuberculosis
cagcugcucgagcaucucca

SEQ ID NO: 2923801 - RNA, 14 nt, Mycobacterium avium subsp. paratuberculosis
cagcugcucggcca

SEQ ID NO: 2923802 - RNA, 16 nt, Mycobacterium avium subsp. paratuberculosis
cagcugcucggccacc

SEQ ID NO: 2923803 - RNA, 17 nt, Mycobacterium avium subsp. paratuberculosis
cagcugcucggccaccg

SEQ ID NO: 2923804 - RNA, 18 nt, Mycobacterium avium subsp. paratuberculosis
cagcugcucggccaccgc

SEQ ID NO: 2923805 - RNA, 19 nt, Mycobacterium avium subsp. paratuberculosis
cagcugcucggccaccgcg

SEQ ID NO: 2923806 - RNA, 20 nt, Mycobacterium avium subsp. paratuberculosis
cagcugcucggccaccgcgc

SEQ ID NO: 2923807 - RNA, 19 nt, Mycobacterium avium subsp. paratuberculosis
cagcugcucguccuggcgc

SEQ ID NO: 2923808 - RNA, 14 nt, Mycobacterium avium subsp. paratuberculosis
cagcugcugcgcgg

SEQ ID NO: 2923809 - RNA, 19 nt, Mycobacterium avium subsp. paratuberculosis
cagcugcugcgcggcggcg

SEQ ID NO: 2923810 - RNA, 15 nt, Mycobacterium avium subsp. paratuberculosis
cagcugcugcggccg

SEQ ID NO: 2923811 - RNA, 16 nt, Mycobacterium avium subsp. paratuberculosis
cagcugcugcggccgg

SEQ ID NO: 2923812 - RNA, 15 nt, Mycobacterium avium subsp. paratuberculosis
cagcugcuggcguga

SEQ ID NO: 2923813 - RNA, 23 nt, Mycobacterium avium subsp. paratuberculosis
cagcugcuggcugcggccccggu

SEQ ID NO: 2923814 - RNA, 19 nt, Mycobacterium avium subsp. paratuberculosis
cagcugcugggacgggucg

SEQ ID NO: 2923815 - RNA, 20 nt, Mycobacterium avium subsp. paratuberculosis
cagcuggaaauaggccgggc

SEQ ID NO: 2923816 - RNA, 16 nt, Mycobacterium avium subsp. paratuberculosis
cagcuggaacaccacg

SEQ ID NO: 2923817 - RNA, 20 nt, Mycobacterium avium subsp. paratuberculosis
cagcuggaacaccacggccg

SEQ ID NO: 2923818 - RNA, 21 nt, Mycobacterium avium subsp. paratuberculosis
cagcuggaacaccacggccgg

SEQ ID NO: 2923819 - RNA, 22 nt, Mycobacterium avium subsp. paratuberculosis
cagcuggagaggcccggcagcc

SEQ ID NO: 2923820 - RNA, 20 nt, Mycobacterium avium subsp. paratuberculosis
cagcuggaucaucucguagc

SEQ ID NO: 2923821 - RNA, 14 nt, Mycobacterium avium subsp. paratuberculosis
cagcuggauggcgc

SEQ ID NO: 2923822 - RNA, 20 nt, Mycobacterium avium subsp. paratuberculosis
cagcuggauggcgcccagcc

SEQ ID NO: 2923823 - RNA, 21 nt, Mycobacterium avium subsp. paratuberculosis
cagcuggauggcgcccagccc

SEQ ID NO: 2923824 - RNA, 13 nt, Mycobacterium avium subsp. paratuberculosis
cagcuggccgugc

SEQ ID NO: 2923825 - RNA, 18 nt, Mycobacterium avium subsp. paratuberculosis
cagcuggccgugcaccgu

SEQ ID NO: 2923826 - RNA, 20 nt, Mycobacterium avium subsp. paratuberculosis
cagcuggccgugcaccgucg

SEQ ID NO: 2923827 - RNA, 19 nt, Mycobacterium avium subsp. paratuberculosis
cagcugggacagcgucacc

SEQ ID NO: 2923828 - RNA, 20 nt, Mycobacterium avium subsp. paratuberculosis
cagcugggacagcgucacca

SEQ ID NO: 2923829 - RNA, 19 nt, Mycobacterium avium subsp. paratuberculosis
cagcugggcagccagaucu

SEQ ID NO: 2923830 - RNA, 13 nt, Mycobacterium avium subsp. paratuberculosis
cagcugggccagc

SEQ ID NO: 2923831 - RNA, 18 nt, Mycobacterium avium subsp. paratuberculosis
cagcugggccagcgcggu

SEQ ID NO: 2923832 - RNA, 20 nt, Mycobacterium avium subsp. paratuberculosis
cagcugggcguacugcucgg

SEQ ID NO: 2923833 - RNA, 22 nt, Mycobacterium avium subsp. paratuberculosis
cagcugggcguacugcucggcg

SEQ ID NO: 2923834 - RNA, 13 nt, Mycobacterium avium subsp. paratuberculosis
cagcugggcugcc

SEQ ID NO: 2923835 - RNA, 20 nt, Mycobacterium avium subsp. paratuberculosis
cagcuggguggucaccagcg

SEQ ID NO: 2923836 - RNA, 21 nt, Mycobacterium avium subsp. paratuberculosis
cagcuggguggucaccagcgc

SEQ ID NO: 2923837 - RNA, 16 nt, Mycobacterium avium subsp. paratuberculosis
cagcuggucccacagc

SEQ ID NO: 2923838 - RNA, 18 nt, Mycobacterium avium subsp. paratuberculosis
cagcuggucccacagcgg

SEQ ID NO: 2923839 - RNA, 14 nt, Mycobacterium avium subsp. paratuberculosis
cagcugguccggcc

SEQ ID NO: 2923840 - RNA, 15 nt, Mycobacterium avium subsp. paratuberculosis
cagcugguccggccg

SEQ ID NO: 2923841 - RNA, 16 nt, Mycobacterium avium subsp. paratuberculosis
cagcugguccggccgg

SEQ ID NO: 2923842 - RNA, 17 nt, Mycobacterium avium subsp. paratuberculosis
cagcugguccggccggc

SEQ ID NO: 2923843 - RNA, 19 nt, Mycobacterium avium subsp. paratuberculosis
cagcugguccggccggccg

SEQ ID NO: 2923844 - RNA, 22 nt, Mycobacterium avium subsp. paratuberculosis
cagcuggugaagcugccgacca

SEQ ID NO: 2923845 - RNA, 14 nt, Mycobacterium avium subsp. paratuberculosis
cagcuggugcagau

SEQ ID NO: 2923846 - RNA, 21 nt, Mycobacterium avium subsp. paratuberculosis
cagcuguuccugguagucguc

SEQ ID NO: 2923847 - RNA, 15 nt, Mycobacterium avium subsp. paratuberculosis
cagcuguucgggcag

SEQ ID NO: 2923848 - RNA, 17 nt, Mycobacterium avium subsp. paratuberculosis
cagcuguugacgggccg

SEQ ID NO: 2923849 - RNA, 19 nt, Mycobacterium avium subsp. paratuberculosis
cagcuguugacgggccgcg

SEQ ID NO: 2923850 - RNA, 13 nt, Mycobacterium avium subsp. paratuberculosis
cagcuguugcggc

SEQ ID NO: 2923851 - RNA, 15 nt, Mycobacterium avium subsp. paratuberculosis
cagcuguugcggcgu

SEQ ID NO: 2923852 - RNA, 23 nt, Mycobacterium avium subsp. paratuberculosis
cagcuguugcggcgucagguccg

SEQ ID NO: 2923853 - RNA, 14 nt, Mycobacterium avium subsp. paratuberculosis
cagcuucaccgguc

SEQ ID NO: 2923854 - RNA, 16 nt, Mycobacterium avium subsp. paratuberculosis
cagcuuccgccucggc

SEQ ID NO: 2923855 - RNA, 18 nt, Mycobacterium avium subsp. paratuberculosis
cagcuuccgccucggcga

SEQ ID NO: 2923856 - RNA, 15 nt, Mycobacterium avium subsp. paratuberculosis
cagcuucggcgccga

SEQ ID NO: 2923857 - RNA, 22 nt, Mycobacterium avium subsp. paratuberculosis
cagcuucggcgccgagcacgaa

SEQ ID NO: 2923858 - RNA, 21 nt, Mycobacterium avium subsp. paratuberculosis
cagcuucgugucaccgcccac

SEQ ID NO: 2923859 - RNA, 15 nt, Mycobacterium avium subsp. paratuberculosis
cagcuucucggcguc

SEQ ID NO: 2923860 - RNA, 15 nt, Mycobacterium avium subsp. paratuberculosis
cagcuugaagcccuc

SEQ ID NO: 2923861 - RNA, 18 nt, Mycobacterium avium subsp. paratuberculosis
cagcuugaagcccucguc

SEQ ID NO: 2923862 - RNA, 14 nt, Mycobacterium avium subsp. paratuberculosis
cagcuugaccaccc

SEQ ID NO: 2923863 - RNA, 16 nt, Mycobacterium avium subsp. paratuberculosis
cagcuugaccgugacg

SEQ ID NO: 2923864 - RNA, 20 nt, Mycobacterium avium subsp. paratuberculosis
cagcuugaccgugacggugc

SEQ ID NO: 2923865 - RNA, 15 nt, Mycobacterium avium subsp. paratuberculosis
cagcuugaugcuggc

SEQ ID NO: 2923866 - RNA, 17 nt, Mycobacterium avium subsp. paratuberculosis
cagcuuggagccgagca

SEQ ID NO: 2923867 - RNA, 17 nt, Mycobacterium avium subsp. paratuberculosis
caggauccgcccgccgg

SEQ ID NO: 2923868 - RNA, 21 nt, Mycobacterium avium subsp. paratuberculosis
caggaucgagccggccgucag

SEQ ID NO: 2923869 - RNA, 21 nt, Mycobacterium avium subsp. paratuberculosis
caggaucgccggucguggggc

SEQ ID NO: 2923870 - RNA, 16 nt, Mycobacterium avium subsp. paratuberculosis
caggaucgcggugacc

SEQ ID NO: 2923871 - RNA, 14 nt, Mycobacterium avium subsp. paratuberculosis
caggaucggcgggc

SEQ ID NO: 2923872 - RNA, 18 nt, Mycobacterium avium subsp. paratuberculosis
caggaucggcgggcgccg

SEQ ID NO: 2923873 - RNA, 21 nt, Mycobacterium avium subsp. paratuberculosis
caggaucucgcgggcccgcgc

SEQ ID NO: 2923874 - RNA, 23 nt, Mycobacterium avium subsp. paratuberculosis
caggaucucgcgggcccgcgcgg

SEQ ID NO: 2923875 - RNA, 16 nt, Mycobacterium avium subsp. paratuberculosis
caggaucugcagcacg

SEQ ID NO: 2923876 - RNA, 14 nt, Mycobacterium avium subsp. paratuberculosis
caggaucugcgcaa

SEQ ID NO: 2923877 - RNA, 18 nt, Mycobacterium avium subsp. paratuberculosis
caggaucugcgcaagaag

SEQ ID NO: 2923878 - RNA, 21 nt, Mycobacterium avium subsp. paratuberculosis
caggaucugcgcaagaagggc

SEQ ID NO: 2923879 - RNA, 22 nt, Mycobacterium avium subsp. paratuberculosis
caggaucugcucggcgucgcac

SEQ ID NO: 2923880 - RNA, 23 nt, Mycobacterium avium subsp. paratuberculosis
caggaucugggugagcgacacca

SEQ ID NO: 2923881 - RNA, 20 nt, Mycobacterium avium subsp. paratuberculosis
caggaucuugucggcggccu

SEQ ID NO: 2923882 - RNA, 22 nt, Mycobacterium avium subsp. paratuberculosis
caggaucuuugcauacagcagg

SEQ ID NO: 2923883 - RNA, 23 nt, Mycobacterium avium subsp. paratuberculosis
caggaucuuugcauacagcaggc

SEQ ID NO: 2923884 - RNA, 14 nt, Mycobacterium avium subsp. paratuberculosis
caggaugaccgccc

SEQ ID NO: 2923885 - RNA, 15 nt, Mycobacterium avium subsp. paratuberculosis
caggaugaccgcguc

SEQ ID NO: 2923886 - RNA, 16 nt, Mycobacterium avium subsp. paratuberculosis
caggaugaccgcgucg

SEQ ID NO: 2923887 - RNA, 22 nt, Mycobacterium avium subsp. paratuberculosis
caggaugaccgcgucggcgccg

SEQ ID NO: 2923888 - RNA, 14 nt, Mycobacterium avium subsp. paratuberculosis
caggaugacgccgc

SEQ ID NO: 2923889 - RNA, 16 nt, Mycobacterium avium subsp. paratuberculosis
caggaugacgccgcgg

SEQ ID NO: 2923890 - RNA, 15 nt, Mycobacterium avium subsp. paratuberculosis
caggaugagcugggc

SEQ ID NO: 2923891 - RNA, 22 nt, Mycobacterium avium subsp. paratuberculosis
caggaugagcugggcggcgcgc

SEQ ID NO: 2923892 - RNA, 23 nt, Mycobacterium avium subsp. paratuberculosis
caggaugagcugggcggcgcgcu

SEQ ID NO: 2923893 - RNA, 22 nt, Mycobacterium avium subsp. paratuberculosis
caggaugaucuucuccagguug

SEQ ID NO: 2923894 - RNA, 17 nt, Mycobacterium avium subsp. paratuberculosis
caggaugcagccggcca

SEQ ID NO: 2923895 - RNA, 14 nt, Mycobacterium avium subsp. paratuberculosis
caggaugcccagca

SEQ ID NO: 2923896 - RNA, 23 nt, Mycobacterium avium subsp. paratuberculosis
caggaugcccagcaccacuucca

SEQ ID NO: 2923897 - RNA, 13 nt, Mycobacterium avium subsp. paratuberculosis
caggaugcccggg

SEQ ID NO: 2923898 - RNA, 17 nt, Mycobacterium avium subsp. paratuberculosis
caggaugcccgggccgu

SEQ ID NO: 2923899 - RNA, 19 nt, Mycobacterium avium subsp. paratuberculosis
caggaugcgggugaugccg

SEQ ID NO: 2923900 - RNA, 20 nt, Mycobacterium avium subsp. paratuberculosis
caggaugcguuggccgagca

SEQ ID NO: 2923901 - RNA, 18 nt, Mycobacterium avium subsp. paratuberculosis
caggaugcuggggucggc

SEQ ID NO: 2923902 - RNA, 20 nt, Mycobacterium avium subsp. paratuberculosis
caggauggagcugaccuggc

SEQ ID NO: 2923903 - RNA, 18 nt, Mycobacterium avium subsp. paratuberculosis
caggauggccugcacggu

SEQ ID NO: 2923904 - RNA, 21 nt, Mycobacterium avium subsp. paratuberculosis
caggauggugaaaucguccau

SEQ ID NO: 2923905 - RNA, 23 nt, Mycobacterium avium subsp. paratuberculosis
caggaugguguucugcucgucgg

SEQ ID NO: 2923906 - RNA, 22 nt, Mycobacterium avium subsp. paratuberculosis
caggaugucguccucggucagg

SEQ ID NO: 2923907 - RNA, 23 nt, Mycobacterium avium subsp. paratuberculosis
caggauguucaccccggcgcgga

SEQ ID NO: 2923908 - RNA, 23 nt, Mycobacterium avium subsp. paratuberculosis
caggauucccgaccccgccagca

SEQ ID NO: 2923909 - RNA, 16 nt, Mycobacterium avium subsp. paratuberculosis
caggauuccgucggcg

SEQ ID NO: 2923910 - RNA, 17 nt, Mycobacterium avium subsp. paratuberculosis
caggauuccgucggcgg

SEQ ID NO: 2923911 - RNA, 20 nt, Mycobacterium avium subsp. paratuberculosis
caggauucucagcagcgggc

SEQ ID NO: 2923912 - RNA, 22 nt, Mycobacterium avium subsp. paratuberculosis
caggauucucagcagcgggccg

SEQ ID NO: 2923913 - RNA, 20 nt, Mycobacterium avium subsp. paratuberculosis
caggcacacgaacaccggcg

SEQ ID NO: 2923914 - RNA, 19 nt, Mycobacterium avium subsp. paratuberculosis
caggcacagcagggcaccg

SEQ ID NO: 2923915 - RNA, 15 nt, Mycobacterium avium subsp. paratuberculosis
caggcacggugucga

SEQ ID NO: 2923916 - RNA, 13 nt, Mycobacterium avium subsp. paratuberculosis
caggcacucgccc

SEQ ID NO: 2923917 - RNA, 16 nt, Mycobacterium avium subsp. paratuberculosis
caggcacucgcccagg

SEQ ID NO: 2923918 - RNA, 17 nt, Mycobacterium avium subsp. paratuberculosis
caggcacucgcccaggg

SEQ ID NO: 2923919 - RNA, 20 nt, Mycobacterium avium subsp. paratuberculosis
caggcacugaucccuccguc

SEQ ID NO: 2923920 - RNA, 15 nt, Mycobacterium avium subsp. paratuberculosis
caggcagacccccag

SEQ ID NO: 2923921 - RNA, 20 nt, Mycobacterium avium subsp. paratuberculosis
caggcagacccccagcagcg

SEQ ID NO: 2923922 - RNA, 12 nt, Mycobacterium avium subsp. paratuberculosis
caggcagcagca

SEQ ID NO: 2923923 - RNA, 16 nt, Mycobacterium avium subsp. paratuberculosis
caggcagcccggcugc

SEQ ID NO: 2923924 - RNA, 19 nt, Mycobacterium avium subsp. paratuberculosis
caggcagcccggcugcgca

SEQ ID NO: 2923925 - RNA, 15 nt, Mycobacterium avium subsp. paratuberculosis
caggcaggccggcag

SEQ ID NO: 2923926 - RNA, 14 nt, Mycobacterium avium subsp. paratuberculosis
caggcaggcggcca

SEQ ID NO: 2923927 - RNA, 16 nt, Mycobacterium avium subsp. paratuberculosis
caggcaucgcgugccg

SEQ ID NO: 2923928 - RNA, 20 nt, Mycobacterium avium subsp. paratuberculosis
caggcaucgcgugccgacca

SEQ ID NO: 2923929 - RNA, 24 nt, Mycobacterium avium subsp. paratuberculosis
caggcaucgcgugccgaccagccg

SEQ ID NO: 2923930 - RNA, 18 nt, Mycobacterium avium subsp. paratuberculosis
caggcaugggaucagcag

SEQ ID NO: 2923931 - RNA, 20 nt, Mycobacterium avium subsp. paratuberculosis
caggcaugggaucagcagca

SEQ ID NO: 2923932 - RNA, 18 nt, Mycobacterium avium subsp. paratuberculosis
caggcauuccaccgcgcg

SEQ ID NO: 2923933 - RNA, 22 nt, Mycobacterium avium subsp. paratuberculosis
caggcauuccaccgcgcggcgc

SEQ ID NO: 2923934 - RNA, 20 nt, Mycobacterium avium subsp. paratuberculosis
caggcauuuccagguccggg

SEQ ID NO: 2923935 - RNA, 19 nt, Mycobacterium avium subsp. paratuberculosis
caggccacaugggccacgg

SEQ ID NO: 2923936 - RNA, 21 nt, Mycobacterium avium subsp. paratuberculosis
caggccacaugggccacggcg

SEQ ID NO: 2923937 - RNA, 22 nt, Mycobacterium avium subsp. paratuberculosis
caggccacaugggccacggcgc

SEQ ID NO: 2923938 - RNA, 23 nt, Mycobacterium avium subsp. paratuberculosis
caggccacaugggccacggcgcg

SEQ ID NO: 2923939 - RNA, 17 nt, Mycobacterium avium subsp. paratuberculosis
caggccacccgggcgcc

SEQ ID NO: 2923940 - RNA, 20 nt, Mycobacterium avium subsp. paratuberculosis
caggccacccgggcgccggc

SEQ ID NO: 2923941 - RNA, 21 nt, Mycobacterium avium subsp. paratuberculosis
caggccacccgggcgccggcg

SEQ ID NO: 2923942 - RNA, 15 nt, Mycobacterium avium subsp. paratuberculosis
caggccaccgcacgu

SEQ ID NO: 2923943 - RNA, 17 nt, Mycobacterium avium subsp. paratuberculosis
caggccagcaccuggcg

SEQ ID NO: 2923944 - RNA, 15 nt, Mycobacterium avium subsp. paratuberculosis
caggccaucagcccg

SEQ ID NO: 2923945 - RNA, 17 nt, Mycobacterium avium subsp. paratuberculosis
caggccaucagcccggc

SEQ ID NO: 2923946 - RNA, 23 nt, Mycobacterium avium subsp. paratuberculosis
caggccaucagcccggcguccug

SEQ ID NO: 2923947 - RNA, 15 nt, Mycobacterium avium subsp. paratuberculosis
caggccaugaucgaa

SEQ ID NO: 2923948 - RNA, 17 nt, Mycobacterium avium subsp. paratuberculosis
caggccauggcgcaccg

SEQ ID NO: 2923949 - RNA, 18 nt, Mycobacterium avium subsp. paratuberculosis
caggccauggcgcaccgc

SEQ ID NO: 2923950 - RNA, 21 nt, Mycobacterium avium subsp. paratuberculosis
caggccauggcgcaccgcggc

SEQ ID NO: 2923951 - RNA, 18 nt, Mycobacterium avium subsp. paratuberculosis
caggccggcagccggcgc

SEQ ID NO: 2923952 - RNA, 15 nt, Mycobacterium avium subsp. paratuberculosis
caggccggccaccag

SEQ ID NO: 2923953 - RNA, 20 nt, Mycobacterium avium subsp. paratuberculosis
caggccggccugccaccgcg

SEQ ID NO: 2923954 - RNA, 21 nt, Mycobacterium avium subsp. paratuberculosis
caggccggccugccaccgcga

SEQ ID NO: 2923955 - RNA, 23 nt, Mycobacterium avium subsp. paratuberculosis
caggccggccugccggaugccgc

SEQ ID NO: 2923956 - RNA, 14 nt, Mycobacterium avium subsp. paratuberculosis
caggccggcgacga

SEQ ID NO: 2923957 - RNA, 17 nt, Mycobacterium avium subsp. paratuberculosis
caggccggcgacgccgg

SEQ ID NO: 2923958 - RNA, 17 nt, Mycobacterium avium subsp. paratuberculosis
caggccggcgccgcggg

SEQ ID NO: 2923959 - RNA, 15 nt, Mycobacterium avium subsp. paratuberculosis
caggccggcgccggg

SEQ ID NO: 2923960 - RNA, 14 nt, Mycobacterium avium subsp. paratuberculosis
caggccggcggugg

SEQ ID NO: 2923961 - RNA, 22 nt, Mycobacterium avium subsp. paratuberculosis
caggccggcgguggugccgccg

SEQ ID NO: 2923962 - RNA, 23 nt, Mycobacterium avium subsp. paratuberculosis
caggccggcgguggugccgccgu

SEQ ID NO: 2923963 - RNA, 20 nt, Mycobacterium avium subsp. paratuberculosis
caggccgggaaugucgcgca

SEQ ID NO: 2923964 - RNA, 23 nt, Mycobacterium avium subsp. paratuberculosis
caggccgggaaugucgcgcagca

SEQ ID NO: 2923965 - RNA, 20 nt, Mycobacterium avium subsp. paratuberculosis
caggccgggauagagcaccg

SEQ ID NO: 2923966 - RNA, 16 nt, Mycobacterium avium subsp. paratuberculosis
caggccggucacccag

SEQ ID NO: 2923967 - RNA, 18 nt, Mycobacterium avium subsp. paratuberculosis
caggccggucacccaggc

SEQ ID NO: 2923968 - RNA, 16 nt, Mycobacterium avium subsp. paratuberculosis
caggccggucagcgac

SEQ ID NO: 2923969 - RNA, 17 nt, Mycobacterium avium subsp. paratuberculosis
caggccggucagcgacg

SEQ ID NO: 2923970 - RNA, 18 nt, Mycobacterium avium subsp. paratuberculosis
caggccggucagcgacga

SEQ ID NO: 2923971 - RNA, 16 nt, Mycobacterium avium subsp. paratuberculosis
caggccguagcggcuc

SEQ ID NO: 2923972 - RNA, 15 nt, Mycobacterium avium subsp. paratuberculosis
caggccguccaccag

SEQ ID NO: 2923973 - RNA, 22 nt, Mycobacterium avium subsp. paratuberculosis
caggccguccaccagaucgccc

SEQ ID NO: 2923974 - RNA, 16 nt, Mycobacterium avium subsp. paratuberculosis
caggccguccagcagc

SEQ ID NO: 2923975 - RNA, 17 nt, Mycobacterium avium subsp. paratuberculosis
caggccguccagcagca

SEQ ID NO: 2923976 - RNA, 20 nt, Mycobacterium avium subsp. paratuberculosis
caggccguccagcagcagcg

SEQ ID NO: 2923977 - RNA, 16 nt, Mycobacterium avium subsp. paratuberculosis
caggccgucgaggcgc

SEQ ID NO: 2923978 - RNA, 22 nt, Mycobacterium avium subsp. paratuberculosis
caggccgucgaggcgcugcagc

SEQ ID NO: 2923979 - RNA, 15 nt, Mycobacterium avium subsp. paratuberculosis
caggccgucgccggu

SEQ ID NO: 2923980 - RNA, 14 nt, Mycobacterium avium subsp. paratuberculosis
caggccgucggcgc

SEQ ID NO: 2923981 - RNA, 20 nt, Mycobacterium avium subsp. paratuberculosis
caggccgucggggaugccga

SEQ ID NO: 2923982 - RNA, 17 nt, Mycobacterium avium subsp. paratuberculosis
caggccgucucgagccg

SEQ ID NO: 2923983 - RNA, 23 nt, Mycobacterium avium subsp. paratuberculosis
caggccgucucgagccggcgcac

SEQ ID NO: 2923984 - RNA, 20 nt, Mycobacterium avium subsp. paratuberculosis
caggccgugcacgaacaggg

SEQ ID NO: 2923985 - RNA, 23 nt, Mycobacterium avium subsp. paratuberculosis
caggccgugcacgaacaggguga

SEQ ID NO: 2923986 - RNA, 17 nt, Mycobacterium avium subsp. paratuberculosis
caggccgugguuggcga

SEQ ID NO: 2923987 - RNA, 16 nt, Mycobacterium avium subsp. paratuberculosis
caggccguuguggcca

SEQ ID NO: 2923988 - RNA, 19 nt, Mycobacterium avium subsp. paratuberculosis
caggccguuguggccaccc

SEQ ID NO: 2923989 - RNA, 23 nt, Mycobacterium avium subsp. paratuberculosis
caggccguuguggccacccucgc

SEQ ID NO: 2923990 - RNA, 22 nt, Mycobacterium avium subsp. paratuberculosis
caggccucgaggaucgcggcca

SEQ ID NO: 2923991 - RNA, 19 nt, Mycobacterium avium subsp. paratuberculosis
caggccugguaggccgccu

SEQ ID NO: 2923992 - RNA, 20 nt, Mycobacterium avium subsp. paratuberculosis
caggccugguaggccgccuu

SEQ ID NO: 2923993 - RNA, 16 nt, Mycobacterium avium subsp. paratuberculosis
caggccuuccgcaaca

SEQ ID NO: 2923994 - RNA, 22 nt, Mycobacterium avium subsp. paratuberculosis
caggccuuccgcaacaucguca

SEQ ID NO: 2923995 - RNA, 16 nt, Mycobacterium avium subsp. paratuberculosis
caggcgaacauggcgg

SEQ ID NO: 2923996 - RNA, 14 nt, Mycobacterium avium subsp. paratuberculosis
caggcgaagguggg

SEQ ID NO: 2923997 - RNA, 20 nt, Mycobacterium avium subsp. paratuberculosis
caggcgaaggugggcagcgc

SEQ ID NO: 2923998 - RNA, 23 nt, Mycobacterium avium subsp. paratuberculosis
caggcgaaggugggcagcgccac

SEQ ID NO: 2923999 - RNA, 15 nt, Mycobacterium avium subsp. paratuberculosis
caggcgaaucggcgc

SEQ ID NO: 2924000 - RNA, 18 nt, Mycobacterium avium subsp. paratuberculosis
caggcgaaucggcgcaca

SEQ ID NO: 2924001 - RNA, 15 nt, Mycobacterium avium subsp. paratuberculosis
caggcgacccgcacc

SEQ ID NO: 2924002 - RNA, 22 nt, Mycobacterium avium subsp. paratuberculosis
caggcgaccggccccaacggcg

SEQ ID NO: 2924003 - RNA, 23 nt, Mycobacterium avium subsp. paratuberculosis
caggcgacuguccaggccgaggc

SEQ ID NO: 2924004 - RNA, 14 nt, Mycobacterium avium subsp. paratuberculosis
caggcgagccgaca

SEQ ID NO: 2924005 - RNA, 18 nt, Mycobacterium avium subsp. paratuberculosis
caggcgaguuaugccguc

SEQ ID NO: 2924006 - RNA, 23 nt, Mycobacterium avium subsp. paratuberculosis
caggcgaguuaugccgucaccca

SEQ ID NO: 2924007 - RNA, 17 nt, Mycobacterium avium subsp. paratuberculosis
caggcgaucucgccgaa

SEQ ID NO: 2924008 - RNA, 17 nt, Mycobacterium avium subsp. paratuberculosis
caggcgaugaagccggc

SEQ ID NO: 2924009 - RNA, 20 nt, Mycobacterium avium subsp. paratuberculosis
caggcgaugaagccggcgaa

SEQ ID NO: 2924010 - RNA, 12 nt, Mycobacterium avium subsp. paratuberculosis
caggcgaugccg

SEQ ID NO: 2924011 - RNA, 16 nt, Mycobacterium avium subsp. paratuberculosis
caggcgaugccgccga

SEQ ID NO: 2924012 - RNA, 17 nt, Mycobacterium avium subsp. paratuberculosis
caggcgauggcgucggc

SEQ ID NO: 2924013 - RNA, 18 nt, Mycobacterium avium subsp. paratuberculosis
caggcgauggcgucggcc

SEQ ID NO: 2924014 - RNA, 19 nt, Mycobacterium avium subsp. paratuberculosis
caggcgauggcgucggcca

SEQ ID NO: 2924015 - RNA, 24 nt, Mycobacterium avium subsp. paratuberculosis
caggcgauggcgucggccagcggc

SEQ ID NO: 2924016 - RNA, 17 nt, Mycobacterium avium subsp. paratuberculosis
caggcgauggugccggc

SEQ ID NO: 2924017 - RNA, 19 nt, Mycobacterium avium subsp. paratuberculosis
caggcgauggugccggcca

SEQ ID NO: 2924018 - RNA, 21 nt, Mycobacterium avium subsp. paratuberculosis
caggcgauguggguggucagc

SEQ ID NO: 2924019 - RNA, 23 nt, Mycobacterium avium subsp. paratuberculosis
caggcgauguggguggucagcgc

SEQ ID NO: 2924020 - RNA, 17 nt, Mycobacterium avium subsp. paratuberculosis
caggcgcaacagcaccu

SEQ ID NO: 2924021 - RNA, 18 nt, Mycobacterium avium subsp. paratuberculosis
caggcgcaacagcaccuc

SEQ ID NO: 2924022 - RNA, 22 nt, Mycobacterium avium subsp. paratuberculosis
caggcgcaccaccagcucgucg

SEQ ID NO: 2924023 - RNA, 17 nt, Mycobacterium avium subsp. paratuberculosis
caggcgcaccgccaccg

SEQ ID NO: 2924024 - RNA, 18 nt, Mycobacterium avium subsp. paratuberculosis
caggcgcaccgccaccgc

SEQ ID NO: 2924025 - RNA, 21 nt, Mycobacterium avium subsp. paratuberculosis
caggcgccauugucggaucgc

SEQ ID NO: 2924026 - RNA, 13 nt, Mycobacterium avium subsp. paratuberculosis
caggcgcccagga

SEQ ID NO: 2924027 - RNA, 15 nt, Mycobacterium avium subsp. paratuberculosis
caggcgcccaggauc

SEQ ID NO: 2924028 - RNA, 13 nt, Mycobacterium avium subsp. paratuberculosis
caggcgccccagc

SEQ ID NO: 2924029 - RNA, 19 nt, Mycobacterium avium subsp. paratuberculosis
caggcgcccugcacgaaca

SEQ ID NO: 2924030 - RNA, 22 nt, Mycobacterium avium subsp. paratuberculosis
caggcgcccugcacgaacaacu

SEQ ID NO: 2924031 - RNA, 14 nt, Mycobacterium avium subsp. paratuberculosis
caggcgccgcagca

SEQ ID NO: 2924032 - RNA, 18 nt, Mycobacterium avium subsp. paratuberculosis
caggcgccggccagcacg

SEQ ID NO: 2924033 - RNA, 22 nt, Mycobacterium avium subsp. paratuberculosis
caggcgccggccagcacggcca

SEQ ID NO: 2924034 - RNA, 16 nt, Mycobacterium avium subsp. paratuberculosis
caggcgccgucgaugg

SEQ ID NO: 2924035 - RNA, 18 nt, Mycobacterium avium subsp. paratuberculosis
caggcugccgcugcgccg

SEQ ID NO: 2924036 - RNA, 20 nt, Mycobacterium avium subsp. paratuberculosis
caggcugccgcugcgccggc

SEQ ID NO: 2924037 - RNA, 21 nt, Mycobacterium avium subsp. paratuberculosis
caggcugccgcugcgccggcg

SEQ ID NO: 2924038 - RNA, 17 nt, Mycobacterium avium subsp. paratuberculosis
caggcugcucggcgggc

SEQ ID NO: 2924039 - RNA, 23 nt, Mycobacterium avium subsp. paratuberculosis
caggcuggacaccacgucgucgg

SEQ ID NO: 2924040 - RNA, 22 nt, Mycobacterium avium subsp. paratuberculosis
caggcuggcaucgucggcgccg

SEQ ID NO: 2924041 - RNA, 23 nt, Mycobacterium avium subsp. paratuberculosis
caggcuggcaucgucggcgccgg

SEQ ID NO: 2924042 - RNA, 14 nt, Mycobacterium avium subsp. paratuberculosis
caggcuggccagcu

SEQ ID NO: 2924043 - RNA, 20 nt, Mycobacterium avium subsp. paratuberculosis
caggcuggccagcucggcgu

SEQ ID NO: 2924044 - RNA, 22 nt, Mycobacterium avium subsp. paratuberculosis
caggcuggccagcucggcgugg

SEQ ID NO: 2924045 - RNA, 14 nt, Mycobacterium avium subsp. paratuberculosis
caggcuggccaggc

SEQ ID NO: 2924046 - RNA, 17 nt, Mycobacterium avium subsp. paratuberculosis
caggcuggcggcgauca

SEQ ID NO: 2924047 - RNA, 20 nt, Mycobacterium avium subsp. paratuberculosis
caggcuggcggcgaucaccg

SEQ ID NO: 2924048 - RNA, 22 nt, Mycobacterium avium subsp. paratuberculosis
caggcuggcggcgaucaccgcc

SEQ ID NO: 2924049 - RNA, 14 nt, Mycobacterium avium subsp. paratuberculosis
caggcuguccugcg

SEQ ID NO: 2924050 - RNA, 16 nt, Mycobacterium avium subsp. paratuberculosis
caggcuucgcagcaga

SEQ ID NO: 2924051 - RNA, 15 nt, Mycobacterium avium subsp. paratuberculosis
caggcuugccccgua

SEQ ID NO: 2924052 - RNA, 19 nt, Mycobacterium avium subsp. paratuberculosis
caggcuuggcccgccgccg

SEQ ID NO: 2924053 - RNA, 20 nt, Mycobacterium avium subsp. paratuberculosis
caggcuuggcccgccgccgg

SEQ ID NO: 2924054 - RNA, 20 nt, Mycobacterium avium subsp. paratuberculosis
cagggacaugccgagcagca

SEQ ID NO: 2924055 - RNA, 22 nt, Mycobacterium avium subsp. paratuberculosis
cagggacaugccgagcagcacc

SEQ ID NO: 2924056 - RNA, 23 nt, Mycobacterium avium subsp. paratuberculosis
cagggacaugccgagcagcaccg

SEQ ID NO: 2924057 - RNA, 20 nt, Mycobacterium avium subsp. paratuberculosis
cagggaccagugguggccga

SEQ ID NO: 2924058 - RNA, 14 nt, Mycobacterium avium subsp. paratuberculosis
cagggacuccgggg

SEQ ID NO: 2924059 - RNA, 15 nt, Mycobacterium avium subsp. paratuberculosis
cagggacuccgggga

SEQ ID NO: 2924060 - RNA, 14 nt, Mycobacterium avium subsp. paratuberculosis
cagggagccgacga

SEQ ID NO: 2924061 - RNA, 20 nt, Mycobacterium avium subsp. paratuberculosis
cagggagcugcccgcacugg

SEQ ID NO: 2924062 - RNA, 16 nt, Mycobacterium avium subsp. paratuberculosis
cagggaggacagcacc

SEQ ID NO: 2924063 - RNA, 18 nt, Mycobacterium avium subsp. paratuberculosis
cagggaggacagcaccgc

SEQ ID NO: 2924064 - RNA, 19 nt, Mycobacterium avium subsp. paratuberculosis
cagggaggacagcaccgcc

SEQ ID NO: 2924065 - RNA, 23 nt, Mycobacterium avium subsp. paratuberculosis
cagggaggacagcaccgccaucg

SEQ ID NO: 2924066 - RNA, 19 nt, Mycobacterium avium subsp. paratuberculosis
cagggcaaagaucggugcc

SEQ ID NO: 2924067 - RNA, 15 nt, Mycobacterium avium subsp. paratuberculosis
cagggcaccgacggc

SEQ ID NO: 2924068 - RNA, 17 nt, Mycobacterium avium subsp. paratuberculosis
cagggcaccgacggccg

SEQ ID NO: 2924069 - RNA, 20 nt, Mycobacterium avium subsp. paratuberculosis
cagggcaccgacggccgcac

SEQ ID NO: 2924070 - RNA, 18 nt, Mycobacterium avium subsp. paratuberculosis
cagggcagccagcccgcg

SEQ ID NO: 2924071 - RNA, 12 nt, Mycobacterium avium subsp. paratuberculosis
cagggcagcgcc

SEQ ID NO: 2924072 - RNA, 14 nt, Mycobacterium avium subsp. paratuberculosis
cagggcagcgccuc

SEQ ID NO: 2924073 - RNA, 18 nt, Mycobacterium avium subsp. paratuberculosis
cagggcagcgcgaccagc

SEQ ID NO: 2924074 - RNA, 16 nt, Mycobacterium avium subsp. paratuberculosis
cagggccaagacacgc

SEQ ID NO: 2924075 - RNA, 11 nt, Mycobacterium avium subsp. paratuberculosis
cagggccaccg

SEQ ID NO: 2924076 - RNA, 16 nt, Mycobacterium avium subsp. paratuberculosis
cagggccaccgcgucg

SEQ ID NO: 2924077 - RNA, 11 nt, Mycobacterium avium subsp. paratuberculosis
cagggccagca

SEQ ID NO: 2924078 - RNA, 21 nt, Mycobacterium avium subsp. paratuberculosis
cagggccagcaacaccagcug

SEQ ID NO: 2924079 - RNA, 17 nt, Mycobacterium avium subsp. paratuberculosis
cagggccagcaccauga

SEQ ID NO: 2924080 - RNA, 16 nt, Mycobacterium avium subsp. paratuberculosis
cagggccagcagcccg

SEQ ID NO: 2924081 - RNA, 13 nt, Mycobacterium avium subsp. paratuberculosis
cagggccagcgcc

SEQ ID NO: 2924082 - RNA, 14 nt, Mycobacterium avium subsp. paratuberculosis
cagggccagcgcca

SEQ ID NO: 2924083 - RNA, 23 nt, Mycobacterium avium subsp. paratuberculosis
cagggccagcgccaugccgccga

SEQ ID NO: 2924084 - RNA, 17 nt, Mycobacterium avium subsp. paratuberculosis
cagggccagcgccucgg

SEQ ID NO: 2924085 - RNA, 11 nt, Mycobacterium avium subsp. paratuberculosis
cagggccaggc

SEQ ID NO: 2924086 - RNA, 20 nt, Mycobacterium avium subsp. paratuberculosis
cagggccaggccgugaucgg

SEQ ID NO: 2924087 - RNA, 20 nt, Mycobacterium avium subsp. paratuberculosis
cagggccagguucaggcccg

SEQ ID NO: 2924088 - RNA, 21 nt, Mycobacterium avium subsp. paratuberculosis
cagggccagguucaggcccgc

SEQ ID NO: 2924089 - RNA, 22 nt, Mycobacterium avium subsp. paratuberculosis
cagggccagguucaggcccgcg

SEQ ID NO: 2924090 - RNA, 17 nt, Mycobacterium avium subsp. paratuberculosis
cagggcccacagcagcc

SEQ ID NO: 2924091 - RNA, 18 nt, Mycobacterium avium subsp. paratuberculosis
cagggcccacagcagccg

SEQ ID NO: 2924092 - RNA, 20 nt, Mycobacterium avium subsp. paratuberculosis
cagggcccacagcagccgca

SEQ ID NO: 2924093 - RNA, 20 nt, Mycobacterium avium subsp. paratuberculosis
cagggccccguuggugcggu

SEQ ID NO: 2924094 - RNA, 22 nt, Mycobacterium avium subsp. paratuberculosis
cagggccccguuggugcggugc

SEQ ID NO: 2924095 - RNA, 16 nt, Mycobacterium avium subsp. paratuberculosis
cagggcccgcagccgc

SEQ ID NO: 2924096 - RNA, 18 nt, Mycobacterium avium subsp. paratuberculosis
cagggcccgcagccgcug

SEQ ID NO: 2924097 - RNA, 19 nt, Mycobacterium avium subsp. paratuberculosis
cagggcccgcagccgcugg

SEQ ID NO: 2924098 - RNA, 21 nt, Mycobacterium avium subsp. paratuberculosis
cagggcccgcagccgcuggcc

SEQ ID NO: 2924099 - RNA, 21 nt, Mycobacterium avium subsp. paratuberculosis
cagggccgaaaaaccugcggu

SEQ ID NO: 2924100 - RNA, 23 nt, Mycobacterium avium subsp. paratuberculosis
cagggccgaaaaaccugcggugc

SEQ ID NO: 2924101 - RNA, 12 nt, Mycobacterium avium subsp. paratuberculosis
cagggccgcgcg

SEQ ID NO: 2924102 - RNA, 18 nt, Mycobacterium avium subsp. paratuberculosis
cagggccgcggccgccgc

SEQ ID NO: 2924103 - RNA, 19 nt, Mycobacterium avium subsp. paratuberculosis
cagggccgcggccgccgcg

SEQ ID NO: 2924104 - RNA, 16 nt, Mycobacterium avium subsp. paratuberculosis
cagggccgggcgugcc

SEQ ID NO: 2924105 - RNA, 13 nt, Mycobacterium avium subsp. paratuberculosis
cagggccucgccg

SEQ ID NO: 2924106 - RNA, 14 nt, Mycobacterium avium subsp. paratuberculosis
cagggccucgccgu

SEQ ID NO: 2924107 - RNA, 17 nt, Mycobacterium avium subsp. paratuberculosis
cagggccucgccguugc

SEQ ID NO: 2924108 - RNA, 14 nt, Mycobacterium avium subsp. paratuberculosis
cagggccucggcga

SEQ ID NO: 2924109 - RNA, 16 nt, Mycobacterium avium subsp. paratuberculosis
cagggccucggcgacc

SEQ ID NO: 2924110 - RNA, 17 nt, Mycobacterium avium subsp. paratuberculosis
cagggccucgucgucgu

SEQ ID NO: 2924111 - RNA, 16 nt, Mycobacterium avium subsp. paratuberculosis
cagggccugcagcacc

SEQ ID NO: 2924112 - RNA, 17 nt, Mycobacterium avium subsp. paratuberculosis
cagggccugcagcacca

SEQ ID NO: 2924113 - RNA, 20 nt, Mycobacterium avium subsp. paratuberculosis
cagggccugcagcaccaggc

SEQ ID NO: 2924114 - RNA, 20 nt, Mycobacterium avium subsp. paratuberculosis
cagggcgaacggcggaucca

SEQ ID NO: 2924115 - RNA, 15 nt, Mycobacterium avium subsp. paratuberculosis
cagggcgacaucggc

SEQ ID NO: 2924116 - RNA, 17 nt, Mycobacterium avium subsp. paratuberculosis
cagggcgacgccgcgga

SEQ ID NO: 2924117 - RNA, 19 nt, Mycobacterium avium subsp. paratuberculosis
cagggcgacgccgcggaag

SEQ ID NO: 2924118 - RNA, 16 nt, Mycobacterium avium subsp. paratuberculosis
cagggcgacggcggcg

SEQ ID NO: 2924119 - RNA, 23 nt, Mycobacterium avium subsp. paratuberculosis
cagggugacguggcggccgucgc

SEQ ID NO: 2924120 - RNA, 21 nt, Mycobacterium avium subsp. paratuberculosis
cagggugcaggcccgggcggc

SEQ ID NO: 2924121 - RNA, 19 nt, Mycobacterium avium subsp. paratuberculosis
cagggugccaaggucgccg

SEQ ID NO: 2924122 - RNA, 21 nt, Mycobacterium avium subsp. paratuberculosis
cagggugccaaggucgccggu

SEQ ID NO: 2924123 - RNA, 20 nt, Mycobacterium avium subsp. paratuberculosis
cagggugccccgcaccgcca

SEQ ID NO: 2924124 - RNA, 15 nt, Mycobacterium avium subsp. paratuberculosis
cagggugccccgcga

SEQ ID NO: 2924125 - RNA, 11 nt, Mycobacterium avium subsp. paratuberculosis
cagggugccga

SEQ ID NO: 2924126 - RNA, 15 nt, Mycobacterium avium subsp. paratuberculosis
cagggugccgacgac

SEQ ID NO: 2924127 - RNA, 22 nt, Mycobacterium avium subsp. paratuberculosis
cagggugccgauguaggacagg

SEQ ID NO: 2924128 - RNA, 23 nt, Mycobacterium avium subsp. paratuberculosis
cagggugccgauguaggacaggu

SEQ ID NO: 2924129 - RNA, 14 nt, Mycobacterium avium subsp. paratuberculosis
cagggugccgccgc

SEQ ID NO: 2924130 - RNA, 20 nt, Mycobacterium avium subsp. paratuberculosis
cagggugccgcugcccgccg

SEQ ID NO: 2924131 - RNA, 21 nt, Mycobacterium avium subsp. paratuberculosis
cagggugccgcugcccgccgc

SEQ ID NO: 2924132 - RNA, 22 nt, Mycobacterium avium subsp. paratuberculosis
cagggugcgcacgaucugcagg

SEQ ID NO: 2924133 - RNA, 19 nt, Mycobacterium avium subsp. paratuberculosis
cagggugcgcagcgcgucg

SEQ ID NO: 2924134 - RNA, 17 nt, Mycobacterium avium subsp. paratuberculosis
cagggugcguuccaggu

SEQ ID NO: 2924135 - RNA, 19 nt, Mycobacterium avium subsp. paratuberculosis
cagggugcguuccaggucc

SEQ ID NO: 2924136 - RNA, 22 nt, Mycobacterium avium subsp. paratuberculosis
cagggugcguuccagguccgcg

SEQ ID NO: 2924137 - RNA, 18 nt, Mycobacterium avium subsp. paratuberculosis
cagggugcucagccgcac

SEQ ID NO: 2924138 - RNA, 16 nt, Mycobacterium avium subsp. paratuberculosis
caggguggccagcacc

SEQ ID NO: 2924139 - RNA, 17 nt, Mycobacterium avium subsp. paratuberculosis
caggguggccagcaccg

SEQ ID NO: 2924140 - RNA, 23 nt, Mycobacterium avium subsp. paratuberculosis
caggguggccagcaccgcgucga

SEQ ID NO: 2924141 - RNA, 17 nt, Mycobacterium avium subsp. paratuberculosis
caggguggccagcacgc

SEQ ID NO: 2924142 - RNA, 18 nt, Mycobacterium avium subsp. paratuberculosis
caggguggccagcacgcu

SEQ ID NO: 2924143 - RNA, 15 nt, Mycobacterium avium subsp. paratuberculosis
caggguggccccagc

SEQ ID NO: 2924144 - RNA, 17 nt, Mycobacterium avium subsp. paratuberculosis
caggguggccccagccc

SEQ ID NO: 2924145 - RNA, 16 nt, Mycobacterium avium subsp. paratuberculosis
caggguggccgccacc

SEQ ID NO: 2924146 - RNA, 17 nt, Mycobacterium avium subsp. paratuberculosis
caggguggccgccacca

SEQ ID NO: 2924147 - RNA, 19 nt, Mycobacterium avium subsp. paratuberculosis
caggguggccgccaccagg

SEQ ID NO: 2924148 - RNA, 20 nt, Mycobacterium avium subsp. paratuberculosis
caggguggccgccaccaggc

SEQ ID NO: 2924149 - RNA, 22 nt, Mycobacterium avium subsp. paratuberculosis
caggguggccgccaccaggcug

SEQ ID NO: 2924150 - RNA, 19 nt, Mycobacterium avium subsp. paratuberculosis
caggguggccucgucggcg

SEQ ID NO: 2924151 - RNA, 20 nt, Mycobacterium avium subsp. paratuberculosis
caggguggccucgucggcgc

SEQ ID NO: 2924152 - RNA, 14 nt, Mycobacterium avium subsp. paratuberculosis
caggguggucagcg

SEQ ID NO: 2924153 - RNA, 15 nt, Mycobacterium avium subsp. paratuberculosis
caggguggucagcgu

SEQ ID NO: 2924154 - RNA, 17 nt, Mycobacterium avium subsp. paratuberculosis
caggguguaggccgcgu

SEQ ID NO: 2924155 - RNA, 12 nt, Mycobacterium avium subsp. paratuberculosis
cagggugucgau

SEQ ID NO: 2924156 - RNA, 16 nt, Mycobacterium avium subsp. paratuberculosis
cagggugucgucgcgc

SEQ ID NO: 2924157 - RNA, 17 nt, Mycobacterium avium subsp. paratuberculosis
cagggugucgucgcgca

SEQ ID NO: 2924158 - RNA, 19 nt, Mycobacterium avium subsp. paratuberculosis
cagggugucgucgcgcacc

SEQ ID NO: 2924159 - RNA, 21 nt, Mycobacterium avium subsp. paratuberculosis
cagggugucgucgcgcaccca

SEQ ID NO: 2924160 - RNA, 18 nt, Mycobacterium avium subsp. paratuberculosis
cagggugugacggauccg

SEQ ID NO: 2924161 - RNA, 19 nt, Mycobacterium avium subsp. paratuberculosis
caggguguuguccgagccg

SEQ ID NO: 2924162 - RNA, 18 nt, Mycobacterium avium subsp. paratuberculosis
caggguucucgcggcggc

SEQ ID NO: 2924163 - RNA, 20 nt, Mycobacterium avium subsp. paratuberculosis
caggguucucgcggcggccg

SEQ ID NO: 2924164 - RNA, 14 nt, Mycobacterium avium subsp. paratuberculosis
caggguugccgcac

SEQ ID NO: 2924165 - RNA, 16 nt, Mycobacterium avium subsp. paratuberculosis
caggguugccgcacga

SEQ ID NO: 2924166 - RNA, 19 nt, Mycobacterium avium subsp. paratuberculosis
caggguuucaugcacggcg

SEQ ID NO: 2924167 - RNA, 16 nt, Mycobacterium avium subsp. paratuberculosis
caggguuuccucgagc

SEQ ID NO: 2924168 - RNA, 19 nt, Mycobacterium avium subsp. paratuberculosis
caggguuugggcgugcggc

SEQ ID NO: 2924169 - RNA, 20 nt, Mycobacterium avium subsp. paratuberculosis
caggguuuucacgucgagcg

SEQ ID NO: 2924170 - RNA, 14 nt, Mycobacterium avium subsp. paratuberculosis
cagguaaaccagca

SEQ ID NO: 2924171 - RNA, 15 nt, Mycobacterium avium subsp. paratuberculosis
cagguaaaccagcag

SEQ ID NO: 2924172 - RNA, 19 nt, Mycobacterium avium subsp. paratuberculosis
cagguaaucgaaggccagg

SEQ ID NO: 2924173 - RNA, 20 nt, Mycobacterium avium subsp. paratuberculosis
cagguaaucgaaggccaggu

SEQ ID NO: 2924174 - RNA, 16 nt, Mycobacterium avium subsp. paratuberculosis
cagguacaccaccagg

SEQ ID NO: 2924175 - RNA, 14 nt, Mycobacterium avium subsp. paratuberculosis
cagguaccggcggg

SEQ ID NO: 2924176 - RNA, 17 nt, Mycobacterium avium subsp. paratuberculosis
cagguaccggcgggcga

SEQ ID NO: 2924177 - RNA, 18 nt, Mycobacterium avium subsp. paratuberculosis
cagguaccggcgggcgaa

SEQ ID NO: 2924178 - RNA, 20 nt, Mycobacterium avium subsp. paratuberculosis
cagguaccgguuccgggcga

SEQ ID NO: 2924179 - RNA, 22 nt, Mycobacterium avium subsp. paratuberculosis
cagguaccgguuccgggcgacc

SEQ ID NO: 2924180 - RNA, 14 nt, Mycobacterium avium subsp. paratuberculosis
cagguacgcgacgg

SEQ ID NO: 2924181 - RNA, 20 nt, Mycobacterium avium subsp. paratuberculosis
cagguacgcggcguugccgc

SEQ ID NO: 2924182 - RNA, 23 nt, Mycobacterium avium subsp. paratuberculosis
cagguacgcggcguugccgccgg

SEQ ID NO: 2924183 - RNA, 14 nt, Mycobacterium avium subsp. paratuberculosis
cagguacuccucgg

SEQ ID NO: 2924184 - RNA, 17 nt, Mycobacterium avium subsp. paratuberculosis
cagguacuccucggugu

SEQ ID NO: 2924185 - RNA, 20 nt, Mycobacterium avium subsp. paratuberculosis
cagguacugcuugccgccgg

SEQ ID NO: 2924186 - RNA, 22 nt, Mycobacterium avium subsp. paratuberculosis
cagguacugggcguggucgccg

SEQ ID NO: 2924187 - RNA, 18 nt, Mycobacterium avium subsp. paratuberculosis
cagguagaagccgcgacg

SEQ ID NO: 2924188 - RNA, 19 nt, Mycobacterium avium subsp. paratuberculosis
cagguagacgaugcccagc

SEQ ID NO: 2924189 - RNA, 23 nt, Mycobacterium avium subsp. paratuberculosis
cagguagauggugaucgaccgga

SEQ ID NO: 2924190 - RNA, 22 nt, Mycobacterium avium subsp. paratuberculosis
cagguagcaggcgcgcagcagg

SEQ ID NO: 2924191 - RNA, 19 nt, Mycobacterium avium subsp. paratuberculosis
cagguagcccaugucgccg

SEQ ID NO: 2924192 - RNA, 20 nt, Mycobacterium avium subsp. paratuberculosis
cagguagcccaugucgccgg

SEQ ID NO: 2924193 - RNA, 15 nt, Mycobacterium avium subsp. paratuberculosis
cagguagccgagguc

SEQ ID NO: 2924194 - RNA, 13 nt, Mycobacterium avium subsp. paratuberculosis
cagguagccgccg

SEQ ID NO: 2924195 - RNA, 22 nt, Mycobacterium avium subsp. paratuberculosis
cagguagccgccguagccggcg

SEQ ID NO: 2924196 - RNA, 16 nt, Mycobacterium avium subsp. paratuberculosis
cagguagcgcagcccg

SEQ ID NO: 2924197 - RNA, 16 nt, Mycobacterium avium subsp. paratuberculosis
cagguagcggcugacc

SEQ ID NO: 2924198 - RNA, 17 nt, Mycobacterium avium subsp. paratuberculosis
cagguagcggugcucga

SEQ ID NO: 2924199 - RNA, 20 nt, Mycobacterium avium subsp. paratuberculosis
cagguagcggugcucgaugu

SEQ ID NO: 2924200 - RNA, 21 nt, Mycobacterium avium subsp. paratuberculosis
cagguagcggugcucgaugua

SEQ ID NO: 2924201 - RNA, 15 nt, Mycobacterium avium subsp. paratuberculosis
cagguaggcgccgcu

SEQ ID NO: 2924202 - RNA, 17 nt, Mycobacterium avium subsp. paratuberculosis
cagguaggcgccgcucg

SEQ ID NO: 2924203 - RNA, 15 nt, Mycobacterium avium subsp. paratuberculosis
caggucgccgcgcag

SEQ ID NO: 2924204 - RNA, 19 nt, Mycobacterium avium subsp. paratuberculosis
caggucgccgcgcagcacc

SEQ ID NO: 2924205 - RNA, 22 nt, Mycobacterium avium subsp. paratuberculosis
caggucgccgcgcagcaccgcg

SEQ ID NO: 2924206 - RNA, 13 nt, Mycobacterium avium subsp. paratuberculosis
caggucgccggcg

SEQ ID NO: 2924207 - RNA, 17 nt, Mycobacterium avium subsp. paratuberculosis
caggucgccggcggccg

SEQ ID NO: 2924208 - RNA, 18 nt, Mycobacterium avium subsp. paratuberculosis
caggucgccggcggccga

SEQ ID NO: 2924209 - RNA, 20 nt, Mycobacterium avium subsp. paratuberculosis
caggucgccggcggccgaca

SEQ ID NO: 2924210 - RNA, 12 nt, Mycobacterium avium subsp. paratuberculosis
caggucgcgccg

SEQ ID NO: 2924211 - RNA, 15 nt, Mycobacterium avium subsp. paratuberculosis
caggucgcgccggag

SEQ ID NO: 2924212 - RNA, 17 nt, Mycobacterium avium subsp. paratuberculosis
caggucgcggcgcugcg

SEQ ID NO: 2924213 - RNA, 19 nt, Mycobacterium avium subsp. paratuberculosis
caggucgcggcgcugcgcc

SEQ ID NO: 2924214 - RNA, 20 nt, Mycobacterium avium subsp. paratuberculosis
caggucgcggcgcugcgccg

SEQ ID NO: 2924215 - RNA, 11 nt, Mycobacterium avium subsp. paratuberculosis
caggucgcggu

SEQ ID NO: 2924216 - RNA, 23 nt, Mycobacterium avium subsp. paratuberculosis
caggucgcgguagcgcucgucgu

SEQ ID NO: 2924217 - RNA, 15 nt, Mycobacterium avium subsp. paratuberculosis
caggucgcggugggc

SEQ ID NO: 2924218 - RNA, 17 nt, Mycobacterium avium subsp. paratuberculosis
caggucgcggugggcgc

SEQ ID NO: 2924219 - RNA, 17 nt, Mycobacterium avium subsp. paratuberculosis
caggucgcugcccggcg

SEQ ID NO: 2924220 - RNA, 22 nt, Mycobacterium avium subsp. paratuberculosis
caggucgcugcccggcguguag

SEQ ID NO: 2924221 - RNA, 13 nt, Mycobacterium avium subsp. paratuberculosis
caggucggccagc

SEQ ID NO: 2924222 - RNA, 17 nt, Mycobacterium avium subsp. paratuberculosis
caggucggccagcgccg

SEQ ID NO: 2924223 - RNA, 20 nt, Mycobacterium avium subsp. paratuberculosis
caggucggccagcgccgccc

SEQ ID NO: 2924224 - RNA, 21 nt, Mycobacterium avium subsp. paratuberculosis
caggucggccagcgccgcccg

SEQ ID NO: 2924225 - RNA, 14 nt, Mycobacterium avium subsp. paratuberculosis
caggucggccagcu

SEQ ID NO: 2924226 - RNA, 16 nt, Mycobacterium avium subsp. paratuberculosis
caggucggccagcugc

SEQ ID NO: 2924227 - RNA, 14 nt, Mycobacterium avium subsp. paratuberculosis
caggucggccgcgg

SEQ ID NO: 2924228 - RNA, 17 nt, Mycobacterium avium subsp. paratuberculosis
caggucggccgcggccg

SEQ ID NO: 2924229 - RNA, 11 nt, Mycobacterium avium subsp. paratuberculosis
caggucggccu

SEQ ID NO: 2924230 - RNA, 22 nt, Mycobacterium avium subsp. paratuberculosis
caggucggccuucagcguccac

SEQ ID NO: 2924231 - RNA, 19 nt, Mycobacterium avium subsp. paratuberculosis
caggucggcgggagccggc

SEQ ID NO: 2924232 - RNA, 21 nt, Mycobacterium avium subsp. paratuberculosis
caggucggcgggagccggcgg

SEQ ID NO: 2924233 - RNA, 14 nt, Mycobacterium avium subsp. paratuberculosis
caggucggcggucg

SEQ ID NO: 2924234 - RNA, 17 nt, Mycobacterium avium subsp. paratuberculosis
caggucggcggucgcgg

SEQ ID NO: 2924235 - RNA, 14 nt, Mycobacterium avium subsp. paratuberculosis
caggucggcgugca

SEQ ID NO: 2924236 - RNA, 19 nt, Mycobacterium avium subsp. paratuberculosis
caggucggcgugcagcacg

SEQ ID NO: 2924237 - RNA, 22 nt, Mycobacterium avium subsp. paratuberculosis
caggucggcgugcagcacgggg

SEQ ID NO: 2924238 - RNA, 21 nt, Mycobacterium avium subsp. paratuberculosis
caggucggcgugcucgucgcg

SEQ ID NO: 2924239 - RNA, 17 nt, Mycobacterium avium subsp. paratuberculosis
caggucgggacguccgc

SEQ ID NO: 2924240 - RNA, 20 nt, Mycobacterium avium subsp. paratuberculosis
caggucgggacguccgcgcg

SEQ ID NO: 2924241 - RNA, 15 nt, Mycobacterium avium subsp. paratuberculosis
caggucgggccggcc

SEQ ID NO: 2924242 - RNA, 17 nt, Mycobacterium avium subsp. paratuberculosis
caggucgggccggccga

SEQ ID NO: 2924243 - RNA, 15 nt, Mycobacterium avium subsp. paratuberculosis
caggucggggcccgu

SEQ ID NO: 2924244 - RNA, 18 nt, Mycobacterium avium subsp. paratuberculosis
caggucggggcccguccc

SEQ ID NO: 2924245 - RNA, 19 nt, Mycobacterium avium subsp. paratuberculosis
caggucggggcccgucccc

SEQ ID NO: 2924246 - RNA, 16 nt, Mycobacterium avium subsp. paratuberculosis
caggucggggugggcg

SEQ ID NO: 2924247 - RNA, 14 nt, Mycobacterium avium subsp. paratuberculosis
caggucggugccgc

SEQ ID NO: 2924248 - RNA, 18 nt, Mycobacterium avium subsp. paratuberculosis
caggucggugccgcggcg

SEQ ID NO: 2924249 - RNA, 18 nt, Mycobacterium avium subsp. paratuberculosis
caggucggugcgcggggu

SEQ ID NO: 2924250 - RNA, 20 nt, Mycobacterium avium subsp. paratuberculosis
caggucguaguaggcgccga

SEQ ID NO: 2924251 - RNA, 15 nt, Mycobacterium avium subsp. paratuberculosis
caggucgucgacguc

SEQ ID NO: 2924252 - RNA, 16 nt, Mycobacterium avium subsp. paratuberculosis
caggucgucgacgucc

SEQ ID NO: 2924253 - RNA, 14 nt, Mycobacterium avium subsp. paratuberculosis
caggucgucgauca

SEQ ID NO: 2924254 - RNA, 16 nt, Mycobacterium avium subsp. paratuberculosis
caggucgucgucgccg

SEQ ID NO: 2924255 - RNA, 19 nt, Mycobacterium avium subsp. paratuberculosis
caggucguucauucagcac

SEQ ID NO: 2924256 - RNA, 18 nt, Mycobacterium avium subsp. paratuberculosis
caggucguugccggugcc

SEQ ID NO: 2924257 - RNA, 21 nt, Mycobacterium avium subsp. paratuberculosis
caggucguugccggugccgac

SEQ ID NO: 2924258 - RNA, 20 nt, Mycobacterium avium subsp. paratuberculosis
caggucuccguagcccugca

SEQ ID NO: 2924259 - RNA, 17 nt, Mycobacterium avium subsp. paratuberculosis
caggucuccguugucga

SEQ ID NO: 2924260 - RNA, 17 nt, Mycobacterium avium subsp. paratuberculosis
caggucuucggucgcga

SEQ ID NO: 2924261 - RNA, 18 nt, Mycobacterium avium subsp. paratuberculosis
caggucuucggucgcgac

SEQ ID NO: 2924262 - RNA, 23 nt, Mycobacterium avium subsp. paratuberculosis
caggucuucucguccgcgcuggc

SEQ ID NO: 2924263 - RNA, 14 nt, Mycobacterium avium subsp. paratuberculosis
caggugaacagcag

SEQ ID NO: 2924264 - RNA, 16 nt, Mycobacterium avium subsp. paratuberculosis
caggugaacagcagcc

SEQ ID NO: 2924265 - RNA, 20 nt, Mycobacterium avium subsp. paratuberculosis
caggugaacagcagccacga

SEQ ID NO: 2924266 - RNA, 13 nt, Mycobacterium avium subsp. paratuberculosis
caggugacgccgc

SEQ ID NO: 2924267 - RNA, 17 nt, Mycobacterium avium subsp. paratuberculosis
caggugacgccgcacga

SEQ ID NO: 2924268 - RNA, 20 nt, Mycobacterium avium subsp. paratuberculosis
caggugacggauguggucgg

SEQ ID NO: 2924269 - RNA, 23 nt, Mycobacterium avium subsp. paratuberculosis
caggugacggauguggucggcca

SEQ ID NO: 2924270 - RNA, 20 nt, Mycobacterium avium subsp. paratuberculosis
caggugagccgggugcccgc

SEQ ID NO: 2924271 - RNA, 23 nt, Mycobacterium avium subsp. paratuberculosis
caggugaucuugcccagccacgc

SEQ ID NO: 2924272 - RNA, 15 nt, Mycobacterium avium subsp. paratuberculosis
caggugaugcggccc

SEQ ID NO: 2924273 - RNA, 15 nt, Mycobacterium avium subsp. paratuberculosis
caggugcaccaccca

SEQ ID NO: 2924274 - RNA, 16 nt, Mycobacterium avium subsp. paratuberculosis
caggugcaccacccag

SEQ ID NO: 2924275 - RNA, 19 nt, Mycobacterium avium subsp. paratuberculosis
caggugcaccacccaggcc

SEQ ID NO: 2924276 - RNA, 23 nt, Mycobacterium avium subsp. paratuberculosis
caggugcacccgaugcucgaugc

SEQ ID NO: 2924277 - RNA, 13 nt, Mycobacterium avium subsp. paratuberculosis
caggugcacccgc

SEQ ID NO: 2924278 - RNA, 18 nt, Mycobacterium avium subsp. paratuberculosis
caggugcacccgcggcgc

SEQ ID NO: 2924279 - RNA, 14 nt, Mycobacterium avium subsp. paratuberculosis
caggugcacgccga

SEQ ID NO: 2924280 - RNA, 17 nt, Mycobacterium avium subsp. paratuberculosis
caggugcacgccgagca

SEQ ID NO: 2924281 - RNA, 23 nt, Mycobacterium avium subsp. paratuberculosis
caggugcacgccgagcagcaccg

SEQ ID NO: 2924282 - RNA, 18 nt, Mycobacterium avium subsp. paratuberculosis
caggugcagaccggacag

SEQ ID NO: 2924283 - RNA, 21 nt, Mycobacterium avium subsp. paratuberculosis
caggugcagaccggacagcug

SEQ ID NO: 2924284 - RNA, 22 nt, Mycobacterium avium subsp. paratuberculosis
caggugcagaccggacagcugg

SEQ ID NO: 2924285 - RNA, 19 nt, Mycobacterium avium subsp. paratuberculosis
caggugcagcagcagccac

SEQ ID NO: 2924286 - RNA, 14 nt, Mycobacterium avium subsp. paratuberculosis
caggugcagcgugg

SEQ ID NO: 2924287 - RNA, 18 nt, Mycobacterium avium subsp. paratuberculosis
cagguugcgguguugcgc

SEQ ID NO: 2924288 - RNA, 22 nt, Mycobacterium avium subsp. paratuberculosis
cagguugcgguguugcgcagcg

SEQ ID NO: 2924289 - RNA, 16 nt, Mycobacterium avium subsp. paratuberculosis
cagguuggacaguucg

SEQ ID NO: 2924290 - RNA, 14 nt, Mycobacterium avium subsp. paratuberculosis
cagguuggcgccga

SEQ ID NO: 2924291 - RNA, 15 nt, Mycobacterium avium subsp. paratuberculosis
cagguuggcgccgaa

SEQ ID NO: 2924292 - RNA, 13 nt, Mycobacterium avium subsp. paratuberculosis
cagguuggcggcg

SEQ ID NO: 2924293 - RNA, 17 nt, Mycobacterium avium subsp. paratuberculosis
cagguuggcggcggccc

SEQ ID NO: 2924294 - RNA, 22 nt, Mycobacterium avium subsp. paratuberculosis
cagguuggcggcggcccgcgcg

SEQ ID NO: 2924295 - RNA, 16 nt, Mycobacterium avium subsp. paratuberculosis
cagguuggggccgaug

SEQ ID NO: 2924296 - RNA, 16 nt, Mycobacterium avium subsp. paratuberculosis
cagguuggucagcagc

SEQ ID NO: 2924297 - RNA, 20 nt, Mycobacterium avium subsp. paratuberculosis
cagguuggucagcagcagcg

SEQ ID NO: 2924298 - RNA, 16 nt, Mycobacterium avium subsp. paratuberculosis
cagguuguagucggcg

SEQ ID NO: 2924299 - RNA, 20 nt, Mycobacterium avium subsp. paratuberculosis
cagguuguccagccggugca

SEQ ID NO: 2924300 - RNA, 23 nt, Mycobacterium avium subsp. paratuberculosis
cagguuguccagccggugcacca

SEQ ID NO: 2924301 - RNA, 24 nt, Mycobacterium avium subsp. paratuberculosis
cagguuguccagccggugcaccac

SEQ ID NO: 2924302 - RNA, 16 nt, Mycobacterium avium subsp. paratuberculosis
cagguugucgccgcgc

SEQ ID NO: 2924303 - RNA, 17 nt, Mycobacterium avium subsp. paratuberculosis
cagguugucgccgcgcc

SEQ ID NO: 2924304 - RNA, 18 nt, Mycobacterium avium subsp. paratuberculosis
cagguugucgccgcgcca

SEQ ID NO: 2924305 - RNA, 23 nt, Mycobacterium avium subsp. paratuberculosis
cagguugucgccgcgccagccgc

SEQ ID NO: 2924306 - RNA, 23 nt, Mycobacterium avium subsp. paratuberculosis
cagguugucgcugaacgccccgu

SEQ ID NO: 2924307 - RNA, 13 nt, Mycobacterium avium subsp. paratuberculosis
cagguugucggcc

SEQ ID NO: 2924308 - RNA, 15 nt, Mycobacterium avium subsp. paratuberculosis
cagguugucggccaa

SEQ ID NO: 2924309 - RNA, 17 nt, Mycobacterium avium subsp. paratuberculosis
cagguugucgucgggca

SEQ ID NO: 2924310 - RNA, 17 nt, Mycobacterium avium subsp. paratuberculosis
cagguuguggugcacga

SEQ ID NO: 2924311 - RNA, 22 nt, Mycobacterium avium subsp. paratuberculosis
cagguuucgcucgucggcgcgg

SEQ ID NO: 2924312 - RNA, 15 nt, Mycobacterium avium subsp. paratuberculosis
cagguuuugcagcgg

SEQ ID NO: 2924313 - RNA, 16 nt, Mycobacterium avium subsp. paratuberculosis
cagguuuugcagcgga

SEQ ID NO: 2924314 - RNA, 21 nt, Mycobacterium avium subsp. paratuberculosis
caguacagcuaggccagcagc

SEQ ID NO: 2924315 - RNA, 18 nt, Mycobacterium avium subsp. paratuberculosis
caguaccagcggccgucg

SEQ ID NO: 2924316 - RNA, 13 nt, Mycobacterium avium subsp. paratuberculosis
caguaccggcgau

SEQ ID NO: 2924317 - RNA, 23 nt, Mycobacterium avium subsp. paratuberculosis
caguaccggcgaugccagcgcac

SEQ ID NO: 2924318 - RNA, 15 nt, Mycobacterium avium subsp. paratuberculosis
caguaccgggccugu

SEQ ID NO: 2924319 - RNA, 13 nt, Mycobacterium avium subsp. paratuberculosis
caguacgcgccgg

SEQ ID NO: 2924320 - RNA, 14 nt, Mycobacterium avium subsp. paratuberculosis
caguagaacggccc

SEQ ID NO: 2924321 - RNA, 19 nt, Mycobacterium avium subsp. paratuberculosis
caguagaaguggccgaccg

SEQ ID NO: 2924322 - RNA, 14 nt, Mycobacterium avium subsp. paratuberculosis
caguagacgccgcc

SEQ ID NO: 2924323 - RNA, 16 nt, Mycobacterium avium subsp. paratuberculosis
caguagacgccgccgu

SEQ ID NO: 2924324 - RNA, 16 nt, Mycobacterium avium subsp. paratuberculosis
caguagacguugccga

SEQ ID NO: 2924325 - RNA, 21 nt, Mycobacterium avium subsp. paratuberculosis
caguagacguugccgaucccg

SEQ ID NO: 2924326 - RNA, 22 nt, Mycobacterium avium subsp. paratuberculosis
caguagacguugccgaucccgg

SEQ ID NO: 2924327 - RNA, 19 nt, Mycobacterium avium subsp. paratuberculosis
caguagccgaucuccaccg

SEQ ID NO: 2924328 - RNA, 20 nt, Mycobacterium avium subsp. paratuberculosis
caguagccgaucuccaccga

SEQ ID NO: 2924329 - RNA, 15 nt, Mycobacterium avium subsp. paratuberculosis
caguagccgccgggc

SEQ ID NO: 2924330 - RNA, 17 nt, Mycobacterium avium subsp. paratuberculosis
caguagccgccgggcgu

SEQ ID NO: 2924331 - RNA, 15 nt, Mycobacterium avium subsp. paratuberculosis
caguagccggccagc

SEQ ID NO: 2924332 - RNA, 21 nt, Mycobacterium avium subsp. paratuberculosis
caguagcgcaccggucagcgc

SEQ ID NO: 2924333 - RNA, 20 nt, Mycobacterium avium subsp. paratuberculosis
caguagcggaaguacaccgg

SEQ ID NO: 2924334 - RNA, 19 nt, Mycobacterium avium subsp. paratuberculosis
caguaggucacccgguccc

SEQ ID NO: 2924335 - RNA, 20 nt, Mycobacterium avium subsp. paratuberculosis
caguagugguccaccgccgc

SEQ ID NO: 2924336 - RNA, 20 nt, Mycobacterium avium subsp. paratuberculosis
caguaucuuguucgccgaca

SEQ ID NO: 2924337 - RNA, 17 nt, Mycobacterium avium subsp. paratuberculosis
caguaugcccgccgcug

SEQ ID NO: 2924338 - RNA, 20 nt, Mycobacterium avium subsp. paratuberculosis
caguccagcgaaucgaccgg

SEQ ID NO: 2924339 - RNA, 19 nt, Mycobacterium avium subsp. paratuberculosis
caguccagcucccaggacg

SEQ ID NO: 2924340 - RNA, 16 nt, Mycobacterium avium subsp. paratuberculosis
caguccaggccgccgu

SEQ ID NO: 2924341 - RNA, 17 nt, Mycobacterium avium subsp. paratuberculosis
caguccaggccgccgug

SEQ ID NO: 2924342 - RNA, 24 nt, Mycobacterium avium subsp. paratuberculosis
cagucccagaucguagggcucggc

SEQ ID NO: 2924343 - RNA, 13 nt, Mycobacterium avium subsp. paratuberculosis
cagucccagcaca

SEQ ID NO: 2924344 - RNA, 13 nt, Mycobacterium avium subsp. paratuberculosis
cagucccaguugu

SEQ ID NO: 2924345 - RNA, 22 nt, Mycobacterium avium subsp. paratuberculosis
cagucccaguuguuuccccagc

SEQ ID NO: 2924346 - RNA, 15 nt, Mycobacterium avium subsp. paratuberculosis
caguccccgccuucg

SEQ ID NO: 2924347 - RNA, 14 nt, Mycobacterium avium subsp. paratuberculosis
cagucccgcguugu

SEQ ID NO: 2924348 - RNA, 23 nt, Mycobacterium avium subsp. paratuberculosis
cagucccgcguugugcaccaaca

SEQ ID NO: 2924349 - RNA, 14 nt, Mycobacterium avium subsp. paratuberculosis
caguccgacgcgac

SEQ ID NO: 2924350 - RNA, 13 nt, Mycobacterium avium subsp. paratuberculosis
caguccgcccagc

SEQ ID NO: 2924351 - RNA, 14 nt, Mycobacterium avium subsp. paratuberculosis
caguccgcccagcg

SEQ ID NO: 2924352 - RNA, 13 nt, Mycobacterium avium subsp. paratuberculosis
caguccgccccga

SEQ ID NO: 2924353 - RNA, 20 nt, Mycobacterium avium subsp. paratuberculosis
caguccgccggagaccagca

SEQ ID NO: 2924354 - RNA, 14 nt, Mycobacterium avium subsp. paratuberculosis
caguccgcgccggu

SEQ ID NO: 2924355 - RNA, 17 nt, Mycobacterium avium subsp. paratuberculosis
caguccgcgccgguccc

SEQ ID NO: 2924356 - RNA, 22 nt, Mycobacterium avium subsp. paratuberculosis
caguccgcgccggucccgcggc

SEQ ID NO: 2924357 - RNA, 19 nt, Mycobacterium avium subsp. paratuberculosis
caguccgcgugacaagccg

SEQ ID NO: 2924358 - RNA, 20 nt, Mycobacterium avium subsp. paratuberculosis
caguccggacacggccagcg

SEQ ID NO: 2924359 - RNA, 22 nt, Mycobacterium avium subsp. paratuberculosis
caguccggacacggccagcgcc

SEQ ID NO: 2924360 - RNA, 16 nt, Mycobacterium avium subsp. paratuberculosis
caguccggcagcagcg

SEQ ID NO: 2924361 - RNA, 13 nt, Mycobacterium avium subsp. paratuberculosis
caguccggccagc

SEQ ID NO: 2924362 - RNA, 13 nt, Mycobacterium avium subsp. paratuberculosis
caguccggccgug

SEQ ID NO: 2924363 - RNA, 21 nt, Mycobacterium avium subsp. paratuberculosis
caguccggcgaguacccgccg

SEQ ID NO: 2924364 - RNA, 13 nt, Mycobacterium avium subsp. paratuberculosis
caguccggcgccc

SEQ ID NO: 2924365 - RNA, 16 nt, Mycobacterium avium subsp. paratuberculosis
caguccggcgcccggc

SEQ ID NO: 2924366 - RNA, 18 nt, Mycobacterium avium subsp. paratuberculosis
caguccggcgcccggcuc

SEQ ID NO: 2924367 - RNA, 19 nt, Mycobacterium avium subsp. paratuberculosis
caguccggcgcccggcucc

SEQ ID NO: 2924368 - RNA, 14 nt, Mycobacterium avium subsp. paratuberculosis
caguccggcgccga

SEQ ID NO: 2924369 - RNA, 15 nt, Mycobacterium avium subsp. paratuberculosis
caguccggcgccgac

SEQ ID NO: 2924370 - RNA, 16 nt, Mycobacterium avium subsp. paratuberculosis
caguccggcgccgacc

SEQ ID NO: 2924371 - RNA, 20 nt, Mycobacterium avium subsp. paratuberculosis
caguccggcggucagcaccg

SEQ ID NO: 2924372 - RNA, 19 nt, Mycobacterium avium subsp. paratuberculosis
cagugcccgcccagcugca

SEQ ID NO: 2924373 - RNA, 16 nt, Mycobacterium avium subsp. paratuberculosis
cagugccgcaccagca

SEQ ID NO: 2924374 - RNA, 17 nt, Mycobacterium avium subsp. paratuberculosis
cagugccgcaccagcac

SEQ ID NO: 2924375 - RNA, 19 nt, Mycobacterium avium subsp. paratuberculosis
cagugccgcaccagcaccc

SEQ ID NO: 2924376 - RNA, 21 nt, Mycobacterium avium subsp. paratuberculosis
cagugccgcaccagcaccccg

SEQ ID NO: 2924377 - RNA, 15 nt, Mycobacterium avium subsp. paratuberculosis
cagugccgcaggugg

SEQ ID NO: 2924378 - RNA, 16 nt, Mycobacterium avium subsp. paratuberculosis
cagugccgcagguggu

SEQ ID NO: 2924379 - RNA, 21 nt, Mycobacterium avium subsp. paratuberculosis
cagugccgcgcggacgcggcg

SEQ ID NO: 2924380 - RNA, 12 nt, Mycobacterium avium subsp. paratuberculosis
cagugccggcga

SEQ ID NO: 2924381 - RNA, 16 nt, Mycobacterium avium subsp. paratuberculosis
cagugccggcgcaccg

SEQ ID NO: 2924382 - RNA, 17 nt, Mycobacterium avium subsp. paratuberculosis
cagugccggcgcaccgc

SEQ ID NO: 2924383 - RNA, 21 nt, Mycobacterium avium subsp. paratuberculosis
cagugccggcgcaccgcgucg

SEQ ID NO: 2924384 - RNA, 13 nt, Mycobacterium avium subsp. paratuberculosis
cagugccggugca

SEQ ID NO: 2924385 - RNA, 14 nt, Mycobacterium avium subsp. paratuberculosis
cagugcgagaaaau

SEQ ID NO: 2924386 - RNA, 13 nt, Mycobacterium avium subsp. paratuberculosis
cagugcgaucgcc

SEQ ID NO: 2924387 - RNA, 15 nt, Mycobacterium avium subsp. paratuberculosis
cagugcgcaggcggc

SEQ ID NO: 2924388 - RNA, 16 nt, Mycobacterium avium subsp. paratuberculosis
cagugcgcaggcggcg

SEQ ID NO: 2924389 - RNA, 17 nt, Mycobacterium avium subsp. paratuberculosis
cagugcgcaggcggcgc

SEQ ID NO: 2924390 - RNA, 22 nt, Mycobacterium avium subsp. paratuberculosis
cagugcgcauucggcgacgcuc

SEQ ID NO: 2924391 - RNA, 23 nt, Mycobacterium avium subsp. paratuberculosis
cagugcgccgucccggacgcugc

SEQ ID NO: 2924392 - RNA, 13 nt, Mycobacterium avium subsp. paratuberculosis
cagugcgcgccgu

SEQ ID NO: 2924393 - RNA, 20 nt, Mycobacterium avium subsp. paratuberculosis
cagugcggacgccacaacau

SEQ ID NO: 2924394 - RNA, 13 nt, Mycobacterium avium subsp. paratuberculosis
cagugcggcccgc

SEQ ID NO: 2924395 - RNA, 19 nt, Mycobacterium avium subsp. paratuberculosis
cagugcggguacgcguacg

SEQ ID NO: 2924396 - RNA, 20 nt, Mycobacterium avium subsp. paratuberculosis
cagugcgucgcccaucacca

SEQ ID NO: 2924397 - RNA, 15 nt, Mycobacterium avium subsp. paratuberculosis
cagugcgugaccugc

SEQ ID NO: 2924398 - RNA, 15 nt, Mycobacterium avium subsp. paratuberculosis
cagugcucuccgcug

SEQ ID NO: 2924399 - RNA, 15 nt, Mycobacterium avium subsp. paratuberculosis
caguggaucggcccg

SEQ ID NO: 2924400 - RNA, 14 nt, Mycobacterium avium subsp. paratuberculosis
caguggcugucggg

SEQ ID NO: 2924401 - RNA, 22 nt, Mycobacterium avium subsp. paratuberculosis
caguggguggugugcucgguga

SEQ ID NO: 2924402 - RNA, 17 nt, Mycobacterium avium subsp. paratuberculosis
cagugguagagcucugg

SEQ ID NO: 2924403 - RNA, 22 nt, Mycobacterium avium subsp. paratuberculosis
cagugguggccgaacgggucgg

SEQ ID NO: 2924404 - RNA, 14 nt, Mycobacterium avium subsp. paratuberculosis
cagugucacugcgg

SEQ ID NO: 2924405 - RNA, 14 nt, Mycobacterium avium subsp. paratuberculosis
caguguccagucgg

SEQ ID NO: 2924406 - RNA, 19 nt, Mycobacterium avium subsp. paratuberculosis
caguguccagucggccgug

SEQ ID NO: 2924407 - RNA, 20 nt, Mycobacterium avium subsp. paratuberculosis
caguguccagucggccguga

SEQ ID NO: 2924408 - RNA, 15 nt, Mycobacterium avium subsp. paratuberculosis
caguguccgaucgcc

SEQ ID NO: 2924409 - RNA, 16 nt, Mycobacterium avium subsp. paratuberculosis
caguguccgaucgccu

SEQ ID NO: 2924410 - RNA, 19 nt, Mycobacterium avium subsp. paratuberculosis
caguguccgaucgccuccu

SEQ ID NO: 2924411 - RNA, 20 nt, Mycobacterium avium subsp. paratuberculosis
caguguccgaucgccuccuc

SEQ ID NO: 2924412 - RNA, 22 nt, Mycobacterium avium subsp. paratuberculosis
cagugucggaaucggcgccgaa

SEQ ID NO: 2924413 - RNA, 14 nt, Mycobacterium avium subsp. paratuberculosis
cagugucguggcga

SEQ ID NO: 2924414 - RNA, 15 nt, Mycobacterium avium subsp. paratuberculosis
caguguggccgcggc

SEQ ID NO: 2924415 - RNA, 15 nt, Mycobacterium avium subsp. paratuberculosis
caguuaggucuuguc

SEQ ID NO: 2924416 - RNA, 22 nt, Mycobacterium avium subsp. paratuberculosis
caguucaccgaaguccgccagg

SEQ ID NO: 2924417 - RNA, 13 nt, Mycobacterium avium subsp. paratuberculosis
caguucaucgugg

SEQ ID NO: 2924418 - RNA, 23 nt, Mycobacterium avium subsp. paratuberculosis
caguuccaccaguguccgggcgc

SEQ ID NO: 2924419 - RNA, 22 nt, Mycobacterium avium subsp. paratuberculosis
caguuccaugucgacgacguug

SEQ ID NO: 2924420 - RNA, 18 nt, Mycobacterium avium subsp. paratuberculosis
caguucccggccagcgca

SEQ ID NO: 2924421 - RNA, 18 nt, Mycobacterium avium subsp. paratuberculosis
caguucccggcgggcagg

SEQ ID NO: 2924422 - RNA, 11 nt, Mycobacterium avium subsp. paratuberculosis
caguucccggg

SEQ ID NO: 2924423 - RNA, 16 nt, Mycobacterium avium subsp. paratuberculosis
caguuccggagcgcgg

SEQ ID NO: 2924424 - RNA, 17 nt, Mycobacterium avium subsp. paratuberculosis
caguuccggagcgcggu

SEQ ID NO: 2924425 - RNA, 14 nt, Mycobacterium avium subsp. paratuberculosis
caguuccucggcga

SEQ ID NO: 2924426 - RNA, 15 nt, Mycobacterium avium subsp. paratuberculosis
caguuccucggcgau

SEQ ID NO: 2924427 - RNA, 22 nt, Mycobacterium avium subsp. paratuberculosis
caguuccuugauccggccgcgg

SEQ ID NO: 2924428 - RNA, 17 nt, Mycobacterium avium subsp. paratuberculosis
caguucgaccggcacca

SEQ ID NO: 2924429 - RNA, 22 nt, Mycobacterium avium subsp. paratuberculosis
caguucgaccggcaccagcagc

SEQ ID NO: 2924430 - RNA, 13 nt, Mycobacterium avium subsp. paratuberculosis
caguucgaugccg

SEQ ID NO: 2924431 - RNA, 19 nt, Mycobacterium avium subsp. paratuberculosis
caguucgaugcgcucggcg

SEQ ID NO: 2924432 - RNA, 22 nt, Mycobacterium avium subsp. paratuberculosis
caguucgaugcgcucggcgacc

SEQ ID NO: 2924433 - RNA, 16 nt, Mycobacterium avium subsp. paratuberculosis
caguucgcaccccacc

SEQ ID NO: 2924434 - RNA, 20 nt, Mycobacterium avium subsp. paratuberculosis
caguucgcaccccaccgaca

SEQ ID NO: 2924435 - RNA, 15 nt, Mycobacterium avium subsp. paratuberculosis
caguucgcccuggcc

SEQ ID NO: 2924436 - RNA, 15 nt, Mycobacterium avium subsp. paratuberculosis
caguucgcggcgcac

SEQ ID NO: 2924437 - RNA, 16 nt, Mycobacterium avium subsp. paratuberculosis
caguucggccagcgcg

SEQ ID NO: 2924438 - RNA, 17 nt, Mycobacterium avium subsp. paratuberculosis
caguucggccgccgugc

SEQ ID NO: 2924439 - RNA, 18 nt, Mycobacterium avium subsp. paratuberculosis
caguucggccgccgugcu

SEQ ID NO: 2924440 - RNA, 14 nt, Mycobacterium avium subsp. paratuberculosis
caguucggcgcgca

SEQ ID NO: 2924441 - RNA, 17 nt, Mycobacterium avium subsp. paratuberculosis
caguucggcgcgcaucu

SEQ ID NO: 2924442 - RNA, 17 nt, Mycobacterium avium subsp. paratuberculosis
caguucggugcacggcg

SEQ ID NO: 2924443 - RNA, 17 nt, Mycobacterium avium subsp. paratuberculosis
caguucgguggggccgc

SEQ ID NO: 2924444 - RNA, 19 nt, Mycobacterium avium subsp. paratuberculosis
caguucgguggggccgccg

SEQ ID NO: 2924445 - RNA, 20 nt, Mycobacterium avium subsp. paratuberculosis
caguucgguggggccgccgu

SEQ ID NO: 2924446 - RNA, 20 nt, Mycobacterium avium subsp. paratuberculosis
caguucguagaucacggcgu

SEQ ID NO: 2924447 - RNA, 16 nt, Mycobacterium avium subsp. paratuberculosis
caguucguccacgcug

SEQ ID NO: 2924448 - RNA, 20 nt, Mycobacterium avium subsp. paratuberculosis
caguucuucgaugacggccg

SEQ ID NO: 2924449 - RNA, 19 nt, Mycobacterium avium subsp. paratuberculosis
caguugacguugaucgcgc

SEQ ID NO: 2924450 - RNA, 14 nt, Mycobacterium avium subsp. paratuberculosis
caguugcaccggca

SEQ ID NO: 2924451 - RNA, 17 nt, Mycobacterium avium subsp. paratuberculosis
caguugcaccggcaccg

SEQ ID NO: 2924452 - RNA, 13 nt, Mycobacterium avium subsp. paratuberculosis
caguugccggcca

SEQ ID NO: 2924453 - RNA, 16 nt, Mycobacterium avium subsp. paratuberculosis
caguugcgaccccgcc

SEQ ID NO: 2924454 - RNA, 21 nt, Mycobacterium avium subsp. paratuberculosis
caguugcgaccccgccgucga

SEQ ID NO: 2924455 - RNA, 22 nt, Mycobacterium avium subsp. paratuberculosis
caguugcgaccccgccgucgac

SEQ ID NO: 2924456 - RNA, 16 nt, Mycobacterium avium subsp. paratuberculosis
caguugcgcggcgggc

SEQ ID NO: 2924457 - RNA, 14 nt, Mycobacterium avium subsp. paratuberculosis
caucacgguggccg

SEQ ID NO: 2924458 - RNA, 16 nt, Mycobacterium avium subsp. paratuberculosis
caucacgguggccgcc

SEQ ID NO: 2924459 - RNA, 17 nt, Mycobacterium avium subsp. paratuberculosis
caucacgguggccgcca

SEQ ID NO: 2924460 - RNA, 23 nt, Mycobacterium avium subsp. paratuberculosis
caucacgguggccgccaccaaca

SEQ ID NO: 2924461 - RNA, 15 nt, Mycobacterium avium subsp. paratuberculosis
caucacgugcuggcg

SEQ ID NO: 2924462 - RNA, 22 nt, Mycobacterium avium subsp. paratuberculosis
caucagaacgcccgcaacucca

SEQ ID NO: 2924463 - RNA, 22 nt, Mycobacterium avium subsp. paratuberculosis
caucagcaccgaaucgccgagc

SEQ ID NO: 2924464 - RNA, 18 nt, Mycobacterium avium subsp. paratuberculosis
caucagcaccgccucggc

SEQ ID NO: 2924465 - RNA, 21 nt, Mycobacterium avium subsp. paratuberculosis
caucagcaccgccucggccac

SEQ ID NO: 2924466 - RNA, 18 nt, Mycobacterium avium subsp. paratuberculosis
caucagcaggaccaggcc

SEQ ID NO: 2924467 - RNA, 23 nt, Mycobacterium avium subsp. paratuberculosis
caucagcccggcguccugcagca

SEQ ID NO: 2924468 - RNA, 17 nt, Mycobacterium avium subsp. paratuberculosis
caucagcccggugacga

SEQ ID NO: 2924469 - RNA, 18 nt, Mycobacterium avium subsp. paratuberculosis
caucagccgccgucgcgc

SEQ ID NO: 2924470 - RNA, 20 nt, Mycobacterium avium subsp. paratuberculosis
caucagccgccgucgcgcca

SEQ ID NO: 2924471 - RNA, 17 nt, Mycobacterium avium subsp. paratuberculosis
caucagccugcggugau

SEQ ID NO: 2924472 - RNA, 14 nt, Mycobacterium avium subsp. paratuberculosis
caucagcgacguca

SEQ ID NO: 2924473 - RNA, 13 nt, Mycobacterium avium subsp. paratuberculosis
caucagcgccacc

SEQ ID NO: 2924474 - RNA, 15 nt, Mycobacterium avium subsp. paratuberculosis
caucagcgccaccag

SEQ ID NO: 2924475 - RNA, 17 nt, Mycobacterium avium subsp. paratuberculosis
caucagcgccaccagca

SEQ ID NO: 2924476 - RNA, 20 nt, Mycobacterium avium subsp. paratuberculosis
caucagcgccaccagcaccg

SEQ ID NO: 2924477 - RNA, 14 nt, Mycobacterium avium subsp. paratuberculosis
caucagcgcccgcg

SEQ ID NO: 2924478 - RNA, 19 nt, Mycobacterium avium subsp. paratuberculosis
caucagcggagugaccgcc

SEQ ID NO: 2924479 - RNA, 21 nt, Mycobacterium avium subsp. paratuberculosis
caucagcggagugaccgccag

SEQ ID NO: 2924480 - RNA, 14 nt, Mycobacterium avium subsp. paratuberculosis
caucagcggggcgu

SEQ ID NO: 2924481 - RNA, 13 nt, Mycobacterium avium subsp. paratuberculosis
caucagcucggca

SEQ ID NO: 2924482 - RNA, 20 nt, Mycobacterium avium subsp. paratuberculosis
caucagcucggcagccccgu

SEQ ID NO: 2924483 - RNA, 21 nt, Mycobacterium avium subsp. paratuberculosis
caucagcucggcagccccguc

SEQ ID NO: 2924484 - RNA, 17 nt, Mycobacterium avium subsp. paratuberculosis
caucagcucggcggccu

SEQ ID NO: 2924485 - RNA, 23 nt, Mycobacterium avium subsp. paratuberculosis
caucagcucgucagcgcgggcca

SEQ ID NO: 2924486 - RNA, 13 nt, Mycobacterium avium subsp. paratuberculosis
caucaggcggccg

SEQ ID NO: 2924487 - RNA, 22 nt, Mycobacterium avium subsp. paratuberculosis
caucaggcggccggcccggccc

SEQ ID NO: 2924488 - RNA, 19 nt, Mycobacterium avium subsp. paratuberculosis
caucagggcaaagaucggu

SEQ ID NO: 2924489 - RNA, 21 nt, Mycobacterium avium subsp. paratuberculosis
caucagugcggcccgccgggc

SEQ ID NO: 2924490 - RNA, 22 nt, Mycobacterium avium subsp. paratuberculosis
caucaucgcuacaccccaccgg

SEQ ID NO: 2924491 - RNA, 19 nt, Mycobacterium avium subsp. paratuberculosis
caucaucucggcgaaguag

SEQ ID NO: 2924492 - RNA, 18 nt, Mycobacterium avium subsp. paratuberculosis
caucaugccgcccaucac

SEQ ID NO: 2924493 - RNA, 14 nt, Mycobacterium avium subsp. paratuberculosis
caucauguccaggu

SEQ ID NO: 2924494 - RNA, 15 nt, Mycobacterium avium subsp. paratuberculosis
cauccaccagggcgg

SEQ ID NO: 2924495 - RNA, 13 nt, Mycobacterium avium subsp. paratuberculosis
cauccacucggcc

SEQ ID NO: 2924496 - RNA, 16 nt, Mycobacterium avium subsp. paratuberculosis
cauccacucggccacc

SEQ ID NO: 2924497 - RNA, 17 nt, Mycobacterium avium subsp. paratuberculosis
cauccacucggccacca

SEQ ID NO: 2924498 - RNA, 19 nt, Mycobacterium avium subsp. paratuberculosis
cauccacucgggccagccc

SEQ ID NO: 2924499 - RNA, 17 nt, Mycobacterium avium subsp. paratuberculosis
cauccagaugcccagca

SEQ ID NO: 2924500 - RNA, 18 nt, Mycobacterium avium subsp. paratuberculosis
cauccagaugcccagcag

SEQ ID NO: 2924501 - RNA, 12 nt, Mycobacterium avium subsp. paratuberculosis
cauccagcgccg

SEQ ID NO: 2924502 - RNA, 17 nt, Mycobacterium avium subsp. paratuberculosis
cauccagcgccgcagcg

SEQ ID NO: 2924503 - RNA, 15 nt, Mycobacterium avium subsp. paratuberculosis
cauccagcgccgcca

SEQ ID NO: 2924504 - RNA, 16 nt, Mycobacterium avium subsp. paratuberculosis
cauccagcgccgccaa

SEQ ID NO: 2924505 - RNA, 17 nt, Mycobacterium avium subsp. paratuberculosis
cauccagcgccgccaac

SEQ ID NO: 2924506 - RNA, 15 nt, Mycobacterium avium subsp. paratuberculosis
cauccaggaccgcgc

SEQ ID NO: 2924507 - RNA, 21 nt, Mycobacterium avium subsp. paratuberculosis
cauccaggaccgcgcgccggc

SEQ ID NO: 2924508 - RNA, 22 nt, Mycobacterium avium subsp. paratuberculosis
cauccaggaccgcgcgccggcc

SEQ ID NO: 2924509 - RNA, 17 nt, Mycobacterium avium subsp. paratuberculosis
cauccaggccagcaccu

SEQ ID NO: 2924510 - RNA, 17 nt, Mycobacterium avium subsp. paratuberculosis
cauccaggugaacagca

SEQ ID NO: 2924511 - RNA, 20 nt, Mycobacterium avium subsp. paratuberculosis
cauccaggugaacagcagcc

SEQ ID NO: 2924512 - RNA, 20 nt, Mycobacterium avium subsp. paratuberculosis
cauccagguggcgccuccgc

SEQ ID NO: 2924513 - RNA, 22 nt, Mycobacterium avium subsp. paratuberculosis
cauccagguggcgccuccgccc

SEQ ID NO: 2924514 - RNA, 13 nt, Mycobacterium avium subsp. paratuberculosis
cauccagucggcg

SEQ ID NO: 2924515 - RNA, 22 nt, Mycobacterium avium subsp. paratuberculosis
cauccauugggccgcggcgucg

SEQ ID NO: 2924516 - RNA, 23 nt, Mycobacterium avium subsp. paratuberculosis
caucccacccggguugcgugcag

SEQ ID NO: 2924517 - RNA, 18 nt, Mycobacterium avium subsp. paratuberculosis
cauccccaggauggccgc

SEQ ID NO: 2924518 - RNA, 22 nt, Mycobacterium avium subsp. paratuberculosis
caucccccgcagcuucugcagc

SEQ ID NO: 2924519 - RNA, 17 nt, Mycobacterium avium subsp. paratuberculosis
caucccccucggcggga

SEQ ID NO: 2924520 - RNA, 21 nt, Mycobacterium avium subsp. paratuberculosis
cauccccgcaaacacgagcag

SEQ ID NO: 2924521 - RNA, 13 nt, Mycobacterium avium subsp. paratuberculosis
cauccccgcggcc

SEQ ID NO: 2924522 - RNA, 17 nt, Mycobacterium avium subsp. paratuberculosis
cauccccgcggccaccc

SEQ ID NO: 2924523 - RNA, 20 nt, Mycobacterium avium subsp. paratuberculosis
cauccccgcggccaccccgg

SEQ ID NO: 2924524 - RNA, 16 nt, Mycobacterium avium subsp. paratuberculosis
cauccccgcguuggcc

SEQ ID NO: 2924525 - RNA, 12 nt, Mycobacterium avium subsp. paratuberculosis
cauccccgugcg

SEQ ID NO: 2924526 - RNA, 17 nt, Mycobacterium avium subsp. paratuberculosis
caucccgauccgcgccg

SEQ ID NO: 2924527 - RNA, 23 nt, Mycobacterium avium subsp. paratuberculosis
caucccgauccgcgccgccgcca

SEQ ID NO: 2924528 - RNA, 14 nt, Mycobacterium avium subsp. paratuberculosis
caucccgaucgacg

SEQ ID NO: 2924529 - RNA, 19 nt, Mycobacterium avium subsp. paratuberculosis
caucccgaucgacgucagc

SEQ ID NO: 2924530 - RNA, 17 nt, Mycobacterium avium subsp. paratuberculosis
caucccgaugucggcga

SEQ ID NO: 2924531 - RNA, 22 nt, Mycobacterium avium subsp. paratuberculosis
caucccgcaauugcgccagcag

SEQ ID NO: 2924532 - RNA, 12 nt, Mycobacterium avium subsp. paratuberculosis
caucccgccgac

SEQ ID NO: 2924533 - RNA, 20 nt, Mycobacterium avium subsp. paratuberculosis
caucccgccgggcaucucgu

SEQ ID NO: 2924534 - RNA, 23 nt, Mycobacterium avium subsp. paratuberculosis
caucccgccgggcaucucguugu

SEQ ID NO: 2924535 - RNA, 19 nt, Mycobacterium avium subsp. paratuberculosis
caucccgcgccugccuggc

SEQ ID NO: 2924536 - RNA, 20 nt, Mycobacterium avium subsp. paratuberculosis
caucccgcugaagccgaacg

SEQ ID NO: 2924537 - RNA, 11 nt, Mycobacterium avium subsp. paratuberculosis
caucccgcuuc

SEQ ID NO: 2924538 - RNA, 15 nt, Mycobacterium avium subsp. paratuberculosis
caucccgcuucuggc

SEQ ID NO: 2924539 - RNA, 19 nt, Mycobacterium avium subsp. paratuberculosis
caucccgcuucuggcgggc

SEQ ID NO: 2924540 - RNA, 21 nt, Mycobacterium avium subsp. paratuberculosis
caucccgcuucuggcgggcga

SEQ ID NO: 2924541 - RNA, 14 nt, Mycobacterium avium subsp. paratuberculosis
caucgagccgagca

SEQ ID NO: 2924542 - RNA, 16 nt, Mycobacterium avium subsp. paratuberculosis
caucgagccgagcacc

SEQ ID NO: 2924543 - RNA, 20 nt, Mycobacterium avium subsp. paratuberculosis
caucgagccgagcaccggca

SEQ ID NO: 2924544 - RNA, 14 nt, Mycobacterium avium subsp. paratuberculosis
caucgagccgguac

SEQ ID NO: 2924545 - RNA, 15 nt, Mycobacterium avium subsp. paratuberculosis
caucgagccgguacg

SEQ ID NO: 2924546 - RNA, 17 nt, Mycobacterium avium subsp. paratuberculosis
caucgagccgguacggc

SEQ ID NO: 2924547 - RNA, 21 nt, Mycobacterium avium subsp. paratuberculosis
caucgagcugcaacgcgucgg

SEQ ID NO: 2924548 - RNA, 23 nt, Mycobacterium avium subsp. paratuberculosis
caucgagcugcaacgcgucggcg

SEQ ID NO: 2924549 - RNA, 15 nt, Mycobacterium avium subsp. paratuberculosis
caucgaggaccggcg

SEQ ID NO: 2924550 - RNA, 18 nt, Mycobacterium avium subsp. paratuberculosis
caucgaggaccggcgccg

SEQ ID NO: 2924551 - RNA, 16 nt, Mycobacterium avium subsp. paratuberculosis
caucgaguaggcccag

SEQ ID NO: 2924552 - RNA, 20 nt, Mycobacterium avium subsp. paratuberculosis
caucgauggcgggcgcgccg

SEQ ID NO: 2924553 - RNA, 16 nt, Mycobacterium avium subsp. paratuberculosis
caucgauggcggugug

SEQ ID NO: 2924554 - RNA, 13 nt, Mycobacterium avium subsp. paratuberculosis
caucgcaccgcga

SEQ ID NO: 2924555 - RNA, 17 nt, Mycobacterium avium subsp. paratuberculosis
caucgcagcgcgcggcg

SEQ ID NO: 2924556 - RNA, 19 nt, Mycobacterium avium subsp. paratuberculosis
caucgccacccgcaccucg

SEQ ID NO: 2924557 - RNA, 20 nt, Mycobacterium avium subsp. paratuberculosis
caucgccaccgucgucgagc

SEQ ID NO: 2924558 - RNA, 19 nt, Mycobacterium avium subsp. paratuberculosis
caucgccaccuggaagcgc

SEQ ID NO: 2924559 - RNA, 13 nt, Mycobacterium avium subsp. paratuberculosis
caucgccacgccg

SEQ ID NO: 2924560 - RNA, 14 nt, Mycobacterium avium subsp. paratuberculosis
caucgccacgccgu

SEQ ID NO: 2924561 - RNA, 23 nt, Mycobacterium avium subsp. paratuberculosis
caucgccacgccguggcccgccc

SEQ ID NO: 2924562 - RNA, 22 nt, Mycobacterium avium subsp. paratuberculosis
caucgccagcaacgacccggcc

SEQ ID NO: 2924563 - RNA, 19 nt, Mycobacterium avium subsp. paratuberculosis
caucgccaggaaccacacc

SEQ ID NO: 2924564 - RNA, 22 nt, Mycobacterium avium subsp. paratuberculosis
caucgccaggaaccacaccccg

SEQ ID NO: 2924565 - RNA, 23 nt, Mycobacterium avium subsp. paratuberculosis
caucgccaggaaccacaccccgg

SEQ ID NO: 2924566 - RNA, 19 nt, Mycobacterium avium subsp. paratuberculosis
caucgccaucagcagcgcc

SEQ ID NO: 2924567 - RNA, 18 nt, Mycobacterium avium subsp. paratuberculosis
caucgcccagccggcgga

SEQ ID NO: 2924568 - RNA, 14 nt, Mycobacterium avium subsp. paratuberculosis
caucgcccagcgca

SEQ ID NO: 2924569 - RNA, 15 nt, Mycobacterium avium subsp. paratuberculosis
caucgcccagcgcag

SEQ ID NO: 2924570 - RNA, 12 nt, Mycobacterium avium subsp. paratuberculosis
caucgccccgga

SEQ ID NO: 2924571 - RNA, 14 nt, Mycobacterium avium subsp. paratuberculosis
caucgccccggaga

SEQ ID NO: 2924572 - RNA, 15 nt, Mycobacterium avium subsp. paratuberculosis
caucgccccggcgac

SEQ ID NO: 2924573 - RNA, 16 nt, Mycobacterium avium subsp. paratuberculosis
caucgccccggcgacg

SEQ ID NO: 2924574 - RNA, 17 nt, Mycobacterium avium subsp. paratuberculosis
caucgccccggcgacgu

SEQ ID NO: 2924575 - RNA, 14 nt, Mycobacterium avium subsp. paratuberculosis
caucgcccggugcg

SEQ ID NO: 2924576 - RNA, 23 nt, Mycobacterium avium subsp. paratuberculosis
caucgcccggugcgccagcguga

SEQ ID NO: 2924577 - RNA, 14 nt, Mycobacterium avium subsp. paratuberculosis
caucgccgaaccgg

SEQ ID NO: 2924578 - RNA, 23 nt, Mycobacterium avium subsp. paratuberculosis
caucgccgaaccgggcgcgcaga

SEQ ID NO: 2924579 - RNA, 20 nt, Mycobacterium avium subsp. paratuberculosis
caucgccgaaccgucccaca

SEQ ID NO: 2924580 - RNA, 20 nt, Mycobacterium avium subsp. paratuberculosis
caucgccgacggugagcacc

SEQ ID NO: 2924581 - RNA, 12 nt, Mycobacterium avium subsp. paratuberculosis
caucgccgagcc

SEQ ID NO: 2924582 - RNA, 21 nt, Mycobacterium avium subsp. paratuberculosis
caucgccgagggcgacgaugc

SEQ ID NO: 2924583 - RNA, 20 nt, Mycobacterium avium subsp. paratuberculosis
caucgccgccaucgccgccg

SEQ ID NO: 2924584 - RNA, 14 nt, Mycobacterium avium subsp. paratuberculosis
caucgccgcgaccc

SEQ ID NO: 2924585 - RNA, 16 nt, Mycobacterium avium subsp. paratuberculosis
caucgccgcgacccgg

SEQ ID NO: 2924586 - RNA, 18 nt, Mycobacterium avium subsp. paratuberculosis
caucgccgcgcacccggc

SEQ ID NO: 2924587 - RNA, 21 nt, Mycobacterium avium subsp. paratuberculosis
caucgccgcgcacccggccac

SEQ ID NO: 2924588 - RNA, 20 nt, Mycobacterium avium subsp. paratuberculosis
caucgccgcggccggagaac

SEQ ID NO: 2924589 - RNA, 14 nt, Mycobacterium avium subsp. paratuberculosis
caucgccgcggugc

SEQ ID NO: 2924590 - RNA, 12 nt, Mycobacterium avium subsp. paratuberculosis
caucgccggcga

SEQ ID NO: 2924591 - RNA, 13 nt, Mycobacterium avium subsp. paratuberculosis
caucgccggcgac

SEQ ID NO: 2924592 - RNA, 15 nt, Mycobacterium avium subsp. paratuberculosis
caucgccggcgaccg

SEQ ID NO: 2924593 - RNA, 19 nt, Mycobacterium avium subsp. paratuberculosis
caucgccggcgaugcgcgc

SEQ ID NO: 2924594 - RNA, 20 nt, Mycobacterium avium subsp. paratuberculosis
caucgccggcgaugcgcgcc

SEQ ID NO: 2924595 - RNA, 14 nt, Mycobacterium avium subsp. paratuberculosis
caucgccggcgcgc

SEQ ID NO: 2924596 - RNA, 17 nt, Mycobacterium avium subsp. paratuberculosis
caucgccgucauggugu

SEQ ID NO: 2924597 - RNA, 18 nt, Mycobacterium avium subsp. paratuberculosis
caucgccgucaugguguc

SEQ ID NO: 2924598 - RNA, 16 nt, Mycobacterium avium subsp. paratuberculosis
caucgccgucgccacc

SEQ ID NO: 2924599 - RNA, 17 nt, Mycobacterium avium subsp. paratuberculosis
caucgccgucgccaccg

SEQ ID NO: 2924600 - RNA, 18 nt, Mycobacterium avium subsp. paratuberculosis
caucgccgucgccaccga

SEQ ID NO: 2924601 - RNA, 13 nt, Mycobacterium avium subsp. paratuberculosis
caucgccgucguc

SEQ ID NO: 2924602 - RNA, 17 nt, Mycobacterium avium subsp. paratuberculosis
caucgccucgaccagca

SEQ ID NO: 2924603 - RNA, 20 nt, Mycobacterium avium subsp. paratuberculosis
caucgccucgaccagcaccg

SEQ ID NO: 2924604 - RNA, 14 nt, Mycobacterium avium subsp. paratuberculosis
caucgccucggcca

SEQ ID NO: 2924605 - RNA, 17 nt, Mycobacterium avium subsp. paratuberculosis
caucgccucggccacca

SEQ ID NO: 2924606 - RNA, 19 nt, Mycobacterium avium subsp. paratuberculosis
caucgccucggccaccaga

SEQ ID NO: 2924607 - RNA, 14 nt, Mycobacterium avium subsp. paratuberculosis
caucgccucggccg

SEQ ID NO: 2924608 - RNA, 17 nt, Mycobacterium avium subsp. paratuberculosis
caucgccucggccgcgg

SEQ ID NO: 2924609 - RNA, 13 nt, Mycobacterium avium subsp. paratuberculosis
caucgccucggcg

SEQ ID NO: 2924610 - RNA, 14 nt, Mycobacterium avium subsp. paratuberculosis
caucgccucggcgg

SEQ ID NO: 2924611 - RNA, 15 nt, Mycobacterium avium subsp. paratuberculosis
caucgccucggcggc

SEQ ID NO: 2924612 - RNA, 14 nt, Mycobacterium avium subsp. paratuberculosis
caucgccucggcgu

SEQ ID NO: 2924613 - RNA, 16 nt, Mycobacterium avium subsp. paratuberculosis
caucgccucggcgucc

SEQ ID NO: 2924614 - RNA, 19 nt, Mycobacterium avium subsp. paratuberculosis
caucgccucggucgcguga

SEQ ID NO: 2924615 - RNA, 17 nt, Mycobacterium avium subsp. paratuberculosis
caucgccugagcaaccg

SEQ ID NO: 2924616 - RNA, 20 nt, Mycobacterium avium subsp. paratuberculosis
caucgccugagcaaccgguu

SEQ ID NO: 2924617 - RNA, 21 nt, Mycobacterium avium subsp. paratuberculosis
caucgccugagcaaccgguuc

SEQ ID NO: 2924618 - RNA, 23 nt, Mycobacterium avium subsp. paratuberculosis
caucgcgaucgacagcuccaaca

SEQ ID NO: 2924619 - RNA, 13 nt, Mycobacterium avium subsp. paratuberculosis
caucgcgcaccag

SEQ ID NO: 2924620 - RNA, 21 nt, Mycobacterium avium subsp. paratuberculosis
caucgcgcaccagggccugca

SEQ ID NO: 2924621 - RNA, 12 nt, Mycobacterium avium subsp. paratuberculosis
caucgcgccgca

SEQ ID NO: 2924622 - RNA, 17 nt, Mycobacterium avium subsp. paratuberculosis
caucgcgcgcggcgacg

SEQ ID NO: 2924623 - RNA, 15 nt, Mycobacterium avium subsp. paratuberculosis
caucgcgcgcggcgg

SEQ ID NO: 2924624 - RNA, 17 nt, Mycobacterium avium subsp. paratuberculosis
caucgcgcgcggcggcc

SEQ ID NO: 2924625 - RNA, 14 nt, Mycobacterium avium subsp. paratuberculosis
caucgcggccgccc

SEQ ID NO: 2924626 - RNA, 20 nt, Mycobacterium avium subsp. paratuberculosis
caucgucggggacgaagacc

SEQ ID NO: 2924627 - RNA, 16 nt, Mycobacterium avium subsp. paratuberculosis
caucgucgucaccucg

SEQ ID NO: 2924628 - RNA, 14 nt, Mycobacterium avium subsp. paratuberculosis
caucgucguuggcg

SEQ ID NO: 2924629 - RNA, 14 nt, Mycobacterium avium subsp. paratuberculosis
caucgucucggacc

SEQ ID NO: 2924630 - RNA, 20 nt, Mycobacterium avium subsp. paratuberculosis
caucgugaucgcccaccugg

SEQ ID NO: 2924631 - RNA, 18 nt, Mycobacterium avium subsp. paratuberculosis
caucguggcgacgacgcc

SEQ ID NO: 2924632 - RNA, 17 nt, Mycobacterium avium subsp. paratuberculosis
caucguggcgcgacgcg

SEQ ID NO: 2924633 - RNA, 15 nt, Mycobacterium avium subsp. paratuberculosis
caucgugggcgccgu

SEQ ID NO: 2924634 - RNA, 17 nt, Mycobacterium avium subsp. paratuberculosis
caucgugugggcgcccg

SEQ ID NO: 2924635 - RNA, 19 nt, Mycobacterium avium subsp. paratuberculosis
caucguucccugcgcggcg

SEQ ID NO: 2924636 - RNA, 14 nt, Mycobacterium avium subsp. paratuberculosis
caucguugccggcg

SEQ ID NO: 2924637 - RNA, 17 nt, Mycobacterium avium subsp. paratuberculosis
caucguugccggcggcg

SEQ ID NO: 2924638 - RNA, 18 nt, Mycobacterium avium subsp. paratuberculosis
caucguugccggcggcga

SEQ ID NO: 2924639 - RNA, 15 nt, Mycobacterium avium subsp. paratuberculosis
caucuacgaccucga

SEQ ID NO: 2924640 - RNA, 16 nt, Mycobacterium avium subsp. paratuberculosis
caucucaccgacgacc

SEQ ID NO: 2924641 - RNA, 23 nt, Mycobacterium avium subsp. paratuberculosis
caucucaccgacgaccucggugu

SEQ ID NO: 2924642 - RNA, 19 nt, Mycobacterium avium subsp. paratuberculosis
caucucagcguucacgucg

SEQ ID NO: 2924643 - RNA, 22 nt, Mycobacterium avium subsp. paratuberculosis
caucucagcguucacgucgauc

SEQ ID NO: 2924644 - RNA, 12 nt, Mycobacterium avium subsp. paratuberculosis
caucuccagccg

SEQ ID NO: 2924645 - RNA, 16 nt, Mycobacterium avium subsp. paratuberculosis
caucuccagccgcggc

SEQ ID NO: 2924646 - RNA, 22 nt, Mycobacterium avium subsp. paratuberculosis
caucuccagcgcggucucgauc

SEQ ID NO: 2924647 - RNA, 12 nt, Mycobacterium avium subsp. paratuberculosis
caucuccagcuc

SEQ ID NO: 2924648 - RNA, 19 nt, Mycobacterium avium subsp. paratuberculosis
caucuccagcuccgcggcc

SEQ ID NO: 2924649 - RNA, 21 nt, Mycobacterium avium subsp. paratuberculosis
caucuccagcuccgcggccag

SEQ ID NO: 2924650 - RNA, 17 nt, Mycobacterium avium subsp. paratuberculosis
caucuccgagucggcgu

SEQ ID NO: 2924651 - RNA, 14 nt, Mycobacterium avium subsp. paratuberculosis
caucuccuccgggc

SEQ ID NO: 2924652 - RNA, 18 nt, Mycobacterium avium subsp. paratuberculosis
caucuccugcacgcgcgg

SEQ ID NO: 2924653 - RNA, 23 nt, Mycobacterium avium subsp. paratuberculosis
caucuccuuggggcugaccucgc

SEQ ID NO: 2924654 - RNA, 17 nt, Mycobacterium avium subsp. paratuberculosis
caucucgaaugcggcug

SEQ ID NO: 2924655 - RNA, 21 nt, Mycobacterium avium subsp. paratuberculosis
caucucgaaugcggcugccgg

SEQ ID NO: 2924656 - RNA, 15 nt, Mycobacterium avium subsp. paratuberculosis
caucucgacggugac

SEQ ID NO: 2924657 - RNA, 21 nt, Mycobacterium avium subsp. paratuberculosis
caucucgacggugaccggcuc

SEQ ID NO: 2924658 - RNA, 21 nt, Mycobacterium avium subsp. paratuberculosis
caucucgggagugcggcccac

SEQ ID NO: 2924659 - RNA, 22 nt, Mycobacterium avium subsp. paratuberculosis
caucucgggagugcggcccacc

SEQ ID NO: 2924660 - RNA, 16 nt, Mycobacterium avium subsp. paratuberculosis
caucucggugguguca

SEQ ID NO: 2924661 - RNA, 16 nt, Mycobacterium avium subsp. paratuberculosis
caucucgucaaccgca

SEQ ID NO: 2924662 - RNA, 20 nt, Mycobacterium avium subsp. paratuberculosis
caucucgucaaccgcagucg

SEQ ID NO: 2924663 - RNA, 18 nt, Mycobacterium avium subsp. paratuberculosis
caucucgugcccgggccc

SEQ ID NO: 2924664 - RNA, 17 nt, Mycobacterium avium subsp. paratuberculosis
caucucguugucgucgg

SEQ ID NO: 2924665 - RNA, 14 nt, Mycobacterium avium subsp. paratuberculosis
caucugcacagcuu

SEQ ID NO: 2924666 - RNA, 16 nt, Mycobacterium avium subsp. paratuberculosis
caucugcacagcuucg

SEQ ID NO: 2924667 - RNA, 18 nt, Mycobacterium avium subsp. paratuberculosis
caucugcacagcuucggc

SEQ ID NO: 2924668 - RNA, 13 nt, Mycobacterium avium subsp. paratuberculosis
caucugccggcag

SEQ ID NO: 2924669 - RNA, 19 nt, Mycobacterium avium subsp. paratuberculosis
caucugccgggcggcgacg

SEQ ID NO: 2924670 - RNA, 13 nt, Mycobacterium avium subsp. paratuberculosis
caucugcucggcg

SEQ ID NO: 2924671 - RNA, 17 nt, Mycobacterium avium subsp. paratuberculosis
caucugcucggcgucca

SEQ ID NO: 2924672 - RNA, 22 nt, Mycobacterium avium subsp. paratuberculosis
caucugcuugaugaugucggcg

SEQ ID NO: 2924673 - RNA, 11 nt, Mycobacterium avium subsp. paratuberculosis
caucuggccgc

SEQ ID NO: 2924674 - RNA, 13 nt, Mycobacterium avium subsp. paratuberculosis
caucuggccgcgg

SEQ ID NO: 2924675 - RNA, 22 nt, Mycobacterium avium subsp. paratuberculosis
caucuucacgugcgcggcgucc

SEQ ID NO: 2924676 - RNA, 19 nt, Mycobacterium avium subsp. paratuberculosis
caucuucaguucggccggc

SEQ ID NO: 2924677 - RNA, 17 nt, Mycobacterium avium subsp. paratuberculosis
caucuugaucugggugc

SEQ ID NO: 2924678 - RNA, 18 nt, Mycobacterium avium subsp. paratuberculosis
caucuuggucagccgcgg

SEQ ID NO: 2924679 - RNA, 14 nt, Mycobacterium avium subsp. paratuberculosis
caugaacgccgggu

SEQ ID NO: 2924680 - RNA, 16 nt, Mycobacterium avium subsp. paratuberculosis
caugaacgccgggucc

SEQ ID NO: 2924681 - RNA, 18 nt, Mycobacterium avium subsp. paratuberculosis
caugaacgccggguccca

SEQ ID NO: 2924682 - RNA, 14 nt, Mycobacterium avium subsp. paratuberculosis
caugaacgcgucgc

SEQ ID NO: 2924683 - RNA, 16 nt, Mycobacterium avium subsp. paratuberculosis
caugaacggcagcucg

SEQ ID NO: 2924684 - RNA, 14 nt, Mycobacterium avium subsp. paratuberculosis
caugaacggcgggg

SEQ ID NO: 2924685 - RNA, 17 nt, Mycobacterium avium subsp. paratuberculosis
caugaagaucagcaccg

SEQ ID NO: 2924686 - RNA, 23 nt, Mycobacterium avium subsp. paratuberculosis
caugaagccguugaugcgcaccg

SEQ ID NO: 2924687 - RNA, 20 nt, Mycobacterium avium subsp. paratuberculosis
caugaagccguugccgccgc

SEQ ID NO: 2924688 - RNA, 13 nt, Mycobacterium avium subsp. paratuberculosis
caugaaggcgacg

SEQ ID NO: 2924689 - RNA, 16 nt, Mycobacterium avium subsp. paratuberculosis
caugaaggcgacgucg

SEQ ID NO: 2924690 - RNA, 18 nt, Mycobacterium avium subsp. paratuberculosis
caugaaggcgacgucggu

SEQ ID NO: 2924691 - RNA, 13 nt, Mycobacterium avium subsp. paratuberculosis
caugaccaccgcg

SEQ ID NO: 2924692 - RNA, 14 nt, Mycobacterium avium subsp. paratuberculosis
caugaccaccgcgu

SEQ ID NO: 2924693 - RNA, 13 nt, Mycobacterium avium subsp. paratuberculosis
caugacccacggg

SEQ ID NO: 2924694 - RNA, 17 nt, Mycobacterium avium subsp. paratuberculosis
caugaccgauccgccgg

SEQ ID NO: 2924695 - RNA, 12 nt, Mycobacterium avium subsp. paratuberculosis
caugaccggcca

SEQ ID NO: 2924696 - RNA, 15 nt, Mycobacterium avium subsp. paratuberculosis
caugacgaacaugcu

SEQ ID NO: 2924697 - RNA, 17 nt, Mycobacterium avium subsp. paratuberculosis
caugacgcccagcugca

SEQ ID NO: 2924698 - RNA, 17 nt, Mycobacterium avium subsp. paratuberculosis
caugagcagaccgaacc

SEQ ID NO: 2924699 - RNA, 13 nt, Mycobacterium avium subsp. paratuberculosis
caugagcccucca

SEQ ID NO: 2924700 - RNA, 15 nt, Mycobacterium avium subsp. paratuberculosis
caugagcccuccagc

SEQ ID NO: 2924701 - RNA, 16 nt, Mycobacterium avium subsp. paratuberculosis
caugagcccuccagcu

SEQ ID NO: 2924702 - RNA, 22 nt, Mycobacterium avium subsp. paratuberculosis
caugagcccuccagcugguuga

SEQ ID NO: 2924703 - RNA, 17 nt, Mycobacterium avium subsp. paratuberculosis
caugagcuaggucaccg

SEQ ID NO: 2924704 - RNA, 20 nt, Mycobacterium avium subsp. paratuberculosis
caugaucaggccccacccgc

SEQ ID NO: 2924705 - RNA, 19 nt, Mycobacterium avium subsp. paratuberculosis
caugaucgccaguccggcg

SEQ ID NO: 2924706 - RNA, 15 nt, Mycobacterium avium subsp. paratuberculosis
caugaucgcccgcuc

SEQ ID NO: 2924707 - RNA, 23 nt, Mycobacterium avium subsp. paratuberculosis
caugaucgcccgcuccgcggugc

SEQ ID NO: 2924708 - RNA, 21 nt, Mycobacterium avium subsp. paratuberculosis
caugaucggcaggauccgguc

SEQ ID NO: 2924709 - RNA, 23 nt, Mycobacterium avium subsp. paratuberculosis
caugaucggcaggauccggucga

SEQ ID NO: 2924710 - RNA, 16 nt, Mycobacterium avium subsp. paratuberculosis
caugaugcccaggccc

SEQ ID NO: 2924711 - RNA, 17 nt, Mycobacterium avium subsp. paratuberculosis
caugcgguggucgaaau

SEQ ID NO: 2924712 - RNA, 16 nt, Mycobacterium avium subsp. paratuberculosis
caugcguuugccgucg

SEQ ID NO: 2924713 - RNA, 14 nt, Mycobacterium avium subsp. paratuberculosis
caugcucaggauga

SEQ ID NO: 2924714 - RNA, 14 nt, Mycobacterium avium subsp. paratuberculosis
caugcugccgccgg

SEQ ID NO: 2924715 - RNA, 16 nt, Mycobacterium avium subsp. paratuberculosis
caugcugccgccggcg

SEQ ID NO: 2924716 - RNA, 19 nt, Mycobacterium avium subsp. paratuberculosis
caugcugggcuaccagccc

SEQ ID NO: 2924717 - RNA, 21 nt, Mycobacterium avium subsp. paratuberculosis
caugcugggcuaccagcccca

SEQ ID NO: 2924718 - RNA, 15 nt, Mycobacterium avium subsp. paratuberculosis
caugcuggugccgcc

SEQ ID NO: 2924719 - RNA, 18 nt, Mycobacterium avium subsp. paratuberculosis
caugcuguuccagacguc

SEQ ID NO: 2924720 - RNA, 22 nt, Mycobacterium avium subsp. paratuberculosis
caugcuguuccagacgucggcg

SEQ ID NO: 2924721 - RNA, 15 nt, Mycobacterium avium subsp. paratuberculosis
caugcuuccgaucaa

SEQ ID NO: 2924722 - RNA, 23 nt, Mycobacterium avium subsp. paratuberculosis
cauggacaugugagguggcuggg

SEQ ID NO: 2924723 - RNA, 21 nt, Mycobacterium avium subsp. paratuberculosis
cauggacgcggccucaccgcg

SEQ ID NO: 2924724 - RNA, 20 nt, Mycobacterium avium subsp. paratuberculosis
cauggagaugcuucagcccu

SEQ ID NO: 2924725 - RNA, 21 nt, Mycobacterium avium subsp. paratuberculosis
cauggcaguuguuccaguccc

SEQ ID NO: 2924726 - RNA, 14 nt, Mycobacterium avium subsp. paratuberculosis
cauggccagcacca

SEQ ID NO: 2924727 - RNA, 16 nt, Mycobacterium avium subsp. paratuberculosis
cauggccagcucgucg

SEQ ID NO: 2924728 - RNA, 12 nt, Mycobacterium avium subsp. paratuberculosis
cauggccgucgg

SEQ ID NO: 2924729 - RNA, 19 nt, Mycobacterium avium subsp. paratuberculosis
cauggccgucgggucggcg

SEQ ID NO: 2924730 - RNA, 21 nt, Mycobacterium avium subsp. paratuberculosis
cauggccgucgggucggcgag

SEQ ID NO: 2924731 - RNA, 23 nt, Mycobacterium avium subsp. paratuberculosis
cauggccuccccauccgcggcca

SEQ ID NO: 2924732 - RNA, 17 nt, Mycobacterium avium subsp. paratuberculosis
cauggccuugacgucgg

SEQ ID NO: 2924733 - RNA, 17 nt, Mycobacterium avium subsp. paratuberculosis
cauggcgaacacgucgg

SEQ ID NO: 2924734 - RNA, 18 nt, Mycobacterium avium subsp. paratuberculosis
cauggcgaacacgucggc

SEQ ID NO: 2924735 - RNA, 20 nt, Mycobacterium avium subsp. paratuberculosis
cauggcgaacacgucggcca

SEQ ID NO: 2924736 - RNA, 24 nt, Mycobacterium avium subsp. paratuberculosis
cauggcgaacacgucggccagcgc

SEQ ID NO: 2924737 - RNA, 19 nt, Mycobacterium avium subsp. paratuberculosis
cauggcgaaguagucggcg

SEQ ID NO: 2924738 - RNA, 18 nt, Mycobacterium avium subsp. paratuberculosis
cauggcgaucaccccggc

SEQ ID NO: 2924739 - RNA, 19 nt, Mycobacterium avium subsp. paratuberculosis
cauggcgaucaccccggcg

SEQ ID NO: 2924740 - RNA, 22 nt, Mycobacterium avium subsp. paratuberculosis
cauggcgaucaccccggcgacg

SEQ ID NO: 2924741 - RNA, 20 nt, Mycobacterium avium subsp. paratuberculosis
cauggcgaugacgucgucgc

SEQ ID NO: 2924742 - RNA, 23 nt, Mycobacterium avium subsp. paratuberculosis
cauggcgaugacgucgucgcggc

SEQ ID NO: 2924743 - RNA, 23 nt, Mycobacterium avium subsp. paratuberculosis
cauggcgcaccgcggccucggcg

SEQ ID NO: 2924744 - RNA, 17 nt, Mycobacterium avium subsp. paratuberculosis
cauggcgcccgcguaca

SEQ ID NO: 2924745 - RNA, 14 nt, Mycobacterium avium subsp. paratuberculosis
cauggcgcggcggc

SEQ ID NO: 2924746 - RNA, 18 nt, Mycobacterium avium subsp. paratuberculosis
cauggcgcggcggccggc

SEQ ID NO: 2924747 - RNA, 13 nt, Mycobacterium avium subsp. paratuberculosis
cauggcggccagc

SEQ ID NO: 2924748 - RNA, 16 nt, Mycobacterium avium subsp. paratuberculosis
cauggcggccagccgg

SEQ ID NO: 2924749 - RNA, 19 nt, Mycobacterium avium subsp. paratuberculosis
cauggcggcccgcgccggc

SEQ ID NO: 2924750 - RNA, 20 nt, Mycobacterium avium subsp. paratuberculosis
cauggcggcccgcgccggcg

SEQ ID NO: 2924751 - RNA, 15 nt, Mycobacterium avium subsp. paratuberculosis
cauggcgugcugaug

SEQ ID NO: 2924752 - RNA, 14 nt, Mycobacterium avium subsp. paratuberculosis
cauggcuggcggca

SEQ ID NO: 2924753 - RNA, 22 nt, Mycobacterium avium subsp. paratuberculosis
caugggcaucgucucggaccgg

SEQ ID NO: 2924754 - RNA, 20 nt, Mycobacterium avium subsp. paratuberculosis
caugggccacggcgcgagga

SEQ ID NO: 2924755 - RNA, 18 nt, Mycobacterium avium subsp. paratuberculosis
caugggcccggcccguca

SEQ ID NO: 2924756 - RNA, 23 nt, Mycobacterium avium subsp. paratuberculosis
caugggcgcguuggccggcugga

SEQ ID NO: 2924757 - RNA, 14 nt, Mycobacterium avium subsp. paratuberculosis
caugggcgugccgg

SEQ ID NO: 2924758 - RNA, 16 nt, Mycobacterium avium subsp. paratuberculosis
caugggcgugccggcc

SEQ ID NO: 2924759 - RNA, 18 nt, Mycobacterium avium subsp. paratuberculosis
caugggcgugccggcccg

SEQ ID NO: 2924760 - RNA, 14 nt, Mycobacterium avium subsp. paratuberculosis
caugggcugcaaca

SEQ ID NO: 2924761 - RNA, 19 nt, Mycobacterium avium subsp. paratuberculosis
cauggucgcccacaccgga

SEQ ID NO: 2924762 - RNA, 13 nt, Mycobacterium avium subsp. paratuberculosis
cauggucgcggcc

SEQ ID NO: 2924763 - RNA, 20 nt, Mycobacterium avium subsp. paratuberculosis
cauggucggcgacgccgucg

SEQ ID NO: 2924764 - RNA, 12 nt, Mycobacterium avium subsp. paratuberculosis
cauggucgucgu

SEQ ID NO: 2924765 - RNA, 17 nt, Mycobacterium avium subsp. paratuberculosis
cauggugaacugguuga

SEQ ID NO: 2924766 - RNA, 23 nt, Mycobacterium avium subsp. paratuberculosis
cauggugaacugguugacgucgg

SEQ ID NO: 2924767 - RNA, 19 nt, Mycobacterium avium subsp. paratuberculosis
cauggugaagcccagcgcg

SEQ ID NO: 2924768 - RNA, 17 nt, Mycobacterium avium subsp. paratuberculosis
cauggugaccagcguga

SEQ ID NO: 2924769 - RNA, 16 nt, Mycobacterium avium subsp. paratuberculosis
cauggugaugaucccg

SEQ ID NO: 2924770 - RNA, 20 nt, Mycobacterium avium subsp. paratuberculosis
cauggugaugaucccgguga

SEQ ID NO: 2924771 - RNA, 21 nt, Mycobacterium avium subsp. paratuberculosis
cauggugcggguguccgagcg

SEQ ID NO: 2924772 - RNA, 24 nt, Mycobacterium avium subsp. paratuberculosis
cauggugcggguguccgagcgggc

SEQ ID NO: 2924773 - RNA, 13 nt, Mycobacterium avium subsp. paratuberculosis
caugguggcggcg

SEQ ID NO: 2924774 - RNA, 14 nt, Mycobacterium avium subsp. paratuberculosis
caugguggcggcgc

SEQ ID NO: 2924775 - RNA, 18 nt, Mycobacterium avium subsp. paratuberculosis
cauggugggguagacggc

SEQ ID NO: 2924776 - RNA, 21 nt, Mycobacterium avium subsp. paratuberculosis
caugguggucgaacuggcgca

SEQ ID NO: 2924777 - RNA, 19 nt, Mycobacterium avium subsp. paratuberculosis
cauggugucaggaucgccg

SEQ ID NO: 2924778 - RNA, 18 nt, Mycobacterium avium subsp. paratuberculosis
caugguguuccaccagcg

SEQ ID NO: 2924779 - RNA, 20 nt, Mycobacterium avium subsp. paratuberculosis
caugguguuccaccagcggc

SEQ ID NO: 2924780 - RNA, 23 nt, Mycobacterium avium subsp. paratuberculosis
cauguacaggaucaacucgucgg

SEQ ID NO: 2924781 - RNA, 13 nt, Mycobacterium avium subsp. paratuberculosis
cauguaccaggcg

SEQ ID NO: 2924782 - RNA, 16 nt, Mycobacterium avium subsp. paratuberculosis
cauguaccaggcgacg

SEQ ID NO: 2924783 - RNA, 15 nt, Mycobacterium avium subsp. paratuberculosis
cauguagcgcuggua

SEQ ID NO: 2924784 - RNA, 16 nt, Mycobacterium avium subsp. paratuberculosis
cauguaguucagcagc

SEQ ID NO: 2924785 - RNA, 17 nt, Mycobacterium avium subsp. paratuberculosis
caugucaaugccgcagc

SEQ ID NO: 2924786 - RNA, 22 nt, Mycobacterium avium subsp. paratuberculosis
cauguccccgaccaucauggcc

SEQ ID NO: 2924787 - RNA, 22 nt, Mycobacterium avium subsp. paratuberculosis
cauguccccgccgguggcggcg

SEQ ID NO: 2924788 - RNA, 19 nt, Mycobacterium avium subsp. paratuberculosis
cauguccggggugagcagg

SEQ ID NO: 2924789 - RNA, 22 nt, Mycobacterium avium subsp. paratuberculosis
cauguccggggugagcagggcc

SEQ ID NO: 2924790 - RNA, 17 nt, Mycobacterium avium subsp. paratuberculosis
cauguccucgggguggu

SEQ ID NO: 2924791 - RNA, 20 nt, Mycobacterium avium subsp. paratuberculosis
caugucgaccucggccacca

SEQ ID NO: 2924792 - RNA, 21 nt, Mycobacterium avium subsp. paratuberculosis
caugucgaccucggccaccac

SEQ ID NO: 2924793 - RNA, 23 nt, Mycobacterium avium subsp. paratuberculosis
caugucgaccucggccaccaccu

SEQ ID NO: 2924794 - RNA, 20 nt, Mycobacterium avium subsp. paratuberculosis
caugucgaucggcucggcgc

SEQ ID NO: 2924795 - RNA, 18 nt, Mycobacterium avium subsp. paratuberculosis
ccaacacggcggcgcgca

SEQ ID NO: 2924796 - RNA, 12 nt, Mycobacterium avium subsp. paratuberculosis
ccaacagcagca

SEQ ID NO: 2924797 - RNA, 22 nt, Mycobacterium avium subsp. paratuberculosis
ccaacagcagcagaaccagcac

SEQ ID NO: 2924798 - RNA, 20 nt, Mycobacterium avium subsp. paratuberculosis
ccaacagcagcgccgcggcc

SEQ ID NO: 2924799 - RNA, 22 nt, Mycobacterium avium subsp. paratuberculosis
ccaacagcagcgccgcggccgg

SEQ ID NO: 2924800 - RNA, 22 nt, Mycobacterium avium subsp. paratuberculosis
ccaacagcggcccgaucaccgc

SEQ ID NO: 2924801 - RNA, 12 nt, Mycobacterium avium subsp. paratuberculosis
ccaacagcucgc

SEQ ID NO: 2924802 - RNA, 16 nt, Mycobacterium avium subsp. paratuberculosis
ccaacagcucgcgggc

SEQ ID NO: 2924803 - RNA, 19 nt, Mycobacterium avium subsp. paratuberculosis
ccaacaggucggcgugcag

SEQ ID NO: 2924804 - RNA, 20 nt, Mycobacterium avium subsp. paratuberculosis
ccaacaggugcuuggucagc

SEQ ID NO: 2924805 - RNA, 22 nt, Mycobacterium avium subsp. paratuberculosis
ccaacaggugcuuggucagcgc

SEQ ID NO: 2924806 - RNA, 23 nt, Mycobacterium avium subsp. paratuberculosis
ccaacagugcgcaggcggcgcgc

SEQ ID NO: 2924807 - RNA, 20 nt, Mycobacterium avium subsp. paratuberculosis
ccaacaucgacgugccguug

SEQ ID NO: 2924808 - RNA, 11 nt, Mycobacterium avium subsp. paratuberculosis
ccaacaugccu

SEQ ID NO: 2924809 - RNA, 13 nt, Mycobacterium avium subsp. paratuberculosis
ccaaccaccgugg

SEQ ID NO: 2924810 - RNA, 16 nt, Mycobacterium avium subsp. paratuberculosis
ccaaccaccguggccc

SEQ ID NO: 2924811 - RNA, 20 nt, Mycobacterium avium subsp. paratuberculosis
ccaaccaggucgcggcgcug

SEQ ID NO: 2924812 - RNA, 18 nt, Mycobacterium avium subsp. paratuberculosis
ccaaccccgggcggcucg

SEQ ID NO: 2924813 - RNA, 19 nt, Mycobacterium avium subsp. paratuberculosis
ccaacccgaucggcccggc

SEQ ID NO: 2924814 - RNA, 12 nt, Mycobacterium avium subsp. paratuberculosis
ccaacccgggcg

SEQ ID NO: 2924815 - RNA, 15 nt, Mycobacterium avium subsp. paratuberculosis
ccaacccgggcgcca

SEQ ID NO: 2924816 - RNA, 19 nt, Mycobacterium avium subsp. paratuberculosis
ccaaccgcauucggccgcc

SEQ ID NO: 2924817 - RNA, 20 nt, Mycobacterium avium subsp. paratuberculosis
ccaaccgcauucggccgcca

SEQ ID NO: 2924818 - RNA, 16 nt, Mycobacterium avium subsp. paratuberculosis
ccaaccgcccggcgcc

SEQ ID NO: 2924819 - RNA, 18 nt, Mycobacterium avium subsp. paratuberculosis
ccaaccgcccggcgccga

SEQ ID NO: 2924820 - RNA, 14 nt, Mycobacterium avium subsp. paratuberculosis
ccaaccgcucggcg

SEQ ID NO: 2924821 - RNA, 20 nt, Mycobacterium avium subsp. paratuberculosis
ccaaccggaucggcuagcag

SEQ ID NO: 2924822 - RNA, 14 nt, Mycobacterium avium subsp. paratuberculosis
ccaaccggccccga

SEQ ID NO: 2924823 - RNA, 16 nt, Mycobacterium avium subsp. paratuberculosis
ccaaccggccccgagc

SEQ ID NO: 2924824 - RNA, 15 nt, Mycobacterium avium subsp. paratuberculosis
ccaaccgggcaggca

SEQ ID NO: 2924825 - RNA, 22 nt, Mycobacterium avium subsp. paratuberculosis
ccaaccuggacgguuucaccgc

SEQ ID NO: 2924826 - RNA, 23 nt, Mycobacterium avium subsp. paratuberculosis
ccaaccuggacgguuucaccgcc

SEQ ID NO: 2924827 - RNA, 16 nt, Mycobacterium avium subsp. paratuberculosis
ccaacgacagcgacgg

SEQ ID NO: 2924828 - RNA, 16 nt, Mycobacterium avium subsp. paratuberculosis
ccaacgacgucggcgu

SEQ ID NO: 2924829 - RNA, 20 nt, Mycobacterium avium subsp. paratuberculosis
ccaacgacgucggcgucauc

SEQ ID NO: 2924830 - RNA, 21 nt, Mycobacterium avium subsp. paratuberculosis
ccaacgcagcgcauccgacac

SEQ ID NO: 2924831 - RNA, 17 nt, Mycobacterium avium subsp. paratuberculosis
ccaacgccacguagcag

SEQ ID NO: 2924832 - RNA, 21 nt, Mycobacterium avium subsp. paratuberculosis
ccaacgccacguagcagcaga

SEQ ID NO: 2924833 - RNA, 16 nt, Mycobacterium avium subsp. paratuberculosis
ccaacgccucgucgac

SEQ ID NO: 2924834 - RNA, 17 nt, Mycobacterium avium subsp. paratuberculosis
ccaacgccucgucgacc

SEQ ID NO: 2924835 - RNA, 23 nt, Mycobacterium avium subsp. paratuberculosis
ccaacgcgaaggugaacgagauc

SEQ ID NO: 2924836 - RNA, 12 nt, Mycobacterium avium subsp. paratuberculosis
ccaacgcggcca

SEQ ID NO: 2924837 - RNA, 16 nt, Mycobacterium avium subsp. paratuberculosis
ccaacgcggcgccggu

SEQ ID NO: 2924838 - RNA, 21 nt, Mycobacterium avium subsp. paratuberculosis
ccaacgcguucuccucgaaca

SEQ ID NO: 2924839 - RNA, 20 nt, Mycobacterium avium subsp. paratuberculosis
ccaacggauucagcgucgcc

SEQ ID NO: 2924840 - RNA, 18 nt, Mycobacterium avium subsp. paratuberculosis
ccaacggcaccaccacgg

SEQ ID NO: 2924841 - RNA, 16 nt, Mycobacterium avium subsp. paratuberculosis
ccaacggcagcagcac

SEQ ID NO: 2924842 - RNA, 14 nt, Mycobacterium avium subsp. paratuberculosis
ccaacggccgcacg

SEQ ID NO: 2924843 - RNA, 17 nt, Mycobacterium avium subsp. paratuberculosis
ccaacggcgugcagccg

SEQ ID NO: 2924844 - RNA, 14 nt, Mycobacterium avium subsp. paratuberculosis
ccaacggcucgccg

SEQ ID NO: 2924845 - RNA, 16 nt, Mycobacterium avium subsp. paratuberculosis
ccaacggcucgccgcg

SEQ ID NO: 2924846 - RNA, 17 nt, Mycobacterium avium subsp. paratuberculosis
ccaacggcucgccgcgc

SEQ ID NO: 2924847 - RNA, 20 nt, Mycobacterium avium subsp. paratuberculosis
ccaacggcucgccgcgcauc

SEQ ID NO: 2924848 - RNA, 20 nt, Mycobacterium avium subsp. paratuberculosis
ccaacgggaagagcggcgug

SEQ ID NO: 2924849 - RNA, 21 nt, Mycobacterium avium subsp. paratuberculosis
ccaacgggaagagcggcguga

SEQ ID NO: 2924850 - RNA, 15 nt, Mycobacterium avium subsp. paratuberculosis
ccaacgggcggcgga

SEQ ID NO: 2924851 - RNA, 22 nt, Mycobacterium avium subsp. paratuberculosis
ccaacgggcggcggaucagcac

SEQ ID NO: 2924852 - RNA, 19 nt, Mycobacterium avium subsp. paratuberculosis
ccaacgguucggccgcucg

SEQ ID NO: 2924853 - RNA, 23 nt, Mycobacterium avium subsp. paratuberculosis
ccaacgguuuccaccaccacccg

SEQ ID NO: 2924854 - RNA, 16 nt, Mycobacterium avium subsp. paratuberculosis
ccaacgugaugagcgc

SEQ ID NO: 2924855 - RNA, 17 nt, Mycobacterium avium subsp. paratuberculosis
ccaacgugaugagcgcg

SEQ ID NO: 2924856 - RNA, 18 nt, Mycobacterium avium subsp. paratuberculosis
ccaacgugaugagcgcgu

SEQ ID NO: 2924857 - RNA, 18 nt, Mycobacterium avium subsp. paratuberculosis
ccaacguggguggccccu

SEQ ID NO: 2924858 - RNA, 17 nt, Mycobacterium avium subsp. paratuberculosis
ccaacuacccgccgacg

SEQ ID NO: 2924859 - RNA, 21 nt, Mycobacterium avium subsp. paratuberculosis
ccaacucaugggcccggcccg

SEQ ID NO: 2924860 - RNA, 24 nt, Mycobacterium avium subsp. paratuberculosis
ccaacucaugggcccggcccguca

SEQ ID NO: 2924861 - RNA, 15 nt, Mycobacterium avium subsp. paratuberculosis
ccaacuccaccgccc

SEQ ID NO: 2924862 - RNA, 13 nt, Mycobacterium avium subsp. paratuberculosis
ccaacuccggcgg

SEQ ID NO: 2924863 - RNA, 14 nt, Mycobacterium avium subsp. paratuberculosis
ccaacuccggcggc

SEQ ID NO: 2924864 - RNA, 15 nt, Mycobacterium avium subsp. paratuberculosis
ccaacuccggcggca

SEQ ID NO: 2924865 - RNA, 17 nt, Mycobacterium avium subsp. paratuberculosis
ccaacuccggcggcagc

SEQ ID NO: 2924866 - RNA, 23 nt, Mycobacterium avium subsp. paratuberculosis
ccaacugaauuccuggccggugc

SEQ ID NO: 2924867 - RNA, 19 nt, Mycobacterium avium subsp. paratuberculosis
ccaacugcauuucggacgg

SEQ ID NO: 2924868 - RNA, 22 nt, Mycobacterium avium subsp. paratuberculosis
ccaacugcauuucggacggcga

SEQ ID NO: 2924869 - RNA, 22 nt, Mycobacterium avium subsp. paratuberculosis
ccaacugggugggugcggugcg

SEQ ID NO: 2924870 - RNA, 16 nt, Mycobacterium avium subsp. paratuberculosis
ccaagaaccaacugag

SEQ ID NO: 2924871 - RNA, 19 nt, Mycobacterium avium subsp. paratuberculosis
ccaagaaguuuccccacca

SEQ ID NO: 2924872 - RNA, 21 nt, Mycobacterium avium subsp. paratuberculosis
ccaagacccgcgucaucgggc

SEQ ID NO: 2924873 - RNA, 13 nt, Mycobacterium avium subsp. paratuberculosis
ccaagacgguggg

SEQ ID NO: 2924874 - RNA, 14 nt, Mycobacterium avium subsp. paratuberculosis
ccaagauugggcca

SEQ ID NO: 2924875 - RNA, 22 nt, Mycobacterium avium subsp. paratuberculosis
ccaagccauuucagcagcgcgg

SEQ ID NO: 2924876 - RNA, 23 nt, Mycobacterium avium subsp. paratuberculosis
ccaagccauuucagcagcgcggc

SEQ ID NO: 2924877 - RNA, 17 nt, Mycobacterium avium subsp. paratuberculosis
ccaagccggccaggccc

SEQ ID NO: 2924878 - RNA, 18 nt, Mycobacterium avium subsp. paratuberculosis
ccaagccgggcggcagca

SEQ ID NO: 2924879 - RNA, 15 nt, Mycobacterium avium subsp. paratuberculosis
ccacagcugcaggcu

SEQ ID NO: 2924880 - RNA, 16 nt, Mycobacterium avium subsp. paratuberculosis
ccacagcugccggccg

SEQ ID NO: 2924881 - RNA, 17 nt, Mycobacterium avium subsp. paratuberculosis
ccacagcugccggccgu

SEQ ID NO: 2924882 - RNA, 15 nt, Mycobacterium avium subsp. paratuberculosis
ccacagcugcuggcu

SEQ ID NO: 2924883 - RNA, 18 nt, Mycobacterium avium subsp. paratuberculosis
ccacagcugcuggcugcg

SEQ ID NO: 2924884 - RNA, 21 nt, Mycobacterium avium subsp. paratuberculosis
ccacagcugcuggcugcggcc

SEQ ID NO: 2924885 - RNA, 17 nt, Mycobacterium avium subsp. paratuberculosis
ccacaggacguugaggc

SEQ ID NO: 2924886 - RNA, 16 nt, Mycobacterium avium subsp. paratuberculosis
ccacaggccgaacagc

SEQ ID NO: 2924887 - RNA, 16 nt, Mycobacterium avium subsp. paratuberculosis
ccacaguccgcccagc

SEQ ID NO: 2924888 - RNA, 23 nt, Mycobacterium avium subsp. paratuberculosis
ccacauacaccgggaucggcggc

SEQ ID NO: 2924889 - RNA, 14 nt, Mycobacterium avium subsp. paratuberculosis
ccacaucagcucgg

SEQ ID NO: 2924890 - RNA, 16 nt, Mycobacterium avium subsp. paratuberculosis
ccacaucggucucgac

SEQ ID NO: 2924891 - RNA, 22 nt, Mycobacterium avium subsp. paratuberculosis
ccacaucgguugcuccggcguc

SEQ ID NO: 2924892 - RNA, 17 nt, Mycobacterium avium subsp. paratuberculosis
ccacaucugccggcaga

SEQ ID NO: 2924893 - RNA, 14 nt, Mycobacterium avium subsp. paratuberculosis
ccacaucugguugc

SEQ ID NO: 2924894 - RNA, 23 nt, Mycobacterium avium subsp. paratuberculosis
ccacaugccguugccaggccgcg

SEQ ID NO: 2924895 - RNA, 18 nt, Mycobacterium avium subsp. paratuberculosis
ccacaugggccacggcgc

SEQ ID NO: 2924896 - RNA, 19 nt, Mycobacterium avium subsp. paratuberculosis
ccacaugggccacggcgcg

SEQ ID NO: 2924897 - RNA, 20 nt, Mycobacterium avium subsp. paratuberculosis
ccacaugggccacggcgcga

SEQ ID NO: 2924898 - RNA, 21 nt, Mycobacterium avium subsp. paratuberculosis
ccacaugggccacggcgcgag

SEQ ID NO: 2924899 - RNA, 20 nt, Mycobacterium avium subsp. paratuberculosis
ccacauguucuccucgucgc

SEQ ID NO: 2924900 - RNA, 17 nt, Mycobacterium avium subsp. paratuberculosis
ccacauucccgccgccg

SEQ ID NO: 2924901 - RNA, 20 nt, Mycobacterium avium subsp. paratuberculosis
ccacauucccgccgccgcgg

SEQ ID NO: 2924902 - RNA, 16 nt, Mycobacterium avium subsp. paratuberculosis
ccacauugcugaugcc

SEQ ID NO: 2924903 - RNA, 23 nt, Mycobacterium avium subsp. paratuberculosis
ccacauuggcgaccgcggccgcg

SEQ ID NO: 2924904 - RNA, 23 nt, Mycobacterium avium subsp. paratuberculosis
ccaccaaaaguguuuccgcugag

SEQ ID NO: 2924905 - RNA, 14 nt, Mycobacterium avium subsp. paratuberculosis
ccaccaacaggucg

SEQ ID NO: 2924906 - RNA, 18 nt, Mycobacterium avium subsp. paratuberculosis
ccaccaacaucgacgugc

SEQ ID NO: 2924907 - RNA, 20 nt, Mycobacterium avium subsp. paratuberculosis
ccaccaacaucgacgugccg

SEQ ID NO: 2924908 - RNA, 19 nt, Mycobacterium avium subsp. paratuberculosis
ccaccaacgccacguagca

SEQ ID NO: 2924909 - RNA, 16 nt, Mycobacterium avium subsp. paratuberculosis
ccaccaacggcagcag

SEQ ID NO: 2924910 - RNA, 17 nt, Mycobacterium avium subsp. paratuberculosis
ccaccaacggcagcagc

SEQ ID NO: 2924911 - RNA, 18 nt, Mycobacterium avium subsp. paratuberculosis
ccaccaacggcagcagca

SEQ ID NO: 2924912 - RNA, 16 nt, Mycobacterium avium subsp. paratuberculosis
ccaccaacggcucgcc

SEQ ID NO: 2924913 - RNA, 21 nt, Mycobacterium avium subsp. paratuberculosis
ccaccaacggcucgccgcgca

SEQ ID NO: 2924914 - RNA, 24 nt, Mycobacterium avium subsp. paratuberculosis
ccaccaacggcucgccgcgcauca

SEQ ID NO: 2924915 - RNA, 20 nt, Mycobacterium avium subsp. paratuberculosis
ccaccaaggucuccgggcug

SEQ ID NO: 2924916 - RNA, 19 nt, Mycobacterium avium subsp. paratuberculosis
ccaccaauucgcgcugcca

SEQ ID NO: 2924917 - RNA, 16 nt, Mycobacterium avium subsp. paratuberculosis
ccaccacacccagcgc

SEQ ID NO: 2924918 - RNA, 19 nt, Mycobacterium avium subsp. paratuberculosis
ccaccacacccgcggccgc

SEQ ID NO: 2924919 - RNA, 21 nt, Mycobacterium avium subsp. paratuberculosis
ccaccacacccgcggccgcug

SEQ ID NO: 2924920 - RNA, 19 nt, Mycobacterium avium subsp. paratuberculosis
ccaccacaguggccgccag

SEQ ID NO: 2924921 - RNA, 17 nt, Mycobacterium avium subsp. paratuberculosis
ccaccacaucggucucg

SEQ ID NO: 2924922 - RNA, 20 nt, Mycobacterium avium subsp. paratuberculosis
ccaccacauucccgccgccg

SEQ ID NO: 2924923 - RNA, 15 nt, Mycobacterium avium subsp. paratuberculosis
ccaccacauuggcga

SEQ ID NO: 2924924 - RNA, 21 nt, Mycobacterium avium subsp. paratuberculosis
ccaccacauuggcgaccgcgg

SEQ ID NO: 2924925 - RNA, 15 nt, Mycobacterium avium subsp. paratuberculosis
ccaccaccacacccg

SEQ ID NO: 2924926 - RNA, 13 nt, Mycobacterium avium subsp. paratuberculosis
ccaccaccacgag

SEQ ID NO: 2924927 - RNA, 15 nt, Mycobacterium avium subsp. paratuberculosis
ccaccaccacggggc

SEQ ID NO: 2924928 - RNA, 15 nt, Mycobacterium avium subsp. paratuberculosis
ccaccaccagcgggc

SEQ ID NO: 2924929 - RNA, 12 nt, Mycobacterium avium subsp. paratuberculosis
ccaccacccgga

SEQ ID NO: 2924930 - RNA, 14 nt, Mycobacterium avium subsp. paratuberculosis
ccaccaccgacagc

SEQ ID NO: 2924931 - RNA, 16 nt, Mycobacterium avium subsp. paratuberculosis
ccaccaccgagccggc

SEQ ID NO: 2924932 - RNA, 15 nt, Mycobacterium avium subsp. paratuberculosis
ccaccaccgaggugg

SEQ ID NO: 2924933 - RNA, 21 nt, Mycobacterium avium subsp. paratuberculosis
ccaccaccgagguggcccagc

SEQ ID NO: 2924934 - RNA, 13 nt, Mycobacterium avium subsp. paratuberculosis
ccaccaccgccac

SEQ ID NO: 2924935 - RNA, 20 nt, Mycobacterium avium subsp. paratuberculosis
ccaccaccgccaccagcgca

SEQ ID NO: 2924936 - RNA, 13 nt, Mycobacterium avium subsp. paratuberculosis
ccaccaccgccgg

SEQ ID NO: 2924937 - RNA, 15 nt, Mycobacterium avium subsp. paratuberculosis
ccaccaccgccggcc

SEQ ID NO: 2924938 - RNA, 13 nt, Mycobacterium avium subsp. paratuberculosis
ccaccaccgccgu

SEQ ID NO: 2924939 - RNA, 12 nt, Mycobacterium avium subsp. paratuberculosis
ccaccaccgccu

SEQ ID NO: 2924940 - RNA, 14 nt, Mycobacterium avium subsp. paratuberculosis
ccaccaccgcgccg

SEQ ID NO: 2924941 - RNA, 18 nt, Mycobacterium avium subsp. paratuberculosis
ccaccaccgcgccgucgu

SEQ ID NO: 2924942 - RNA, 12 nt, Mycobacterium avium subsp. paratuberculosis
ccaccaccgcgg

SEQ ID NO: 2924943 - RNA, 13 nt, Mycobacterium avium subsp. paratuberculosis
ccaccaccgcggc

SEQ ID NO: 2924944 - RNA, 12 nt, Mycobacterium avium subsp. paratuberculosis
ccaccaccggcc

SEQ ID NO: 2924945 - RNA, 13 nt, Mycobacterium avium subsp. paratuberculosis
ccaccaccggccg

SEQ ID NO: 2924946 - RNA, 14 nt, Mycobacterium avium subsp. paratuberculosis
ccaccaccggccgc

SEQ ID NO: 2924947 - RNA, 16 nt, Mycobacterium avium subsp. paratuberculosis
ccaccaccggccgcgc

SEQ ID NO: 2924948 - RNA, 17 nt, Mycobacterium avium subsp. paratuberculosis
ccaccaccggccgcgcg

SEQ ID NO: 2924949 - RNA, 20 nt, Mycobacterium avium subsp. paratuberculosis
ccaccaccggcuuggccacg

SEQ ID NO: 2924950 - RNA, 13 nt, Mycobacterium avium subsp. paratuberculosis
ccaccaccgguga

SEQ ID NO: 2924951 - RNA, 19 nt, Mycobacterium avium subsp. paratuberculosis
ccaccaccggugaacgggu

SEQ ID NO: 2924952 - RNA, 13 nt, Mycobacterium avium subsp. paratuberculosis
ccaccaccuccuc

SEQ ID NO: 2924953 - RNA, 14 nt, Mycobacterium avium subsp. paratuberculosis
ccaccaccuccucg

SEQ ID NO: 2924954 - RNA, 17 nt, Mycobacterium avium subsp. paratuberculosis
ccaccaccucgcgggcg

SEQ ID NO: 2924955 - RNA, 15 nt, Mycobacterium avium subsp. paratuberculosis
ccaccaccugcuucc

SEQ ID NO: 2924956 - RNA, 12 nt, Mycobacterium avium subsp. paratuberculosis
ccaccacgaacc

SEQ ID NO: 2924957 - RNA, 17 nt, Mycobacterium avium subsp. paratuberculosis
ccaccacgaaccaggcg

SEQ ID NO: 2924958 - RNA, 23 nt, Mycobacterium avium subsp. paratuberculosis
ccaccacgaaccaggcgccggcc

SEQ ID NO: 2924959 - RNA, 24 nt, Mycobacterium avium subsp. paratuberculosis
ccaccacgaaccaggcgccggcca

SEQ ID NO: 2924960 - RNA, 15 nt, Mycobacterium avium subsp. paratuberculosis
ccaccacgaacgcgc

SEQ ID NO: 2924961 - RNA, 18 nt, Mycobacterium avium subsp. paratuberculosis
ccaccacgaccagugccc

SEQ ID NO: 2924962 - RNA, 16 nt, Mycobacterium avium subsp. paratuberculosis
ccaccacgacgccggg

SEQ ID NO: 2924963 - RNA, 17 nt, Mycobacterium avium subsp. paratuberculosis
ccaccacgacgccgggc

SEQ ID NO: 2924964 - RNA, 20 nt, Mycobacterium avium subsp. paratuberculosis
ccaccagugucagggcagcg

SEQ ID NO: 2924965 - RNA, 19 nt, Mycobacterium avium subsp. paratuberculosis
ccaccaguguccgggcgcc

SEQ ID NO: 2924966 - RNA, 16 nt, Mycobacterium avium subsp. paratuberculosis
ccaccaucaggccggc

SEQ ID NO: 2924967 - RNA, 15 nt, Mycobacterium avium subsp. paratuberculosis
ccaccaucccgccgc

SEQ ID NO: 2924968 - RNA, 16 nt, Mycobacterium avium subsp. paratuberculosis
ccaccaucccgccgcc

SEQ ID NO: 2924969 - RNA, 19 nt, Mycobacterium avium subsp. paratuberculosis
ccaccaucccgccgccgaa

SEQ ID NO: 2924970 - RNA, 23 nt, Mycobacterium avium subsp. paratuberculosis
ccaccaucccgccgccgaacagc

SEQ ID NO: 2924971 - RNA, 17 nt, Mycobacterium avium subsp. paratuberculosis
ccaccaucuccgcggcg

SEQ ID NO: 2924972 - RNA, 16 nt, Mycobacterium avium subsp. paratuberculosis
ccaccaugccggcguc

SEQ ID NO: 2924973 - RNA, 18 nt, Mycobacterium avium subsp. paratuberculosis
ccaccauggcuuccgccg

SEQ ID NO: 2924974 - RNA, 19 nt, Mycobacterium avium subsp. paratuberculosis
ccaccauggcuuccgccga

SEQ ID NO: 2924975 - RNA, 17 nt, Mycobacterium avium subsp. paratuberculosis
ccaccaugucggcgucg

SEQ ID NO: 2924976 - RNA, 20 nt, Mycobacterium avium subsp. paratuberculosis
ccaccaugucguugacgcug

SEQ ID NO: 2924977 - RNA, 22 nt, Mycobacterium avium subsp. paratuberculosis
ccaccauguuccagaaccggca

SEQ ID NO: 2924978 - RNA, 12 nt, Mycobacterium avium subsp. paratuberculosis
ccacccaccggc

SEQ ID NO: 2924979 - RNA, 19 nt, Mycobacterium avium subsp. paratuberculosis
ccacccacucccagccgcc

SEQ ID NO: 2924980 - RNA, 21 nt, Mycobacterium avium subsp. paratuberculosis
ccacccacucccagccgccgg

SEQ ID NO: 2924981 - RNA, 20 nt, Mycobacterium avium subsp. paratuberculosis
ccacccaggccacccgggcg

SEQ ID NO: 2924982 - RNA, 21 nt, Mycobacterium avium subsp. paratuberculosis
ccacccaggccacccgggcgc

SEQ ID NO: 2924983 - RNA, 12 nt, Mycobacterium avium subsp. paratuberculosis
ccacccaggugu

SEQ ID NO: 2924984 - RNA, 14 nt, Mycobacterium avium subsp. paratuberculosis
ccacccccagcccg

SEQ ID NO: 2924985 - RNA, 16 nt, Mycobacterium avium subsp. paratuberculosis
ccacccccgacccgaa

SEQ ID NO: 2924986 - RNA, 13 nt, Mycobacterium avium subsp. paratuberculosis
ccacccccgcggu

SEQ ID NO: 2924987 - RNA, 16 nt, Mycobacterium avium subsp. paratuberculosis
ccaccccgaacccggc

SEQ ID NO: 2924988 - RNA, 18 nt, Mycobacterium avium subsp. paratuberculosis
ccaccccgaacccggcca

SEQ ID NO: 2924989 - RNA, 19 nt, Mycobacterium avium subsp. paratuberculosis
ccaccccgaacccggccag

SEQ ID NO: 2924990 - RNA, 20 nt, Mycobacterium avium subsp. paratuberculosis
ccaccccgaacccggccagc

SEQ ID NO: 2924991 - RNA, 20 nt, Mycobacterium avium subsp. paratuberculosis
ccaccccgagcucgggcgcg

SEQ ID NO: 2924992 - RNA, 17 nt, Mycobacterium avium subsp. paratuberculosis
ccaccccgaucggggcc

SEQ ID NO: 2924993 - RNA, 21 nt, Mycobacterium avium subsp. paratuberculosis
ccaccccgcagaacaccagcg

SEQ ID NO: 2924994 - RNA, 16 nt, Mycobacterium avium subsp. paratuberculosis
ccaccccgccaaucac

SEQ ID NO: 2924995 - RNA, 15 nt, Mycobacterium avium subsp. paratuberculosis
ccaccccggacggcc

SEQ ID NO: 2924996 - RNA, 12 nt, Mycobacterium avium subsp. paratuberculosis
ccaccccggcgg

SEQ ID NO: 2924997 - RNA, 13 nt, Mycobacterium avium subsp. paratuberculosis
ccaccccggcggu

SEQ ID NO: 2924998 - RNA, 14 nt, Mycobacterium avium subsp. paratuberculosis
ccaccccggcgguc

SEQ ID NO: 2924999 - RNA, 21 nt, Mycobacterium avium subsp. paratuberculosis
ccaccccggcggucggaucga

SEQ ID NO: 2925000 - RNA, 20 nt, Mycobacterium avium subsp. paratuberculosis
ccaccccggcguccacgccg

SEQ ID NO: 2925001 - RNA, 22 nt, Mycobacterium avium subsp. paratuberculosis
ccaccccgggaacgacggugcg

SEQ ID NO: 2925002 - RNA, 19 nt, Mycobacterium avium subsp. paratuberculosis
ccacccgaugaccggcccg

SEQ ID NO: 2925003 - RNA, 20 nt, Mycobacterium avium subsp. paratuberculosis
ccacccgaugaccggcccgg

SEQ ID NO: 2925004 - RNA, 22 nt, Mycobacterium avium subsp. paratuberculosis
ccacccgaugaccggcccggcg

SEQ ID NO: 2925005 - RNA, 22 nt, Mycobacterium avium subsp. paratuberculosis
ccacccgcaacgcugaccgcag

SEQ ID NO: 2925006 - RNA, 19 nt, Mycobacterium avium subsp. paratuberculosis
ccacccgcaccucgcccgg

SEQ ID NO: 2925007 - RNA, 22 nt, Mycobacterium avium subsp. paratuberculosis
ccacccgcaccucgcccggcuc

SEQ ID NO: 2925008 - RNA, 18 nt, Mycobacterium avium subsp. paratuberculosis
ccacccgcacgcccgggc

SEQ ID NO: 2925009 - RNA, 23 nt, Mycobacterium avium subsp. paratuberculosis
ccacccgcacggucgcggugucg

SEQ ID NO: 2925010 - RNA, 16 nt, Mycobacterium avium subsp. paratuberculosis
ccacccgcagcgaggc

SEQ ID NO: 2925011 - RNA, 14 nt, Mycobacterium avium subsp. paratuberculosis
ccacccgcagcgcg

SEQ ID NO: 2925012 - RNA, 16 nt, Mycobacterium avium subsp. paratuberculosis
ccacccgcagcgcggc

SEQ ID NO: 2925013 - RNA, 17 nt, Mycobacterium avium subsp. paratuberculosis
ccacccgcagcgcggcg

SEQ ID NO: 2925014 - RNA, 15 nt, Mycobacterium avium subsp. paratuberculosis
ccacccgcagcucgc

SEQ ID NO: 2925015 - RNA, 17 nt, Mycobacterium avium subsp. paratuberculosis
ccacccgcagggcgccg

SEQ ID NO: 2925016 - RNA, 18 nt, Mycobacterium avium subsp. paratuberculosis
ccacccgcagggcgccgg

SEQ ID NO: 2925017 - RNA, 21 nt, Mycobacterium avium subsp. paratuberculosis
ccacccgcagggcgccgguga

SEQ ID NO: 2925018 - RNA, 14 nt, Mycobacterium avium subsp. paratuberculosis
ccacccgcagugcg

SEQ ID NO: 2925019 - RNA, 15 nt, Mycobacterium avium subsp. paratuberculosis
ccacccgcaugcuga

SEQ ID NO: 2925020 - RNA, 13 nt, Mycobacterium avium subsp. paratuberculosis
ccacccgccagcc

SEQ ID NO: 2925021 - RNA, 15 nt, Mycobacterium avium subsp. paratuberculosis
ccacccgccagcccg

SEQ ID NO: 2925022 - RNA, 16 nt, Mycobacterium avium subsp. paratuberculosis
ccacccgccccgccgc

SEQ ID NO: 2925023 - RNA, 20 nt, Mycobacterium avium subsp. paratuberculosis
ccacccgccccgccgcggcc

SEQ ID NO: 2925024 - RNA, 12 nt, Mycobacterium avium subsp. paratuberculosis
ccacccgcgauc

SEQ ID NO: 2925025 - RNA, 14 nt, Mycobacterium avium subsp. paratuberculosis
ccacccgcgccggc

SEQ ID NO: 2925026 - RNA, 14 nt, Mycobacterium avium subsp. paratuberculosis
ccacccgcggccgg

SEQ ID NO: 2925027 - RNA, 15 nt, Mycobacterium avium subsp. paratuberculosis
ccacccgcggccggc

SEQ ID NO: 2925028 - RNA, 17 nt, Mycobacterium avium subsp. paratuberculosis
ccacccgcggccggccc

SEQ ID NO: 2925029 - RNA, 20 nt, Mycobacterium avium subsp. paratuberculosis
ccacccgcggccggcccagc

SEQ ID NO: 2925030 - RNA, 23 nt, Mycobacterium avium subsp. paratuberculosis
ccacccgcggccggcccagcgcg

SEQ ID NO: 2925031 - RNA, 15 nt, Mycobacterium avium subsp. paratuberculosis
ccacccggcccacca

SEQ ID NO: 2925032 - RNA, 13 nt, Mycobacterium avium subsp. paratuberculosis
ccacccggcgggc

SEQ ID NO: 2925033 - RNA, 15 nt, Mycobacterium avium subsp. paratuberculosis
ccacccggcgggcca

SEQ ID NO: 2925034 - RNA, 16 nt, Mycobacterium avium subsp. paratuberculosis
ccacccgggcgccggc

SEQ ID NO: 2925035 - RNA, 17 nt, Mycobacterium avium subsp. paratuberculosis
ccacccggggccguccg

SEQ ID NO: 2925036 - RNA, 22 nt, Mycobacterium avium subsp. paratuberculosis
ccacccggggccguccgggaua

SEQ ID NO: 2925037 - RNA, 16 nt, Mycobacterium avium subsp. paratuberculosis
ccacccggucgacgau

SEQ ID NO: 2925038 - RNA, 22 nt, Mycobacterium avium subsp. paratuberculosis
ccacccggucgacgauggcccg

SEQ ID NO: 2925039 - RNA, 15 nt, Mycobacterium avium subsp. paratuberculosis
ccacccggucgaugu

SEQ ID NO: 2925040 - RNA, 16 nt, Mycobacterium avium subsp. paratuberculosis
ccacccggucgaugug

SEQ ID NO: 2925041 - RNA, 21 nt, Mycobacterium avium subsp. paratuberculosis
ccacccggucgaugugcgcgc

SEQ ID NO: 2925042 - RNA, 20 nt, Mycobacterium avium subsp. paratuberculosis
ccacccggugggacugggcg

SEQ ID NO: 2925043 - RNA, 21 nt, Mycobacterium avium subsp. paratuberculosis
ccacccggugggacugggcgc

SEQ ID NO: 2925044 - RNA, 12 nt, Mycobacterium avium subsp. paratuberculosis
ccacccgucggu

SEQ ID NO: 2925045 - RNA, 16 nt, Mycobacterium avium subsp. paratuberculosis
ccacccgucggugaag

SEQ ID NO: 2925046 - RNA, 20 nt, Mycobacterium avium subsp. paratuberculosis
ccacccguuccucgacguag

SEQ ID NO: 2925047 - RNA, 21 nt, Mycobacterium avium subsp. paratuberculosis
ccacccguuccucgacguagg

SEQ ID NO: 2925048 - RNA, 18 nt, Mycobacterium avium subsp. paratuberculosis
ccacccguuggcaggccc

SEQ ID NO: 2925049 - RNA, 17 nt, Mycobacterium avium subsp. paratuberculosis
ccaccgcgccgucuucc

SEQ ID NO: 2925050 - RNA, 22 nt, Mycobacterium avium subsp. paratuberculosis
ccaccgcgccuuugacguucgc

SEQ ID NO: 2925051 - RNA, 19 nt, Mycobacterium avium subsp. paratuberculosis
ccaccgcgcgcugccgcgc

SEQ ID NO: 2925052 - RNA, 20 nt, Mycobacterium avium subsp. paratuberculosis
ccaccgcgcgcugccgcgcc

SEQ ID NO: 2925053 - RNA, 13 nt, Mycobacterium avium subsp. paratuberculosis
ccaccgcgcggcc

SEQ ID NO: 2925054 - RNA, 14 nt, Mycobacterium avium subsp. paratuberculosis
ccaccgcgcggcca

SEQ ID NO: 2925055 - RNA, 15 nt, Mycobacterium avium subsp. paratuberculosis
ccaccgcgcggccag

SEQ ID NO: 2925056 - RNA, 15 nt, Mycobacterium avium subsp. paratuberculosis
ccaccgcgcggcgca

SEQ ID NO: 2925057 - RNA, 16 nt, Mycobacterium avium subsp. paratuberculosis
ccaccgcgcggcgcag

SEQ ID NO: 2925058 - RNA, 22 nt, Mycobacterium avium subsp. paratuberculosis
ccaccgcgcggcgcaguucgac

SEQ ID NO: 2925059 - RNA, 14 nt, Mycobacterium avium subsp. paratuberculosis
ccaccgcgcggugc

SEQ ID NO: 2925060 - RNA, 14 nt, Mycobacterium avium subsp. paratuberculosis
ccaccgcggccagc

SEQ ID NO: 2925061 - RNA, 15 nt, Mycobacterium avium subsp. paratuberculosis
ccaccgcggcgccgu

SEQ ID NO: 2925062 - RNA, 19 nt, Mycobacterium avium subsp. paratuberculosis
ccaccgcggcgccgucgaa

SEQ ID NO: 2925063 - RNA, 13 nt, Mycobacterium avium subsp. paratuberculosis
ccaccgcggcgcg

SEQ ID NO: 2925064 - RNA, 18 nt, Mycobacterium avium subsp. paratuberculosis
ccaccgcggcgcgcggcc

SEQ ID NO: 2925065 - RNA, 21 nt, Mycobacterium avium subsp. paratuberculosis
ccaccgcggcgcgcggccgcg

SEQ ID NO: 2925066 - RNA, 13 nt, Mycobacterium avium subsp. paratuberculosis
ccaccgcggcggc

SEQ ID NO: 2925067 - RNA, 15 nt, Mycobacterium avium subsp. paratuberculosis
ccaccgcggcggcca

SEQ ID NO: 2925068 - RNA, 16 nt, Mycobacterium avium subsp. paratuberculosis
ccaccgcggcggccag

SEQ ID NO: 2925069 - RNA, 21 nt, Mycobacterium avium subsp. paratuberculosis
ccaccgcggcguugcccgggu

SEQ ID NO: 2925070 - RNA, 15 nt, Mycobacterium avium subsp. paratuberculosis
ccaccgcggggcugg

SEQ ID NO: 2925071 - RNA, 21 nt, Mycobacterium avium subsp. paratuberculosis
ccaccgcggggcugggcgcca

SEQ ID NO: 2925072 - RNA, 12 nt, Mycobacterium avium subsp. paratuberculosis
ccaccgcgguga

SEQ ID NO: 2925073 - RNA, 15 nt, Mycobacterium avium subsp. paratuberculosis
ccaccgcggugaccg

SEQ ID NO: 2925074 - RNA, 18 nt, Mycobacterium avium subsp. paratuberculosis
ccaccgcggugaccgccc

SEQ ID NO: 2925075 - RNA, 20 nt, Mycobacterium avium subsp. paratuberculosis
ccaccgcggugaccgcccgc

SEQ ID NO: 2925076 - RNA, 17 nt, Mycobacterium avium subsp. paratuberculosis
ccaccgcggugagcggc

SEQ ID NO: 2925077 - RNA, 19 nt, Mycobacterium avium subsp. paratuberculosis
ccaccgcggugagcggccg

SEQ ID NO: 2925078 - RNA, 22 nt, Mycobacterium avium subsp. paratuberculosis
ccaccgcggugagcggccgcag

SEQ ID NO: 2925079 - RNA, 13 nt, Mycobacterium avium subsp. paratuberculosis
ccaccgcgguggg

SEQ ID NO: 2925080 - RNA, 16 nt, Mycobacterium avium subsp. paratuberculosis
ccaccgcggugggcca

SEQ ID NO: 2925081 - RNA, 16 nt, Mycobacterium avium subsp. paratuberculosis
ccaccgcguccgcggu

SEQ ID NO: 2925082 - RNA, 12 nt, Mycobacterium avium subsp. paratuberculosis
ccaccgcgucgc

SEQ ID NO: 2925083 - RNA, 14 nt, Mycobacterium avium subsp. paratuberculosis
ccaccgcgucgcag

SEQ ID NO: 2925084 - RNA, 21 nt, Mycobacterium avium subsp. paratuberculosis
ccaccgcguugaucagcgcca

SEQ ID NO: 2925085 - RNA, 24 nt, Mycobacterium avium subsp. paratuberculosis
ccaccgcguugaucagcgccaggu

SEQ ID NO: 2925086 - RNA, 15 nt, Mycobacterium avium subsp. paratuberculosis
ccaccgcugggcggc

SEQ ID NO: 2925087 - RNA, 23 nt, Mycobacterium avium subsp. paratuberculosis
ccaccgcugggcggcgcggcggu

SEQ ID NO: 2925088 - RNA, 16 nt, Mycobacterium avium subsp. paratuberculosis
ccaccggaagcgcgca

SEQ ID NO: 2925089 - RNA, 13 nt, Mycobacterium avium subsp. paratuberculosis
ccaccggagcggc

SEQ ID NO: 2925090 - RNA, 15 nt, Mycobacterium avium subsp. paratuberculosis
ccaccggagcggcgg

SEQ ID NO: 2925091 - RNA, 18 nt, Mycobacterium avium subsp. paratuberculosis
ccaccggauggcgcccgg

SEQ ID NO: 2925092 - RNA, 18 nt, Mycobacterium avium subsp. paratuberculosis
ccaccggcaaccgccacg

SEQ ID NO: 2925093 - RNA, 10 nt, Mycobacterium avium subsp. paratuberculosis
ccaccggcac

SEQ ID NO: 2925094 - RNA, 12 nt, Mycobacterium avium subsp. paratuberculosis
ccaccggcacca

SEQ ID NO: 2925095 - RNA, 18 nt, Mycobacterium avium subsp. paratuberculosis
ccaccggcaccacgauca

SEQ ID NO: 2925096 - RNA, 22 nt, Mycobacterium avium subsp. paratuberculosis
ccaccggcaccacgaucaccag

SEQ ID NO: 2925097 - RNA, 12 nt, Mycobacterium avium subsp. paratuberculosis
ccaccggcacgg

SEQ ID NO: 2925098 - RNA, 13 nt, Mycobacterium avium subsp. paratuberculosis
ccaccggcaucgg

SEQ ID NO: 2925099 - RNA, 14 nt, Mycobacterium avium subsp. paratuberculosis
ccaccggcccagcc

SEQ ID NO: 2925100 - RNA, 15 nt, Mycobacterium avium subsp. paratuberculosis
ccaccggcccagccg

SEQ ID NO: 2925101 - RNA, 18 nt, Mycobacterium avium subsp. paratuberculosis
ccaccggcccagccggcg

SEQ ID NO: 2925102 - RNA, 19 nt, Mycobacterium avium subsp. paratuberculosis
ccaccggcccagccggcgg

SEQ ID NO: 2925103 - RNA, 20 nt, Mycobacterium avium subsp. paratuberculosis
ccaccggcccagccggcggu

SEQ ID NO: 2925104 - RNA, 15 nt, Mycobacterium avium subsp. paratuberculosis
ccaccggcccggccg

SEQ ID NO: 2925105 - RNA, 16 nt, Mycobacterium avium subsp. paratuberculosis
ccaccggcccggccgg

SEQ ID NO: 2925106 - RNA, 14 nt, Mycobacterium avium subsp. paratuberculosis
ccaccggcccggcg

SEQ ID NO: 2925107 - RNA, 17 nt, Mycobacterium avium subsp. paratuberculosis
ccaccggcccggcgggc

SEQ ID NO: 2925108 - RNA, 14 nt, Mycobacterium avium subsp. paratuberculosis
ccaccggccgaccg

SEQ ID NO: 2925109 - RNA, 13 nt, Mycobacterium avium subsp. paratuberculosis
ccaccggccgaug

SEQ ID NO: 2925110 - RNA, 17 nt, Mycobacterium avium subsp. paratuberculosis
ccaccggccgcccggcg

SEQ ID NO: 2925111 - RNA, 18 nt, Mycobacterium avium subsp. paratuberculosis
ccaccggccgcccggcga

SEQ ID NO: 2925112 - RNA, 19 nt, Mycobacterium avium subsp. paratuberculosis
ccaccggccgcccggcgag

SEQ ID NO: 2925113 - RNA, 12 nt, Mycobacterium avium subsp. paratuberculosis
ccaccggccgcg

SEQ ID NO: 2925114 - RNA, 20 nt, Mycobacterium avium subsp. paratuberculosis
ccaccggccgguccgcccag

SEQ ID NO: 2925115 - RNA, 12 nt, Mycobacterium avium subsp. paratuberculosis
ccaccggcgaug

SEQ ID NO: 2925116 - RNA, 18 nt, Mycobacterium avium subsp. paratuberculosis
ccaccggcgcagcgcguc

SEQ ID NO: 2925117 - RNA, 11 nt, Mycobacterium avium subsp. paratuberculosis
ccaccggcgcg

SEQ ID NO: 2925118 - RNA, 11 nt, Mycobacterium avium subsp. paratuberculosis
ccaccggcgga

SEQ ID NO: 2925119 - RNA, 14 nt, Mycobacterium avium subsp. paratuberculosis
ccaccggcuggccg

SEQ ID NO: 2925120 - RNA, 18 nt, Mycobacterium avium subsp. paratuberculosis
ccaccgggaccugcugcu

SEQ ID NO: 2925121 - RNA, 22 nt, Mycobacterium avium subsp. paratuberculosis
ccaccgggaucacccucggcgu

SEQ ID NO: 2925122 - RNA, 13 nt, Mycobacterium avium subsp. paratuberculosis
ccaccgggcagcc

SEQ ID NO: 2925123 - RNA, 14 nt, Mycobacterium avium subsp. paratuberculosis
ccaccgggcagccg

SEQ ID NO: 2925124 - RNA, 17 nt, Mycobacterium avium subsp. paratuberculosis
ccaccgggcagccgcac

SEQ ID NO: 2925125 - RNA, 13 nt, Mycobacterium avium subsp. paratuberculosis
ccaccgggccgcc

SEQ ID NO: 2925126 - RNA, 15 nt, Mycobacterium avium subsp. paratuberculosis
ccaccgggccgccau

SEQ ID NO: 2925127 - RNA, 15 nt, Mycobacterium avium subsp. paratuberculosis
ccaccgggcgucggc

SEQ ID NO: 2925128 - RNA, 14 nt, Mycobacterium avium subsp. paratuberculosis
ccaccggggucacc

SEQ ID NO: 2925129 - RNA, 15 nt, Mycobacterium avium subsp. paratuberculosis
ccaccgggucgucgc

SEQ ID NO: 2925130 - RNA, 18 nt, Mycobacterium avium subsp. paratuberculosis
ccaccgggucgucgcgga

SEQ ID NO: 2925131 - RNA, 22 nt, Mycobacterium avium subsp. paratuberculosis
ccaccggugacgaccggcagcc

SEQ ID NO: 2925132 - RNA, 14 nt, Mycobacterium avium subsp. paratuberculosis
ccaccgguggccgg

SEQ ID NO: 2925133 - RNA, 17 nt, Mycobacterium avium subsp. paratuberculosis
ccaccgguggccgggag

SEQ ID NO: 2925134 - RNA, 16 nt, Mycobacterium avium subsp. paratuberculosis
ccaccgucaccgccgc

SEQ ID NO: 2925135 - RNA, 20 nt, Mycobacterium avium subsp. paratuberculosis
ccaccugguuggcccgcacc

SEQ ID NO: 2925136 - RNA, 15 nt, Mycobacterium avium subsp. paratuberculosis
ccaccuucaccgcgc

SEQ ID NO: 2925137 - RNA, 16 nt, Mycobacterium avium subsp. paratuberculosis
ccaccuucaccgcgcc

SEQ ID NO: 2925138 - RNA, 17 nt, Mycobacterium avium subsp. paratuberculosis
ccaccuucaccgcgccg

SEQ ID NO: 2925139 - RNA, 19 nt, Mycobacterium avium subsp. paratuberculosis
ccaccuucaccgcgccggu

SEQ ID NO: 2925140 - RNA, 15 nt, Mycobacterium avium subsp. paratuberculosis
ccaccuucaucgccg

SEQ ID NO: 2925141 - RNA, 20 nt, Mycobacterium avium subsp. paratuberculosis
ccaccuucccaaccccgggc

SEQ ID NO: 2925142 - RNA, 14 nt, Mycobacterium avium subsp. paratuberculosis
ccaccuugcgcggg

SEQ ID NO: 2925143 - RNA, 22 nt, Mycobacterium avium subsp. paratuberculosis
ccaccuugcgcgggucgccggg

SEQ ID NO: 2925144 - RNA, 17 nt, Mycobacterium avium subsp. paratuberculosis
ccaccuuggacaggccc

SEQ ID NO: 2925145 - RNA, 20 nt, Mycobacterium avium subsp. paratuberculosis
ccaccuuggccggugcgccg

SEQ ID NO: 2925146 - RNA, 23 nt, Mycobacterium avium subsp. paratuberculosis
ccaccuuggcgucgaucagcgcg

SEQ ID NO: 2925147 - RNA, 15 nt, Mycobacterium avium subsp. paratuberculosis
ccaccuugguggccg

SEQ ID NO: 2925148 - RNA, 19 nt, Mycobacterium avium subsp. paratuberculosis
ccaccuugguggccgcggc

SEQ ID NO: 2925149 - RNA, 20 nt, Mycobacterium avium subsp. paratuberculosis
ccaccuugguggccgcggcc

SEQ ID NO: 2925150 - RNA, 17 nt, Mycobacterium avium subsp. paratuberculosis
ccaccuugucggcgccc

SEQ ID NO: 2925151 - RNA, 13 nt, Mycobacterium avium subsp. paratuberculosis
ccacgaaacccau

SEQ ID NO: 2925152 - RNA, 15 nt, Mycobacterium avium subsp. paratuberculosis
ccacgaaacugaccu

SEQ ID NO: 2925153 - RNA, 12 nt, Mycobacterium avium subsp. paratuberculosis
ccacgaacaccg

SEQ ID NO: 2925154 - RNA, 16 nt, Mycobacterium avium subsp. paratuberculosis
ccacgaacaccggcgc

SEQ ID NO: 2925155 - RNA, 17 nt, Mycobacterium avium subsp. paratuberculosis
ccacgaacaccggcgcg

SEQ ID NO: 2925156 - RNA, 21 nt, Mycobacterium avium subsp. paratuberculosis
ccacgaacaccggcgcgacca

SEQ ID NO: 2925157 - RNA, 15 nt, Mycobacterium avium subsp. paratuberculosis
ccacgaaccaggcgc

SEQ ID NO: 2925158 - RNA, 16 nt, Mycobacterium avium subsp. paratuberculosis
ccacgaaccaggcgcc

SEQ ID NO: 2925159 - RNA, 18 nt, Mycobacterium avium subsp. paratuberculosis
ccacgaaccaggcgccgg

SEQ ID NO: 2925160 - RNA, 22 nt, Mycobacterium avium subsp. paratuberculosis
ccacgaaccgguugcgggccga

SEQ ID NO: 2925161 - RNA, 14 nt, Mycobacterium avium subsp. paratuberculosis
ccacgaacgcgccg

SEQ ID NO: 2925162 - RNA, 17 nt, Mycobacterium avium subsp. paratuberculosis
ccacgaacgcgccgccg

SEQ ID NO: 2925163 - RNA, 13 nt, Mycobacterium avium subsp. paratuberculosis
ccacgaacgcugc

SEQ ID NO: 2925164 - RNA, 18 nt, Mycobacterium avium subsp. paratuberculosis
ccacgaagaugaucagcg

SEQ ID NO: 2925165 - RNA, 21 nt, Mycobacterium avium subsp. paratuberculosis
ccacgaagaugaucagcgcgc

SEQ ID NO: 2925166 - RNA, 22 nt, Mycobacterium avium subsp. paratuberculosis
ccacgaagaugaucagcgcgcc

SEQ ID NO: 2925167 - RNA, 18 nt, Mycobacterium avium subsp. paratuberculosis
ccacgaagcgggcggcga

SEQ ID NO: 2925168 - RNA, 21 nt, Mycobacterium avium subsp. paratuberculosis
ccacgaagcuggcgaacagca

SEQ ID NO: 2925169 - RNA, 21 nt, Mycobacterium avium subsp. paratuberculosis
ccacgaagggcgccagcaccu

SEQ ID NO: 2925170 - RNA, 13 nt, Mycobacterium avium subsp. paratuberculosis
ccacgacaccagc

SEQ ID NO: 2925171 - RNA, 12 nt, Mycobacterium avium subsp. paratuberculosis
ccacgacauccc

SEQ ID NO: 2925172 - RNA, 16 nt, Mycobacterium avium subsp. paratuberculosis
ccacgaccagcggcag

SEQ ID NO: 2925173 - RNA, 17 nt, Mycobacterium avium subsp. paratuberculosis
ccacgaccagcggcagc

SEQ ID NO: 2925174 - RNA, 18 nt, Mycobacterium avium subsp. paratuberculosis
ccacgaccagcggcagca

SEQ ID NO: 2925175 - RNA, 20 nt, Mycobacterium avium subsp. paratuberculosis
ccacgaccagcggcagcacg

SEQ ID NO: 2925176 - RNA, 19 nt, Mycobacterium avium subsp. paratuberculosis
ccacgaccagugcccggcc

SEQ ID NO: 2925177 - RNA, 15 nt, Mycobacterium avium subsp. paratuberculosis
ccacgaccccggcgg

SEQ ID NO: 2925178 - RNA, 16 nt, Mycobacterium avium subsp. paratuberculosis
ccacgaccccggcggc

SEQ ID NO: 2925179 - RNA, 15 nt, Mycobacterium avium subsp. paratuberculosis
ccacgaccucggggu

SEQ ID NO: 2925180 - RNA, 21 nt, Mycobacterium avium subsp. paratuberculosis
ccacgaccuggcgggccagcu

SEQ ID NO: 2925181 - RNA, 14 nt, Mycobacterium avium subsp. paratuberculosis
ccacgacgccgggc

SEQ ID NO: 2925182 - RNA, 13 nt, Mycobacterium avium subsp. paratuberculosis
ccacgacgcgcca

SEQ ID NO: 2925183 - RNA, 16 nt, Mycobacterium avium subsp. paratuberculosis
ccacgacgcgccacgc

SEQ ID NO: 2925184 - RNA, 21 nt, Mycobacterium avium subsp. paratuberculosis
ccacgacgcgccacgccccgg

SEQ ID NO: 2925185 - RNA, 11 nt, Mycobacterium avium subsp. paratuberculosis
ccacgacgcgg

SEQ ID NO: 2925186 - RNA, 12 nt, Mycobacterium avium subsp. paratuberculosis
ccacgacgcggc

SEQ ID NO: 2925187 - RNA, 13 nt, Mycobacterium avium subsp. paratuberculosis
ccacgacgcggcg

SEQ ID NO: 2925188 - RNA, 15 nt, Mycobacterium avium subsp. paratuberculosis
ccacgacgcggcgau

SEQ ID NO: 2925189 - RNA, 19 nt, Mycobacterium avium subsp. paratuberculosis
ccacgacgcggcgcgcgau

SEQ ID NO: 2925190 - RNA, 12 nt, Mycobacterium avium subsp. paratuberculosis
ccacgacggcgc

SEQ ID NO: 2925191 - RNA, 15 nt, Mycobacterium avium subsp. paratuberculosis
ccacgacggcgcugg

SEQ ID NO: 2925192 - RNA, 22 nt, Mycobacterium avium subsp. paratuberculosis
ccacgacggcgcuggccgcggc

SEQ ID NO: 2925193 - RNA, 14 nt, Mycobacterium avium subsp. paratuberculosis
ccacgacggggaac

SEQ ID NO: 2925194 - RNA, 22 nt, Mycobacterium avium subsp. paratuberculosis
ccacgacguacccccgcacgcc

SEQ ID NO: 2925195 - RNA, 14 nt, Mycobacterium avium subsp. paratuberculosis
ccacgacguccucg

SEQ ID NO: 2925196 - RNA, 17 nt, Mycobacterium avium subsp. paratuberculosis
ccacgacguccucgacg

SEQ ID NO: 2925197 - RNA, 18 nt, Mycobacterium avium subsp. paratuberculosis
ccacgacguccucgacga

SEQ ID NO: 2925198 - RNA, 20 nt, Mycobacterium avium subsp. paratuberculosis
ccacgacgucgagccagcgg

SEQ ID NO: 2925199 - RNA, 21 nt, Mycobacterium avium subsp. paratuberculosis
ccacgacgucugggccgccga

SEQ ID NO: 2925200 - RNA, 22 nt, Mycobacterium avium subsp. paratuberculosis
ccacgacgucugggccgccgag

SEQ ID NO: 2925201 - RNA, 16 nt, Mycobacterium avium subsp. paratuberculosis
ccacgacugcgcggcc

SEQ ID NO: 2925202 - RNA, 17 nt, Mycobacterium avium subsp. paratuberculosis
ccacgacugcgcggccg

SEQ ID NO: 2925203 - RNA, 18 nt, Mycobacterium avium subsp. paratuberculosis
ccacgacugcgcggccgg

SEQ ID NO: 2925204 - RNA, 19 nt, Mycobacterium avium subsp. paratuberculosis
ccacgacugcgcggccggc

SEQ ID NO: 2925205 - RNA, 21 nt, Mycobacterium avium subsp. paratuberculosis
ccacgacugcgcggccggcgu

SEQ ID NO: 2925206 - RNA, 21 nt, Mycobacterium avium subsp. paratuberculosis
ccacgacuucacaggccgccu

SEQ ID NO: 2925207 - RNA, 22 nt, Mycobacterium avium subsp. paratuberculosis
ccacgacuucacaggccgccuc

SEQ ID NO: 2925208 - RNA, 12 nt, Mycobacterium avium subsp. paratuberculosis
ccacgagcccag

SEQ ID NO: 2925209 - RNA, 14 nt, Mycobacterium avium subsp. paratuberculosis
ccacgagcccagcc

SEQ ID NO: 2925210 - RNA, 15 nt, Mycobacterium avium subsp. paratuberculosis
ccacgagcccagccg

SEQ ID NO: 2925211 - RNA, 18 nt, Mycobacterium avium subsp. paratuberculosis
ccacgaguaaccggugcg

SEQ ID NO: 2925212 - RNA, 20 nt, Mycobacterium avium subsp. paratuberculosis
ccacgaucaccaccaccgcc

SEQ ID NO: 2925213 - RNA, 15 nt, Mycobacterium avium subsp. paratuberculosis
ccacgaucacgucgg

SEQ ID NO: 2925214 - RNA, 24 nt, Mycobacterium avium subsp. paratuberculosis
ccacgaucacgucggugacgcccu

SEQ ID NO: 2925215 - RNA, 17 nt, Mycobacterium avium subsp. paratuberculosis
ccacgauccgcgcggcc

SEQ ID NO: 2925216 - RNA, 18 nt, Mycobacterium avium subsp. paratuberculosis
ccacgauccgcgcggcca

SEQ ID NO: 2925217 - RNA, 19 nt, Mycobacterium avium subsp. paratuberculosis
ccacgauccgcgcggccac

SEQ ID NO: 2925218 - RNA, 18 nt, Mycobacterium avium subsp. paratuberculosis
ccacgauccggggcagca

SEQ ID NO: 2925219 - RNA, 14 nt, Mycobacterium avium subsp. paratuberculosis
ccacgaucgcgauc

SEQ ID NO: 2925220 - RNA, 20 nt, Mycobacterium avium subsp. paratuberculosis
ccacgcuagcgugacgcucg

SEQ ID NO: 2925221 - RNA, 19 nt, Mycobacterium avium subsp. paratuberculosis
ccacgcucgacgcgucgac

SEQ ID NO: 2925222 - RNA, 13 nt, Mycobacterium avium subsp. paratuberculosis
ccacgcucggcga

SEQ ID NO: 2925223 - RNA, 17 nt, Mycobacterium avium subsp. paratuberculosis
ccacgcucggcggcgcg

SEQ ID NO: 2925224 - RNA, 15 nt, Mycobacterium avium subsp. paratuberculosis
ccacgcucgggccgg

SEQ ID NO: 2925225 - RNA, 20 nt, Mycobacterium avium subsp. paratuberculosis
ccacgcucucgccggucagc

SEQ ID NO: 2925226 - RNA, 20 nt, Mycobacterium avium subsp. paratuberculosis
ccacgcugagcaaccgccga

SEQ ID NO: 2925227 - RNA, 14 nt, Mycobacterium avium subsp. paratuberculosis
ccacgcuggccccg

SEQ ID NO: 2925228 - RNA, 18 nt, Mycobacterium avium subsp. paratuberculosis
ccacgcuggcggugucga

SEQ ID NO: 2925229 - RNA, 21 nt, Mycobacterium avium subsp. paratuberculosis
ccacgcuggcguccaggucgc

SEQ ID NO: 2925230 - RNA, 20 nt, Mycobacterium avium subsp. paratuberculosis
ccacgcuggcgugacgcucg

SEQ ID NO: 2925231 - RNA, 20 nt, Mycobacterium avium subsp. paratuberculosis
ccacgcuggugugacgcucg

SEQ ID NO: 2925232 - RNA, 16 nt, Mycobacterium avium subsp. paratuberculosis
ccacgcuguagggcca

SEQ ID NO: 2925233 - RNA, 17 nt, Mycobacterium avium subsp. paratuberculosis
ccacgcuguagggccac

SEQ ID NO: 2925234 - RNA, 19 nt, Mycobacterium avium subsp. paratuberculosis
ccacgcuguagggccacca

SEQ ID NO: 2925235 - RNA, 20 nt, Mycobacterium avium subsp. paratuberculosis
ccacgcuguagggccaccac

SEQ ID NO: 2925236 - RNA, 23 nt, Mycobacterium avium subsp. paratuberculosis
ccacgcuguagggccaccacgcc

SEQ ID NO: 2925237 - RNA, 18 nt, Mycobacterium avium subsp. paratuberculosis
ccacgcugugcucgacga

SEQ ID NO: 2925238 - RNA, 15 nt, Mycobacterium avium subsp. paratuberculosis
ccacggagcgcccgg

SEQ ID NO: 2925239 - RNA, 16 nt, Mycobacterium avium subsp. paratuberculosis
ccacggagcgcccggc

SEQ ID NO: 2925240 - RNA, 17 nt, Mycobacterium avium subsp. paratuberculosis
ccacggagcgcccggcc

SEQ ID NO: 2925241 - RNA, 21 nt, Mycobacterium avium subsp. paratuberculosis
ccacggagucgguuucgaccu

SEQ ID NO: 2925242 - RNA, 13 nt, Mycobacterium avium subsp. paratuberculosis
ccacggcaccgcc

SEQ ID NO: 2925243 - RNA, 15 nt, Mycobacterium avium subsp. paratuberculosis
ccacggcaccgccgc

SEQ ID NO: 2925244 - RNA, 14 nt, Mycobacterium avium subsp. paratuberculosis
ccacggcacgucga

SEQ ID NO: 2925245 - RNA, 18 nt, Mycobacterium avium subsp. paratuberculosis
ccacggcacgucgagggu

SEQ ID NO: 2925246 - RNA, 18 nt, Mycobacterium avium subsp. paratuberculosis
ccacggcagcugcagcgg

SEQ ID NO: 2925247 - RNA, 14 nt, Mycobacterium avium subsp. paratuberculosis
ccacggccagcacc

SEQ ID NO: 2925248 - RNA, 15 nt, Mycobacterium avium subsp. paratuberculosis
ccacggccagcaccg

SEQ ID NO: 2925249 - RNA, 23 nt, Mycobacterium avium subsp. paratuberculosis
ccacggccagcaccgccagcgcc

SEQ ID NO: 2925250 - RNA, 22 nt, Mycobacterium avium subsp. paratuberculosis
ccacggccaggaagccggcgac

SEQ ID NO: 2925251 - RNA, 23 nt, Mycobacterium avium subsp. paratuberculosis
ccacggccaggaagccggcgacg

SEQ ID NO: 2925252 - RNA, 23 nt, Mycobacterium avium subsp. paratuberculosis
ccacggccaugcagaccagcccg

SEQ ID NO: 2925253 - RNA, 13 nt, Mycobacterium avium subsp. paratuberculosis
ccacggccccagc

SEQ ID NO: 2925254 - RNA, 15 nt, Mycobacterium avium subsp. paratuberculosis
ccacggccccagccg

SEQ ID NO: 2925255 - RNA, 18 nt, Mycobacterium avium subsp. paratuberculosis
ccacggccccagccgccg

SEQ ID NO: 2925256 - RNA, 20 nt, Mycobacterium avium subsp. paratuberculosis
ccacggccccagccgccgcg

SEQ ID NO: 2925257 - RNA, 21 nt, Mycobacterium avium subsp. paratuberculosis
ccacggccccagccgccgcga

SEQ ID NO: 2925258 - RNA, 21 nt, Mycobacterium avium subsp. paratuberculosis
ccacggcccgcgccccggcgg

SEQ ID NO: 2925259 - RNA, 11 nt, Mycobacterium avium subsp. paratuberculosis
ccacggccgca

SEQ ID NO: 2925260 - RNA, 13 nt, Mycobacterium avium subsp. paratuberculosis
ccacggccgccga

SEQ ID NO: 2925261 - RNA, 12 nt, Mycobacterium avium subsp. paratuberculosis
ccacggccgcgg

SEQ ID NO: 2925262 - RNA, 13 nt, Mycobacterium avium subsp. paratuberculosis
ccacggccgcggc

SEQ ID NO: 2925263 - RNA, 15 nt, Mycobacterium avium subsp. paratuberculosis
ccacggccgcggccc

SEQ ID NO: 2925264 - RNA, 16 nt, Mycobacterium avium subsp. paratuberculosis
ccacggccgcggcccg

SEQ ID NO: 2925265 - RNA, 17 nt, Mycobacterium avium subsp. paratuberculosis
ccacggccgcggcccgg

SEQ ID NO: 2925266 - RNA, 13 nt, Mycobacterium avium subsp. paratuberculosis
ccacggccggcag

SEQ ID NO: 2925267 - RNA, 14 nt, Mycobacterium avium subsp. paratuberculosis
ccacggccggcagc

SEQ ID NO: 2925268 - RNA, 15 nt, Mycobacterium avium subsp. paratuberculosis
ccacggccggcagca

SEQ ID NO: 2925269 - RNA, 18 nt, Mycobacterium avium subsp. paratuberculosis
ccacggccggcagcaucg

SEQ ID NO: 2925270 - RNA, 21 nt, Mycobacterium avium subsp. paratuberculosis
ccacggccugguacagcaccg

SEQ ID NO: 2925271 - RNA, 13 nt, Mycobacterium avium subsp. paratuberculosis
ccacggcgacgac

SEQ ID NO: 2925272 - RNA, 16 nt, Mycobacterium avium subsp. paratuberculosis
ccacggcgccaugcgc

SEQ ID NO: 2925273 - RNA, 18 nt, Mycobacterium avium subsp. paratuberculosis
ccacggcgccaugcgccg

SEQ ID NO: 2925274 - RNA, 19 nt, Mycobacterium avium subsp. paratuberculosis
ccacggcgccaugcgccgc

SEQ ID NO: 2925275 - RNA, 21 nt, Mycobacterium avium subsp. paratuberculosis
ccacggcgccaugcgccgcgc

SEQ ID NO: 2925276 - RNA, 16 nt, Mycobacterium avium subsp. paratuberculosis
ccacggcgcgugcugu

SEQ ID NO: 2925277 - RNA, 13 nt, Mycobacterium avium subsp. paratuberculosis
ccacggcggcaug

SEQ ID NO: 2925278 - RNA, 16 nt, Mycobacterium avium subsp. paratuberculosis
ccacggcggccgaauc

SEQ ID NO: 2925279 - RNA, 11 nt, Mycobacterium avium subsp. paratuberculosis
ccacggcggug

SEQ ID NO: 2925280 - RNA, 12 nt, Mycobacterium avium subsp. paratuberculosis
ccacggcggugu

SEQ ID NO: 2925281 - RNA, 18 nt, Mycobacterium avium subsp. paratuberculosis
ccacggcggugucggcgg

SEQ ID NO: 2925282 - RNA, 19 nt, Mycobacterium avium subsp. paratuberculosis
ccacggcggugucggcggc

SEQ ID NO: 2925283 - RNA, 22 nt, Mycobacterium avium subsp. paratuberculosis
ccacggcguugaccaacgccgc

SEQ ID NO: 2925284 - RNA, 20 nt, Mycobacterium avium subsp. paratuberculosis
ccacgggaugcggcacgcgu

SEQ ID NO: 2925285 - RNA, 22 nt, Mycobacterium avium subsp. paratuberculosis
ccacgggaugcggcacgcguca

SEQ ID NO: 2925286 - RNA, 17 nt, Mycobacterium avium subsp. paratuberculosis
ccacgggcggucggacg

SEQ ID NO: 2925287 - RNA, 21 nt, Mycobacterium avium subsp. paratuberculosis
ccacgggcggucggacgcggg

SEQ ID NO: 2925288 - RNA, 14 nt, Mycobacterium avium subsp. paratuberculosis
ccacggggcgccgc

SEQ ID NO: 2925289 - RNA, 23 nt, Mycobacterium avium subsp. paratuberculosis
ccacggggcgccgcugcgggcca

SEQ ID NO: 2925290 - RNA, 16 nt, Mycobacterium avium subsp. paratuberculosis
ccacggggcgggucgu

SEQ ID NO: 2925291 - RNA, 14 nt, Mycobacterium avium subsp. paratuberculosis
ccacggggucgaga

SEQ ID NO: 2925292 - RNA, 15 nt, Mycobacterium avium subsp. paratuberculosis
ccacgggucgccgau

SEQ ID NO: 2925293 - RNA, 16 nt, Mycobacterium avium subsp. paratuberculosis
ccacgggucgccgauc

SEQ ID NO: 2925294 - RNA, 23 nt, Mycobacterium avium subsp. paratuberculosis
ccacgggucgccgaucucggcca

SEQ ID NO: 2925295 - RNA, 16 nt, Mycobacterium avium subsp. paratuberculosis
ccacgggucgccgugg

SEQ ID NO: 2925296 - RNA, 18 nt, Mycobacterium avium subsp. paratuberculosis
ccacgggucgcugugcag

SEQ ID NO: 2925297 - RNA, 15 nt, Mycobacterium avium subsp. paratuberculosis
ccacgggucggucgg

SEQ ID NO: 2925298 - RNA, 20 nt, Mycobacterium avium subsp. paratuberculosis
ccacgggucggucggcccgc

SEQ ID NO: 2925299 - RNA, 20 nt, Mycobacterium avium subsp. paratuberculosis
ccacggguuggggccgcgga

SEQ ID NO: 2925300 - RNA, 15 nt, Mycobacterium avium subsp. paratuberculosis
ccacggucacagccg

SEQ ID NO: 2925301 - RNA, 17 nt, Mycobacterium avium subsp. paratuberculosis
ccacggucacagccgcg

SEQ ID NO: 2925302 - RNA, 23 nt, Mycobacterium avium subsp. paratuberculosis
ccacggucacagccgcgauagcc

SEQ ID NO: 2925303 - RNA, 22 nt, Mycobacterium avium subsp. paratuberculosis
ccacggucaccccgaguucggc

SEQ ID NO: 2925304 - RNA, 16 nt, Mycobacterium avium subsp. paratuberculosis
ccacggucagcgcguc

SEQ ID NO: 2925305 - RNA, 16 nt, Mycobacterium avium subsp. paratuberculosis
ccacguugaugccgcc

SEQ ID NO: 2925306 - RNA, 21 nt, Mycobacterium avium subsp. paratuberculosis
ccacguugaugccgcccagca

SEQ ID NO: 2925307 - RNA, 19 nt, Mycobacterium avium subsp. paratuberculosis
ccacguugcgcccggccau

SEQ ID NO: 2925308 - RNA, 20 nt, Mycobacterium avium subsp. paratuberculosis
ccacuccaauacggcccggc

SEQ ID NO: 2925309 - RNA, 21 nt, Mycobacterium avium subsp. paratuberculosis
ccacuccaauacggcccggcg

SEQ ID NO: 2925310 - RNA, 22 nt, Mycobacterium avium subsp. paratuberculosis
ccacuccaauacggcccggcga

SEQ ID NO: 2925311 - RNA, 17 nt, Mycobacterium avium subsp. paratuberculosis
ccacuccaccaccggcc

SEQ ID NO: 2925312 - RNA, 18 nt, Mycobacterium avium subsp. paratuberculosis
ccacuccaccaccggccg

SEQ ID NO: 2925313 - RNA, 21 nt, Mycobacterium avium subsp. paratuberculosis
ccacuccaccaccggccgcgc

SEQ ID NO: 2925314 - RNA, 13 nt, Mycobacterium avium subsp. paratuberculosis
ccacuccagcacc

SEQ ID NO: 2925315 - RNA, 13 nt, Mycobacterium avium subsp. paratuberculosis
ccacucccagccg

SEQ ID NO: 2925316 - RNA, 16 nt, Mycobacterium avium subsp. paratuberculosis
ccacucccagccgccg

SEQ ID NO: 2925317 - RNA, 16 nt, Mycobacterium avium subsp. paratuberculosis
ccacuccgaggucagc

SEQ ID NO: 2925318 - RNA, 22 nt, Mycobacterium avium subsp. paratuberculosis
ccacuccgaggucagcgcguac

SEQ ID NO: 2925319 - RNA, 14 nt, Mycobacterium avium subsp. paratuberculosis
ccacucgccgcgaa

SEQ ID NO: 2925320 - RNA, 21 nt, Mycobacterium avium subsp. paratuberculosis
ccacucgccgcgaacgacgac

SEQ ID NO: 2925321 - RNA, 17 nt, Mycobacterium avium subsp. paratuberculosis
ccacucgccgugagaag

SEQ ID NO: 2925322 - RNA, 20 nt, Mycobacterium avium subsp. paratuberculosis
ccacucggacagguggccga

SEQ ID NO: 2925323 - RNA, 12 nt, Mycobacterium avium subsp. paratuberculosis
ccacucggccac

SEQ ID NO: 2925324 - RNA, 17 nt, Mycobacterium avium subsp. paratuberculosis
ccacucggccaccaugu

SEQ ID NO: 2925325 - RNA, 20 nt, Mycobacterium avium subsp. paratuberculosis
ccacucgggaaaugcgucgg

SEQ ID NO: 2925326 - RNA, 17 nt, Mycobacterium avium subsp. paratuberculosis
ccacucgggccagccca

SEQ ID NO: 2925327 - RNA, 18 nt, Mycobacterium avium subsp. paratuberculosis
ccacucgggccagcccau

SEQ ID NO: 2925328 - RNA, 14 nt, Mycobacterium avium subsp. paratuberculosis
ccacucgggcggcc

SEQ ID NO: 2925329 - RNA, 19 nt, Mycobacterium avium subsp. paratuberculosis
ccacucgggcggccgcgga

SEQ ID NO: 2925330 - RNA, 15 nt, Mycobacterium avium subsp. paratuberculosis
ccacucgucgacguu

SEQ ID NO: 2925331 - RNA, 20 nt, Mycobacterium avium subsp. paratuberculosis
ccacucgucgaucgacgccg

SEQ ID NO: 2925332 - RNA, 21 nt, Mycobacterium avium subsp. paratuberculosis
ccacucgucgaucgacgccga

SEQ ID NO: 2925333 - RNA, 17 nt, Mycobacterium avium subsp. paratuberculosis
ccacucgucgaugucga

SEQ ID NO: 2925334 - RNA, 13 nt, Mycobacterium avium subsp. paratuberculosis
ccacugagcgcag

SEQ ID NO: 2925335 - RNA, 16 nt, Mycobacterium avium subsp. paratuberculosis
ccacugauccgucauc

SEQ ID NO: 2925336 - RNA, 22 nt, Mycobacterium avium subsp. paratuberculosis
ccacugauccgucaucucguca

SEQ ID NO: 2925337 - RNA, 17 nt, Mycobacterium avium subsp. paratuberculosis
ccacugccaagacgucc

SEQ ID NO: 2925338 - RNA, 15 nt, Mycobacterium avium subsp. paratuberculosis
ccacugccgccgccc

SEQ ID NO: 2925339 - RNA, 16 nt, Mycobacterium avium subsp. paratuberculosis
ccacugccgccgccca

SEQ ID NO: 2925340 - RNA, 17 nt, Mycobacterium avium subsp. paratuberculosis
ccacugccgccgcccag

SEQ ID NO: 2925341 - RNA, 18 nt, Mycobacterium avium subsp. paratuberculosis
ccacugccugacccggcc

SEQ ID NO: 2925342 - RNA, 22 nt, Mycobacterium avium subsp. paratuberculosis
ccacugcgccgucaucgacacc

SEQ ID NO: 2925343 - RNA, 15 nt, Mycobacterium avium subsp. paratuberculosis
ccacugcgcgcccga

SEQ ID NO: 2925344 - RNA, 16 nt, Mycobacterium avium subsp. paratuberculosis
ccacugcggcagaccg

SEQ ID NO: 2925345 - RNA, 14 nt, Mycobacterium avium subsp. paratuberculosis
ccacuggcgccacc

SEQ ID NO: 2925346 - RNA, 20 nt, Mycobacterium avium subsp. paratuberculosis
ccacuggcggccggccgcgc

SEQ ID NO: 2925347 - RNA, 18 nt, Mycobacterium avium subsp. paratuberculosis
ccacugggcgucggcgcc

SEQ ID NO: 2925348 - RNA, 19 nt, Mycobacterium avium subsp. paratuberculosis
ccacugggcgucggcgccc

SEQ ID NO: 2925349 - RNA, 22 nt, Mycobacterium avium subsp. paratuberculosis
ccacugggcgucggcgcccccc

SEQ ID NO: 2925350 - RNA, 19 nt, Mycobacterium avium subsp. paratuberculosis
ccacugguaaccgcccgag

SEQ ID NO: 2925351 - RNA, 15 nt, Mycobacterium avium subsp. paratuberculosis
ccacuuccagcaccg

SEQ ID NO: 2925352 - RNA, 17 nt, Mycobacterium avium subsp. paratuberculosis
ccacuuccuucuugggc

SEQ ID NO: 2925353 - RNA, 17 nt, Mycobacterium avium subsp. paratuberculosis
ccacuucgacggcagcg

SEQ ID NO: 2925354 - RNA, 17 nt, Mycobacterium avium subsp. paratuberculosis
ccacuucuccacgccga

SEQ ID NO: 2925355 - RNA, 21 nt, Mycobacterium avium subsp. paratuberculosis
ccacuucuccacgccgacgaa

SEQ ID NO: 2925356 - RNA, 14 nt, Mycobacterium avium subsp. paratuberculosis
ccacuucuggcgcu

SEQ ID NO: 2925357 - RNA, 18 nt, Mycobacterium avium subsp. paratuberculosis
ccacuucuggcgcugcuc

SEQ ID NO: 2925358 - RNA, 15 nt, Mycobacterium avium subsp. paratuberculosis
ccacuugaaggaggc

SEQ ID NO: 2925359 - RNA, 22 nt, Mycobacterium avium subsp. paratuberculosis
ccacuugcccagauugcggccc

SEQ ID NO: 2925360 - RNA, 14 nt, Mycobacterium avium subsp. paratuberculosis
ccacuuguccacca

SEQ ID NO: 2925361 - RNA, 19 nt, Mycobacterium avium subsp. paratuberculosis
ccagaaacgacaucacgaa

SEQ ID NO: 2925362 - RNA, 14 nt, Mycobacterium avium subsp. paratuberculosis
ccagaaaucgccgg

SEQ ID NO: 2925363 - RNA, 15 nt, Mycobacterium avium subsp. paratuberculosis
ccagaaaucgccggg

SEQ ID NO: 2925364 - RNA, 17 nt, Mycobacterium avium subsp. paratuberculosis
ccagaacacguuucggc

SEQ ID NO: 2925365 - RNA, 23 nt, Mycobacterium avium subsp. paratuberculosis
ccagaacacguuucggcccucca

SEQ ID NO: 2925366 - RNA, 14 nt, Mycobacterium avium subsp. paratuberculosis
ccagaacagccagu

SEQ ID NO: 2925367 - RNA, 14 nt, Mycobacterium avium subsp. paratuberculosis
ccagaaccgcucgg

SEQ ID NO: 2925368 - RNA, 13 nt, Mycobacterium avium subsp. paratuberculosis
ccagaaccggcaa

SEQ ID NO: 2925369 - RNA, 23 nt, Mycobacterium avium subsp. paratuberculosis
ccagaaccggcaggacgggggcc

SEQ ID NO: 2925370 - RNA, 17 nt, Mycobacterium avium subsp. paratuberculosis
ccagaacggaauucagu

SEQ ID NO: 2925371 - RNA, 13 nt, Mycobacterium avium subsp. paratuberculosis
ccagaacggcggc

SEQ ID NO: 2925372 - RNA, 15 nt, Mycobacterium avium subsp. paratuberculosis
ccagaacggcggcag

SEQ ID NO: 2925373 - RNA, 13 nt, Mycobacterium avium subsp. paratuberculosis
ccagaacucggcg

SEQ ID NO: 2925374 - RNA, 15 nt, Mycobacterium avium subsp. paratuberculosis
ccagaacugggccgc

SEQ ID NO: 2925375 - RNA, 16 nt, Mycobacterium avium subsp. paratuberculosis
ccagaacugggccgcc

SEQ ID NO: 2925376 - RNA, 21 nt, Mycobacterium avium subsp. paratuberculosis
ccagaacugggccgccgucgc

SEQ ID NO: 2925377 - RNA, 23 nt, Mycobacterium avium subsp. paratuberculosis
ccagaacugggccgccgucgcca

SEQ ID NO: 2925378 - RNA, 21 nt, Mycobacterium avium subsp. paratuberculosis
ccagaacugguccuccaacgg

SEQ ID NO: 2925379 - RNA, 21 nt, Mycobacterium avium subsp. paratuberculosis
ccagaagaucugccggugccg

SEQ ID NO: 2925380 - RNA, 16 nt, Mycobacterium avium subsp. paratuberculosis
ccagaaguggucgauc

SEQ ID NO: 2925381 - RNA, 21 nt, Mycobacterium avium subsp. paratuberculosis
ccagaauucgccggggcacca

SEQ ID NO: 2925382 - RNA, 15 nt, Mycobacterium avium subsp. paratuberculosis
ccagacaggccggcc

SEQ ID NO: 2925383 - RNA, 18 nt, Mycobacterium avium subsp. paratuberculosis
ccagacaggccggccgcu

SEQ ID NO: 2925384 - RNA, 20 nt, Mycobacterium avium subsp. paratuberculosis
ccagaccgaagaucaccgcg

SEQ ID NO: 2925385 - RNA, 22 nt, Mycobacterium avium subsp. paratuberculosis
ccagaccgcacaauccggucag

SEQ ID NO: 2925386 - RNA, 13 nt, Mycobacterium avium subsp. paratuberculosis
ccagaccggccgg

SEQ ID NO: 2925387 - RNA, 14 nt, Mycobacterium avium subsp. paratuberculosis
ccagaccggccggg

SEQ ID NO: 2925388 - RNA, 16 nt, Mycobacterium avium subsp. paratuberculosis
ccagaccggccggggc

SEQ ID NO: 2925389 - RNA, 22 nt, Mycobacterium avium subsp. paratuberculosis
ccagaccggccggggcgggcac

SEQ ID NO: 2925390 - RNA, 19 nt, Mycobacterium avium subsp. paratuberculosis
ccagcaaacccagcaccaa

SEQ ID NO: 2925391 - RNA, 14 nt, Mycobacterium avium subsp. paratuberculosis
ccagcaacaccagc

SEQ ID NO: 2925392 - RNA, 15 nt, Mycobacterium avium subsp. paratuberculosis
ccagcaacaccagcu

SEQ ID NO: 2925393 - RNA, 16 nt, Mycobacterium avium subsp. paratuberculosis
ccagcaacaccagcug

SEQ ID NO: 2925394 - RNA, 18 nt, Mycobacterium avium subsp. paratuberculosis
ccagcaacaccagcugga

SEQ ID NO: 2925395 - RNA, 18 nt, Mycobacterium avium subsp. paratuberculosis
ccagcaacaccagggugc

SEQ ID NO: 2925396 - RNA, 19 nt, Mycobacterium avium subsp. paratuberculosis
ccagcaacacccagccgcu

SEQ ID NO: 2925397 - RNA, 21 nt, Mycobacterium avium subsp. paratuberculosis
ccagcaacacccagccgcuga

SEQ ID NO: 2925398 - RNA, 15 nt, Mycobacterium avium subsp. paratuberculosis
ccagcaacagcagcg

SEQ ID NO: 2925399 - RNA, 16 nt, Mycobacterium avium subsp. paratuberculosis
ccagcaacagcagcgg

SEQ ID NO: 2925400 - RNA, 13 nt, Mycobacterium avium subsp. paratuberculosis
ccagcaaccccgc

SEQ ID NO: 2925401 - RNA, 14 nt, Mycobacterium avium subsp. paratuberculosis
ccagcaaccgccgu

SEQ ID NO: 2925402 - RNA, 23 nt, Mycobacterium avium subsp. paratuberculosis
ccagcaaccgccguggcagggcc

SEQ ID NO: 2925403 - RNA, 22 nt, Mycobacterium avium subsp. paratuberculosis
ccagcaaccggaauggcagcag

SEQ ID NO: 2925404 - RNA, 15 nt, Mycobacterium avium subsp. paratuberculosis
ccagcaacgacccgg

SEQ ID NO: 2925405 - RNA, 16 nt, Mycobacterium avium subsp. paratuberculosis
ccagcaacgacccggc

SEQ ID NO: 2925406 - RNA, 18 nt, Mycobacterium avium subsp. paratuberculosis
ccagcaacgacccggcca

SEQ ID NO: 2925407 - RNA, 22 nt, Mycobacterium avium subsp. paratuberculosis
ccagcaacgacccggccaccgc

SEQ ID NO: 2925408 - RNA, 23 nt, Mycobacterium avium subsp. paratuberculosis
ccagcaacgacccggccaccgcc

SEQ ID NO: 2925409 - RNA, 20 nt, Mycobacterium avium subsp. paratuberculosis
ccagcaacugcucgaccagc

SEQ ID NO: 2925410 - RNA, 22 nt, Mycobacterium avium subsp. paratuberculosis
ccagcaacugcucgaccagccc

SEQ ID NO: 2925411 - RNA, 14 nt, Mycobacterium avium subsp. paratuberculosis
ccagcacaacgccu

SEQ ID NO: 2925412 - RNA, 22 nt, Mycobacterium avium subsp. paratuberculosis
ccagcacacccucgacccguuc

SEQ ID NO: 2925413 - RNA, 17 nt, Mycobacterium avium subsp. paratuberculosis
ccagcacaccggaucgg

SEQ ID NO: 2925414 - RNA, 22 nt, Mycobacterium avium subsp. paratuberculosis
ccagcacaccggaucggcugcg

SEQ ID NO: 2925415 - RNA, 14 nt, Mycobacterium avium subsp. paratuberculosis
ccagcacagcgagg

SEQ ID NO: 2925416 - RNA, 18 nt, Mycobacterium avium subsp. paratuberculosis
ccagcacagcgaggcgac

SEQ ID NO: 2925417 - RNA, 21 nt, Mycobacterium avium subsp. paratuberculosis
ccagcacauagcgcagcucua

SEQ ID NO: 2925418 - RNA, 17 nt, Mycobacterium avium subsp. paratuberculosis
ccagcaccaacagcggc

SEQ ID NO: 2925419 - RNA, 20 nt, Mycobacterium avium subsp. paratuberculosis
ccagcaccaacagcggcccg

SEQ ID NO: 2925420 - RNA, 12 nt, Mycobacterium avium subsp. paratuberculosis
ccagcaccacca

SEQ ID NO: 2925421 - RNA, 14 nt, Mycobacterium avium subsp. paratuberculosis
ccagcaccaccaac

SEQ ID NO: 2925422 - RNA, 23 nt, Mycobacterium avium subsp. paratuberculosis
ccagcaccaccaacggcucgccg

SEQ ID NO: 2925423 - RNA, 22 nt, Mycobacterium avium subsp. paratuberculosis
ccagcaccaccacguugcgcgg

SEQ ID NO: 2925424 - RNA, 13 nt, Mycobacterium avium subsp. paratuberculosis
ccagcaccacccg

SEQ ID NO: 2925425 - RNA, 12 nt, Mycobacterium avium subsp. paratuberculosis
ccagcaccaccg

SEQ ID NO: 2925426 - RNA, 13 nt, Mycobacterium avium subsp. paratuberculosis
ccagcaccaccgc

SEQ ID NO: 2925427 - RNA, 14 nt, Mycobacterium avium subsp. paratuberculosis
ccagcaccaccgcg

SEQ ID NO: 2925428 - RNA, 15 nt, Mycobacterium avium subsp. paratuberculosis
ccagcaccaccgcga

SEQ ID NO: 2925429 - RNA, 20 nt, Mycobacterium avium subsp. paratuberculosis
ccagcaccaccgucaccgcc

SEQ ID NO: 2925430 - RNA, 22 nt, Mycobacterium avium subsp. paratuberculosis
ccagcaccaccgucaccgccgc

SEQ ID NO: 2925431 - RNA, 14 nt, Mycobacterium avium subsp. paratuberculosis
ccagcaccaccgug

SEQ ID NO: 2925432 - RNA, 16 nt, Mycobacterium avium subsp. paratuberculosis
ccagcaccaccguggc

SEQ ID NO: 2925433 - RNA, 23 nt, Mycobacterium avium subsp. paratuberculosis
ccagcaccaccucgcgcggggcg

SEQ ID NO: 2925434 - RNA, 13 nt, Mycobacterium avium subsp. paratuberculosis
ccagcaccagcac

SEQ ID NO: 2925435 - RNA, 15 nt, Mycobacterium avium subsp. paratuberculosis
ccagcaccagcacgg

SEQ ID NO: 2925436 - RNA, 18 nt, Mycobacterium avium subsp. paratuberculosis
ccagcaccagcacggcga

SEQ ID NO: 2925437 - RNA, 19 nt, Mycobacterium avium subsp. paratuberculosis
ccagcaccagcagccgguc

SEQ ID NO: 2925438 - RNA, 13 nt, Mycobacterium avium subsp. paratuberculosis
ccagcaccagccc

SEQ ID NO: 2925439 - RNA, 16 nt, Mycobacterium avium subsp. paratuberculosis
ccagcaccagcccgau

SEQ ID NO: 2925440 - RNA, 14 nt, Mycobacterium avium subsp. paratuberculosis
ccagcaccagcgcg

SEQ ID NO: 2925441 - RNA, 15 nt, Mycobacterium avium subsp. paratuberculosis
ccagcaccagcgcgc

SEQ ID NO: 2925442 - RNA, 14 nt, Mycobacterium avium subsp. paratuberculosis
ccagcaccagcgug

SEQ ID NO: 2925443 - RNA, 12 nt, Mycobacterium avium subsp. paratuberculosis
ccagcaccaggc

SEQ ID NO: 2925444 - RNA, 19 nt, Mycobacterium avium subsp. paratuberculosis
ccagcaccauccagugcag

SEQ ID NO: 2925445 - RNA, 13 nt, Mycobacterium avium subsp. paratuberculosis
ccagcacccagca

SEQ ID NO: 2925446 - RNA, 18 nt, Mycobacterium avium subsp. paratuberculosis
ccagcacccagcacagcg

SEQ ID NO: 2925447 - RNA, 19 nt, Mycobacterium avium subsp. paratuberculosis
ccagcacccagcacagcga

SEQ ID NO: 2925448 - RNA, 13 nt, Mycobacterium avium subsp. paratuberculosis
ccagcaccccgcc

SEQ ID NO: 2925449 - RNA, 15 nt, Mycobacterium avium subsp. paratuberculosis
ccagcaccccgccgc

SEQ ID NO: 2925450 - RNA, 17 nt, Mycobacterium avium subsp. paratuberculosis
ccagcaccccgccgcag

SEQ ID NO: 2925451 - RNA, 18 nt, Mycobacterium avium subsp. paratuberculosis
ccagcaccccgccgcagc

SEQ ID NO: 2925452 - RNA, 17 nt, Mycobacterium avium subsp. paratuberculosis
ccagcaccccgguccag

SEQ ID NO: 2925453 - RNA, 17 nt, Mycobacterium avium subsp. paratuberculosis
ccagcacccgcaacgcg

SEQ ID NO: 2925454 - RNA, 18 nt, Mycobacterium avium subsp. paratuberculosis
ccagcacccgcaacgcgc

SEQ ID NO: 2925455 - RNA, 20 nt, Mycobacterium avium subsp. paratuberculosis
ccagcacccgcucgccgaug

SEQ ID NO: 2925456 - RNA, 23 nt, Mycobacterium avium subsp. paratuberculosis
ccagcacccgcucgccgaugacg

SEQ ID NO: 2925457 - RNA, 21 nt, Mycobacterium avium subsp. paratuberculosis
ccagcacccgcucgcgggccc

SEQ ID NO: 2925458 - RNA, 20 nt, Mycobacterium avium subsp. paratuberculosis
ccagcacccgcugauccagc

SEQ ID NO: 2925459 - RNA, 18 nt, Mycobacterium avium subsp. paratuberculosis
ccagcacccggcccacgc

SEQ ID NO: 2925460 - RNA, 13 nt, Mycobacterium avium subsp. paratuberculosis
ccagcacccgggc

SEQ ID NO: 2925461 - RNA, 14 nt, Mycobacterium avium subsp. paratuberculosis
ccagcacccgggcc

SEQ ID NO: 2925462 - RNA, 17 nt, Mycobacterium avium subsp. paratuberculosis
ccagcacccggucggug

SEQ ID NO: 2925463 - RNA, 23 nt, Mycobacterium avium subsp. paratuberculosis
ccagcacccgguuccaccgggcc

SEQ ID NO: 2925464 - RNA, 15 nt, Mycobacterium avium subsp. paratuberculosis
ccagcaccgacgcgc

SEQ ID NO: 2925465 - RNA, 23 nt, Mycobacterium avium subsp. paratuberculosis
ccagcaccgagaucucgucgaug

SEQ ID NO: 2925466 - RNA, 16 nt, Mycobacterium avium subsp. paratuberculosis
ccagcaccgaguugau

SEQ ID NO: 2925467 - RNA, 14 nt, Mycobacterium avium subsp. paratuberculosis
ccagcaccgccacc

SEQ ID NO: 2925468 - RNA, 16 nt, Mycobacterium avium subsp. paratuberculosis
ccagcaccgccaccgg

SEQ ID NO: 2925469 - RNA, 17 nt, Mycobacterium avium subsp. paratuberculosis
ccagcaccgccaccggc

SEQ ID NO: 2925470 - RNA, 18 nt, Mycobacterium avium subsp. paratuberculosis
ccagcaccgccaccggcc

SEQ ID NO: 2925471 - RNA, 20 nt, Mycobacterium avium subsp. paratuberculosis
ccagcaccgccacgucgaac

SEQ ID NO: 2925472 - RNA, 13 nt, Mycobacterium avium subsp. paratuberculosis
ccagcaccgccag

SEQ ID NO: 2925473 - RNA, 23 nt, Mycobacterium avium subsp. paratuberculosis
ccagcaccgccagcgccggcagc

SEQ ID NO: 2925474 - RNA, 12 nt, Mycobacterium avium subsp. paratuberculosis
ccagcaccgccc

SEQ ID NO: 2925475 - RNA, 22 nt, Mycobacterium avium subsp. paratuberculosis
ccagcacggucagcggccagcc

SEQ ID NO: 2925476 - RNA, 20 nt, Mycobacterium avium subsp. paratuberculosis
ccagcacggucccguccauc

SEQ ID NO: 2925477 - RNA, 13 nt, Mycobacterium avium subsp. paratuberculosis
ccagcacgucacc

SEQ ID NO: 2925478 - RNA, 19 nt, Mycobacterium avium subsp. paratuberculosis
ccagcacgugaugcagcug

SEQ ID NO: 2925479 - RNA, 19 nt, Mycobacterium avium subsp. paratuberculosis
ccagcacgugcccagcccg

SEQ ID NO: 2925480 - RNA, 20 nt, Mycobacterium avium subsp. paratuberculosis
ccagcacgugcccagcccgc

SEQ ID NO: 2925481 - RNA, 23 nt, Mycobacterium avium subsp. paratuberculosis
ccagcacgugcccagcccgcgcg

SEQ ID NO: 2925482 - RNA, 17 nt, Mycobacterium avium subsp. paratuberculosis
ccagcacguggccgggc

SEQ ID NO: 2925483 - RNA, 11 nt, Mycobacterium avium subsp. paratuberculosis
ccagcacguug

SEQ ID NO: 2925484 - RNA, 16 nt, Mycobacterium avium subsp. paratuberculosis
ccagcagauacuccuc

SEQ ID NO: 2925485 - RNA, 17 nt, Mycobacterium avium subsp. paratuberculosis
ccagcagauagcccagc

SEQ ID NO: 2925486 - RNA, 18 nt, Mycobacterium avium subsp. paratuberculosis
ccagcagauagcccagcc

SEQ ID NO: 2925487 - RNA, 19 nt, Mycobacterium avium subsp. paratuberculosis
ccagcagauagcccagcca

SEQ ID NO: 2925488 - RNA, 16 nt, Mycobacterium avium subsp. paratuberculosis
ccagcagaugccgccc

SEQ ID NO: 2925489 - RNA, 12 nt, Mycobacterium avium subsp. paratuberculosis
ccagcagcacca

SEQ ID NO: 2925490 - RNA, 14 nt, Mycobacterium avium subsp. paratuberculosis
ccagcagcaccaga

SEQ ID NO: 2925491 - RNA, 19 nt, Mycobacterium avium subsp. paratuberculosis
ccagcagcaccagaugcac

SEQ ID NO: 2925492 - RNA, 17 nt, Mycobacterium avium subsp. paratuberculosis
ccagcagcaccagggcg

SEQ ID NO: 2925493 - RNA, 19 nt, Mycobacterium avium subsp. paratuberculosis
ccagcagcaccgcgaccgg

SEQ ID NO: 2925494 - RNA, 20 nt, Mycobacterium avium subsp. paratuberculosis
ccagcagcaccgcgaccggu

SEQ ID NO: 2925495 - RNA, 15 nt, Mycobacterium avium subsp. paratuberculosis
ccagcagcaccgcgu

SEQ ID NO: 2925496 - RNA, 12 nt, Mycobacterium avium subsp. paratuberculosis
ccagcagcaccu

SEQ ID NO: 2925497 - RNA, 21 nt, Mycobacterium avium subsp. paratuberculosis
ccagcagcagcaggucgucga

SEQ ID NO: 2925498 - RNA, 13 nt, Mycobacterium avium subsp. paratuberculosis
ccagcagcagccc

SEQ ID NO: 2925499 - RNA, 14 nt, Mycobacterium avium subsp. paratuberculosis
ccagcagcagcccg

SEQ ID NO: 2925500 - RNA, 19 nt, Mycobacterium avium subsp. paratuberculosis
ccagcagcagcccgccgau

SEQ ID NO: 2925501 - RNA, 16 nt, Mycobacterium avium subsp. paratuberculosis
ccagcagcagccgcgc

SEQ ID NO: 2925502 - RNA, 17 nt, Mycobacterium avium subsp. paratuberculosis
ccagcagcagccgcgcc

SEQ ID NO: 2925503 - RNA, 18 nt, Mycobacterium avium subsp. paratuberculosis
ccagcagcagccgcgccg

SEQ ID NO: 2925504 - RNA, 13 nt, Mycobacterium avium subsp. paratuberculosis
ccagcagcagcgc

SEQ ID NO: 2925505 - RNA, 14 nt, Mycobacterium avium subsp. paratuberculosis
ccagcagcagcgcc

SEQ ID NO: 2925506 - RNA, 18 nt, Mycobacterium avium subsp. paratuberculosis
ccagcagcagcgccgcca

SEQ ID NO: 2925507 - RNA, 16 nt, Mycobacterium avium subsp. paratuberculosis
ccagcagcagcgcggc

SEQ ID NO: 2925508 - RNA, 17 nt, Mycobacterium avium subsp. paratuberculosis
ccagcagcagcgcggca

SEQ ID NO: 2925509 - RNA, 9 nt, Mycobacterium avium subsp. paratuberculosis
ccagcagcc

SEQ ID NO: 2925510 - RNA, 13 nt, Mycobacterium avium subsp. paratuberculosis
ccagcagccagcc

SEQ ID NO: 2925511 - RNA, 15 nt, Mycobacterium avium subsp. paratuberculosis
ccagcagccagccca

SEQ ID NO: 2925512 - RNA, 18 nt, Mycobacterium avium subsp. paratuberculosis
ccagcagccagcccagcc

SEQ ID NO: 2925513 - RNA, 19 nt, Mycobacterium avium subsp. paratuberculosis
ccagcagccagcccagccg

SEQ ID NO: 2925514 - RNA, 15 nt, Mycobacterium avium subsp. paratuberculosis
ccagcagccagcugg

SEQ ID NO: 2925515 - RNA, 13 nt, Mycobacterium avium subsp. paratuberculosis
ccagcagcccggc

SEQ ID NO: 2925516 - RNA, 18 nt, Mycobacterium avium subsp. paratuberculosis
ccagcagcccggccagcc

SEQ ID NO: 2925517 - RNA, 19 nt, Mycobacterium avium subsp. paratuberculosis
ccagcagcccggccagccg

SEQ ID NO: 2925518 - RNA, 22 nt, Mycobacterium avium subsp. paratuberculosis
ccagcagcccggccagccgggc

SEQ ID NO: 2925519 - RNA, 14 nt, Mycobacterium avium subsp. paratuberculosis
ccagcagcccgggc

SEQ ID NO: 2925520 - RNA, 18 nt, Mycobacterium avium subsp. paratuberculosis
ccagcagcccgggcugca

SEQ ID NO: 2925521 - RNA, 14 nt, Mycobacterium avium subsp. paratuberculosis
ccagcagcccgggu

SEQ ID NO: 2925522 - RNA, 13 nt, Mycobacterium avium subsp. paratuberculosis
ccagcagccgcag

SEQ ID NO: 2925523 - RNA, 14 nt, Mycobacterium avium subsp. paratuberculosis
ccagcagccgcagc

SEQ ID NO: 2925524 - RNA, 12 nt, Mycobacterium avium subsp. paratuberculosis
ccagcagccgcg

SEQ ID NO: 2925525 - RNA, 13 nt, Mycobacterium avium subsp. paratuberculosis
ccagcagccgcgc

SEQ ID NO: 2925526 - RNA, 23 nt, Mycobacterium avium subsp. paratuberculosis
ccagcagccgcgcgagcaucacc

SEQ ID NO: 2925527 - RNA, 12 nt, Mycobacterium avium subsp. paratuberculosis
ccagcagccgcu

SEQ ID NO: 2925528 - RNA, 13 nt, Mycobacterium avium subsp. paratuberculosis
ccagcagccgggu

SEQ ID NO: 2925529 - RNA, 14 nt, Mycobacterium avium subsp. paratuberculosis
ccagcagccgguac

SEQ ID NO: 2925530 - RNA, 16 nt, Mycobacterium avium subsp. paratuberculosis
ccagcagccgguacag

SEQ ID NO: 2925531 - RNA, 15 nt, Mycobacterium avium subsp. paratuberculosis
ccagcagccugcccc

SEQ ID NO: 2925532 - RNA, 16 nt, Mycobacterium avium subsp. paratuberculosis
ccagcagccugccccc

SEQ ID NO: 2925533 - RNA, 21 nt, Mycobacterium avium subsp. paratuberculosis
ccagcagcgagaaccggcgca

SEQ ID NO: 2925534 - RNA, 17 nt, Mycobacterium avium subsp. paratuberculosis
ccagcagcgcaccggcg

SEQ ID NO: 2925535 - RNA, 13 nt, Mycobacterium avium subsp. paratuberculosis
ccagcagcgccac

SEQ ID NO: 2925536 - RNA, 16 nt, Mycobacterium avium subsp. paratuberculosis
ccagcagcgccagcac

SEQ ID NO: 2925537 - RNA, 24 nt, Mycobacterium avium subsp. paratuberculosis
ccagcagcgccgcuucgucgccgg

SEQ ID NO: 2925538 - RNA, 17 nt, Mycobacterium avium subsp. paratuberculosis
ccagcagcgccggcagc

SEQ ID NO: 2925539 - RNA, 14 nt, Mycobacterium avium subsp. paratuberculosis
ccagcagcgccucg

SEQ ID NO: 2925540 - RNA, 15 nt, Mycobacterium avium subsp. paratuberculosis
ccagcagcgccucgg

SEQ ID NO: 2925541 - RNA, 13 nt, Mycobacterium avium subsp. paratuberculosis
ccagcagcgccuu

SEQ ID NO: 2925542 - RNA, 15 nt, Mycobacterium avium subsp. paratuberculosis
ccagcagcgccuugc

SEQ ID NO: 2925543 - RNA, 19 nt, Mycobacterium avium subsp. paratuberculosis
ccagcagcgccuugccgac

SEQ ID NO: 2925544 - RNA, 19 nt, Mycobacterium avium subsp. paratuberculosis
ccagcagcgcgacgccgac

SEQ ID NO: 2925545 - RNA, 22 nt, Mycobacterium avium subsp. paratuberculosis
ccagcagcgcgacgccgacgcc

SEQ ID NO: 2925546 - RNA, 23 nt, Mycobacterium avium subsp. paratuberculosis
ccagcagcgcgacgccgacgccc

SEQ ID NO: 2925547 - RNA, 13 nt, Mycobacterium avium subsp. paratuberculosis
ccagcagcgcggc

SEQ ID NO: 2925548 - RNA, 15 nt, Mycobacterium avium subsp. paratuberculosis
ccagcagcgcggcga

SEQ ID NO: 2925549 - RNA, 12 nt, Mycobacterium avium subsp. paratuberculosis
ccagcagcggca

SEQ ID NO: 2925550 - RNA, 16 nt, Mycobacterium avium subsp. paratuberculosis
ccagcagcggcacccg

SEQ ID NO: 2925551 - RNA, 17 nt, Mycobacterium avium subsp. paratuberculosis
ccagcagcggcacccgg

SEQ ID NO: 2925552 - RNA, 22 nt, Mycobacterium avium subsp. paratuberculosis
ccagcagcggcaguagcgcacc

SEQ ID NO: 2925553 - RNA, 19 nt, Mycobacterium avium subsp. paratuberculosis
ccagcagcggccggcgcag

SEQ ID NO: 2925554 - RNA, 20 nt, Mycobacterium avium subsp. paratuberculosis
ccagcagcggcuuggucacc

SEQ ID NO: 2925555 - RNA, 23 nt, Mycobacterium avium subsp. paratuberculosis
ccagcagcggcuuggucaccagc

SEQ ID NO: 2925556 - RNA, 19 nt, Mycobacterium avium subsp. paratuberculosis
ccagcagcgggcccgggcu

SEQ ID NO: 2925557 - RNA, 22 nt, Mycobacterium avium subsp. paratuberculosis
ccagcagcgggcccgggcugcc

SEQ ID NO: 2925558 - RNA, 22 nt, Mycobacterium avium subsp. paratuberculosis
ccagcagcggggcgagcuggcc

SEQ ID NO: 2925559 - RNA, 15 nt, Mycobacterium avium subsp. paratuberculosis
ccagcagcggggugu

SEQ ID NO: 2925560 - RNA, 20 nt, Mycobacterium avium subsp. paratuberculosis
ccagccagcgcgcgaucagc

SEQ ID NO: 2925561 - RNA, 13 nt, Mycobacterium avium subsp. paratuberculosis
ccagccaggccgc

SEQ ID NO: 2925562 - RNA, 15 nt, Mycobacterium avium subsp. paratuberculosis
ccagccaggccgccg

SEQ ID NO: 2925563 - RNA, 20 nt, Mycobacterium avium subsp. paratuberculosis
ccagccaggccgccgggccg

SEQ ID NO: 2925564 - RNA, 23 nt, Mycobacterium avium subsp. paratuberculosis
ccagccaguugggggccagcgcc

SEQ ID NO: 2925565 - RNA, 15 nt, Mycobacterium avium subsp. paratuberculosis
ccagccauacugacg

SEQ ID NO: 2925566 - RNA, 21 nt, Mycobacterium avium subsp. paratuberculosis
ccagccauacugacgccgguc

SEQ ID NO: 2925567 - RNA, 23 nt, Mycobacterium avium subsp. paratuberculosis
ccagccauacugacgccggucgc

SEQ ID NO: 2925568 - RNA, 14 nt, Mycobacterium avium subsp. paratuberculosis
ccagccaucugcug

SEQ ID NO: 2925569 - RNA, 15 nt, Mycobacterium avium subsp. paratuberculosis
ccagcccauguccag

SEQ ID NO: 2925570 - RNA, 12 nt, Mycobacterium avium subsp. paratuberculosis
ccagccccacca

SEQ ID NO: 2925571 - RNA, 13 nt, Mycobacterium avium subsp. paratuberculosis
ccagccccaccac

SEQ ID NO: 2925572 - RNA, 14 nt, Mycobacterium avium subsp. paratuberculosis
ccagccccaccacc

SEQ ID NO: 2925573 - RNA, 23 nt, Mycobacterium avium subsp. paratuberculosis
ccagccccaccaccgccaccagc

SEQ ID NO: 2925574 - RNA, 16 nt, Mycobacterium avium subsp. paratuberculosis
ccagccccaccggcca

SEQ ID NO: 2925575 - RNA, 18 nt, Mycobacterium avium subsp. paratuberculosis
ccagccccaccggccacu

SEQ ID NO: 2925576 - RNA, 13 nt, Mycobacterium avium subsp. paratuberculosis
ccagccccagcac

SEQ ID NO: 2925577 - RNA, 19 nt, Mycobacterium avium subsp. paratuberculosis
ccagccccagcacgaugac

SEQ ID NO: 2925578 - RNA, 14 nt, Mycobacterium avium subsp. paratuberculosis
ccagcccccgcggg

SEQ ID NO: 2925579 - RNA, 17 nt, Mycobacterium avium subsp. paratuberculosis
ccagcccccgcgggucg

SEQ ID NO: 2925580 - RNA, 22 nt, Mycobacterium avium subsp. paratuberculosis
ccagcccccgcgggucgucgac

SEQ ID NO: 2925581 - RNA, 21 nt, Mycobacterium avium subsp. paratuberculosis
ccagccccgggaaccagccca

SEQ ID NO: 2925582 - RNA, 14 nt, Mycobacterium avium subsp. paratuberculosis
ccagccccucgacc

SEQ ID NO: 2925583 - RNA, 22 nt, Mycobacterium avium subsp. paratuberculosis
ccagccccucgacguccaggcc

SEQ ID NO: 2925584 - RNA, 21 nt, Mycobacterium avium subsp. paratuberculosis
ccagccccuuguagcccuccg

SEQ ID NO: 2925585 - RNA, 14 nt, Mycobacterium avium subsp. paratuberculosis
ccagcccgagcacc

SEQ ID NO: 2925586 - RNA, 15 nt, Mycobacterium avium subsp. paratuberculosis
ccagcccgagcacca

SEQ ID NO: 2925587 - RNA, 17 nt, Mycobacterium avium subsp. paratuberculosis
ccagcccgagcaccagc

SEQ ID NO: 2925588 - RNA, 18 nt, Mycobacterium avium subsp. paratuberculosis
ccagcccgagcaccagcg

SEQ ID NO: 2925589 - RNA, 19 nt, Mycobacterium avium subsp. paratuberculosis
ccagcccgagcaccagcgg

SEQ ID NO: 2925590 - RNA, 18 nt, Mycobacterium avium subsp. paratuberculosis
ccagcccgaugccgccga

SEQ ID NO: 2925591 - RNA, 13 nt, Mycobacterium avium subsp. paratuberculosis
ccagcccgccgcg

SEQ ID NO: 2925592 - RNA, 12 nt, Mycobacterium avium subsp. paratuberculosis
ccagcccgccgg

SEQ ID NO: 2925593 - RNA, 14 nt, Mycobacterium avium subsp. paratuberculosis
ccagcccgccgggc

SEQ ID NO: 2925594 - RNA, 12 nt, Mycobacterium avium subsp. paratuberculosis
ccagcccgccgu

SEQ ID NO: 2925595 - RNA, 14 nt, Mycobacterium avium subsp. paratuberculosis
ccagcccgccgucg

SEQ ID NO: 2925596 - RNA, 16 nt, Mycobacterium avium subsp. paratuberculosis
ccagcccgccgucggc

SEQ ID NO: 2925597 - RNA, 15 nt, Mycobacterium avium subsp. paratuberculosis
ccagcccgcgccgag

SEQ ID NO: 2925598 - RNA, 19 nt, Mycobacterium avium subsp. paratuberculosis
ccagcccgcgcgagcgcag

SEQ ID NO: 2925599 - RNA, 14 nt, Mycobacterium avium subsp. paratuberculosis
ccagcccgcgggcg

SEQ ID NO: 2925600 - RNA, 16 nt, Mycobacterium avium subsp. paratuberculosis
ccagcccgcgggcggc

SEQ ID NO: 2925601 - RNA, 17 nt, Mycobacterium avium subsp. paratuberculosis
ccagcccggccagcggc

SEQ ID NO: 2925602 - RNA, 13 nt, Mycobacterium avium subsp. paratuberculosis
ccagcccggcccc

SEQ ID NO: 2925603 - RNA, 12 nt, Mycobacterium avium subsp. paratuberculosis
ccagcccggccg

SEQ ID NO: 2925604 - RNA, 14 nt, Mycobacterium avium subsp. paratuberculosis
ccagcccggccgcc

SEQ ID NO: 2925605 - RNA, 16 nt, Mycobacterium avium subsp. paratuberculosis
ccagcccggccgccga

SEQ ID NO: 2925606 - RNA, 15 nt, Mycobacterium avium subsp. paratuberculosis
ccagcccggcgacga

SEQ ID NO: 2925607 - RNA, 19 nt, Mycobacterium avium subsp. paratuberculosis
ccagcccggcgaugaucag

SEQ ID NO: 2925608 - RNA, 17 nt, Mycobacterium avium subsp. paratuberculosis
ccagcccggcguacagc

SEQ ID NO: 2925609 - RNA, 14 nt, Mycobacterium avium subsp. paratuberculosis
ccagcccggcgugc

SEQ ID NO: 2925610 - RNA, 16 nt, Mycobacterium avium subsp. paratuberculosis
ccagcccggcgugcag

SEQ ID NO: 2925611 - RNA, 13 nt, Mycobacterium avium subsp. paratuberculosis
ccagcccggcugg

SEQ ID NO: 2925612 - RNA, 21 nt, Mycobacterium avium subsp. paratuberculosis
ccagcccggcuggcaggucgc

SEQ ID NO: 2925613 - RNA, 21 nt, Mycobacterium avium subsp. paratuberculosis
ccagcccgggaaagcggguga

SEQ ID NO: 2925614 - RNA, 13 nt, Mycobacterium avium subsp. paratuberculosis
ccagcccgggggu

SEQ ID NO: 2925615 - RNA, 14 nt, Mycobacterium avium subsp. paratuberculosis
ccagcccgggggug

SEQ ID NO: 2925616 - RNA, 13 nt, Mycobacterium avium subsp. paratuberculosis
ccagcccggucac

SEQ ID NO: 2925617 - RNA, 21 nt, Mycobacterium avium subsp. paratuberculosis
ccagcccggucaccaucagca

SEQ ID NO: 2925618 - RNA, 20 nt, Mycobacterium avium subsp. paratuberculosis
ccagcccggugaucgccgcc

SEQ ID NO: 2925619 - RNA, 14 nt, Mycobacterium avium subsp. paratuberculosis
ccagcccgucggcc

SEQ ID NO: 2925620 - RNA, 23 nt, Mycobacterium avium subsp. paratuberculosis
ccagcccgucggccuccagccgg

SEQ ID NO: 2925621 - RNA, 15 nt, Mycobacterium avium subsp. paratuberculosis
ccagcccgucgggug

SEQ ID NO: 2925622 - RNA, 22 nt, Mycobacterium avium subsp. paratuberculosis
ccagcccgucguccuugagccc

SEQ ID NO: 2925623 - RNA, 20 nt, Mycobacterium avium subsp. paratuberculosis
ccagcccguggccagcgcca

SEQ ID NO: 2925624 - RNA, 21 nt, Mycobacterium avium subsp. paratuberculosis
ccagcccguggccagcgccag

SEQ ID NO: 2925625 - RNA, 21 nt, Mycobacterium avium subsp. paratuberculosis
ccagcccguugucgagcaccg

SEQ ID NO: 2925626 - RNA, 23 nt, Mycobacterium avium subsp. paratuberculosis
ccagcccguugucgagcaccgcg

SEQ ID NO: 2925627 - RNA, 19 nt, Mycobacterium avium subsp. paratuberculosis
ccagcccguuguggcggcc

SEQ ID NO: 2925628 - RNA, 20 nt, Mycobacterium avium subsp. paratuberculosis
ccagcccguuguggcggcca

SEQ ID NO: 2925629 - RNA, 22 nt, Mycobacterium avium subsp. paratuberculosis
ccagcccuacccguccagcgcg

SEQ ID NO: 2925630 - RNA, 23 nt, Mycobacterium avium subsp. paratuberculosis
ccagcccuacccguccagcgcga

SEQ ID NO: 2925631 - RNA, 14 nt, Mycobacterium avium subsp. paratuberculosis
ccagcccucgucga

SEQ ID NO: 2925632 - RNA, 16 nt, Mycobacterium avium subsp. paratuberculosis
ccagcccucgucgaug

SEQ ID NO: 2925633 - RNA, 17 nt, Mycobacterium avium subsp. paratuberculosis
ccagcccugcucggcca

SEQ ID NO: 2925634 - RNA, 21 nt, Mycobacterium avium subsp. paratuberculosis
ccagccgaaguuggcgucggg

SEQ ID NO: 2925635 - RNA, 23 nt, Mycobacterium avium subsp. paratuberculosis
ccagccgagaucgacccgcuccg

SEQ ID NO: 2925636 - RNA, 14 nt, Mycobacterium avium subsp. paratuberculosis
ccagccgagccggg

SEQ ID NO: 2925637 - RNA, 17 nt, Mycobacterium avium subsp. paratuberculosis
ccagccgagccgggcca

SEQ ID NO: 2925638 - RNA, 18 nt, Mycobacterium avium subsp. paratuberculosis
ccagccgagccgggccag

SEQ ID NO: 2925639 - RNA, 17 nt, Mycobacterium avium subsp. paratuberculosis
ccagccgaggcgcucgc

SEQ ID NO: 2925640 - RNA, 16 nt, Mycobacterium avium subsp. paratuberculosis
ccagccgaucgcggug

SEQ ID NO: 2925641 - RNA, 19 nt, Mycobacterium avium subsp. paratuberculosis
ccagccgaucgcggugcug

SEQ ID NO: 2925642 - RNA, 21 nt, Mycobacterium avium subsp. paratuberculosis
ccagccgaucgcggugcugca

SEQ ID NO: 2925643 - RNA, 21 nt, Mycobacterium avium subsp. paratuberculosis
ccagccgaugcgcccgcgcca

SEQ ID NO: 2925644 - RNA, 20 nt, Mycobacterium avium subsp. paratuberculosis
ccagccgcaccgcgaccguc

SEQ ID NO: 2925645 - RNA, 16 nt, Mycobacterium avium subsp. paratuberculosis
ccagccgugcggcggc

SEQ ID NO: 2925646 - RNA, 17 nt, Mycobacterium avium subsp. paratuberculosis
ccagccgugcggcggcg

SEQ ID NO: 2925647 - RNA, 18 nt, Mycobacterium avium subsp. paratuberculosis
ccagccgugcggcggcgg

SEQ ID NO: 2925648 - RNA, 20 nt, Mycobacterium avium subsp. paratuberculosis
ccagccgugggugucggcga

SEQ ID NO: 2925649 - RNA, 15 nt, Mycobacterium avium subsp. paratuberculosis
ccagccguucccggc

SEQ ID NO: 2925650 - RNA, 17 nt, Mycobacterium avium subsp. paratuberculosis
ccagccguucccggcag

SEQ ID NO: 2925651 - RNA, 18 nt, Mycobacterium avium subsp. paratuberculosis
ccagccguucgcgcacgg

SEQ ID NO: 2925652 - RNA, 22 nt, Mycobacterium avium subsp. paratuberculosis
ccagccguucgcgcacggcgcg

SEQ ID NO: 2925653 - RNA, 19 nt, Mycobacterium avium subsp. paratuberculosis
ccagccguugggcagcucg

SEQ ID NO: 2925654 - RNA, 23 nt, Mycobacterium avium subsp. paratuberculosis
ccagccguugggcagcucggcgg

SEQ ID NO: 2925655 - RNA, 20 nt, Mycobacterium avium subsp. paratuberculosis
ccagccguuguugaggauca

SEQ ID NO: 2925656 - RNA, 15 nt, Mycobacterium avium subsp. paratuberculosis
ccagccuggcggcga

SEQ ID NO: 2925657 - RNA, 21 nt, Mycobacterium avium subsp. paratuberculosis
ccagccuugcagccgcugccg

SEQ ID NO: 2925658 - RNA, 20 nt, Mycobacterium avium subsp. paratuberculosis
ccagcgaauuguucugcuug

SEQ ID NO: 2925659 - RNA, 17 nt, Mycobacterium avium subsp. paratuberculosis
ccagcgacaacagcacg

SEQ ID NO: 2925660 - RNA, 18 nt, Mycobacterium avium subsp. paratuberculosis
ccagcgacaacagcacga

SEQ ID NO: 2925661 - RNA, 19 nt, Mycobacterium avium subsp. paratuberculosis
ccagcgacaacagcacgaa

SEQ ID NO: 2925662 - RNA, 15 nt, Mycobacterium avium subsp. paratuberculosis
ccagcgacaacgugg

SEQ ID NO: 2925663 - RNA, 18 nt, Mycobacterium avium subsp. paratuberculosis
ccagcgacaacguggugu

SEQ ID NO: 2925664 - RNA, 19 nt, Mycobacterium avium subsp. paratuberculosis
ccagcgacaacguggugug

SEQ ID NO: 2925665 - RNA, 14 nt, Mycobacterium avium subsp. paratuberculosis
ccagcgacagcacc

SEQ ID NO: 2925666 - RNA, 18 nt, Mycobacterium avium subsp. paratuberculosis
ccagcgaccgcaggucga

SEQ ID NO: 2925667 - RNA, 16 nt, Mycobacterium avium subsp. paratuberculosis
ccagcgacgccagcgg

SEQ ID NO: 2925668 - RNA, 13 nt, Mycobacterium avium subsp. paratuberculosis
ccagcgacggcag

SEQ ID NO: 2925669 - RNA, 18 nt, Mycobacterium avium subsp. paratuberculosis
ccagcgacggcaggucgg

SEQ ID NO: 2925670 - RNA, 22 nt, Mycobacterium avium subsp. paratuberculosis
ccagcgacggcaggucggugcg

SEQ ID NO: 2925671 - RNA, 13 nt, Mycobacterium avium subsp. paratuberculosis
ccagcgacggccg

SEQ ID NO: 2925672 - RNA, 14 nt, Mycobacterium avium subsp. paratuberculosis
ccagcgacggccgg

SEQ ID NO: 2925673 - RNA, 15 nt, Mycobacterium avium subsp. paratuberculosis
ccagcgacggccggg

SEQ ID NO: 2925674 - RNA, 16 nt, Mycobacterium avium subsp. paratuberculosis
ccagcgacggccgggu

SEQ ID NO: 2925675 - RNA, 20 nt, Mycobacterium avium subsp. paratuberculosis
ccagcgacggccgggucagg

SEQ ID NO: 2925676 - RNA, 21 nt, Mycobacterium avium subsp. paratuberculosis
ccagcgacggccgggucagga

SEQ ID NO: 2925677 - RNA, 20 nt, Mycobacterium avium subsp. paratuberculosis
ccagcgacucggccaggaug

SEQ ID NO: 2925678 - RNA, 22 nt, Mycobacterium avium subsp. paratuberculosis
ccagcgagaccgcuugcggcuc

SEQ ID NO: 2925679 - RNA, 13 nt, Mycobacterium avium subsp. paratuberculosis
ccagcgagcaggu

SEQ ID NO: 2925680 - RNA, 15 nt, Mycobacterium avium subsp. paratuberculosis
ccagcgagcagguca

SEQ ID NO: 2925681 - RNA, 16 nt, Mycobacterium avium subsp. paratuberculosis
ccagcgagcaggucac

SEQ ID NO: 2925682 - RNA, 14 nt, Mycobacterium avium subsp. paratuberculosis
ccagcgagcccagc

SEQ ID NO: 2925683 - RNA, 19 nt, Mycobacterium avium subsp. paratuberculosis
ccagcgagcccagcugcgc

SEQ ID NO: 2925684 - RNA, 21 nt, Mycobacterium avium subsp. paratuberculosis
ccagcgagcccuucgcggugu

SEQ ID NO: 2925685 - RNA, 22 nt, Mycobacterium avium subsp. paratuberculosis
ccagcgagcccuucgcggugug

SEQ ID NO: 2925686 - RNA, 13 nt, Mycobacterium avium subsp. paratuberculosis
ccagcgagccgau

SEQ ID NO: 2925687 - RNA, 15 nt, Mycobacterium avium subsp. paratuberculosis
ccagcgagccgauga

SEQ ID NO: 2925688 - RNA, 19 nt, Mycobacterium avium subsp. paratuberculosis
ccagcgagcucaggccggc

SEQ ID NO: 2925689 - RNA, 16 nt, Mycobacterium avium subsp. paratuberculosis
ccagcgagcugccggc

SEQ ID NO: 2925690 - RNA, 17 nt, Mycobacterium avium subsp. paratuberculosis
ccagcgagcugccggcg

SEQ ID NO: 2925691 - RNA, 19 nt, Mycobacterium avium subsp. paratuberculosis
ccagcgagcugccggcggc

SEQ ID NO: 2925692 - RNA, 20 nt, Mycobacterium avium subsp. paratuberculosis
ccagcgagcugccggcggcc

SEQ ID NO: 2925693 - RNA, 21 nt, Mycobacterium avium subsp. paratuberculosis
ccagcgagcugccggcggccg

SEQ ID NO: 2925694 - RNA, 22 nt, Mycobacterium avium subsp. paratuberculosis
ccagcgagcugccggcggccgc

SEQ ID NO: 2925695 - RNA, 23 nt, Mycobacterium avium subsp. paratuberculosis
ccagcgagcugccggcggccgcc

SEQ ID NO: 2925696 - RNA, 21 nt, Mycobacterium avium subsp. paratuberculosis
ccagcgaggucucccggucca

SEQ ID NO: 2925697 - RNA, 23 nt, Mycobacterium avium subsp. paratuberculosis
ccagcgaguccagccagccgcgc

SEQ ID NO: 2925698 - RNA, 15 nt, Mycobacterium avium subsp. paratuberculosis
ccagcgaguuggcca

SEQ ID NO: 2925699 - RNA, 20 nt, Mycobacterium avium subsp. paratuberculosis
ccagcgauacccguugcgcc

SEQ ID NO: 2925700 - RNA, 23 nt, Mycobacterium avium subsp. paratuberculosis
ccagcgauacccguugcgcccca

SEQ ID NO: 2925701 - RNA, 16 nt, Mycobacterium avium subsp. paratuberculosis
ccagcgauucccgccg

SEQ ID NO: 2925702 - RNA, 18 nt, Mycobacterium avium subsp. paratuberculosis
ccagcgauucccgccgga

SEQ ID NO: 2925703 - RNA, 16 nt, Mycobacterium avium subsp. paratuberculosis
ccagcgcaaccgcggc

SEQ ID NO: 2925704 - RNA, 18 nt, Mycobacterium avium subsp. paratuberculosis
ccagcgcaaccgcggcgg

SEQ ID NO: 2925705 - RNA, 23 nt, Mycobacterium avium subsp. paratuberculosis
ccagcgcaaccgcggcggcggcc

SEQ ID NO: 2925706 - RNA, 13 nt, Mycobacterium avium subsp. paratuberculosis
ccagcgcaacggc

SEQ ID NO: 2925707 - RNA, 18 nt, Mycobacterium avium subsp. paratuberculosis
ccagcgcaacggcgucga

SEQ ID NO: 2925708 - RNA, 19 nt, Mycobacterium avium subsp. paratuberculosis
ccagcgcaacggcgucgac

SEQ ID NO: 2925709 - RNA, 12 nt, Mycobacterium avium subsp. paratuberculosis
ccagcgcacaca

SEQ ID NO: 2925710 - RNA, 15 nt, Mycobacterium avium subsp. paratuberculosis
ccagcgcacacaccg

SEQ ID NO: 2925711 - RNA, 21 nt, Mycobacterium avium subsp. paratuberculosis
ccagcgcacacaccguaccga

SEQ ID NO: 2925712 - RNA, 16 nt, Mycobacterium avium subsp. paratuberculosis
ccagcgcacacagcag

SEQ ID NO: 2925713 - RNA, 18 nt, Mycobacterium avium subsp. paratuberculosis
ccagcgcaccgagcccgu

SEQ ID NO: 2925714 - RNA, 14 nt, Mycobacterium avium subsp. paratuberculosis
ccagcgcaccgggc

SEQ ID NO: 2925715 - RNA, 18 nt, Mycobacterium avium subsp. paratuberculosis
ccagcgcaccgggcccgc

SEQ ID NO: 2925716 - RNA, 19 nt, Mycobacterium avium subsp. paratuberculosis
ccagcgcaccgggcccgcc

SEQ ID NO: 2925717 - RNA, 16 nt, Mycobacterium avium subsp. paratuberculosis
ccagcgcagcaucggc

SEQ ID NO: 2925718 - RNA, 16 nt, Mycobacterium avium subsp. paratuberculosis
ccagcgcagcgccucg

SEQ ID NO: 2925719 - RNA, 15 nt, Mycobacterium avium subsp. paratuberculosis
ccagcgcagguacgc

SEQ ID NO: 2925720 - RNA, 18 nt, Mycobacterium avium subsp. paratuberculosis
ccagcgcaucggucacca

SEQ ID NO: 2925721 - RNA, 21 nt, Mycobacterium avium subsp. paratuberculosis
ccagcgcaucggucaccagcu

SEQ ID NO: 2925722 - RNA, 22 nt, Mycobacterium avium subsp. paratuberculosis
ccagcgcaugccacuugcgcac

SEQ ID NO: 2925723 - RNA, 14 nt, Mycobacterium avium subsp. paratuberculosis
ccagcgccacgggu

SEQ ID NO: 2925724 - RNA, 17 nt, Mycobacterium avium subsp. paratuberculosis
ccagcgccacggguuga

SEQ ID NO: 2925725 - RNA, 22 nt, Mycobacterium avium subsp. paratuberculosis
ccagcgccacuggcuggucacc

SEQ ID NO: 2925726 - RNA, 14 nt, Mycobacterium avium subsp. paratuberculosis
ccagcgccagcgcc

SEQ ID NO: 2925727 - RNA, 15 nt, Mycobacterium avium subsp. paratuberculosis
ccagcgccagcgugg

SEQ ID NO: 2925728 - RNA, 23 nt, Mycobacterium avium subsp. paratuberculosis
ccagcgccagcguggccagcacc

SEQ ID NO: 2925729 - RNA, 22 nt, Mycobacterium avium subsp. paratuberculosis
ccagcgcgcgaucagcgccguc

SEQ ID NO: 2925730 - RNA, 22 nt, Mycobacterium avium subsp. paratuberculosis
ccagcgcgcgaucgccggugcg

SEQ ID NO: 2925731 - RNA, 14 nt, Mycobacterium avium subsp. paratuberculosis
ccagcgcgcgcagc

SEQ ID NO: 2925732 - RNA, 15 nt, Mycobacterium avium subsp. paratuberculosis
ccagcgcgcgcagcg

SEQ ID NO: 2925733 - RNA, 15 nt, Mycobacterium avium subsp. paratuberculosis
ccagcgcgcggccca

SEQ ID NO: 2925734 - RNA, 16 nt, Mycobacterium avium subsp. paratuberculosis
ccagcgcgcggcccag

SEQ ID NO: 2925735 - RNA, 15 nt, Mycobacterium avium subsp. paratuberculosis
ccagcgcgcggcgga

SEQ ID NO: 2925736 - RNA, 17 nt, Mycobacterium avium subsp. paratuberculosis
ccagcgcgcgggcgcgc

SEQ ID NO: 2925737 - RNA, 21 nt, Mycobacterium avium subsp. paratuberculosis
ccagcgcgcgggcgcgcgccg

SEQ ID NO: 2925738 - RNA, 20 nt, Mycobacterium avium subsp. paratuberculosis
ccagcgcgcgggcguccucg

SEQ ID NO: 2925739 - RNA, 23 nt, Mycobacterium avium subsp. paratuberculosis
ccagcgcgcggugcgccagcgcc

SEQ ID NO: 2925740 - RNA, 14 nt, Mycobacterium avium subsp. paratuberculosis
ccagcgcggacacc

SEQ ID NO: 2925741 - RNA, 17 nt, Mycobacterium avium subsp. paratuberculosis
ccagcgcggacaccagg

SEQ ID NO: 2925742 - RNA, 20 nt, Mycobacterium avium subsp. paratuberculosis
ccagcgcggacaccagguug

SEQ ID NO: 2925743 - RNA, 16 nt, Mycobacterium avium subsp. paratuberculosis
ccagcgcggccaccac

SEQ ID NO: 2925744 - RNA, 17 nt, Mycobacterium avium subsp. paratuberculosis
ccagcgcggccaccacc

SEQ ID NO: 2925745 - RNA, 16 nt, Mycobacterium avium subsp. paratuberculosis
ccagcgcggccgggcg

SEQ ID NO: 2925746 - RNA, 21 nt, Mycobacterium avium subsp. paratuberculosis
ccagcgcggccgggcgccccg

SEQ ID NO: 2925747 - RNA, 18 nt, Mycobacterium avium subsp. paratuberculosis
ccagcgcggcgaacccga

SEQ ID NO: 2925748 - RNA, 23 nt, Mycobacterium avium subsp. paratuberculosis
ccagcgcggcgaacccgagcacc

SEQ ID NO: 2925749 - RNA, 13 nt, Mycobacterium avium subsp. paratuberculosis
ccagcgcggcgau

SEQ ID NO: 2925750 - RNA, 14 nt, Mycobacterium avium subsp. paratuberculosis
ccagcgcggcgauc

SEQ ID NO: 2925751 - RNA, 16 nt, Mycobacterium avium subsp. paratuberculosis
ccagcgcggcgaucag

SEQ ID NO: 2925752 - RNA, 21 nt, Mycobacterium avium subsp. paratuberculosis
ccagcgcggcgaucagcagca

SEQ ID NO: 2925753 - RNA, 12 nt, Mycobacterium avium subsp. paratuberculosis
ccagcgcggcgg

SEQ ID NO: 2925754 - RNA, 14 nt, Mycobacterium avium subsp. paratuberculosis
ccagcgcggcggcc

SEQ ID NO: 2925755 - RNA, 23 nt, Mycobacterium avium subsp. paratuberculosis
ccagcgcggcggccaccucggcg

SEQ ID NO: 2925756 - RNA, 23 nt, Mycobacterium avium subsp. paratuberculosis
ccagcgcggcggccagcucggcc

SEQ ID NO: 2925757 - RNA, 15 nt, Mycobacterium avium subsp. paratuberculosis
ccagcgcggcggcgc

SEQ ID NO: 2925758 - RNA, 17 nt, Mycobacterium avium subsp. paratuberculosis
ccagcgcggcggcgccg

SEQ ID NO: 2925759 - RNA, 18 nt, Mycobacterium avium subsp. paratuberculosis
ccagcgcggcggcgccgu

SEQ ID NO: 2925760 - RNA, 14 nt, Mycobacterium avium subsp. paratuberculosis
ccagcgcggcgguc

SEQ ID NO: 2925761 - RNA, 21 nt, Mycobacterium avium subsp. paratuberculosis
ccagcgcggcggucgcgcgcc

SEQ ID NO: 2925762 - RNA, 22 nt, Mycobacterium avium subsp. paratuberculosis
ccagcgcggcggucgcgcgccg

SEQ ID NO: 2925763 - RNA, 16 nt, Mycobacterium avium subsp. paratuberculosis
ccagcgcggcgucacc

SEQ ID NO: 2925764 - RNA, 19 nt, Mycobacterium avium subsp. paratuberculosis
ccagcgcggggucggccag

SEQ ID NO: 2925765 - RNA, 21 nt, Mycobacterium avium subsp. paratuberculosis
ccagcgcggggucggccaguc

SEQ ID NO: 2925766 - RNA, 13 nt, Mycobacterium avium subsp. paratuberculosis
ccagcgcggucgc

SEQ ID NO: 2925767 - RNA, 24 nt, Mycobacterium avium subsp. paratuberculosis
ccagcgcggucgccaccaccagcg

SEQ ID NO: 2925768 - RNA, 14 nt, Mycobacterium avium subsp. paratuberculosis
ccagcgcggucucg

SEQ ID NO: 2925769 - RNA, 14 nt, Mycobacterium avium subsp. paratuberculosis
ccagcgcggugaag

SEQ ID NO: 2925770 - RNA, 15 nt, Mycobacterium avium subsp. paratuberculosis
ccagcgcggugagca

SEQ ID NO: 2925771 - RNA, 23 nt, Mycobacterium avium subsp. paratuberculosis
ccagcgcggugagcagcaugccg

SEQ ID NO: 2925772 - RNA, 20 nt, Mycobacterium avium subsp. paratuberculosis
ccagcgcggugaugugcagg

SEQ ID NO: 2925773 - RNA, 15 nt, Mycobacterium avium subsp. paratuberculosis
ccagcgcggugccca

SEQ ID NO: 2925774 - RNA, 16 nt, Mycobacterium avium subsp. paratuberculosis
ccagcgcggugcccag

SEQ ID NO: 2925775 - RNA, 14 nt, Mycobacterium avium subsp. paratuberculosis
ccagcgcggugccg

SEQ ID NO: 2925776 - RNA, 15 nt, Mycobacterium avium subsp. paratuberculosis
ccagcgcggugccgg

SEQ ID NO: 2925777 - RNA, 14 nt, Mycobacterium avium subsp. paratuberculosis
ccagcgcgguggcc

SEQ ID NO: 2925778 - RNA, 21 nt, Mycobacterium avium subsp. paratuberculosis
ccagcgcggugucgacgucgg

SEQ ID NO: 2925779 - RNA, 13 nt, Mycobacterium avium subsp. paratuberculosis
ccagcgcggugug

SEQ ID NO: 2925780 - RNA, 22 nt, Mycobacterium avium subsp. paratuberculosis
ccagcgcggugugcggcggcuc

SEQ ID NO: 2925781 - RNA, 19 nt, Mycobacterium avium subsp. paratuberculosis
ccagcgcguagagcaucag

SEQ ID NO: 2925782 - RNA, 18 nt, Mycobacterium avium subsp. paratuberculosis
ccagcgcguagucggcgu

SEQ ID NO: 2925783 - RNA, 20 nt, Mycobacterium avium subsp. paratuberculosis
ccagcgcguagucggcgucg

SEQ ID NO: 2925784 - RNA, 21 nt, Mycobacterium avium subsp. paratuberculosis
ccagcgcguagucggcgucgg

SEQ ID NO: 2925785 - RNA, 23 nt, Mycobacterium avium subsp. paratuberculosis
ccagcgcguagucggcgucggcc

SEQ ID NO: 2925786 - RNA, 24 nt, Mycobacterium avium subsp. paratuberculosis
ccagcgcguagucggcgucggcca

SEQ ID NO: 2925787 - RNA, 21 nt, Mycobacterium avium subsp. paratuberculosis
ccagcgcgucgcacagcgccg

SEQ ID NO: 2925788 - RNA, 17 nt, Mycobacterium avium subsp. paratuberculosis
ccagcgcgucgcugccg

SEQ ID NO: 2925789 - RNA, 13 nt, Mycobacterium avium subsp. paratuberculosis
ccagcgcgucggc

SEQ ID NO: 2925790 - RNA, 16 nt, Mycobacterium avium subsp. paratuberculosis
ccagcgcgucggccag

SEQ ID NO: 2925791 - RNA, 16 nt, Mycobacterium avium subsp. paratuberculosis
ccagcgcgugaucggu

SEQ ID NO: 2925792 - RNA, 21 nt, Mycobacterium avium subsp. paratuberculosis
ccagcgcgugaucggugcccg

SEQ ID NO: 2925793 - RNA, 22 nt, Mycobacterium avium subsp. paratuberculosis
ccagcgcgugaucggugcccgc

SEQ ID NO: 2925794 - RNA, 16 nt, Mycobacterium avium subsp. paratuberculosis
ccagcgcguugaagcu

SEQ ID NO: 2925795 - RNA, 21 nt, Mycobacterium avium subsp. paratuberculosis
ccagcgcguugaagcugacga

SEQ ID NO: 2925796 - RNA, 14 nt, Mycobacterium avium subsp. paratuberculosis
ccagcgcucgacga

SEQ ID NO: 2925797 - RNA, 17 nt, Mycobacterium avium subsp. paratuberculosis
ccagcgcucgacgaggc

SEQ ID NO: 2925798 - RNA, 21 nt, Mycobacterium avium subsp. paratuberculosis
ccagcgcucgacgaggcgggc

SEQ ID NO: 2925799 - RNA, 15 nt, Mycobacterium avium subsp. paratuberculosis
ccagcgcuggccggc

SEQ ID NO: 2925800 - RNA, 16 nt, Mycobacterium avium subsp. paratuberculosis
ccagcgcuggccggcc

SEQ ID NO: 2925801 - RNA, 18 nt, Mycobacterium avium subsp. paratuberculosis
ccagcgcuggccggccac

SEQ ID NO: 2925802 - RNA, 23 nt, Mycobacterium avium subsp. paratuberculosis
ccagcgcuggccggccaccagcg

SEQ ID NO: 2925803 - RNA, 18 nt, Mycobacterium avium subsp. paratuberculosis
ccagcggaaccgggggcc

SEQ ID NO: 2925804 - RNA, 23 nt, Mycobacterium avium subsp. paratuberculosis
ccagcggaaccgggggccgucac

SEQ ID NO: 2925805 - RNA, 22 nt, Mycobacterium avium subsp. paratuberculosis
ccagcggagcguucuccacccg

SEQ ID NO: 2925806 - RNA, 18 nt, Mycobacterium avium subsp. paratuberculosis
ccagcggaucgagguagc

SEQ ID NO: 2925807 - RNA, 14 nt, Mycobacterium avium subsp. paratuberculosis
ccagcggaucggcg

SEQ ID NO: 2925808 - RNA, 15 nt, Mycobacterium avium subsp. paratuberculosis
ccagcggaucggcgg

SEQ ID NO: 2925809 - RNA, 17 nt, Mycobacterium avium subsp. paratuberculosis
ccagcggaucggcgguc

SEQ ID NO: 2925810 - RNA, 20 nt, Mycobacterium avium subsp. paratuberculosis
ccagcggaucggcggucccg

SEQ ID NO: 2925811 - RNA, 20 nt, Mycobacterium avium subsp. paratuberculosis
ccagcggcaacugggcggcc

SEQ ID NO: 2925812 - RNA, 23 nt, Mycobacterium avium subsp. paratuberculosis
ccagcggcaacugggcggccugc

SEQ ID NO: 2925813 - RNA, 21 nt, Mycobacterium avium subsp. paratuberculosis
ccagcgggcugugccggcggg

SEQ ID NO: 2925814 - RNA, 22 nt, Mycobacterium avium subsp. paratuberculosis
ccagcgggcugugccggcgggu

SEQ ID NO: 2925815 - RNA, 15 nt, Mycobacterium avium subsp. paratuberculosis
ccagcggggcaagca

SEQ ID NO: 2925816 - RNA, 21 nt, Mycobacterium avium subsp. paratuberculosis
ccagcggggcaagcagcggca

SEQ ID NO: 2925817 - RNA, 21 nt, Mycobacterium avium subsp. paratuberculosis
ccagcggggcgaccuugcgca

SEQ ID NO: 2925818 - RNA, 21 nt, Mycobacterium avium subsp. paratuberculosis
ccagcgggucgauggcgacgg

SEQ ID NO: 2925819 - RNA, 22 nt, Mycobacterium avium subsp. paratuberculosis
ccagcgggucgugcaucggcgc

SEQ ID NO: 2925820 - RNA, 20 nt, Mycobacterium avium subsp. paratuberculosis
ccagcgggugauggccgccg

SEQ ID NO: 2925821 - RNA, 21 nt, Mycobacterium avium subsp. paratuberculosis
ccagcgggugauggccgccgc

SEQ ID NO: 2925822 - RNA, 17 nt, Mycobacterium avium subsp. paratuberculosis
ccagcggguugccgcug

SEQ ID NO: 2925823 - RNA, 17 nt, Mycobacterium avium subsp. paratuberculosis
ccagcgguaaccacccg

SEQ ID NO: 2925824 - RNA, 18 nt, Mycobacterium avium subsp. paratuberculosis
ccagcgguaaccacccgu

SEQ ID NO: 2925825 - RNA, 18 nt, Mycobacterium avium subsp. paratuberculosis
ccagcggucacggacagg

SEQ ID NO: 2925826 - RNA, 21 nt, Mycobacterium avium subsp. paratuberculosis
ccagcggucacggacaggugu

SEQ ID NO: 2925827 - RNA, 16 nt, Mycobacterium avium subsp. paratuberculosis
ccagcgguccagcgug

SEQ ID NO: 2925828 - RNA, 17 nt, Mycobacterium avium subsp. paratuberculosis
ccagcgguccagcguga

SEQ ID NO: 2925829 - RNA, 16 nt, Mycobacterium avium subsp. paratuberculosis
ccagcggucggcgguu

SEQ ID NO: 2925830 - RNA, 23 nt, Mycobacterium avium subsp. paratuberculosis
ccagcgguugcacggucuggugg

SEQ ID NO: 2925831 - RNA, 22 nt, Mycobacterium avium subsp. paratuberculosis
ccagcgguuuggauggcccgcc

SEQ ID NO: 2925832 - RNA, 22 nt, Mycobacterium avium subsp. paratuberculosis
ccagcguagaacauccacggca

SEQ ID NO: 2925833 - RNA, 17 nt, Mycobacterium avium subsp. paratuberculosis
ccagcgucaacucgucg

SEQ ID NO: 2925834 - RNA, 21 nt, Mycobacterium avium subsp. paratuberculosis
ccagcgucaacucgucggcga

SEQ ID NO: 2925835 - RNA, 20 nt, Mycobacterium avium subsp. paratuberculosis
ccagcgucaccuucaccacg

SEQ ID NO: 2925836 - RNA, 15 nt, Mycobacterium avium subsp. paratuberculosis
ccagcgucagggcga

SEQ ID NO: 2925837 - RNA, 22 nt, Mycobacterium avium subsp. paratuberculosis
ccagcgucagggcgacuccggc

SEQ ID NO: 2925838 - RNA, 15 nt, Mycobacterium avium subsp. paratuberculosis
ccagcgucgacgcgg

SEQ ID NO: 2925839 - RNA, 17 nt, Mycobacterium avium subsp. paratuberculosis
ccagcgucgacgcggug

SEQ ID NO: 2925840 - RNA, 17 nt, Mycobacterium avium subsp. paratuberculosis
ccagcgucgacugcacc

SEQ ID NO: 2925841 - RNA, 20 nt, Mycobacterium avium subsp. paratuberculosis
ccagcgucgaguuguugggc

SEQ ID NO: 2925842 - RNA, 14 nt, Mycobacterium avium subsp. paratuberculosis
ccagcgucgcgccg

SEQ ID NO: 2925843 - RNA, 15 nt, Mycobacterium avium subsp. paratuberculosis
ccagcgucgcgccgc

SEQ ID NO: 2925844 - RNA, 13 nt, Mycobacterium avium subsp. paratuberculosis
ccagcgucgcggc

SEQ ID NO: 2925845 - RNA, 14 nt, Mycobacterium avium subsp. paratuberculosis
ccagcgucgcggcc

SEQ ID NO: 2925846 - RNA, 18 nt, Mycobacterium avium subsp. paratuberculosis
ccagcgucgcggccggga

SEQ ID NO: 2925847 - RNA, 16 nt, Mycobacterium avium subsp. paratuberculosis
ccagcgucuccggcgg

SEQ ID NO: 2925848 - RNA, 17 nt, Mycobacterium avium subsp. paratuberculosis
ccagcgucuccggcggg

SEQ ID NO: 2925849 - RNA, 18 nt, Mycobacterium avium subsp. paratuberculosis
ccagcgucuccggcgggc

SEQ ID NO: 2925850 - RNA, 20 nt, Mycobacterium avium subsp. paratuberculosis
ccagcgucuccggcgggcug

SEQ ID NO: 2925851 - RNA, 14 nt, Mycobacterium avium subsp. paratuberculosis
ccagcgucucggcg

SEQ ID NO: 2925852 - RNA, 18 nt, Mycobacterium avium subsp. paratuberculosis
ccagcgucucggcggccg

SEQ ID NO: 2925853 - RNA, 19 nt, Mycobacterium avium subsp. paratuberculosis
ccagcgucucggcggccga

SEQ ID NO: 2925854 - RNA, 21 nt, Mycobacterium avium subsp. paratuberculosis
ccagcgucucggcggccgagc

SEQ ID NO: 2925855 - RNA, 22 nt, Mycobacterium avium subsp. paratuberculosis
ccagcgucuggcagccggccgg

SEQ ID NO: 2925856 - RNA, 23 nt, Mycobacterium avium subsp. paratuberculosis
ccagcgucuggcagccggccggc

SEQ ID NO: 2925857 - RNA, 23 nt, Mycobacterium avium subsp. paratuberculosis
ccagcgucuugacgaacuccugc

SEQ ID NO: 2925858 - RNA, 16 nt, Mycobacterium avium subsp. paratuberculosis
ccagcgugaacaccgc

SEQ ID NO: 2925859 - RNA, 17 nt, Mycobacterium avium subsp. paratuberculosis
ccagcgugaacaccgcg

SEQ ID NO: 2925860 - RNA, 18 nt, Mycobacterium avium subsp. paratuberculosis
ccagcgugaacaccgcgu

SEQ ID NO: 2925861 - RNA, 15 nt, Mycobacterium avium subsp. paratuberculosis
ccagcgugaacagcg

SEQ ID NO: 2925862 - RNA, 18 nt, Mycobacterium avium subsp. paratuberculosis
ccagcgugaacagcgccc

SEQ ID NO: 2925863 - RNA, 20 nt, Mycobacterium avium subsp. paratuberculosis
ccagcgugaacagcgcccgg

SEQ ID NO: 2925864 - RNA, 21 nt, Mycobacterium avium subsp. paratuberculosis
ccagcgugaacagcgcccggc

SEQ ID NO: 2925865 - RNA, 14 nt, Mycobacterium avium subsp. paratuberculosis
ccagcgugaccucg

SEQ ID NO: 2925866 - RNA, 23 nt, Mycobacterium avium subsp. paratuberculosis
ccagcgugaccucgacggugcug

SEQ ID NO: 2925867 - RNA, 16 nt, Mycobacterium avium subsp. paratuberculosis
ccagcgugacgcccgg

SEQ ID NO: 2925868 - RNA, 19 nt, Mycobacterium avium subsp. paratuberculosis
ccagcgugacgcccggcgc

SEQ ID NO: 2925869 - RNA, 23 nt, Mycobacterium avium subsp. paratuberculosis
ccagcgugacgcccggcgccggc

SEQ ID NO: 2925870 - RNA, 15 nt, Mycobacterium avium subsp. paratuberculosis
ccagcgugacgccgg

SEQ ID NO: 2925871 - RNA, 18 nt, Mycobacterium avium subsp. paratuberculosis
ccagcgugacgccgggcc

SEQ ID NO: 2925872 - RNA, 19 nt, Mycobacterium avium subsp. paratuberculosis
ccagcgugacgccgggccg

SEQ ID NO: 2925873 - RNA, 20 nt, Mycobacterium avium subsp. paratuberculosis
ccagcgugacgccgggccgc

SEQ ID NO: 2925874 - RNA, 21 nt, Mycobacterium avium subsp. paratuberculosis
ccagcgugacgccgggccgcc

SEQ ID NO: 2925875 - RNA, 22 nt, Mycobacterium avium subsp. paratuberculosis
ccagcgugacgccgggccgccg

SEQ ID NO: 2925876 - RNA, 15 nt, Mycobacterium avium subsp. paratuberculosis
ccagcgugacgcucg

SEQ ID NO: 2925877 - RNA, 19 nt, Mycobacterium avium subsp. paratuberculosis
ccagcgugacgcucgggcu

SEQ ID NO: 2925878 - RNA, 18 nt, Mycobacterium avium subsp. paratuberculosis
ccagcgugacgucgacgu

SEQ ID NO: 2925879 - RNA, 14 nt, Mycobacterium avium subsp. paratuberculosis
ccagcgugccgcgc

SEQ ID NO: 2925880 - RNA, 15 nt, Mycobacterium avium subsp. paratuberculosis
ccagcgugccgcgca

SEQ ID NO: 2925881 - RNA, 20 nt, Mycobacterium avium subsp. paratuberculosis
ccagcgugccgcgcaccacc

SEQ ID NO: 2925882 - RNA, 22 nt, Mycobacterium avium subsp. paratuberculosis
ccagcgugccgcgcaccaccuc

SEQ ID NO: 2925883 - RNA, 14 nt, Mycobacterium avium subsp. paratuberculosis
ccagcgugcgcggc

SEQ ID NO: 2925884 - RNA, 19 nt, Mycobacterium avium subsp. paratuberculosis
ccagcgugcgcggcuggcc

SEQ ID NO: 2925885 - RNA, 20 nt, Mycobacterium avium subsp. paratuberculosis
ccagcgugcugccggacacc

SEQ ID NO: 2925886 - RNA, 17 nt, Mycobacterium avium subsp. paratuberculosis
ccagcguggccagcacc

SEQ ID NO: 2925887 - RNA, 18 nt, Mycobacterium avium subsp. paratuberculosis
ccagcguggccagcaccg

SEQ ID NO: 2925888 - RNA, 13 nt, Mycobacterium avium subsp. paratuberculosis
ccagcguggccgg

SEQ ID NO: 2925889 - RNA, 14 nt, Mycobacterium avium subsp. paratuberculosis
ccagcguggccggc

SEQ ID NO: 2925890 - RNA, 15 nt, Mycobacterium avium subsp. paratuberculosis
ccagcguggccggca

SEQ ID NO: 2925891 - RNA, 16 nt, Mycobacterium avium subsp. paratuberculosis
ccagcguggccggcag

SEQ ID NO: 2925892 - RNA, 13 nt, Mycobacterium avium subsp. paratuberculosis
ccagcguggcgaa

SEQ ID NO: 2925893 - RNA, 21 nt, Mycobacterium avium subsp. paratuberculosis
ccagcguggcgcgccccggcc

SEQ ID NO: 2925894 - RNA, 16 nt, Mycobacterium avium subsp. paratuberculosis
ccagcgugguaacgga

SEQ ID NO: 2925895 - RNA, 16 nt, Mycobacterium avium subsp. paratuberculosis
ccagcguggugcgccc

SEQ ID NO: 2925896 - RNA, 20 nt, Mycobacterium avium subsp. paratuberculosis
ccagcguguagacggugcug

SEQ ID NO: 2925897 - RNA, 15 nt, Mycobacterium avium subsp. paratuberculosis
ccagcucgucgccga

SEQ ID NO: 2925898 - RNA, 17 nt, Mycobacterium avium subsp. paratuberculosis
ccagcucgucgccgacc

SEQ ID NO: 2925899 - RNA, 20 nt, Mycobacterium avium subsp. paratuberculosis
ccagcucgucgcggaacagc

SEQ ID NO: 2925900 - RNA, 17 nt, Mycobacterium avium subsp. paratuberculosis
ccagcucguugccggcg

SEQ ID NO: 2925901 - RNA, 18 nt, Mycobacterium avium subsp. paratuberculosis
ccagcucguugccggcgg

SEQ ID NO: 2925902 - RNA, 19 nt, Mycobacterium avium subsp. paratuberculosis
ccagcucguugccggcggc

SEQ ID NO: 2925903 - RNA, 22 nt, Mycobacterium avium subsp. paratuberculosis
ccagcucguugccggcggccag

SEQ ID NO: 2925904 - RNA, 16 nt, Mycobacterium avium subsp. paratuberculosis
ccagcucucgagcaca

SEQ ID NO: 2925905 - RNA, 17 nt, Mycobacterium avium subsp. paratuberculosis
ccagcugaacacgaacc

SEQ ID NO: 2925906 - RNA, 18 nt, Mycobacterium avium subsp. paratuberculosis
ccagcugaacacgaaccc

SEQ ID NO: 2925907 - RNA, 19 nt, Mycobacterium avium subsp. paratuberculosis
ccagcugaacacgaacccg

SEQ ID NO: 2925908 - RNA, 22 nt, Mycobacterium avium subsp. paratuberculosis
ccagcugaacacgaacccggcg

SEQ ID NO: 2925909 - RNA, 18 nt, Mycobacterium avium subsp. paratuberculosis
ccagcugauagccgcccu

SEQ ID NO: 2925910 - RNA, 17 nt, Mycobacterium avium subsp. paratuberculosis
ccagcugauucgcggug

SEQ ID NO: 2925911 - RNA, 20 nt, Mycobacterium avium subsp. paratuberculosis
ccagcugauucgcgguggcg

SEQ ID NO: 2925912 - RNA, 16 nt, Mycobacterium avium subsp. paratuberculosis
ccagcugcaccggggc

SEQ ID NO: 2925913 - RNA, 17 nt, Mycobacterium avium subsp. paratuberculosis
ccagcugcaccggggcc

SEQ ID NO: 2925914 - RNA, 20 nt, Mycobacterium avium subsp. paratuberculosis
ccagcugcaccggggccggc

SEQ ID NO: 2925915 - RNA, 14 nt, Mycobacterium avium subsp. paratuberculosis
ccagcugcccacca

SEQ ID NO: 2925916 - RNA, 23 nt, Mycobacterium avium subsp. paratuberculosis
ccagcugcccaccagcaggucga

SEQ ID NO: 2925917 - RNA, 16 nt, Mycobacterium avium subsp. paratuberculosis
ccagcugcccgccgac

SEQ ID NO: 2925918 - RNA, 19 nt, Mycobacterium avium subsp. paratuberculosis
ccagcugcgaaucgucggc

SEQ ID NO: 2925919 - RNA, 20 nt, Mycobacterium avium subsp. paratuberculosis
ccagcugcgaaucgucggcg

SEQ ID NO: 2925920 - RNA, 21 nt, Mycobacterium avium subsp. paratuberculosis
ccagcugcgaaucgucggcga

SEQ ID NO: 2925921 - RNA, 23 nt, Mycobacterium avium subsp. paratuberculosis
ccagcugcgaaucgucggcgaug

SEQ ID NO: 2925922 - RNA, 24 nt, Mycobacterium avium subsp. paratuberculosis
ccagcugcgaaucgucggcgaugg

SEQ ID NO: 2925923 - RNA, 17 nt, Mycobacterium avium subsp. paratuberculosis
ccagcugcgacagcacg

SEQ ID NO: 2925924 - RNA, 13 nt, Mycobacterium avium subsp. paratuberculosis
ccagcugcgcgcc

SEQ ID NO: 2925925 - RNA, 20 nt, Mycobacterium avium subsp. paratuberculosis
ccagcugcgcgccggcggcc

SEQ ID NO: 2925926 - RNA, 15 nt, Mycobacterium avium subsp. paratuberculosis
ccagcugcgcgucgg

SEQ ID NO: 2925927 - RNA, 17 nt, Mycobacterium avium subsp. paratuberculosis
ccagcugcgcgucggcc

SEQ ID NO: 2925928 - RNA, 22 nt, Mycobacterium avium subsp. paratuberculosis
ccagcugcggaaaugcccgcgc

SEQ ID NO: 2925929 - RNA, 20 nt, Mycobacterium avium subsp. paratuberculosis
ccagcugcggaucgggcgug

SEQ ID NO: 2925930 - RNA, 21 nt, Mycobacterium avium subsp. paratuberculosis
ccagcugcggaucgggcgugg

SEQ ID NO: 2925931 - RNA, 21 nt, Mycobacterium avium subsp. paratuberculosis
ccagcugcggguugcgggcca

SEQ ID NO: 2925932 - RNA, 20 nt, Mycobacterium avium subsp. paratuberculosis
ccagcuggagaggcccggca

SEQ ID NO: 2925933 - RNA, 21 nt, Mycobacterium avium subsp. paratuberculosis
ccagcuggagaggcccggcag

SEQ ID NO: 2925934 - RNA, 22 nt, Mycobacterium avium subsp. paratuberculosis
ccagcuggagaggcccggcagc

SEQ ID NO: 2925935 - RNA, 23 nt, Mycobacterium avium subsp. paratuberculosis
ccagcuggagaggcccggcagcc

SEQ ID NO: 2925936 - RNA, 17 nt, Mycobacterium avium subsp. paratuberculosis
ccagcuggauggcgccc

SEQ ID NO: 2925937 - RNA, 21 nt, Mycobacterium avium subsp. paratuberculosis
ccagcuggauggcgcccagcc

SEQ ID NO: 2925938 - RNA, 23 nt, Mycobacterium avium subsp. paratuberculosis
ccagcugggaggcgcacaacgag

SEQ ID NO: 2925939 - RNA, 15 nt, Mycobacterium avium subsp. paratuberculosis
ccagcugggcagcca

SEQ ID NO: 2925940 - RNA, 15 nt, Mycobacterium avium subsp. paratuberculosis
ccagcugggccagcg

SEQ ID NO: 2925941 - RNA, 15 nt, Mycobacterium avium subsp. paratuberculosis
ccagcugggccgcca

SEQ ID NO: 2925942 - RNA, 20 nt, Mycobacterium avium subsp. paratuberculosis
ccagcugggccgccagccgg

SEQ ID NO: 2925943 - RNA, 19 nt, Mycobacterium avium subsp. paratuberculosis
ccagcuggguggucaccag

SEQ ID NO: 2925944 - RNA, 20 nt, Mycobacterium avium subsp. paratuberculosis
ccagcuggguggucaccagc

SEQ ID NO: 2925945 - RNA, 23 nt, Mycobacterium avium subsp. paratuberculosis
ccagcuggguggucaccagcgcg

SEQ ID NO: 2925946 - RNA, 17 nt, Mycobacterium avium subsp. paratuberculosis
ccagcuggugaagcugc

SEQ ID NO: 2925947 - RNA, 18 nt, Mycobacterium avium subsp. paratuberculosis
ccagcuggugaagcugcc

SEQ ID NO: 2925948 - RNA, 19 nt, Mycobacterium avium subsp. paratuberculosis
ccagcuguugacgggccgc

SEQ ID NO: 2925949 - RNA, 13 nt, Mycobacterium avium subsp. paratuberculosis
ccagcuucaccgg

SEQ ID NO: 2925950 - RNA, 14 nt, Mycobacterium avium subsp. paratuberculosis
ccagcuucaccggu

SEQ ID NO: 2925951 - RNA, 15 nt, Mycobacterium avium subsp. paratuberculosis
ccagcuucaccgguc

SEQ ID NO: 2925952 - RNA, 17 nt, Mycobacterium avium subsp. paratuberculosis
ccagcuucaccggucgg

SEQ ID NO: 2925953 - RNA, 19 nt, Mycobacterium avium subsp. paratuberculosis
ccagcuucaccggucgggc

SEQ ID NO: 2925954 - RNA, 14 nt, Mycobacterium avium subsp. paratuberculosis
ccagcuucgggcgc

SEQ ID NO: 2925955 - RNA, 15 nt, Mycobacterium avium subsp. paratuberculosis
ccagcuucgggcgcg

SEQ ID NO: 2925956 - RNA, 16 nt, Mycobacterium avium subsp. paratuberculosis
ccagcuucgggcgcgc

SEQ ID NO: 2925957 - RNA, 22 nt, Mycobacterium avium subsp. paratuberculosis
ccagcuucgggcgcgcgcgcca

SEQ ID NO: 2925958 - RNA, 18 nt, Mycobacterium avium subsp. paratuberculosis
ccagcuucucggcguccc

SEQ ID NO: 2925959 - RNA, 22 nt, Mycobacterium avium subsp. paratuberculosis
ccagcuugaagcccucgucgaa

SEQ ID NO: 2925960 - RNA, 14 nt, Mycobacterium avium subsp. paratuberculosis
ccagcuugucgauc

SEQ ID NO: 2925961 - RNA, 17 nt, Mycobacterium avium subsp. paratuberculosis
ccagcuuuccggccgcc

SEQ ID NO: 2925962 - RNA, 14 nt, Mycobacterium avium subsp. paratuberculosis
ccaggaacacggcu

SEQ ID NO: 2925963 - RNA, 23 nt, Mycobacterium avium subsp. paratuberculosis
ccaggaacacggcucgggggccg

SEQ ID NO: 2925964 - RNA, 14 nt, Mycobacterium avium subsp. paratuberculosis
ccaggaaccacacc

SEQ ID NO: 2925965 - RNA, 18 nt, Mycobacterium avium subsp. paratuberculosis
ccaggaaccacaccccgg

SEQ ID NO: 2925966 - RNA, 19 nt, Mycobacterium avium subsp. paratuberculosis
ccaggaaccacaccccggc

SEQ ID NO: 2925967 - RNA, 22 nt, Mycobacterium avium subsp. paratuberculosis
ccaggaacgacacguggaccga

SEQ ID NO: 2925968 - RNA, 16 nt, Mycobacterium avium subsp. paratuberculosis
ccaggaacggcacccg

SEQ ID NO: 2925969 - RNA, 19 nt, Mycobacterium avium subsp. paratuberculosis
ccaggaacggcacccgcag

SEQ ID NO: 2925970 - RNA, 23 nt, Mycobacterium avium subsp. paratuberculosis
ccaggaacuggucgaacagcgcg

SEQ ID NO: 2925971 - RNA, 15 nt, Mycobacterium avium subsp. paratuberculosis
ccaggaagaacccgg

SEQ ID NO: 2925972 - RNA, 18 nt, Mycobacterium avium subsp. paratuberculosis
ccaggaagaacccggcgu

SEQ ID NO: 2925973 - RNA, 22 nt, Mycobacterium avium subsp. paratuberculosis
ccaggaagacguaggcggccag

SEQ ID NO: 2925974 - RNA, 15 nt, Mycobacterium avium subsp. paratuberculosis
ccaggaagccggcga

SEQ ID NO: 2925975 - RNA, 17 nt, Mycobacterium avium subsp. paratuberculosis
ccaggaagccggcgacg

SEQ ID NO: 2925976 - RNA, 15 nt, Mycobacterium avium subsp. paratuberculosis
ccaggaaggucccgg

SEQ ID NO: 2925977 - RNA, 19 nt, Mycobacterium avium subsp. paratuberculosis
ccaggaaguacaccaccgc

SEQ ID NO: 2925978 - RNA, 20 nt, Mycobacterium avium subsp. paratuberculosis
ccaggaaguacaccaccgcg

SEQ ID NO: 2925979 - RNA, 20 nt, Mycobacterium avium subsp. paratuberculosis
ccaggaaguagccggccagc

SEQ ID NO: 2925980 - RNA, 17 nt, Mycobacterium avium subsp. paratuberculosis
ccaggaauucgggcacc

SEQ ID NO: 2925981 - RNA, 18 nt, Mycobacterium avium subsp. paratuberculosis
ccaggccaacagcagcag

SEQ ID NO: 2925982 - RNA, 19 nt, Mycobacterium avium subsp. paratuberculosis
ccaggccaacagcagcaga

SEQ ID NO: 2925983 - RNA, 13 nt, Mycobacterium avium subsp. paratuberculosis
ccaggccacccgg

SEQ ID NO: 2925984 - RNA, 15 nt, Mycobacterium avium subsp. paratuberculosis
ccaggccacccgggc

SEQ ID NO: 2925985 - RNA, 12 nt, Mycobacterium avium subsp. paratuberculosis
ccaggccaccgc

SEQ ID NO: 2925986 - RNA, 16 nt, Mycobacterium avium subsp. paratuberculosis
ccaggccaccgcacgu

SEQ ID NO: 2925987 - RNA, 18 nt, Mycobacterium avium subsp. paratuberculosis
ccaggcccagcagcaccg

SEQ ID NO: 2925988 - RNA, 22 nt, Mycobacterium avium subsp. paratuberculosis
ccaggcccagcagcaccgcgac

SEQ ID NO: 2925989 - RNA, 17 nt, Mycobacterium avium subsp. paratuberculosis
ccaggcccagcccggcc

SEQ ID NO: 2925990 - RNA, 14 nt, Mycobacterium avium subsp. paratuberculosis
ccaggcccaucgcg

SEQ ID NO: 2925991 - RNA, 17 nt, Mycobacterium avium subsp. paratuberculosis
ccaggccccggccgagc

SEQ ID NO: 2925992 - RNA, 21 nt, Mycobacterium avium subsp. paratuberculosis
ccaggccccggccgagcgcag

SEQ ID NO: 2925993 - RNA, 14 nt, Mycobacterium avium subsp. paratuberculosis
ccaggcccggcacc

SEQ ID NO: 2925994 - RNA, 20 nt, Mycobacterium avium subsp. paratuberculosis
ccaggcccucgccgcgguca

SEQ ID NO: 2925995 - RNA, 15 nt, Mycobacterium avium subsp. paratuberculosis
ccaggccgacgccgg

SEQ ID NO: 2925996 - RNA, 17 nt, Mycobacterium avium subsp. paratuberculosis
ccaggccgacgccggcc

SEQ ID NO: 2925997 - RNA, 14 nt, Mycobacterium avium subsp. paratuberculosis
ccaggccgacgcug

SEQ ID NO: 2925998 - RNA, 18 nt, Mycobacterium avium subsp. paratuberculosis
ccaggccgacgcuggccg

SEQ ID NO: 2925999 - RNA, 14 nt, Mycobacterium avium subsp. paratuberculosis
ccaggccgaugaug

SEQ ID NO: 2926000 - RNA, 13 nt, Mycobacterium avium subsp. paratuberculosis
ccaggccgccgcc

SEQ ID NO: 2926001 - RNA, 16 nt, Mycobacterium avium subsp. paratuberculosis
ccaggccgccgccacc

SEQ ID NO: 2926002 - RNA, 12 nt, Mycobacterium avium subsp. paratuberculosis
ccaggccgccgg

SEQ ID NO: 2926003 - RNA, 13 nt, Mycobacterium avium subsp. paratuberculosis
ccaggccgccggg

SEQ ID NO: 2926004 - RNA, 15 nt, Mycobacterium avium subsp. paratuberculosis
ccaggccgccgggcc

SEQ ID NO: 2926005 - RNA, 16 nt, Mycobacterium avium subsp. paratuberculosis
ccaggccgccgggccg

SEQ ID NO: 2926006 - RNA, 20 nt, Mycobacterium avium subsp. paratuberculosis
ccaggccgccgggccgccga

SEQ ID NO: 2926007 - RNA, 21 nt, Mycobacterium avium subsp. paratuberculosis
ccaggccgccgggccgccgau

SEQ ID NO: 2926008 - RNA, 13 nt, Mycobacterium avium subsp. paratuberculosis
ccaggccgccgug

SEQ ID NO: 2926009 - RNA, 14 nt, Mycobacterium avium subsp. paratuberculosis
ccaggccgccgugg

SEQ ID NO: 2926010 - RNA, 16 nt, Mycobacterium avium subsp. paratuberculosis
ccaggccgcgagcacg

SEQ ID NO: 2926011 - RNA, 13 nt, Mycobacterium avium subsp. paratuberculosis
ccaggccgcgccg

SEQ ID NO: 2926012 - RNA, 15 nt, Mycobacterium avium subsp. paratuberculosis
ccaggccgcgccggg

SEQ ID NO: 2926013 - RNA, 15 nt, Mycobacterium avium subsp. paratuberculosis
ccaggccgcggucgc

SEQ ID NO: 2926014 - RNA, 17 nt, Mycobacterium avium subsp. paratuberculosis
ccaggccgcggucgccc

SEQ ID NO: 2926015 - RNA, 20 nt, Mycobacterium avium subsp. paratuberculosis
ccaggccggccugccggaug

SEQ ID NO: 2926016 - RNA, 15 nt, Mycobacterium avium subsp. paratuberculosis
ccaggccggcgacga

SEQ ID NO: 2926017 - RNA, 16 nt, Mycobacterium avium subsp. paratuberculosis
ccaggccggcgacgau

SEQ ID NO: 2926018 - RNA, 17 nt, Mycobacterium avium subsp. paratuberculosis
ccaggccggcgacgccg

SEQ ID NO: 2926019 - RNA, 19 nt, Mycobacterium avium subsp. paratuberculosis
ccaggccggcgagcucgcg

SEQ ID NO: 2926020 - RNA, 22 nt, Mycobacterium avium subsp. paratuberculosis
ccaggccggcgagcucgcggcc

SEQ ID NO: 2926021 - RNA, 14 nt, Mycobacterium avium subsp. paratuberculosis
ccaggccggcgccg

SEQ ID NO: 2926022 - RNA, 18 nt, Mycobacterium avium subsp. paratuberculosis
ccaggccggcgccgcggg

SEQ ID NO: 2926023 - RNA, 21 nt, Mycobacterium avium subsp. paratuberculosis
ccaggccguccaccagaucgc

SEQ ID NO: 2926024 - RNA, 14 nt, Mycobacterium avium subsp. paratuberculosis
ccaggccgucgagg

SEQ ID NO: 2926025 - RNA, 14 nt, Mycobacterium avium subsp. paratuberculosis
ccaggccgucggcg

SEQ ID NO: 2926026 - RNA, 16 nt, Mycobacterium avium subsp. paratuberculosis
ccaggccgucggcgcg

SEQ ID NO: 2926027 - RNA, 17 nt, Mycobacterium avium subsp. paratuberculosis
ccaggccgucggcgcgg

SEQ ID NO: 2926028 - RNA, 18 nt, Mycobacterium avium subsp. paratuberculosis
ccaggccgucggcgcggc

SEQ ID NO: 2926029 - RNA, 13 nt, Mycobacterium avium subsp. paratuberculosis
ccaggccgugauc

SEQ ID NO: 2926030 - RNA, 15 nt, Mycobacterium avium subsp. paratuberculosis
ccaggccgugaucgg

SEQ ID NO: 2926031 - RNA, 20 nt, Mycobacterium avium subsp. paratuberculosis
ccaggccgugaucggccuuc

SEQ ID NO: 2926032 - RNA, 16 nt, Mycobacterium avium subsp. paratuberculosis
ccaggccgugguuggc

SEQ ID NO: 2926033 - RNA, 17 nt, Mycobacterium avium subsp. paratuberculosis
ccaggccgugguuggcg

SEQ ID NO: 2926034 - RNA, 19 nt, Mycobacterium avium subsp. paratuberculosis
ccaggccucccacagcgga

SEQ ID NO: 2926035 - RNA, 23 nt, Mycobacterium avium subsp. paratuberculosis
ccaggccuuccgcaacaucguca

SEQ ID NO: 2926036 - RNA, 15 nt, Mycobacterium avium subsp. paratuberculosis
ccaggccuugucguc

SEQ ID NO: 2926037 - RNA, 16 nt, Mycobacterium avium subsp. paratuberculosis
ccaggccuugucgucc

SEQ ID NO: 2926038 - RNA, 22 nt, Mycobacterium avium subsp. paratuberculosis
ccaggccuugucguccucgauc

SEQ ID NO: 2926039 - RNA, 21 nt, Mycobacterium avium subsp. paratuberculosis
ccaggcgaacauggcggccag

SEQ ID NO: 2926040 - RNA, 22 nt, Mycobacterium avium subsp. paratuberculosis
ccaggcgaacauggcggccagc

SEQ ID NO: 2926041 - RNA, 21 nt, Mycobacterium avium subsp. paratuberculosis
ccaggcgaaguuggucaccac

SEQ ID NO: 2926042 - RNA, 20 nt, Mycobacterium avium subsp. paratuberculosis
ccaggcgacuguccaggccg

SEQ ID NO: 2926043 - RNA, 18 nt, Mycobacterium avium subsp. paratuberculosis
ccaggcgaugccgccgac

SEQ ID NO: 2926044 - RNA, 12 nt, Mycobacterium avium subsp. paratuberculosis
ccaggcgcaccg

SEQ ID NO: 2926045 - RNA, 16 nt, Mycobacterium avium subsp. paratuberculosis
ccaggcgcaccgccac

SEQ ID NO: 2926046 - RNA, 19 nt, Mycobacterium avium subsp. paratuberculosis
ccaggcgcaccgccaccgc

SEQ ID NO: 2926047 - RNA, 21 nt, Mycobacterium avium subsp. paratuberculosis
ccaggcgccacagcagcacca

SEQ ID NO: 2926048 - RNA, 15 nt, Mycobacterium avium subsp. paratuberculosis
ccaggcgcccagcac

SEQ ID NO: 2926049 - RNA, 17 nt, Mycobacterium avium subsp. paratuberculosis
ccaggcgcccagcaccc

SEQ ID NO: 2926050 - RNA, 12 nt, Mycobacterium avium subsp. paratuberculosis
ccaggcgccggc

SEQ ID NO: 2926051 - RNA, 15 nt, Mycobacterium avium subsp. paratuberculosis
ccaggcgccggccag

SEQ ID NO: 2926052 - RNA, 16 nt, Mycobacterium avium subsp. paratuberculosis
ccaggcgccggccagc

SEQ ID NO: 2926053 - RNA, 13 nt, Mycobacterium avium subsp. paratuberculosis
ccaggcgccgggu

SEQ ID NO: 2926054 - RNA, 18 nt, Mycobacterium avium subsp. paratuberculosis
ccaggcgccgucgauggc

SEQ ID NO: 2926055 - RNA, 13 nt, Mycobacterium avium subsp. paratuberculosis
ccaggcgcgcgcu

SEQ ID NO: 2926056 - RNA, 14 nt, Mycobacterium avium subsp. paratuberculosis
ccaggcgcgcgcug

SEQ ID NO: 2926057 - RNA, 19 nt, Mycobacterium avium subsp. paratuberculosis
ccaggcgcgcguagcgcag

SEQ ID NO: 2926058 - RNA, 14 nt, Mycobacterium avium subsp. paratuberculosis
ccaggcgcucgucg

SEQ ID NO: 2926059 - RNA, 17 nt, Mycobacterium avium subsp. paratuberculosis
ccaggcggaaugcagga

SEQ ID NO: 2926060 - RNA, 24 nt, Mycobacterium avium subsp. paratuberculosis
ccaggcggaaugcaggaucgcggu

SEQ ID NO: 2926061 - RNA, 14 nt, Mycobacterium avium subsp. paratuberculosis
ccaggcggcgacga

SEQ ID NO: 2926062 - RNA, 22 nt, Mycobacterium avium subsp. paratuberculosis
ccaggcggcgacgaacgccggc

SEQ ID NO: 2926063 - RNA, 12 nt, Mycobacterium avium subsp. paratuberculosis
ccaggcgggcca

SEQ ID NO: 2926064 - RNA, 14 nt, Mycobacterium avium subsp. paratuberculosis
ccaggcgggccagc

SEQ ID NO: 2926065 - RNA, 15 nt, Mycobacterium avium subsp. paratuberculosis
ccaggcgggccagcu

SEQ ID NO: 2926066 - RNA, 17 nt, Mycobacterium avium subsp. paratuberculosis
ccaggguggccgccacc

SEQ ID NO: 2926067 - RNA, 14 nt, Mycobacterium avium subsp. paratuberculosis
ccaggguggucagc

SEQ ID NO: 2926068 - RNA, 18 nt, Mycobacterium avium subsp. paratuberculosis
ccaggguggucagcgucu

SEQ ID NO: 2926069 - RNA, 23 nt, Mycobacterium avium subsp. paratuberculosis
ccaggguggucagcgucucggcg

SEQ ID NO: 2926070 - RNA, 16 nt, Mycobacterium avium subsp. paratuberculosis
ccagggugucccagcg

SEQ ID NO: 2926071 - RNA, 18 nt, Mycobacterium avium subsp. paratuberculosis
ccagggugucccagcgcc

SEQ ID NO: 2926072 - RNA, 20 nt, Mycobacterium avium subsp. paratuberculosis
ccagggugucccagcgccac

SEQ ID NO: 2926073 - RNA, 15 nt, Mycobacterium avium subsp. paratuberculosis
ccagggugucgacga

SEQ ID NO: 2926074 - RNA, 13 nt, Mycobacterium avium subsp. paratuberculosis
ccagggugucguc

SEQ ID NO: 2926075 - RNA, 19 nt, Mycobacterium avium subsp. paratuberculosis
ccagggugucgucgcgcac

SEQ ID NO: 2926076 - RNA, 22 nt, Mycobacterium avium subsp. paratuberculosis
ccagggugucgucgucgguuuc

SEQ ID NO: 2926077 - RNA, 18 nt, Mycobacterium avium subsp. paratuberculosis
ccaggguucucgcggcgg

SEQ ID NO: 2926078 - RNA, 19 nt, Mycobacterium avium subsp. paratuberculosis
ccaggguucucgcggcggc

SEQ ID NO: 2926079 - RNA, 19 nt, Mycobacterium avium subsp. paratuberculosis
ccaggguuggucggagccg

SEQ ID NO: 2926080 - RNA, 19 nt, Mycobacterium avium subsp. paratuberculosis
ccaggguuucaugcacggc

SEQ ID NO: 2926081 - RNA, 21 nt, Mycobacterium avium subsp. paratuberculosis
ccaggguuucaugcacggcgc

SEQ ID NO: 2926082 - RNA, 18 nt, Mycobacterium avium subsp. paratuberculosis
ccaggguuugggcgugcg

SEQ ID NO: 2926083 - RNA, 21 nt, Mycobacterium avium subsp. paratuberculosis
ccaggguuugggcgugcggcc

SEQ ID NO: 2926084 - RNA, 21 nt, Mycobacterium avium subsp. paratuberculosis
ccagguacacguagcggucca

SEQ ID NO: 2926085 - RNA, 22 nt, Mycobacterium avium subsp. paratuberculosis
ccagguacacguagcgguccag

SEQ ID NO: 2926086 - RNA, 15 nt, Mycobacterium avium subsp. paratuberculosis
ccagguacgcgacgg

SEQ ID NO: 2926087 - RNA, 17 nt, Mycobacterium avium subsp. paratuberculosis
ccagguacgcgacgggc

SEQ ID NO: 2926088 - RNA, 20 nt, Mycobacterium avium subsp. paratuberculosis
ccagguacuccucgaagaac

SEQ ID NO: 2926089 - RNA, 19 nt, Mycobacterium avium subsp. paratuberculosis
ccagguacugaucaccgcg

SEQ ID NO: 2926090 - RNA, 20 nt, Mycobacterium avium subsp. paratuberculosis
ccagguacugaucaccgcgc

SEQ ID NO: 2926091 - RNA, 21 nt, Mycobacterium avium subsp. paratuberculosis
ccagguacugaucaccgcgcu

SEQ ID NO: 2926092 - RNA, 24 nt, Mycobacterium avium subsp. paratuberculosis
ccagguacugaucaccgcgcucgg

SEQ ID NO: 2926093 - RNA, 22 nt, Mycobacterium avium subsp. paratuberculosis
ccagguagacgaugcccagccc

SEQ ID NO: 2926094 - RNA, 20 nt, Mycobacterium avium subsp. paratuberculosis
ccagguagauggugaucgac

SEQ ID NO: 2926095 - RNA, 19 nt, Mycobacterium avium subsp. paratuberculosis
ccagguagcccaugucgcc

SEQ ID NO: 2926096 - RNA, 23 nt, Mycobacterium avium subsp. paratuberculosis
ccagguagcccaugucgccggug

SEQ ID NO: 2926097 - RNA, 15 nt, Mycobacterium avium subsp. paratuberculosis
ccagguaggcggugg

SEQ ID NO: 2926098 - RNA, 17 nt, Mycobacterium avium subsp. paratuberculosis
ccagguaggcguugauc

SEQ ID NO: 2926099 - RNA, 22 nt, Mycobacterium avium subsp. paratuberculosis
ccagguagggcacaccggugcu

SEQ ID NO: 2926100 - RNA, 16 nt, Mycobacterium avium subsp. paratuberculosis
ccagguagguggccgu

SEQ ID NO: 2926101 - RNA, 21 nt, Mycobacterium avium subsp. paratuberculosis
ccagguaguuguucgacugca

SEQ ID NO: 2926102 - RNA, 23 nt, Mycobacterium avium subsp. paratuberculosis
ccagguaguuguucgacugcagg

SEQ ID NO: 2926103 - RNA, 20 nt, Mycobacterium avium subsp. paratuberculosis
ccagguauucaucgcggccg

SEQ ID NO: 2926104 - RNA, 22 nt, Mycobacterium avium subsp. paratuberculosis
ccagguauucaucgcggccgcc

SEQ ID NO: 2926105 - RNA, 23 nt, Mycobacterium avium subsp. paratuberculosis
ccagguauucguugcccugccug

SEQ ID NO: 2926106 - RNA, 23 nt, Mycobacterium avium subsp. paratuberculosis
ccaggucaugguggcggcgccgg

SEQ ID NO: 2926107 - RNA, 14 nt, Mycobacterium avium subsp. paratuberculosis
ccagguccacaccg

SEQ ID NO: 2926108 - RNA, 17 nt, Mycobacterium avium subsp. paratuberculosis
ccagguccacaccgugg

SEQ ID NO: 2926109 - RNA, 17 nt, Mycobacterium avium subsp. paratuberculosis
ccagguccaccagguga

SEQ ID NO: 2926110 - RNA, 16 nt, Mycobacterium avium subsp. paratuberculosis
ccagguccaccccgcc

SEQ ID NO: 2926111 - RNA, 17 nt, Mycobacterium avium subsp. paratuberculosis
ccagguccaccccgcca

SEQ ID NO: 2926112 - RNA, 17 nt, Mycobacterium avium subsp. paratuberculosis
ccagguccgcgguggug

SEQ ID NO: 2926113 - RNA, 12 nt, Mycobacterium avium subsp. paratuberculosis
ccagguccggga

SEQ ID NO: 2926114 - RNA, 18 nt, Mycobacterium avium subsp. paratuberculosis
ccagguccgggcacucga

SEQ ID NO: 2926115 - RNA, 15 nt, Mycobacterium avium subsp. paratuberculosis
ccagguccucgcugg

SEQ ID NO: 2926116 - RNA, 20 nt, Mycobacterium avium subsp. paratuberculosis
ccagguccucgcuggcgauc

SEQ ID NO: 2926117 - RNA, 14 nt, Mycobacterium avium subsp. paratuberculosis
ccagguccuugagg

SEQ ID NO: 2926118 - RNA, 17 nt, Mycobacterium avium subsp. paratuberculosis
ccagguccuugaucggg

SEQ ID NO: 2926119 - RNA, 23 nt, Mycobacterium avium subsp. paratuberculosis
ccaggucgaagaggugcucgacg

SEQ ID NO: 2926120 - RNA, 19 nt, Mycobacterium avium subsp. paratuberculosis
ccaggucgacggggucgga

SEQ ID NO: 2926121 - RNA, 21 nt, Mycobacterium avium subsp. paratuberculosis
ccaggucgacggggucggaca

SEQ ID NO: 2926122 - RNA, 18 nt, Mycobacterium avium subsp. paratuberculosis
ccaggucgaucucggcca

SEQ ID NO: 2926123 - RNA, 21 nt, Mycobacterium avium subsp. paratuberculosis
ccaggucgaucucggccagcg

SEQ ID NO: 2926124 - RNA, 23 nt, Mycobacterium avium subsp. paratuberculosis
ccaggucgcacaccagcacggcg

SEQ ID NO: 2926125 - RNA, 22 nt, Mycobacterium avium subsp. paratuberculosis
ccaggucgcccagauagaucgc

SEQ ID NO: 2926126 - RNA, 18 nt, Mycobacterium avium subsp. paratuberculosis
ccaggucgccgcgcagca

SEQ ID NO: 2926127 - RNA, 21 nt, Mycobacterium avium subsp. paratuberculosis
ccaggucgccgcgcagcaccg

SEQ ID NO: 2926128 - RNA, 22 nt, Mycobacterium avium subsp. paratuberculosis
ccaggucgccgcgcagcaccgc

SEQ ID NO: 2926129 - RNA, 13 nt, Mycobacterium avium subsp. paratuberculosis
ccaggucgccggc

SEQ ID NO: 2926130 - RNA, 14 nt, Mycobacterium avium subsp. paratuberculosis
ccaggucgccggcg

SEQ ID NO: 2926131 - RNA, 17 nt, Mycobacterium avium subsp. paratuberculosis
ccaggucgccggcggcc

SEQ ID NO: 2926132 - RNA, 22 nt, Mycobacterium avium subsp. paratuberculosis
ccaggucgccggcggccgacag

SEQ ID NO: 2926133 - RNA, 14 nt, Mycobacterium avium subsp. paratuberculosis
ccaggucgcggcgc

SEQ ID NO: 2926134 - RNA, 17 nt, Mycobacterium avium subsp. paratuberculosis
ccaggucgcugacgaug

SEQ ID NO: 2926135 - RNA, 18 nt, Mycobacterium avium subsp. paratuberculosis
ccaggucggggcccgucc

SEQ ID NO: 2926136 - RNA, 23 nt, Mycobacterium avium subsp. paratuberculosis
ccaggucgggguccaggccgcgc

SEQ ID NO: 2926137 - RNA, 14 nt, Mycobacterium avium subsp. paratuberculosis
ccaggucggggugg

SEQ ID NO: 2926138 - RNA, 18 nt, Mycobacterium avium subsp. paratuberculosis
ccaggucggggugggcga

SEQ ID NO: 2926139 - RNA, 19 nt, Mycobacterium avium subsp. paratuberculosis
ccaggucgugaaacauggc

SEQ ID NO: 2926140 - RNA, 19 nt, Mycobacterium avium subsp. paratuberculosis
ccaggucguuggagucguc

SEQ ID NO: 2926141 - RNA, 21 nt, Mycobacterium avium subsp. paratuberculosis
ccaggucuucucguccgcgcu

SEQ ID NO: 2926142 - RNA, 16 nt, Mycobacterium avium subsp. paratuberculosis
ccaggugaacagcagc

SEQ ID NO: 2926143 - RNA, 17 nt, Mycobacterium avium subsp. paratuberculosis
ccaggugaacagcagcc

SEQ ID NO: 2926144 - RNA, 18 nt, Mycobacterium avium subsp. paratuberculosis
ccaggugaacagcagcca

SEQ ID NO: 2926145 - RNA, 13 nt, Mycobacterium avium subsp. paratuberculosis
ccaggugaacagg

SEQ ID NO: 2926146 - RNA, 17 nt, Mycobacterium avium subsp. paratuberculosis
ccaggugaaugcucagc

SEQ ID NO: 2926147 - RNA, 12 nt, Mycobacterium avium subsp. paratuberculosis
ccaggugaccgg

SEQ ID NO: 2926148 - RNA, 14 nt, Mycobacterium avium subsp. paratuberculosis
ccaggugaccggcc

SEQ ID NO: 2926149 - RNA, 20 nt, Mycobacterium avium subsp. paratuberculosis
ccaggugcacccgaugcucg

SEQ ID NO: 2926150 - RNA, 14 nt, Mycobacterium avium subsp. paratuberculosis
ccagucgccgccgc

SEQ ID NO: 2926151 - RNA, 15 nt, Mycobacterium avium subsp. paratuberculosis
ccagucgccgccgcg

SEQ ID NO: 2926152 - RNA, 18 nt, Mycobacterium avium subsp. paratuberculosis
ccagucgccgccgcgcac

SEQ ID NO: 2926153 - RNA, 23 nt, Mycobacterium avium subsp. paratuberculosis
ccagucgccgccgcgcaccgcgc

SEQ ID NO: 2926154 - RNA, 14 nt, Mycobacterium avium subsp. paratuberculosis
ccagucgccgcgca

SEQ ID NO: 2926155 - RNA, 16 nt, Mycobacterium avium subsp. paratuberculosis
ccagucgccgcgcaga

SEQ ID NO: 2926156 - RNA, 19 nt, Mycobacterium avium subsp. paratuberculosis
ccagucgcgcagcgucauc

SEQ ID NO: 2926157 - RNA, 22 nt, Mycobacterium avium subsp. paratuberculosis
ccagucgcgcagcgucaucgcg

SEQ ID NO: 2926158 - RNA, 13 nt, Mycobacterium avium subsp. paratuberculosis
ccagucgcgccga

SEQ ID NO: 2926159 - RNA, 14 nt, Mycobacterium avium subsp. paratuberculosis
ccagucgcgccgag

SEQ ID NO: 2926160 - RNA, 22 nt, Mycobacterium avium subsp. paratuberculosis
ccagucgcgccgagguggccgc

SEQ ID NO: 2926161 - RNA, 20 nt, Mycobacterium avium subsp. paratuberculosis
ccagucggccaucagcaccg

SEQ ID NO: 2926162 - RNA, 13 nt, Mycobacterium avium subsp. paratuberculosis
ccagucggccgug

SEQ ID NO: 2926163 - RNA, 13 nt, Mycobacterium avium subsp. paratuberculosis
ccagucggcgccg

SEQ ID NO: 2926164 - RNA, 15 nt, Mycobacterium avium subsp. paratuberculosis
ccagucggcgucuuc

SEQ ID NO: 2926165 - RNA, 16 nt, Mycobacterium avium subsp. paratuberculosis
ccagucggucaacgug

SEQ ID NO: 2926166 - RNA, 23 nt, Mycobacterium avium subsp. paratuberculosis
ccagucggucaacgugucgagca

SEQ ID NO: 2926167 - RNA, 22 nt, Mycobacterium avium subsp. paratuberculosis
ccagucguacucccaggccgcg

SEQ ID NO: 2926168 - RNA, 22 nt, Mycobacterium avium subsp. paratuberculosis
ccagucguuggugcgcaccagc

SEQ ID NO: 2926169 - RNA, 18 nt, Mycobacterium avium subsp. paratuberculosis
ccagucugagcccgggca

SEQ ID NO: 2926170 - RNA, 19 nt, Mycobacterium avium subsp. paratuberculosis
ccagucugagcccgggcag

SEQ ID NO: 2926171 - RNA, 19 nt, Mycobacterium avium subsp. paratuberculosis
ccagugacgccugcggccc

SEQ ID NO: 2926172 - RNA, 16 nt, Mycobacterium avium subsp. paratuberculosis
ccagugcaccucgacg

SEQ ID NO: 2926173 - RNA, 13 nt, Mycobacterium avium subsp. paratuberculosis
ccagugcacgcuc

SEQ ID NO: 2926174 - RNA, 14 nt, Mycobacterium avium subsp. paratuberculosis
ccagugcacgcucg

SEQ ID NO: 2926175 - RNA, 17 nt, Mycobacterium avium subsp. paratuberculosis
ccagugcacgcucggcg

SEQ ID NO: 2926176 - RNA, 15 nt, Mycobacterium avium subsp. paratuberculosis
ccagugccaguacca

SEQ ID NO: 2926177 - RNA, 16 nt, Mycobacterium avium subsp. paratuberculosis
ccagugcccgagcacc

SEQ ID NO: 2926178 - RNA, 12 nt, Mycobacterium avium subsp. paratuberculosis
ccagugcccggc

SEQ ID NO: 2926179 - RNA, 22 nt, Mycobacterium avium subsp. paratuberculosis
ccagugccgcagguggugggcg

SEQ ID NO: 2926180 - RNA, 13 nt, Mycobacterium avium subsp. paratuberculosis
ccagugccgggcc

SEQ ID NO: 2926181 - RNA, 15 nt, Mycobacterium avium subsp. paratuberculosis
ccagugcgcgccgug

SEQ ID NO: 2926182 - RNA, 17 nt, Mycobacterium avium subsp. paratuberculosis
ccagugcgugaccugcu

SEQ ID NO: 2926183 - RNA, 22 nt, Mycobacterium avium subsp. paratuberculosis
ccagugcgugaccugcugggcg

SEQ ID NO: 2926184 - RNA, 17 nt, Mycobacterium avium subsp. paratuberculosis
ccaguggaucggcccga

SEQ ID NO: 2926185 - RNA, 21 nt, Mycobacterium avium subsp. paratuberculosis
ccaguggcugucgggugccgc

SEQ ID NO: 2926186 - RNA, 13 nt, Mycobacterium avium subsp. paratuberculosis
ccaguguccgggc

SEQ ID NO: 2926187 - RNA, 18 nt, Mycobacterium avium subsp. paratuberculosis
ccaguguccgggcgccca

SEQ ID NO: 2926188 - RNA, 18 nt, Mycobacterium avium subsp. paratuberculosis
ccaguguggccgcggcgg

SEQ ID NO: 2926189 - RNA, 20 nt, Mycobacterium avium subsp. paratuberculosis
ccaguguggccgcggcggcc

SEQ ID NO: 2926190 - RNA, 21 nt, Mycobacterium avium subsp. paratuberculosis
ccaguguggccgcggcggccc

SEQ ID NO: 2926191 - RNA, 14 nt, Mycobacterium avium subsp. paratuberculosis
ccaguucaccgcgc

SEQ ID NO: 2926192 - RNA, 15 nt, Mycobacterium avium subsp. paratuberculosis
ccaguuccugcaugc

SEQ ID NO: 2926193 - RNA, 15 nt, Mycobacterium avium subsp. paratuberculosis
ccaguucgagcgccg

SEQ ID NO: 2926194 - RNA, 17 nt, Mycobacterium avium subsp. paratuberculosis
ccaguucgagcgccgcg

SEQ ID NO: 2926195 - RNA, 14 nt, Mycobacterium avium subsp. paratuberculosis
ccaguucgccggug

SEQ ID NO: 2926196 - RNA, 12 nt, Mycobacterium avium subsp. paratuberculosis
ccaguucggcca

SEQ ID NO: 2926197 - RNA, 18 nt, Mycobacterium avium subsp. paratuberculosis
ccaguucggccaccgcgu

SEQ ID NO: 2926198 - RNA, 17 nt, Mycobacterium avium subsp. paratuberculosis
ccaguucggccagcgcg

SEQ ID NO: 2926199 - RNA, 16 nt, Mycobacterium avium subsp. paratuberculosis
ccaguucgucggccgu

SEQ ID NO: 2926200 - RNA, 20 nt, Mycobacterium avium subsp. paratuberculosis
ccaguugaaguccggcgguc

SEQ ID NO: 2926201 - RNA, 16 nt, Mycobacterium avium subsp. paratuberculosis
ccaguugacguugauc

SEQ ID NO: 2926202 - RNA, 20 nt, Mycobacterium avium subsp. paratuberculosis
ccaguugacguugaucgcgc

SEQ ID NO: 2926203 - RNA, 22 nt, Mycobacterium avium subsp. paratuberculosis
ccaguugacguugaucgcgccg

SEQ ID NO: 2926204 - RNA, 16 nt, Mycobacterium avium subsp. paratuberculosis
ccaguugcaccggcac

SEQ ID NO: 2926205 - RNA, 15 nt, Mycobacterium avium subsp. paratuberculosis
ccaguugcgaccccg

SEQ ID NO: 2926206 - RNA, 16 nt, Mycobacterium avium subsp. paratuberculosis
ccaguugcgaccccgc

SEQ ID NO: 2926207 - RNA, 17 nt, Mycobacterium avium subsp. paratuberculosis
ccaguugcgaccccgcc

SEQ ID NO: 2926208 - RNA, 21 nt, Mycobacterium avium subsp. paratuberculosis
ccaguugcgaccccgccgucg

SEQ ID NO: 2926209 - RNA, 23 nt, Mycobacterium avium subsp. paratuberculosis
ccaguugcgaccccgccgucgac

SEQ ID NO: 2926210 - RNA, 22 nt, Mycobacterium avium subsp. paratuberculosis
ccaguugcggcacgccgaccac

SEQ ID NO: 2926211 - RNA, 15 nt, Mycobacterium avium subsp. paratuberculosis
ccaguuggcgucguc

SEQ ID NO: 2926212 - RNA, 22 nt, Mycobacterium avium subsp. paratuberculosis
ccaguuggcgucgucggcggcg

SEQ ID NO: 2926213 - RNA, 22 nt, Mycobacterium avium subsp. paratuberculosis
ccaguugggggccagcgccgag

SEQ ID NO: 2926214 - RNA, 13 nt, Mycobacterium avium subsp. paratuberculosis
ccaguugucgauc

SEQ ID NO: 2926215 - RNA, 20 nt, Mycobacterium avium subsp. paratuberculosis
ccaguugucgaucuccucgc

SEQ ID NO: 2926216 - RNA, 20 nt, Mycobacterium avium subsp. paratuberculosis
ccaguuguuuccccagcccg

SEQ ID NO: 2926217 - RNA, 23 nt, Mycobacterium avium subsp. paratuberculosis
ccaguuguuuccccagcccggau

SEQ ID NO: 2926218 - RNA, 15 nt, Mycobacterium avium subsp. paratuberculosis
ccaguuugccgucgg

SEQ ID NO: 2926219 - RNA, 14 nt, Mycobacterium avium subsp. paratuberculosis
ccauaaaccggccg

SEQ ID NO: 2926220 - RNA, 20 nt, Mycobacterium avium subsp. paratuberculosis
ccauaaaccggccggcgcgc

SEQ ID NO: 2926221 - RNA, 15 nt, Mycobacterium avium subsp. paratuberculosis
ccauaaagccgucgu

SEQ ID NO: 2926222 - RNA, 15 nt, Mycobacterium avium subsp. paratuberculosis
ccauacacgggccgu

SEQ ID NO: 2926223 - RNA, 15 nt, Mycobacterium avium subsp. paratuberculosis
ccauacugacgccgg

SEQ ID NO: 2926224 - RNA, 17 nt, Mycobacterium avium subsp. paratuberculosis
ccaucaacccgagcacc

SEQ ID NO: 2926225 - RNA, 23 nt, Mycobacterium avium subsp. paratuberculosis
ccaucaacccgagcaccgggccg

SEQ ID NO: 2926226 - RNA, 14 nt, Mycobacterium avium subsp. paratuberculosis
ccaucaccagcgcg

SEQ ID NO: 2926227 - RNA, 20 nt, Mycobacterium avium subsp. paratuberculosis
ccaucaccagcgcguagagc

SEQ ID NO: 2926228 - RNA, 13 nt, Mycobacterium avium subsp. paratuberculosis
ccaucaccagcgg

SEQ ID NO: 2926229 - RNA, 15 nt, Mycobacterium avium subsp. paratuberculosis
ccaucaccagcggcu

SEQ ID NO: 2926230 - RNA, 15 nt, Mycobacterium avium subsp. paratuberculosis
ccaucaccccgaagc

SEQ ID NO: 2926231 - RNA, 13 nt, Mycobacterium avium subsp. paratuberculosis
ccaucaccgcacc

SEQ ID NO: 2926232 - RNA, 20 nt, Mycobacterium avium subsp. paratuberculosis
ccaucaccggaccggccagc

SEQ ID NO: 2926233 - RNA, 23 nt, Mycobacterium avium subsp. paratuberculosis
ccaucaccggaccggccagcagc

SEQ ID NO: 2926234 - RNA, 17 nt, Mycobacterium avium subsp. paratuberculosis
ccaucaccuccuuggcc

SEQ ID NO: 2926235 - RNA, 19 nt, Mycobacterium avium subsp. paratuberculosis
ccaucgugggcgccgucgc

SEQ ID NO: 2926236 - RNA, 22 nt, Mycobacterium avium subsp. paratuberculosis
ccaucgugggcgccgucgccgc

SEQ ID NO: 2926237 - RNA, 21 nt, Mycobacterium avium subsp. paratuberculosis
ccaucucagcguucacgucga

SEQ ID NO: 2926238 - RNA, 14 nt, Mycobacterium avium subsp. paratuberculosis
ccaucuccagcucc

SEQ ID NO: 2926239 - RNA, 15 nt, Mycobacterium avium subsp. paratuberculosis
ccaucuccagcuccg

SEQ ID NO: 2926240 - RNA, 19 nt, Mycobacterium avium subsp. paratuberculosis
ccaucuccuccgggcugac

SEQ ID NO: 2926241 - RNA, 16 nt, Mycobacterium avium subsp. paratuberculosis
ccaucucgugcccggg

SEQ ID NO: 2926242 - RNA, 17 nt, Mycobacterium avium subsp. paratuberculosis
ccaucucgugcccgggc

SEQ ID NO: 2926243 - RNA, 18 nt, Mycobacterium avium subsp. paratuberculosis
ccaucucgugcccgggcc

SEQ ID NO: 2926244 - RNA, 20 nt, Mycobacterium avium subsp. paratuberculosis
ccaucucgugcccgggcccg

SEQ ID NO: 2926245 - RNA, 15 nt, Mycobacterium avium subsp. paratuberculosis
ccaucugcacagcuu

SEQ ID NO: 2926246 - RNA, 22 nt, Mycobacterium avium subsp. paratuberculosis
ccaucugcacagcuucggcgcc

SEQ ID NO: 2926247 - RNA, 15 nt, Mycobacterium avium subsp. paratuberculosis
ccaucugccggcgcu

SEQ ID NO: 2926248 - RNA, 12 nt, Mycobacterium avium subsp. paratuberculosis
ccaucuggccgc

SEQ ID NO: 2926249 - RNA, 23 nt, Mycobacterium avium subsp. paratuberculosis
ccaucuggccgcgggugcggccc

SEQ ID NO: 2926250 - RNA, 23 nt, Mycobacterium avium subsp. paratuberculosis
ccaucuucacgugcgcggcgucc

SEQ ID NO: 2926251 - RNA, 16 nt, Mycobacterium avium subsp. paratuberculosis
ccaucuucaguucggc

SEQ ID NO: 2926252 - RNA, 15 nt, Mycobacterium avium subsp. paratuberculosis
ccaugaaccggucgu

SEQ ID NO: 2926253 - RNA, 17 nt, Mycobacterium avium subsp. paratuberculosis
ccaugaacgcgucgccg

SEQ ID NO: 2926254 - RNA, 23 nt, Mycobacterium avium subsp. paratuberculosis
ccaugaacuccgacuccagcagc

SEQ ID NO: 2926255 - RNA, 20 nt, Mycobacterium avium subsp. paratuberculosis
ccaugaacugguuccacacc

SEQ ID NO: 2926256 - RNA, 15 nt, Mycobacterium avium subsp. paratuberculosis
ccaugaagccguuga

SEQ ID NO: 2926257 - RNA, 20 nt, Mycobacterium avium subsp. paratuberculosis
ccaugaagccguugccgccg

SEQ ID NO: 2926258 - RNA, 18 nt, Mycobacterium avium subsp. paratuberculosis
ccaugaauucgaacuggg

SEQ ID NO: 2926259 - RNA, 13 nt, Mycobacterium avium subsp. paratuberculosis
ccaugacccgguu

SEQ ID NO: 2926260 - RNA, 21 nt, Mycobacterium avium subsp. paratuberculosis
ccaugaucacaccgcugucgg

SEQ ID NO: 2926261 - RNA, 21 nt, Mycobacterium avium subsp. paratuberculosis
ccaugaucagcgccguggccc

SEQ ID NO: 2926262 - RNA, 12 nt, Mycobacterium avium subsp. paratuberculosis
ccaugaucgaaa

SEQ ID NO: 2926263 - RNA, 22 nt, Mycobacterium avium subsp. paratuberculosis
ccaugaugucguuguccagcgu

SEQ ID NO: 2926264 - RNA, 22 nt, Mycobacterium avium subsp. paratuberculosis
ccaugcccagcaguccggcggu

SEQ ID NO: 2926265 - RNA, 17 nt, Mycobacterium avium subsp. paratuberculosis
ccaugcccaugucgauc

SEQ ID NO: 2926266 - RNA, 20 nt, Mycobacterium avium subsp. paratuberculosis
ccaugccccaggugacgccg

SEQ ID NO: 2926267 - RNA, 23 nt, Mycobacterium avium subsp. paratuberculosis
ccaugcccgcccacgggucgccg

SEQ ID NO: 2926268 - RNA, 18 nt, Mycobacterium avium subsp. paratuberculosis
ccaugccgccauccuguc

SEQ ID NO: 2926269 - RNA, 23 nt, Mycobacterium avium subsp. paratuberculosis
ccaugccgccgaagcccgacauc

SEQ ID NO: 2926270 - RNA, 13 nt, Mycobacterium avium subsp. paratuberculosis
ccaugccgccgac

SEQ ID NO: 2926271 - RNA, 17 nt, Mycobacterium avium subsp. paratuberculosis
ccaugccgccgaccgcc

SEQ ID NO: 2926272 - RNA, 16 nt, Mycobacterium avium subsp. paratuberculosis
ccaugccgcgggccag

SEQ ID NO: 2926273 - RNA, 18 nt, Mycobacterium avium subsp. paratuberculosis
ccaugccgcgggccagca

SEQ ID NO: 2926274 - RNA, 20 nt, Mycobacterium avium subsp. paratuberculosis
ccaugccgcgggccagcagc

SEQ ID NO: 2926275 - RNA, 14 nt, Mycobacterium avium subsp. paratuberculosis
ccaugccggccuga

SEQ ID NO: 2926276 - RNA, 18 nt, Mycobacterium avium subsp. paratuberculosis
ccaugccgucgcgcaccg

SEQ ID NO: 2926277 - RNA, 21 nt, Mycobacterium avium subsp. paratuberculosis
ccaugccucuucggcgcgccg

SEQ ID NO: 2926278 - RNA, 23 nt, Mycobacterium avium subsp. paratuberculosis
ccaugccucuucggcgcgccggc

SEQ ID NO: 2926279 - RNA, 19 nt, Mycobacterium avium subsp. paratuberculosis
ccaugcucuugcgggcggc

SEQ ID NO: 2926280 - RNA, 22 nt, Mycobacterium avium subsp. paratuberculosis
ccaugcucuugcgggcggcagc

SEQ ID NO: 2926281 - RNA, 17 nt, Mycobacterium avium subsp. paratuberculosis
ccaugcuggugccgccg

SEQ ID NO: 2926282 - RNA, 18 nt, Mycobacterium avium subsp. paratuberculosis
ccaugcuggugccgccga

SEQ ID NO: 2926283 - RNA, 20 nt, Mycobacterium avium subsp. paratuberculosis
ccaugcuggugccgccgaug

SEQ ID NO: 2926284 - RNA, 13 nt, Mycobacterium avium subsp. paratuberculosis
ccauggaguuguc

SEQ ID NO: 2926285 - RNA, 12 nt, Mycobacterium avium subsp. paratuberculosis
ccauggccagga

SEQ ID NO: 2926286 - RNA, 16 nt, Mycobacterium avium subsp. paratuberculosis
ccauggccaggaacgg

SEQ ID NO: 2926287 - RNA, 16 nt, Mycobacterium avium subsp. paratuberculosis
ccauggcgcaccgcgg

SEQ ID NO: 2926288 - RNA, 17 nt, Mycobacterium avium subsp. paratuberculosis
ccauggcgcaccgcggc

SEQ ID NO: 2926289 - RNA, 19 nt, Mycobacterium avium subsp. paratuberculosis
ccauggcgcaccgcggccu

SEQ ID NO: 2926290 - RNA, 14 nt, Mycobacterium avium subsp. paratuberculosis
ccauggcgcggcgg

SEQ ID NO: 2926291 - RNA, 20 nt, Mycobacterium avium subsp. paratuberculosis
ccauggcgcggcggccggcc

SEQ ID NO: 2926292 - RNA, 14 nt, Mycobacterium avium subsp. paratuberculosis
ccauggcggcaucc

SEQ ID NO: 2926293 - RNA, 14 nt, Mycobacterium avium subsp. paratuberculosis
ccauggcggcccgc

SEQ ID NO: 2926294 - RNA, 18 nt, Mycobacterium avium subsp. paratuberculosis
ccauggcggcccgcgccg

SEQ ID NO: 2926295 - RNA, 22 nt, Mycobacterium avium subsp. paratuberculosis
ccaugggguugaccuugaccag

SEQ ID NO: 2926296 - RNA, 23 nt, Mycobacterium avium subsp. paratuberculosis
ccaugggguugaccuugaccagc

SEQ ID NO: 2926297 - RNA, 16 nt, Mycobacterium avium subsp. paratuberculosis
ccaugggucucggcga

SEQ ID NO: 2926298 - RNA, 23 nt, Mycobacterium avium subsp. paratuberculosis
ccauggucaggguguaggccgcg

SEQ ID NO: 2926299 - RNA, 16 nt, Mycobacterium avium subsp. paratuberculosis
ccauggucgagccgca

SEQ ID NO: 2926300 - RNA, 17 nt, Mycobacterium avium subsp. paratuberculosis
ccauggucgagccgcag

SEQ ID NO: 2926301 - RNA, 15 nt, Mycobacterium avium subsp. paratuberculosis
ccauggucgcggccg

SEQ ID NO: 2926302 - RNA, 17 nt, Mycobacterium avium subsp. paratuberculosis
ccauggucgcggccgug

SEQ ID NO: 2926303 - RNA, 20 nt, Mycobacterium avium subsp. paratuberculosis
ccauggugccgccguugcga

SEQ ID NO: 2926304 - RNA, 20 nt, Mycobacterium avium subsp. paratuberculosis
ccauguacagaccccacacc

SEQ ID NO: 2926305 - RNA, 20 nt, Mycobacterium avium subsp. paratuberculosis
ccauguagcagacggacacc

SEQ ID NO: 2926306 - RNA, 19 nt, Mycobacterium avium subsp. paratuberculosis
ccauguaguucagcagccg

SEQ ID NO: 2926307 - RNA, 21 nt, Mycobacterium avium subsp. paratuberculosis
ccauguaguucagcagccggc

SEQ ID NO: 2926308 - RNA, 23 nt, Mycobacterium avium subsp. paratuberculosis
ccauguaguucagcagccggcag

SEQ ID NO: 2926309 - RNA, 15 nt, Mycobacterium avium subsp. paratuberculosis
ccauguccccgacca

SEQ ID NO: 2926310 - RNA, 22 nt, Mycobacterium avium subsp. paratuberculosis
ccauguccccgaccaucauggc

SEQ ID NO: 2926311 - RNA, 16 nt, Mycobacterium avium subsp. paratuberculosis
ccauguccggcaggcu

SEQ ID NO: 2926312 - RNA, 13 nt, Mycobacterium avium subsp. paratuberculosis
ccaugucgacgcu

SEQ ID NO: 2926313 - RNA, 17 nt, Mycobacterium avium subsp. paratuberculosis
ccaugucgacgcugagc

SEQ ID NO: 2926314 - RNA, 17 nt, Mycobacterium avium subsp. paratuberculosis
ccaugucgucgagcucg

SEQ ID NO: 2926315 - RNA, 16 nt, Mycobacterium avium subsp. paratuberculosis
ccaugucgucggcgga

SEQ ID NO: 2926316 - RNA, 17 nt, Mycobacterium avium subsp. paratuberculosis
ccaugucguugacgcug

SEQ ID NO: 2926317 - RNA, 19 nt, Mycobacterium avium subsp. paratuberculosis
ccaugucguugacgcuggg

SEQ ID NO: 2926318 - RNA, 14 nt, Mycobacterium avium subsp. paratuberculosis
ccaugugccgcauc

SEQ ID NO: 2926319 - RNA, 12 nt, Mycobacterium avium subsp. paratuberculosis
cccacccggggc

SEQ ID NO: 2926320 - RNA, 13 nt, Mycobacterium avium subsp. paratuberculosis
cccacccggguug

SEQ ID NO: 2926321 - RNA, 17 nt, Mycobacterium avium subsp. paratuberculosis
cccaccgaaucacccac

SEQ ID NO: 2926322 - RNA, 18 nt, Mycobacterium avium subsp. paratuberculosis
cccaccgaaucacccacg

SEQ ID NO: 2926323 - RNA, 14 nt, Mycobacterium avium subsp. paratuberculosis
cccaccgacgcggc

SEQ ID NO: 2926324 - RNA, 14 nt, Mycobacterium avium subsp. paratuberculosis
cccaccgaucagga

SEQ ID NO: 2926325 - RNA, 12 nt, Mycobacterium avium subsp. paratuberculosis
cccaccgccacc

SEQ ID NO: 2926326 - RNA, 16 nt, Mycobacterium avium subsp. paratuberculosis
cccaccgccaccaggc

SEQ ID NO: 2926327 - RNA, 12 nt, Mycobacterium avium subsp. paratuberculosis
cccaccgcgaca

SEQ ID NO: 2926328 - RNA, 20 nt, Mycobacterium avium subsp. paratuberculosis
cccaccgcgacacgucgaca

SEQ ID NO: 2926329 - RNA, 16 nt, Mycobacterium avium subsp. paratuberculosis
cccaccgcgacccggc

SEQ ID NO: 2926330 - RNA, 15 nt, Mycobacterium avium subsp. paratuberculosis
cccaccgcggcgcgc

SEQ ID NO: 2926331 - RNA, 18 nt, Mycobacterium avium subsp. paratuberculosis
cccaccgcggcgcgcggc

SEQ ID NO: 2926332 - RNA, 19 nt, Mycobacterium avium subsp. paratuberculosis
cccaccgcggugaccgccc

SEQ ID NO: 2926333 - RNA, 15 nt, Mycobacterium avium subsp. paratuberculosis
cccaccgcuggaacc

SEQ ID NO: 2926334 - RNA, 14 nt, Mycobacterium avium subsp. paratuberculosis
cccaccggcccagc

SEQ ID NO: 2926335 - RNA, 15 nt, Mycobacterium avium subsp. paratuberculosis
cccaccggcccagcc

SEQ ID NO: 2926336 - RNA, 13 nt, Mycobacterium avium subsp. paratuberculosis
cccaccggcccgg

SEQ ID NO: 2926337 - RNA, 17 nt, Mycobacterium avium subsp. paratuberculosis
cccaccggcccggcggg

SEQ ID NO: 2926338 - RNA, 14 nt, Mycobacterium avium subsp. paratuberculosis
cccaccggcgcagc

SEQ ID NO: 2926339 - RNA, 17 nt, Mycobacterium avium subsp. paratuberculosis
cccaccggcgcagcgcg

SEQ ID NO: 2926340 - RNA, 12 nt, Mycobacterium avium subsp. paratuberculosis
cccaccgggauc

SEQ ID NO: 2926341 - RNA, 17 nt, Mycobacterium avium subsp. paratuberculosis
cccaccgguggccggga

SEQ ID NO: 2926342 - RNA, 18 nt, Mycobacterium avium subsp. paratuberculosis
cccaccgucgccacgauc

SEQ ID NO: 2926343 - RNA, 21 nt, Mycobacterium avium subsp. paratuberculosis
cccaccgucgccacgaucacc

SEQ ID NO: 2926344 - RNA, 16 nt, Mycobacterium avium subsp. paratuberculosis
cccaccugaucgcggc

SEQ ID NO: 2926345 - RNA, 17 nt, Mycobacterium avium subsp. paratuberculosis
cccaccugaucgcggcg

SEQ ID NO: 2926346 - RNA, 21 nt, Mycobacterium avium subsp. paratuberculosis
cccaccugaucgcggcgagca

SEQ ID NO: 2926347 - RNA, 13 nt, Mycobacterium avium subsp. paratuberculosis
cccaccuggaggc

SEQ ID NO: 2926348 - RNA, 14 nt, Mycobacterium avium subsp. paratuberculosis
cccaccuggaggcc

SEQ ID NO: 2926349 - RNA, 17 nt, Mycobacterium avium subsp. paratuberculosis
cccaccugguucucccg

SEQ ID NO: 2926350 - RNA, 18 nt, Mycobacterium avium subsp. paratuberculosis
cccaccugguuggcccgc

SEQ ID NO: 2926351 - RNA, 21 nt, Mycobacterium avium subsp. paratuberculosis
cccaccuucccaaccccgggc

SEQ ID NO: 2926352 - RNA, 22 nt, Mycobacterium avium subsp. paratuberculosis
cccacgaaccgguugcgggccg

SEQ ID NO: 2926353 - RNA, 21 nt, Mycobacterium avium subsp. paratuberculosis
cccacgaagaugaucagcgcg

SEQ ID NO: 2926354 - RNA, 22 nt, Mycobacterium avium subsp. paratuberculosis
cccacgaagaugaucagcgcgc

SEQ ID NO: 2926355 - RNA, 14 nt, Mycobacterium avium subsp. paratuberculosis
cccacgacgacugg

SEQ ID NO: 2926356 - RNA, 21 nt, Mycobacterium avium subsp. paratuberculosis
cccacgacgucugggccgccg

SEQ ID NO: 2926357 - RNA, 12 nt, Mycobacterium avium subsp. paratuberculosis
cccacgaucacg

SEQ ID NO: 2926358 - RNA, 15 nt, Mycobacterium avium subsp. paratuberculosis
cccacgcagcggugc

SEQ ID NO: 2926359 - RNA, 16 nt, Mycobacterium avium subsp. paratuberculosis
cccacgccagccgggu

SEQ ID NO: 2926360 - RNA, 19 nt, Mycobacterium avium subsp. paratuberculosis
cccacgccagccggguggc

SEQ ID NO: 2926361 - RNA, 20 nt, Mycobacterium avium subsp. paratuberculosis
cccacgccaugugccggcgc

SEQ ID NO: 2926362 - RNA, 15 nt, Mycobacterium avium subsp. paratuberculosis
cccacgccgcccagg

SEQ ID NO: 2926363 - RNA, 16 nt, Mycobacterium avium subsp. paratuberculosis
cccacgccgcccaggc

SEQ ID NO: 2926364 - RNA, 21 nt, Mycobacterium avium subsp. paratuberculosis
cccacgccgcccaggccccgg

SEQ ID NO: 2926365 - RNA, 13 nt, Mycobacterium avium subsp. paratuberculosis
cccacgccgucga

SEQ ID NO: 2926366 - RNA, 15 nt, Mycobacterium avium subsp. paratuberculosis
cccacgccgucgacc

SEQ ID NO: 2926367 - RNA, 22 nt, Mycobacterium avium subsp. paratuberculosis
cccacgccuugcgguuggccgg

SEQ ID NO: 2926368 - RNA, 15 nt, Mycobacterium avium subsp. paratuberculosis
cccacgggaugcggc

SEQ ID NO: 2926369 - RNA, 22 nt, Mycobacterium avium subsp. paratuberculosis
cccacgggaugcggcacgcguc

SEQ ID NO: 2926370 - RNA, 17 nt, Mycobacterium avium subsp. paratuberculosis
cccacgggucgccgauc

SEQ ID NO: 2926371 - RNA, 23 nt, Mycobacterium avium subsp. paratuberculosis
cccacggucuuugccggccauga

SEQ ID NO: 2926372 - RNA, 19 nt, Mycobacterium avium subsp. paratuberculosis
cccacggugaggacaccac

SEQ ID NO: 2926373 - RNA, 14 nt, Mycobacterium avium subsp. paratuberculosis
cccacguaggcgau

SEQ ID NO: 2926374 - RNA, 22 nt, Mycobacterium avium subsp. paratuberculosis
cccacguaggcgaugucgacgu

SEQ ID NO: 2926375 - RNA, 12 nt, Mycobacterium avium subsp. paratuberculosis
cccacguagggg

SEQ ID NO: 2926376 - RNA, 13 nt, Mycobacterium avium subsp. paratuberculosis
cccacgucgccgu

SEQ ID NO: 2926377 - RNA, 16 nt, Mycobacterium avium subsp. paratuberculosis
cccacgugcggcgccc

SEQ ID NO: 2926378 - RNA, 22 nt, Mycobacterium avium subsp. paratuberculosis
cccacguggugaucagcauccg

SEQ ID NO: 2926379 - RNA, 23 nt, Mycobacterium avium subsp. paratuberculosis
cccacguggugaucagcauccgc

SEQ ID NO: 2926380 - RNA, 16 nt, Mycobacterium avium subsp. paratuberculosis
cccacguugagcacgc

SEQ ID NO: 2926381 - RNA, 14 nt, Mycobacterium avium subsp. paratuberculosis
cccacucccagccg

SEQ ID NO: 2926382 - RNA, 16 nt, Mycobacterium avium subsp. paratuberculosis
cccacucccagccgcc

SEQ ID NO: 2926383 - RNA, 19 nt, Mycobacterium avium subsp. paratuberculosis
cccacucccagccgccggc

SEQ ID NO: 2926384 - RNA, 20 nt, Mycobacterium avium subsp. paratuberculosis
cccacucccagccgccggcc

SEQ ID NO: 2926385 - RNA, 16 nt, Mycobacterium avium subsp. paratuberculosis
cccacucgucgaucga

SEQ ID NO: 2926386 - RNA, 21 nt, Mycobacterium avium subsp. paratuberculosis
cccacugcccguagucggcgg

SEQ ID NO: 2926387 - RNA, 13 nt, Mycobacterium avium subsp. paratuberculosis
cccacuggcggcc

SEQ ID NO: 2926388 - RNA, 18 nt, Mycobacterium avium subsp. paratuberculosis
cccacuggcggccggccg

SEQ ID NO: 2926389 - RNA, 19 nt, Mycobacterium avium subsp. paratuberculosis
cccacuggcggccggccgc

SEQ ID NO: 2926390 - RNA, 23 nt, Mycobacterium avium subsp. paratuberculosis
cccacuggcggccggccgcgccc

SEQ ID NO: 2926391 - RNA, 21 nt, Mycobacterium avium subsp. paratuberculosis
cccacugguaaccgcccgagc

SEQ ID NO: 2926392 - RNA, 21 nt, Mycobacterium avium subsp. paratuberculosis
cccacuggucguugcacaccc

SEQ ID NO: 2926393 - RNA, 21 nt, Mycobacterium avium subsp. paratuberculosis
cccacuuuucccgcgcgagca

SEQ ID NO: 2926394 - RNA, 15 nt, Mycobacterium avium subsp. paratuberculosis
cccagaaacaccauc

SEQ ID NO: 2926395 - RNA, 13 nt, Mycobacterium avium subsp. paratuberculosis
cccagaaccgcuc

SEQ ID NO: 2926396 - RNA, 16 nt, Mycobacterium avium subsp. paratuberculosis
cccagaaccgcucggc

SEQ ID NO: 2926397 - RNA, 23 nt, Mycobacterium avium subsp. paratuberculosis
cccagaaccgcucggcggcgccg

SEQ ID NO: 2926398 - RNA, 20 nt, Mycobacterium avium subsp. paratuberculosis
cccagaacugcugccgucca

SEQ ID NO: 2926399 - RNA, 19 nt, Mycobacterium avium subsp. paratuberculosis
cccagaacugggccgccgu

SEQ ID NO: 2926400 - RNA, 20 nt, Mycobacterium avium subsp. paratuberculosis
cccagaacugggccgccguc

SEQ ID NO: 2926401 - RNA, 14 nt, Mycobacterium avium subsp. paratuberculosis
cccagaauucgccg

SEQ ID NO: 2926402 - RNA, 17 nt, Mycobacterium avium subsp. paratuberculosis
cccagacaggccggccg

SEQ ID NO: 2926403 - RNA, 18 nt, Mycobacterium avium subsp. paratuberculosis
cccagacaggccggccgc

SEQ ID NO: 2926404 - RNA, 15 nt, Mycobacterium avium subsp. paratuberculosis
cccagccccagcacg

SEQ ID NO: 2926405 - RNA, 16 nt, Mycobacterium avium subsp. paratuberculosis
cccagccccagcacga

SEQ ID NO: 2926406 - RNA, 18 nt, Mycobacterium avium subsp. paratuberculosis
cccagccccagcacgaug

SEQ ID NO: 2926407 - RNA, 19 nt, Mycobacterium avium subsp. paratuberculosis
cccagccccucgccgggcg

SEQ ID NO: 2926408 - RNA, 21 nt, Mycobacterium avium subsp. paratuberculosis
cccagcccgagcaccagcgga

SEQ ID NO: 2926409 - RNA, 15 nt, Mycobacterium avium subsp. paratuberculosis
cccagcccgccgcgu

SEQ ID NO: 2926410 - RNA, 16 nt, Mycobacterium avium subsp. paratuberculosis
cccagcccgccgcguc

SEQ ID NO: 2926411 - RNA, 16 nt, Mycobacterium avium subsp. paratuberculosis
cccagcccgccgggcu

SEQ ID NO: 2926412 - RNA, 14 nt, Mycobacterium avium subsp. paratuberculosis
cccagcccgcgccg

SEQ ID NO: 2926413 - RNA, 18 nt, Mycobacterium avium subsp. paratuberculosis
cccagcccgcgccgagca

SEQ ID NO: 2926414 - RNA, 14 nt, Mycobacterium avium subsp. paratuberculosis
cccagcccgcgcga

SEQ ID NO: 2926415 - RNA, 18 nt, Mycobacterium avium subsp. paratuberculosis
cccagcccgcgcgagcgc

SEQ ID NO: 2926416 - RNA, 22 nt, Mycobacterium avium subsp. paratuberculosis
cccagcccgcgcgagcgcagcg

SEQ ID NO: 2926417 - RNA, 17 nt, Mycobacterium avium subsp. paratuberculosis
cccagcccgcgggcggc

SEQ ID NO: 2926418 - RNA, 11 nt, Mycobacterium avium subsp. paratuberculosis
cccagcccgga

SEQ ID NO: 2926419 - RNA, 13 nt, Mycobacterium avium subsp. paratuberculosis
cccagcccggcca

SEQ ID NO: 2926420 - RNA, 19 nt, Mycobacterium avium subsp. paratuberculosis
cccagcccggccagcaccc

SEQ ID NO: 2926421 - RNA, 15 nt, Mycobacterium avium subsp. paratuberculosis
cccagcccggcgacg

SEQ ID NO: 2926422 - RNA, 23 nt, Mycobacterium avium subsp. paratuberculosis
cccagcccucgucgaugacgucc

SEQ ID NO: 2926423 - RNA, 16 nt, Mycobacterium avium subsp. paratuberculosis
cccagccgagccgggc

SEQ ID NO: 2926424 - RNA, 22 nt, Mycobacterium avium subsp. paratuberculosis
cccagccgcaggugcagcuccu

SEQ ID NO: 2926425 - RNA, 22 nt, Mycobacterium avium subsp. paratuberculosis
cccagccgcauucggugagcca

SEQ ID NO: 2926426 - RNA, 16 nt, Mycobacterium avium subsp. paratuberculosis
cccagccgccagccgg

SEQ ID NO: 2926427 - RNA, 13 nt, Mycobacterium avium subsp. paratuberculosis
cccagccgccgcg

SEQ ID NO: 2926428 - RNA, 16 nt, Mycobacterium avium subsp. paratuberculosis
cccagccgccgcgaca

SEQ ID NO: 2926429 - RNA, 21 nt, Mycobacterium avium subsp. paratuberculosis
cccagccgccgcgacacccgc

SEQ ID NO: 2926430 - RNA, 13 nt, Mycobacterium avium subsp. paratuberculosis
cccagccgccggc

SEQ ID NO: 2926431 - RNA, 14 nt, Mycobacterium avium subsp. paratuberculosis
cccagccgccggcc

SEQ ID NO: 2926432 - RNA, 17 nt, Mycobacterium avium subsp. paratuberculosis
cccagccgccggccacc

SEQ ID NO: 2926433 - RNA, 20 nt, Mycobacterium avium subsp. paratuberculosis
cccagccgcgucacgucggc

SEQ ID NO: 2926434 - RNA, 20 nt, Mycobacterium avium subsp. paratuberculosis
cccagccgcugaacgcgauc

SEQ ID NO: 2926435 - RNA, 19 nt, Mycobacterium avium subsp. paratuberculosis
cccagccgcugacgauggc

SEQ ID NO: 2926436 - RNA, 16 nt, Mycobacterium avium subsp. paratuberculosis
cccagccgcugcgaca

SEQ ID NO: 2926437 - RNA, 15 nt, Mycobacterium avium subsp. paratuberculosis
cccagccggacagcg

SEQ ID NO: 2926438 - RNA, 14 nt, Mycobacterium avium subsp. paratuberculosis
cccagccggccgac

SEQ ID NO: 2926439 - RNA, 19 nt, Mycobacterium avium subsp. paratuberculosis
cccagccggccgacgcggc

SEQ ID NO: 2926440 - RNA, 13 nt, Mycobacterium avium subsp. paratuberculosis
cccagccggcggu

SEQ ID NO: 2926441 - RNA, 14 nt, Mycobacterium avium subsp. paratuberculosis
cccagccggugcga

SEQ ID NO: 2926442 - RNA, 16 nt, Mycobacterium avium subsp. paratuberculosis
cccagccgucgcaccg

SEQ ID NO: 2926443 - RNA, 16 nt, Mycobacterium avium subsp. paratuberculosis
cccagccgugccccag

SEQ ID NO: 2926444 - RNA, 15 nt, Mycobacterium avium subsp. paratuberculosis
cccagcgacucggcc

SEQ ID NO: 2926445 - RNA, 19 nt, Mycobacterium avium subsp. paratuberculosis
cccagcgacucggccagga

SEQ ID NO: 2926446 - RNA, 13 nt, Mycobacterium avium subsp. paratuberculosis
cccagcgagaccg

SEQ ID NO: 2926447 - RNA, 15 nt, Mycobacterium avium subsp. paratuberculosis
cccagcgagaccgcu

SEQ ID NO: 2926448 - RNA, 18 nt, Mycobacterium avium subsp. paratuberculosis
cccagcgagaccgcuugc

SEQ ID NO: 2926449 - RNA, 13 nt, Mycobacterium avium subsp. paratuberculosis
cccagcgagcagg

SEQ ID NO: 2926450 - RNA, 15 nt, Mycobacterium avium subsp. paratuberculosis
cccagcgagcagguc

SEQ ID NO: 2926451 - RNA, 12 nt, Mycobacterium avium subsp. paratuberculosis
cccagcgagccg

SEQ ID NO: 2926452 - RNA, 14 nt, Mycobacterium avium subsp. paratuberculosis
cccagcgaggcggc

SEQ ID NO: 2926453 - RNA, 13 nt, Mycobacterium avium subsp. paratuberculosis
cccagcgagguga

SEQ ID NO: 2926454 - RNA, 16 nt, Mycobacterium avium subsp. paratuberculosis
cccagcgaggugaagc

SEQ ID NO: 2926455 - RNA, 21 nt, Mycobacterium avium subsp. paratuberculosis
cccagcgaggugaagccguug

SEQ ID NO: 2926456 - RNA, 12 nt, Mycobacterium avium subsp. paratuberculosis
cccagcgcaacg

SEQ ID NO: 2926457 - RNA, 18 nt, Mycobacterium avium subsp. paratuberculosis
cccagcgcaacggcgucg

SEQ ID NO: 2926458 - RNA, 21 nt, Mycobacterium avium subsp. paratuberculosis
cccagcgcaacggcgucgaca

SEQ ID NO: 2926459 - RNA, 15 nt, Mycobacterium avium subsp. paratuberculosis
cccagcgcagcaucg

SEQ ID NO: 2926460 - RNA, 14 nt, Mycobacterium avium subsp. paratuberculosis
cccagcgcagcgcc

SEQ ID NO: 2926461 - RNA, 15 nt, Mycobacterium avium subsp. paratuberculosis
cccagcgcagcgccu

SEQ ID NO: 2926462 - RNA, 18 nt, Mycobacterium avium subsp. paratuberculosis
cccagcgcagcgccucgg

SEQ ID NO: 2926463 - RNA, 22 nt, Mycobacterium avium subsp. paratuberculosis
cccagcgcagcgccucggcggc

SEQ ID NO: 2926464 - RNA, 13 nt, Mycobacterium avium subsp. paratuberculosis
cccagcgccacgg

SEQ ID NO: 2926465 - RNA, 13 nt, Mycobacterium avium subsp. paratuberculosis
cccagcgccagga

SEQ ID NO: 2926466 - RNA, 14 nt, Mycobacterium avium subsp. paratuberculosis
cccagcgcccgggc

SEQ ID NO: 2926467 - RNA, 17 nt, Mycobacterium avium subsp. paratuberculosis
cccagcgcccguagccg

SEQ ID NO: 2926468 - RNA, 15 nt, Mycobacterium avium subsp. paratuberculosis
cccagcgccgcggcg

SEQ ID NO: 2926469 - RNA, 18 nt, Mycobacterium avium subsp. paratuberculosis
cccagcgccucgagcacc

SEQ ID NO: 2926470 - RNA, 19 nt, Mycobacterium avium subsp. paratuberculosis
cccagcgccucgagcacca

SEQ ID NO: 2926471 - RNA, 20 nt, Mycobacterium avium subsp. paratuberculosis
cccagcgccucgagcaccac

SEQ ID NO: 2926472 - RNA, 22 nt, Mycobacterium avium subsp. paratuberculosis
cccagcgcgaccagugcaccuc

SEQ ID NO: 2926473 - RNA, 21 nt, Mycobacterium avium subsp. paratuberculosis
cccagcgcgacgucgaccgcg

SEQ ID NO: 2926474 - RNA, 20 nt, Mycobacterium avium subsp. paratuberculosis
cccagcgcgaggucgacgga

SEQ ID NO: 2926475 - RNA, 16 nt, Mycobacterium avium subsp. paratuberculosis
cccagcgcgcgaucgc

SEQ ID NO: 2926476 - RNA, 13 nt, Mycobacterium avium subsp. paratuberculosis
cccagcgcgcggc

SEQ ID NO: 2926477 - RNA, 14 nt, Mycobacterium avium subsp. paratuberculosis
cccagcgcgcggcg

SEQ ID NO: 2926478 - RNA, 12 nt, Mycobacterium avium subsp. paratuberculosis
cccagcgcggcg

SEQ ID NO: 2926479 - RNA, 13 nt, Mycobacterium avium subsp. paratuberculosis
cccagcgcggcga

SEQ ID NO: 2926480 - RNA, 16 nt, Mycobacterium avium subsp. paratuberculosis
cccagcgcggcggcca

SEQ ID NO: 2926481 - RNA, 13 nt, Mycobacterium avium subsp. paratuberculosis
cccagcgcggucg

SEQ ID NO: 2926482 - RNA, 14 nt, Mycobacterium avium subsp. paratuberculosis
cccagcgcggucgc

SEQ ID NO: 2926483 - RNA, 13 nt, Mycobacterium avium subsp. paratuberculosis
cccagcgcguuga

SEQ ID NO: 2926484 - RNA, 18 nt, Mycobacterium avium subsp. paratuberculosis
cccagcgcguugcggccg

SEQ ID NO: 2926485 - RNA, 22 nt, Mycobacterium avium subsp. paratuberculosis
cccagcggaaccgggggccguc

SEQ ID NO: 2926486 - RNA, 22 nt, Mycobacterium avium subsp. paratuberculosis
cccagcggagcguucuccaccc

SEQ ID NO: 2926487 - RNA, 12 nt, Mycobacterium avium subsp. paratuberculosis
cccagcggcacg

SEQ ID NO: 2926488 - RNA, 13 nt, Mycobacterium avium subsp. paratuberculosis
cccagcggcacgg

SEQ ID NO: 2926489 - RNA, 19 nt, Mycobacterium avium subsp. paratuberculosis
cccagcggcacgggcaccg

SEQ ID NO: 2926490 - RNA, 14 nt, Mycobacterium avium subsp. paratuberculosis
cccaggccccggcc

SEQ ID NO: 2926491 - RNA, 20 nt, Mycobacterium avium subsp. paratuberculosis
cccaggccccggccgagcgc

SEQ ID NO: 2926492 - RNA, 23 nt, Mycobacterium avium subsp. paratuberculosis
cccaggccccggccgagcgcagc

SEQ ID NO: 2926493 - RNA, 14 nt, Mycobacterium avium subsp. paratuberculosis
cccaggcccggcac

SEQ ID NO: 2926494 - RNA, 20 nt, Mycobacterium avium subsp. paratuberculosis
cccaggcccgggagaaccuc

SEQ ID NO: 2926495 - RNA, 15 nt, Mycobacterium avium subsp. paratuberculosis
cccaggcccgggauc

SEQ ID NO: 2926496 - RNA, 13 nt, Mycobacterium avium subsp. paratuberculosis
cccaggcccgguu

SEQ ID NO: 2926497 - RNA, 17 nt, Mycobacterium avium subsp. paratuberculosis
cccaggccgacgccggc

SEQ ID NO: 2926498 - RNA, 23 nt, Mycobacterium avium subsp. paratuberculosis
cccaggccgauggugguaccgac

SEQ ID NO: 2926499 - RNA, 13 nt, Mycobacterium avium subsp. paratuberculosis
cccaggccgccag

SEQ ID NO: 2926500 - RNA, 14 nt, Mycobacterium avium subsp. paratuberculosis
cccaggccgccagc

SEQ ID NO: 2926501 - RNA, 15 nt, Mycobacterium avium subsp. paratuberculosis
cccaggccgccagcu

SEQ ID NO: 2926502 - RNA, 14 nt, Mycobacterium avium subsp. paratuberculosis
cccaggccgccgcc

SEQ ID NO: 2926503 - RNA, 15 nt, Mycobacterium avium subsp. paratuberculosis
cccaggccgccgcca

SEQ ID NO: 2926504 - RNA, 15 nt, Mycobacterium avium subsp. paratuberculosis
cccaggccgcggcca

SEQ ID NO: 2926505 - RNA, 17 nt, Mycobacterium avium subsp. paratuberculosis
cccaggccgcggccaag

SEQ ID NO: 2926506 - RNA, 21 nt, Mycobacterium avium subsp. paratuberculosis
cccaggccgcggccaagugcg

SEQ ID NO: 2926507 - RNA, 15 nt, Mycobacterium avium subsp. paratuberculosis
cccaggccgcggucg

SEQ ID NO: 2926508 - RNA, 20 nt, Mycobacterium avium subsp. paratuberculosis
cccaggccgcggucgccccg

SEQ ID NO: 2926509 - RNA, 15 nt, Mycobacterium avium subsp. paratuberculosis
cccaggccggcggug

SEQ ID NO: 2926510 - RNA, 18 nt, Mycobacterium avium subsp. paratuberculosis
cccaggccggcgguggug

SEQ ID NO: 2926511 - RNA, 23 nt, Mycobacterium avium subsp. paratuberculosis
cccaggcgaacauggcggccagc

SEQ ID NO: 2926512 - RNA, 14 nt, Mycobacterium avium subsp. paratuberculosis
cccaggcgaugccg

SEQ ID NO: 2926513 - RNA, 20 nt, Mycobacterium avium subsp. paratuberculosis
cccaggcgaugccgccgacg

SEQ ID NO: 2926514 - RNA, 15 nt, Mycobacterium avium subsp. paratuberculosis
cccaggcgucgucgu

SEQ ID NO: 2926515 - RNA, 21 nt, Mycobacterium avium subsp. paratuberculosis
cccaggcgucgucgucgagcc

SEQ ID NO: 2926516 - RNA, 22 nt, Mycobacterium avium subsp. paratuberculosis
cccaggcgucgucgucgagccg

SEQ ID NO: 2926517 - RNA, 23 nt, Mycobacterium avium subsp. paratuberculosis
cccaggcgucgucgucgagccgc

SEQ ID NO: 2926518 - RNA, 15 nt, Mycobacterium avium subsp. paratuberculosis
cccaggcguggucgg

SEQ ID NO: 2926519 - RNA, 17 nt, Mycobacterium avium subsp. paratuberculosis
cccaggcguggucggcg

SEQ ID NO: 2926520 - RNA, 18 nt, Mycobacterium avium subsp. paratuberculosis
cccaggcguggucggcgc

SEQ ID NO: 2926521 - RNA, 20 nt, Mycobacterium avium subsp. paratuberculosis
cccaggcguggucggcgcgg

SEQ ID NO: 2926522 - RNA, 13 nt, Mycobacterium avium subsp. paratuberculosis
cccaggcucagga

SEQ ID NO: 2926523 - RNA, 21 nt, Mycobacterium avium subsp. paratuberculosis
cccaggcucaggaucagcagc

SEQ ID NO: 2926524 - RNA, 21 nt, Mycobacterium avium subsp. paratuberculosis
cccagggccucggcgaccgcc

SEQ ID NO: 2926525 - RNA, 15 nt, Mycobacterium avium subsp. paratuberculosis
cccagggcgcgucca

SEQ ID NO: 2926526 - RNA, 20 nt, Mycobacterium avium subsp. paratuberculosis
cccagggcgcguccacucca

SEQ ID NO: 2926527 - RNA, 20 nt, Mycobacterium avium subsp. paratuberculosis
cccagggcgugcgcggccgc

SEQ ID NO: 2926528 - RNA, 15 nt, Mycobacterium avium subsp. paratuberculosis
cccaggggagcggcg

SEQ ID NO: 2926529 - RNA, 12 nt, Mycobacterium avium subsp. paratuberculosis
cccagggugcgc

SEQ ID NO: 2926530 - RNA, 18 nt, Mycobacterium avium subsp. paratuberculosis
cccagggugcgccgcucg

SEQ ID NO: 2926531 - RNA, 16 nt, Mycobacterium avium subsp. paratuberculosis
cccaggguugccgcac

SEQ ID NO: 2926532 - RNA, 18 nt, Mycobacterium avium subsp. paratuberculosis
cccaggguuggucggagc

SEQ ID NO: 2926533 - RNA, 22 nt, Mycobacterium avium subsp. paratuberculosis
cccagguaaucgaaggccaggu

SEQ ID NO: 2926534 - RNA, 20 nt, Mycobacterium avium subsp. paratuberculosis
cccagguauucguugcccug

SEQ ID NO: 2926535 - RNA, 13 nt, Mycobacterium avium subsp. paratuberculosis
cccaggucggcgu

SEQ ID NO: 2926536 - RNA, 17 nt, Mycobacterium avium subsp. paratuberculosis
cccaggucgggacgucc

SEQ ID NO: 2926537 - RNA, 21 nt, Mycobacterium avium subsp. paratuberculosis
cccaggucgggacguccgcgc

SEQ ID NO: 2926538 - RNA, 23 nt, Mycobacterium avium subsp. paratuberculosis
cccaggucgggacguccgcgcga

SEQ ID NO: 2926539 - RNA, 20 nt, Mycobacterium avium subsp. paratuberculosis
cccaggucgugaaacauggc

SEQ ID NO: 2926540 - RNA, 23 nt, Mycobacterium avium subsp. paratuberculosis
cccaggucuucucguccgcgcug

SEQ ID NO: 2926541 - RNA, 15 nt, Mycobacterium avium subsp. paratuberculosis
cccaggugcagaccg

SEQ ID NO: 2926542 - RNA, 18 nt, Mycobacterium avium subsp. paratuberculosis
cccaggugcagaccggac

SEQ ID NO: 2926543 - RNA, 19 nt, Mycobacterium avium subsp. paratuberculosis
cccagguggaugcgagcca

SEQ ID NO: 2926544 - RNA, 18 nt, Mycobacterium avium subsp. paratuberculosis
cccaggugggcgcgcagc

SEQ ID NO: 2926545 - RNA, 19 nt, Mycobacterium avium subsp. paratuberculosis
cccaggugggcgcgcagca

SEQ ID NO: 2926546 - RNA, 17 nt, Mycobacterium avium subsp. paratuberculosis
cccagguguccggcccg

SEQ ID NO: 2926547 - RNA, 18 nt, Mycobacterium avium subsp. paratuberculosis
cccagguguccggcccga

SEQ ID NO: 2926548 - RNA, 22 nt, Mycobacterium avium subsp. paratuberculosis
cccagguuccggugucgagccg

SEQ ID NO: 2926549 - RNA, 17 nt, Mycobacterium avium subsp. paratuberculosis
cccagguucuccggccc

SEQ ID NO: 2926550 - RNA, 19 nt, Mycobacterium avium subsp. paratuberculosis
cccagguucuccggcccgc

SEQ ID NO: 2926551 - RNA, 21 nt, Mycobacterium avium subsp. paratuberculosis
cccagguucuccggcccgcuc

SEQ ID NO: 2926552 - RNA, 23 nt, Mycobacterium avium subsp. paratuberculosis
cccaguagcggaaguacaccggu

SEQ ID NO: 2926553 - RNA, 16 nt, Mycobacterium avium subsp. paratuberculosis
cccaguccagucgcgc

SEQ ID NO: 2926554 - RNA, 13 nt, Mycobacterium avium subsp. paratuberculosis
cccagucccagca

SEQ ID NO: 2926555 - RNA, 14 nt, Mycobacterium avium subsp. paratuberculosis
cccaguccggccag

SEQ ID NO: 2926556 - RNA, 14 nt, Mycobacterium avium subsp. paratuberculosis
cccagucgccgccg

SEQ ID NO: 2926557 - RNA, 21 nt, Mycobacterium avium subsp. paratuberculosis
cccagugcaggcaggccccuc

SEQ ID NO: 2926558 - RNA, 15 nt, Mycobacterium avium subsp. paratuberculosis
cccagugcaggcuga

SEQ ID NO: 2926559 - RNA, 21 nt, Mycobacterium avium subsp. paratuberculosis
cccagugcaggcugacgcgac

SEQ ID NO: 2926560 - RNA, 23 nt, Mycobacterium avium subsp. paratuberculosis
cccagugcaggcugacgcgaccg

SEQ ID NO: 2926561 - RNA, 16 nt, Mycobacterium avium subsp. paratuberculosis
cccagugccaguacca

SEQ ID NO: 2926562 - RNA, 15 nt, Mycobacterium avium subsp. paratuberculosis
cccagugcgcgccgu

SEQ ID NO: 2926563 - RNA, 14 nt, Mycobacterium avium subsp. paratuberculosis
cccagugcucgacc

SEQ ID NO: 2926564 - RNA, 16 nt, Mycobacterium avium subsp. paratuberculosis
cccagugcucgaccag

SEQ ID NO: 2926565 - RNA, 20 nt, Mycobacterium avium subsp. paratuberculosis
cccaguggaucggcccgacg

SEQ ID NO: 2926566 - RNA, 15 nt, Mycobacterium avium subsp. paratuberculosis
cccaguucccggcgg

SEQ ID NO: 2926567 - RNA, 19 nt, Mycobacterium avium subsp. paratuberculosis
cccaguuggcgucgucggc

SEQ ID NO: 2926568 - RNA, 21 nt, Mycobacterium avium subsp. paratuberculosis
cccaguuggcgucgucggcgg

SEQ ID NO: 2926569 - RNA, 11 nt, Mycobacterium avium subsp. paratuberculosis
cccaguuguuu

SEQ ID NO: 2926570 - RNA, 18 nt, Mycobacterium avium subsp. paratuberculosis
cccaguuguuuccccagc

SEQ ID NO: 2926571 - RNA, 20 nt, Mycobacterium avium subsp. paratuberculosis
cccaguuucccgucggggug

SEQ ID NO: 2926572 - RNA, 20 nt, Mycobacterium avium subsp. paratuberculosis
cccauacacgggccguccau

SEQ ID NO: 2926573 - RNA, 22 nt, Mycobacterium avium subsp. paratuberculosis
cccauaucgagguaggccaccg

SEQ ID NO: 2926574 - RNA, 22 nt, Mycobacterium avium subsp. paratuberculosis
ccccagcggggcaagcagcggc

SEQ ID NO: 2926575 - RNA, 18 nt, Mycobacterium avium subsp. paratuberculosis
ccccagcuccucggcccc

SEQ ID NO: 2926576 - RNA, 16 nt, Mycobacterium avium subsp. paratuberculosis
ccccagcugggccgcc

SEQ ID NO: 2926577 - RNA, 22 nt, Mycobacterium avium subsp. paratuberculosis
ccccaggacgguuucugccggc

SEQ ID NO: 2926578 - RNA, 21 nt, Mycobacterium avium subsp. paratuberculosis
ccccaggaggcacuggcgcug

SEQ ID NO: 2926579 - RNA, 19 nt, Mycobacterium avium subsp. paratuberculosis
ccccaggcgaacauggcgg

SEQ ID NO: 2926580 - RNA, 20 nt, Mycobacterium avium subsp. paratuberculosis
ccccaggcgaacauggcggc

SEQ ID NO: 2926581 - RNA, 20 nt, Mycobacterium avium subsp. paratuberculosis
ccccaggcgaugccgccgac

SEQ ID NO: 2926582 - RNA, 13 nt, Mycobacterium avium subsp. paratuberculosis
ccccagggccucg

SEQ ID NO: 2926583 - RNA, 14 nt, Mycobacterium avium subsp. paratuberculosis
ccccaggucggggu

SEQ ID NO: 2926584 - RNA, 23 nt, Mycobacterium avium subsp. paratuberculosis
ccccaguuggcgucgucggcggc

SEQ ID NO: 2926585 - RNA, 19 nt, Mycobacterium avium subsp. paratuberculosis
ccccaguuucccgucgggg

SEQ ID NO: 2926586 - RNA, 16 nt, Mycobacterium avium subsp. paratuberculosis
ccccauacacgggccg

SEQ ID NO: 2926587 - RNA, 19 nt, Mycobacterium avium subsp. paratuberculosis
ccccauacacgggccgucc

SEQ ID NO: 2926588 - RNA, 13 nt, Mycobacterium avium subsp. paratuberculosis
ccccauugccgcg

SEQ ID NO: 2926589 - RNA, 14 nt, Mycobacterium avium subsp. paratuberculosis
ccccauugccgcgc

SEQ ID NO: 2926590 - RNA, 15 nt, Mycobacterium avium subsp. paratuberculosis
ccccauugccgcgcc

SEQ ID NO: 2926591 - RNA, 15 nt, Mycobacterium avium subsp. paratuberculosis
cccccaaaacccggc

SEQ ID NO: 2926592 - RNA, 23 nt, Mycobacterium avium subsp. paratuberculosis
cccccaaugucacggcgggucgg

SEQ ID NO: 2926593 - RNA, 19 nt, Mycobacterium avium subsp. paratuberculosis
cccccaccacgaagcuggc

SEQ ID NO: 2926594 - RNA, 23 nt, Mycobacterium avium subsp. paratuberculosis
cccccaccacguaggcgaucagc

SEQ ID NO: 2926595 - RNA, 21 nt, Mycobacterium avium subsp. paratuberculosis
cccccagcucgacgacuucgg

SEQ ID NO: 2926596 - RNA, 21 nt, Mycobacterium avium subsp. paratuberculosis
cccccauacacgggccgucca

SEQ ID NO: 2926597 - RNA, 20 nt, Mycobacterium avium subsp. paratuberculosis
ccccccauacacgggccguc

SEQ ID NO: 2926598 - RNA, 12 nt, Mycobacterium avium subsp. paratuberculosis
ccccccgggcac

SEQ ID NO: 2926599 - RNA, 13 nt, Mycobacterium avium subsp. paratuberculosis
ccccccugcucgc

SEQ ID NO: 2926600 - RNA, 12 nt, Mycobacterium avium subsp. paratuberculosis
cccccgacccgc

SEQ ID NO: 2926601 - RNA, 15 nt, Mycobacterium avium subsp. paratuberculosis
cccccgacgccgaca

SEQ ID NO: 2926602 - RNA, 16 nt, Mycobacterium avium subsp. paratuberculosis
cccccgagcuucgggu

SEQ ID NO: 2926603 - RNA, 22 nt, Mycobacterium avium subsp. paratuberculosis
cccccgaggagacgucggccgg

SEQ ID NO: 2926604 - RNA, 20 nt, Mycobacterium avium subsp. paratuberculosis
cccccgagucggagacccgc

SEQ ID NO: 2926605 - RNA, 15 nt, Mycobacterium avium subsp. paratuberculosis
cccccgauccgccgu

SEQ ID NO: 2926606 - RNA, 12 nt, Mycobacterium avium subsp. paratuberculosis
cccccgcagccc

SEQ ID NO: 2926607 - RNA, 12 nt, Mycobacterium avium subsp. paratuberculosis
cccccgcccggc

SEQ ID NO: 2926608 - RNA, 13 nt, Mycobacterium avium subsp. paratuberculosis
cccccgcccggcc

SEQ ID NO: 2926609 - RNA, 13 nt, Mycobacterium avium subsp. paratuberculosis
cccccgccgaccg

SEQ ID NO: 2926610 - RNA, 22 nt, Mycobacterium avium subsp. paratuberculosis
cccccgccgaccgguccgccgc

SEQ ID NO: 2926611 - RNA, 14 nt, Mycobacterium avium subsp. paratuberculosis
cccccgccgcgagc

SEQ ID NO: 2926612 - RNA, 21 nt, Mycobacterium avium subsp. paratuberculosis
cccccgccgcgagcagacaca

SEQ ID NO: 2926613 - RNA, 14 nt, Mycobacterium avium subsp. paratuberculosis
cccccgccggggcc

SEQ ID NO: 2926614 - RNA, 14 nt, Mycobacterium avium subsp. paratuberculosis
cccccgcgccgccc

SEQ ID NO: 2926615 - RNA, 21 nt, Mycobacterium avium subsp. paratuberculosis
cccccgcgcugcccagcgcgg

SEQ ID NO: 2926616 - RNA, 12 nt, Mycobacterium avium subsp. paratuberculosis
cccccgcggcgg

SEQ ID NO: 2926617 - RNA, 13 nt, Mycobacterium avium subsp. paratuberculosis
cccccgcggcggc

SEQ ID NO: 2926618 - RNA, 22 nt, Mycobacterium avium subsp. paratuberculosis
cccccggaccacguccccgggc

SEQ ID NO: 2926619 - RNA, 16 nt, Mycobacterium avium subsp. paratuberculosis
cccccggaccugccgg

SEQ ID NO: 2926620 - RNA, 17 nt, Mycobacterium avium subsp. paratuberculosis
cccccggaccugccggc

SEQ ID NO: 2926621 - RNA, 23 nt, Mycobacterium avium subsp. paratuberculosis
cccccggcgugagcgagccggca

SEQ ID NO: 2926622 - RNA, 18 nt, Mycobacterium avium subsp. paratuberculosis
cccccgggaugccugccc

SEQ ID NO: 2926623 - RNA, 20 nt, Mycobacterium avium subsp. paratuberculosis
cccccgggaugccugcccgc

SEQ ID NO: 2926624 - RNA, 19 nt, Mycobacterium avium subsp. paratuberculosis
cccccggggccuccagcca

SEQ ID NO: 2926625 - RNA, 12 nt, Mycobacterium avium subsp. paratuberculosis
cccccggggugg

SEQ ID NO: 2926626 - RNA, 23 nt, Mycobacterium avium subsp. paratuberculosis
cccccgggguggugugcaaggcg

SEQ ID NO: 2926627 - RNA, 19 nt, Mycobacterium avium subsp. paratuberculosis
cccccggugucugaccucg

SEQ ID NO: 2926628 - RNA, 14 nt, Mycobacterium avium subsp. paratuberculosis
cccccgucgggccg

SEQ ID NO: 2926629 - RNA, 17 nt, Mycobacterium avium subsp. paratuberculosis
cccccgucgggccgucc

SEQ ID NO: 2926630 - RNA, 23 nt, Mycobacterium avium subsp. paratuberculosis
cccccgucgggccguccgccggc

SEQ ID NO: 2926631 - RNA, 14 nt, Mycobacterium avium subsp. paratuberculosis
cccccguuggacau

SEQ ID NO: 2926632 - RNA, 14 nt, Mycobacterium avium subsp. paratuberculosis
cccccucggccggu

SEQ ID NO: 2926633 - RNA, 14 nt, Mycobacterium avium subsp. paratuberculosis
cccccucggcgccg

SEQ ID NO: 2926634 - RNA, 13 nt, Mycobacterium avium subsp. paratuberculosis
cccccucggcggg

SEQ ID NO: 2926635 - RNA, 15 nt, Mycobacterium avium subsp. paratuberculosis
cccccugcucagcgg

SEQ ID NO: 2926636 - RNA, 21 nt, Mycobacterium avium subsp. paratuberculosis
cccccuugagccgguccgacg

SEQ ID NO: 2926637 - RNA, 17 nt, Mycobacterium avium subsp. paratuberculosis
ccccgaacccggccagc

SEQ ID NO: 2926638 - RNA, 18 nt, Mycobacterium avium subsp. paratuberculosis
ccccgaacccggccagcg

SEQ ID NO: 2926639 - RNA, 19 nt, Mycobacterium avium subsp. paratuberculosis
ccccgaacccggccagcgu

SEQ ID NO: 2926640 - RNA, 13 nt, Mycobacterium avium subsp. paratuberculosis
ccccgaaccgccc

SEQ ID NO: 2926641 - RNA, 17 nt, Mycobacterium avium subsp. paratuberculosis
ccccgacaccguggugg

SEQ ID NO: 2926642 - RNA, 14 nt, Mycobacterium avium subsp. paratuberculosis
ccccgacaggccca

SEQ ID NO: 2926643 - RNA, 17 nt, Mycobacterium avium subsp. paratuberculosis
ccccgacaggcccaccc

SEQ ID NO: 2926644 - RNA, 16 nt, Mycobacterium avium subsp. paratuberculosis
ccccgacaucgccauc

SEQ ID NO: 2926645 - RNA, 21 nt, Mycobacterium avium subsp. paratuberculosis
ccccgaccacaccggcgcugc

SEQ ID NO: 2926646 - RNA, 22 nt, Mycobacterium avium subsp. paratuberculosis
ccccgaccaucauggccucccc

SEQ ID NO: 2926647 - RNA, 14 nt, Mycobacterium avium subsp. paratuberculosis
ccccgaccgacgcg

SEQ ID NO: 2926648 - RNA, 20 nt, Mycobacterium avium subsp. paratuberculosis
ccccgacgaucgcgccggcc

SEQ ID NO: 2926649 - RNA, 22 nt, Mycobacterium avium subsp. paratuberculosis
ccccgacgaucgcgccggccgc

SEQ ID NO: 2926650 - RNA, 14 nt, Mycobacterium avium subsp. paratuberculosis
ccccgacgccgacg

SEQ ID NO: 2926651 - RNA, 16 nt, Mycobacterium avium subsp. paratuberculosis
ccccgacgccgacggc

SEQ ID NO: 2926652 - RNA, 15 nt, Mycobacterium avium subsp. paratuberculosis
ccccgacggcgccgc

SEQ ID NO: 2926653 - RNA, 19 nt, Mycobacterium avium subsp. paratuberculosis
ccccgacggcgccgcggcc

SEQ ID NO: 2926654 - RNA, 20 nt, Mycobacterium avium subsp. paratuberculosis
ccccgacggcgccgcggccg

SEQ ID NO: 2926655 - RNA, 13 nt, Mycobacterium avium subsp. paratuberculosis
ccccgacgugcag

SEQ ID NO: 2926656 - RNA, 15 nt, Mycobacterium avium subsp. paratuberculosis
ccccgacgugcagcg

SEQ ID NO: 2926657 - RNA, 16 nt, Mycobacterium avium subsp. paratuberculosis
ccccgagaucgcgggc

SEQ ID NO: 2926658 - RNA, 16 nt, Mycobacterium avium subsp. paratuberculosis
ccccgagcagcggguc

SEQ ID NO: 2926659 - RNA, 16 nt, Mycobacterium avium subsp. paratuberculosis
ccccggaccugccggc

SEQ ID NO: 2926660 - RNA, 17 nt, Mycobacterium avium subsp. paratuberculosis
ccccggaccugccggcg

SEQ ID NO: 2926661 - RNA, 12 nt, Mycobacterium avium subsp. paratuberculosis
ccccggacggcc

SEQ ID NO: 2926662 - RNA, 13 nt, Mycobacterium avium subsp. paratuberculosis
ccccggacggccg

SEQ ID NO: 2926663 - RNA, 14 nt, Mycobacterium avium subsp. paratuberculosis
ccccggacggccga

SEQ ID NO: 2926664 - RNA, 14 nt, Mycobacterium avium subsp. paratuberculosis
ccccggagauccgg

SEQ ID NO: 2926665 - RNA, 19 nt, Mycobacterium avium subsp. paratuberculosis
ccccggagauccggccgcu

SEQ ID NO: 2926666 - RNA, 15 nt, Mycobacterium avium subsp. paratuberculosis
ccccggagucgucga

SEQ ID NO: 2926667 - RNA, 22 nt, Mycobacterium avium subsp. paratuberculosis
ccccggauccgucgccccgcac

SEQ ID NO: 2926668 - RNA, 23 nt, Mycobacterium avium subsp. paratuberculosis
ccccggauccgucgccccgcacc

SEQ ID NO: 2926669 - RNA, 12 nt, Mycobacterium avium subsp. paratuberculosis
ccccggccaggg

SEQ ID NO: 2926670 - RNA, 17 nt, Mycobacterium avium subsp. paratuberculosis
ccccggccagggugccg

SEQ ID NO: 2926671 - RNA, 14 nt, Mycobacterium avium subsp. paratuberculosis
ccccggccccggcc

SEQ ID NO: 2926672 - RNA, 15 nt, Mycobacterium avium subsp. paratuberculosis
ccccggccccggccg

SEQ ID NO: 2926673 - RNA, 16 nt, Mycobacterium avium subsp. paratuberculosis
ccccggccccggccgg

SEQ ID NO: 2926674 - RNA, 18 nt, Mycobacterium avium subsp. paratuberculosis
ccccggccccggccggcg

SEQ ID NO: 2926675 - RNA, 13 nt, Mycobacterium avium subsp. paratuberculosis
ccccggccgagcg

SEQ ID NO: 2926676 - RNA, 22 nt, Mycobacterium avium subsp. paratuberculosis
ccccggccgcggugaccgcgcc

SEQ ID NO: 2926677 - RNA, 12 nt, Mycobacterium avium subsp. paratuberculosis
ccccggccgggc

SEQ ID NO: 2926678 - RNA, 14 nt, Mycobacterium avium subsp. paratuberculosis
ccccggcgacggcg

SEQ ID NO: 2926679 - RNA, 20 nt, Mycobacterium avium subsp. paratuberculosis
ccccggcgacggcggccguc

SEQ ID NO: 2926680 - RNA, 13 nt, Mycobacterium avium subsp. paratuberculosis
ccccggcgacguc

SEQ ID NO: 2926681 - RNA, 15 nt, Mycobacterium avium subsp. paratuberculosis
ccccggcgacgucgc

SEQ ID NO: 2926682 - RNA, 18 nt, Mycobacterium avium subsp. paratuberculosis
ccccggcgacgucgccgg

SEQ ID NO: 2926683 - RNA, 17 nt, Mycobacterium avium subsp. paratuberculosis
ccccggcgaggccaggc

SEQ ID NO: 2926684 - RNA, 19 nt, Mycobacterium avium subsp. paratuberculosis
ccccggcgcagcgccgcgc

SEQ ID NO: 2926685 - RNA, 20 nt, Mycobacterium avium subsp. paratuberculosis
ccccggcgcagcgccgcgcc

SEQ ID NO: 2926686 - RNA, 13 nt, Mycobacterium avium subsp. paratuberculosis
ccccggcgccguc

SEQ ID NO: 2926687 - RNA, 15 nt, Mycobacterium avium subsp. paratuberculosis
ccccggcgcgacggc

SEQ ID NO: 2926688 - RNA, 14 nt, Mycobacterium avium subsp. paratuberculosis
ccccggcgcgccug

SEQ ID NO: 2926689 - RNA, 21 nt, Mycobacterium avium subsp. paratuberculosis
ccccggcgcggaacgcgccgg

SEQ ID NO: 2926690 - RNA, 23 nt, Mycobacterium avium subsp. paratuberculosis
ccccggcgcggaacgcgccgggc

SEQ ID NO: 2926691 - RNA, 13 nt, Mycobacterium avium subsp. paratuberculosis
ccccggcggccgc

SEQ ID NO: 2926692 - RNA, 14 nt, Mycobacterium avium subsp. paratuberculosis
ccccggcggccgcg

SEQ ID NO: 2926693 - RNA, 15 nt, Mycobacterium avium subsp. paratuberculosis
ccccggcggccgcgu

SEQ ID NO: 2926694 - RNA, 18 nt, Mycobacterium avium subsp. paratuberculosis
ccccggcggccgcgucgg

SEQ ID NO: 2926695 - RNA, 14 nt, Mycobacterium avium subsp. paratuberculosis
ccccggcggccggc

SEQ ID NO: 2926696 - RNA, 15 nt, Mycobacterium avium subsp. paratuberculosis
ccccggcggccggcc

SEQ ID NO: 2926697 - RNA, 17 nt, Mycobacterium avium subsp. paratuberculosis
ccccggcggccggcccc

SEQ ID NO: 2926698 - RNA, 15 nt, Mycobacterium avium subsp. paratuberculosis
ccccggcgggcggcc

SEQ ID NO: 2926699 - RNA, 14 nt, Mycobacterium avium subsp. paratuberculosis
ccccggcgggcucg

SEQ ID NO: 2926700 - RNA, 17 nt, Mycobacterium avium subsp. paratuberculosis
ccccggcgggcucgccg

SEQ ID NO: 2926701 - RNA, 19 nt, Mycobacterium avium subsp. paratuberculosis
ccccggcgggcucgccggc

SEQ ID NO: 2926702 - RNA, 22 nt, Mycobacterium avium subsp. paratuberculosis
ccccggcgggcucgccggcccg

SEQ ID NO: 2926703 - RNA, 23 nt, Mycobacterium avium subsp. paratuberculosis
ccccggcgggcucgccggcccga

SEQ ID NO: 2926704 - RNA, 14 nt, Mycobacterium avium subsp. paratuberculosis
ccccggcgggucug

SEQ ID NO: 2926705 - RNA, 13 nt, Mycobacterium avium subsp. paratuberculosis
ccccggcggucgg

SEQ ID NO: 2926706 - RNA, 17 nt, Mycobacterium avium subsp. paratuberculosis
ccccggcguccacgccg

SEQ ID NO: 2926707 - RNA, 21 nt, Mycobacterium avium subsp. paratuberculosis
ccccggcgucgaugaccucgc

SEQ ID NO: 2926708 - RNA, 20 nt, Mycobacterium avium subsp. paratuberculosis
ccccggcgugagcgagccgg

SEQ ID NO: 2926709 - RNA, 23 nt, Mycobacterium avium subsp. paratuberculosis
ccccggcgugagcgagccggcac

SEQ ID NO: 2926710 - RNA, 18 nt, Mycobacterium avium subsp. paratuberculosis
ccccggcgugggugucga

SEQ ID NO: 2926711 - RNA, 13 nt, Mycobacterium avium subsp. paratuberculosis
ccccggcugcugc

SEQ ID NO: 2926712 - RNA, 21 nt, Mycobacterium avium subsp. paratuberculosis
ccccggcugcugcacgacgac

SEQ ID NO: 2926713 - RNA, 13 nt, Mycobacterium avium subsp. paratuberculosis
ccccgggaaccag

SEQ ID NO: 2926714 - RNA, 15 nt, Mycobacterium avium subsp. paratuberculosis
ccccgggaacgacgg

SEQ ID NO: 2926715 - RNA, 20 nt, Mycobacterium avium subsp. paratuberculosis
ccccgggauccgaggcguca

SEQ ID NO: 2926716 - RNA, 21 nt, Mycobacterium avium subsp. paratuberculosis
ccccgggaugccugcccgcgc

SEQ ID NO: 2926717 - RNA, 13 nt, Mycobacterium avium subsp. paratuberculosis
ccccgggcaccag

SEQ ID NO: 2926718 - RNA, 16 nt, Mycobacterium avium subsp. paratuberculosis
ccccgggcaccagcgc

SEQ ID NO: 2926719 - RNA, 21 nt, Mycobacterium avium subsp. paratuberculosis
ccccgggcaccagcgcgacgg

SEQ ID NO: 2926720 - RNA, 13 nt, Mycobacterium avium subsp. paratuberculosis
ccccgggcccagc

SEQ ID NO: 2926721 - RNA, 18 nt, Mycobacterium avium subsp. paratuberculosis
ccccgggcccagcaccac

SEQ ID NO: 2926722 - RNA, 13 nt, Mycobacterium avium subsp. paratuberculosis
ccccgggcggcuc

SEQ ID NO: 2926723 - RNA, 21 nt, Mycobacterium avium subsp. paratuberculosis
ccccggggccuccagccagcg

SEQ ID NO: 2926724 - RNA, 23 nt, Mycobacterium avium subsp. paratuberculosis
ccccggggccuccagccagcgcg

SEQ ID NO: 2926725 - RNA, 16 nt, Mycobacterium avium subsp. paratuberculosis
ccccgggggaccagcg

SEQ ID NO: 2926726 - RNA, 16 nt, Mycobacterium avium subsp. paratuberculosis
ccccgguagccagcac

SEQ ID NO: 2926727 - RNA, 17 nt, Mycobacterium avium subsp. paratuberculosis
ccccgguagccagcacc

SEQ ID NO: 2926728 - RNA, 23 nt, Mycobacterium avium subsp. paratuberculosis
ccccgguagccagcaccgccccg

SEQ ID NO: 2926729 - RNA, 17 nt, Mycobacterium avium subsp. paratuberculosis
ccccggucaccccggcc

SEQ ID NO: 2926730 - RNA, 19 nt, Mycobacterium avium subsp. paratuberculosis
ccccggucaccccggccau

SEQ ID NO: 2926731 - RNA, 13 nt, Mycobacterium avium subsp. paratuberculosis
ccccggucaccgg

SEQ ID NO: 2926732 - RNA, 16 nt, Mycobacterium avium subsp. paratuberculosis
ccccgguccaggcgac

SEQ ID NO: 2926733 - RNA, 23 nt, Mycobacterium avium subsp. paratuberculosis
ccccgguccaggcgaccggcccc

SEQ ID NO: 2926734 - RNA, 15 nt, Mycobacterium avium subsp. paratuberculosis
ccccggucccgccgg

SEQ ID NO: 2926735 - RNA, 19 nt, Mycobacterium avium subsp. paratuberculosis
ccccggucgugucaugugc

SEQ ID NO: 2926736 - RNA, 18 nt, Mycobacterium avium subsp. paratuberculosis
ccccggugaccucccgga

SEQ ID NO: 2926737 - RNA, 17 nt, Mycobacterium avium subsp. paratuberculosis
ccccggugccgcagugc

SEQ ID NO: 2926738 - RNA, 22 nt, Mycobacterium avium subsp. paratuberculosis
ccccggugucugaccucgcgcc

SEQ ID NO: 2926739 - RNA, 15 nt, Mycobacterium avium subsp. paratuberculosis
ccccgguucaccagu

SEQ ID NO: 2926740 - RNA, 20 nt, Mycobacterium avium subsp. paratuberculosis
ccccguacggguugccgucg

SEQ ID NO: 2926741 - RNA, 21 nt, Mycobacterium avium subsp. paratuberculosis
ccccguacggguugccgucga

SEQ ID NO: 2926742 - RNA, 17 nt, Mycobacterium avium subsp. paratuberculosis
ccccguagucacccggc

SEQ ID NO: 2926743 - RNA, 18 nt, Mycobacterium avium subsp. paratuberculosis
ccccguagucacccggcc

SEQ ID NO: 2926744 - RNA, 17 nt, Mycobacterium avium subsp. paratuberculosis
cccgacauccaggaccg

SEQ ID NO: 2926745 - RNA, 21 nt, Mycobacterium avium subsp. paratuberculosis
cccgacauccaggaccgcgcg

SEQ ID NO: 2926746 - RNA, 23 nt, Mycobacterium avium subsp. paratuberculosis
cccgacauccaggaccgcgcgcc

SEQ ID NO: 2926747 - RNA, 17 nt, Mycobacterium avium subsp. paratuberculosis
cccgacaucugccgggc

SEQ ID NO: 2926748 - RNA, 18 nt, Mycobacterium avium subsp. paratuberculosis
cccgacaucugccgggcg

SEQ ID NO: 2926749 - RNA, 20 nt, Mycobacterium avium subsp. paratuberculosis
cccgacaucugccgggcggc

SEQ ID NO: 2926750 - RNA, 20 nt, Mycobacterium avium subsp. paratuberculosis
cccgaccacaccggcgcugc

SEQ ID NO: 2926751 - RNA, 16 nt, Mycobacterium avium subsp. paratuberculosis
cccgaccagcaccgcg

SEQ ID NO: 2926752 - RNA, 20 nt, Mycobacterium avium subsp. paratuberculosis
cccgaccaucauggccuccc

SEQ ID NO: 2926753 - RNA, 17 nt, Mycobacterium avium subsp. paratuberculosis
cccgaccccgccagcac

SEQ ID NO: 2926754 - RNA, 18 nt, Mycobacterium avium subsp. paratuberculosis
cccgaccccgccagcacc

SEQ ID NO: 2926755 - RNA, 14 nt, Mycobacterium avium subsp. paratuberculosis
cccgaccccggcga

SEQ ID NO: 2926756 - RNA, 18 nt, Mycobacterium avium subsp. paratuberculosis
cccgaccccggcgagcgc

SEQ ID NO: 2926757 - RNA, 13 nt, Mycobacterium avium subsp. paratuberculosis
cccgacccgcacc

SEQ ID NO: 2926758 - RNA, 14 nt, Mycobacterium avium subsp. paratuberculosis
cccgacccgcacca

SEQ ID NO: 2926759 - RNA, 17 nt, Mycobacterium avium subsp. paratuberculosis
cccgacccgcaccaccg

SEQ ID NO: 2926760 - RNA, 20 nt, Mycobacterium avium subsp. paratuberculosis
cccgacccgcaccaccgccc

SEQ ID NO: 2926761 - RNA, 17 nt, Mycobacterium avium subsp. paratuberculosis
cccgaccgacgcccggc

SEQ ID NO: 2926762 - RNA, 15 nt, Mycobacterium avium subsp. paratuberculosis
cccgaccgacgcggu

SEQ ID NO: 2926763 - RNA, 13 nt, Mycobacterium avium subsp. paratuberculosis
cccgaccgcgccg

SEQ ID NO: 2926764 - RNA, 14 nt, Mycobacterium avium subsp. paratuberculosis
cccgaccgcgccga

SEQ ID NO: 2926765 - RNA, 15 nt, Mycobacterium avium subsp. paratuberculosis
cccgaccucgucgac

SEQ ID NO: 2926766 - RNA, 16 nt, Mycobacterium avium subsp. paratuberculosis
cccgaccucgucgacg

SEQ ID NO: 2926767 - RNA, 18 nt, Mycobacterium avium subsp. paratuberculosis
cccgaccucgucgacggc

SEQ ID NO: 2926768 - RNA, 21 nt, Mycobacterium avium subsp. paratuberculosis
cccgaccucgucgacggcggc

SEQ ID NO: 2926769 - RNA, 20 nt, Mycobacterium avium subsp. paratuberculosis
cccgaccugaucuucgagac

SEQ ID NO: 2926770 - RNA, 18 nt, Mycobacterium avium subsp. paratuberculosis
cccgacgaagccgccgcc

SEQ ID NO: 2926771 - RNA, 19 nt, Mycobacterium avium subsp. paratuberculosis
cccgacgaagccgccgccc

SEQ ID NO: 2926772 - RNA, 21 nt, Mycobacterium avium subsp. paratuberculosis
cccgacgaagccgccgcccuc

SEQ ID NO: 2926773 - RNA, 12 nt, Mycobacterium avium subsp. paratuberculosis
cccgacgacgau

SEQ ID NO: 2926774 - RNA, 13 nt, Mycobacterium avium subsp. paratuberculosis
cccgacgacgccg

SEQ ID NO: 2926775 - RNA, 16 nt, Mycobacterium avium subsp. paratuberculosis
cccgacgacgccguca

SEQ ID NO: 2926776 - RNA, 20 nt, Mycobacterium avium subsp. paratuberculosis
cccgacgccgacaccagcgc

SEQ ID NO: 2926777 - RNA, 21 nt, Mycobacterium avium subsp. paratuberculosis
cccgacgccgacaccagcgcg

SEQ ID NO: 2926778 - RNA, 13 nt, Mycobacterium avium subsp. paratuberculosis
cccgacgccgacg

SEQ ID NO: 2926779 - RNA, 15 nt, Mycobacterium avium subsp. paratuberculosis
cccgacgccgacggc

SEQ ID NO: 2926780 - RNA, 13 nt, Mycobacterium avium subsp. paratuberculosis
cccgacgccggac

SEQ ID NO: 2926781 - RNA, 23 nt, Mycobacterium avium subsp. paratuberculosis
cccgacgccggaccccacagcgc

SEQ ID NO: 2926782 - RNA, 13 nt, Mycobacterium avium subsp. paratuberculosis
cccgacgcggcgc

SEQ ID NO: 2926783 - RNA, 16 nt, Mycobacterium avium subsp. paratuberculosis
cccgacgcggcgcgac

SEQ ID NO: 2926784 - RNA, 18 nt, Mycobacterium avium subsp. paratuberculosis
cccgacggagacgacgac

SEQ ID NO: 2926785 - RNA, 23 nt, Mycobacterium avium subsp. paratuberculosis
cccgacggauucccgaacagggc

SEQ ID NO: 2926786 - RNA, 16 nt, Mycobacterium avium subsp. paratuberculosis
cccgacggcagcaccg

SEQ ID NO: 2926787 - RNA, 23 nt, Mycobacterium avium subsp. paratuberculosis
cccgacggcagcaccgccgacau

SEQ ID NO: 2926788 - RNA, 17 nt, Mycobacterium avium subsp. paratuberculosis
cccgacggcgcgcccga

SEQ ID NO: 2926789 - RNA, 18 nt, Mycobacterium avium subsp. paratuberculosis
cccgacggcgcgcccgac

SEQ ID NO: 2926790 - RNA, 19 nt, Mycobacterium avium subsp. paratuberculosis
cccgacggcgcgcccgacg

SEQ ID NO: 2926791 - RNA, 19 nt, Mycobacterium avium subsp. paratuberculosis
cccgacgggaacucggcca

SEQ ID NO: 2926792 - RNA, 21 nt, Mycobacterium avium subsp. paratuberculosis
cccgacgggaacucggccagc

SEQ ID NO: 2926793 - RNA, 19 nt, Mycobacterium avium subsp. paratuberculosis
cccgacgggcgugccggcg

SEQ ID NO: 2926794 - RNA, 20 nt, Mycobacterium avium subsp. paratuberculosis
cccgacgggcgugccggcgg

SEQ ID NO: 2926795 - RNA, 19 nt, Mycobacterium avium subsp. paratuberculosis
cccgacggguucgcgcagc

SEQ ID NO: 2926796 - RNA, 20 nt, Mycobacterium avium subsp. paratuberculosis
cccgacggguucgcgcagcc

SEQ ID NO: 2926797 - RNA, 19 nt, Mycobacterium avium subsp. paratuberculosis
cccgacgucgacgcgggcg

SEQ ID NO: 2926798 - RNA, 15 nt, Mycobacterium avium subsp. paratuberculosis
cccgacgugcagcgc

SEQ ID NO: 2926799 - RNA, 22 nt, Mycobacterium avium subsp. paratuberculosis
cccgacgugcagcgccagcacc

SEQ ID NO: 2926800 - RNA, 16 nt, Mycobacterium avium subsp. paratuberculosis
cccgacguugccgcug

SEQ ID NO: 2926801 - RNA, 23 nt, Mycobacterium avium subsp. paratuberculosis
cccgacguugccgcuggucaggc

SEQ ID NO: 2926802 - RNA, 13 nt, Mycobacterium avium subsp. paratuberculosis
cccgacuccucac

SEQ ID NO: 2926803 - RNA, 17 nt, Mycobacterium avium subsp. paratuberculosis
cccgacuccucacaccu

SEQ ID NO: 2926804 - RNA, 17 nt, Mycobacterium avium subsp. paratuberculosis
cccgacuucggcucggc

SEQ ID NO: 2926805 - RNA, 22 nt, Mycobacterium avium subsp. paratuberculosis
cccgacuucggcucggcgacaa

SEQ ID NO: 2926806 - RNA, 14 nt, Mycobacterium avium subsp. paratuberculosis
cccgagagcugcug

SEQ ID NO: 2926807 - RNA, 19 nt, Mycobacterium avium subsp. paratuberculosis
cccgagagcugcugccgcc

SEQ ID NO: 2926808 - RNA, 12 nt, Mycobacterium avium subsp. paratuberculosis
cccgagcaccac

SEQ ID NO: 2926809 - RNA, 20 nt, Mycobacterium avium subsp. paratuberculosis
cccgagcaccaccaggccca

SEQ ID NO: 2926810 - RNA, 12 nt, Mycobacterium avium subsp. paratuberculosis
cccgagcacccc

SEQ ID NO: 2926811 - RNA, 18 nt, Mycobacterium avium subsp. paratuberculosis
cccgagcaccccggcggc

SEQ ID NO: 2926812 - RNA, 21 nt, Mycobacterium avium subsp. paratuberculosis
cccgagcaccccggcggccgc

SEQ ID NO: 2926813 - RNA, 14 nt, Mycobacterium avium subsp. paratuberculosis
cccgagcaccgggc

SEQ ID NO: 2926814 - RNA, 16 nt, Mycobacterium avium subsp. paratuberculosis
cccgagcaccgggccg

SEQ ID NO: 2926815 - RNA, 13 nt, Mycobacterium avium subsp. paratuberculosis
cccgagcacgucg

SEQ ID NO: 2926816 - RNA, 15 nt, Mycobacterium avium subsp. paratuberculosis
cccgagcacgucgag

SEQ ID NO: 2926817 - RNA, 18 nt, Mycobacterium avium subsp. paratuberculosis
cccgagcagaucgggucg

SEQ ID NO: 2926818 - RNA, 18 nt, Mycobacterium avium subsp. paratuberculosis
cccgagcaggcggaucgg

SEQ ID NO: 2926819 - RNA, 13 nt, Mycobacterium avium subsp. paratuberculosis
cccgagcaucgcc

SEQ ID NO: 2926820 - RNA, 17 nt, Mycobacterium avium subsp. paratuberculosis
cccgagcaucgccgagc

SEQ ID NO: 2926821 - RNA, 18 nt, Mycobacterium avium subsp. paratuberculosis
cccgagcauuucgcgcac

SEQ ID NO: 2926822 - RNA, 13 nt, Mycobacterium avium subsp. paratuberculosis
cccgagccgcaca

SEQ ID NO: 2926823 - RNA, 13 nt, Mycobacterium avium subsp. paratuberculosis
cccgagcggcgac

SEQ ID NO: 2926824 - RNA, 13 nt, Mycobacterium avium subsp. paratuberculosis
cccgagcgggccu

SEQ ID NO: 2926825 - RNA, 15 nt, Mycobacterium avium subsp. paratuberculosis
cccgagcgucacgcc

SEQ ID NO: 2926826 - RNA, 21 nt, Mycobacterium avium subsp. paratuberculosis
cccgagcgucacgccagcgug

SEQ ID NO: 2926827 - RNA, 21 nt, Mycobacterium avium subsp. paratuberculosis
cccgagcgucauuccgccgcg

SEQ ID NO: 2926828 - RNA, 22 nt, Mycobacterium avium subsp. paratuberculosis
cccgagcgucauuccgccgcgc

SEQ ID NO: 2926829 - RNA, 17 nt, Mycobacterium avium subsp. paratuberculosis
cccgcaacuccacaacc

SEQ ID NO: 2926830 - RNA, 16 nt, Mycobacterium avium subsp. paratuberculosis
cccgcaaggccgccag

SEQ ID NO: 2926831 - RNA, 17 nt, Mycobacterium avium subsp. paratuberculosis
cccgcaaggccgccagc

SEQ ID NO: 2926832 - RNA, 17 nt, Mycobacterium avium subsp. paratuberculosis
cccgcaauugcgccagc

SEQ ID NO: 2926833 - RNA, 19 nt, Mycobacterium avium subsp. paratuberculosis
cccgcaauugcgccagcag

SEQ ID NO: 2926834 - RNA, 14 nt, Mycobacterium avium subsp. paratuberculosis
cccgcacaccggcc

SEQ ID NO: 2926835 - RNA, 18 nt, Mycobacterium avium subsp. paratuberculosis
cccgcaccaccgcccgga

SEQ ID NO: 2926836 - RNA, 15 nt, Mycobacterium avium subsp. paratuberculosis
cccgcacccgccgcc

SEQ ID NO: 2926837 - RNA, 16 nt, Mycobacterium avium subsp. paratuberculosis
cccgcacccgccgccc

SEQ ID NO: 2926838 - RNA, 15 nt, Mycobacterium avium subsp. paratuberculosis
cccgcacccuugacu

SEQ ID NO: 2926839 - RNA, 22 nt, Mycobacterium avium subsp. paratuberculosis
cccgcaccguguagccgaccga

SEQ ID NO: 2926840 - RNA, 14 nt, Mycobacterium avium subsp. paratuberculosis
cccgcaccucgccc

SEQ ID NO: 2926841 - RNA, 15 nt, Mycobacterium avium subsp. paratuberculosis
cccgcaccugcgcgc

SEQ ID NO: 2926842 - RNA, 17 nt, Mycobacterium avium subsp. paratuberculosis
cccgcaccugcgcgccg

SEQ ID NO: 2926843 - RNA, 15 nt, Mycobacterium avium subsp. paratuberculosis
cccgcacgaugccgc

SEQ ID NO: 2926844 - RNA, 13 nt, Mycobacterium avium subsp. paratuberculosis
cccgcacgcccgg

SEQ ID NO: 2926845 - RNA, 15 nt, Mycobacterium avium subsp. paratuberculosis
cccgcacgcccgggc

SEQ ID NO: 2926846 - RNA, 16 nt, Mycobacterium avium subsp. paratuberculosis
cccgcacgcccgggca

SEQ ID NO: 2926847 - RNA, 15 nt, Mycobacterium avium subsp. paratuberculosis
cccgcacgcugucgg

SEQ ID NO: 2926848 - RNA, 14 nt, Mycobacterium avium subsp. paratuberculosis
cccgcacggccgcc

SEQ ID NO: 2926849 - RNA, 16 nt, Mycobacterium avium subsp. paratuberculosis
cccgcacggucgcggu

SEQ ID NO: 2926850 - RNA, 17 nt, Mycobacterium avium subsp. paratuberculosis
cccgcagaacaccagcg

SEQ ID NO: 2926851 - RNA, 18 nt, Mycobacterium avium subsp. paratuberculosis
cccgcagccagcgcagca

SEQ ID NO: 2926852 - RNA, 20 nt, Mycobacterium avium subsp. paratuberculosis
cccgcagccagcgcagcacu

SEQ ID NO: 2926853 - RNA, 14 nt, Mycobacterium avium subsp. paratuberculosis
cccgcagcccgacc

SEQ ID NO: 2926854 - RNA, 12 nt, Mycobacterium avium subsp. paratuberculosis
cccgcagccgcg

SEQ ID NO: 2926855 - RNA, 13 nt, Mycobacterium avium subsp. paratuberculosis
cccgcagccgcga

SEQ ID NO: 2926856 - RNA, 15 nt, Mycobacterium avium subsp. paratuberculosis
cccgcagccgcgacg

SEQ ID NO: 2926857 - RNA, 17 nt, Mycobacterium avium subsp. paratuberculosis
cccgcagccgcgagucg

SEQ ID NO: 2926858 - RNA, 16 nt, Mycobacterium avium subsp. paratuberculosis
cccgcagcgccagcgc

SEQ ID NO: 2926859 - RNA, 18 nt, Mycobacterium avium subsp. paratuberculosis
cccgcagcgccagcgcgc

SEQ ID NO: 2926860 - RNA, 20 nt, Mycobacterium avium subsp. paratuberculosis
cccgcagcgccagcgcgccc

SEQ ID NO: 2926861 - RNA, 13 nt, Mycobacterium avium subsp. paratuberculosis
cccgcagcgccuc

SEQ ID NO: 2926862 - RNA, 16 nt, Mycobacterium avium subsp. paratuberculosis
cccgcagcgccucggc

SEQ ID NO: 2926863 - RNA, 23 nt, Mycobacterium avium subsp. paratuberculosis
cccgcagcgccucggcguggcag

SEQ ID NO: 2926864 - RNA, 13 nt, Mycobacterium avium subsp. paratuberculosis
cccgcagcgcggc

SEQ ID NO: 2926865 - RNA, 14 nt, Mycobacterium avium subsp. paratuberculosis
cccgcagcgcggcg

SEQ ID NO: 2926866 - RNA, 15 nt, Mycobacterium avium subsp. paratuberculosis
cccgcagcgcggcgg

SEQ ID NO: 2926867 - RNA, 14 nt, Mycobacterium avium subsp. paratuberculosis
cccgcagcggggcg

SEQ ID NO: 2926868 - RNA, 12 nt, Mycobacterium avium subsp. paratuberculosis
cccgcagcucca

SEQ ID NO: 2926869 - RNA, 17 nt, Mycobacterium avium subsp. paratuberculosis
cccgcagcuccagcgag

SEQ ID NO: 2926870 - RNA, 16 nt, Mycobacterium avium subsp. paratuberculosis
cccgcagcucgccggu

SEQ ID NO: 2926871 - RNA, 19 nt, Mycobacterium avium subsp. paratuberculosis
cccgcagcucgccgguggc

SEQ ID NO: 2926872 - RNA, 13 nt, Mycobacterium avium subsp. paratuberculosis
cccgcagcucgga

SEQ ID NO: 2926873 - RNA, 12 nt, Mycobacterium avium subsp. paratuberculosis
cccgcagcuucu

SEQ ID NO: 2926874 - RNA, 20 nt, Mycobacterium avium subsp. paratuberculosis
cccgcaggaucgagccggcc

SEQ ID NO: 2926875 - RNA, 14 nt, Mycobacterium avium subsp. paratuberculosis
cccgcaggccauga

SEQ ID NO: 2926876 - RNA, 16 nt, Mycobacterium avium subsp. paratuberculosis
cccgcaggccaugauc

SEQ ID NO: 2926877 - RNA, 12 nt, Mycobacterium avium subsp. paratuberculosis
cccgcagggcgc

SEQ ID NO: 2926878 - RNA, 15 nt, Mycobacterium avium subsp. paratuberculosis
cccgcagggcgccgg

SEQ ID NO: 2926879 - RNA, 20 nt, Mycobacterium avium subsp. paratuberculosis
cccgcagggcgccggugaag

SEQ ID NO: 2926880 - RNA, 12 nt, Mycobacterium avium subsp. paratuberculosis
cccgcagugcgu

SEQ ID NO: 2926881 - RNA, 18 nt, Mycobacterium avium subsp. paratuberculosis
cccgcaguucggccgccg

SEQ ID NO: 2926882 - RNA, 19 nt, Mycobacterium avium subsp. paratuberculosis
cccgcaguucggccgccgu

SEQ ID NO: 2926883 - RNA, 20 nt, Mycobacterium avium subsp. paratuberculosis
cccgcaucaacugcaccagc

SEQ ID NO: 2926884 - RNA, 22 nt, Mycobacterium avium subsp. paratuberculosis
cccgcaucaacugcaccagcgg

SEQ ID NO: 2926885 - RNA, 23 nt, Mycobacterium avium subsp. paratuberculosis
cccgcaucaacugcaccagcggc

SEQ ID NO: 2926886 - RNA, 19 nt, Mycobacterium avium subsp. paratuberculosis
cccgcauccgccgggcggc

SEQ ID NO: 2926887 - RNA, 15 nt, Mycobacterium avium subsp. paratuberculosis
cccgcaucgcacaga

SEQ ID NO: 2926888 - RNA, 19 nt, Mycobacterium avium subsp. paratuberculosis
cccgcaucgccgaaccggg

SEQ ID NO: 2926889 - RNA, 22 nt, Mycobacterium avium subsp. paratuberculosis
cccgcaucgccgaaccgggcgc

SEQ ID NO: 2926890 - RNA, 14 nt, Mycobacterium avium subsp. paratuberculosis
cccgcaugcaccgg

SEQ ID NO: 2926891 - RNA, 19 nt, Mycobacterium avium subsp. paratuberculosis
cccgcaugcaccggugcac

SEQ ID NO: 2926892 - RNA, 23 nt, Mycobacterium avium subsp. paratuberculosis
cccgcaugcaccggugcaccgcg

SEQ ID NO: 2926893 - RNA, 16 nt, Mycobacterium avium subsp. paratuberculosis
cccgcauggccuugag

SEQ ID NO: 2926894 - RNA, 23 nt, Mycobacterium avium subsp. paratuberculosis
cccgcauggccuugagaacgucg

SEQ ID NO: 2926895 - RNA, 21 nt, Mycobacterium avium subsp. paratuberculosis
cccgcauguccggggugagca

SEQ ID NO: 2926896 - RNA, 23 nt, Mycobacterium avium subsp. paratuberculosis
cccgcauguccggggugagcagg

SEQ ID NO: 2926897 - RNA, 18 nt, Mycobacterium avium subsp. paratuberculosis
cccgcauuccgucuuggc

SEQ ID NO: 2926898 - RNA, 23 nt, Mycobacterium avium subsp. paratuberculosis
cccgccacggccagcaccgccag

SEQ ID NO: 2926899 - RNA, 13 nt, Mycobacterium avium subsp. paratuberculosis
cccgccacgugcg

SEQ ID NO: 2926900 - RNA, 21 nt, Mycobacterium avium subsp. paratuberculosis
cccgccacgugcggcugcgcg

SEQ ID NO: 2926901 - RNA, 18 nt, Mycobacterium avium subsp. paratuberculosis
cccgccagauagggcagc

SEQ ID NO: 2926902 - RNA, 17 nt, Mycobacterium avium subsp. paratuberculosis
cccgccagaucgccauc

SEQ ID NO: 2926903 - RNA, 13 nt, Mycobacterium avium subsp. paratuberculosis
cccgccagcaccg

SEQ ID NO: 2926904 - RNA, 17 nt, Mycobacterium avium subsp. paratuberculosis
cccgccagcaccgacag

SEQ ID NO: 2926905 - RNA, 12 nt, Mycobacterium avium subsp. paratuberculosis
cccgccagcccg

SEQ ID NO: 2926906 - RNA, 21 nt, Mycobacterium avium subsp. paratuberculosis
cccgccagggcgacgccgcgg

SEQ ID NO: 2926907 - RNA, 21 nt, Mycobacterium avium subsp. paratuberculosis
cccgccauggcggcaucccca

SEQ ID NO: 2926908 - RNA, 13 nt, Mycobacterium avium subsp. paratuberculosis
cccgcccacgggu

SEQ ID NO: 2926909 - RNA, 16 nt, Mycobacterium avium subsp. paratuberculosis
cccgcccagcaccagu

SEQ ID NO: 2926910 - RNA, 13 nt, Mycobacterium avium subsp. paratuberculosis
cccgcccagcgac

SEQ ID NO: 2926911 - RNA, 13 nt, Mycobacterium avium subsp. paratuberculosis
cccgcccagcgca

SEQ ID NO: 2926912 - RNA, 14 nt, Mycobacterium avium subsp. paratuberculosis
cccgcccagcgcca

SEQ ID NO: 2926913 - RNA, 17 nt, Mycobacterium avium subsp. paratuberculosis
cccgcccaggccgccag

SEQ ID NO: 2926914 - RNA, 22 nt, Mycobacterium avium subsp. paratuberculosis
cccgccgggcgccacgcuggcg

SEQ ID NO: 2926915 - RNA, 15 nt, Mycobacterium avium subsp. paratuberculosis
cccgccgggcgucgc

SEQ ID NO: 2926916 - RNA, 19 nt, Mycobacterium avium subsp. paratuberculosis
cccgccgggcugaccgucg

SEQ ID NO: 2926917 - RNA, 13 nt, Mycobacterium avium subsp. paratuberculosis
cccgccggggccg

SEQ ID NO: 2926918 - RNA, 15 nt, Mycobacterium avium subsp. paratuberculosis
cccgccggggccggc

SEQ ID NO: 2926919 - RNA, 20 nt, Mycobacterium avium subsp. paratuberculosis
cccgccggguggccgccacg

SEQ ID NO: 2926920 - RNA, 16 nt, Mycobacterium avium subsp. paratuberculosis
cccgccgguggccgcg

SEQ ID NO: 2926921 - RNA, 18 nt, Mycobacterium avium subsp. paratuberculosis
cccgccggugucggcgac

SEQ ID NO: 2926922 - RNA, 11 nt, Mycobacterium avium subsp. paratuberculosis
cccgccgucga

SEQ ID NO: 2926923 - RNA, 13 nt, Mycobacterium avium subsp. paratuberculosis
cccgccgucgacg

SEQ ID NO: 2926924 - RNA, 18 nt, Mycobacterium avium subsp. paratuberculosis
cccgccgucgacgcgugc

SEQ ID NO: 2926925 - RNA, 14 nt, Mycobacterium avium subsp. paratuberculosis
cccgccgucggcau

SEQ ID NO: 2926926 - RNA, 15 nt, Mycobacterium avium subsp. paratuberculosis
cccgccgugaccggc

SEQ ID NO: 2926927 - RNA, 15 nt, Mycobacterium avium subsp. paratuberculosis
cccgccgugcgcccc

SEQ ID NO: 2926928 - RNA, 18 nt, Mycobacterium avium subsp. paratuberculosis
cccgccgugcgccccgcc

SEQ ID NO: 2926929 - RNA, 16 nt, Mycobacterium avium subsp. paratuberculosis
cccgccguuucagcag

SEQ ID NO: 2926930 - RNA, 18 nt, Mycobacterium avium subsp. paratuberculosis
cccgccguuucagcagcg

SEQ ID NO: 2926931 - RNA, 21 nt, Mycobacterium avium subsp. paratuberculosis
cccgccguuucagcagcgcgu

SEQ ID NO: 2926932 - RNA, 13 nt, Mycobacterium avium subsp. paratuberculosis
cccgccucacagc

SEQ ID NO: 2926933 - RNA, 14 nt, Mycobacterium avium subsp. paratuberculosis
cccgccucggcggc

SEQ ID NO: 2926934 - RNA, 17 nt, Mycobacterium avium subsp. paratuberculosis
cccgccucggcggccgc

SEQ ID NO: 2926935 - RNA, 18 nt, Mycobacterium avium subsp. paratuberculosis
cccgccucggcggccgcc

SEQ ID NO: 2926936 - RNA, 20 nt, Mycobacterium avium subsp. paratuberculosis
cccgccuggccaccucgacg

SEQ ID NO: 2926937 - RNA, 22 nt, Mycobacterium avium subsp. paratuberculosis
cccgcgaaaucuucgccgucag

SEQ ID NO: 2926938 - RNA, 20 nt, Mycobacterium avium subsp. paratuberculosis
cccgcgaacacgcgaugauc

SEQ ID NO: 2926939 - RNA, 21 nt, Mycobacterium avium subsp. paratuberculosis
cccgcgaacgccucguuggcc

SEQ ID NO: 2926940 - RNA, 15 nt, Mycobacterium avium subsp. paratuberculosis
cccgcgacacgccgc

SEQ ID NO: 2926941 - RNA, 16 nt, Mycobacterium avium subsp. paratuberculosis
cccgcgacacgccgcg

SEQ ID NO: 2926942 - RNA, 19 nt, Mycobacterium avium subsp. paratuberculosis
cccgcgacacgccgcgcau

SEQ ID NO: 2926943 - RNA, 23 nt, Mycobacterium avium subsp. paratuberculosis
cccgcgacccagacuugggcagc

SEQ ID NO: 2926944 - RNA, 12 nt, Mycobacterium avium subsp. paratuberculosis
cccgcgaccccu

SEQ ID NO: 2926945 - RNA, 16 nt, Mycobacterium avium subsp. paratuberculosis
cccgcgaccgcagcag

SEQ ID NO: 2926946 - RNA, 16 nt, Mycobacterium avium subsp. paratuberculosis
cccgcgacggcgagcc

SEQ ID NO: 2926947 - RNA, 17 nt, Mycobacterium avium subsp. paratuberculosis
cccgcgacggcgagccg

SEQ ID NO: 2926948 - RNA, 12 nt, Mycobacterium avium subsp. paratuberculosis
cccgcgacgucc

SEQ ID NO: 2926949 - RNA, 14 nt, Mycobacterium avium subsp. paratuberculosis
cccgcgacugucgg

SEQ ID NO: 2926950 - RNA, 16 nt, Mycobacterium avium subsp. paratuberculosis
cccgcgacugucggcg

SEQ ID NO: 2926951 - RNA, 18 nt, Mycobacterium avium subsp. paratuberculosis
cccgcgacugucggcgcc

SEQ ID NO: 2926952 - RNA, 21 nt, Mycobacterium avium subsp. paratuberculosis
cccgcgacugucggcgccccg

SEQ ID NO: 2926953 - RNA, 19 nt, Mycobacterium avium subsp. paratuberculosis
cccgcgacugucggcucgc

SEQ ID NO: 2926954 - RNA, 15 nt, Mycobacterium avium subsp. paratuberculosis
cccgcgagcugcccc

SEQ ID NO: 2926955 - RNA, 20 nt, Mycobacterium avium subsp. paratuberculosis
cccgcgaggugucgacgcug

SEQ ID NO: 2926956 - RNA, 14 nt, Mycobacterium avium subsp. paratuberculosis
cccgcgaucgccag

SEQ ID NO: 2926957 - RNA, 15 nt, Mycobacterium avium subsp. paratuberculosis
cccgcgaucgccagc

SEQ ID NO: 2926958 - RNA, 14 nt, Mycobacterium avium subsp. paratuberculosis
cccgcgaucggcgc

SEQ ID NO: 2926959 - RNA, 16 nt, Mycobacterium avium subsp. paratuberculosis
cccgcgaucggcgcca

SEQ ID NO: 2926960 - RNA, 22 nt, Mycobacterium avium subsp. paratuberculosis
cccgcgcaauacccgaccagca

SEQ ID NO: 2926961 - RNA, 23 nt, Mycobacterium avium subsp. paratuberculosis
cccgcgcaauacccgaccagcac

SEQ ID NO: 2926962 - RNA, 22 nt, Mycobacterium avium subsp. paratuberculosis
cccgcgcaccgucaucgcggcg

SEQ ID NO: 2926963 - RNA, 14 nt, Mycobacterium avium subsp. paratuberculosis
cccgcgcacgcucg

SEQ ID NO: 2926964 - RNA, 16 nt, Mycobacterium avium subsp. paratuberculosis
cccgcgcaggccccgg

SEQ ID NO: 2926965 - RNA, 17 nt, Mycobacterium avium subsp. paratuberculosis
cccgcgcaggccccggg

SEQ ID NO: 2926966 - RNA, 15 nt, Mycobacterium avium subsp. paratuberculosis
cccgcgcaucccguc

SEQ ID NO: 2926967 - RNA, 22 nt, Mycobacterium avium subsp. paratuberculosis
cccgcgcaucccgucgaccagg

SEQ ID NO: 2926968 - RNA, 14 nt, Mycobacterium avium subsp. paratuberculosis
cccgcgccaccccg

SEQ ID NO: 2926969 - RNA, 15 nt, Mycobacterium avium subsp. paratuberculosis
cccgcgccaccccga

SEQ ID NO: 2926970 - RNA, 15 nt, Mycobacterium avium subsp. paratuberculosis
cccgcgccacgccgc

SEQ ID NO: 2926971 - RNA, 17 nt, Mycobacterium avium subsp. paratuberculosis
cccgcgccagcucggcg

SEQ ID NO: 2926972 - RNA, 19 nt, Mycobacterium avium subsp. paratuberculosis
cccgcgccagcucggcggc

SEQ ID NO: 2926973 - RNA, 15 nt, Mycobacterium avium subsp. paratuberculosis
cccgcgcccaccugg

SEQ ID NO: 2926974 - RNA, 16 nt, Mycobacterium avium subsp. paratuberculosis
cccgcgccccggcggc

SEQ ID NO: 2926975 - RNA, 18 nt, Mycobacterium avium subsp. paratuberculosis
cccgcgccccggcggcca

SEQ ID NO: 2926976 - RNA, 13 nt, Mycobacterium avium subsp. paratuberculosis
cccgcgcccgcau

SEQ ID NO: 2926977 - RNA, 12 nt, Mycobacterium avium subsp. paratuberculosis
cccgcgcccgcc

SEQ ID NO: 2926978 - RNA, 14 nt, Mycobacterium avium subsp. paratuberculosis
cccgcgcccgccgc

SEQ ID NO: 2926979 - RNA, 15 nt, Mycobacterium avium subsp. paratuberculosis
cccgcgcccgccgcg

SEQ ID NO: 2926980 - RNA, 11 nt, Mycobacterium avium subsp. paratuberculosis
cccgcgccgac

SEQ ID NO: 2926981 - RNA, 12 nt, Mycobacterium avium subsp. paratuberculosis
cccgcgccgacc

SEQ ID NO: 2926982 - RNA, 21 nt, Mycobacterium avium subsp. paratuberculosis
cccgcgccgacggccgcgccg

SEQ ID NO: 2926983 - RNA, 11 nt, Mycobacterium avium subsp. paratuberculosis
cccgcgccgcc

SEQ ID NO: 2926984 - RNA, 12 nt, Mycobacterium avium subsp. paratuberculosis
cccgcgccgccc

SEQ ID NO: 2926985 - RNA, 17 nt, Mycobacterium avium subsp. paratuberculosis
cccgcgccgcccggagg

SEQ ID NO: 2926986 - RNA, 15 nt, Mycobacterium avium subsp. paratuberculosis
cccgcgccgcggcca

SEQ ID NO: 2926987 - RNA, 13 nt, Mycobacterium avium subsp. paratuberculosis
cccgcgccgcguc

SEQ ID NO: 2926988 - RNA, 18 nt, Mycobacterium avium subsp. paratuberculosis
cccgcgccgcgucgucgu

SEQ ID NO: 2926989 - RNA, 13 nt, Mycobacterium avium subsp. paratuberculosis
cccgcgccggcag

SEQ ID NO: 2926990 - RNA, 13 nt, Mycobacterium avium subsp. paratuberculosis
cccgcgccgggca

SEQ ID NO: 2926991 - RNA, 16 nt, Mycobacterium avium subsp. paratuberculosis
cccgcgccgggcguug

SEQ ID NO: 2926992 - RNA, 20 nt, Mycobacterium avium subsp. paratuberculosis
cccgcgcgagcgcagcgcca

SEQ ID NO: 2926993 - RNA, 13 nt, Mycobacterium avium subsp. paratuberculosis
cccgcgcgaucgg

SEQ ID NO: 2926994 - RNA, 13 nt, Mycobacterium avium subsp. paratuberculosis
cccgcgcgcucgg

SEQ ID NO: 2926995 - RNA, 13 nt, Mycobacterium avium subsp. paratuberculosis
cccgcgcggccgc

SEQ ID NO: 2926996 - RNA, 13 nt, Mycobacterium avium subsp. paratuberculosis
cccgcgcggcgca

SEQ ID NO: 2926997 - RNA, 14 nt, Mycobacterium avium subsp. paratuberculosis
cccgcgcggcgcag

SEQ ID NO: 2926998 - RNA, 20 nt, Mycobacterium avium subsp. paratuberculosis
cccgcgcggcgcagggcggc

SEQ ID NO: 2926999 - RNA, 14 nt, Mycobacterium avium subsp. paratuberculosis
cccgcgcggcggcc

SEQ ID NO: 2927000 - RNA, 23 nt, Mycobacterium avium subsp. paratuberculosis
cccgcucaggucggccgcggccg

SEQ ID NO: 2927001 - RNA, 16 nt, Mycobacterium avium subsp. paratuberculosis
cccgcuccagcggcca

SEQ ID NO: 2927002 - RNA, 17 nt, Mycobacterium avium subsp. paratuberculosis
cccgcuccagcggccac

SEQ ID NO: 2927003 - RNA, 22 nt, Mycobacterium avium subsp. paratuberculosis
cccgcuccauggcggcgaccaa

SEQ ID NO: 2927004 - RNA, 14 nt, Mycobacterium avium subsp. paratuberculosis
cccgcucccauccg

SEQ ID NO: 2927005 - RNA, 15 nt, Mycobacterium avium subsp. paratuberculosis
cccgcucccgggaca

SEQ ID NO: 2927006 - RNA, 20 nt, Mycobacterium avium subsp. paratuberculosis
cccgcucccgggacagcccg

SEQ ID NO: 2927007 - RNA, 12 nt, Mycobacterium avium subsp. paratuberculosis
cccgcuccgcgg

SEQ ID NO: 2927008 - RNA, 16 nt, Mycobacterium avium subsp. paratuberculosis
cccgcuccgcgggcag

SEQ ID NO: 2927009 - RNA, 18 nt, Mycobacterium avium subsp. paratuberculosis
cccgcuccgcgggcagcg

SEQ ID NO: 2927010 - RNA, 15 nt, Mycobacterium avium subsp. paratuberculosis
cccgcuccgcggugc

SEQ ID NO: 2927011 - RNA, 17 nt, Mycobacterium avium subsp. paratuberculosis
cccgcuccgcggugcug

SEQ ID NO: 2927012 - RNA, 14 nt, Mycobacterium avium subsp. paratuberculosis
cccgcuccggcgga

SEQ ID NO: 2927013 - RNA, 14 nt, Mycobacterium avium subsp. paratuberculosis
cccgcuccuccucg

SEQ ID NO: 2927014 - RNA, 16 nt, Mycobacterium avium subsp. paratuberculosis
cccgcuccuccucgcg

SEQ ID NO: 2927015 - RNA, 19 nt, Mycobacterium avium subsp. paratuberculosis
cccgcuccuccucgcgccg

SEQ ID NO: 2927016 - RNA, 17 nt, Mycobacterium avium subsp. paratuberculosis
cccgcuccugcaggccg

SEQ ID NO: 2927017 - RNA, 19 nt, Mycobacterium avium subsp. paratuberculosis
cccgcuccugcaggccgag

SEQ ID NO: 2927018 - RNA, 14 nt, Mycobacterium avium subsp. paratuberculosis
cccgcucgacgcgc

SEQ ID NO: 2927019 - RNA, 19 nt, Mycobacterium avium subsp. paratuberculosis
cccgcucgacgcgcacccg

SEQ ID NO: 2927020 - RNA, 14 nt, Mycobacterium avium subsp. paratuberculosis
cccgcucgcgggcc

SEQ ID NO: 2927021 - RNA, 21 nt, Mycobacterium avium subsp. paratuberculosis
cccgcucgcgggcccgcgccg

SEQ ID NO: 2927022 - RNA, 13 nt, Mycobacterium avium subsp. paratuberculosis
cccgcucggcggg

SEQ ID NO: 2927023 - RNA, 13 nt, Mycobacterium avium subsp. paratuberculosis
cccgcucggcgug

SEQ ID NO: 2927024 - RNA, 13 nt, Mycobacterium avium subsp. paratuberculosis
cccgcucgggcca

SEQ ID NO: 2927025 - RNA, 13 nt, Mycobacterium avium subsp. paratuberculosis
cccgcucgggcgc

SEQ ID NO: 2927026 - RNA, 20 nt, Mycobacterium avium subsp. paratuberculosis
cccgcugaaagcucgcgucg

SEQ ID NO: 2927027 - RNA, 23 nt, Mycobacterium avium subsp. paratuberculosis
cccgcugaaagcucgcgucgacg

SEQ ID NO: 2927028 - RNA, 20 nt, Mycobacterium avium subsp. paratuberculosis
cccgcugaccgccgcgcucg

SEQ ID NO: 2927029 - RNA, 12 nt, Mycobacterium avium subsp. paratuberculosis
cccgcugcacca

SEQ ID NO: 2927030 - RNA, 14 nt, Mycobacterium avium subsp. paratuberculosis
cccgcugcaccagc

SEQ ID NO: 2927031 - RNA, 15 nt, Mycobacterium avium subsp. paratuberculosis
cccgcugcaccagcc

SEQ ID NO: 2927032 - RNA, 17 nt, Mycobacterium avium subsp. paratuberculosis
cccgcugcaccagcccg

SEQ ID NO: 2927033 - RNA, 16 nt, Mycobacterium avium subsp. paratuberculosis
cccgcugcagcgccga

SEQ ID NO: 2927034 - RNA, 19 nt, Mycobacterium avium subsp. paratuberculosis
cccgcugccguccggcggc

SEQ ID NO: 2927035 - RNA, 20 nt, Mycobacterium avium subsp. paratuberculosis
cccgcugccguccggcggca

SEQ ID NO: 2927036 - RNA, 12 nt, Mycobacterium avium subsp. paratuberculosis
cccgcugcgccg

SEQ ID NO: 2927037 - RNA, 15 nt, Mycobacterium avium subsp. paratuberculosis
cccgcugcggcaaug

SEQ ID NO: 2927038 - RNA, 13 nt, Mycobacterium avium subsp. paratuberculosis
cccgcugcggcgc

SEQ ID NO: 2927039 - RNA, 15 nt, Mycobacterium avium subsp. paratuberculosis
cccgcugcggcgcag

SEQ ID NO: 2927040 - RNA, 16 nt, Mycobacterium avium subsp. paratuberculosis
cccgcuggaacagcgg

SEQ ID NO: 2927041 - RNA, 18 nt, Mycobacterium avium subsp. paratuberculosis
cccgcuggaacagcgggc

SEQ ID NO: 2927042 - RNA, 22 nt, Mycobacterium avium subsp. paratuberculosis
cccgcuggaacagcgggccggc

SEQ ID NO: 2927043 - RNA, 19 nt, Mycobacterium avium subsp. paratuberculosis
cccgcuggaucccggugag

SEQ ID NO: 2927044 - RNA, 14 nt, Mycobacterium avium subsp. paratuberculosis
cccgcuggcccggc

SEQ ID NO: 2927045 - RNA, 14 nt, Mycobacterium avium subsp. paratuberculosis
cccgcuggccgccg

SEQ ID NO: 2927046 - RNA, 15 nt, Mycobacterium avium subsp. paratuberculosis
cccgcuggccgccgc

SEQ ID NO: 2927047 - RNA, 22 nt, Mycobacterium avium subsp. paratuberculosis
cccgcuggcgaauucggaaccc

SEQ ID NO: 2927048 - RNA, 18 nt, Mycobacterium avium subsp. paratuberculosis
cccgcuggcgccggcguc

SEQ ID NO: 2927049 - RNA, 17 nt, Mycobacterium avium subsp. paratuberculosis
cccgcuggggcgcaccg

SEQ ID NO: 2927050 - RNA, 18 nt, Mycobacterium avium subsp. paratuberculosis
cccgcuggggcgcaccgc

SEQ ID NO: 2927051 - RNA, 19 nt, Mycobacterium avium subsp. paratuberculosis
cccgcuggggcgcaccgcc

SEQ ID NO: 2927052 - RNA, 21 nt, Mycobacterium avium subsp. paratuberculosis
cccgcuggggcgcaccgccug

SEQ ID NO: 2927053 - RNA, 18 nt, Mycobacterium avium subsp. paratuberculosis
cccgcuucaggcagcgca

SEQ ID NO: 2927054 - RNA, 15 nt, Mycobacterium avium subsp. paratuberculosis
cccgcuucgcccggc

SEQ ID NO: 2927055 - RNA, 19 nt, Mycobacterium avium subsp. paratuberculosis
cccgcuucgcccggcugcg

SEQ ID NO: 2927056 - RNA, 20 nt, Mycobacterium avium subsp. paratuberculosis
cccgcuucgcccggcugcgc

SEQ ID NO: 2927057 - RNA, 20 nt, Mycobacterium avium subsp. paratuberculosis
cccgcuucggcucggggucg

SEQ ID NO: 2927058 - RNA, 18 nt, Mycobacterium avium subsp. paratuberculosis
cccgcuugauggcggcgc

SEQ ID NO: 2927059 - RNA, 22 nt, Mycobacterium avium subsp. paratuberculosis
cccgcuugauggcggcgcggau

SEQ ID NO: 2927060 - RNA, 16 nt, Mycobacterium avium subsp. paratuberculosis
cccgcuugccgacgug

SEQ ID NO: 2927061 - RNA, 13 nt, Mycobacterium avium subsp. paratuberculosis
cccgcuugcgcag

SEQ ID NO: 2927062 - RNA, 22 nt, Mycobacterium avium subsp. paratuberculosis
cccgcuugggugaaucaccaag

SEQ ID NO: 2927063 - RNA, 17 nt, Mycobacterium avium subsp. paratuberculosis
cccggaaaaccccaccc

SEQ ID NO: 2927064 - RNA, 21 nt, Mycobacterium avium subsp. paratuberculosis
cccggaaaaccccaccccgag

SEQ ID NO: 2927065 - RNA, 17 nt, Mycobacterium avium subsp. paratuberculosis
cccggaaagcgcgggca

SEQ ID NO: 2927066 - RNA, 18 nt, Mycobacterium avium subsp. paratuberculosis
cccggaaagcgcgggcag

SEQ ID NO: 2927067 - RNA, 20 nt, Mycobacterium avium subsp. paratuberculosis
cccggaacagcuuggcgcag

SEQ ID NO: 2927068 - RNA, 24 nt, Mycobacterium avium subsp. paratuberculosis
cccggaacagcuuggcgcagccgg

SEQ ID NO: 2927069 - RNA, 14 nt, Mycobacterium avium subsp. paratuberculosis
cccggaacccgcgu

SEQ ID NO: 2927070 - RNA, 16 nt, Mycobacterium avium subsp. paratuberculosis
cccggaacccgcgugg

SEQ ID NO: 2927071 - RNA, 21 nt, Mycobacterium avium subsp. paratuberculosis
cccggaacccgcguggcaggu

SEQ ID NO: 2927072 - RNA, 19 nt, Mycobacterium avium subsp. paratuberculosis
cccggaacgcgucgcccac

SEQ ID NO: 2927073 - RNA, 21 nt, Mycobacterium avium subsp. paratuberculosis
cccggaacgcgucgcccacgc

SEQ ID NO: 2927074 - RNA, 14 nt, Mycobacterium avium subsp. paratuberculosis
cccggaacggcggg

SEQ ID NO: 2927075 - RNA, 17 nt, Mycobacterium avium subsp. paratuberculosis
cccggaacggcgggccc

SEQ ID NO: 2927076 - RNA, 16 nt, Mycobacterium avium subsp. paratuberculosis
cccggaagugccggcg

SEQ ID NO: 2927077 - RNA, 21 nt, Mycobacterium avium subsp. paratuberculosis
cccggaaugugcuugaucagc

SEQ ID NO: 2927078 - RNA, 20 nt, Mycobacterium avium subsp. paratuberculosis
cccggacaacggaucgagcg

SEQ ID NO: 2927079 - RNA, 14 nt, Mycobacterium avium subsp. paratuberculosis
cccggacagccacu

SEQ ID NO: 2927080 - RNA, 15 nt, Mycobacterium avium subsp. paratuberculosis
cccggacagccacuc

SEQ ID NO: 2927081 - RNA, 18 nt, Mycobacterium avium subsp. paratuberculosis
cccggacagcgcgacgca

SEQ ID NO: 2927082 - RNA, 23 nt, Mycobacterium avium subsp. paratuberculosis
cccggacagcgcgacgcacgccg

SEQ ID NO: 2927083 - RNA, 21 nt, Mycobacterium avium subsp. paratuberculosis
cccggacauaggcgucgcggu

SEQ ID NO: 2927084 - RNA, 20 nt, Mycobacterium avium subsp. paratuberculosis
cccggaccaggguggcccca

SEQ ID NO: 2927085 - RNA, 21 nt, Mycobacterium avium subsp. paratuberculosis
cccggccagccgggcggccag

SEQ ID NO: 2927086 - RNA, 16 nt, Mycobacterium avium subsp. paratuberculosis
cccggccagccgguau

SEQ ID NO: 2927087 - RNA, 16 nt, Mycobacterium avium subsp. paratuberculosis
cccggccagcggcagc

SEQ ID NO: 2927088 - RNA, 23 nt, Mycobacterium avium subsp. paratuberculosis
cccggccagcggcagcggcgucg

SEQ ID NO: 2927089 - RNA, 18 nt, Mycobacterium avium subsp. paratuberculosis
cccggccaguccggcagc

SEQ ID NO: 2927090 - RNA, 19 nt, Mycobacterium avium subsp. paratuberculosis
cccggcccaagacccgcgu

SEQ ID NO: 2927091 - RNA, 21 nt, Mycobacterium avium subsp. paratuberculosis
cccggcccaagacccgcguca

SEQ ID NO: 2927092 - RNA, 15 nt, Mycobacterium avium subsp. paratuberculosis
cccggcccaccaccg

SEQ ID NO: 2927093 - RNA, 17 nt, Mycobacterium avium subsp. paratuberculosis
cccggcccacgccgucg

SEQ ID NO: 2927094 - RNA, 20 nt, Mycobacterium avium subsp. paratuberculosis
cccggcccacgccgucgucg

SEQ ID NO: 2927095 - RNA, 12 nt, Mycobacterium avium subsp. paratuberculosis
cccggcccagcc

SEQ ID NO: 2927096 - RNA, 13 nt, Mycobacterium avium subsp. paratuberculosis
cccggcccagccg

SEQ ID NO: 2927097 - RNA, 14 nt, Mycobacterium avium subsp. paratuberculosis
cccggcccagccgc

SEQ ID NO: 2927098 - RNA, 15 nt, Mycobacterium avium subsp. paratuberculosis
cccggcccagccgcu

SEQ ID NO: 2927099 - RNA, 17 nt, Mycobacterium avium subsp. paratuberculosis
cccggcccagccgcugc

SEQ ID NO: 2927100 - RNA, 15 nt, Mycobacterium avium subsp. paratuberculosis
cccggcccagccggu

SEQ ID NO: 2927101 - RNA, 21 nt, Mycobacterium avium subsp. paratuberculosis
cccggcccaucaccggaccgg

SEQ ID NO: 2927102 - RNA, 14 nt, Mycobacterium avium subsp. paratuberculosis
cccggccccaccgc

SEQ ID NO: 2927103 - RNA, 16 nt, Mycobacterium avium subsp. paratuberculosis
cccggccccaccgccg

SEQ ID NO: 2927104 - RNA, 14 nt, Mycobacterium avium subsp. paratuberculosis
cccggccccggccg

SEQ ID NO: 2927105 - RNA, 15 nt, Mycobacterium avium subsp. paratuberculosis
cccggccccggccgg

SEQ ID NO: 2927106 - RNA, 16 nt, Mycobacterium avium subsp. paratuberculosis
cccggccccggccggc

SEQ ID NO: 2927107 - RNA, 19 nt, Mycobacterium avium subsp. paratuberculosis
cccggccccggccggcggg

SEQ ID NO: 2927108 - RNA, 18 nt, Mycobacterium avium subsp. paratuberculosis
cccggcccgcuggccgcc

SEQ ID NO: 2927109 - RNA, 13 nt, Mycobacterium avium subsp. paratuberculosis
cccggcccggcgc

SEQ ID NO: 2927110 - RNA, 13 nt, Mycobacterium avium subsp. paratuberculosis
cccggcccgucca

SEQ ID NO: 2927111 - RNA, 18 nt, Mycobacterium avium subsp. paratuberculosis
cccggcccgucgagcggc

SEQ ID NO: 2927112 - RNA, 12 nt, Mycobacterium avium subsp. paratuberculosis
cccggccgacga

SEQ ID NO: 2927113 - RNA, 16 nt, Mycobacterium avium subsp. paratuberculosis
cccggccgacgggcgu

SEQ ID NO: 2927114 - RNA, 13 nt, Mycobacterium avium subsp. paratuberculosis
cccggccgagccg

SEQ ID NO: 2927115 - RNA, 16 nt, Mycobacterium avium subsp. paratuberculosis
cccggccgaggucacc

SEQ ID NO: 2927116 - RNA, 20 nt, Mycobacterium avium subsp. paratuberculosis
cccggccgaggucaccaccg

SEQ ID NO: 2927117 - RNA, 12 nt, Mycobacterium avium subsp. paratuberculosis
cccggccgccag

SEQ ID NO: 2927118 - RNA, 22 nt, Mycobacterium avium subsp. paratuberculosis
cccggccgccgaggacacguug

SEQ ID NO: 2927119 - RNA, 13 nt, Mycobacterium avium subsp. paratuberculosis
cccggccgccggg

SEQ ID NO: 2927120 - RNA, 12 nt, Mycobacterium avium subsp. paratuberculosis
cccggccgcgac

SEQ ID NO: 2927121 - RNA, 15 nt, Mycobacterium avium subsp. paratuberculosis
cccggccgcgacagc

SEQ ID NO: 2927122 - RNA, 16 nt, Mycobacterium avium subsp. paratuberculosis
cccggccgcgacagcc

SEQ ID NO: 2927123 - RNA, 17 nt, Mycobacterium avium subsp. paratuberculosis
cccggccgcgacagccg

SEQ ID NO: 2927124 - RNA, 18 nt, Mycobacterium avium subsp. paratuberculosis
cccggccgcgacagccgg

SEQ ID NO: 2927125 - RNA, 21 nt, Mycobacterium avium subsp. paratuberculosis
cccggccgcgauccagcgcug

SEQ ID NO: 2927126 - RNA, 17 nt, Mycobacterium avium subsp. paratuberculosis
cccggccgcgcaccgcc

SEQ ID NO: 2927127 - RNA, 20 nt, Mycobacterium avium subsp. paratuberculosis
cccggccgcgcaccgccccg

SEQ ID NO: 2927128 - RNA, 13 nt, Mycobacterium avium subsp. paratuberculosis
cccggccgcgccg

SEQ ID NO: 2927129 - RNA, 17 nt, Mycobacterium avium subsp. paratuberculosis
cccggccgcgccggaug

SEQ ID NO: 2927130 - RNA, 13 nt, Mycobacterium avium subsp. paratuberculosis
cccggccgcggcc

SEQ ID NO: 2927131 - RNA, 14 nt, Mycobacterium avium subsp. paratuberculosis
cccggccgcggccc

SEQ ID NO: 2927132 - RNA, 15 nt, Mycobacterium avium subsp. paratuberculosis
cccggccgcggccca

SEQ ID NO: 2927133 - RNA, 20 nt, Mycobacterium avium subsp. paratuberculosis
cccggccgcggugaccgcgc

SEQ ID NO: 2927134 - RNA, 22 nt, Mycobacterium avium subsp. paratuberculosis
cccggccgcggugaccgcgccg

SEQ ID NO: 2927135 - RNA, 21 nt, Mycobacterium avium subsp. paratuberculosis
cccggccggcgaaacacagca

SEQ ID NO: 2927136 - RNA, 14 nt, Mycobacterium avium subsp. paratuberculosis
cccggccggcgcga

SEQ ID NO: 2927137 - RNA, 21 nt, Mycobacterium avium subsp. paratuberculosis
cccggccggcgcgaccagcgg

SEQ ID NO: 2927138 - RNA, 22 nt, Mycobacterium avium subsp. paratuberculosis
cccggccggcgcgaccagcggc

SEQ ID NO: 2927139 - RNA, 13 nt, Mycobacterium avium subsp. paratuberculosis
cccggccggcggg

SEQ ID NO: 2927140 - RNA, 12 nt, Mycobacterium avium subsp. paratuberculosis
cccggccgggcg

SEQ ID NO: 2927141 - RNA, 17 nt, Mycobacterium avium subsp. paratuberculosis
cccggccggucgccgau

SEQ ID NO: 2927142 - RNA, 15 nt, Mycobacterium avium subsp. paratuberculosis
cccggccggucgccu

SEQ ID NO: 2927143 - RNA, 17 nt, Mycobacterium avium subsp. paratuberculosis
cccggccggucgccugc

SEQ ID NO: 2927144 - RNA, 17 nt, Mycobacterium avium subsp. paratuberculosis
cccggccgguggccggu

SEQ ID NO: 2927145 - RNA, 15 nt, Mycobacterium avium subsp. paratuberculosis
cccggccgugcgcag

SEQ ID NO: 2927146 - RNA, 17 nt, Mycobacterium avium subsp. paratuberculosis
cccggccguggacccgc

SEQ ID NO: 2927147 - RNA, 20 nt, Mycobacterium avium subsp. paratuberculosis
cccggccguggacccgcccc

SEQ ID NO: 2927148 - RNA, 23 nt, Mycobacterium avium subsp. paratuberculosis
cccggccguggacccgccccgac

SEQ ID NO: 2927149 - RNA, 20 nt, Mycobacterium avium subsp. paratuberculosis
cccggccguugggccagcgg

SEQ ID NO: 2927150 - RNA, 21 nt, Mycobacterium avium subsp. paratuberculosis
cccggccguugggccagcggc

SEQ ID NO: 2927151 - RNA, 22 nt, Mycobacterium avium subsp. paratuberculosis
cccggccucgugcaaggccugc

SEQ ID NO: 2927152 - RNA, 17 nt, Mycobacterium avium subsp. paratuberculosis
cccggcgaacgccucgg

SEQ ID NO: 2927153 - RNA, 16 nt, Mycobacterium avium subsp. paratuberculosis
cccggcgaaucagcag

SEQ ID NO: 2927154 - RNA, 22 nt, Mycobacterium avium subsp. paratuberculosis
cccggcgaauucggugaucgcg

SEQ ID NO: 2927155 - RNA, 18 nt, Mycobacterium avium subsp. paratuberculosis
cccggcgaccaccagccg

SEQ ID NO: 2927156 - RNA, 16 nt, Mycobacterium avium subsp. paratuberculosis
cccggcgacgaagcag

SEQ ID NO: 2927157 - RNA, 19 nt, Mycobacterium avium subsp. paratuberculosis
cccggcgacgaagcagcuc

SEQ ID NO: 2927158 - RNA, 14 nt, Mycobacterium avium subsp. paratuberculosis
cccggcgacggcgc

SEQ ID NO: 2927159 - RNA, 18 nt, Mycobacterium avium subsp. paratuberculosis
cccggcgacggcggccgu

SEQ ID NO: 2927160 - RNA, 20 nt, Mycobacterium avium subsp. paratuberculosis
cccggcgacggcggugggcu

SEQ ID NO: 2927161 - RNA, 12 nt, Mycobacterium avium subsp. paratuberculosis
cccggcgacguc

SEQ ID NO: 2927162 - RNA, 13 nt, Mycobacterium avium subsp. paratuberculosis
cccggcgacgucg

SEQ ID NO: 2927163 - RNA, 17 nt, Mycobacterium avium subsp. paratuberculosis
cccggcgacgucgccgg

SEQ ID NO: 2927164 - RNA, 20 nt, Mycobacterium avium subsp. paratuberculosis
cccggcgacgucgccggccu

SEQ ID NO: 2927165 - RNA, 22 nt, Mycobacterium avium subsp. paratuberculosis
cccggcgacgucgccggccugc

SEQ ID NO: 2927166 - RNA, 23 nt, Mycobacterium avium subsp. paratuberculosis
cccggcgacgucgccggccugcc

SEQ ID NO: 2927167 - RNA, 14 nt, Mycobacterium avium subsp. paratuberculosis
cccggcgacgucgu

SEQ ID NO: 2927168 - RNA, 13 nt, Mycobacterium avium subsp. paratuberculosis
cccggcgagcacg

SEQ ID NO: 2927169 - RNA, 20 nt, Mycobacterium avium subsp. paratuberculosis
cccggcgagcacgccgccgg

SEQ ID NO: 2927170 - RNA, 16 nt, Mycobacterium avium subsp. paratuberculosis
cccggcggccggccgc

SEQ ID NO: 2927171 - RNA, 20 nt, Mycobacterium avium subsp. paratuberculosis
cccggcgggcaucaucgcua

SEQ ID NO: 2927172 - RNA, 15 nt, Mycobacterium avium subsp. paratuberculosis
cccggcgggccacga

SEQ ID NO: 2927173 - RNA, 21 nt, Mycobacterium avium subsp. paratuberculosis
cccggcgggggcggcggggug

SEQ ID NO: 2927174 - RNA, 24 nt, Mycobacterium avium subsp. paratuberculosis
cccggcgggucugugaccacgguc

SEQ ID NO: 2927175 - RNA, 12 nt, Mycobacterium avium subsp. paratuberculosis
cccggcggucgc

SEQ ID NO: 2927176 - RNA, 16 nt, Mycobacterium avium subsp. paratuberculosis
cccggcggucgccgaa

SEQ ID NO: 2927177 - RNA, 17 nt, Mycobacterium avium subsp. paratuberculosis
cccggcggucggaucga

SEQ ID NO: 2927178 - RNA, 20 nt, Mycobacterium avium subsp. paratuberculosis
cccggcggucggaucgagcu

SEQ ID NO: 2927179 - RNA, 23 nt, Mycobacterium avium subsp. paratuberculosis
cccggcgguuuuguugaccguug

SEQ ID NO: 2927180 - RNA, 14 nt, Mycobacterium avium subsp. paratuberculosis
cccggcguacagca

SEQ ID NO: 2927181 - RNA, 18 nt, Mycobacterium avium subsp. paratuberculosis
cccggcgucacgcuggcg

SEQ ID NO: 2927182 - RNA, 21 nt, Mycobacterium avium subsp. paratuberculosis
cccggcgucacgcuggcguga

SEQ ID NO: 2927183 - RNA, 18 nt, Mycobacterium avium subsp. paratuberculosis
cccggcguccacgccgug

SEQ ID NO: 2927184 - RNA, 19 nt, Mycobacterium avium subsp. paratuberculosis
cccggcguccaguagccgc

SEQ ID NO: 2927185 - RNA, 23 nt, Mycobacterium avium subsp. paratuberculosis
cccggcguccgcgaacgggugcg

SEQ ID NO: 2927186 - RNA, 15 nt, Mycobacterium avium subsp. paratuberculosis
cccggcgucgaugac

SEQ ID NO: 2927187 - RNA, 20 nt, Mycobacterium avium subsp. paratuberculosis
cccggcgucgaugaccucgc

SEQ ID NO: 2927188 - RNA, 16 nt, Mycobacterium avium subsp. paratuberculosis
cccggcgucggagucg

SEQ ID NO: 2927189 - RNA, 15 nt, Mycobacterium avium subsp. paratuberculosis
cccggcgucucggcg

SEQ ID NO: 2927190 - RNA, 12 nt, Mycobacterium avium subsp. paratuberculosis
cccggcgugagc

SEQ ID NO: 2927191 - RNA, 12 nt, Mycobacterium avium subsp. paratuberculosis
cccggcgugcag

SEQ ID NO: 2927192 - RNA, 13 nt, Mycobacterium avium subsp. paratuberculosis
cccggcgugcagg

SEQ ID NO: 2927193 - RNA, 17 nt, Mycobacterium avium subsp. paratuberculosis
cccggcgugggccgcag

SEQ ID NO: 2927194 - RNA, 21 nt, Mycobacterium avium subsp. paratuberculosis
cccggcgugggccgcagcgcg

SEQ ID NO: 2927195 - RNA, 22 nt, Mycobacterium avium subsp. paratuberculosis
cccggcgugggccgcagcgcgg

SEQ ID NO: 2927196 - RNA, 19 nt, Mycobacterium avium subsp. paratuberculosis
cccggcuaauucgggccgc

SEQ ID NO: 2927197 - RNA, 21 nt, Mycobacterium avium subsp. paratuberculosis
cccggcuaauucgggccgccg

SEQ ID NO: 2927198 - RNA, 23 nt, Mycobacterium avium subsp. paratuberculosis
cccggcucagcgcgacgugccgg

SEQ ID NO: 2927199 - RNA, 20 nt, Mycobacterium avium subsp. paratuberculosis
cccggcucgaaguggcagcg

SEQ ID NO: 2927200 - RNA, 11 nt, Mycobacterium avium subsp. paratuberculosis
cccggcucgau

SEQ ID NO: 2927201 - RNA, 19 nt, Mycobacterium avium subsp. paratuberculosis
cccggcucgaucgcgguca

SEQ ID NO: 2927202 - RNA, 16 nt, Mycobacterium avium subsp. paratuberculosis
cccggcucgccgggcu

SEQ ID NO: 2927203 - RNA, 20 nt, Mycobacterium avium subsp. paratuberculosis
cccggcucggaaccguugga

SEQ ID NO: 2927204 - RNA, 15 nt, Mycobacterium avium subsp. paratuberculosis
cccggcucggugcgc

SEQ ID NO: 2927205 - RNA, 18 nt, Mycobacterium avium subsp. paratuberculosis
cccggcucggugcgccag

SEQ ID NO: 2927206 - RNA, 18 nt, Mycobacterium avium subsp. paratuberculosis
cccggcucuccaucuucg

SEQ ID NO: 2927207 - RNA, 13 nt, Mycobacterium avium subsp. paratuberculosis
cccggcugcgcag

SEQ ID NO: 2927208 - RNA, 15 nt, Mycobacterium avium subsp. paratuberculosis
cccggcugcgcagcg

SEQ ID NO: 2927209 - RNA, 17 nt, Mycobacterium avium subsp. paratuberculosis
cccggcugcgccgcgcu

SEQ ID NO: 2927210 - RNA, 12 nt, Mycobacterium avium subsp. paratuberculosis
cccggcugcugc

SEQ ID NO: 2927211 - RNA, 14 nt, Mycobacterium avium subsp. paratuberculosis
cccggcugcugcac

SEQ ID NO: 2927212 - RNA, 17 nt, Mycobacterium avium subsp. paratuberculosis
cccggcugcugcacgac

SEQ ID NO: 2927213 - RNA, 21 nt, Mycobacterium avium subsp. paratuberculosis
cccggcugcugcacgacgacc

SEQ ID NO: 2927214 - RNA, 14 nt, Mycobacterium avium subsp. paratuberculosis
cccggcuggcaggu

SEQ ID NO: 2927215 - RNA, 19 nt, Mycobacterium avium subsp. paratuberculosis
cccggcuggcaggucgcgc

SEQ ID NO: 2927216 - RNA, 21 nt, Mycobacterium avium subsp. paratuberculosis
cccggcuggcaggucgcgccg

SEQ ID NO: 2927217 - RNA, 22 nt, Mycobacterium avium subsp. paratuberculosis
cccggcuggcaggucgcgccgg

SEQ ID NO: 2927218 - RNA, 15 nt, Mycobacterium avium subsp. paratuberculosis
cccggcuggccgcac

SEQ ID NO: 2927219 - RNA, 16 nt, Mycobacterium avium subsp. paratuberculosis
cccggcugggcgcgca

SEQ ID NO: 2927220 - RNA, 16 nt, Mycobacterium avium subsp. paratuberculosis
cccggcuucgccgccg

SEQ ID NO: 2927221 - RNA, 17 nt, Mycobacterium avium subsp. paratuberculosis
cccggcuucgccgccgc

SEQ ID NO: 2927222 - RNA, 19 nt, Mycobacterium avium subsp. paratuberculosis
cccggcuucgccgccgcac

SEQ ID NO: 2927223 - RNA, 23 nt, Mycobacterium avium subsp. paratuberculosis
cccggcuucgccgccgcaccggc

SEQ ID NO: 2927224 - RNA, 14 nt, Mycobacterium avium subsp. paratuberculosis
cccggcuucgcugc

SEQ ID NO: 2927225 - RNA, 21 nt, Mycobacterium avium subsp. paratuberculosis
cccggcuucgcugcgccggcg

SEQ ID NO: 2927226 - RNA, 22 nt, Mycobacterium avium subsp. paratuberculosis
cccggcuucgcugcgccggcgg

SEQ ID NO: 2927227 - RNA, 15 nt, Mycobacterium avium subsp. paratuberculosis
cccggcuuuccgacg

SEQ ID NO: 2927228 - RNA, 18 nt, Mycobacterium avium subsp. paratuberculosis
cccgggaaaugcugcacc

SEQ ID NO: 2927229 - RNA, 19 nt, Mycobacterium avium subsp. paratuberculosis
cccgggaaaugcugcaccc

SEQ ID NO: 2927230 - RNA, 20 nt, Mycobacterium avium subsp. paratuberculosis
cccgggaaaugcugcaccca

SEQ ID NO: 2927231 - RNA, 20 nt, Mycobacterium avium subsp. paratuberculosis
cccgggaaccagcccagguc

SEQ ID NO: 2927232 - RNA, 18 nt, Mycobacterium avium subsp. paratuberculosis
cccgggaacgacggugcg

SEQ ID NO: 2927233 - RNA, 21 nt, Mycobacterium avium subsp. paratuberculosis
cccgggaagccgcagcaggug

SEQ ID NO: 2927234 - RNA, 14 nt, Mycobacterium avium subsp. paratuberculosis
cccgggacagcccg

SEQ ID NO: 2927235 - RNA, 13 nt, Mycobacterium avium subsp. paratuberculosis
cccgggacccgga

SEQ ID NO: 2927236 - RNA, 14 nt, Mycobacterium avium subsp. paratuberculosis
cccgggacccggaa

SEQ ID NO: 2927237 - RNA, 21 nt, Mycobacterium avium subsp. paratuberculosis
cccgggauccgaggcgucagg

SEQ ID NO: 2927238 - RNA, 13 nt, Mycobacterium avium subsp. paratuberculosis
cccgggaugccga

SEQ ID NO: 2927239 - RNA, 14 nt, Mycobacterium avium subsp. paratuberculosis
cccgggaugccgag

SEQ ID NO: 2927240 - RNA, 23 nt, Mycobacterium avium subsp. paratuberculosis
cccgggaugccugcccgcgcagg

SEQ ID NO: 2927241 - RNA, 17 nt, Mycobacterium avium subsp. paratuberculosis
cccgggaugggccugga

SEQ ID NO: 2927242 - RNA, 15 nt, Mycobacterium avium subsp. paratuberculosis
cccgggcaccagcgc

SEQ ID NO: 2927243 - RNA, 20 nt, Mycobacterium avium subsp. paratuberculosis
cccgggcaccagcgcgacgg

SEQ ID NO: 2927244 - RNA, 12 nt, Mycobacterium avium subsp. paratuberculosis
cccgggcacgcg

SEQ ID NO: 2927245 - RNA, 14 nt, Mycobacterium avium subsp. paratuberculosis
cccgggcacgcgag

SEQ ID NO: 2927246 - RNA, 21 nt, Mycobacterium avium subsp. paratuberculosis
cccgggcagcuuccgccucgg

SEQ ID NO: 2927247 - RNA, 17 nt, Mycobacterium avium subsp. paratuberculosis
cccgggcaggcggcgcg

SEQ ID NO: 2927248 - RNA, 19 nt, Mycobacterium avium subsp. paratuberculosis
cccgggcaggcggcgcgcc

SEQ ID NO: 2927249 - RNA, 16 nt, Mycobacterium avium subsp. paratuberculosis
cccgggcaucccgccg

SEQ ID NO: 2927250 - RNA, 18 nt, Mycobacterium avium subsp. paratuberculosis
cccgggcaucccgccgaa

SEQ ID NO: 2927251 - RNA, 14 nt, Mycobacterium avium subsp. paratuberculosis
cccgggccagcagg

SEQ ID NO: 2927252 - RNA, 12 nt, Mycobacterium avium subsp. paratuberculosis
cccgggccagga

SEQ ID NO: 2927253 - RNA, 13 nt, Mycobacterium avium subsp. paratuberculosis
cccgggccaggac

SEQ ID NO: 2927254 - RNA, 12 nt, Mycobacterium avium subsp. paratuberculosis
cccgggccaggc

SEQ ID NO: 2927255 - RNA, 13 nt, Mycobacterium avium subsp. paratuberculosis
cccgguaggccgc

SEQ ID NO: 2927256 - RNA, 17 nt, Mycobacterium avium subsp. paratuberculosis
cccgguaggccgccgcg

SEQ ID NO: 2927257 - RNA, 15 nt, Mycobacterium avium subsp. paratuberculosis
cccggucaccccggc

SEQ ID NO: 2927258 - RNA, 15 nt, Mycobacterium avium subsp. paratuberculosis
cccggucacccgugg

SEQ ID NO: 2927259 - RNA, 17 nt, Mycobacterium avium subsp. paratuberculosis
cccggucaccgguccgg

SEQ ID NO: 2927260 - RNA, 17 nt, Mycobacterium avium subsp. paratuberculosis
cccggucagcguccagu

SEQ ID NO: 2927261 - RNA, 14 nt, Mycobacterium avium subsp. paratuberculosis
cccggucagcucgc

SEQ ID NO: 2927262 - RNA, 16 nt, Mycobacterium avium subsp. paratuberculosis
cccggucagcucgccg

SEQ ID NO: 2927263 - RNA, 19 nt, Mycobacterium avium subsp. paratuberculosis
cccggucagcucgccgucc

SEQ ID NO: 2927264 - RNA, 20 nt, Mycobacterium avium subsp. paratuberculosis
cccggucagcucgccguccg

SEQ ID NO: 2927265 - RNA, 21 nt, Mycobacterium avium subsp. paratuberculosis
cccggucagcucgccguccgg

SEQ ID NO: 2927266 - RNA, 22 nt, Mycobacterium avium subsp. paratuberculosis
cccggucagguugacgccgaug

SEQ ID NO: 2927267 - RNA, 15 nt, Mycobacterium avium subsp. paratuberculosis
cccggucaguucguc

SEQ ID NO: 2927268 - RNA, 16 nt, Mycobacterium avium subsp. paratuberculosis
cccggucaguucgucg

SEQ ID NO: 2927269 - RNA, 21 nt, Mycobacterium avium subsp. paratuberculosis
cccgguccacggugucgcugu

SEQ ID NO: 2927270 - RNA, 23 nt, Mycobacterium avium subsp. paratuberculosis
cccggucccgccggugaucuccc

SEQ ID NO: 2927271 - RNA, 14 nt, Mycobacterium avium subsp. paratuberculosis
cccgguccggcccg

SEQ ID NO: 2927272 - RNA, 19 nt, Mycobacterium avium subsp. paratuberculosis
cccgguccggcuggucggc

SEQ ID NO: 2927273 - RNA, 14 nt, Mycobacterium avium subsp. paratuberculosis
cccgguccgggucg

SEQ ID NO: 2927274 - RNA, 19 nt, Mycobacterium avium subsp. paratuberculosis
cccgguccgggucgcugag

SEQ ID NO: 2927275 - RNA, 19 nt, Mycobacterium avium subsp. paratuberculosis
cccgguccuucucgcacag

SEQ ID NO: 2927276 - RNA, 13 nt, Mycobacterium avium subsp. paratuberculosis
cccgguccuugag

SEQ ID NO: 2927277 - RNA, 14 nt, Mycobacterium avium subsp. paratuberculosis
cccggucgacgaug

SEQ ID NO: 2927278 - RNA, 16 nt, Mycobacterium avium subsp. paratuberculosis
cccggucgacgauggc

SEQ ID NO: 2927279 - RNA, 19 nt, Mycobacterium avium subsp. paratuberculosis
cccggucgaggucggccag

SEQ ID NO: 2927280 - RNA, 20 nt, Mycobacterium avium subsp. paratuberculosis
cccggucgaggucggccagc

SEQ ID NO: 2927281 - RNA, 14 nt, Mycobacterium avium subsp. paratuberculosis
cccggucgaugauc

SEQ ID NO: 2927282 - RNA, 17 nt, Mycobacterium avium subsp. paratuberculosis
cccggucgaugaucugg

SEQ ID NO: 2927283 - RNA, 23 nt, Mycobacterium avium subsp. paratuberculosis
cccggucgccggugugaucgagc

SEQ ID NO: 2927284 - RNA, 21 nt, Mycobacterium avium subsp. paratuberculosis
cccggucgcggccguagccgu

SEQ ID NO: 2927285 - RNA, 20 nt, Mycobacterium avium subsp. paratuberculosis
cccggucggaguccagcacg

SEQ ID NO: 2927286 - RNA, 13 nt, Mycobacterium avium subsp. paratuberculosis
cccggucggccgc

SEQ ID NO: 2927287 - RNA, 19 nt, Mycobacterium avium subsp. paratuberculosis
cccggucguagucggcccg

SEQ ID NO: 2927288 - RNA, 22 nt, Mycobacterium avium subsp. paratuberculosis
cccggucguagucggcccgccg

SEQ ID NO: 2927289 - RNA, 16 nt, Mycobacterium avium subsp. paratuberculosis
cccggucgucgagcac

SEQ ID NO: 2927290 - RNA, 20 nt, Mycobacterium avium subsp. paratuberculosis
cccggucgucgagcaccggc

SEQ ID NO: 2927291 - RNA, 22 nt, Mycobacterium avium subsp. paratuberculosis
cccggucgucgagcaccggcug

SEQ ID NO: 2927292 - RNA, 14 nt, Mycobacterium avium subsp. paratuberculosis
cccggucgucgccg

SEQ ID NO: 2927293 - RNA, 17 nt, Mycobacterium avium subsp. paratuberculosis
cccggucgucgccggau

SEQ ID NO: 2927294 - RNA, 19 nt, Mycobacterium avium subsp. paratuberculosis
cccggucgucgccggaugu

SEQ ID NO: 2927295 - RNA, 15 nt, Mycobacterium avium subsp. paratuberculosis
cccggucugaucgcc

SEQ ID NO: 2927296 - RNA, 14 nt, Mycobacterium avium subsp. paratuberculosis
cccggucugcggcc

SEQ ID NO: 2927297 - RNA, 16 nt, Mycobacterium avium subsp. paratuberculosis
cccggucugcggccgc

SEQ ID NO: 2927298 - RNA, 18 nt, Mycobacterium avium subsp. paratuberculosis
cccggucugcggccgcga

SEQ ID NO: 2927299 - RNA, 16 nt, Mycobacterium avium subsp. paratuberculosis
cccggucuugccggcu

SEQ ID NO: 2927300 - RNA, 19 nt, Mycobacterium avium subsp. paratuberculosis
cccggucuuguugugcugc

SEQ ID NO: 2927301 - RNA, 14 nt, Mycobacterium avium subsp. paratuberculosis
cccggugacgaaca

SEQ ID NO: 2927302 - RNA, 20 nt, Mycobacterium avium subsp. paratuberculosis
cccggugacgaacaucgacg

SEQ ID NO: 2927303 - RNA, 22 nt, Mycobacterium avium subsp. paratuberculosis
cccggugacgaacaucgacgac

SEQ ID NO: 2927304 - RNA, 20 nt, Mycobacterium avium subsp. paratuberculosis
cccggugagccucagggcgc

SEQ ID NO: 2927305 - RNA, 14 nt, Mycobacterium avium subsp. paratuberculosis
cccggugaucgccg

SEQ ID NO: 2927306 - RNA, 12 nt, Mycobacterium avium subsp. paratuberculosis
cccggugaugac

SEQ ID NO: 2927307 - RNA, 16 nt, Mycobacterium avium subsp. paratuberculosis
cccggugccgcuggau

SEQ ID NO: 2927308 - RNA, 15 nt, Mycobacterium avium subsp. paratuberculosis
cccggugcgacgccg

SEQ ID NO: 2927309 - RNA, 17 nt, Mycobacterium avium subsp. paratuberculosis
cccggugcgacgccgcg

SEQ ID NO: 2927310 - RNA, 18 nt, Mycobacterium avium subsp. paratuberculosis
cccggugcgacgccgcgc

SEQ ID NO: 2927311 - RNA, 13 nt, Mycobacterium avium subsp. paratuberculosis
cccggugcgccgg

SEQ ID NO: 2927312 - RNA, 16 nt, Mycobacterium avium subsp. paratuberculosis
cccgguggacgcgaug

SEQ ID NO: 2927313 - RNA, 20 nt, Mycobacterium avium subsp. paratuberculosis
cccgguggacgcgauggcgc

SEQ ID NO: 2927314 - RNA, 16 nt, Mycobacterium avium subsp. paratuberculosis
cccgguggaugggcuc

SEQ ID NO: 2927315 - RNA, 13 nt, Mycobacterium avium subsp. paratuberculosis
cccgguggcccgg

SEQ ID NO: 2927316 - RNA, 12 nt, Mycobacterium avium subsp. paratuberculosis
cccgguggccga

SEQ ID NO: 2927317 - RNA, 16 nt, Mycobacterium avium subsp. paratuberculosis
cccggugucgccgucg

SEQ ID NO: 2927318 - RNA, 20 nt, Mycobacterium avium subsp. paratuberculosis
cccggugucgccgucgccgc

SEQ ID NO: 2927319 - RNA, 16 nt, Mycobacterium avium subsp. paratuberculosis
cccggugucugaccuc

SEQ ID NO: 2927320 - RNA, 17 nt, Mycobacterium avium subsp. paratuberculosis
cccggugucugaccucg

SEQ ID NO: 2927321 - RNA, 13 nt, Mycobacterium avium subsp. paratuberculosis
cccgguucaccag

SEQ ID NO: 2927322 - RNA, 20 nt, Mycobacterium avium subsp. paratuberculosis
cccgguuccaaccaccgugg

SEQ ID NO: 2927323 - RNA, 22 nt, Mycobacterium avium subsp. paratuberculosis
cccgguuccaaccaccguggcc

SEQ ID NO: 2927324 - RNA, 18 nt, Mycobacterium avium subsp. paratuberculosis
cccgguuccaccgggccg

SEQ ID NO: 2927325 - RNA, 19 nt, Mycobacterium avium subsp. paratuberculosis
cccgguuccagcggcaccg

SEQ ID NO: 2927326 - RNA, 17 nt, Mycobacterium avium subsp. paratuberculosis
cccgguucccggcacca

SEQ ID NO: 2927327 - RNA, 16 nt, Mycobacterium avium subsp. paratuberculosis
cccgguucccgugcug

SEQ ID NO: 2927328 - RNA, 18 nt, Mycobacterium avium subsp. paratuberculosis
cccgguuccgcgacaucg

SEQ ID NO: 2927329 - RNA, 17 nt, Mycobacterium avium subsp. paratuberculosis
cccgguucugggcgggc

SEQ ID NO: 2927330 - RNA, 18 nt, Mycobacterium avium subsp. paratuberculosis
cccgguugaccccggccc

SEQ ID NO: 2927331 - RNA, 19 nt, Mycobacterium avium subsp. paratuberculosis
cccgguugaccccggcccc

SEQ ID NO: 2927332 - RNA, 21 nt, Mycobacterium avium subsp. paratuberculosis
cccgguugaccccggccccgg

SEQ ID NO: 2927333 - RNA, 13 nt, Mycobacterium avium subsp. paratuberculosis
cccgguugagcac

SEQ ID NO: 2927334 - RNA, 15 nt, Mycobacterium avium subsp. paratuberculosis
cccgguugagcaccg

SEQ ID NO: 2927335 - RNA, 16 nt, Mycobacterium avium subsp. paratuberculosis
cccgguugagcaccgc

SEQ ID NO: 2927336 - RNA, 19 nt, Mycobacterium avium subsp. paratuberculosis
cccgguugagugcgccgug

SEQ ID NO: 2927337 - RNA, 23 nt, Mycobacterium avium subsp. paratuberculosis
cccgguugagugcgccgugcagc

SEQ ID NO: 2927338 - RNA, 17 nt, Mycobacterium avium subsp. paratuberculosis
cccgguugauccggauc

SEQ ID NO: 2927339 - RNA, 20 nt, Mycobacterium avium subsp. paratuberculosis
cccgguugauccggaucggg

SEQ ID NO: 2927340 - RNA, 13 nt, Mycobacterium avium subsp. paratuberculosis
cccgucggugaag

SEQ ID NO: 2927341 - RNA, 23 nt, Mycobacterium avium subsp. paratuberculosis
cccgucggugaaguuggcggcgg

SEQ ID NO: 2927342 - RNA, 22 nt, Mycobacterium avium subsp. paratuberculosis
cccgucguccuugagcccccac

SEQ ID NO: 2927343 - RNA, 23 nt, Mycobacterium avium subsp. paratuberculosis
cccgucguccuugagcccccacc

SEQ ID NO: 2927344 - RNA, 13 nt, Mycobacterium avium subsp. paratuberculosis
cccgucgucgaug

SEQ ID NO: 2927345 - RNA, 16 nt, Mycobacterium avium subsp. paratuberculosis
cccgucgucgaugcgc

SEQ ID NO: 2927346 - RNA, 20 nt, Mycobacterium avium subsp. paratuberculosis
cccgucgucgaugcgcagca

SEQ ID NO: 2927347 - RNA, 23 nt, Mycobacterium avium subsp. paratuberculosis
cccgucgucgaugcgcagcagcg

SEQ ID NO: 2927348 - RNA, 13 nt, Mycobacterium avium subsp. paratuberculosis
cccgucgucgccg

SEQ ID NO: 2927349 - RNA, 15 nt, Mycobacterium avium subsp. paratuberculosis
cccgucgucgccgau

SEQ ID NO: 2927350 - RNA, 16 nt, Mycobacterium avium subsp. paratuberculosis
cccgucgucggcgccg

SEQ ID NO: 2927351 - RNA, 17 nt, Mycobacterium avium subsp. paratuberculosis
cccgucgucggcgccgc

SEQ ID NO: 2927352 - RNA, 20 nt, Mycobacterium avium subsp. paratuberculosis
cccgucgucggcgccgcgcc

SEQ ID NO: 2927353 - RNA, 21 nt, Mycobacterium avium subsp. paratuberculosis
cccgucgucggcgccgcgccg

SEQ ID NO: 2927354 - RNA, 23 nt, Mycobacterium avium subsp. paratuberculosis
cccgucucggcgugcucggccac

SEQ ID NO: 2927355 - RNA, 15 nt, Mycobacterium avium subsp. paratuberculosis
cccgugaucgccacg

SEQ ID NO: 2927356 - RNA, 17 nt, Mycobacterium avium subsp. paratuberculosis
cccgugaucgccacggc

SEQ ID NO: 2927357 - RNA, 19 nt, Mycobacterium avium subsp. paratuberculosis
cccgugaucgccacggcgg

SEQ ID NO: 2927358 - RNA, 14 nt, Mycobacterium avium subsp. paratuberculosis
cccgugcaggaucg

SEQ ID NO: 2927359 - RNA, 12 nt, Mycobacterium avium subsp. paratuberculosis
cccgugccgcac

SEQ ID NO: 2927360 - RNA, 13 nt, Mycobacterium avium subsp. paratuberculosis
cccgugcgccgcc

SEQ ID NO: 2927361 - RNA, 22 nt, Mycobacterium avium subsp. paratuberculosis
cccgugcggggccucgucgccg

SEQ ID NO: 2927362 - RNA, 23 nt, Mycobacterium avium subsp. paratuberculosis
cccgugcggggccucgucgccgc

SEQ ID NO: 2927363 - RNA, 11 nt, Mycobacterium avium subsp. paratuberculosis
cccgugcuggc

SEQ ID NO: 2927364 - RNA, 13 nt, Mycobacterium avium subsp. paratuberculosis
cccgugcuggcca

SEQ ID NO: 2927365 - RNA, 16 nt, Mycobacterium avium subsp. paratuberculosis
cccguggaucaucccg

SEQ ID NO: 2927366 - RNA, 17 nt, Mycobacterium avium subsp. paratuberculosis
cccguggccagcgccag

SEQ ID NO: 2927367 - RNA, 13 nt, Mycobacterium avium subsp. paratuberculosis
cccgugggccgac

SEQ ID NO: 2927368 - RNA, 21 nt, Mycobacterium avium subsp. paratuberculosis
cccgugggccgaccggccggu

SEQ ID NO: 2927369 - RNA, 23 nt, Mycobacterium avium subsp. paratuberculosis
cccgugguagacgccggacgugg

SEQ ID NO: 2927370 - RNA, 23 nt, Mycobacterium avium subsp. paratuberculosis
cccguggugggcgaacagcagca

SEQ ID NO: 2927371 - RNA, 16 nt, Mycobacterium avium subsp. paratuberculosis
cccgugucgcggccuc

SEQ ID NO: 2927372 - RNA, 14 nt, Mycobacterium avium subsp. paratuberculosis
cccguucagugacc

SEQ ID NO: 2927373 - RNA, 20 nt, Mycobacterium avium subsp. paratuberculosis
cccguucagugaccagugca

SEQ ID NO: 2927374 - RNA, 13 nt, Mycobacterium avium subsp. paratuberculosis
cccguuccccggc

SEQ ID NO: 2927375 - RNA, 14 nt, Mycobacterium avium subsp. paratuberculosis
cccguuccccggcc

SEQ ID NO: 2927376 - RNA, 17 nt, Mycobacterium avium subsp. paratuberculosis
cccguuccccggccgac

SEQ ID NO: 2927377 - RNA, 18 nt, Mycobacterium avium subsp. paratuberculosis
cccguuccccggccgacg

SEQ ID NO: 2927378 - RNA, 12 nt, Mycobacterium avium subsp. paratuberculosis
cccguucccgac

SEQ ID NO: 2927379 - RNA, 14 nt, Mycobacterium avium subsp. paratuberculosis
cccguuccucgacg

SEQ ID NO: 2927380 - RNA, 17 nt, Mycobacterium avium subsp. paratuberculosis
cccguucgagcgccgga

SEQ ID NO: 2927381 - RNA, 18 nt, Mycobacterium avium subsp. paratuberculosis
cccguucgagcgccggac

SEQ ID NO: 2927382 - RNA, 21 nt, Mycobacterium avium subsp. paratuberculosis
cccguucgccgacagcagcuc

SEQ ID NO: 2927383 - RNA, 15 nt, Mycobacterium avium subsp. paratuberculosis
cccguucggcgucga

SEQ ID NO: 2927384 - RNA, 23 nt, Mycobacterium avium subsp. paratuberculosis
cccguucgguggccaccgcgacg

SEQ ID NO: 2927385 - RNA, 17 nt, Mycobacterium avium subsp. paratuberculosis
cccguugagcaccgcga

SEQ ID NO: 2927386 - RNA, 14 nt, Mycobacterium avium subsp. paratuberculosis
cccguugagcagcg

SEQ ID NO: 2927387 - RNA, 19 nt, Mycobacterium avium subsp. paratuberculosis
cccguugaucucggucugc

SEQ ID NO: 2927388 - RNA, 15 nt, Mycobacterium avium subsp. paratuberculosis
cccguugccaacacc

SEQ ID NO: 2927389 - RNA, 14 nt, Mycobacterium avium subsp. paratuberculosis
cccguugcgcccca

SEQ ID NO: 2927390 - RNA, 16 nt, Mycobacterium avium subsp. paratuberculosis
cccguuggcaggcccg

SEQ ID NO: 2927391 - RNA, 10 nt, Mycobacterium avium subsp. paratuberculosis
cccguuggcg

SEQ ID NO: 2927392 - RNA, 14 nt, Mycobacterium avium subsp. paratuberculosis
cccguuggcgccgg

SEQ ID NO: 2927393 - RNA, 20 nt, Mycobacterium avium subsp. paratuberculosis
cccguuggcgccggucgacg

SEQ ID NO: 2927394 - RNA, 19 nt, Mycobacterium avium subsp. paratuberculosis
cccguugggguccucgaug

SEQ ID NO: 2927395 - RNA, 21 nt, Mycobacterium avium subsp. paratuberculosis
cccguugggguccucgauggc

SEQ ID NO: 2927396 - RNA, 14 nt, Mycobacterium avium subsp. paratuberculosis
cccguugucgagca

SEQ ID NO: 2927397 - RNA, 19 nt, Mycobacterium avium subsp. paratuberculosis
cccguugucgagcaccgcg

SEQ ID NO: 2927398 - RNA, 20 nt, Mycobacterium avium subsp. paratuberculosis
cccguugucgagcaccgcga

SEQ ID NO: 2927399 - RNA, 15 nt, Mycobacterium avium subsp. paratuberculosis
cccuacccguccagc

SEQ ID NO: 2927400 - RNA, 14 nt, Mycobacterium avium subsp. paratuberculosis
cccuaccgccgagc

SEQ ID NO: 2927401 - RNA, 14 nt, Mycobacterium avium subsp. paratuberculosis
cccuacgccguggc

SEQ ID NO: 2927402 - RNA, 12 nt, Mycobacterium avium subsp. paratuberculosis
cccuacgggcgc

SEQ ID NO: 2927403 - RNA, 16 nt, Mycobacterium avium subsp. paratuberculosis
cccuacgggcgcaccg

SEQ ID NO: 2927404 - RNA, 19 nt, Mycobacterium avium subsp. paratuberculosis
cccuacgggcgcaccgcgc

SEQ ID NO: 2927405 - RNA, 20 nt, Mycobacterium avium subsp. paratuberculosis
cccuacgggcgcaccgcgcg

SEQ ID NO: 2927406 - RNA, 24 nt, Mycobacterium avium subsp. paratuberculosis
cccuacgggcgcaccgcgcgccag

SEQ ID NO: 2927407 - RNA, 14 nt, Mycobacterium avium subsp. paratuberculosis
cccuagcgggccag

SEQ ID NO: 2927408 - RNA, 18 nt, Mycobacterium avium subsp. paratuberculosis
cccuagcgggccaggaug

SEQ ID NO: 2927409 - RNA, 22 nt, Mycobacterium avium subsp. paratuberculosis
cccuagcgugccguccagcucc

SEQ ID NO: 2927410 - RNA, 15 nt, Mycobacterium avium subsp. paratuberculosis
cccuauggcaucgcc

SEQ ID NO: 2927411 - RNA, 21 nt, Mycobacterium avium subsp. paratuberculosis
cccuauggcaucgccaaggcg

SEQ ID NO: 2927412 - RNA, 14 nt, Mycobacterium avium subsp. paratuberculosis
cccucaccacgauc

SEQ ID NO: 2927413 - RNA, 16 nt, Mycobacterium avium subsp. paratuberculosis
cccucacuccagcggc

SEQ ID NO: 2927414 - RNA, 15 nt, Mycobacterium avium subsp. paratuberculosis
cccucagaccauggc

SEQ ID NO: 2927415 - RNA, 19 nt, Mycobacterium avium subsp. paratuberculosis
cccucagaccauggcgcgg

SEQ ID NO: 2927416 - RNA, 22 nt, Mycobacterium avium subsp. paratuberculosis
cccucagaccauggcgcggcgg

SEQ ID NO: 2927417 - RNA, 12 nt, Mycobacterium avium subsp. paratuberculosis
cccucagccgga

SEQ ID NO: 2927418 - RNA, 14 nt, Mycobacterium avium subsp. paratuberculosis
cccucagccggaac

SEQ ID NO: 2927419 - RNA, 14 nt, Mycobacterium avium subsp. paratuberculosis
cccucaggcgucca

SEQ ID NO: 2927420 - RNA, 14 nt, Mycobacterium avium subsp. paratuberculosis
cccucagggagcug

SEQ ID NO: 2927421 - RNA, 15 nt, Mycobacterium avium subsp. paratuberculosis
cccucagggagcugc

SEQ ID NO: 2927422 - RNA, 20 nt, Mycobacterium avium subsp. paratuberculosis
cccucagggagcugcccgca

SEQ ID NO: 2927423 - RNA, 20 nt, Mycobacterium avium subsp. paratuberculosis
cccucagguggacagaugcc

SEQ ID NO: 2927424 - RNA, 22 nt, Mycobacterium avium subsp. paratuberculosis
cccucaucgucgacccggccgc

SEQ ID NO: 2927425 - RNA, 19 nt, Mycobacterium avium subsp. paratuberculosis
cccugcacccagccgugcc

SEQ ID NO: 2927426 - RNA, 22 nt, Mycobacterium avium subsp. paratuberculosis
cccugcacccagccgugcccca

SEQ ID NO: 2927427 - RNA, 17 nt, Mycobacterium avium subsp. paratuberculosis
cccugcacuaccccguc

SEQ ID NO: 2927428 - RNA, 17 nt, Mycobacterium avium subsp. paratuberculosis
cccugcagccggguggc

SEQ ID NO: 2927429 - RNA, 22 nt, Mycobacterium avium subsp. paratuberculosis
cccugcagccggguggcccgcc

SEQ ID NO: 2927430 - RNA, 23 nt, Mycobacterium avium subsp. paratuberculosis
cccugcagguagguggccagccg

SEQ ID NO: 2927431 - RNA, 19 nt, Mycobacterium avium subsp. paratuberculosis
cccugccagcgcccgcugc

SEQ ID NO: 2927432 - RNA, 14 nt, Mycobacterium avium subsp. paratuberculosis
cccugccccacggc

SEQ ID NO: 2927433 - RNA, 23 nt, Mycobacterium avium subsp. paratuberculosis
cccugcccgucgggcgcggcggc

SEQ ID NO: 2927434 - RNA, 15 nt, Mycobacterium avium subsp. paratuberculosis
cccugccgucaccgg

SEQ ID NO: 2927435 - RNA, 19 nt, Mycobacterium avium subsp. paratuberculosis
cccugccgucaccggccau

SEQ ID NO: 2927436 - RNA, 19 nt, Mycobacterium avium subsp. paratuberculosis
cccugccugcugcccaucc

SEQ ID NO: 2927437 - RNA, 21 nt, Mycobacterium avium subsp. paratuberculosis
cccugcgaauacccgcccagc

SEQ ID NO: 2927438 - RNA, 14 nt, Mycobacterium avium subsp. paratuberculosis
cccugcgagcccgg

SEQ ID NO: 2927439 - RNA, 13 nt, Mycobacterium avium subsp. paratuberculosis
cccugcgccagca

SEQ ID NO: 2927440 - RNA, 19 nt, Mycobacterium avium subsp. paratuberculosis
cccugcgccagcagcagcg

SEQ ID NO: 2927441 - RNA, 22 nt, Mycobacterium avium subsp. paratuberculosis
cccugcgccagcagcagcgcgg

SEQ ID NO: 2927442 - RNA, 13 nt, Mycobacterium avium subsp. paratuberculosis
cccugcgcgcccu

SEQ ID NO: 2927443 - RNA, 17 nt, Mycobacterium avium subsp. paratuberculosis
cccugcgcgcccugcug

SEQ ID NO: 2927444 - RNA, 18 nt, Mycobacterium avium subsp. paratuberculosis
cccugcgcgcccugcugg

SEQ ID NO: 2927445 - RNA, 23 nt, Mycobacterium avium subsp. paratuberculosis
cccugcgcggaaguggaccgcgu

SEQ ID NO: 2927446 - RNA, 18 nt, Mycobacterium avium subsp. paratuberculosis
cccugcgcggccugcagc

SEQ ID NO: 2927447 - RNA, 22 nt, Mycobacterium avium subsp. paratuberculosis
cccugcgcggccugcagcaccg

SEQ ID NO: 2927448 - RNA, 15 nt, Mycobacterium avium subsp. paratuberculosis
cccugcgcggcgaug

SEQ ID NO: 2927449 - RNA, 22 nt, Mycobacterium avium subsp. paratuberculosis
cccugcgcggcgaugcgcucca

SEQ ID NO: 2927450 - RNA, 16 nt, Mycobacterium avium subsp. paratuberculosis
cccugcgcucagcacg

SEQ ID NO: 2927451 - RNA, 19 nt, Mycobacterium avium subsp. paratuberculosis
cccugcgcucagcacgcgg

SEQ ID NO: 2927452 - RNA, 17 nt, Mycobacterium avium subsp. paratuberculosis
cccugcggccagugccg

SEQ ID NO: 2927453 - RNA, 12 nt, Mycobacterium avium subsp. paratuberculosis
cccugcgucauc

SEQ ID NO: 2927454 - RNA, 17 nt, Mycobacterium avium subsp. paratuberculosis
cccugcguccggcccgg

SEQ ID NO: 2927455 - RNA, 21 nt, Mycobacterium avium subsp. paratuberculosis
cccugcguccggcccggcguc

SEQ ID NO: 2927456 - RNA, 23 nt, Mycobacterium avium subsp. paratuberculosis
cccugcguccggcccggcguccg

SEQ ID NO: 2927457 - RNA, 19 nt, Mycobacterium avium subsp. paratuberculosis
cccugcucagcggccaucg

SEQ ID NO: 2927458 - RNA, 21 nt, Mycobacterium avium subsp. paratuberculosis
cccugcucggccagcggguga

SEQ ID NO: 2927459 - RNA, 22 nt, Mycobacterium avium subsp. paratuberculosis
cccugcucggccagcgggugau

SEQ ID NO: 2927460 - RNA, 14 nt, Mycobacterium avium subsp. paratuberculosis
cccugcucggugau

SEQ ID NO: 2927461 - RNA, 16 nt, Mycobacterium avium subsp. paratuberculosis
cccugcucuucgcgcg

SEQ ID NO: 2927462 - RNA, 19 nt, Mycobacterium avium subsp. paratuberculosis
cccugcuugaacagcaccc

SEQ ID NO: 2927463 - RNA, 13 nt, Mycobacterium avium subsp. paratuberculosis
cccuggaaggcga

SEQ ID NO: 2927464 - RNA, 22 nt, Mycobacterium avium subsp. paratuberculosis
cccuggaaggcgaucacgaaga

SEQ ID NO: 2927465 - RNA, 21 nt, Mycobacterium avium subsp. paratuberculosis
cccuggacgaguggucggccg

SEQ ID NO: 2927466 - RNA, 21 nt, Mycobacterium avium subsp. paratuberculosis
cccuggaugucacgguccagg

SEQ ID NO: 2927467 - RNA, 13 nt, Mycobacterium avium subsp. paratuberculosis
cccuggccagcac

SEQ ID NO: 2927468 - RNA, 16 nt, Mycobacterium avium subsp. paratuberculosis
cccuggccagcaccgc

SEQ ID NO: 2927469 - RNA, 17 nt, Mycobacterium avium subsp. paratuberculosis
cccuggccagcaccgcg

SEQ ID NO: 2927470 - RNA, 19 nt, Mycobacterium avium subsp. paratuberculosis
cccuggccccagaaccgcu

SEQ ID NO: 2927471 - RNA, 13 nt, Mycobacterium avium subsp. paratuberculosis
cccuggccgccgg

SEQ ID NO: 2927472 - RNA, 13 nt, Mycobacterium avium subsp. paratuberculosis
cccuggccgcguu

SEQ ID NO: 2927473 - RNA, 14 nt, Mycobacterium avium subsp. paratuberculosis
cccuggcgggcggc

SEQ ID NO: 2927474 - RNA, 18 nt, Mycobacterium avium subsp. paratuberculosis
cccuggcgggcggcccgc

SEQ ID NO: 2927475 - RNA, 19 nt, Mycobacterium avium subsp. paratuberculosis
cccugggacagcgagaagu

SEQ ID NO: 2927476 - RNA, 19 nt, Mycobacterium avium subsp. paratuberculosis
cccugguacgcgccgucgu

SEQ ID NO: 2927477 - RNA, 21 nt, Mycobacterium avium subsp. paratuberculosis
cccugguccuuaaucgggacg

SEQ ID NO: 2927478 - RNA, 22 nt, Mycobacterium avium subsp. paratuberculosis
cccuggucgaagauggccaggu

SEQ ID NO: 2927479 - RNA, 19 nt, Mycobacterium avium subsp. paratuberculosis
cccuggugaccgacgacgu

SEQ ID NO: 2927480 - RNA, 17 nt, Mycobacterium avium subsp. paratuberculosis
cccuggugcaacaccga

SEQ ID NO: 2927481 - RNA, 21 nt, Mycobacterium avium subsp. paratuberculosis
cccugugaggcguuggcccgc

SEQ ID NO: 2927482 - RNA, 15 nt, Mycobacterium avium subsp. paratuberculosis
cccuguucgccgucg

SEQ ID NO: 2927483 - RNA, 16 nt, Mycobacterium avium subsp. paratuberculosis
cccuucaccucggccu

SEQ ID NO: 2927484 - RNA, 17 nt, Mycobacterium avium subsp. paratuberculosis
cccuucauuagccggac

SEQ ID NO: 2927485 - RNA, 15 nt, Mycobacterium avium subsp. paratuberculosis
cccuuccccggcggc

SEQ ID NO: 2927486 - RNA, 19 nt, Mycobacterium avium subsp. paratuberculosis
cccuucgaacgcgacgaag

SEQ ID NO: 2927487 - RNA, 18 nt, Mycobacterium avium subsp. paratuberculosis
cccuucgaugucgccggc

SEQ ID NO: 2927488 - RNA, 14 nt, Mycobacterium avium subsp. paratuberculosis
cccuucggccggca

SEQ ID NO: 2927489 - RNA, 15 nt, Mycobacterium avium subsp. paratuberculosis
cccuucggccggcag

SEQ ID NO: 2927490 - RNA, 16 nt, Mycobacterium avium subsp. paratuberculosis
cccuucggccggcagc

SEQ ID NO: 2927491 - RNA, 18 nt, Mycobacterium avium subsp. paratuberculosis
cccuucggccggcagcgg

SEQ ID NO: 2927492 - RNA, 17 nt, Mycobacterium avium subsp. paratuberculosis
cccuucggcgcccgcuc

SEQ ID NO: 2927493 - RNA, 21 nt, Mycobacterium avium subsp. paratuberculosis
cccuugagcacggugaucagc

SEQ ID NO: 2927494 - RNA, 12 nt, Mycobacterium avium subsp. paratuberculosis
cccuugcagcac

SEQ ID NO: 2927495 - RNA, 17 nt, Mycobacterium avium subsp. paratuberculosis
cccuugcccggacgaug

SEQ ID NO: 2927496 - RNA, 20 nt, Mycobacterium avium subsp. paratuberculosis
cccuugcccggacgaugccg

SEQ ID NO: 2927497 - RNA, 20 nt, Mycobacterium avium subsp. paratuberculosis
cccuuggacucccccaccac

SEQ ID NO: 2927498 - RNA, 13 nt, Mycobacterium avium subsp. paratuberculosis
cccuuggccagca

SEQ ID NO: 2927499 - RNA, 15 nt, Mycobacterium avium subsp. paratuberculosis
cccuuggccagcagu

SEQ ID NO: 2927500 - RNA, 15 nt, Mycobacterium avium subsp. paratuberculosis
cccuuggcggccacg

SEQ ID NO: 2927501 - RNA, 15 nt, Mycobacterium avium subsp. paratuberculosis
cccuuggcggcggcc

SEQ ID NO: 2927502 - RNA, 22 nt, Mycobacterium avium subsp. paratuberculosis
cccuugggcggauuggugccga

SEQ ID NO: 2927503 - RNA, 20 nt, Mycobacterium avium subsp. paratuberculosis
cccuugguguaggcgaucgg

SEQ ID NO: 2927504 - RNA, 18 nt, Mycobacterium avium subsp. paratuberculosis
cccuuugcgcugcccgau

SEQ ID NO: 2927505 - RNA, 15 nt, Mycobacterium avium subsp. paratuberculosis
cccuuuugccgaucg

SEQ ID NO: 2927506 - RNA, 16 nt, Mycobacterium avium subsp. paratuberculosis
ccgaaaaacgcgucgc

SEQ ID NO: 2927507 - RNA, 21 nt, Mycobacterium avium subsp. paratuberculosis
ccgaaaaacgcgucgcguggc

SEQ ID NO: 2927508 - RNA, 19 nt, Mycobacterium avium subsp. paratuberculosis
ccgaaaagcaccaggcucg

SEQ ID NO: 2927509 - RNA, 20 nt, Mycobacterium avium subsp. paratuberculosis
ccgaagaacgacuggcggcg

SEQ ID NO: 2927510 - RNA, 17 nt, Mycobacterium avium subsp. paratuberculosis
ccgaagaacucagccga

SEQ ID NO: 2927511 - RNA, 17 nt, Mycobacterium avium subsp. paratuberculosis
ccgaagaccgccgaaag

SEQ ID NO: 2927512 - RNA, 15 nt, Mycobacterium avium subsp. paratuberculosis
ccgaagaccgggccg

SEQ ID NO: 2927513 - RNA, 17 nt, Mycobacterium avium subsp. paratuberculosis
ccgaagaccgggccgau

SEQ ID NO: 2927514 - RNA, 22 nt, Mycobacterium avium subsp. paratuberculosis
ccgaagacgaugaaaccccagc

SEQ ID NO: 2927515 - RNA, 17 nt, Mycobacterium avium subsp. paratuberculosis
ccgaagauggccagcgc

SEQ ID NO: 2927516 - RNA, 20 nt, Mycobacterium avium subsp. paratuberculosis
ccgaagauggccagcgcggc

SEQ ID NO: 2927517 - RNA, 21 nt, Mycobacterium avium subsp. paratuberculosis
ccgaagauggccagcgcggcg

SEQ ID NO: 2927518 - RNA, 18 nt, Mycobacterium avium subsp. paratuberculosis
ccgaagauggccaggaac

SEQ ID NO: 2927519 - RNA, 23 nt, Mycobacterium avium subsp. paratuberculosis
ccgaagcccgacaucugccgggc

SEQ ID NO: 2927520 - RNA, 19 nt, Mycobacterium avium subsp. paratuberculosis
ccgaagcccgagcgucacg

SEQ ID NO: 2927521 - RNA, 12 nt, Mycobacterium avium subsp. paratuberculosis
ccgaagcccgca

SEQ ID NO: 2927522 - RNA, 14 nt, Mycobacterium avium subsp. paratuberculosis
ccgaagcccgcagc

SEQ ID NO: 2927523 - RNA, 18 nt, Mycobacterium avium subsp. paratuberculosis
ccgaagccgacaccgggu

SEQ ID NO: 2927524 - RNA, 19 nt, Mycobacterium avium subsp. paratuberculosis
ccgaagccgacgucgacca

SEQ ID NO: 2927525 - RNA, 15 nt, Mycobacterium avium subsp. paratuberculosis
ccgaagccggcgcag

SEQ ID NO: 2927526 - RNA, 14 nt, Mycobacterium avium subsp. paratuberculosis
ccgaagccggcucg

SEQ ID NO: 2927527 - RNA, 15 nt, Mycobacterium avium subsp. paratuberculosis
ccgaagccgucgacc

SEQ ID NO: 2927528 - RNA, 18 nt, Mycobacterium avium subsp. paratuberculosis
ccgaagccgucgaccccg

SEQ ID NO: 2927529 - RNA, 20 nt, Mycobacterium avium subsp. paratuberculosis
ccgaagccgucgaccccgcc

SEQ ID NO: 2927530 - RNA, 13 nt, Mycobacterium avium subsp. paratuberculosis
ccgaagccguuga

SEQ ID NO: 2927531 - RNA, 17 nt, Mycobacterium avium subsp. paratuberculosis
ccgaagcgccacggggc

SEQ ID NO: 2927532 - RNA, 22 nt, Mycobacterium avium subsp. paratuberculosis
ccgaagcgcuuucccugcucga

SEQ ID NO: 2927533 - RNA, 13 nt, Mycobacterium avium subsp. paratuberculosis
ccgaagcggcgca

SEQ ID NO: 2927534 - RNA, 20 nt, Mycobacterium avium subsp. paratuberculosis
ccgaagcucaucaccggcgc

SEQ ID NO: 2927535 - RNA, 22 nt, Mycobacterium avium subsp. paratuberculosis
ccgaagcucaucaccggcgcgc

SEQ ID NO: 2927536 - RNA, 24 nt, Mycobacterium avium subsp. paratuberculosis
ccgaagcucaucaccggcgcgccg

SEQ ID NO: 2927537 - RNA, 22 nt, Mycobacterium avium subsp. paratuberculosis
ccgaaggcguuggagccgacca

SEQ ID NO: 2927538 - RNA, 20 nt, Mycobacterium avium subsp. paratuberculosis
ccgaaggcuuuacgaggcgu

SEQ ID NO: 2927539 - RNA, 19 nt, Mycobacterium avium subsp. paratuberculosis
ccgaagggaaaggcagcag

SEQ ID NO: 2927540 - RNA, 20 nt, Mycobacterium avium subsp. paratuberculosis
ccgaaggguauucgugucua

SEQ ID NO: 2927541 - RNA, 19 nt, Mycobacterium avium subsp. paratuberculosis
ccgaaggugggguugaagc

SEQ ID NO: 2927542 - RNA, 22 nt, Mycobacterium avium subsp. paratuberculosis
ccgaaguccgccagggugccgc

SEQ ID NO: 2927543 - RNA, 22 nt, Mycobacterium avium subsp. paratuberculosis
ccgaagucgacgcaccacgagc

SEQ ID NO: 2927544 - RNA, 16 nt, Mycobacterium avium subsp. paratuberculosis
ccgaaguuccagccga

SEQ ID NO: 2927545 - RNA, 17 nt, Mycobacterium avium subsp. paratuberculosis
ccgaaguucgacacggu

SEQ ID NO: 2927546 - RNA, 19 nt, Mycobacterium avium subsp. paratuberculosis
ccgaaguucgacacgguga

SEQ ID NO: 2927547 - RNA, 22 nt, Mycobacterium avium subsp. paratuberculosis
ccgaaguuggcgucgggcaccu

SEQ ID NO: 2927548 - RNA, 20 nt, Mycobacterium avium subsp. paratuberculosis
ccgaaguugucggguucucg

SEQ ID NO: 2927549 - RNA, 15 nt, Mycobacterium avium subsp. paratuberculosis
ccgaauccagcgcgc

SEQ ID NO: 2927550 - RNA, 17 nt, Mycobacterium avium subsp. paratuberculosis
ccgaauccagcgcgccg

SEQ ID NO: 2927551 - RNA, 21 nt, Mycobacterium avium subsp. paratuberculosis
ccgaauccagcgcgccgcuga

SEQ ID NO: 2927552 - RNA, 15 nt, Mycobacterium avium subsp. paratuberculosis
ccgaauccggccgga

SEQ ID NO: 2927553 - RNA, 14 nt, Mycobacterium avium subsp. paratuberculosis
ccgaaucggucgac

SEQ ID NO: 2927554 - RNA, 15 nt, Mycobacterium avium subsp. paratuberculosis
ccgaaugacguggca

SEQ ID NO: 2927555 - RNA, 22 nt, Mycobacterium avium subsp. paratuberculosis
ccgaaugagacgacccgagagc

SEQ ID NO: 2927556 - RNA, 14 nt, Mycobacterium avium subsp. paratuberculosis
ccgaaugccacgcc

SEQ ID NO: 2927557 - RNA, 15 nt, Mycobacterium avium subsp. paratuberculosis
ccgaaugccacgccg

SEQ ID NO: 2927558 - RNA, 15 nt, Mycobacterium avium subsp. paratuberculosis
ccgacaagggccggg

SEQ ID NO: 2927559 - RNA, 16 nt, Mycobacterium avium subsp. paratuberculosis
ccgacaagggccgggc

SEQ ID NO: 2927560 - RNA, 19 nt, Mycobacterium avium subsp. paratuberculosis
ccgacaagggccgggcgcu

SEQ ID NO: 2927561 - RNA, 20 nt, Mycobacterium avium subsp. paratuberculosis
ccgacaagggccgggcgcug

SEQ ID NO: 2927562 - RNA, 14 nt, Mycobacterium avium subsp. paratuberculosis
ccgacaccaccgcg

SEQ ID NO: 2927563 - RNA, 17 nt, Mycobacterium avium subsp. paratuberculosis
ccgacaccaccgcgcgc

SEQ ID NO: 2927564 - RNA, 14 nt, Mycobacterium avium subsp. paratuberculosis
ccgacaccaccggc

SEQ ID NO: 2927565 - RNA, 20 nt, Mycobacterium avium subsp. paratuberculosis
ccgacaccaccggccgcccg

SEQ ID NO: 2927566 - RNA, 15 nt, Mycobacterium avium subsp. paratuberculosis
ccgacaccaccugca

SEQ ID NO: 2927567 - RNA, 22 nt, Mycobacterium avium subsp. paratuberculosis
ccgacaccaccugcacggggac

SEQ ID NO: 2927568 - RNA, 12 nt, Mycobacterium avium subsp. paratuberculosis
ccgacaccagcg

SEQ ID NO: 2927569 - RNA, 24 nt, Mycobacterium avium subsp. paratuberculosis
ccgacaccgcauuugccgacaugc

SEQ ID NO: 2927570 - RNA, 11 nt, Mycobacterium avium subsp. paratuberculosis
ccgacaccgcc

SEQ ID NO: 2927571 - RNA, 18 nt, Mycobacterium avium subsp. paratuberculosis
ccgacaccgccccgccgc

SEQ ID NO: 2927572 - RNA, 19 nt, Mycobacterium avium subsp. paratuberculosis
ccgacaccgccccgccgcg

SEQ ID NO: 2927573 - RNA, 16 nt, Mycobacterium avium subsp. paratuberculosis
ccgacaccgccuucga

SEQ ID NO: 2927574 - RNA, 14 nt, Mycobacterium avium subsp. paratuberculosis
ccgacaccggccgg

SEQ ID NO: 2927575 - RNA, 15 nt, Mycobacterium avium subsp. paratuberculosis
ccgacaccggccggg

SEQ ID NO: 2927576 - RNA, 18 nt, Mycobacterium avium subsp. paratuberculosis
ccgacaccggccgggacg

SEQ ID NO: 2927577 - RNA, 23 nt, Mycobacterium avium subsp. paratuberculosis
ccgacaccgggucccccgccgac

SEQ ID NO: 2927578 - RNA, 16 nt, Mycobacterium avium subsp. paratuberculosis
ccgacaccgucgccgu

SEQ ID NO: 2927579 - RNA, 18 nt, Mycobacterium avium subsp. paratuberculosis
ccgacaccgucgccguga

SEQ ID NO: 2927580 - RNA, 17 nt, Mycobacterium avium subsp. paratuberculosis
ccgacacguaggccgcc

SEQ ID NO: 2927581 - RNA, 18 nt, Mycobacterium avium subsp. paratuberculosis
ccgacacguaggccgccu

SEQ ID NO: 2927582 - RNA, 20 nt, Mycobacterium avium subsp. paratuberculosis
ccgacacguaggccgccugc

SEQ ID NO: 2927583 - RNA, 19 nt, Mycobacterium avium subsp. paratuberculosis
ccgacagauacuucgucga

SEQ ID NO: 2927584 - RNA, 17 nt, Mycobacterium avium subsp. paratuberculosis
ccgacagaugcggcacc

SEQ ID NO: 2927585 - RNA, 21 nt, Mycobacterium avium subsp. paratuberculosis
ccgacagaugcggcaccagcc

SEQ ID NO: 2927586 - RNA, 23 nt, Mycobacterium avium subsp. paratuberculosis
ccgacagaugcggcaccagcccg

SEQ ID NO: 2927587 - RNA, 19 nt, Mycobacterium avium subsp. paratuberculosis
ccgacagcaaaccgaccgc

SEQ ID NO: 2927588 - RNA, 12 nt, Mycobacterium avium subsp. paratuberculosis
ccgacagcaccc

SEQ ID NO: 2927589 - RNA, 15 nt, Mycobacterium avium subsp. paratuberculosis
ccgacagcacgccgg

SEQ ID NO: 2927590 - RNA, 17 nt, Mycobacterium avium subsp. paratuberculosis
ccgacagcacgccgggc

SEQ ID NO: 2927591 - RNA, 19 nt, Mycobacterium avium subsp. paratuberculosis
ccgacagcacgccgggcau

SEQ ID NO: 2927592 - RNA, 18 nt, Mycobacterium avium subsp. paratuberculosis
ccgacagcccccgcagcc

SEQ ID NO: 2927593 - RNA, 23 nt, Mycobacterium avium subsp. paratuberculosis
ccgaccaguucuucgaugacggc

SEQ ID NO: 2927594 - RNA, 21 nt, Mycobacterium avium subsp. paratuberculosis
ccgacccaauacgaucagcag

SEQ ID NO: 2927595 - RNA, 15 nt, Mycobacterium avium subsp. paratuberculosis
ccgacccccgccgcg

SEQ ID NO: 2927596 - RNA, 20 nt, Mycobacterium avium subsp. paratuberculosis
ccgacccccgccgcgucggu

SEQ ID NO: 2927597 - RNA, 20 nt, Mycobacterium avium subsp. paratuberculosis
ccgaccccgccagcaccgac

SEQ ID NO: 2927598 - RNA, 21 nt, Mycobacterium avium subsp. paratuberculosis
ccgaccccgccagcaccgaca

SEQ ID NO: 2927599 - RNA, 13 nt, Mycobacterium avium subsp. paratuberculosis
ccgaccccggcga

SEQ ID NO: 2927600 - RNA, 17 nt, Mycobacterium avium subsp. paratuberculosis
ccgaccccucggcggcc

SEQ ID NO: 2927601 - RNA, 18 nt, Mycobacterium avium subsp. paratuberculosis
ccgaccccucggcggccg

SEQ ID NO: 2927602 - RNA, 14 nt, Mycobacterium avium subsp. paratuberculosis
ccgaccccugcacu

SEQ ID NO: 2927603 - RNA, 23 nt, Mycobacterium avium subsp. paratuberculosis
ccgaccccugcacuaccccgucg

SEQ ID NO: 2927604 - RNA, 15 nt, Mycobacterium avium subsp. paratuberculosis
ccgacccgaagccca

SEQ ID NO: 2927605 - RNA, 14 nt, Mycobacterium avium subsp. paratuberculosis
ccgacccgcaccac

SEQ ID NO: 2927606 - RNA, 18 nt, Mycobacterium avium subsp. paratuberculosis
ccgacccgcaccaccgcc

SEQ ID NO: 2927607 - RNA, 15 nt, Mycobacterium avium subsp. paratuberculosis
ccgacccgcccgccg

SEQ ID NO: 2927608 - RNA, 16 nt, Mycobacterium avium subsp. paratuberculosis
ccgacccgcccgccgg

SEQ ID NO: 2927609 - RNA, 18 nt, Mycobacterium avium subsp. paratuberculosis
ccgacccgcccgccgggc

SEQ ID NO: 2927610 - RNA, 20 nt, Mycobacterium avium subsp. paratuberculosis
ccgacccgcccgccgggcac

SEQ ID NO: 2927611 - RNA, 12 nt, Mycobacterium avium subsp. paratuberculosis
ccgacccgccgu

SEQ ID NO: 2927612 - RNA, 15 nt, Mycobacterium avium subsp. paratuberculosis
ccgacccggccagcg

SEQ ID NO: 2927613 - RNA, 17 nt, Mycobacterium avium subsp. paratuberculosis
ccgacccggccagcggc

SEQ ID NO: 2927614 - RNA, 14 nt, Mycobacterium avium subsp. paratuberculosis
ccgacccggccgau

SEQ ID NO: 2927615 - RNA, 12 nt, Mycobacterium avium subsp. paratuberculosis
ccgacccgggcu

SEQ ID NO: 2927616 - RNA, 14 nt, Mycobacterium avium subsp. paratuberculosis
ccgacccggucagc

SEQ ID NO: 2927617 - RNA, 16 nt, Mycobacterium avium subsp. paratuberculosis
ccgacccggucagcuc

SEQ ID NO: 2927618 - RNA, 15 nt, Mycobacterium avium subsp. paratuberculosis
ccgacccguccagcg

SEQ ID NO: 2927619 - RNA, 22 nt, Mycobacterium avium subsp. paratuberculosis
ccgacccugcguccggcccggc

SEQ ID NO: 2927620 - RNA, 14 nt, Mycobacterium avium subsp. paratuberculosis
ccgaccgacagccg

SEQ ID NO: 2927621 - RNA, 15 nt, Mycobacterium avium subsp. paratuberculosis
ccgaccgacccggcc

SEQ ID NO: 2927622 - RNA, 23 nt, Mycobacterium avium subsp. paratuberculosis
ccgaccgacgcggucaccggcuc

SEQ ID NO: 2927623 - RNA, 16 nt, Mycobacterium avium subsp. paratuberculosis
ccgaccgaucagcgga

SEQ ID NO: 2927624 - RNA, 13 nt, Mycobacterium avium subsp. paratuberculosis
ccgaccgccacca

SEQ ID NO: 2927625 - RNA, 16 nt, Mycobacterium avium subsp. paratuberculosis
ccgaccgccaccaccc

SEQ ID NO: 2927626 - RNA, 17 nt, Mycobacterium avium subsp. paratuberculosis
ccgaccgccaccacccg

SEQ ID NO: 2927627 - RNA, 19 nt, Mycobacterium avium subsp. paratuberculosis
ccgaccgccaccacccggc

SEQ ID NO: 2927628 - RNA, 14 nt, Mycobacterium avium subsp. paratuberculosis
ccgaccgcccgcug

SEQ ID NO: 2927629 - RNA, 12 nt, Mycobacterium avium subsp. paratuberculosis
ccgaccgccgcc

SEQ ID NO: 2927630 - RNA, 14 nt, Mycobacterium avium subsp. paratuberculosis
ccgaccgccgcggc

SEQ ID NO: 2927631 - RNA, 16 nt, Mycobacterium avium subsp. paratuberculosis
ccgaccgccgcggccg

SEQ ID NO: 2927632 - RNA, 17 nt, Mycobacterium avium subsp. paratuberculosis
ccgaccgccgcggccgc

SEQ ID NO: 2927633 - RNA, 18 nt, Mycobacterium avium subsp. paratuberculosis
ccgaccgccgcggccgcc

SEQ ID NO: 2927634 - RNA, 23 nt, Mycobacterium avium subsp. paratuberculosis
ccgaccgccucgauggcccgcuc

SEQ ID NO: 2927635 - RNA, 12 nt, Mycobacterium avium subsp. paratuberculosis
ccgaccgcgccg

SEQ ID NO: 2927636 - RNA, 14 nt, Mycobacterium avium subsp. paratuberculosis
ccgaccgcgccgaa

SEQ ID NO: 2927637 - RNA, 17 nt, Mycobacterium avium subsp. paratuberculosis
ccgaccgcggucgcggc

SEQ ID NO: 2927638 - RNA, 21 nt, Mycobacterium avium subsp. paratuberculosis
ccgaccgcggucgcggcgccg

SEQ ID NO: 2927639 - RNA, 18 nt, Mycobacterium avium subsp. paratuberculosis
ccgaccgcguacagggcg

SEQ ID NO: 2927640 - RNA, 22 nt, Mycobacterium avium subsp. paratuberculosis
ccgaccgcgugucggcacacca

SEQ ID NO: 2927641 - RNA, 19 nt, Mycobacterium avium subsp. paratuberculosis
ccgaccggccgguuguugc

SEQ ID NO: 2927642 - RNA, 20 nt, Mycobacterium avium subsp. paratuberculosis
ccgaccggcucagcccggcg

SEQ ID NO: 2927643 - RNA, 16 nt, Mycobacterium avium subsp. paratuberculosis
ccgaccgggcgcuccg

SEQ ID NO: 2927644 - RNA, 16 nt, Mycobacterium avium subsp. paratuberculosis
ccgaccgguccgccgc

SEQ ID NO: 2927645 - RNA, 17 nt, Mycobacterium avium subsp. paratuberculosis
ccgaccgguccgccgcc

SEQ ID NO: 2927646 - RNA, 18 nt, Mycobacterium avium subsp. paratuberculosis
ccgaccgguccgccgccg

SEQ ID NO: 2927647 - RNA, 18 nt, Mycobacterium avium subsp. paratuberculosis
ccgaccgguugcccggaa

SEQ ID NO: 2927648 - RNA, 21 nt, Mycobacterium avium subsp. paratuberculosis
ccgaccgucgucccggugaug

SEQ ID NO: 2927649 - RNA, 20 nt, Mycobacterium avium subsp. paratuberculosis
ccgaccuccaaugcgcccug

SEQ ID NO: 2927650 - RNA, 21 nt, Mycobacterium avium subsp. paratuberculosis
ccgaccucgaggccgaggucg

SEQ ID NO: 2927651 - RNA, 19 nt, Mycobacterium avium subsp. paratuberculosis
ccgaccucggccagcgugu

SEQ ID NO: 2927652 - RNA, 14 nt, Mycobacterium avium subsp. paratuberculosis
ccgaccucgucgac

SEQ ID NO: 2927653 - RNA, 16 nt, Mycobacterium avium subsp. paratuberculosis
ccgaccucgucgacgg

SEQ ID NO: 2927654 - RNA, 17 nt, Mycobacterium avium subsp. paratuberculosis
ccgaccucgucgacggc

SEQ ID NO: 2927655 - RNA, 14 nt, Mycobacterium avium subsp. paratuberculosis
ccgaccugcgcgac

SEQ ID NO: 2927656 - RNA, 15 nt, Mycobacterium avium subsp. paratuberculosis
ccgaccuggcggccg

SEQ ID NO: 2927657 - RNA, 18 nt, Mycobacterium avium subsp. paratuberculosis
ccgaccuggcggccggau

SEQ ID NO: 2927658 - RNA, 18 nt, Mycobacterium avium subsp. paratuberculosis
ccgaccugggcggccacc

SEQ ID NO: 2927659 - RNA, 22 nt, Mycobacterium avium subsp. paratuberculosis
ccgaccugggcggccaccgcgc

SEQ ID NO: 2927660 - RNA, 17 nt, Mycobacterium avium subsp. paratuberculosis
ccgaccuggucgccgaa

SEQ ID NO: 2927661 - RNA, 19 nt, Mycobacterium avium subsp. paratuberculosis
ccgaccuggucgccgaacg

SEQ ID NO: 2927662 - RNA, 16 nt, Mycobacterium avium subsp. paratuberculosis
ccgaccuguagggcga

SEQ ID NO: 2927663 - RNA, 17 nt, Mycobacterium avium subsp. paratuberculosis
ccgaccuucugcugcac

SEQ ID NO: 2927664 - RNA, 19 nt, Mycobacterium avium subsp. paratuberculosis
ccgaccuucugcugcacgu

SEQ ID NO: 2927665 - RNA, 22 nt, Mycobacterium avium subsp. paratuberculosis
ccgaccuucugcugcacguccg

SEQ ID NO: 2927666 - RNA, 19 nt, Mycobacterium avium subsp. paratuberculosis
ccgaccuugacccaggccc

SEQ ID NO: 2927667 - RNA, 18 nt, Mycobacterium avium subsp. paratuberculosis
ccgacgaaaucgucgggc

SEQ ID NO: 2927668 - RNA, 22 nt, Mycobacterium avium subsp. paratuberculosis
ccgacgaaaucgucgggccgga

SEQ ID NO: 2927669 - RNA, 17 nt, Mycobacterium avium subsp. paratuberculosis
ccgacgaaccgugcacg

SEQ ID NO: 2927670 - RNA, 18 nt, Mycobacterium avium subsp. paratuberculosis
ccgacgaaccgugcacga

SEQ ID NO: 2927671 - RNA, 17 nt, Mycobacterium avium subsp. paratuberculosis
ccgacgaagaugcgccc

SEQ ID NO: 2927672 - RNA, 18 nt, Mycobacterium avium subsp. paratuberculosis
ccgacgaccaucagcgcc

SEQ ID NO: 2927673 - RNA, 21 nt, Mycobacterium avium subsp. paratuberculosis
ccgacgaccaucagcgcccgg

SEQ ID NO: 2927674 - RNA, 23 nt, Mycobacterium avium subsp. paratuberculosis
ccgacgaccaucagcgcccgggu

SEQ ID NO: 2927675 - RNA, 13 nt, Mycobacterium avium subsp. paratuberculosis
ccgacgaccucgg

SEQ ID NO: 2927676 - RNA, 22 nt, Mycobacterium avium subsp. paratuberculosis
ccgacgaccucggugucgaggu

SEQ ID NO: 2927677 - RNA, 20 nt, Mycobacterium avium subsp. paratuberculosis
ccgacgacgacgucgacgac

SEQ ID NO: 2927678 - RNA, 15 nt, Mycobacterium avium subsp. paratuberculosis
ccgacggcagcaccg

SEQ ID NO: 2927679 - RNA, 17 nt, Mycobacterium avium subsp. paratuberculosis
ccgacggcagcaccgcc

SEQ ID NO: 2927680 - RNA, 18 nt, Mycobacterium avium subsp. paratuberculosis
ccgacggcagcaccgccg

SEQ ID NO: 2927681 - RNA, 19 nt, Mycobacterium avium subsp. paratuberculosis
ccgacggcagcaccgccga

SEQ ID NO: 2927682 - RNA, 13 nt, Mycobacterium avium subsp. paratuberculosis
ccgacggccagca

SEQ ID NO: 2927683 - RNA, 15 nt, Mycobacterium avium subsp. paratuberculosis
ccgacggccagcagg

SEQ ID NO: 2927684 - RNA, 12 nt, Mycobacterium avium subsp. paratuberculosis
ccgacggccgca

SEQ ID NO: 2927685 - RNA, 13 nt, Mycobacterium avium subsp. paratuberculosis
ccgacggccgcac

SEQ ID NO: 2927686 - RNA, 17 nt, Mycobacterium avium subsp. paratuberculosis
ccgacggccgcacccca

SEQ ID NO: 2927687 - RNA, 20 nt, Mycobacterium avium subsp. paratuberculosis
ccgacggccgcaccccaccc

SEQ ID NO: 2927688 - RNA, 12 nt, Mycobacterium avium subsp. paratuberculosis
ccgacggccgcg

SEQ ID NO: 2927689 - RNA, 12 nt, Mycobacterium avium subsp. paratuberculosis
ccgacggcgacc

SEQ ID NO: 2927690 - RNA, 15 nt, Mycobacterium avium subsp. paratuberculosis
ccgacggcgccgcgg

SEQ ID NO: 2927691 - RNA, 16 nt, Mycobacterium avium subsp. paratuberculosis
ccgacggcgccgcggc

SEQ ID NO: 2927692 - RNA, 13 nt, Mycobacterium avium subsp. paratuberculosis
ccgacggcgccgg

SEQ ID NO: 2927693 - RNA, 14 nt, Mycobacterium avium subsp. paratuberculosis
ccgacggcgccggu

SEQ ID NO: 2927694 - RNA, 19 nt, Mycobacterium avium subsp. paratuberculosis
ccgacggcgccggugccca

SEQ ID NO: 2927695 - RNA, 12 nt, Mycobacterium avium subsp. paratuberculosis
ccgacggcgcgc

SEQ ID NO: 2927696 - RNA, 14 nt, Mycobacterium avium subsp. paratuberculosis
ccgacggcgcgccc

SEQ ID NO: 2927697 - RNA, 14 nt, Mycobacterium avium subsp. paratuberculosis
ccgacggcugcccg

SEQ ID NO: 2927698 - RNA, 23 nt, Mycobacterium avium subsp. paratuberculosis
ccgacggcugcccggcccgccgc

SEQ ID NO: 2927699 - RNA, 14 nt, Mycobacterium avium subsp. paratuberculosis
ccgacggcugcggu

SEQ ID NO: 2927700 - RNA, 16 nt, Mycobacterium avium subsp. paratuberculosis
ccgacggcugcgguug

SEQ ID NO: 2927701 - RNA, 21 nt, Mycobacterium avium subsp. paratuberculosis
ccgacggcugcgguuggccgg

SEQ ID NO: 2927702 - RNA, 22 nt, Mycobacterium avium subsp. paratuberculosis
ccgacggcugcgguuggccggc

SEQ ID NO: 2927703 - RNA, 22 nt, Mycobacterium avium subsp. paratuberculosis
ccgacggcuggguggcgaaacc

SEQ ID NO: 2927704 - RNA, 16 nt, Mycobacterium avium subsp. paratuberculosis
ccgacgggcccagcgc

SEQ ID NO: 2927705 - RNA, 17 nt, Mycobacterium avium subsp. paratuberculosis
ccgacgggcccagcgcg

SEQ ID NO: 2927706 - RNA, 15 nt, Mycobacterium avium subsp. paratuberculosis
ccgacgggcccgcgc

SEQ ID NO: 2927707 - RNA, 19 nt, Mycobacterium avium subsp. paratuberculosis
ccgacgggcgugccggcgg

SEQ ID NO: 2927708 - RNA, 20 nt, Mycobacterium avium subsp. paratuberculosis
ccgacgggcgugccggcggc

SEQ ID NO: 2927709 - RNA, 13 nt, Mycobacterium avium subsp. paratuberculosis
ccgacgggcgugu

SEQ ID NO: 2927710 - RNA, 16 nt, Mycobacterium avium subsp. paratuberculosis
ccgacgggcguguagc

SEQ ID NO: 2927711 - RNA, 23 nt, Mycobacterium avium subsp. paratuberculosis
ccgacgggcguguagccugcggc

SEQ ID NO: 2927712 - RNA, 17 nt, Mycobacterium avium subsp. paratuberculosis
ccgacggucgccaccac

SEQ ID NO: 2927713 - RNA, 19 nt, Mycobacterium avium subsp. paratuberculosis
ccgacggucgccaccacca

SEQ ID NO: 2927714 - RNA, 21 nt, Mycobacterium avium subsp. paratuberculosis
ccgacggucgccaccaccacg

SEQ ID NO: 2927715 - RNA, 22 nt, Mycobacterium avium subsp. paratuberculosis
ccgacggucgccaccaccacgg

SEQ ID NO: 2927716 - RNA, 17 nt, Mycobacterium avium subsp. paratuberculosis
ccgacggucgggcccag

SEQ ID NO: 2927717 - RNA, 18 nt, Mycobacterium avium subsp. paratuberculosis
ccgacggugagcaccgcc

SEQ ID NO: 2927718 - RNA, 13 nt, Mycobacterium avium subsp. paratuberculosis
ccgacggugcgug

SEQ ID NO: 2927719 - RNA, 16 nt, Mycobacterium avium subsp. paratuberculosis
ccgacggugcgugcca

SEQ ID NO: 2927720 - RNA, 21 nt, Mycobacterium avium subsp. paratuberculosis
ccgacggugcgugccagcagc

SEQ ID NO: 2927721 - RNA, 23 nt, Mycobacterium avium subsp. paratuberculosis
ccgacggugcgugccagcagcuc

SEQ ID NO: 2927722 - RNA, 20 nt, Mycobacterium avium subsp. paratuberculosis
ccgacgguggcccccaccac

SEQ ID NO: 2927723 - RNA, 15 nt, Mycobacterium avium subsp. paratuberculosis
ccgacgguguccgcg

SEQ ID NO: 2927724 - RNA, 19 nt, Mycobacterium avium subsp. paratuberculosis
ccgacgguguccgcgggca

SEQ ID NO: 2927725 - RNA, 16 nt, Mycobacterium avium subsp. paratuberculosis
ccgacguaggacagca

SEQ ID NO: 2927726 - RNA, 14 nt, Mycobacterium avium subsp. paratuberculosis
ccgacgucagggug

SEQ ID NO: 2927727 - RNA, 20 nt, Mycobacterium avium subsp. paratuberculosis
ccgacgucaggguggccucg

SEQ ID NO: 2927728 - RNA, 14 nt, Mycobacterium avium subsp. paratuberculosis
ccgacgucccagca

SEQ ID NO: 2927729 - RNA, 22 nt, Mycobacterium avium subsp. paratuberculosis
ccgacguccuggaucgcgcagg

SEQ ID NO: 2927730 - RNA, 23 nt, Mycobacterium avium subsp. paratuberculosis
ccgacguccuggaucgcgcaggu

SEQ ID NO: 2927731 - RNA, 23 nt, Mycobacterium avium subsp. paratuberculosis
ccgacguccugguugaggaucug

SEQ ID NO: 2927732 - RNA, 14 nt, Mycobacterium avium subsp. paratuberculosis
ccgacgucgaccag

SEQ ID NO: 2927733 - RNA, 22 nt, Mycobacterium avium subsp. paratuberculosis
ccgacgucgaccagguaggcgc

SEQ ID NO: 2927734 - RNA, 19 nt, Mycobacterium avium subsp. paratuberculosis
ccgacgucgacgcgggcga

SEQ ID NO: 2927735 - RNA, 20 nt, Mycobacterium avium subsp. paratuberculosis
ccgacgucgacgcgggcgac

SEQ ID NO: 2927736 - RNA, 14 nt, Mycobacterium avium subsp. paratuberculosis
ccgacgucggaaac

SEQ ID NO: 2927737 - RNA, 12 nt, Mycobacterium avium subsp. paratuberculosis
ccgacgucgugg

SEQ ID NO: 2927738 - RNA, 14 nt, Mycobacterium avium subsp. paratuberculosis
ccgacgucgugggc

SEQ ID NO: 2927739 - RNA, 22 nt, Mycobacterium avium subsp. paratuberculosis
ccgacgucugguuggccggcgg

SEQ ID NO: 2927740 - RNA, 23 nt, Mycobacterium avium subsp. paratuberculosis
ccgacgucugguuggccggcggg

SEQ ID NO: 2927741 - RNA, 22 nt, Mycobacterium avium subsp. paratuberculosis
ccgacgugcagcgccagcaccg

SEQ ID NO: 2927742 - RNA, 15 nt, Mycobacterium avium subsp. paratuberculosis
ccgacgugcccgauc

SEQ ID NO: 2927743 - RNA, 15 nt, Mycobacterium avium subsp. paratuberculosis
ccgacgugccggugg

SEQ ID NO: 2927744 - RNA, 12 nt, Mycobacterium avium subsp. paratuberculosis
ccgacgugccgu

SEQ ID NO: 2927745 - RNA, 19 nt, Mycobacterium avium subsp. paratuberculosis
ccgacgugcuuggccagcu

SEQ ID NO: 2927746 - RNA, 22 nt, Mycobacterium avium subsp. paratuberculosis
ccgacgugcuuggccagcucgg

SEQ ID NO: 2927747 - RNA, 23 nt, Mycobacterium avium subsp. paratuberculosis
ccgacgugcuuggccagcucggc

SEQ ID NO: 2927748 - RNA, 16 nt, Mycobacterium avium subsp. paratuberculosis
ccgacguggguggugg

SEQ ID NO: 2927749 - RNA, 22 nt, Mycobacterium avium subsp. paratuberculosis
ccgacgugucgucgucgccgcc

SEQ ID NO: 2927750 - RNA, 15 nt, Mycobacterium avium subsp. paratuberculosis
ccgacguugccgcug

SEQ ID NO: 2927751 - RNA, 16 nt, Mycobacterium avium subsp. paratuberculosis
ccgacuagcgcggcgg

SEQ ID NO: 2927752 - RNA, 21 nt, Mycobacterium avium subsp. paratuberculosis
ccgacuagcgcggcggccucg

SEQ ID NO: 2927753 - RNA, 22 nt, Mycobacterium avium subsp. paratuberculosis
ccgacuagcgcggcggccucgg

SEQ ID NO: 2927754 - RNA, 16 nt, Mycobacterium avium subsp. paratuberculosis
ccgacuccccgcccgg

SEQ ID NO: 2927755 - RNA, 17 nt, Mycobacterium avium subsp. paratuberculosis
ccgacuccccgcccggc

SEQ ID NO: 2927756 - RNA, 18 nt, Mycobacterium avium subsp. paratuberculosis
ccgacuccucacaccucg

SEQ ID NO: 2927757 - RNA, 19 nt, Mycobacterium avium subsp. paratuberculosis
ccgacuccucacaccucgc

SEQ ID NO: 2927758 - RNA, 16 nt, Mycobacterium avium subsp. paratuberculosis
ccgacuccuccggccc

SEQ ID NO: 2927759 - RNA, 18 nt, Mycobacterium avium subsp. paratuberculosis
ccgacucgaugcgcguga

SEQ ID NO: 2927760 - RNA, 20 nt, Mycobacterium avium subsp. paratuberculosis
ccgacucgauguagccgggc

SEQ ID NO: 2927761 - RNA, 22 nt, Mycobacterium avium subsp. paratuberculosis
ccgacugauccaccaucuucca

SEQ ID NO: 2927762 - RNA, 15 nt, Mycobacterium avium subsp. paratuberculosis
ccgacugccccgcuc

SEQ ID NO: 2927763 - RNA, 23 nt, Mycobacterium avium subsp. paratuberculosis
ccgagcacgcagccgcgcccgau

SEQ ID NO: 2927764 - RNA, 13 nt, Mycobacterium avium subsp. paratuberculosis
ccgagcacgcggc

SEQ ID NO: 2927765 - RNA, 17 nt, Mycobacterium avium subsp. paratuberculosis
ccgagcacgcggccgcg

SEQ ID NO: 2927766 - RNA, 19 nt, Mycobacterium avium subsp. paratuberculosis
ccgagcacgcggccgcgcc

SEQ ID NO: 2927767 - RNA, 20 nt, Mycobacterium avium subsp. paratuberculosis
ccgagcacgcggccgcgccg

SEQ ID NO: 2927768 - RNA, 16 nt, Mycobacterium avium subsp. paratuberculosis
ccgagcacgucgagca

SEQ ID NO: 2927769 - RNA, 20 nt, Mycobacterium avium subsp. paratuberculosis
ccgagcacgucgagcaccgc

SEQ ID NO: 2927770 - RNA, 21 nt, Mycobacterium avium subsp. paratuberculosis
ccgagcacgucgagcaccgcg

SEQ ID NO: 2927771 - RNA, 20 nt, Mycobacterium avium subsp. paratuberculosis
ccgagcagacgugaaauccc

SEQ ID NO: 2927772 - RNA, 14 nt, Mycobacterium avium subsp. paratuberculosis
ccgagcagcaccgc

SEQ ID NO: 2927773 - RNA, 15 nt, Mycobacterium avium subsp. paratuberculosis
ccgagcagcaccgcg

SEQ ID NO: 2927774 - RNA, 16 nt, Mycobacterium avium subsp. paratuberculosis
ccgagcagcaccgcga

SEQ ID NO: 2927775 - RNA, 15 nt, Mycobacterium avium subsp. paratuberculosis
ccgagcagcaccggc

SEQ ID NO: 2927776 - RNA, 16 nt, Mycobacterium avium subsp. paratuberculosis
ccgagcagcagccgca

SEQ ID NO: 2927777 - RNA, 11 nt, Mycobacterium avium subsp. paratuberculosis
ccgagcagccg

SEQ ID NO: 2927778 - RNA, 14 nt, Mycobacterium avium subsp. paratuberculosis
ccgagcagccgggc

SEQ ID NO: 2927779 - RNA, 16 nt, Mycobacterium avium subsp. paratuberculosis
ccgagcagccgggcca

SEQ ID NO: 2927780 - RNA, 18 nt, Mycobacterium avium subsp. paratuberculosis
ccgagcagcggggugagc

SEQ ID NO: 2927781 - RNA, 13 nt, Mycobacterium avium subsp. paratuberculosis
ccgagcagcgggu

SEQ ID NO: 2927782 - RNA, 19 nt, Mycobacterium avium subsp. paratuberculosis
ccgagcagcgggucgucgg

SEQ ID NO: 2927783 - RNA, 21 nt, Mycobacterium avium subsp. paratuberculosis
ccgagcagcgggucgucgggc

SEQ ID NO: 2927784 - RNA, 12 nt, Mycobacterium avium subsp. paratuberculosis
ccgagcagcuca

SEQ ID NO: 2927785 - RNA, 20 nt, Mycobacterium avium subsp. paratuberculosis
ccgagcagcucagccgccug

SEQ ID NO: 2927786 - RNA, 21 nt, Mycobacterium avium subsp. paratuberculosis
ccgagcaggcggaucggcccg

SEQ ID NO: 2927787 - RNA, 16 nt, Mycobacterium avium subsp. paratuberculosis
ccgagcaucagcugcc

SEQ ID NO: 2927788 - RNA, 21 nt, Mycobacterium avium subsp. paratuberculosis
ccgagcaucagcugccguccg

SEQ ID NO: 2927789 - RNA, 14 nt, Mycobacterium avium subsp. paratuberculosis
ccgagcaucgccga

SEQ ID NO: 2927790 - RNA, 18 nt, Mycobacterium avium subsp. paratuberculosis
ccgagcaucgccgagcgc

SEQ ID NO: 2927791 - RNA, 19 nt, Mycobacterium avium subsp. paratuberculosis
ccgagcaucgccgagcgca

SEQ ID NO: 2927792 - RNA, 22 nt, Mycobacterium avium subsp. paratuberculosis
ccgagcaucggguugccggcgg

SEQ ID NO: 2927793 - RNA, 19 nt, Mycobacterium avium subsp. paratuberculosis
ccgagcauuucgcgcacgu

SEQ ID NO: 2927794 - RNA, 22 nt, Mycobacterium avium subsp. paratuberculosis
ccgagcauuucgcgcacgucga

SEQ ID NO: 2927795 - RNA, 16 nt, Mycobacterium avium subsp. paratuberculosis
ccgagcccgccggcgg

SEQ ID NO: 2927796 - RNA, 18 nt, Mycobacterium avium subsp. paratuberculosis
ccgagcccgccggcggcg

SEQ ID NO: 2927797 - RNA, 20 nt, Mycobacterium avium subsp. paratuberculosis
ccgagcccgccggcggcgau

SEQ ID NO: 2927798 - RNA, 20 nt, Mycobacterium avium subsp. paratuberculosis
ccgagcccguucagugacca

SEQ ID NO: 2927799 - RNA, 14 nt, Mycobacterium avium subsp. paratuberculosis
ccgagcccugcgcc

SEQ ID NO: 2927800 - RNA, 20 nt, Mycobacterium avium subsp. paratuberculosis
ccgagcccugcgccagcagc

SEQ ID NO: 2927801 - RNA, 21 nt, Mycobacterium avium subsp. paratuberculosis
ccgagcccugcgccagcagca

SEQ ID NO: 2927802 - RNA, 18 nt, Mycobacterium avium subsp. paratuberculosis
ccgagcccuuugcgcugc

SEQ ID NO: 2927803 - RNA, 20 nt, Mycobacterium avium subsp. paratuberculosis
ccgagcccuuugcgcugccc

SEQ ID NO: 2927804 - RNA, 21 nt, Mycobacterium avium subsp. paratuberculosis
ccgagcccuuugcgcugcccg

SEQ ID NO: 2927805 - RNA, 23 nt, Mycobacterium avium subsp. paratuberculosis
ccgagcccuuugcgcugcccgau

SEQ ID NO: 2927806 - RNA, 16 nt, Mycobacterium avium subsp. paratuberculosis
ccgagccgacccgggc

SEQ ID NO: 2927807 - RNA, 15 nt, Mycobacterium avium subsp. paratuberculosis
ccgagccgacgauga

SEQ ID NO: 2927808 - RNA, 17 nt, Mycobacterium avium subsp. paratuberculosis
ccgagccgaggccgaug

SEQ ID NO: 2927809 - RNA, 20 nt, Mycobacterium avium subsp. paratuberculosis
ccgagccgaugcccagcagc

SEQ ID NO: 2927810 - RNA, 21 nt, Mycobacterium avium subsp. paratuberculosis
ccgagccgaugcccagcagcg

SEQ ID NO: 2927811 - RNA, 11 nt, Mycobacterium avium subsp. paratuberculosis
ccgagccgccc

SEQ ID NO: 2927812 - RNA, 12 nt, Mycobacterium avium subsp. paratuberculosis
ccgagccgccgg

SEQ ID NO: 2927813 - RNA, 14 nt, Mycobacterium avium subsp. paratuberculosis
ccgagccgccggau

SEQ ID NO: 2927814 - RNA, 13 nt, Mycobacterium avium subsp. paratuberculosis
ccgagccgcgcca

SEQ ID NO: 2927815 - RNA, 14 nt, Mycobacterium avium subsp. paratuberculosis
ccgagccgcgcgcc

SEQ ID NO: 2927816 - RNA, 16 nt, Mycobacterium avium subsp. paratuberculosis
ccgagccgcgcgccga

SEQ ID NO: 2927817 - RNA, 13 nt, Mycobacterium avium subsp. paratuberculosis
ccgagccgcgggu

SEQ ID NO: 2927818 - RNA, 18 nt, Mycobacterium avium subsp. paratuberculosis
ccgagccgcuccaccgcg

SEQ ID NO: 2927819 - RNA, 23 nt, Mycobacterium avium subsp. paratuberculosis
ccgagccgcuccaccgcguccug

SEQ ID NO: 2927820 - RNA, 21 nt, Mycobacterium avium subsp. paratuberculosis
ccgagccgcuugguggcgccg

SEQ ID NO: 2927821 - RNA, 22 nt, Mycobacterium avium subsp. paratuberculosis
ccgagccgcuugguggcgccgg

SEQ ID NO: 2927822 - RNA, 14 nt, Mycobacterium avium subsp. paratuberculosis
ccgagccggcacgg

SEQ ID NO: 2927823 - RNA, 19 nt, Mycobacterium avium subsp. paratuberculosis
ccgagccggcacggccggc

SEQ ID NO: 2927824 - RNA, 15 nt, Mycobacterium avium subsp. paratuberculosis
ccgagccggcgucgc

SEQ ID NO: 2927825 - RNA, 20 nt, Mycobacterium avium subsp. paratuberculosis
ccgagccggcgucgccgcug

SEQ ID NO: 2927826 - RNA, 15 nt, Mycobacterium avium subsp. paratuberculosis
ccgagccgggcagcg

SEQ ID NO: 2927827 - RNA, 18 nt, Mycobacterium avium subsp. paratuberculosis
ccgagccgggcagcgcga

SEQ ID NO: 2927828 - RNA, 19 nt, Mycobacterium avium subsp. paratuberculosis
ccgagccgggccagguccc

SEQ ID NO: 2927829 - RNA, 14 nt, Mycobacterium avium subsp. paratuberculosis
ccgagccgggcggc

SEQ ID NO: 2927830 - RNA, 16 nt, Mycobacterium avium subsp. paratuberculosis
ccgagccgggcggcca

SEQ ID NO: 2927831 - RNA, 22 nt, Mycobacterium avium subsp. paratuberculosis
ccgagccgggcggccagcgugg

SEQ ID NO: 2927832 - RNA, 21 nt, Mycobacterium avium subsp. paratuberculosis
ccgagccgguccgaccagcgg

SEQ ID NO: 2927833 - RNA, 16 nt, Mycobacterium avium subsp. paratuberculosis
ccgagccggugccgcc

SEQ ID NO: 2927834 - RNA, 14 nt, Mycobacterium avium subsp. paratuberculosis
ccgagcgcaccgcg

SEQ ID NO: 2927835 - RNA, 15 nt, Mycobacterium avium subsp. paratuberculosis
ccgagcgcaccgcgg

SEQ ID NO: 2927836 - RNA, 21 nt, Mycobacterium avium subsp. paratuberculosis
ccgagcgcaccgcggagcgca

SEQ ID NO: 2927837 - RNA, 20 nt, Mycobacterium avium subsp. paratuberculosis
ccgagcgccgcguucacccg

SEQ ID NO: 2927838 - RNA, 21 nt, Mycobacterium avium subsp. paratuberculosis
ccgagcgccgcguucacccgc

SEQ ID NO: 2927839 - RNA, 12 nt, Mycobacterium avium subsp. paratuberculosis
ccgagcgcgccg

SEQ ID NO: 2927840 - RNA, 19 nt, Mycobacterium avium subsp. paratuberculosis
ccgagcgcgccgagcagcu

SEQ ID NO: 2927841 - RNA, 21 nt, Mycobacterium avium subsp. paratuberculosis
ccgagcgcgccgagcagcugg

SEQ ID NO: 2927842 - RNA, 13 nt, Mycobacterium avium subsp. paratuberculosis
ccgagcgcgccgc

SEQ ID NO: 2927843 - RNA, 17 nt, Mycobacterium avium subsp. paratuberculosis
ccgagcgcgccgccgcc

SEQ ID NO: 2927844 - RNA, 12 nt, Mycobacterium avium subsp. paratuberculosis
ccgagcgcgcga

SEQ ID NO: 2927845 - RNA, 13 nt, Mycobacterium avium subsp. paratuberculosis
ccgagcgcgcugg

SEQ ID NO: 2927846 - RNA, 14 nt, Mycobacterium avium subsp. paratuberculosis
ccgagcggaugccg

SEQ ID NO: 2927847 - RNA, 18 nt, Mycobacterium avium subsp. paratuberculosis
ccgagcggcaucaguucg

SEQ ID NO: 2927848 - RNA, 15 nt, Mycobacterium avium subsp. paratuberculosis
ccgagggccagcagc

SEQ ID NO: 2927849 - RNA, 16 nt, Mycobacterium avium subsp. paratuberculosis
ccgagggcccgggcag

SEQ ID NO: 2927850 - RNA, 19 nt, Mycobacterium avium subsp. paratuberculosis
ccgagggcccgggcaggca

SEQ ID NO: 2927851 - RNA, 15 nt, Mycobacterium avium subsp. paratuberculosis
ccgagggcggcggcu

SEQ ID NO: 2927852 - RNA, 22 nt, Mycobacterium avium subsp. paratuberculosis
ccgagggcuucccacgccuugc

SEQ ID NO: 2927853 - RNA, 18 nt, Mycobacterium avium subsp. paratuberculosis
ccgagggggaagucgacc

SEQ ID NO: 2927854 - RNA, 21 nt, Mycobacterium avium subsp. paratuberculosis
ccgagggggaagucgaccggg

SEQ ID NO: 2927855 - RNA, 16 nt, Mycobacterium avium subsp. paratuberculosis
ccgagggugccggcca

SEQ ID NO: 2927856 - RNA, 20 nt, Mycobacterium avium subsp. paratuberculosis
ccgaggguucgguggccccg

SEQ ID NO: 2927857 - RNA, 22 nt, Mycobacterium avium subsp. paratuberculosis
ccgaggguuggcgugucgguga

SEQ ID NO: 2927858 - RNA, 17 nt, Mycobacterium avium subsp. paratuberculosis
ccgagguagccgcgcac

SEQ ID NO: 2927859 - RNA, 16 nt, Mycobacterium avium subsp. paratuberculosis
ccgagguagggccggg

SEQ ID NO: 2927860 - RNA, 14 nt, Mycobacterium avium subsp. paratuberculosis
ccgagguagucggc

SEQ ID NO: 2927861 - RNA, 15 nt, Mycobacterium avium subsp. paratuberculosis
ccgagguagucggcc

SEQ ID NO: 2927862 - RNA, 17 nt, Mycobacterium avium subsp. paratuberculosis
ccgaggucaccaccgag

SEQ ID NO: 2927863 - RNA, 15 nt, Mycobacterium avium subsp. paratuberculosis
ccgaggucaccgcgg

SEQ ID NO: 2927864 - RNA, 12 nt, Mycobacterium avium subsp. paratuberculosis
ccgaggucagcg

SEQ ID NO: 2927865 - RNA, 18 nt, Mycobacterium avium subsp. paratuberculosis
ccgaggucauaucgacgg

SEQ ID NO: 2927866 - RNA, 18 nt, Mycobacterium avium subsp. paratuberculosis
ccgagguccucgaccucu

SEQ ID NO: 2927867 - RNA, 18 nt, Mycobacterium avium subsp. paratuberculosis
ccgagguccucgcgcaac

SEQ ID NO: 2927868 - RNA, 13 nt, Mycobacterium avium subsp. paratuberculosis
ccgaggucgacgc

SEQ ID NO: 2927869 - RNA, 15 nt, Mycobacterium avium subsp. paratuberculosis
ccgaggucgacgccc

SEQ ID NO: 2927870 - RNA, 17 nt, Mycobacterium avium subsp. paratuberculosis
ccgaggucgacgccccg

SEQ ID NO: 2927871 - RNA, 13 nt, Mycobacterium avium subsp. paratuberculosis
ccgaggucgccga

SEQ ID NO: 2927872 - RNA, 15 nt, Mycobacterium avium subsp. paratuberculosis
ccgaggucgccgacg

SEQ ID NO: 2927873 - RNA, 18 nt, Mycobacterium avium subsp. paratuberculosis
ccgaggucgccgacgccg

SEQ ID NO: 2927874 - RNA, 17 nt, Mycobacterium avium subsp. paratuberculosis
ccgaggucggucgcggc

SEQ ID NO: 2927875 - RNA, 21 nt, Mycobacterium avium subsp. paratuberculosis
ccgaggucuuucaucgccccg

SEQ ID NO: 2927876 - RNA, 23 nt, Mycobacterium avium subsp. paratuberculosis
ccgaggugaauaccacugcgcgc

SEQ ID NO: 2927877 - RNA, 15 nt, Mycobacterium avium subsp. paratuberculosis
ccgaggugacgaggc

SEQ ID NO: 2927878 - RNA, 17 nt, Mycobacterium avium subsp. paratuberculosis
ccgaggugacgaggccc

SEQ ID NO: 2927879 - RNA, 17 nt, Mycobacterium avium subsp. paratuberculosis
ccgaggugacgucgcgc

SEQ ID NO: 2927880 - RNA, 18 nt, Mycobacterium avium subsp. paratuberculosis
ccgaggugacgucgcgcc

SEQ ID NO: 2927881 - RNA, 20 nt, Mycobacterium avium subsp. paratuberculosis
ccgaggugacgucgcgccgc

SEQ ID NO: 2927882 - RNA, 22 nt, Mycobacterium avium subsp. paratuberculosis
ccgaggugacgucgcgccgcuc

SEQ ID NO: 2927883 - RNA, 13 nt, Mycobacterium avium subsp. paratuberculosis
ccgaggugaucgc

SEQ ID NO: 2927884 - RNA, 17 nt, Mycobacterium avium subsp. paratuberculosis
ccgaggugcaacacucg

SEQ ID NO: 2927885 - RNA, 14 nt, Mycobacterium avium subsp. paratuberculosis
ccgaggugccgcgg

SEQ ID NO: 2927886 - RNA, 18 nt, Mycobacterium avium subsp. paratuberculosis
ccgaggugcugucgucgc

SEQ ID NO: 2927887 - RNA, 17 nt, Mycobacterium avium subsp. paratuberculosis
ccgagguggcccagccg

SEQ ID NO: 2927888 - RNA, 18 nt, Mycobacterium avium subsp. paratuberculosis
ccgagguggcccgccacg

SEQ ID NO: 2927889 - RNA, 14 nt, Mycobacterium avium subsp. paratuberculosis
ccgagguggccgcc

SEQ ID NO: 2927890 - RNA, 16 nt, Mycobacterium avium subsp. paratuberculosis
ccgagguggccgccag

SEQ ID NO: 2927891 - RNA, 18 nt, Mycobacterium avium subsp. paratuberculosis
ccgaguaacucggccuuc

SEQ ID NO: 2927892 - RNA, 18 nt, Mycobacterium avium subsp. paratuberculosis
ccgaguagaacuucgcca

SEQ ID NO: 2927893 - RNA, 21 nt, Mycobacterium avium subsp. paratuberculosis
ccgaguaggaagccaugccgg

SEQ ID NO: 2927894 - RNA, 22 nt, Mycobacterium avium subsp. paratuberculosis
ccgaguaggaagccaugccggg

SEQ ID NO: 2927895 - RNA, 18 nt, Mycobacterium avium subsp. paratuberculosis
ccgaguauccgcgcagcg

SEQ ID NO: 2927896 - RNA, 17 nt, Mycobacterium avium subsp. paratuberculosis
ccgagucacccggcugg

SEQ ID NO: 2927897 - RNA, 21 nt, Mycobacterium avium subsp. paratuberculosis
ccgagucacccggcuggccgc

SEQ ID NO: 2927898 - RNA, 17 nt, Mycobacterium avium subsp. paratuberculosis
ccgaguccacgacgucc

SEQ ID NO: 2927899 - RNA, 22 nt, Mycobacterium avium subsp. paratuberculosis
ccgaguccacgacguccucgac

SEQ ID NO: 2927900 - RNA, 17 nt, Mycobacterium avium subsp. paratuberculosis
ccgaguccgggccgccg

SEQ ID NO: 2927901 - RNA, 12 nt, Mycobacterium avium subsp. paratuberculosis
ccgagucgacgu

SEQ ID NO: 2927902 - RNA, 18 nt, Mycobacterium avium subsp. paratuberculosis
ccgagucgacgugcucgg

SEQ ID NO: 2927903 - RNA, 19 nt, Mycobacterium avium subsp. paratuberculosis
ccgagucgacgugcucggc

SEQ ID NO: 2927904 - RNA, 16 nt, Mycobacterium avium subsp. paratuberculosis
ccgagucgaucgccag

SEQ ID NO: 2927905 - RNA, 22 nt, Mycobacterium avium subsp. paratuberculosis
ccgagucgaucgccagcgcgca

SEQ ID NO: 2927906 - RNA, 16 nt, Mycobacterium avium subsp. paratuberculosis
ccgagucgcgccgcgu

SEQ ID NO: 2927907 - RNA, 22 nt, Mycobacterium avium subsp. paratuberculosis
ccgagucgcgcgaccaguaccg

SEQ ID NO: 2927908 - RNA, 12 nt, Mycobacterium avium subsp. paratuberculosis
ccgagucgcugc

SEQ ID NO: 2927909 - RNA, 14 nt, Mycobacterium avium subsp. paratuberculosis
ccgagucggcgucg

SEQ ID NO: 2927910 - RNA, 21 nt, Mycobacterium avium subsp. paratuberculosis
ccgagucggugaccaccugca

SEQ ID NO: 2927911 - RNA, 21 nt, Mycobacterium avium subsp. paratuberculosis
ccgagucgucgcgcaccagcu

SEQ ID NO: 2927912 - RNA, 15 nt, Mycobacterium avium subsp. paratuberculosis
ccgagugcggcgcgg

SEQ ID NO: 2927913 - RNA, 13 nt, Mycobacterium avium subsp. paratuberculosis
ccgaguggcgccg

SEQ ID NO: 2927914 - RNA, 14 nt, Mycobacterium avium subsp. paratuberculosis
ccgaguggcgccgu

SEQ ID NO: 2927915 - RNA, 16 nt, Mycobacterium avium subsp. paratuberculosis
ccgaguggcgccgucg

SEQ ID NO: 2927916 - RNA, 14 nt, Mycobacterium avium subsp. paratuberculosis
ccgagugggaccgu

SEQ ID NO: 2927917 - RNA, 15 nt, Mycobacterium avium subsp. paratuberculosis
ccgaguuccugcgac

SEQ ID NO: 2927918 - RNA, 20 nt, Mycobacterium avium subsp. paratuberculosis
ccgaguuccugcgaccgccg

SEQ ID NO: 2927919 - RNA, 13 nt, Mycobacterium avium subsp. paratuberculosis
ccgaguucggcca

SEQ ID NO: 2927920 - RNA, 14 nt, Mycobacterium avium subsp. paratuberculosis
ccgaguucggccag

SEQ ID NO: 2927921 - RNA, 21 nt, Mycobacterium avium subsp. paratuberculosis
ccgaguugauaggucacgccg

SEQ ID NO: 2927922 - RNA, 22 nt, Mycobacterium avium subsp. paratuberculosis
ccgaguugauaggucacgccgg

SEQ ID NO: 2927923 - RNA, 23 nt, Mycobacterium avium subsp. paratuberculosis
ccgaguugauaggucacgccggg

SEQ ID NO: 2927924 - RNA, 14 nt, Mycobacterium avium subsp. paratuberculosis
ccgaguuggccggc

SEQ ID NO: 2927925 - RNA, 16 nt, Mycobacterium avium subsp. paratuberculosis
ccgaguuuggcgucga

SEQ ID NO: 2927926 - RNA, 17 nt, Mycobacterium avium subsp. paratuberculosis
ccgauagcuugagcccc

SEQ ID NO: 2927927 - RNA, 22 nt, Mycobacterium avium subsp. paratuberculosis
ccgauagcuugagccccgccgg

SEQ ID NO: 2927928 - RNA, 16 nt, Mycobacterium avium subsp. paratuberculosis
ccgauaguagccagca

SEQ ID NO: 2927929 - RNA, 17 nt, Mycobacterium avium subsp. paratuberculosis
ccgauauaggugagaaa

SEQ ID NO: 2927930 - RNA, 23 nt, Mycobacterium avium subsp. paratuberculosis
ccgaucaacaccgccagcaccgc

SEQ ID NO: 2927931 - RNA, 20 nt, Mycobacterium avium subsp. paratuberculosis
ccgaucaacaggcccagcag

SEQ ID NO: 2927932 - RNA, 23 nt, Mycobacterium avium subsp. paratuberculosis
ccgaucaccaggcccaggccgac

SEQ ID NO: 2927933 - RNA, 20 nt, Mycobacterium avium subsp. paratuberculosis
ccgaucgggaccgucaccgu

SEQ ID NO: 2927934 - RNA, 14 nt, Mycobacterium avium subsp. paratuberculosis
ccgaucggggccag

SEQ ID NO: 2927935 - RNA, 19 nt, Mycobacterium avium subsp. paratuberculosis
ccgaucggggcgcagcccg

SEQ ID NO: 2927936 - RNA, 22 nt, Mycobacterium avium subsp. paratuberculosis
ccgaucggggcgcagcccggcg

SEQ ID NO: 2927937 - RNA, 17 nt, Mycobacterium avium subsp. paratuberculosis
ccgaucguccggcgcca

SEQ ID NO: 2927938 - RNA, 15 nt, Mycobacterium avium subsp. paratuberculosis
ccgaucgugacgccg

SEQ ID NO: 2927939 - RNA, 19 nt, Mycobacterium avium subsp. paratuberculosis
ccgaucgugacgccguccg

SEQ ID NO: 2927940 - RNA, 19 nt, Mycobacterium avium subsp. paratuberculosis
ccgaucgugcgcccauccg

SEQ ID NO: 2927941 - RNA, 23 nt, Mycobacterium avium subsp. paratuberculosis
ccgaucuccaccgagugcggcgc

SEQ ID NO: 2927942 - RNA, 17 nt, Mycobacterium avium subsp. paratuberculosis
ccgaucucgaccagcgc

SEQ ID NO: 2927943 - RNA, 19 nt, Mycobacterium avium subsp. paratuberculosis
ccgaucucgaccagcgccg

SEQ ID NO: 2927944 - RNA, 21 nt, Mycobacterium avium subsp. paratuberculosis
ccgaucucgcggucgaagggu

SEQ ID NO: 2927945 - RNA, 14 nt, Mycobacterium avium subsp. paratuberculosis
ccgaucucgucggu

SEQ ID NO: 2927946 - RNA, 18 nt, Mycobacterium avium subsp. paratuberculosis
ccgaucugaccgagcagc

SEQ ID NO: 2927947 - RNA, 18 nt, Mycobacterium avium subsp. paratuberculosis
ccgaucugauaggucagc

SEQ ID NO: 2927948 - RNA, 22 nt, Mycobacterium avium subsp. paratuberculosis
ccgaucugcucgaugcggcccu

SEQ ID NO: 2927949 - RNA, 20 nt, Mycobacterium avium subsp. paratuberculosis
ccgaucuggcgaucgaugcc

SEQ ID NO: 2927950 - RNA, 12 nt, Mycobacterium avium subsp. paratuberculosis
ccgaucuggcgc

SEQ ID NO: 2927951 - RNA, 21 nt, Mycobacterium avium subsp. paratuberculosis
ccgaucugucgcgcucagugc

SEQ ID NO: 2927952 - RNA, 21 nt, Mycobacterium avium subsp. paratuberculosis
ccgaugaacuugccgaucacc

SEQ ID NO: 2927953 - RNA, 19 nt, Mycobacterium avium subsp. paratuberculosis
ccgaugaagaacaccccga

SEQ ID NO: 2927954 - RNA, 20 nt, Mycobacterium avium subsp. paratuberculosis
ccgaugaagaacaccccgac

SEQ ID NO: 2927955 - RNA, 18 nt, Mycobacterium avium subsp. paratuberculosis
ccgaugaaguacccgguc

SEQ ID NO: 2927956 - RNA, 16 nt, Mycobacterium avium subsp. paratuberculosis
ccgaugaccaccgcug

SEQ ID NO: 2927957 - RNA, 15 nt, Mycobacterium avium subsp. paratuberculosis
ccgaugaccgcggcg

SEQ ID NO: 2927958 - RNA, 13 nt, Mycobacterium avium subsp. paratuberculosis
ccgaugaccggcc

SEQ ID NO: 2927959 - RNA, 22 nt, Mycobacterium avium subsp. paratuberculosis
ccgaugaccggcccggcggccg

SEQ ID NO: 2927960 - RNA, 11 nt, Mycobacterium avium subsp. paratuberculosis
ccgaugacgag

SEQ ID NO: 2927961 - RNA, 19 nt, Mycobacterium avium subsp. paratuberculosis
ccgaugacgagcagcgugc

SEQ ID NO: 2927962 - RNA, 23 nt, Mycobacterium avium subsp. paratuberculosis
ccgaugacgcugccgcgccgcca

SEQ ID NO: 2927963 - RNA, 17 nt, Mycobacterium avium subsp. paratuberculosis
ccgaugacguugcgcgc

SEQ ID NO: 2927964 - RNA, 18 nt, Mycobacterium avium subsp. paratuberculosis
ccgaugagccucagcgcg

SEQ ID NO: 2927965 - RNA, 16 nt, Mycobacterium avium subsp. paratuberculosis
ccgaugaugaugccgc

SEQ ID NO: 2927966 - RNA, 17 nt, Mycobacterium avium subsp. paratuberculosis
ccgaugaugguggcggc

SEQ ID NO: 2927967 - RNA, 13 nt, Mycobacterium avium subsp. paratuberculosis
ccgaugcagggcc

SEQ ID NO: 2927968 - RNA, 19 nt, Mycobacterium avium subsp. paratuberculosis
ccgaugcagggccgaaaaa

SEQ ID NO: 2927969 - RNA, 13 nt, Mycobacterium avium subsp. paratuberculosis
ccgaugcccagca

SEQ ID NO: 2927970 - RNA, 14 nt, Mycobacterium avium subsp. paratuberculosis
ccgaugcccagcag

SEQ ID NO: 2927971 - RNA, 15 nt, Mycobacterium avium subsp. paratuberculosis
ccgaugcccagcagc

SEQ ID NO: 2927972 - RNA, 21 nt, Mycobacterium avium subsp. paratuberculosis
ccgaugcccaucacgccccag

SEQ ID NO: 2927973 - RNA, 12 nt, Mycobacterium avium subsp. paratuberculosis
ccgaugcccgac

SEQ ID NO: 2927974 - RNA, 14 nt, Mycobacterium avium subsp. paratuberculosis
ccgaugcccgacac

SEQ ID NO: 2927975 - RNA, 21 nt, Mycobacterium avium subsp. paratuberculosis
ccgaugcccgacaccgccccg

SEQ ID NO: 2927976 - RNA, 18 nt, Mycobacterium avium subsp. paratuberculosis
ccgaugccgaacuccgcc

SEQ ID NO: 2927977 - RNA, 19 nt, Mycobacterium avium subsp. paratuberculosis
ccgaugccgaacuccgccg

SEQ ID NO: 2927978 - RNA, 19 nt, Mycobacterium avium subsp. paratuberculosis
ccgaugccgccgagggcca

SEQ ID NO: 2927979 - RNA, 15 nt, Mycobacterium avium subsp. paratuberculosis
ccgaugccgcgcagg

SEQ ID NO: 2927980 - RNA, 18 nt, Mycobacterium avium subsp. paratuberculosis
ccgaugccgcgcugcgcc

SEQ ID NO: 2927981 - RNA, 20 nt, Mycobacterium avium subsp. paratuberculosis
ccgaugccgcgcugcgccgg

SEQ ID NO: 2927982 - RNA, 15 nt, Mycobacterium avium subsp. paratuberculosis
ccgaugccggccugg

SEQ ID NO: 2927983 - RNA, 18 nt, Mycobacterium avium subsp. paratuberculosis
ccgaugccggccuggccc

SEQ ID NO: 2927984 - RNA, 12 nt, Mycobacterium avium subsp. paratuberculosis
ccgaugcgcccg

SEQ ID NO: 2927985 - RNA, 15 nt, Mycobacterium avium subsp. paratuberculosis
ccgaugcgcccgcgc

SEQ ID NO: 2927986 - RNA, 15 nt, Mycobacterium avium subsp. paratuberculosis
ccgaugcgcccgcug

SEQ ID NO: 2927987 - RNA, 21 nt, Mycobacterium avium subsp. paratuberculosis
ccgaugcgcccgcugcggcgc

SEQ ID NO: 2927988 - RNA, 12 nt, Mycobacterium avium subsp. paratuberculosis
ccgaugcgccgc

SEQ ID NO: 2927989 - RNA, 14 nt, Mycobacterium avium subsp. paratuberculosis
ccgaugcgccgcac

SEQ ID NO: 2927990 - RNA, 19 nt, Mycobacterium avium subsp. paratuberculosis
ccgaugcgccgcaccaguu

SEQ ID NO: 2927991 - RNA, 13 nt, Mycobacterium avium subsp. paratuberculosis
ccgaugcgcucgc

SEQ ID NO: 2927992 - RNA, 13 nt, Mycobacterium avium subsp. paratuberculosis
ccgaugcggaccg

SEQ ID NO: 2927993 - RNA, 18 nt, Mycobacterium avium subsp. paratuberculosis
ccgaugcggaccggggac

SEQ ID NO: 2927994 - RNA, 17 nt, Mycobacterium avium subsp. paratuberculosis
ccgaugcggugccgggc

SEQ ID NO: 2927995 - RNA, 19 nt, Mycobacterium avium subsp. paratuberculosis
ccgaugcggugccgggcca

SEQ ID NO: 2927996 - RNA, 20 nt, Mycobacterium avium subsp. paratuberculosis
ccgaugcggugccgggccag

SEQ ID NO: 2927997 - RNA, 18 nt, Mycobacterium avium subsp. paratuberculosis
ccgaugcuggccaucgcc

SEQ ID NO: 2927998 - RNA, 19 nt, Mycobacterium avium subsp. paratuberculosis
ccgaugcuggccaucgccg

SEQ ID NO: 2927999 - RNA, 13 nt, Mycobacterium avium subsp. paratuberculosis
ccgauggaggugc

SEQ ID NO: 2928000 - RNA, 17 nt, Mycobacterium avium subsp. paratuberculosis
ccgauggaggugccgcg

SEQ ID NO: 2928001 - RNA, 17 nt, Mycobacterium avium subsp. paratuberculosis
ccgauggccaccgggcg

SEQ ID NO: 2928002 - RNA, 20 nt, Mycobacterium avium subsp. paratuberculosis
ccgauggcccaggccgcggu

SEQ ID NO: 2928003 - RNA, 15 nt, Mycobacterium avium subsp. paratuberculosis
ccgauggccgcccgc

SEQ ID NO: 2928004 - RNA, 13 nt, Mycobacterium avium subsp. paratuberculosis
ccgauggcgccca

SEQ ID NO: 2928005 - RNA, 16 nt, Mycobacterium avium subsp. paratuberculosis
ccgauggcgcccagcg

SEQ ID NO: 2928006 - RNA, 22 nt, Mycobacterium avium subsp. paratuberculosis
ccgauggcggcggcccgccgcg

SEQ ID NO: 2928007 - RNA, 14 nt, Mycobacterium avium subsp. paratuberculosis
ccgauggcggucca

SEQ ID NO: 2928008 - RNA, 21 nt, Mycobacterium avium subsp. paratuberculosis
ccgauggcgguccaccaccac

SEQ ID NO: 2928009 - RNA, 21 nt, Mycobacterium avium subsp. paratuberculosis
ccgauggcguucaucguccac

SEQ ID NO: 2928010 - RNA, 21 nt, Mycobacterium avium subsp. paratuberculosis
ccgauggcucgcgggggccgc

SEQ ID NO: 2928011 - RNA, 18 nt, Mycobacterium avium subsp. paratuberculosis
ccgauggguuggccgucg

SEQ ID NO: 2928012 - RNA, 19 nt, Mycobacterium avium subsp. paratuberculosis
ccgaugguauccgaucgcg

SEQ ID NO: 2928013 - RNA, 14 nt, Mycobacterium avium subsp. paratuberculosis
ccgauggucagcug

SEQ ID NO: 2928014 - RNA, 15 nt, Mycobacterium avium subsp. paratuberculosis
ccgauggucagcugc

SEQ ID NO: 2928015 - RNA, 17 nt, Mycobacterium avium subsp. paratuberculosis
ccgauggugaagccgug

SEQ ID NO: 2928016 - RNA, 19 nt, Mycobacterium avium subsp. paratuberculosis
ccgauggugaagccgugca

SEQ ID NO: 2928017 - RNA, 14 nt, Mycobacterium avium subsp. paratuberculosis
ccgauggugaccuc

SEQ ID NO: 2928018 - RNA, 12 nt, Mycobacterium avium subsp. paratuberculosis
ccgcacaugccg

SEQ ID NO: 2928019 - RNA, 18 nt, Mycobacterium avium subsp. paratuberculosis
ccgcaccaccacguugca

SEQ ID NO: 2928020 - RNA, 23 nt, Mycobacterium avium subsp. paratuberculosis
ccgcaccaccacguugcacggca

SEQ ID NO: 2928021 - RNA, 16 nt, Mycobacterium avium subsp. paratuberculosis
ccgcaccacccagccc

SEQ ID NO: 2928022 - RNA, 18 nt, Mycobacterium avium subsp. paratuberculosis
ccgcaccaccgcccggac

SEQ ID NO: 2928023 - RNA, 15 nt, Mycobacterium avium subsp. paratuberculosis
ccgcaccagcacccc

SEQ ID NO: 2928024 - RNA, 18 nt, Mycobacterium avium subsp. paratuberculosis
ccgcaccagcaccccgcc

SEQ ID NO: 2928025 - RNA, 22 nt, Mycobacterium avium subsp. paratuberculosis
ccgcaccagcaccccgccgcag

SEQ ID NO: 2928026 - RNA, 12 nt, Mycobacterium avium subsp. paratuberculosis
ccgcacccagcg

SEQ ID NO: 2928027 - RNA, 13 nt, Mycobacterium avium subsp. paratuberculosis
ccgcacccagcgg

SEQ ID NO: 2928028 - RNA, 15 nt, Mycobacterium avium subsp. paratuberculosis
ccgcacccagcgggc

SEQ ID NO: 2928029 - RNA, 12 nt, Mycobacterium avium subsp. paratuberculosis
ccgcaccccacc

SEQ ID NO: 2928030 - RNA, 18 nt, Mycobacterium avium subsp. paratuberculosis
ccgcaccccacccgcgcg

SEQ ID NO: 2928031 - RNA, 20 nt, Mycobacterium avium subsp. paratuberculosis
ccgcaccccacccgcgcgac

SEQ ID NO: 2928032 - RNA, 15 nt, Mycobacterium avium subsp. paratuberculosis
ccgcacccccagcuc

SEQ ID NO: 2928033 - RNA, 17 nt, Mycobacterium avium subsp. paratuberculosis
ccgcacccccagcucga

SEQ ID NO: 2928034 - RNA, 20 nt, Mycobacterium avium subsp. paratuberculosis
ccgcacccccuccacacggc

SEQ ID NO: 2928035 - RNA, 17 nt, Mycobacterium avium subsp. paratuberculosis
ccgcaccccgucgcgga

SEQ ID NO: 2928036 - RNA, 18 nt, Mycobacterium avium subsp. paratuberculosis
ccgcacccgauccacggc

SEQ ID NO: 2928037 - RNA, 21 nt, Mycobacterium avium subsp. paratuberculosis
ccgcacccgauccacggcgac

SEQ ID NO: 2928038 - RNA, 15 nt, Mycobacterium avium subsp. paratuberculosis
ccgcacccgccgccc

SEQ ID NO: 2928039 - RNA, 20 nt, Mycobacterium avium subsp. paratuberculosis
ccgcacccgggcccggucgu

SEQ ID NO: 2928040 - RNA, 22 nt, Mycobacterium avium subsp. paratuberculosis
ccgcacccgggcccggucgucg

SEQ ID NO: 2928041 - RNA, 23 nt, Mycobacterium avium subsp. paratuberculosis
ccgcacccgggcccggucgucgc

SEQ ID NO: 2928042 - RNA, 15 nt, Mycobacterium avium subsp. paratuberculosis
ccgcacccguucggc

SEQ ID NO: 2928043 - RNA, 14 nt, Mycobacterium avium subsp. paratuberculosis
ccgcaccgaccagc

SEQ ID NO: 2928044 - RNA, 15 nt, Mycobacterium avium subsp. paratuberculosis
ccgcaccgaccagcg

SEQ ID NO: 2928045 - RNA, 23 nt, Mycobacterium avium subsp. paratuberculosis
ccgcaccgacgaaaucgucgggc

SEQ ID NO: 2928046 - RNA, 12 nt, Mycobacterium avium subsp. paratuberculosis
ccgcaccgagcc

SEQ ID NO: 2928047 - RNA, 22 nt, Mycobacterium avium subsp. paratuberculosis
ccgcaccgauggguuggccguc

SEQ ID NO: 2928048 - RNA, 13 nt, Mycobacterium avium subsp. paratuberculosis
ccgcaccgccagg

SEQ ID NO: 2928049 - RNA, 17 nt, Mycobacterium avium subsp. paratuberculosis
ccgcaccgccaggcugg

SEQ ID NO: 2928050 - RNA, 12 nt, Mycobacterium avium subsp. paratuberculosis
ccgcaccgccuc

SEQ ID NO: 2928051 - RNA, 14 nt, Mycobacterium avium subsp. paratuberculosis
ccgcaccggaaagc

SEQ ID NO: 2928052 - RNA, 14 nt, Mycobacterium avium subsp. paratuberculosis
ccgcaccggacgca

SEQ ID NO: 2928053 - RNA, 15 nt, Mycobacterium avium subsp. paratuberculosis
ccgcaccggccggcc

SEQ ID NO: 2928054 - RNA, 17 nt, Mycobacterium avium subsp. paratuberculosis
ccgcaccggccggcccc

SEQ ID NO: 2928055 - RNA, 18 nt, Mycobacterium avium subsp. paratuberculosis
ccgcaccggccggccccg

SEQ ID NO: 2928056 - RNA, 12 nt, Mycobacterium avium subsp. paratuberculosis
ccgcaccggcgc

SEQ ID NO: 2928057 - RNA, 16 nt, Mycobacterium avium subsp. paratuberculosis
ccgcaccggcgccgcc

SEQ ID NO: 2928058 - RNA, 17 nt, Mycobacterium avium subsp. paratuberculosis
ccgcaccggcgccgcca

SEQ ID NO: 2928059 - RNA, 20 nt, Mycobacterium avium subsp. paratuberculosis
ccgcaccggcgccgccacca

SEQ ID NO: 2928060 - RNA, 14 nt, Mycobacterium avium subsp. paratuberculosis
ccgcaccgggcagc

SEQ ID NO: 2928061 - RNA, 14 nt, Mycobacterium avium subsp. paratuberculosis
ccgcaccggucucc

SEQ ID NO: 2928062 - RNA, 20 nt, Mycobacterium avium subsp. paratuberculosis
ccgcaccgucgugccagcgc

SEQ ID NO: 2928063 - RNA, 21 nt, Mycobacterium avium subsp. paratuberculosis
ccgcaccgucgugccagcgca

SEQ ID NO: 2928064 - RNA, 18 nt, Mycobacterium avium subsp. paratuberculosis
ccgcaccguguagccgac

SEQ ID NO: 2928065 - RNA, 20 nt, Mycobacterium avium subsp. paratuberculosis
ccgcaccguguagccgaccg

SEQ ID NO: 2928066 - RNA, 16 nt, Mycobacterium avium subsp. paratuberculosis
ccgcaccucgcccggc

SEQ ID NO: 2928067 - RNA, 17 nt, Mycobacterium avium subsp. paratuberculosis
ccgcaccucgcccggcu

SEQ ID NO: 2928068 - RNA, 20 nt, Mycobacterium avium subsp. paratuberculosis
ccgcaccucgcccggcucga

SEQ ID NO: 2928069 - RNA, 18 nt, Mycobacterium avium subsp. paratuberculosis
ccgcaccucgccggccgc

SEQ ID NO: 2928070 - RNA, 20 nt, Mycobacterium avium subsp. paratuberculosis
ccgcaccucgccggccgccg

SEQ ID NO: 2928071 - RNA, 20 nt, Mycobacterium avium subsp. paratuberculosis
ccgcaccucgcuggcggcgc

SEQ ID NO: 2928072 - RNA, 17 nt, Mycobacterium avium subsp. paratuberculosis
ccgcaccugcgcgccgu

SEQ ID NO: 2928073 - RNA, 20 nt, Mycobacterium avium subsp. paratuberculosis
ccgcaccugcgcgccguugg

SEQ ID NO: 2928074 - RNA, 21 nt, Mycobacterium avium subsp. paratuberculosis
ccgcaccugcgcgccguuggu

SEQ ID NO: 2928075 - RNA, 17 nt, Mycobacterium avium subsp. paratuberculosis
ccgcacgaaaugcgggc

SEQ ID NO: 2928076 - RNA, 20 nt, Mycobacterium avium subsp. paratuberculosis
ccgcacgaccaugucggcga

SEQ ID NO: 2928077 - RNA, 12 nt, Mycobacterium avium subsp. paratuberculosis
ccgcacgaccug

SEQ ID NO: 2928078 - RNA, 12 nt, Mycobacterium avium subsp. paratuberculosis
ccgcacgagcac

SEQ ID NO: 2928079 - RNA, 18 nt, Mycobacterium avium subsp. paratuberculosis
ccgcacgagcacccagaa

SEQ ID NO: 2928080 - RNA, 18 nt, Mycobacterium avium subsp. paratuberculosis
ccgcacgaugccgcgcuc

SEQ ID NO: 2928081 - RNA, 20 nt, Mycobacterium avium subsp. paratuberculosis
ccgcacgaugccgcgcucga

SEQ ID NO: 2928082 - RNA, 15 nt, Mycobacterium avium subsp. paratuberculosis
ccgcacgcccacagc

SEQ ID NO: 2928083 - RNA, 16 nt, Mycobacterium avium subsp. paratuberculosis
ccgcacgccggguugg

SEQ ID NO: 2928084 - RNA, 23 nt, Mycobacterium avium subsp. paratuberculosis
ccgcacgccggguugggcggcgg

SEQ ID NO: 2928085 - RNA, 14 nt, Mycobacterium avium subsp. paratuberculosis
ccgcacgcgaccgc

SEQ ID NO: 2928086 - RNA, 21 nt, Mycobacterium avium subsp. paratuberculosis
ccgcacgcgaccgcgucgacg

SEQ ID NO: 2928087 - RNA, 17 nt, Mycobacterium avium subsp. paratuberculosis
ccgcacgcugucggggu

SEQ ID NO: 2928088 - RNA, 19 nt, Mycobacterium avium subsp. paratuberculosis
ccgcacgcugucggggucg

SEQ ID NO: 2928089 - RNA, 18 nt, Mycobacterium avium subsp. paratuberculosis
ccgcacggcccaucacca

SEQ ID NO: 2928090 - RNA, 22 nt, Mycobacterium avium subsp. paratuberculosis
ccgcacggcccaucaccagcgg

SEQ ID NO: 2928091 - RNA, 13 nt, Mycobacterium avium subsp. paratuberculosis
ccgcacggccgcc

SEQ ID NO: 2928092 - RNA, 16 nt, Mycobacterium avium subsp. paratuberculosis
ccgcacggucgcggug

SEQ ID NO: 2928093 - RNA, 17 nt, Mycobacterium avium subsp. paratuberculosis
ccgcacggugcagcagc

SEQ ID NO: 2928094 - RNA, 20 nt, Mycobacterium avium subsp. paratuberculosis
ccgcacggugcagcagcgcc

SEQ ID NO: 2928095 - RNA, 22 nt, Mycobacterium avium subsp. paratuberculosis
ccgcacggugcagcagcgccgc

SEQ ID NO: 2928096 - RNA, 19 nt, Mycobacterium avium subsp. paratuberculosis
ccgcacguagacggugucg

SEQ ID NO: 2928097 - RNA, 20 nt, Mycobacterium avium subsp. paratuberculosis
ccgcacguauccgcggucga

SEQ ID NO: 2928098 - RNA, 22 nt, Mycobacterium avium subsp. paratuberculosis
ccgcacguauccgcggucgacc

SEQ ID NO: 2928099 - RNA, 23 nt, Mycobacterium avium subsp. paratuberculosis
ccgcacguauccgcggucgacca

SEQ ID NO: 2928100 - RNA, 21 nt, Mycobacterium avium subsp. paratuberculosis
ccgcacgucccgcccggcgcc

SEQ ID NO: 2928101 - RNA, 23 nt, Mycobacterium avium subsp. paratuberculosis
ccgcacgucccgcccggcgccgg

SEQ ID NO: 2928102 - RNA, 16 nt, Mycobacterium avium subsp. paratuberculosis
ccgcagcgcggcggag

SEQ ID NO: 2928103 - RNA, 17 nt, Mycobacterium avium subsp. paratuberculosis
ccgcagcggcaggucgu

SEQ ID NO: 2928104 - RNA, 23 nt, Mycobacterium avium subsp. paratuberculosis
ccgcagcggcaggucgucgucgc

SEQ ID NO: 2928105 - RNA, 12 nt, Mycobacterium avium subsp. paratuberculosis
ccgcagcggcgc

SEQ ID NO: 2928106 - RNA, 13 nt, Mycobacterium avium subsp. paratuberculosis
ccgcagcggcgcc

SEQ ID NO: 2928107 - RNA, 14 nt, Mycobacterium avium subsp. paratuberculosis
ccgcagcggcgccg

SEQ ID NO: 2928108 - RNA, 15 nt, Mycobacterium avium subsp. paratuberculosis
ccgcagcggcgccgc

SEQ ID NO: 2928109 - RNA, 22 nt, Mycobacterium avium subsp. paratuberculosis
ccgcagcggcgccgcagcucgu

SEQ ID NO: 2928110 - RNA, 16 nt, Mycobacterium avium subsp. paratuberculosis
ccgcagcggcgccggg

SEQ ID NO: 2928111 - RNA, 14 nt, Mycobacterium avium subsp. paratuberculosis
ccgcagcggcggca

SEQ ID NO: 2928112 - RNA, 15 nt, Mycobacterium avium subsp. paratuberculosis
ccgcagcggcggcac

SEQ ID NO: 2928113 - RNA, 20 nt, Mycobacterium avium subsp. paratuberculosis
ccgcagcggcggcacgguug

SEQ ID NO: 2928114 - RNA, 14 nt, Mycobacterium avium subsp. paratuberculosis
ccgcagcggcggcu

SEQ ID NO: 2928115 - RNA, 22 nt, Mycobacterium avium subsp. paratuberculosis
ccgcagcggcuugaccggcucg

SEQ ID NO: 2928116 - RNA, 24 nt, Mycobacterium avium subsp. paratuberculosis
ccgcagcggcuugaccggcucgcc

SEQ ID NO: 2928117 - RNA, 15 nt, Mycobacterium avium subsp. paratuberculosis
ccgcagcggggcgcu

SEQ ID NO: 2928118 - RNA, 15 nt, Mycobacterium avium subsp. paratuberculosis
ccgcagcgugggcac

SEQ ID NO: 2928119 - RNA, 14 nt, Mycobacterium avium subsp. paratuberculosis
ccgcagcuccagcg

SEQ ID NO: 2928120 - RNA, 20 nt, Mycobacterium avium subsp. paratuberculosis
ccgcagcucccccggcguga

SEQ ID NO: 2928121 - RNA, 13 nt, Mycobacterium avium subsp. paratuberculosis
ccgcagcucgauc

SEQ ID NO: 2928122 - RNA, 16 nt, Mycobacterium avium subsp. paratuberculosis
ccgcagcucgcccagc

SEQ ID NO: 2928123 - RNA, 17 nt, Mycobacterium avium subsp. paratuberculosis
ccgcagcucgcccagca

SEQ ID NO: 2928124 - RNA, 14 nt, Mycobacterium avium subsp. paratuberculosis
ccgcagcucgccgg

SEQ ID NO: 2928125 - RNA, 15 nt, Mycobacterium avium subsp. paratuberculosis
ccgcagcucgccggu

SEQ ID NO: 2928126 - RNA, 13 nt, Mycobacterium avium subsp. paratuberculosis
ccgcagcucguug

SEQ ID NO: 2928127 - RNA, 17 nt, Mycobacterium avium subsp. paratuberculosis
ccgcagcugaucggggc

SEQ ID NO: 2928128 - RNA, 21 nt, Mycobacterium avium subsp. paratuberculosis
ccgcagcugaucggggcccac

SEQ ID NO: 2928129 - RNA, 17 nt, Mycobacterium avium subsp. paratuberculosis
ccgcagcuucugcagcu

SEQ ID NO: 2928130 - RNA, 20 nt, Mycobacterium avium subsp. paratuberculosis
ccgcaggaaagcgucacagu

SEQ ID NO: 2928131 - RNA, 16 nt, Mycobacterium avium subsp. paratuberculosis
ccgcaggaaaggaagg

SEQ ID NO: 2928132 - RNA, 19 nt, Mycobacterium avium subsp. paratuberculosis
ccgcaggagaucggcgcgg

SEQ ID NO: 2928133 - RNA, 22 nt, Mycobacterium avium subsp. paratuberculosis
ccgcaggagaucggcgcggagc

SEQ ID NO: 2928134 - RNA, 15 nt, Mycobacterium avium subsp. paratuberculosis
ccgcaggaucgagcc

SEQ ID NO: 2928135 - RNA, 17 nt, Mycobacterium avium subsp. paratuberculosis
ccgcaggaucgagccgg

SEQ ID NO: 2928136 - RNA, 20 nt, Mycobacterium avium subsp. paratuberculosis
ccgcaggaugccgaugucgg

SEQ ID NO: 2928137 - RNA, 15 nt, Mycobacterium avium subsp. paratuberculosis
ccgcaggccgcgagc

SEQ ID NO: 2928138 - RNA, 14 nt, Mycobacterium avium subsp. paratuberculosis
ccgcaggccgucgc

SEQ ID NO: 2928139 - RNA, 10 nt, Mycobacterium avium subsp. paratuberculosis
ccgcaggcga

SEQ ID NO: 2928140 - RNA, 20 nt, Mycobacterium avium subsp. paratuberculosis
ccgcaggcgaacaccucggu

SEQ ID NO: 2928141 - RNA, 21 nt, Mycobacterium avium subsp. paratuberculosis
ccgcaggcgaaggucagaucg

SEQ ID NO: 2928142 - RNA, 15 nt, Mycobacterium avium subsp. paratuberculosis
ccgcaggcggccagc

SEQ ID NO: 2928143 - RNA, 17 nt, Mycobacterium avium subsp. paratuberculosis
ccgcaggcggccagcac

SEQ ID NO: 2928144 - RNA, 13 nt, Mycobacterium avium subsp. paratuberculosis
ccgcagggcgccg

SEQ ID NO: 2928145 - RNA, 17 nt, Mycobacterium avium subsp. paratuberculosis
ccgcaggguggccagca

SEQ ID NO: 2928146 - RNA, 14 nt, Mycobacterium avium subsp. paratuberculosis
ccgcaggugcucgc

SEQ ID NO: 2928147 - RNA, 21 nt, Mycobacterium avium subsp. paratuberculosis
ccgcaggugcucgccggcgcg

SEQ ID NO: 2928148 - RNA, 22 nt, Mycobacterium avium subsp. paratuberculosis
ccgcaggugcucgccggcgcgg

SEQ ID NO: 2928149 - RNA, 23 nt, Mycobacterium avium subsp. paratuberculosis
ccgcaggugcucgccggcgcgga

SEQ ID NO: 2928150 - RNA, 11 nt, Mycobacterium avium subsp. paratuberculosis
ccgcagguggu

SEQ ID NO: 2928151 - RNA, 15 nt, Mycobacterium avium subsp. paratuberculosis
ccgcagguggugggc

SEQ ID NO: 2928152 - RNA, 17 nt, Mycobacterium avium subsp. paratuberculosis
ccgcagguggugggcgu

SEQ ID NO: 2928153 - RNA, 15 nt, Mycobacterium avium subsp. paratuberculosis
ccgcagucgaucacc

SEQ ID NO: 2928154 - RNA, 15 nt, Mycobacterium avium subsp. paratuberculosis
ccgcagugccggcgc

SEQ ID NO: 2928155 - RNA, 19 nt, Mycobacterium avium subsp. paratuberculosis
ccgcagugccggcgcaccg

SEQ ID NO: 2928156 - RNA, 21 nt, Mycobacterium avium subsp. paratuberculosis
ccgcagugccggcgcaccgcg

SEQ ID NO: 2928157 - RNA, 18 nt, Mycobacterium avium subsp. paratuberculosis
ccgcagugcgucagaacc

SEQ ID NO: 2928158 - RNA, 22 nt, Mycobacterium avium subsp. paratuberculosis
ccgcagugcgucagaaccgggg

SEQ ID NO: 2928159 - RNA, 17 nt, Mycobacterium avium subsp. paratuberculosis
ccgcaguucggccgccg

SEQ ID NO: 2928160 - RNA, 21 nt, Mycobacterium avium subsp. paratuberculosis
ccgcaguucggccgccgugcu

SEQ ID NO: 2928161 - RNA, 21 nt, Mycobacterium avium subsp. paratuberculosis
ccgcauacaccuugucggcga

SEQ ID NO: 2928162 - RNA, 16 nt, Mycobacterium avium subsp. paratuberculosis
ccgcaucaacugcacc

SEQ ID NO: 2928163 - RNA, 15 nt, Mycobacterium avium subsp. paratuberculosis
ccgcauccagcgccg

SEQ ID NO: 2928164 - RNA, 17 nt, Mycobacterium avium subsp. paratuberculosis
ccgcauccagcgccgcc

SEQ ID NO: 2928165 - RNA, 14 nt, Mycobacterium avium subsp. paratuberculosis
ccgcauccgccggg

SEQ ID NO: 2928166 - RNA, 15 nt, Mycobacterium avium subsp. paratuberculosis
ccgcauccgccgggc

SEQ ID NO: 2928167 - RNA, 16 nt, Mycobacterium avium subsp. paratuberculosis
ccgcauccgccgggcg

SEQ ID NO: 2928168 - RNA, 15 nt, Mycobacterium avium subsp. paratuberculosis
ccgcaucgaaccgcc

SEQ ID NO: 2928169 - RNA, 16 nt, Mycobacterium avium subsp. paratuberculosis
ccgcaucgaaccgccg

SEQ ID NO: 2928170 - RNA, 17 nt, Mycobacterium avium subsp. paratuberculosis
ccgcaucgaaccgccgc

SEQ ID NO: 2928171 - RNA, 18 nt, Mycobacterium avium subsp. paratuberculosis
ccgcaucgaaccgccgcg

SEQ ID NO: 2928172 - RNA, 17 nt, Mycobacterium avium subsp. paratuberculosis
ccgcaucgaauccacga

SEQ ID NO: 2928173 - RNA, 16 nt, Mycobacterium avium subsp. paratuberculosis
ccgcaucgccgaaccg

SEQ ID NO: 2928174 - RNA, 18 nt, Mycobacterium avium subsp. paratuberculosis
ccgcaucgccgagggcga

SEQ ID NO: 2928175 - RNA, 21 nt, Mycobacterium avium subsp. paratuberculosis
ccgcaucgccgagggcgacga

SEQ ID NO: 2928176 - RNA, 13 nt, Mycobacterium avium subsp. paratuberculosis
ccgcaucgcggcg

SEQ ID NO: 2928177 - RNA, 14 nt, Mycobacterium avium subsp. paratuberculosis
ccgcaucgcggcga

SEQ ID NO: 2928178 - RNA, 16 nt, Mycobacterium avium subsp. paratuberculosis
ccgcaucgcggcgaug

SEQ ID NO: 2928179 - RNA, 20 nt, Mycobacterium avium subsp. paratuberculosis
ccgcaucguugguccaggcg

SEQ ID NO: 2928180 - RNA, 19 nt, Mycobacterium avium subsp. paratuberculosis
ccgcaugaugcggccauga

SEQ ID NO: 2928181 - RNA, 21 nt, Mycobacterium avium subsp. paratuberculosis
ccgcaugcaccggugcaccgc

SEQ ID NO: 2928182 - RNA, 21 nt, Mycobacterium avium subsp. paratuberculosis
ccgcaugcccuugucgcuggc

SEQ ID NO: 2928183 - RNA, 12 nt, Mycobacterium avium subsp. paratuberculosis
ccgcauggccgg

SEQ ID NO: 2928184 - RNA, 15 nt, Mycobacterium avium subsp. paratuberculosis
ccgcauggccggcga

SEQ ID NO: 2928185 - RNA, 17 nt, Mycobacterium avium subsp. paratuberculosis
ccgcauggccggcgaac

SEQ ID NO: 2928186 - RNA, 15 nt, Mycobacterium avium subsp. paratuberculosis
ccgcaugucgaagaa

SEQ ID NO: 2928187 - RNA, 14 nt, Mycobacterium avium subsp. paratuberculosis
ccgccagcaccgcc

SEQ ID NO: 2928188 - RNA, 21 nt, Mycobacterium avium subsp. paratuberculosis
ccgccagcaccgccaccggcc

SEQ ID NO: 2928189 - RNA, 15 nt, Mycobacterium avium subsp. paratuberculosis
ccgccagcaccucgc

SEQ ID NO: 2928190 - RNA, 20 nt, Mycobacterium avium subsp. paratuberculosis
ccgccagcaccucgcggcag

SEQ ID NO: 2928191 - RNA, 21 nt, Mycobacterium avium subsp. paratuberculosis
ccgccagcaccucgcggcagc

SEQ ID NO: 2928192 - RNA, 22 nt, Mycobacterium avium subsp. paratuberculosis
ccgccagcaccucgcggcagcc

SEQ ID NO: 2928193 - RNA, 16 nt, Mycobacterium avium subsp. paratuberculosis
ccgccagcagaugccg

SEQ ID NO: 2928194 - RNA, 23 nt, Mycobacterium avium subsp. paratuberculosis
ccgccagcagaugccgcccaggu

SEQ ID NO: 2928195 - RNA, 11 nt, Mycobacterium avium subsp. paratuberculosis
ccgccagcagc

SEQ ID NO: 2928196 - RNA, 17 nt, Mycobacterium avium subsp. paratuberculosis
ccgccagcagcacggca

SEQ ID NO: 2928197 - RNA, 14 nt, Mycobacterium avium subsp. paratuberculosis
ccgccagcagcagc

SEQ ID NO: 2928198 - RNA, 18 nt, Mycobacterium avium subsp. paratuberculosis
ccgccagcagcagccgcg

SEQ ID NO: 2928199 - RNA, 21 nt, Mycobacterium avium subsp. paratuberculosis
ccgccagcagcagccgcgccg

SEQ ID NO: 2928200 - RNA, 22 nt, Mycobacterium avium subsp. paratuberculosis
ccgccagcagcagccgcgccgc

SEQ ID NO: 2928201 - RNA, 16 nt, Mycobacterium avium subsp. paratuberculosis
ccgccagcagcagcgc

SEQ ID NO: 2928202 - RNA, 20 nt, Mycobacterium avium subsp. paratuberculosis
ccgccagcagcagcgccgcc

SEQ ID NO: 2928203 - RNA, 12 nt, Mycobacterium avium subsp. paratuberculosis
ccgccagcagcg

SEQ ID NO: 2928204 - RNA, 14 nt, Mycobacterium avium subsp. paratuberculosis
ccgccagcagcgca

SEQ ID NO: 2928205 - RNA, 20 nt, Mycobacterium avium subsp. paratuberculosis
ccgccagcaguguccagucg

SEQ ID NO: 2928206 - RNA, 18 nt, Mycobacterium avium subsp. paratuberculosis
ccgccagcauccgcuggu

SEQ ID NO: 2928207 - RNA, 22 nt, Mycobacterium avium subsp. paratuberculosis
ccgccagcauccgcuggugcgc

SEQ ID NO: 2928208 - RNA, 13 nt, Mycobacterium avium subsp. paratuberculosis
ccgccagcauggu

SEQ ID NO: 2928209 - RNA, 22 nt, Mycobacterium avium subsp. paratuberculosis
ccgccagcaugguucguggggu

SEQ ID NO: 2928210 - RNA, 13 nt, Mycobacterium avium subsp. paratuberculosis
ccgccagccacca

SEQ ID NO: 2928211 - RNA, 14 nt, Mycobacterium avium subsp. paratuberculosis
ccgccagcccgaaa

SEQ ID NO: 2928212 - RNA, 19 nt, Mycobacterium avium subsp. paratuberculosis
ccgccagcccgcgucgugu

SEQ ID NO: 2928213 - RNA, 13 nt, Mycobacterium avium subsp. paratuberculosis
ccgccagccgcag

SEQ ID NO: 2928214 - RNA, 14 nt, Mycobacterium avium subsp. paratuberculosis
ccgccagccgcagc

SEQ ID NO: 2928215 - RNA, 12 nt, Mycobacterium avium subsp. paratuberculosis
ccgccagccgcg

SEQ ID NO: 2928216 - RNA, 15 nt, Mycobacterium avium subsp. paratuberculosis
ccgccagccgguacg

SEQ ID NO: 2928217 - RNA, 15 nt, Mycobacterium avium subsp. paratuberculosis
ccgccagcgcaccga

SEQ ID NO: 2928218 - RNA, 14 nt, Mycobacterium avium subsp. paratuberculosis
ccgccagcgcccgc

SEQ ID NO: 2928219 - RNA, 17 nt, Mycobacterium avium subsp. paratuberculosis
ccgccagcgccggcagc

SEQ ID NO: 2928220 - RNA, 14 nt, Mycobacterium avium subsp. paratuberculosis
ccgccagcgcgccg

SEQ ID NO: 2928221 - RNA, 18 nt, Mycobacterium avium subsp. paratuberculosis
ccgccagcgcgccgaucg

SEQ ID NO: 2928222 - RNA, 19 nt, Mycobacterium avium subsp. paratuberculosis
ccgccagcgcgccgaucgc

SEQ ID NO: 2928223 - RNA, 15 nt, Mycobacterium avium subsp. paratuberculosis
ccgccagcgcggcga

SEQ ID NO: 2928224 - RNA, 17 nt, Mycobacterium avium subsp. paratuberculosis
ccgccagcgcggcgauc

SEQ ID NO: 2928225 - RNA, 20 nt, Mycobacterium avium subsp. paratuberculosis
ccgccagcgcggcgaucagc

SEQ ID NO: 2928226 - RNA, 22 nt, Mycobacterium avium subsp. paratuberculosis
ccgccagcgcggcgaucagcag

SEQ ID NO: 2928227 - RNA, 18 nt, Mycobacterium avium subsp. paratuberculosis
ccgccagcgcggcggcgc

SEQ ID NO: 2928228 - RNA, 17 nt, Mycobacterium avium subsp. paratuberculosis
ccgccagcgcggggucg

SEQ ID NO: 2928229 - RNA, 20 nt, Mycobacterium avium subsp. paratuberculosis
ccgccagcgcggggucggcc

SEQ ID NO: 2928230 - RNA, 24 nt, Mycobacterium avium subsp. paratuberculosis
ccgccagcgucccguccugggccu

SEQ ID NO: 2928231 - RNA, 12 nt, Mycobacterium avium subsp. paratuberculosis
ccgccagcucgu

SEQ ID NO: 2928232 - RNA, 15 nt, Mycobacterium avium subsp. paratuberculosis
ccgccagcucgucca

SEQ ID NO: 2928233 - RNA, 16 nt, Mycobacterium avium subsp. paratuberculosis
ccgccagcucguccag

SEQ ID NO: 2928234 - RNA, 21 nt, Mycobacterium avium subsp. paratuberculosis
ccgccagcucguccagcgugc

SEQ ID NO: 2928235 - RNA, 23 nt, Mycobacterium avium subsp. paratuberculosis
ccgccaggaagacguaggcggcc

SEQ ID NO: 2928236 - RNA, 15 nt, Mycobacterium avium subsp. paratuberculosis
ccgccaggaaggcca

SEQ ID NO: 2928237 - RNA, 23 nt, Mycobacterium avium subsp. paratuberculosis
ccgccaggaucugcucggcgucg

SEQ ID NO: 2928238 - RNA, 22 nt, Mycobacterium avium subsp. paratuberculosis
ccgccaggaugucguccucggu

SEQ ID NO: 2928239 - RNA, 15 nt, Mycobacterium avium subsp. paratuberculosis
ccgccaggcggcgac

SEQ ID NO: 2928240 - RNA, 17 nt, Mycobacterium avium subsp. paratuberculosis
ccgccaggcggcgacga

SEQ ID NO: 2928241 - RNA, 23 nt, Mycobacterium avium subsp. paratuberculosis
ccgccaggcggcgacgaacgccg

SEQ ID NO: 2928242 - RNA, 17 nt, Mycobacterium avium subsp. paratuberculosis
ccgccagggcgacgccg

SEQ ID NO: 2928243 - RNA, 19 nt, Mycobacterium avium subsp. paratuberculosis
ccgccagggcgacgccgcg

SEQ ID NO: 2928244 - RNA, 23 nt, Mycobacterium avium subsp. paratuberculosis
ccgccagggcgacgccgcggaag

SEQ ID NO: 2928245 - RNA, 15 nt, Mycobacterium avium subsp. paratuberculosis
ccgccagggcgcggc

SEQ ID NO: 2928246 - RNA, 16 nt, Mycobacterium avium subsp. paratuberculosis
ccgccagggcgcggcg

SEQ ID NO: 2928247 - RNA, 17 nt, Mycobacterium avium subsp. paratuberculosis
ccgccagggcgcggcgc

SEQ ID NO: 2928248 - RNA, 20 nt, Mycobacterium avium subsp. paratuberculosis
ccgccagggcgcggcgcacc

SEQ ID NO: 2928249 - RNA, 20 nt, Mycobacterium avium subsp. paratuberculosis
ccgccagggucucgggcagc

SEQ ID NO: 2928250 - RNA, 21 nt, Mycobacterium avium subsp. paratuberculosis
ccgccagggucucgggcagca

SEQ ID NO: 2928251 - RNA, 23 nt, Mycobacterium avium subsp. paratuberculosis
ccgccagggucucgggcagcagc

SEQ ID NO: 2928252 - RNA, 14 nt, Mycobacterium avium subsp. paratuberculosis
ccgccagggugccg

SEQ ID NO: 2928253 - RNA, 22 nt, Mycobacterium avium subsp. paratuberculosis
ccgccagggugccgcugcccgc

SEQ ID NO: 2928254 - RNA, 16 nt, Mycobacterium avium subsp. paratuberculosis
ccgccaggucggggcc

SEQ ID NO: 2928255 - RNA, 20 nt, Mycobacterium avium subsp. paratuberculosis
ccgccaggucggggcccguc

SEQ ID NO: 2928256 - RNA, 21 nt, Mycobacterium avium subsp. paratuberculosis
ccgccaggucggggcccgucc

SEQ ID NO: 2928257 - RNA, 20 nt, Mycobacterium avium subsp. paratuberculosis
ccgccagguuggcggcggcc

SEQ ID NO: 2928258 - RNA, 22 nt, Mycobacterium avium subsp. paratuberculosis
ccgccagguuggcggcggcccg

SEQ ID NO: 2928259 - RNA, 14 nt, Mycobacterium avium subsp. paratuberculosis
ccgccagucugagc

SEQ ID NO: 2928260 - RNA, 18 nt, Mycobacterium avium subsp. paratuberculosis
ccgccaguucccggccag

SEQ ID NO: 2928261 - RNA, 19 nt, Mycobacterium avium subsp. paratuberculosis
ccgccaguucccggccagc

SEQ ID NO: 2928262 - RNA, 21 nt, Mycobacterium avium subsp. paratuberculosis
ccgccaguucccggccagcgc

SEQ ID NO: 2928263 - RNA, 22 nt, Mycobacterium avium subsp. paratuberculosis
ccgccaguucccggccagcgca

SEQ ID NO: 2928264 - RNA, 17 nt, Mycobacterium avium subsp. paratuberculosis
ccgccaguuguuggccg

SEQ ID NO: 2928265 - RNA, 13 nt, Mycobacterium avium subsp. paratuberculosis
ccgccaucauccg

SEQ ID NO: 2928266 - RNA, 15 nt, Mycobacterium avium subsp. paratuberculosis
ccgccauccgcgccg

SEQ ID NO: 2928267 - RNA, 19 nt, Mycobacterium avium subsp. paratuberculosis
ccgccauccgcgccgaacg

SEQ ID NO: 2928268 - RNA, 20 nt, Mycobacterium avium subsp. paratuberculosis
ccgccauccgcgccgaacgc

SEQ ID NO: 2928269 - RNA, 16 nt, Mycobacterium avium subsp. paratuberculosis
ccgccauccguucggc

SEQ ID NO: 2928270 - RNA, 22 nt, Mycobacterium avium subsp. paratuberculosis
ccgccaucgaucgggcgucgca

SEQ ID NO: 2928271 - RNA, 21 nt, Mycobacterium avium subsp. paratuberculosis
ccgccccgacgaucgcgccgg

SEQ ID NO: 2928272 - RNA, 22 nt, Mycobacterium avium subsp. paratuberculosis
ccgccccgacgaucgcgccggc

SEQ ID NO: 2928273 - RNA, 14 nt, Mycobacterium avium subsp. paratuberculosis
ccgccccgacgugc

SEQ ID NO: 2928274 - RNA, 18 nt, Mycobacterium avium subsp. paratuberculosis
ccgccccgagaucccagc

SEQ ID NO: 2928275 - RNA, 20 nt, Mycobacterium avium subsp. paratuberculosis
ccgccccgagaucccagcgg

SEQ ID NO: 2928276 - RNA, 21 nt, Mycobacterium avium subsp. paratuberculosis
ccgccccgaguuccagcuccg

SEQ ID NO: 2928277 - RNA, 23 nt, Mycobacterium avium subsp. paratuberculosis
ccgccccgaucggauccgccugc

SEQ ID NO: 2928278 - RNA, 13 nt, Mycobacterium avium subsp. paratuberculosis
ccgccccgcccgg

SEQ ID NO: 2928279 - RNA, 14 nt, Mycobacterium avium subsp. paratuberculosis
ccgccccgcccggc

SEQ ID NO: 2928280 - RNA, 15 nt, Mycobacterium avium subsp. paratuberculosis
ccgccccgcccggcg

SEQ ID NO: 2928281 - RNA, 13 nt, Mycobacterium avium subsp. paratuberculosis
ccgccccgccgcg

SEQ ID NO: 2928282 - RNA, 18 nt, Mycobacterium avium subsp. paratuberculosis
ccgccccgccgcgccggg

SEQ ID NO: 2928283 - RNA, 16 nt, Mycobacterium avium subsp. paratuberculosis
ccgccccgcgcgauca

SEQ ID NO: 2928284 - RNA, 18 nt, Mycobacterium avium subsp. paratuberculosis
ccgccccgcgcgaucagg

SEQ ID NO: 2928285 - RNA, 23 nt, Mycobacterium avium subsp. paratuberculosis
ccgccccgcgcgaucaggccggc

SEQ ID NO: 2928286 - RNA, 14 nt, Mycobacterium avium subsp. paratuberculosis
ccgccccgcugccg

SEQ ID NO: 2928287 - RNA, 15 nt, Mycobacterium avium subsp. paratuberculosis
ccgccccggccgcgc

SEQ ID NO: 2928288 - RNA, 16 nt, Mycobacterium avium subsp. paratuberculosis
ccgccccggccgcgca

SEQ ID NO: 2928289 - RNA, 19 nt, Mycobacterium avium subsp. paratuberculosis
ccgccccggucaccccggc

SEQ ID NO: 2928290 - RNA, 20 nt, Mycobacterium avium subsp. paratuberculosis
ccgccccgucggucgggcag

SEQ ID NO: 2928291 - RNA, 21 nt, Mycobacterium avium subsp. paratuberculosis
ccgccccgucggucgggcagu

SEQ ID NO: 2928292 - RNA, 13 nt, Mycobacterium avium subsp. paratuberculosis
ccgccccuccagg

SEQ ID NO: 2928293 - RNA, 23 nt, Mycobacterium avium subsp. paratuberculosis
ccgccccugagggugucggcgau

SEQ ID NO: 2928294 - RNA, 13 nt, Mycobacterium avium subsp. paratuberculosis
ccgccccugcugg

SEQ ID NO: 2928295 - RNA, 19 nt, Mycobacterium avium subsp. paratuberculosis
ccgcccgaaccgcguccac

SEQ ID NO: 2928296 - RNA, 14 nt, Mycobacterium avium subsp. paratuberculosis
ccgcccgacccguc

SEQ ID NO: 2928297 - RNA, 19 nt, Mycobacterium avium subsp. paratuberculosis
ccgcccgacccguccagca

SEQ ID NO: 2928298 - RNA, 23 nt, Mycobacterium avium subsp. paratuberculosis
ccgcccgagaguccgccgccggg

SEQ ID NO: 2928299 - RNA, 22 nt, Mycobacterium avium subsp. paratuberculosis
ccgcccgaucaucucaccgacg

SEQ ID NO: 2928300 - RNA, 14 nt, Mycobacterium avium subsp. paratuberculosis
ccgcccgaucccgu

SEQ ID NO: 2928301 - RNA, 17 nt, Mycobacterium avium subsp. paratuberculosis
ccgcccgaucccgucgu

SEQ ID NO: 2928302 - RNA, 20 nt, Mycobacterium avium subsp. paratuberculosis
ccgcccgaucccgucgucgg

SEQ ID NO: 2928303 - RNA, 23 nt, Mycobacterium avium subsp. paratuberculosis
ccgcccgaucccgucgucggcgc

SEQ ID NO: 2928304 - RNA, 12 nt, Mycobacterium avium subsp. paratuberculosis
ccgcccgcacca

SEQ ID NO: 2928305 - RNA, 16 nt, Mycobacterium avium subsp. paratuberculosis
ccgcccgcaccagcag

SEQ ID NO: 2928306 - RNA, 17 nt, Mycobacterium avium subsp. paratuberculosis
ccgcccgcagcggcggu

SEQ ID NO: 2928307 - RNA, 20 nt, Mycobacterium avium subsp. paratuberculosis
ccgcccgcaguucggccgcc

SEQ ID NO: 2928308 - RNA, 21 nt, Mycobacterium avium subsp. paratuberculosis
ccgcccgcaguucggccgccg

SEQ ID NO: 2928309 - RNA, 13 nt, Mycobacterium avium subsp. paratuberculosis
ccgcccgcccgag

SEQ ID NO: 2928310 - RNA, 13 nt, Mycobacterium avium subsp. paratuberculosis
ccgcccgcccggc

SEQ ID NO: 2928311 - RNA, 14 nt, Mycobacterium avium subsp. paratuberculosis
ccgcccgcccggca

SEQ ID NO: 2928312 - RNA, 15 nt, Mycobacterium avium subsp. paratuberculosis
ccgcccgcccggcac

SEQ ID NO: 2928313 - RNA, 16 nt, Mycobacterium avium subsp. paratuberculosis
ccgcccgcccggcacg

SEQ ID NO: 2928314 - RNA, 22 nt, Mycobacterium avium subsp. paratuberculosis
ccgcccgcgcgaugcgggcgcc

SEQ ID NO: 2928315 - RNA, 23 nt, Mycobacterium avium subsp. paratuberculosis
ccgcccgcgcgaugcgggcgccg

SEQ ID NO: 2928316 - RNA, 15 nt, Mycobacterium avium subsp. paratuberculosis
ccgcccgcgcggcgg

SEQ ID NO: 2928317 - RNA, 22 nt, Mycobacterium avium subsp. paratuberculosis
ccgcccgcgcguggucccacac

SEQ ID NO: 2928318 - RNA, 14 nt, Mycobacterium avium subsp. paratuberculosis
ccgcccgcggugug

SEQ ID NO: 2928319 - RNA, 15 nt, Mycobacterium avium subsp. paratuberculosis
ccgcccgcggugugc

SEQ ID NO: 2928320 - RNA, 16 nt, Mycobacterium avium subsp. paratuberculosis
ccgcccgcggugugcu

SEQ ID NO: 2928321 - RNA, 16 nt, Mycobacterium avium subsp. paratuberculosis
ccgcccgcucgacggc

SEQ ID NO: 2928322 - RNA, 19 nt, Mycobacterium avium subsp. paratuberculosis
ccgcccgcucgacggccgg

SEQ ID NO: 2928323 - RNA, 20 nt, Mycobacterium avium subsp. paratuberculosis
ccgcccgcucgacggccggu

SEQ ID NO: 2928324 - RNA, 22 nt, Mycobacterium avium subsp. paratuberculosis
ccgcccgcugaccgccgcgcuc

SEQ ID NO: 2928325 - RNA, 24 nt, Mycobacterium avium subsp. paratuberculosis
ccgcccgcugaccgccgcgcucgg

SEQ ID NO: 2928326 - RNA, 17 nt, Mycobacterium avium subsp. paratuberculosis
ccgcccggacaccccgu

SEQ ID NO: 2928327 - RNA, 14 nt, Mycobacterium avium subsp. paratuberculosis
ccgcccggaccggc

SEQ ID NO: 2928328 - RNA, 23 nt, Mycobacterium avium subsp. paratuberculosis
ccgcccggagguucgccggaaug

SEQ ID NO: 2928329 - RNA, 19 nt, Mycobacterium avium subsp. paratuberculosis
ccgcccggauucgcggcgg

SEQ ID NO: 2928330 - RNA, 20 nt, Mycobacterium avium subsp. paratuberculosis
ccgcccggauucgcggcggc

SEQ ID NO: 2928331 - RNA, 22 nt, Mycobacterium avium subsp. paratuberculosis
ccgcccggauucgcggcggcgc

SEQ ID NO: 2928332 - RNA, 15 nt, Mycobacterium avium subsp. paratuberculosis
ccgcccggcaacacg

SEQ ID NO: 2928333 - RNA, 17 nt, Mycobacterium avium subsp. paratuberculosis
ccgcccggcccaagacc

SEQ ID NO: 2928334 - RNA, 19 nt, Mycobacterium avium subsp. paratuberculosis
ccgcccggcccaagacccg

SEQ ID NO: 2928335 - RNA, 21 nt, Mycobacterium avium subsp. paratuberculosis
ccgcccggcccaagacccgcg

SEQ ID NO: 2928336 - RNA, 22 nt, Mycobacterium avium subsp. paratuberculosis
ccgcccggcccaagacccgcgu

SEQ ID NO: 2928337 - RNA, 13 nt, Mycobacterium avium subsp. paratuberculosis
ccgcccggcccgc

SEQ ID NO: 2928338 - RNA, 16 nt, Mycobacterium avium subsp. paratuberculosis
ccgcccggcccggcgc

SEQ ID NO: 2928339 - RNA, 21 nt, Mycobacterium avium subsp. paratuberculosis
ccgcccggcccggcgcggccg

SEQ ID NO: 2928340 - RNA, 13 nt, Mycobacterium avium subsp. paratuberculosis
ccgcccggccggu

SEQ ID NO: 2928341 - RNA, 16 nt, Mycobacterium avium subsp. paratuberculosis
ccgcccggccggucgc

SEQ ID NO: 2928342 - RNA, 21 nt, Mycobacterium avium subsp. paratuberculosis
ccgcccggccggucgccgaug

SEQ ID NO: 2928343 - RNA, 11 nt, Mycobacterium avium subsp. paratuberculosis
ccgcccggcga

SEQ ID NO: 2928344 - RNA, 13 nt, Mycobacterium avium subsp. paratuberculosis
ccgcccggcgagc

SEQ ID NO: 2928345 - RNA, 22 nt, Mycobacterium avium subsp. paratuberculosis
ccgcccggcgagcacaggaacg

SEQ ID NO: 2928346 - RNA, 13 nt, Mycobacterium avium subsp. paratuberculosis
ccgcccggcgauc

SEQ ID NO: 2928347 - RNA, 16 nt, Mycobacterium avium subsp. paratuberculosis
ccgcccggcgaucucg

SEQ ID NO: 2928348 - RNA, 13 nt, Mycobacterium avium subsp. paratuberculosis
ccgcccggcgccg

SEQ ID NO: 2928349 - RNA, 17 nt, Mycobacterium avium subsp. paratuberculosis
ccgcccggcgccggccg

SEQ ID NO: 2928350 - RNA, 12 nt, Mycobacterium avium subsp. paratuberculosis
ccgcccggcgcg

SEQ ID NO: 2928351 - RNA, 13 nt, Mycobacterium avium subsp. paratuberculosis
ccgcccggcgcgc

SEQ ID NO: 2928352 - RNA, 22 nt, Mycobacterium avium subsp. paratuberculosis
ccgcccggcgcgcagcccagcc

SEQ ID NO: 2928353 - RNA, 15 nt, Mycobacterium avium subsp. paratuberculosis
ccgcccggcgcgccg

SEQ ID NO: 2928354 - RNA, 13 nt, Mycobacterium avium subsp. paratuberculosis
ccgcccggcggcc

SEQ ID NO: 2928355 - RNA, 17 nt, Mycobacterium avium subsp. paratuberculosis
ccgcccggcggccacca

SEQ ID NO: 2928356 - RNA, 14 nt, Mycobacterium avium subsp. paratuberculosis
ccgccgacaccacc

SEQ ID NO: 2928357 - RNA, 20 nt, Mycobacterium avium subsp. paratuberculosis
ccgccgacaccaccgcgcgc

SEQ ID NO: 2928358 - RNA, 20 nt, Mycobacterium avium subsp. paratuberculosis
ccgccgaccacaugccguug

SEQ ID NO: 2928359 - RNA, 21 nt, Mycobacterium avium subsp. paratuberculosis
ccgccgaccaccuugcgcagc

SEQ ID NO: 2928360 - RNA, 18 nt, Mycobacterium avium subsp. paratuberculosis
ccgccgaccacgccgcgc

SEQ ID NO: 2928361 - RNA, 13 nt, Mycobacterium avium subsp. paratuberculosis
ccgccgaccagga

SEQ ID NO: 2928362 - RNA, 17 nt, Mycobacterium avium subsp. paratuberculosis
ccgccgaccgcccgcug

SEQ ID NO: 2928363 - RNA, 13 nt, Mycobacterium avium subsp. paratuberculosis
ccgccgaccgccg

SEQ ID NO: 2928364 - RNA, 15 nt, Mycobacterium avium subsp. paratuberculosis
ccgccgaccgguccg

SEQ ID NO: 2928365 - RNA, 16 nt, Mycobacterium avium subsp. paratuberculosis
ccgccgaccgguccgc

SEQ ID NO: 2928366 - RNA, 18 nt, Mycobacterium avium subsp. paratuberculosis
ccgccgaccgguccgccg

SEQ ID NO: 2928367 - RNA, 14 nt, Mycobacterium avium subsp. paratuberculosis
ccgccgacgacggc

SEQ ID NO: 2928368 - RNA, 16 nt, Mycobacterium avium subsp. paratuberculosis
ccgccgacgacggcga

SEQ ID NO: 2928369 - RNA, 12 nt, Mycobacterium avium subsp. paratuberculosis
ccgccgacgccc

SEQ ID NO: 2928370 - RNA, 15 nt, Mycobacterium avium subsp. paratuberculosis
ccgccgacgcccagg

SEQ ID NO: 2928371 - RNA, 13 nt, Mycobacterium avium subsp. paratuberculosis
ccgccgacgccug

SEQ ID NO: 2928372 - RNA, 17 nt, Mycobacterium avium subsp. paratuberculosis
ccgccgacgccugcgcg

SEQ ID NO: 2928373 - RNA, 15 nt, Mycobacterium avium subsp. paratuberculosis
ccgccgacggagacg

SEQ ID NO: 2928374 - RNA, 18 nt, Mycobacterium avium subsp. paratuberculosis
ccgccgacggagacgacc

SEQ ID NO: 2928375 - RNA, 13 nt, Mycobacterium avium subsp. paratuberculosis
ccgccgacggcug

SEQ ID NO: 2928376 - RNA, 15 nt, Mycobacterium avium subsp. paratuberculosis
ccgccgacggcugcc

SEQ ID NO: 2928377 - RNA, 18 nt, Mycobacterium avium subsp. paratuberculosis
ccgccgacgguggccccc

SEQ ID NO: 2928378 - RNA, 19 nt, Mycobacterium avium subsp. paratuberculosis
ccgccgacgucgugggcga

SEQ ID NO: 2928379 - RNA, 19 nt, Mycobacterium avium subsp. paratuberculosis
ccgccgacuccccgcccgg

SEQ ID NO: 2928380 - RNA, 13 nt, Mycobacterium avium subsp. paratuberculosis
ccgccgagacggc

SEQ ID NO: 2928381 - RNA, 20 nt, Mycobacterium avium subsp. paratuberculosis
ccgccgagacggcguggcug

SEQ ID NO: 2928382 - RNA, 19 nt, Mycobacterium avium subsp. paratuberculosis
ccgccgagauccaccgcgc

SEQ ID NO: 2928383 - RNA, 21 nt, Mycobacterium avium subsp. paratuberculosis
ccgccgagauccaccgcgcgg

SEQ ID NO: 2928384 - RNA, 22 nt, Mycobacterium avium subsp. paratuberculosis
ccgccgagauccaccgcgcggc

SEQ ID NO: 2928385 - RNA, 23 nt, Mycobacterium avium subsp. paratuberculosis
ccgccgagcagaucacguugauc

SEQ ID NO: 2928386 - RNA, 15 nt, Mycobacterium avium subsp. paratuberculosis
ccgccgagccgcggg

SEQ ID NO: 2928387 - RNA, 20 nt, Mycobacterium avium subsp. paratuberculosis
ccgccgagccgcgggugacg

SEQ ID NO: 2928388 - RNA, 19 nt, Mycobacterium avium subsp. paratuberculosis
ccgccgagccgcuccaccg

SEQ ID NO: 2928389 - RNA, 13 nt, Mycobacterium avium subsp. paratuberculosis
ccgccgagccggc

SEQ ID NO: 2928390 - RNA, 15 nt, Mycobacterium avium subsp. paratuberculosis
ccgccgagccggcac

SEQ ID NO: 2928391 - RNA, 19 nt, Mycobacterium avium subsp. paratuberculosis
ccgccgagccggcacggcc

SEQ ID NO: 2928392 - RNA, 11 nt, Mycobacterium avium subsp. paratuberculosis
ccgccgagcgu

SEQ ID NO: 2928393 - RNA, 14 nt, Mycobacterium avium subsp. paratuberculosis
ccgccgagcgucac

SEQ ID NO: 2928394 - RNA, 21 nt, Mycobacterium avium subsp. paratuberculosis
ccgccgagcucggccaccagc

SEQ ID NO: 2928395 - RNA, 18 nt, Mycobacterium avium subsp. paratuberculosis
ccgccgaggacacguugg

SEQ ID NO: 2928396 - RNA, 12 nt, Mycobacterium avium subsp. paratuberculosis
ccgccgaggcga

SEQ ID NO: 2928397 - RNA, 20 nt, Mycobacterium avium subsp. paratuberculosis
ccgccgaggcgaugccgugc

SEQ ID NO: 2928398 - RNA, 16 nt, Mycobacterium avium subsp. paratuberculosis
ccgccgagggccagca

SEQ ID NO: 2928399 - RNA, 20 nt, Mycobacterium avium subsp. paratuberculosis
ccgccgagggccagcagcca

SEQ ID NO: 2928400 - RNA, 14 nt, Mycobacterium avium subsp. paratuberculosis
ccgccgagggcccg

SEQ ID NO: 2928401 - RNA, 19 nt, Mycobacterium avium subsp. paratuberculosis
ccgccgagggcccgggcag

SEQ ID NO: 2928402 - RNA, 21 nt, Mycobacterium avium subsp. paratuberculosis
ccgccgagggcccgggcaggc

SEQ ID NO: 2928403 - RNA, 22 nt, Mycobacterium avium subsp. paratuberculosis
ccgccgagggcccgggcaggca

SEQ ID NO: 2928404 - RNA, 22 nt, Mycobacterium avium subsp. paratuberculosis
ccgccgagggggaagucgaccg

SEQ ID NO: 2928405 - RNA, 23 nt, Mycobacterium avium subsp. paratuberculosis
ccgccgagggggaagucgaccgg

SEQ ID NO: 2928406 - RNA, 13 nt, Mycobacterium avium subsp. paratuberculosis
ccgccgagucgcg

SEQ ID NO: 2928407 - RNA, 14 nt, Mycobacterium avium subsp. paratuberculosis
ccgccgagucgcgc

SEQ ID NO: 2928408 - RNA, 16 nt, Mycobacterium avium subsp. paratuberculosis
ccgccgagucgcgccg

SEQ ID NO: 2928409 - RNA, 13 nt, Mycobacterium avium subsp. paratuberculosis
ccgccgaucaaca

SEQ ID NO: 2928410 - RNA, 21 nt, Mycobacterium avium subsp. paratuberculosis
ccgccgaucaacaggcccagc

SEQ ID NO: 2928411 - RNA, 16 nt, Mycobacterium avium subsp. paratuberculosis
ccgccgaucgaucagc

SEQ ID NO: 2928412 - RNA, 18 nt, Mycobacterium avium subsp. paratuberculosis
ccgccgaucgaucagccg

SEQ ID NO: 2928413 - RNA, 16 nt, Mycobacterium avium subsp. paratuberculosis
ccgccgaucgugacgc

SEQ ID NO: 2928414 - RNA, 17 nt, Mycobacterium avium subsp. paratuberculosis
ccgccgaucgugacgcc

SEQ ID NO: 2928415 - RNA, 18 nt, Mycobacterium avium subsp. paratuberculosis
ccgccgaugacggcgcga

SEQ ID NO: 2928416 - RNA, 21 nt, Mycobacterium avium subsp. paratuberculosis
ccgccgaugaugguggcggcc

SEQ ID NO: 2928417 - RNA, 16 nt, Mycobacterium avium subsp. paratuberculosis
ccgccgaugcgcccgc

SEQ ID NO: 2928418 - RNA, 17 nt, Mycobacterium avium subsp. paratuberculosis
ccgccgaugcgcccgcu

SEQ ID NO: 2928419 - RNA, 18 nt, Mycobacterium avium subsp. paratuberculosis
ccgccgaugcgcccgcug

SEQ ID NO: 2928420 - RNA, 21 nt, Mycobacterium avium subsp. paratuberculosis
ccgccgauggacacgcugccg

SEQ ID NO: 2928421 - RNA, 13 nt, Mycobacterium avium subsp. paratuberculosis
ccgccgauggcga

SEQ ID NO: 2928422 - RNA, 20 nt, Mycobacterium avium subsp. paratuberculosis
ccgccgaugugaucggcggc

SEQ ID NO: 2928423 - RNA, 21 nt, Mycobacterium avium subsp. paratuberculosis
ccgccgaugugaucggcggcc

SEQ ID NO: 2928424 - RNA, 22 nt, Mycobacterium avium subsp. paratuberculosis
ccgccgaugugaucggcggcca

SEQ ID NO: 2928425 - RNA, 21 nt, Mycobacterium avium subsp. paratuberculosis
ccgccgauucaaccccgcgcg

SEQ ID NO: 2928426 - RNA, 16 nt, Mycobacterium avium subsp. paratuberculosis
ccgccgauuccggccg

SEQ ID NO: 2928427 - RNA, 19 nt, Mycobacterium avium subsp. paratuberculosis
ccgccgauuccggccggcc

SEQ ID NO: 2928428 - RNA, 17 nt, Mycobacterium avium subsp. paratuberculosis
ccgccgcaacagccggc

SEQ ID NO: 2928429 - RNA, 18 nt, Mycobacterium avium subsp. paratuberculosis
ccgccgcaacagccggcc

SEQ ID NO: 2928430 - RNA, 21 nt, Mycobacterium avium subsp. paratuberculosis
ccgccgcacacuuccgggaag

SEQ ID NO: 2928431 - RNA, 12 nt, Mycobacterium avium subsp. paratuberculosis
ccgccgcaccca

SEQ ID NO: 2928432 - RNA, 14 nt, Mycobacterium avium subsp. paratuberculosis
ccgccgcacccagc

SEQ ID NO: 2928433 - RNA, 17 nt, Mycobacterium avium subsp. paratuberculosis
ccgccgcacccagcggg

SEQ ID NO: 2928434 - RNA, 18 nt, Mycobacterium avium subsp. paratuberculosis
ccgccgcacccagcgggc

SEQ ID NO: 2928435 - RNA, 13 nt, Mycobacterium avium subsp. paratuberculosis
ccgccgcaccggc

SEQ ID NO: 2928436 - RNA, 14 nt, Mycobacterium avium subsp. paratuberculosis
ccgccgcaccggcc

SEQ ID NO: 2928437 - RNA, 18 nt, Mycobacterium avium subsp. paratuberculosis
ccgccgcaccggccggcc

SEQ ID NO: 2928438 - RNA, 17 nt, Mycobacterium avium subsp. paratuberculosis
ccgccgcaccgucgugc

SEQ ID NO: 2928439 - RNA, 19 nt, Mycobacterium avium subsp. paratuberculosis
ccgccgcaccucgccggcc

SEQ ID NO: 2928440 - RNA, 13 nt, Mycobacterium avium subsp. paratuberculosis
ccgccgcagcgca

SEQ ID NO: 2928441 - RNA, 15 nt, Mycobacterium avium subsp. paratuberculosis
ccgccgcgcgcggcc

SEQ ID NO: 2928442 - RNA, 17 nt, Mycobacterium avium subsp. paratuberculosis
ccgccgcgcgcggccac

SEQ ID NO: 2928443 - RNA, 18 nt, Mycobacterium avium subsp. paratuberculosis
ccgccgcgcgcggccacc

SEQ ID NO: 2928444 - RNA, 19 nt, Mycobacterium avium subsp. paratuberculosis
ccgccgcgcgcggccaccg

SEQ ID NO: 2928445 - RNA, 14 nt, Mycobacterium avium subsp. paratuberculosis
ccgccgcgcggccg

SEQ ID NO: 2928446 - RNA, 19 nt, Mycobacterium avium subsp. paratuberculosis
ccgccgcgcggccgggcuc

SEQ ID NO: 2928447 - RNA, 22 nt, Mycobacterium avium subsp. paratuberculosis
ccgccgcgcggccgggcucccg

SEQ ID NO: 2928448 - RNA, 23 nt, Mycobacterium avium subsp. paratuberculosis
ccgccgcgcggguacggcggccg

SEQ ID NO: 2928449 - RNA, 12 nt, Mycobacterium avium subsp. paratuberculosis
ccgccgcgcucg

SEQ ID NO: 2928450 - RNA, 14 nt, Mycobacterium avium subsp. paratuberculosis
ccgccgcgcucgca

SEQ ID NO: 2928451 - RNA, 13 nt, Mycobacterium avium subsp. paratuberculosis
ccgccgcgcucgg

SEQ ID NO: 2928452 - RNA, 14 nt, Mycobacterium avium subsp. paratuberculosis
ccgccgcgcucggc

SEQ ID NO: 2928453 - RNA, 17 nt, Mycobacterium avium subsp. paratuberculosis
ccgccgcggacauucug

SEQ ID NO: 2928454 - RNA, 18 nt, Mycobacterium avium subsp. paratuberculosis
ccgccgcggagcggcggu

SEQ ID NO: 2928455 - RNA, 19 nt, Mycobacterium avium subsp. paratuberculosis
ccgccgcggaucuucuccg

SEQ ID NO: 2928456 - RNA, 12 nt, Mycobacterium avium subsp. paratuberculosis
ccgccgcggcac

SEQ ID NO: 2928457 - RNA, 12 nt, Mycobacterium avium subsp. paratuberculosis
ccgccgcggcca

SEQ ID NO: 2928458 - RNA, 14 nt, Mycobacterium avium subsp. paratuberculosis
ccgccgcggccaca

SEQ ID NO: 2928459 - RNA, 13 nt, Mycobacterium avium subsp. paratuberculosis
ccgccgcggccag

SEQ ID NO: 2928460 - RNA, 17 nt, Mycobacterium avium subsp. paratuberculosis
ccgccgcggccaggucg

SEQ ID NO: 2928461 - RNA, 12 nt, Mycobacterium avium subsp. paratuberculosis
ccgccgcggccg

SEQ ID NO: 2928462 - RNA, 13 nt, Mycobacterium avium subsp. paratuberculosis
ccgccgcggccgc

SEQ ID NO: 2928463 - RNA, 14 nt, Mycobacterium avium subsp. paratuberculosis
ccgccgcggccgcg

SEQ ID NO: 2928464 - RNA, 17 nt, Mycobacterium avium subsp. paratuberculosis
ccgccgcggccgcgaug

SEQ ID NO: 2928465 - RNA, 18 nt, Mycobacterium avium subsp. paratuberculosis
ccgccgcggccgcggcgg

SEQ ID NO: 2928466 - RNA, 13 nt, Mycobacterium avium subsp. paratuberculosis
ccgccgcggcgac

SEQ ID NO: 2928467 - RNA, 17 nt, Mycobacterium avium subsp. paratuberculosis
ccgccgcggcgaccacg

SEQ ID NO: 2928468 - RNA, 14 nt, Mycobacterium avium subsp. paratuberculosis
ccgccgcggcgagc

SEQ ID NO: 2928469 - RNA, 15 nt, Mycobacterium avium subsp. paratuberculosis
ccgccgcggcgagcc

SEQ ID NO: 2928470 - RNA, 18 nt, Mycobacterium avium subsp. paratuberculosis
ccgccgcggcgagccggc

SEQ ID NO: 2928471 - RNA, 19 nt, Mycobacterium avium subsp. paratuberculosis
ccgccgcggcgagccggcc

SEQ ID NO: 2928472 - RNA, 20 nt, Mycobacterium avium subsp. paratuberculosis
ccgccgcggcgagccggccg

SEQ ID NO: 2928473 - RNA, 13 nt, Mycobacterium avium subsp. paratuberculosis
ccgccgcggcgcc

SEQ ID NO: 2928474 - RNA, 16 nt, Mycobacterium avium subsp. paratuberculosis
ccgccgcggcgcccgg

SEQ ID NO: 2928475 - RNA, 19 nt, Mycobacterium avium subsp. paratuberculosis
ccgccgcggcgcccggcgc

SEQ ID NO: 2928476 - RNA, 12 nt, Mycobacterium avium subsp. paratuberculosis
ccgccgcggcgg

SEQ ID NO: 2928477 - RNA, 14 nt, Mycobacterium avium subsp. paratuberculosis
ccgccgcggcggcc

SEQ ID NO: 2928478 - RNA, 15 nt, Mycobacterium avium subsp. paratuberculosis
ccgccgcggcggugg

SEQ ID NO: 2928479 - RNA, 20 nt, Mycobacterium avium subsp. paratuberculosis
ccgccgcggcgguggccugc

SEQ ID NO: 2928480 - RNA, 17 nt, Mycobacterium avium subsp. paratuberculosis
ccgccgcggcuccagca

SEQ ID NO: 2928481 - RNA, 20 nt, Mycobacterium avium subsp. paratuberculosis
ccgccgcggcuccagcagcg

SEQ ID NO: 2928482 - RNA, 14 nt, Mycobacterium avium subsp. paratuberculosis
ccgccgcgggaugc

SEQ ID NO: 2928483 - RNA, 12 nt, Mycobacterium avium subsp. paratuberculosis
ccgccgcgggcu

SEQ ID NO: 2928484 - RNA, 13 nt, Mycobacterium avium subsp. paratuberculosis
ccgccgcgggcuc

SEQ ID NO: 2928485 - RNA, 14 nt, Mycobacterium avium subsp. paratuberculosis
ccgccgcgggucgg

SEQ ID NO: 2928486 - RNA, 23 nt, Mycobacterium avium subsp. paratuberculosis
ccgccgcgggucggcgacggcgc

SEQ ID NO: 2928487 - RNA, 18 nt, Mycobacterium avium subsp. paratuberculosis
ccgccgcgguggguccgc

SEQ ID NO: 2928488 - RNA, 15 nt, Mycobacterium avium subsp. paratuberculosis
ccgccgcguacaccg

SEQ ID NO: 2928489 - RNA, 17 nt, Mycobacterium avium subsp. paratuberculosis
ccgccgcguacaccggc

SEQ ID NO: 2928490 - RNA, 20 nt, Mycobacterium avium subsp. paratuberculosis
ccgccgcguacaccggcuga

SEQ ID NO: 2928491 - RNA, 21 nt, Mycobacterium avium subsp. paratuberculosis
ccgccgcguacagccagcccg

SEQ ID NO: 2928492 - RNA, 20 nt, Mycobacterium avium subsp. paratuberculosis
ccgccgcguaggccaggacc

SEQ ID NO: 2928493 - RNA, 21 nt, Mycobacterium avium subsp. paratuberculosis
ccgccgcguaggccaggaccg

SEQ ID NO: 2928494 - RNA, 16 nt, Mycobacterium avium subsp. paratuberculosis
ccgccgcgucagcggc

SEQ ID NO: 2928495 - RNA, 15 nt, Mycobacterium avium subsp. paratuberculosis
ccgccgcgucgccgc

SEQ ID NO: 2928496 - RNA, 17 nt, Mycobacterium avium subsp. paratuberculosis
ccgccgcgucgccgccg

SEQ ID NO: 2928497 - RNA, 21 nt, Mycobacterium avium subsp. paratuberculosis
ccgccgcgucgccgccgggcg

SEQ ID NO: 2928498 - RNA, 21 nt, Mycobacterium avium subsp. paratuberculosis
ccgccgcgucggucagcgcca

SEQ ID NO: 2928499 - RNA, 22 nt, Mycobacterium avium subsp. paratuberculosis
ccgccgcgucggucagcgccac

SEQ ID NO: 2928500 - RNA, 16 nt, Mycobacterium avium subsp. paratuberculosis
ccgccgcgucgugccg

SEQ ID NO: 2928501 - RNA, 18 nt, Mycobacterium avium subsp. paratuberculosis
ccgccgcgucgugccgag

SEQ ID NO: 2928502 - RNA, 19 nt, Mycobacterium avium subsp. paratuberculosis
ccgccgcuagucgcccagc

SEQ ID NO: 2928503 - RNA, 13 nt, Mycobacterium avium subsp. paratuberculosis
ccgccgcucaccg

SEQ ID NO: 2928504 - RNA, 17 nt, Mycobacterium avium subsp. paratuberculosis
ccgccgcucaccgccga

SEQ ID NO: 2928505 - RNA, 18 nt, Mycobacterium avium subsp. paratuberculosis
ccgccgcucaccgccgag

SEQ ID NO: 2928506 - RNA, 22 nt, Mycobacterium avium subsp. paratuberculosis
ccgccgcucaccgccgagccgc

SEQ ID NO: 2928507 - RNA, 17 nt, Mycobacterium avium subsp. paratuberculosis
ccgccgcugacgcggcg

SEQ ID NO: 2928508 - RNA, 20 nt, Mycobacterium avium subsp. paratuberculosis
ccgccgcugacgcggcgggc

SEQ ID NO: 2928509 - RNA, 22 nt, Mycobacterium avium subsp. paratuberculosis
ccgccgcugacgcggcgggcau

SEQ ID NO: 2928510 - RNA, 23 nt, Mycobacterium avium subsp. paratuberculosis
ccgccgcugacgcggcgggcaua

SEQ ID NO: 2928511 - RNA, 14 nt, Mycobacterium avium subsp. paratuberculosis
ccgccgcugcagcu

SEQ ID NO: 2928512 - RNA, 16 nt, Mycobacterium avium subsp. paratuberculosis
ccgccgcugcagcugc

SEQ ID NO: 2928513 - RNA, 22 nt, Mycobacterium avium subsp. paratuberculosis
ccgccgcugcgcgcgcgaucgg

SEQ ID NO: 2928514 - RNA, 13 nt, Mycobacterium avium subsp. paratuberculosis
ccgccgcugucga

SEQ ID NO: 2928515 - RNA, 14 nt, Mycobacterium avium subsp. paratuberculosis
ccgccggaacggga

SEQ ID NO: 2928516 - RNA, 23 nt, Mycobacterium avium subsp. paratuberculosis
ccgccggaacgggaagaucgucg

SEQ ID NO: 2928517 - RNA, 16 nt, Mycobacterium avium subsp. paratuberculosis
ccgccggaacucggcc

SEQ ID NO: 2928518 - RNA, 18 nt, Mycobacterium avium subsp. paratuberculosis
ccgccggaacucggccgg

SEQ ID NO: 2928519 - RNA, 19 nt, Mycobacterium avium subsp. paratuberculosis
ccgccggaacucggccggc

SEQ ID NO: 2928520 - RNA, 14 nt, Mycobacterium avium subsp. paratuberculosis
ccgccggacaccac

SEQ ID NO: 2928521 - RNA, 16 nt, Mycobacterium avium subsp. paratuberculosis
ccgccggacaccaccg

SEQ ID NO: 2928522 - RNA, 18 nt, Mycobacterium avium subsp. paratuberculosis
ccgccggagaccagcagc

SEQ ID NO: 2928523 - RNA, 13 nt, Mycobacterium avium subsp. paratuberculosis
ccgccggagccga

SEQ ID NO: 2928524 - RNA, 16 nt, Mycobacterium avium subsp. paratuberculosis
ccgccggagccgaucg

SEQ ID NO: 2928525 - RNA, 17 nt, Mycobacterium avium subsp. paratuberculosis
ccgccggagccgaucgc

SEQ ID NO: 2928526 - RNA, 16 nt, Mycobacterium avium subsp. paratuberculosis
ccgccgggcggcgucc

SEQ ID NO: 2928527 - RNA, 19 nt, Mycobacterium avium subsp. paratuberculosis
ccgccgggcggcguccucg

SEQ ID NO: 2928528 - RNA, 22 nt, Mycobacterium avium subsp. paratuberculosis
ccgccgggcggcguccucgacc

SEQ ID NO: 2928529 - RNA, 13 nt, Mycobacterium avium subsp. paratuberculosis
ccgccgggcgggc

SEQ ID NO: 2928530 - RNA, 18 nt, Mycobacterium avium subsp. paratuberculosis
ccgccgggcgggccgcag

SEQ ID NO: 2928531 - RNA, 19 nt, Mycobacterium avium subsp. paratuberculosis
ccgccgggcgggccgcagc

SEQ ID NO: 2928532 - RNA, 21 nt, Mycobacterium avium subsp. paratuberculosis
ccgccgggcugaccgucgacc

SEQ ID NO: 2928533 - RNA, 21 nt, Mycobacterium avium subsp. paratuberculosis
ccgccgggcugagcugugccg

SEQ ID NO: 2928534 - RNA, 19 nt, Mycobacterium avium subsp. paratuberculosis
ccgccgggcuuccccaacc

SEQ ID NO: 2928535 - RNA, 22 nt, Mycobacterium avium subsp. paratuberculosis
ccgccggggacccgcaccggaa

SEQ ID NO: 2928536 - RNA, 12 nt, Mycobacterium avium subsp. paratuberculosis
ccgccggggccc

SEQ ID NO: 2928537 - RNA, 13 nt, Mycobacterium avium subsp. paratuberculosis
ccgccggggcccc

SEQ ID NO: 2928538 - RNA, 21 nt, Mycobacterium avium subsp. paratuberculosis
ccgccggggccccaacccccc

SEQ ID NO: 2928539 - RNA, 19 nt, Mycobacterium avium subsp. paratuberculosis
ccgccggggccggcgaugc

SEQ ID NO: 2928540 - RNA, 18 nt, Mycobacterium avium subsp. paratuberculosis
ccgccggggcgccgccga

SEQ ID NO: 2928541 - RNA, 14 nt, Mycobacterium avium subsp. paratuberculosis
ccgccggggcgggc

SEQ ID NO: 2928542 - RNA, 16 nt, Mycobacterium avium subsp. paratuberculosis
ccgccggggcgggcag

SEQ ID NO: 2928543 - RNA, 17 nt, Mycobacterium avium subsp. paratuberculosis
ccgccggggcgggcagc

SEQ ID NO: 2928544 - RNA, 21 nt, Mycobacterium avium subsp. paratuberculosis
ccgccgggggagucggggugc

SEQ ID NO: 2928545 - RNA, 23 nt, Mycobacterium avium subsp. paratuberculosis
ccgccgggggagucggggugcuc

SEQ ID NO: 2928546 - RNA, 17 nt, Mycobacterium avium subsp. paratuberculosis
ccgccggggugcaccgu

SEQ ID NO: 2928547 - RNA, 12 nt, Mycobacterium avium subsp. paratuberculosis
ccgccggggugu

SEQ ID NO: 2928548 - RNA, 21 nt, Mycobacterium avium subsp. paratuberculosis
ccgccggggugugcagcggga

SEQ ID NO: 2928549 - RNA, 22 nt, Mycobacterium avium subsp. paratuberculosis
ccgccggguccuugcgccccgg

SEQ ID NO: 2928550 - RNA, 14 nt, Mycobacterium avium subsp. paratuberculosis
ccgccggguggccg

SEQ ID NO: 2928551 - RNA, 16 nt, Mycobacterium avium subsp. paratuberculosis
ccgccggguggccgcc

SEQ ID NO: 2928552 - RNA, 18 nt, Mycobacterium avium subsp. paratuberculosis
ccgccggguggccgccac

SEQ ID NO: 2928553 - RNA, 19 nt, Mycobacterium avium subsp. paratuberculosis
ccgccggguggccgccacg

SEQ ID NO: 2928554 - RNA, 20 nt, Mycobacterium avium subsp. paratuberculosis
ccgccggguggccgccacgu

SEQ ID NO: 2928555 - RNA, 20 nt, Mycobacterium avium subsp. paratuberculosis
ccgccggucacggcgucggc

SEQ ID NO: 2928556 - RNA, 14 nt, Mycobacterium avium subsp. paratuberculosis
ccgccgguccagug

SEQ ID NO: 2928557 - RNA, 22 nt, Mycobacterium avium subsp. paratuberculosis
ccgccgguccagugccggcgag

SEQ ID NO: 2928558 - RNA, 22 nt, Mycobacterium avium subsp. paratuberculosis
ccgccggucgcccccucggccg

SEQ ID NO: 2928559 - RNA, 19 nt, Mycobacterium avium subsp. paratuberculosis
ccgccggugaccacgcuga

SEQ ID NO: 2928560 - RNA, 23 nt, Mycobacterium avium subsp. paratuberculosis
ccgccggugaucucccgugcggu

SEQ ID NO: 2928561 - RNA, 12 nt, Mycobacterium avium subsp. paratuberculosis
ccgccggugcca

SEQ ID NO: 2928562 - RNA, 19 nt, Mycobacterium avium subsp. paratuberculosis
ccgccggugccgacgauga

SEQ ID NO: 2928563 - RNA, 15 nt, Mycobacterium avium subsp. paratuberculosis
ccgccggugccguug

SEQ ID NO: 2928564 - RNA, 18 nt, Mycobacterium avium subsp. paratuberculosis
ccgccggugccguugauc

SEQ ID NO: 2928565 - RNA, 16 nt, Mycobacterium avium subsp. paratuberculosis
ccgccggugcgcagcu

SEQ ID NO: 2928566 - RNA, 22 nt, Mycobacterium avium subsp. paratuberculosis
ccgccggugcgcagcuugcucu

SEQ ID NO: 2928567 - RNA, 13 nt, Mycobacterium avium subsp. paratuberculosis
ccgccgguggaga

SEQ ID NO: 2928568 - RNA, 13 nt, Mycobacterium avium subsp. paratuberculosis
ccgccgguggccg

SEQ ID NO: 2928569 - RNA, 14 nt, Mycobacterium avium subsp. paratuberculosis
ccgccgguggccgc

SEQ ID NO: 2928570 - RNA, 15 nt, Mycobacterium avium subsp. paratuberculosis
ccgccgguggccgcg

SEQ ID NO: 2928571 - RNA, 16 nt, Mycobacterium avium subsp. paratuberculosis
ccgccgguggccgcgc

SEQ ID NO: 2928572 - RNA, 17 nt, Mycobacterium avium subsp. paratuberculosis
ccgccgguggccgcgcu

SEQ ID NO: 2928573 - RNA, 12 nt, Mycobacterium avium subsp. paratuberculosis
ccgccgguggcg

SEQ ID NO: 2928574 - RNA, 14 nt, Mycobacterium avium subsp. paratuberculosis
ccgccgguggcggc

SEQ ID NO: 2928575 - RNA, 16 nt, Mycobacterium avium subsp. paratuberculosis
ccgccgguggcggcga

SEQ ID NO: 2928576 - RNA, 16 nt, Mycobacterium avium subsp. paratuberculosis
ccgccggugucggcga

SEQ ID NO: 2928577 - RNA, 19 nt, Mycobacterium avium subsp. paratuberculosis
ccgccggugucggcgacca

SEQ ID NO: 2928578 - RNA, 19 nt, Mycobacterium avium subsp. paratuberculosis
ccgccgguugaucacccgg

SEQ ID NO: 2928579 - RNA, 13 nt, Mycobacterium avium subsp. paratuberculosis
ccgccguagccgg

SEQ ID NO: 2928580 - RNA, 16 nt, Mycobacterium avium subsp. paratuberculosis
ccgccguagccggcgg

SEQ ID NO: 2928581 - RNA, 15 nt, Mycobacterium avium subsp. paratuberculosis
ccgccguagcgccgg

SEQ ID NO: 2928582 - RNA, 14 nt, Mycobacterium avium subsp. paratuberculosis
ccgccgucaccgcc

SEQ ID NO: 2928583 - RNA, 17 nt, Mycobacterium avium subsp. paratuberculosis
ccgccgucaccgccagg

SEQ ID NO: 2928584 - RNA, 14 nt, Mycobacterium avium subsp. paratuberculosis
ccgccgucaucggc

SEQ ID NO: 2928585 - RNA, 20 nt, Mycobacterium avium subsp. paratuberculosis
ccgccgucaucggcggaagc

SEQ ID NO: 2928586 - RNA, 19 nt, Mycobacterium avium subsp. paratuberculosis
ccgccguccagcgucaccu

SEQ ID NO: 2928587 - RNA, 18 nt, Mycobacterium avium subsp. paratuberculosis
ccgccgucccaccggcga

SEQ ID NO: 2928588 - RNA, 21 nt, Mycobacterium avium subsp. paratuberculosis
ccgccgucccaccggcgaugu

SEQ ID NO: 2928589 - RNA, 16 nt, Mycobacterium avium subsp. paratuberculosis
ccgccguccccgcgcg

SEQ ID NO: 2928590 - RNA, 18 nt, Mycobacterium avium subsp. paratuberculosis
ccgccguccccgcgcggc

SEQ ID NO: 2928591 - RNA, 12 nt, Mycobacterium avium subsp. paratuberculosis
ccgccgucccgu

SEQ ID NO: 2928592 - RNA, 17 nt, Mycobacterium avium subsp. paratuberculosis
ccgccgucccgucacgg

SEQ ID NO: 2928593 - RNA, 16 nt, Mycobacterium avium subsp. paratuberculosis
ccgccgucccguccga

SEQ ID NO: 2928594 - RNA, 20 nt, Mycobacterium avium subsp. paratuberculosis
ccgccgucccguccgacggc

SEQ ID NO: 2928595 - RNA, 13 nt, Mycobacterium avium subsp. paratuberculosis
ccgccgucgacca

SEQ ID NO: 2928596 - RNA, 13 nt, Mycobacterium avium subsp. paratuberculosis
ccgccgucgacgc

SEQ ID NO: 2928597 - RNA, 17 nt, Mycobacterium avium subsp. paratuberculosis
ccgccgucgacgcgugc

SEQ ID NO: 2928598 - RNA, 12 nt, Mycobacterium avium subsp. paratuberculosis
ccgccgucgagu

SEQ ID NO: 2928599 - RNA, 19 nt, Mycobacterium avium subsp. paratuberculosis
ccgccgucgccaccaccgc

SEQ ID NO: 2928600 - RNA, 15 nt, Mycobacterium avium subsp. paratuberculosis
ccgccgucgcgccag

SEQ ID NO: 2928601 - RNA, 16 nt, Mycobacterium avium subsp. paratuberculosis
ccgccgucgcgccagg

SEQ ID NO: 2928602 - RNA, 23 nt, Mycobacterium avium subsp. paratuberculosis
ccgccgucgcgccaggaccagcg

SEQ ID NO: 2928603 - RNA, 15 nt, Mycobacterium avium subsp. paratuberculosis
ccgccgucggcaucc

SEQ ID NO: 2928604 - RNA, 13 nt, Mycobacterium avium subsp. paratuberculosis
ccgccgucggggc

SEQ ID NO: 2928605 - RNA, 21 nt, Mycobacterium avium subsp. paratuberculosis
ccgccgucggggcgucggcgg

SEQ ID NO: 2928606 - RNA, 22 nt, Mycobacterium avium subsp. paratuberculosis
ccgccgucggggcgucggcggc

SEQ ID NO: 2928607 - RNA, 13 nt, Mycobacterium avium subsp. paratuberculosis
ccgccgucggggu

SEQ ID NO: 2928608 - RNA, 15 nt, Mycobacterium avium subsp. paratuberculosis
ccgccgucgguguag

SEQ ID NO: 2928609 - RNA, 16 nt, Mycobacterium avium subsp. paratuberculosis
ccgccgucgguguagc

SEQ ID NO: 2928610 - RNA, 21 nt, Mycobacterium avium subsp. paratuberculosis
ccgccgucgguguagcgagug

SEQ ID NO: 2928611 - RNA, 18 nt, Mycobacterium avium subsp. paratuberculosis
ccgccuugcccggcucgg

SEQ ID NO: 2928612 - RNA, 18 nt, Mycobacterium avium subsp. paratuberculosis
ccgccuuggccacgucga

SEQ ID NO: 2928613 - RNA, 20 nt, Mycobacterium avium subsp. paratuberculosis
ccgccuuggccacgucgaag

SEQ ID NO: 2928614 - RNA, 15 nt, Mycobacterium avium subsp. paratuberculosis
ccgccuuggcgcgcu

SEQ ID NO: 2928615 - RNA, 14 nt, Mycobacterium avium subsp. paratuberculosis
ccgccuugggccgg

SEQ ID NO: 2928616 - RNA, 15 nt, Mycobacterium avium subsp. paratuberculosis
ccgccuugggccggu

SEQ ID NO: 2928617 - RNA, 19 nt, Mycobacterium avium subsp. paratuberculosis
ccgccuugggccggucggu

SEQ ID NO: 2928618 - RNA, 13 nt, Mycobacterium avium subsp. paratuberculosis
ccgcgaaaacagc

SEQ ID NO: 2928619 - RNA, 18 nt, Mycobacterium avium subsp. paratuberculosis
ccgcgaaaacagcgacca

SEQ ID NO: 2928620 - RNA, 20 nt, Mycobacterium avium subsp. paratuberculosis
ccgcgaaaacagcgaccagu

SEQ ID NO: 2928621 - RNA, 23 nt, Mycobacterium avium subsp. paratuberculosis
ccgcgaaaacagcgaccagucgg

SEQ ID NO: 2928622 - RNA, 16 nt, Mycobacterium avium subsp. paratuberculosis
ccgcgaaagcgucggc

SEQ ID NO: 2928623 - RNA, 21 nt, Mycobacterium avium subsp. paratuberculosis
ccgcgaaagugcaacuggcaa

SEQ ID NO: 2928624 - RNA, 22 nt, Mycobacterium avium subsp. paratuberculosis
ccgcgaaagugcuacugccgac

SEQ ID NO: 2928625 - RNA, 13 nt, Mycobacterium avium subsp. paratuberculosis
ccgcgaacacgcg

SEQ ID NO: 2928626 - RNA, 19 nt, Mycobacterium avium subsp. paratuberculosis
ccgcgaacaucgccagcaa

SEQ ID NO: 2928627 - RNA, 20 nt, Mycobacterium avium subsp. paratuberculosis
ccgcgaacaucgccagcaac

SEQ ID NO: 2928628 - RNA, 23 nt, Mycobacterium avium subsp. paratuberculosis
ccgcgaacaucgccagcaacgac

SEQ ID NO: 2928629 - RNA, 16 nt, Mycobacterium avium subsp. paratuberculosis
ccgcgaacgccucggc

SEQ ID NO: 2928630 - RNA, 19 nt, Mycobacterium avium subsp. paratuberculosis
ccgcgaacgccucggcgag

SEQ ID NO: 2928631 - RNA, 20 nt, Mycobacterium avium subsp. paratuberculosis
ccgcgaacgccucggcgagc

SEQ ID NO: 2928632 - RNA, 22 nt, Mycobacterium avium subsp. paratuberculosis
ccgcgaacgccucggcgagccg

SEQ ID NO: 2928633 - RNA, 19 nt, Mycobacterium avium subsp. paratuberculosis
ccgcgaacgccucguuggc

SEQ ID NO: 2928634 - RNA, 13 nt, Mycobacterium avium subsp. paratuberculosis
ccgcgaacggccc

SEQ ID NO: 2928635 - RNA, 15 nt, Mycobacterium avium subsp. paratuberculosis
ccgcgaacggcccgc

SEQ ID NO: 2928636 - RNA, 16 nt, Mycobacterium avium subsp. paratuberculosis
ccgcgaacggcccgcc

SEQ ID NO: 2928637 - RNA, 17 nt, Mycobacterium avium subsp. paratuberculosis
ccgcgaacggcccgccg

SEQ ID NO: 2928638 - RNA, 22 nt, Mycobacterium avium subsp. paratuberculosis
ccgcgaacgggugaccggcggc

SEQ ID NO: 2928639 - RNA, 20 nt, Mycobacterium avium subsp. paratuberculosis
ccgcgaacgggugcggcgcu

SEQ ID NO: 2928640 - RNA, 16 nt, Mycobacterium avium subsp. paratuberculosis
ccgcgaacucaggcgc

SEQ ID NO: 2928641 - RNA, 18 nt, Mycobacterium avium subsp. paratuberculosis
ccgcgaacucaggcgcgc

SEQ ID NO: 2928642 - RNA, 15 nt, Mycobacterium avium subsp. paratuberculosis
ccgcgaacucgucga

SEQ ID NO: 2928643 - RNA, 17 nt, Mycobacterium avium subsp. paratuberculosis
ccgcgaacucgucgaug

SEQ ID NO: 2928644 - RNA, 13 nt, Mycobacterium avium subsp. paratuberculosis
ccgcgaaggcggc

SEQ ID NO: 2928645 - RNA, 15 nt, Mycobacterium avium subsp. paratuberculosis
ccgcgaaggcggcgu

SEQ ID NO: 2928646 - RNA, 19 nt, Mycobacterium avium subsp. paratuberculosis
ccgcgaaggcggcgucgau

SEQ ID NO: 2928647 - RNA, 16 nt, Mycobacterium avium subsp. paratuberculosis
ccgcgaagguggcacg

SEQ ID NO: 2928648 - RNA, 21 nt, Mycobacterium avium subsp. paratuberculosis
ccgcgaaucgauaacgcgcgc

SEQ ID NO: 2928649 - RNA, 22 nt, Mycobacterium avium subsp. paratuberculosis
ccgcgaauugagguagucggcc

SEQ ID NO: 2928650 - RNA, 19 nt, Mycobacterium avium subsp. paratuberculosis
ccgcgaauuugguugcggu

SEQ ID NO: 2928651 - RNA, 19 nt, Mycobacterium avium subsp. paratuberculosis
ccgcgacaaggucgaccgc

SEQ ID NO: 2928652 - RNA, 17 nt, Mycobacterium avium subsp. paratuberculosis
ccgcgacacccgcgacg

SEQ ID NO: 2928653 - RNA, 14 nt, Mycobacterium avium subsp. paratuberculosis
ccgcgacacgccgc

SEQ ID NO: 2928654 - RNA, 15 nt, Mycobacterium avium subsp. paratuberculosis
ccgcgacacgccgcg

SEQ ID NO: 2928655 - RNA, 19 nt, Mycobacterium avium subsp. paratuberculosis
ccgcgacacgccgcgcauc

SEQ ID NO: 2928656 - RNA, 15 nt, Mycobacterium avium subsp. paratuberculosis
ccgcgacacgucgac

SEQ ID NO: 2928657 - RNA, 22 nt, Mycobacterium avium subsp. paratuberculosis
ccgcgacacgucgacacgccgg

SEQ ID NO: 2928658 - RNA, 14 nt, Mycobacterium avium subsp. paratuberculosis
ccgcgacagccgcc

SEQ ID NO: 2928659 - RNA, 21 nt, Mycobacterium avium subsp. paratuberculosis
ccgcgacagccgcccggcgcc

SEQ ID NO: 2928660 - RNA, 13 nt, Mycobacterium avium subsp. paratuberculosis
ccgcgacaucggc

SEQ ID NO: 2928661 - RNA, 15 nt, Mycobacterium avium subsp. paratuberculosis
ccgcgacaucggcgc

SEQ ID NO: 2928662 - RNA, 16 nt, Mycobacterium avium subsp. paratuberculosis
ccgcgacaucggcgcc

SEQ ID NO: 2928663 - RNA, 17 nt, Mycobacterium avium subsp. paratuberculosis
ccgcgacaucggcgccg

SEQ ID NO: 2928664 - RNA, 18 nt, Mycobacterium avium subsp. paratuberculosis
ccgcgacaucggcgccga

SEQ ID NO: 2928665 - RNA, 21 nt, Mycobacterium avium subsp. paratuberculosis
ccgcgacaucggcgccgacgg

SEQ ID NO: 2928666 - RNA, 18 nt, Mycobacterium avium subsp. paratuberculosis
ccgcgacaucggugaccg

SEQ ID NO: 2928667 - RNA, 22 nt, Mycobacterium avium subsp. paratuberculosis
ccgcgacaucggugaccgucgc

SEQ ID NO: 2928668 - RNA, 16 nt, Mycobacterium avium subsp. paratuberculosis
ccgcgaccacagcgcc

SEQ ID NO: 2928669 - RNA, 20 nt, Mycobacterium avium subsp. paratuberculosis
ccgcgaccacagcgccucgu

SEQ ID NO: 2928670 - RNA, 12 nt, Mycobacterium avium subsp. paratuberculosis
ccgcgaccacgc

SEQ ID NO: 2928671 - RNA, 17 nt, Mycobacterium avium subsp. paratuberculosis
ccgcgaccacgccgcgg

SEQ ID NO: 2928672 - RNA, 18 nt, Mycobacterium avium subsp. paratuberculosis
ccgcgaccacgccgcggu

SEQ ID NO: 2928673 - RNA, 22 nt, Mycobacterium avium subsp. paratuberculosis
ccgcgaccacgccgcggucgcu

SEQ ID NO: 2928674 - RNA, 15 nt, Mycobacterium avium subsp. paratuberculosis
ccgcgaccagcucgg

SEQ ID NO: 2928675 - RNA, 17 nt, Mycobacterium avium subsp. paratuberculosis
ccgcgaccagcucgggc

SEQ ID NO: 2928676 - RNA, 16 nt, Mycobacterium avium subsp. paratuberculosis
ccgcgacccaggccgc

SEQ ID NO: 2928677 - RNA, 17 nt, Mycobacterium avium subsp. paratuberculosis
ccgcgacccaggccgcc

SEQ ID NO: 2928678 - RNA, 13 nt, Mycobacterium avium subsp. paratuberculosis
ccgcgaccccgga

SEQ ID NO: 2928679 - RNA, 17 nt, Mycobacterium avium subsp. paratuberculosis
ccgcgaccccggaccgc

SEQ ID NO: 2928680 - RNA, 22 nt, Mycobacterium avium subsp. paratuberculosis
ccgcgaccccggaccgcggaac

SEQ ID NO: 2928681 - RNA, 17 nt, Mycobacterium avium subsp. paratuberculosis
ccgcgacccggccgagc

SEQ ID NO: 2928682 - RNA, 19 nt, Mycobacterium avium subsp. paratuberculosis
ccgcgacccggccgagcgc

SEQ ID NO: 2928683 - RNA, 22 nt, Mycobacterium avium subsp. paratuberculosis
ccgcgacccggccgagcgcgcc

SEQ ID NO: 2928684 - RNA, 16 nt, Mycobacterium avium subsp. paratuberculosis
ccgcgacccgggccgc

SEQ ID NO: 2928685 - RNA, 14 nt, Mycobacterium avium subsp. paratuberculosis
ccgcgaccgcagca

SEQ ID NO: 2928686 - RNA, 20 nt, Mycobacterium avium subsp. paratuberculosis
ccgcgaccgcagcaggcgga

SEQ ID NO: 2928687 - RNA, 13 nt, Mycobacterium avium subsp. paratuberculosis
ccgcgaccgccuc

SEQ ID NO: 2928688 - RNA, 14 nt, Mycobacterium avium subsp. paratuberculosis
ccgcgaccgccucg

SEQ ID NO: 2928689 - RNA, 22 nt, Mycobacterium avium subsp. paratuberculosis
ccgcgaccgguccgugccacgg

SEQ ID NO: 2928690 - RNA, 13 nt, Mycobacterium avium subsp. paratuberculosis
ccgcgaccgucag

SEQ ID NO: 2928691 - RNA, 20 nt, Mycobacterium avium subsp. paratuberculosis
ccgcgacgaacugccguuga

SEQ ID NO: 2928692 - RNA, 16 nt, Mycobacterium avium subsp. paratuberculosis
ccgcgacgacaccacc

SEQ ID NO: 2928693 - RNA, 20 nt, Mycobacterium avium subsp. paratuberculosis
ccgcgacgacaccaccgugc

SEQ ID NO: 2928694 - RNA, 18 nt, Mycobacterium avium subsp. paratuberculosis
ccgcgacgacaccgugug

SEQ ID NO: 2928695 - RNA, 24 nt, Mycobacterium avium subsp. paratuberculosis
ccgcgaguucgcgcacgcuggccg

SEQ ID NO: 2928696 - RNA, 23 nt, Mycobacterium avium subsp. paratuberculosis
ccgcgaguuguacccuucggccg

SEQ ID NO: 2928697 - RNA, 21 nt, Mycobacterium avium subsp. paratuberculosis
ccgcgaucaacaccgguccgg

SEQ ID NO: 2928698 - RNA, 13 nt, Mycobacterium avium subsp. paratuberculosis
ccgcgaucaccac

SEQ ID NO: 2928699 - RNA, 14 nt, Mycobacterium avium subsp. paratuberculosis
ccgcgaucaccacc

SEQ ID NO: 2928700 - RNA, 15 nt, Mycobacterium avium subsp. paratuberculosis
ccgcgaucaccaccc

SEQ ID NO: 2928701 - RNA, 18 nt, Mycobacterium avium subsp. paratuberculosis
ccgcgaucaccaccccgg

SEQ ID NO: 2928702 - RNA, 19 nt, Mycobacterium avium subsp. paratuberculosis
ccgcgaucaccaccccggu

SEQ ID NO: 2928703 - RNA, 23 nt, Mycobacterium avium subsp. paratuberculosis
ccgcgaucaccaccccggugccg

SEQ ID NO: 2928704 - RNA, 17 nt, Mycobacterium avium subsp. paratuberculosis
ccgcgaucaccgagaug

SEQ ID NO: 2928705 - RNA, 14 nt, Mycobacterium avium subsp. paratuberculosis
ccgcgaucagcccc

SEQ ID NO: 2928706 - RNA, 15 nt, Mycobacterium avium subsp. paratuberculosis
ccgcgaucagcucgu

SEQ ID NO: 2928707 - RNA, 21 nt, Mycobacterium avium subsp. paratuberculosis
ccgcgaucagggcccacagca

SEQ ID NO: 2928708 - RNA, 16 nt, Mycobacterium avium subsp. paratuberculosis
ccgcgaucagggccgc

SEQ ID NO: 2928709 - RNA, 17 nt, Mycobacterium avium subsp. paratuberculosis
ccgcgaucagggccgcg

SEQ ID NO: 2928710 - RNA, 21 nt, Mycobacterium avium subsp. paratuberculosis
ccgcgaucagggccgcggccg

SEQ ID NO: 2928711 - RNA, 22 nt, Mycobacterium avium subsp. paratuberculosis
ccgcgaucagggccgcggccgc

SEQ ID NO: 2928712 - RNA, 15 nt, Mycobacterium avium subsp. paratuberculosis
ccgcgauccagcgcu

SEQ ID NO: 2928713 - RNA, 16 nt, Mycobacterium avium subsp. paratuberculosis
ccgcgauccagcgcug

SEQ ID NO: 2928714 - RNA, 17 nt, Mycobacterium avium subsp. paratuberculosis
ccgcgauccagcgcugg

SEQ ID NO: 2928715 - RNA, 18 nt, Mycobacterium avium subsp. paratuberculosis
ccgcgauccagcgcuggc

SEQ ID NO: 2928716 - RNA, 20 nt, Mycobacterium avium subsp. paratuberculosis
ccgcgauccagcgcuggccg

SEQ ID NO: 2928717 - RNA, 15 nt, Mycobacterium avium subsp. paratuberculosis
ccgcgauccgggcau

SEQ ID NO: 2928718 - RNA, 17 nt, Mycobacterium avium subsp. paratuberculosis
ccgcgaucgccaacgcg

SEQ ID NO: 2928719 - RNA, 18 nt, Mycobacterium avium subsp. paratuberculosis
ccgcgaucgccagcgcgg

SEQ ID NO: 2928720 - RNA, 15 nt, Mycobacterium avium subsp. paratuberculosis
ccgcgaucgccgacg

SEQ ID NO: 2928721 - RNA, 17 nt, Mycobacterium avium subsp. paratuberculosis
ccgcgaucgccgacguc

SEQ ID NO: 2928722 - RNA, 22 nt, Mycobacterium avium subsp. paratuberculosis
ccgcgaucggauggugcccacc

SEQ ID NO: 2928723 - RNA, 15 nt, Mycobacterium avium subsp. paratuberculosis
ccgcgaucggcgcca

SEQ ID NO: 2928724 - RNA, 16 nt, Mycobacterium avium subsp. paratuberculosis
ccgcgaucucggcgga

SEQ ID NO: 2928725 - RNA, 21 nt, Mycobacterium avium subsp. paratuberculosis
ccgcgaucugcucggugucga

SEQ ID NO: 2928726 - RNA, 14 nt, Mycobacterium avium subsp. paratuberculosis
ccgcgaucuugccg

SEQ ID NO: 2928727 - RNA, 17 nt, Mycobacterium avium subsp. paratuberculosis
ccgcgaucuugccgccg

SEQ ID NO: 2928728 - RNA, 12 nt, Mycobacterium avium subsp. paratuberculosis
ccgcgaugaggc

SEQ ID NO: 2928729 - RNA, 13 nt, Mycobacterium avium subsp. paratuberculosis
ccgcgaugaucac

SEQ ID NO: 2928730 - RNA, 22 nt, Mycobacterium avium subsp. paratuberculosis
ccgcgaugauggcgucgacgug

SEQ ID NO: 2928731 - RNA, 23 nt, Mycobacterium avium subsp. paratuberculosis
ccgcgaugauggcgucgacgugc

SEQ ID NO: 2928732 - RNA, 18 nt, Mycobacterium avium subsp. paratuberculosis
ccgcgaugcaacaccgaa

SEQ ID NO: 2928733 - RNA, 19 nt, Mycobacterium avium subsp. paratuberculosis
ccgcgaugcaacaccgaac

SEQ ID NO: 2928734 - RNA, 20 nt, Mycobacterium avium subsp. paratuberculosis
ccgcgaugcaacaccgaacg

SEQ ID NO: 2928735 - RNA, 19 nt, Mycobacterium avium subsp. paratuberculosis
ccgcgaugcagaacagccg

SEQ ID NO: 2928736 - RNA, 20 nt, Mycobacterium avium subsp. paratuberculosis
ccgcgaugcagaacagccgg

SEQ ID NO: 2928737 - RNA, 22 nt, Mycobacterium avium subsp. paratuberculosis
ccgcgaugcagaacagccgguc

SEQ ID NO: 2928738 - RNA, 14 nt, Mycobacterium avium subsp. paratuberculosis
ccgcgaugcccgcc

SEQ ID NO: 2928739 - RNA, 15 nt, Mycobacterium avium subsp. paratuberculosis
ccgcgaugcccgccg

SEQ ID NO: 2928740 - RNA, 17 nt, Mycobacterium avium subsp. paratuberculosis
ccgcgaugcccgccggc

SEQ ID NO: 2928741 - RNA, 18 nt, Mycobacterium avium subsp. paratuberculosis
ccgcgaugcccgccggcc

SEQ ID NO: 2928742 - RNA, 14 nt, Mycobacterium avium subsp. paratuberculosis
ccgcgauggcacac

SEQ ID NO: 2928743 - RNA, 20 nt, Mycobacterium avium subsp. paratuberculosis
ccgcgauggcacacagcgug

SEQ ID NO: 2928744 - RNA, 23 nt, Mycobacterium avium subsp. paratuberculosis
ccgcgauggcacacagcgugacc

SEQ ID NO: 2928745 - RNA, 17 nt, Mycobacterium avium subsp. paratuberculosis
ccgcgauggcccgcgcg

SEQ ID NO: 2928746 - RNA, 19 nt, Mycobacterium avium subsp. paratuberculosis
ccgcgauggcccgcgcgau

SEQ ID NO: 2928747 - RNA, 14 nt, Mycobacterium avium subsp. paratuberculosis
ccgcgaugguggcg

SEQ ID NO: 2928748 - RNA, 18 nt, Mycobacterium avium subsp. paratuberculosis
ccgcgauguagcggacgg

SEQ ID NO: 2928749 - RNA, 20 nt, Mycobacterium avium subsp. paratuberculosis
ccgcgauguagcggacgggc

SEQ ID NO: 2928750 - RNA, 23 nt, Mycobacterium avium subsp. paratuberculosis
ccgcgauguagcggacgggccgc

SEQ ID NO: 2928751 - RNA, 19 nt, Mycobacterium avium subsp. paratuberculosis
ccgcgaugucggugggccg

SEQ ID NO: 2928752 - RNA, 21 nt, Mycobacterium avium subsp. paratuberculosis
ccgcgaugucggugggccgca

SEQ ID NO: 2928753 - RNA, 21 nt, Mycobacterium avium subsp. paratuberculosis
ccgcgauuuccgguugcggca

SEQ ID NO: 2928754 - RNA, 23 nt, Mycobacterium avium subsp. paratuberculosis
ccgcgauuuccgguugcggcagc

SEQ ID NO: 2928755 - RNA, 15 nt, Mycobacterium avium subsp. paratuberculosis
ccgcgcaaccgggcc

SEQ ID NO: 2928756 - RNA, 16 nt, Mycobacterium avium subsp. paratuberculosis
ccgcgcaaccgggccg

SEQ ID NO: 2928757 - RNA, 18 nt, Mycobacterium avium subsp. paratuberculosis
ccgcgcaaccgggccgca

SEQ ID NO: 2928758 - RNA, 20 nt, Mycobacterium avium subsp. paratuberculosis
ccgcgcaauacccgaccagc

SEQ ID NO: 2928759 - RNA, 23 nt, Mycobacterium avium subsp. paratuberculosis
ccgcgcaauacccgaccagcacc

SEQ ID NO: 2928760 - RNA, 21 nt, Mycobacterium avium subsp. paratuberculosis
ccgcgcaaucaaaaaccccgc

SEQ ID NO: 2928761 - RNA, 14 nt, Mycobacterium avium subsp. paratuberculosis
ccgcgcaccaccuc

SEQ ID NO: 2928762 - RNA, 23 nt, Mycobacterium avium subsp. paratuberculosis
ccgcgcaccaccucuucgugcac

SEQ ID NO: 2928763 - RNA, 16 nt, Mycobacterium avium subsp. paratuberculosis
ccgcgcaccacggugg

SEQ ID NO: 2928764 - RNA, 18 nt, Mycobacterium avium subsp. paratuberculosis
ccgcgcaccacgguggcg

SEQ ID NO: 2928765 - RNA, 19 nt, Mycobacterium avium subsp. paratuberculosis
ccgcgcaccacgguggcgc

SEQ ID NO: 2928766 - RNA, 23 nt, Mycobacterium avium subsp. paratuberculosis
ccgcgcaccccgaaccgcccgcc

SEQ ID NO: 2928767 - RNA, 14 nt, Mycobacterium avium subsp. paratuberculosis
ccgcgcacccggcc

SEQ ID NO: 2928768 - RNA, 20 nt, Mycobacterium avium subsp. paratuberculosis
ccgcgcaccgccccgcccuu

SEQ ID NO: 2928769 - RNA, 13 nt, Mycobacterium avium subsp. paratuberculosis
ccgcgcaccgcga

SEQ ID NO: 2928770 - RNA, 17 nt, Mycobacterium avium subsp. paratuberculosis
ccgcgcaccggcgcugg

SEQ ID NO: 2928771 - RNA, 15 nt, Mycobacterium avium subsp. paratuberculosis
ccgcgcaccgucauc

SEQ ID NO: 2928772 - RNA, 18 nt, Mycobacterium avium subsp. paratuberculosis
ccgcgcaccgucaucgcg

SEQ ID NO: 2928773 - RNA, 13 nt, Mycobacterium avium subsp. paratuberculosis
ccgcgcacgacgu

SEQ ID NO: 2928774 - RNA, 14 nt, Mycobacterium avium subsp. paratuberculosis
ccgcgcacgacgug

SEQ ID NO: 2928775 - RNA, 15 nt, Mycobacterium avium subsp. paratuberculosis
ccgcgcacgacgugg

SEQ ID NO: 2928776 - RNA, 17 nt, Mycobacterium avium subsp. paratuberculosis
ccgcgcacgcucgcggu

SEQ ID NO: 2928777 - RNA, 19 nt, Mycobacterium avium subsp. paratuberculosis
ccgcgcacgcucgcggugc

SEQ ID NO: 2928778 - RNA, 17 nt, Mycobacterium avium subsp. paratuberculosis
ccgcgcacucgaacggc

SEQ ID NO: 2928779 - RNA, 16 nt, Mycobacterium avium subsp. paratuberculosis
ccgcgccccgagcagc

SEQ ID NO: 2928780 - RNA, 17 nt, Mycobacterium avium subsp. paratuberculosis
ccgcgccccgagcagcg

SEQ ID NO: 2928781 - RNA, 19 nt, Mycobacterium avium subsp. paratuberculosis
ccgcgccccgagcagcggg

SEQ ID NO: 2928782 - RNA, 13 nt, Mycobacterium avium subsp. paratuberculosis
ccgcgccccggcc

SEQ ID NO: 2928783 - RNA, 16 nt, Mycobacterium avium subsp. paratuberculosis
ccgcgccccggcgcag

SEQ ID NO: 2928784 - RNA, 16 nt, Mycobacterium avium subsp. paratuberculosis
ccgcgccccggcgcgc

SEQ ID NO: 2928785 - RNA, 14 nt, Mycobacterium avium subsp. paratuberculosis
ccgcgccccggcgg

SEQ ID NO: 2928786 - RNA, 20 nt, Mycobacterium avium subsp. paratuberculosis
ccgcgcccgcauguucucga

SEQ ID NO: 2928787 - RNA, 14 nt, Mycobacterium avium subsp. paratuberculosis
ccgcgcccgccccg

SEQ ID NO: 2928788 - RNA, 15 nt, Mycobacterium avium subsp. paratuberculosis
ccgcgcccgccggcc

SEQ ID NO: 2928789 - RNA, 16 nt, Mycobacterium avium subsp. paratuberculosis
ccgcgcccgccggccc

SEQ ID NO: 2928790 - RNA, 12 nt, Mycobacterium avium subsp. paratuberculosis
ccgcgcccgcuc

SEQ ID NO: 2928791 - RNA, 17 nt, Mycobacterium avium subsp. paratuberculosis
ccgcgcccggcuucgcc

SEQ ID NO: 2928792 - RNA, 15 nt, Mycobacterium avium subsp. paratuberculosis
ccgcgcccgucgagc

SEQ ID NO: 2928793 - RNA, 15 nt, Mycobacterium avium subsp. paratuberculosis
ccgcgcccuggugca

SEQ ID NO: 2928794 - RNA, 15 nt, Mycobacterium avium subsp. paratuberculosis
ccgcgcccuucuucg

SEQ ID NO: 2928795 - RNA, 21 nt, Mycobacterium avium subsp. paratuberculosis
ccgcgccgaacaccacgccga

SEQ ID NO: 2928796 - RNA, 20 nt, Mycobacterium avium subsp. paratuberculosis
ccgcgccgaacgcaccaccg

SEQ ID NO: 2928797 - RNA, 21 nt, Mycobacterium avium subsp. paratuberculosis
ccgcgccgacagaugcggcac

SEQ ID NO: 2928798 - RNA, 18 nt, Mycobacterium avium subsp. paratuberculosis
ccgcgccgaccagcgcgu

SEQ ID NO: 2928799 - RNA, 19 nt, Mycobacterium avium subsp. paratuberculosis
ccgcgccgaccagcgcguu

SEQ ID NO: 2928800 - RNA, 14 nt, Mycobacterium avium subsp. paratuberculosis
ccgcgccgaccucg

SEQ ID NO: 2928801 - RNA, 21 nt, Mycobacterium avium subsp. paratuberculosis
ccgcgccgaccucgucggcgg

SEQ ID NO: 2928802 - RNA, 24 nt, Mycobacterium avium subsp. paratuberculosis
ccgcgccgaccucgucggcggugc

SEQ ID NO: 2928803 - RNA, 12 nt, Mycobacterium avium subsp. paratuberculosis
ccgcgccgacgc

SEQ ID NO: 2928804 - RNA, 13 nt, Mycobacterium avium subsp. paratuberculosis
ccgcgccgacgcc

SEQ ID NO: 2928805 - RNA, 16 nt, Mycobacterium avium subsp. paratuberculosis
ccgcgccgacgcccac

SEQ ID NO: 2928806 - RNA, 22 nt, Mycobacterium avium subsp. paratuberculosis
ccgcgccgacgcccacagcgcc

SEQ ID NO: 2928807 - RNA, 19 nt, Mycobacterium avium subsp. paratuberculosis
ccgcgccgagcaaccggga

SEQ ID NO: 2928808 - RNA, 15 nt, Mycobacterium avium subsp. paratuberculosis
ccgcgccgaggcgcu

SEQ ID NO: 2928809 - RNA, 17 nt, Mycobacterium avium subsp. paratuberculosis
ccgcgccgaggcgcucg

SEQ ID NO: 2928810 - RNA, 19 nt, Mycobacterium avium subsp. paratuberculosis
ccgcgccgaggcgcucggc

SEQ ID NO: 2928811 - RNA, 22 nt, Mycobacterium avium subsp. paratuberculosis
ccgcgccgaggcgcucggcccg

SEQ ID NO: 2928812 - RNA, 23 nt, Mycobacterium avium subsp. paratuberculosis
ccgcgccgaggcgcucggcccgc

SEQ ID NO: 2928813 - RNA, 15 nt, Mycobacterium avium subsp. paratuberculosis
ccgcgccgaucacga

SEQ ID NO: 2928814 - RNA, 16 nt, Mycobacterium avium subsp. paratuberculosis
ccgcgccgaucacgaa

SEQ ID NO: 2928815 - RNA, 12 nt, Mycobacterium avium subsp. paratuberculosis
ccgcgccgcauu

SEQ ID NO: 2928816 - RNA, 19 nt, Mycobacterium avium subsp. paratuberculosis
ccgcgccgccacaccucgg

SEQ ID NO: 2928817 - RNA, 11 nt, Mycobacterium avium subsp. paratuberculosis
ccgcgccgccc

SEQ ID NO: 2928818 - RNA, 14 nt, Mycobacterium avium subsp. paratuberculosis
ccgcgccgcccgga

SEQ ID NO: 2928819 - RNA, 14 nt, Mycobacterium avium subsp. paratuberculosis
ccgcgccgcccggc

SEQ ID NO: 2928820 - RNA, 13 nt, Mycobacterium avium subsp. paratuberculosis
ccgcgccgccgcc

SEQ ID NO: 2928821 - RNA, 17 nt, Mycobacterium avium subsp. paratuberculosis
ccgcgccgccgccagcc

SEQ ID NO: 2928822 - RNA, 18 nt, Mycobacterium avium subsp. paratuberculosis
ccgcgccgccgccagcca

SEQ ID NO: 2928823 - RNA, 22 nt, Mycobacterium avium subsp. paratuberculosis
ccgcgccgccgccagccagccg

SEQ ID NO: 2928824 - RNA, 15 nt, Mycobacterium avium subsp. paratuberculosis
ccgcgccgccgcccu

SEQ ID NO: 2928825 - RNA, 14 nt, Mycobacterium avium subsp. paratuberculosis
ccgcgccgccgcgu

SEQ ID NO: 2928826 - RNA, 17 nt, Mycobacterium avium subsp. paratuberculosis
ccgcgccgccggugacc

SEQ ID NO: 2928827 - RNA, 17 nt, Mycobacterium avium subsp. paratuberculosis
ccgcgccgccuucuugc

SEQ ID NO: 2928828 - RNA, 22 nt, Mycobacterium avium subsp. paratuberculosis
ccgcgccgccuucuugcgcggc

SEQ ID NO: 2928829 - RNA, 21 nt, Mycobacterium avium subsp. paratuberculosis
ccgcgccgcgaugcaacaccg

SEQ ID NO: 2928830 - RNA, 14 nt, Mycobacterium avium subsp. paratuberculosis
ccgcgccgcgccgc

SEQ ID NO: 2928831 - RNA, 16 nt, Mycobacterium avium subsp. paratuberculosis
ccgcgccgcgccgccu

SEQ ID NO: 2928832 - RNA, 15 nt, Mycobacterium avium subsp. paratuberculosis
ccgcgccgcggccag

SEQ ID NO: 2928833 - RNA, 16 nt, Mycobacterium avium subsp. paratuberculosis
ccgcgccgcggccagc

SEQ ID NO: 2928834 - RNA, 19 nt, Mycobacterium avium subsp. paratuberculosis
ccgcgccgcggccagcgcc

SEQ ID NO: 2928835 - RNA, 17 nt, Mycobacterium avium subsp. paratuberculosis
ccgcgccgcgucgucgu

SEQ ID NO: 2928836 - RNA, 20 nt, Mycobacterium avium subsp. paratuberculosis
ccgcgccgcgucgucgucga

SEQ ID NO: 2928837 - RNA, 13 nt, Mycobacterium avium subsp. paratuberculosis
ccgcgccggaguu

SEQ ID NO: 2928838 - RNA, 15 nt, Mycobacterium avium subsp. paratuberculosis
ccgcgccggaguuga

SEQ ID NO: 2928839 - RNA, 19 nt, Mycobacterium avium subsp. paratuberculosis
ccgcgccggcacucgucgu

SEQ ID NO: 2928840 - RNA, 12 nt, Mycobacterium avium subsp. paratuberculosis
ccgcgccggccu

SEQ ID NO: 2928841 - RNA, 17 nt, Mycobacterium avium subsp. paratuberculosis
ccgcgccggccuuggcc

SEQ ID NO: 2928842 - RNA, 13 nt, Mycobacterium avium subsp. paratuberculosis
ccgcgccggcgca

SEQ ID NO: 2928843 - RNA, 19 nt, Mycobacterium avium subsp. paratuberculosis
ccgcgccggcggcggcggu

SEQ ID NO: 2928844 - RNA, 22 nt, Mycobacterium avium subsp. paratuberculosis
ccgcgccggcggcggcgguccg

SEQ ID NO: 2928845 - RNA, 21 nt, Mycobacterium avium subsp. paratuberculosis
ccgcgccggcgugucggcgcc

SEQ ID NO: 2928846 - RNA, 15 nt, Mycobacterium avium subsp. paratuberculosis
ccgcgccgggcacca

SEQ ID NO: 2928847 - RNA, 16 nt, Mycobacterium avium subsp. paratuberculosis
ccgcgccgggcaccac

SEQ ID NO: 2928848 - RNA, 21 nt, Mycobacterium avium subsp. paratuberculosis
ccgcgccgggcaccaccaccg

SEQ ID NO: 2928849 - RNA, 19 nt, Mycobacterium avium subsp. paratuberculosis
ccgcgccgggcgaagucgc

SEQ ID NO: 2928850 - RNA, 14 nt, Mycobacterium avium subsp. paratuberculosis
ccgcgccgggcgga

SEQ ID NO: 2928851 - RNA, 13 nt, Mycobacterium avium subsp. paratuberculosis
ccgcgccgggcgu

SEQ ID NO: 2928852 - RNA, 18 nt, Mycobacterium avium subsp. paratuberculosis
ccgcgccggggugggcca

SEQ ID NO: 2928853 - RNA, 22 nt, Mycobacterium avium subsp. paratuberculosis
ccgcgccgggguguccagcggg

SEQ ID NO: 2928854 - RNA, 16 nt, Mycobacterium avium subsp. paratuberculosis
ccgcgccggucccgcg

SEQ ID NO: 2928855 - RNA, 22 nt, Mycobacterium avium subsp. paratuberculosis
ccgcgccggucccgcggcggcg

SEQ ID NO: 2928856 - RNA, 15 nt, Mycobacterium avium subsp. paratuberculosis
ccgcgccgguccggc

SEQ ID NO: 2928857 - RNA, 19 nt, Mycobacterium avium subsp. paratuberculosis
ccgcgccgguccggcccug

SEQ ID NO: 2928858 - RNA, 22 nt, Mycobacterium avium subsp. paratuberculosis
ccgcgccgguguucggcgccag

SEQ ID NO: 2928859 - RNA, 16 nt, Mycobacterium avium subsp. paratuberculosis
ccgcgccguagcggcc

SEQ ID NO: 2928860 - RNA, 21 nt, Mycobacterium avium subsp. paratuberculosis
ccgcgccguagcggcccaggu

SEQ ID NO: 2928861 - RNA, 23 nt, Mycobacterium avium subsp. paratuberculosis
ccgcgccgucgucgagcaccacc

SEQ ID NO: 2928862 - RNA, 15 nt, Mycobacterium avium subsp. paratuberculosis
ccgcgccgucgucgu

SEQ ID NO: 2928863 - RNA, 21 nt, Mycobacterium avium subsp. paratuberculosis
ccgcgccgucuuccgggccac

SEQ ID NO: 2928864 - RNA, 22 nt, Mycobacterium avium subsp. paratuberculosis
ccgcgcggagaugguggucacc

SEQ ID NO: 2928865 - RNA, 12 nt, Mycobacterium avium subsp. paratuberculosis
ccgcgcggcagg

SEQ ID NO: 2928866 - RNA, 16 nt, Mycobacterium avium subsp. paratuberculosis
ccgcgcggcagguugc

SEQ ID NO: 2928867 - RNA, 12 nt, Mycobacterium avium subsp. paratuberculosis
ccgcgcggccac

SEQ ID NO: 2928868 - RNA, 16 nt, Mycobacterium avium subsp. paratuberculosis
ccgcgcggccaccagc

SEQ ID NO: 2928869 - RNA, 17 nt, Mycobacterium avium subsp. paratuberculosis
ccgcgcggccaccagcg

SEQ ID NO: 2928870 - RNA, 18 nt, Mycobacterium avium subsp. paratuberculosis
ccgcgcggccaccagcgc

SEQ ID NO: 2928871 - RNA, 19 nt, Mycobacterium avium subsp. paratuberculosis
ccgcgcggccagcggcgcc

SEQ ID NO: 2928872 - RNA, 18 nt, Mycobacterium avium subsp. paratuberculosis
ccgcgcggcccgcgacgu

SEQ ID NO: 2928873 - RNA, 14 nt, Mycobacterium avium subsp. paratuberculosis
ccgcgcggccgcca

SEQ ID NO: 2928874 - RNA, 15 nt, Mycobacterium avium subsp. paratuberculosis
ccgcgcggccgccag

SEQ ID NO: 2928875 - RNA, 14 nt, Mycobacterium avium subsp. paratuberculosis
ccgcgcggccgccu

SEQ ID NO: 2928876 - RNA, 12 nt, Mycobacterium avium subsp. paratuberculosis
ccgcgcggccgg

SEQ ID NO: 2928877 - RNA, 14 nt, Mycobacterium avium subsp. paratuberculosis
ccgcgcggccgggc

SEQ ID NO: 2928878 - RNA, 16 nt, Mycobacterium avium subsp. paratuberculosis
ccgcgcggcgacgauc

SEQ ID NO: 2928879 - RNA, 13 nt, Mycobacterium avium subsp. paratuberculosis
ccgcgcggcgaug

SEQ ID NO: 2928880 - RNA, 14 nt, Mycobacterium avium subsp. paratuberculosis
ccgcgcggcgaugg

SEQ ID NO: 2928881 - RNA, 19 nt, Mycobacterium avium subsp. paratuberculosis
ccgcgcggcgauggccgac

SEQ ID NO: 2928882 - RNA, 21 nt, Mycobacterium avium subsp. paratuberculosis
ccgcgcggcgcagggcggccg

SEQ ID NO: 2928883 - RNA, 22 nt, Mycobacterium avium subsp. paratuberculosis
ccgcgcggcgcagggcggccgg

SEQ ID NO: 2928884 - RNA, 14 nt, Mycobacterium avium subsp. paratuberculosis
ccgcgcggcgccag

SEQ ID NO: 2928885 - RNA, 15 nt, Mycobacterium avium subsp. paratuberculosis
ccgcgcggcgccagc

SEQ ID NO: 2928886 - RNA, 17 nt, Mycobacterium avium subsp. paratuberculosis
ccgcgcggcgccagcgg

SEQ ID NO: 2928887 - RNA, 20 nt, Mycobacterium avium subsp. paratuberculosis
ccgcgcggcgccagcggccg

SEQ ID NO: 2928888 - RNA, 17 nt, Mycobacterium avium subsp. paratuberculosis
ccgcgcggcgcccccgc

SEQ ID NO: 2928889 - RNA, 14 nt, Mycobacterium avium subsp. paratuberculosis
ccgcgcggcggcca

SEQ ID NO: 2928890 - RNA, 16 nt, Mycobacterium avium subsp. paratuberculosis
ccgcgcggcggccaac

SEQ ID NO: 2928891 - RNA, 13 nt, Mycobacterium avium subsp. paratuberculosis
ccgcgcggcgggc

SEQ ID NO: 2928892 - RNA, 16 nt, Mycobacterium avium subsp. paratuberculosis
ccgcgcggcgggcccg

SEQ ID NO: 2928893 - RNA, 20 nt, Mycobacterium avium subsp. paratuberculosis
ccgcgcggcgggcccgcagc

SEQ ID NO: 2928894 - RNA, 20 nt, Mycobacterium avium subsp. paratuberculosis
ccgcgcggcgguccagcgag

SEQ ID NO: 2928895 - RNA, 21 nt, Mycobacterium avium subsp. paratuberculosis
ccgcgcggcgguccagcgagc

SEQ ID NO: 2928896 - RNA, 13 nt, Mycobacterium avium subsp. paratuberculosis
ccgcgcggcggug

SEQ ID NO: 2928897 - RNA, 16 nt, Mycobacterium avium subsp. paratuberculosis
ccgcgcggcggugacc

SEQ ID NO: 2928898 - RNA, 18 nt, Mycobacterium avium subsp. paratuberculosis
ccgcgcggcggugaccgg

SEQ ID NO: 2928899 - RNA, 15 nt, Mycobacterium avium subsp. paratuberculosis
ccgcgcggcggugcu

SEQ ID NO: 2928900 - RNA, 22 nt, Mycobacterium avium subsp. paratuberculosis
ccgcgcggcggugcucgcgccg

SEQ ID NO: 2928901 - RNA, 20 nt, Mycobacterium avium subsp. paratuberculosis
ccgcgcggcggugucggugc

SEQ ID NO: 2928902 - RNA, 18 nt, Mycobacterium avium subsp. paratuberculosis
ccgcgcggcgucggccug

SEQ ID NO: 2928903 - RNA, 22 nt, Mycobacterium avium subsp. paratuberculosis
ccgcgcggcgucggccugcccg

SEQ ID NO: 2928904 - RNA, 21 nt, Mycobacterium avium subsp. paratuberculosis
ccgcgcggcuaauucagcugc

SEQ ID NO: 2928905 - RNA, 21 nt, Mycobacterium avium subsp. paratuberculosis
ccgcgcggcuaguuggccggc

SEQ ID NO: 2928906 - RNA, 14 nt, Mycobacterium avium subsp. paratuberculosis
ccgcgcggcucaca

SEQ ID NO: 2928907 - RNA, 16 nt, Mycobacterium avium subsp. paratuberculosis
ccgcgcggcucacagc

SEQ ID NO: 2928908 - RNA, 17 nt, Mycobacterium avium subsp. paratuberculosis
ccgcgcggcucacagcg

SEQ ID NO: 2928909 - RNA, 21 nt, Mycobacterium avium subsp. paratuberculosis
ccgcgcggcucacagcgcggc

SEQ ID NO: 2928910 - RNA, 22 nt, Mycobacterium avium subsp. paratuberculosis
ccgcgcggcucacagcgcggcg

SEQ ID NO: 2928911 - RNA, 23 nt, Mycobacterium avium subsp. paratuberculosis
ccgcgcggcucacagcgcggcgg

SEQ ID NO: 2928912 - RNA, 24 nt, Mycobacterium avium subsp. paratuberculosis
ccgcgcggcucacagcgcggcggu

SEQ ID NO: 2928913 - RNA, 14 nt, Mycobacterium avium subsp. paratuberculosis
ccgcgcggcucgcg

SEQ ID NO: 2928914 - RNA, 20 nt, Mycobacterium avium subsp. paratuberculosis
ccgcgcggcucgcgggcgau

SEQ ID NO: 2928915 - RNA, 12 nt, Mycobacterium avium subsp. paratuberculosis
ccgcgcgggcca

SEQ ID NO: 2928916 - RNA, 13 nt, Mycobacterium avium subsp. paratuberculosis
ccgcgcgggccag

SEQ ID NO: 2928917 - RNA, 14 nt, Mycobacterium avium subsp. paratuberculosis
ccgcgcgggccagc

SEQ ID NO: 2928918 - RNA, 15 nt, Mycobacterium avium subsp. paratuberculosis
ccgcgcgggccagcg

SEQ ID NO: 2928919 - RNA, 22 nt, Mycobacterium avium subsp. paratuberculosis
ccgcgcgggccgccgacgucgu

SEQ ID NO: 2928920 - RNA, 14 nt, Mycobacterium avium subsp. paratuberculosis
ccgcgcgggcgacc

SEQ ID NO: 2928921 - RNA, 23 nt, Mycobacterium avium subsp. paratuberculosis
ccgcgcgggcgaccugcgggccc

SEQ ID NO: 2928922 - RNA, 15 nt, Mycobacterium avium subsp. paratuberculosis
ccgcgcgggggccgc

SEQ ID NO: 2928923 - RNA, 16 nt, Mycobacterium avium subsp. paratuberculosis
ccgcgcgggggccgcc

SEQ ID NO: 2928924 - RNA, 17 nt, Mycobacterium avium subsp. paratuberculosis
ccgcgcgggggccgccg

SEQ ID NO: 2928925 - RNA, 18 nt, Mycobacterium avium subsp. paratuberculosis
ccgcgcgggggccgccgc

SEQ ID NO: 2928926 - RNA, 19 nt, Mycobacterium avium subsp. paratuberculosis
ccgcgcgggggccgccgcg

SEQ ID NO: 2928927 - RNA, 21 nt, Mycobacterium avium subsp. paratuberculosis
ccgcgcggguacggcggccgc

SEQ ID NO: 2928928 - RNA, 21 nt, Mycobacterium avium subsp. paratuberculosis
ccgcgcggugcaccaggacgc

SEQ ID NO: 2928929 - RNA, 14 nt, Mycobacterium avium subsp. paratuberculosis
ccgcgcggugcccg

SEQ ID NO: 2928930 - RNA, 17 nt, Mycobacterium avium subsp. paratuberculosis
ccgcgcggugcccggaa

SEQ ID NO: 2928931 - RNA, 13 nt, Mycobacterium avium subsp. paratuberculosis
ccgcgcguagugc

SEQ ID NO: 2928932 - RNA, 20 nt, Mycobacterium avium subsp. paratuberculosis
ccgcgcguagugcucgcgca

SEQ ID NO: 2928933 - RNA, 13 nt, Mycobacterium avium subsp. paratuberculosis
ccgcgcgucgcgc

SEQ ID NO: 2928934 - RNA, 14 nt, Mycobacterium avium subsp. paratuberculosis
ccgcgcgucgcgca

SEQ ID NO: 2928935 - RNA, 17 nt, Mycobacterium avium subsp. paratuberculosis
ccgcgcgucgggcucgc

SEQ ID NO: 2928936 - RNA, 18 nt, Mycobacterium avium subsp. paratuberculosis
ccgcgcgucgggcucgcg

SEQ ID NO: 2928937 - RNA, 17 nt, Mycobacterium avium subsp. paratuberculosis
ccgcgcgucgggggugc

SEQ ID NO: 2928938 - RNA, 19 nt, Mycobacterium avium subsp. paratuberculosis
ccgcgcgucgggggugccg

SEQ ID NO: 2928939 - RNA, 22 nt, Mycobacterium avium subsp. paratuberculosis
ccgcgcgucgggggugccgcuc

SEQ ID NO: 2928940 - RNA, 22 nt, Mycobacterium avium subsp. paratuberculosis
ccgcgcgucucccccgaucagc

SEQ ID NO: 2928941 - RNA, 19 nt, Mycobacterium avium subsp. paratuberculosis
ccgcgcgugcagccgggcg

SEQ ID NO: 2928942 - RNA, 21 nt, Mycobacterium avium subsp. paratuberculosis
ccgcgcgugcagccgggcggc

SEQ ID NO: 2928943 - RNA, 16 nt, Mycobacterium avium subsp. paratuberculosis
ccgcgcgugcccgcgg

SEQ ID NO: 2928944 - RNA, 16 nt, Mycobacterium avium subsp. paratuberculosis
ccgcgcgugggccaac

SEQ ID NO: 2928945 - RNA, 12 nt, Mycobacterium avium subsp. paratuberculosis
ccgcgcgugguc

SEQ ID NO: 2928946 - RNA, 21 nt, Mycobacterium avium subsp. paratuberculosis
ccgcgcguggucccacaccac

SEQ ID NO: 2928947 - RNA, 22 nt, Mycobacterium avium subsp. paratuberculosis
ccgcgcguggucccacaccacc

SEQ ID NO: 2928948 - RNA, 21 nt, Mycobacterium avium subsp. paratuberculosis
ccgcgcguucgaguucgucga

SEQ ID NO: 2928949 - RNA, 22 nt, Mycobacterium avium subsp. paratuberculosis
ccgcggccacacuggcgugacg

SEQ ID NO: 2928950 - RNA, 13 nt, Mycobacterium avium subsp. paratuberculosis
ccgcggccaccac

SEQ ID NO: 2928951 - RNA, 17 nt, Mycobacterium avium subsp. paratuberculosis
ccgcggccaccaccgcc

SEQ ID NO: 2928952 - RNA, 18 nt, Mycobacterium avium subsp. paratuberculosis
ccgcggccaccaccgcca

SEQ ID NO: 2928953 - RNA, 22 nt, Mycobacterium avium subsp. paratuberculosis
ccgcggccaccaccgccacggc

SEQ ID NO: 2928954 - RNA, 13 nt, Mycobacterium avium subsp. paratuberculosis
ccgcggccaccgg

SEQ ID NO: 2928955 - RNA, 15 nt, Mycobacterium avium subsp. paratuberculosis
ccgcggccaccggga

SEQ ID NO: 2928956 - RNA, 22 nt, Mycobacterium avium subsp. paratuberculosis
ccgcggccaccgggaccgucgg

SEQ ID NO: 2928957 - RNA, 12 nt, Mycobacterium avium subsp. paratuberculosis
ccgcggccaccu

SEQ ID NO: 2928958 - RNA, 21 nt, Mycobacterium avium subsp. paratuberculosis
ccgcggccacgcucgggccgg

SEQ ID NO: 2928959 - RNA, 12 nt, Mycobacterium avium subsp. paratuberculosis
ccgcggccagcg

SEQ ID NO: 2928960 - RNA, 15 nt, Mycobacterium avium subsp. paratuberculosis
ccgcggccagcgagg

SEQ ID NO: 2928961 - RNA, 17 nt, Mycobacterium avium subsp. paratuberculosis
ccgcggccagcgaggug

SEQ ID NO: 2928962 - RNA, 14 nt, Mycobacterium avium subsp. paratuberculosis
ccgcggccagcgcc

SEQ ID NO: 2928963 - RNA, 14 nt, Mycobacterium avium subsp. paratuberculosis
ccgcggccagcugc

SEQ ID NO: 2928964 - RNA, 18 nt, Mycobacterium avium subsp. paratuberculosis
ccgcggccagcugcccgc

SEQ ID NO: 2928965 - RNA, 20 nt, Mycobacterium avium subsp. paratuberculosis
ccgcggccagcugcgacagc

SEQ ID NO: 2928966 - RNA, 12 nt, Mycobacterium avium subsp. paratuberculosis
ccgcggccaggu

SEQ ID NO: 2928967 - RNA, 15 nt, Mycobacterium avium subsp. paratuberculosis
ccgcggccaggucga

SEQ ID NO: 2928968 - RNA, 18 nt, Mycobacterium avium subsp. paratuberculosis
ccgcggccaggucgaggu

SEQ ID NO: 2928969 - RNA, 13 nt, Mycobacterium avium subsp. paratuberculosis
ccgcggcccggcc

SEQ ID NO: 2928970 - RNA, 17 nt, Mycobacterium avium subsp. paratuberculosis
ccgcggcccugcagcgc

SEQ ID NO: 2928971 - RNA, 18 nt, Mycobacterium avium subsp. paratuberculosis
ccgcggcccugcagcgcc

SEQ ID NO: 2928972 - RNA, 12 nt, Mycobacterium avium subsp. paratuberculosis
ccgcggccgccg

SEQ ID NO: 2928973 - RNA, 17 nt, Mycobacterium avium subsp. paratuberculosis
ccgcggccgccgccgcg

SEQ ID NO: 2928974 - RNA, 19 nt, Mycobacterium avium subsp. paratuberculosis
ccgcggccgccgccgcggc

SEQ ID NO: 2928975 - RNA, 16 nt, Mycobacterium avium subsp. paratuberculosis
ccgcggccgccgcgac

SEQ ID NO: 2928976 - RNA, 19 nt, Mycobacterium avium subsp. paratuberculosis
ccgcggccgccgcgacggc

SEQ ID NO: 2928977 - RNA, 13 nt, Mycobacterium avium subsp. paratuberculosis
ccgcggccgccuc

SEQ ID NO: 2928978 - RNA, 16 nt, Mycobacterium avium subsp. paratuberculosis
ccgcggccgccucccg

SEQ ID NO: 2928979 - RNA, 20 nt, Mycobacterium avium subsp. paratuberculosis
ccgcggccgccucccgcagc

SEQ ID NO: 2928980 - RNA, 22 nt, Mycobacterium avium subsp. paratuberculosis
ccgcggccgccucccgcagcgc

SEQ ID NO: 2928981 - RNA, 13 nt, Mycobacterium avium subsp. paratuberculosis
ccgcggccgccuu

SEQ ID NO: 2928982 - RNA, 23 nt, Mycobacterium avium subsp. paratuberculosis
ccgcggccgccuucacgaccggc

SEQ ID NO: 2928983 - RNA, 11 nt, Mycobacterium avium subsp. paratuberculosis
ccgcggccgcg

SEQ ID NO: 2928984 - RNA, 12 nt, Mycobacterium avium subsp. paratuberculosis
ccgcggccgcga

SEQ ID NO: 2928985 - RNA, 16 nt, Mycobacterium avium subsp. paratuberculosis
ccgcggccgcgacggu

SEQ ID NO: 2928986 - RNA, 13 nt, Mycobacterium avium subsp. paratuberculosis
ccgcggccgcgcg

SEQ ID NO: 2928987 - RNA, 14 nt, Mycobacterium avium subsp. paratuberculosis
ccgcggccgcgcgc

SEQ ID NO: 2928988 - RNA, 15 nt, Mycobacterium avium subsp. paratuberculosis
ccgcggccgcgcgcc

SEQ ID NO: 2928989 - RNA, 17 nt, Mycobacterium avium subsp. paratuberculosis
ccgcggccgcgcgcccg

SEQ ID NO: 2928990 - RNA, 15 nt, Mycobacterium avium subsp. paratuberculosis
ccgcggccgcggcgg

SEQ ID NO: 2928991 - RNA, 16 nt, Mycobacterium avium subsp. paratuberculosis
ccgcggccgcggcggg

SEQ ID NO: 2928992 - RNA, 17 nt, Mycobacterium avium subsp. paratuberculosis
ccgcggccgcggcgggc

SEQ ID NO: 2928993 - RNA, 12 nt, Mycobacterium avium subsp. paratuberculosis
ccgcggccgcgu

SEQ ID NO: 2928994 - RNA, 16 nt, Mycobacterium avium subsp. paratuberculosis
ccgcggccgcugcgcc

SEQ ID NO: 2928995 - RNA, 23 nt, Mycobacterium avium subsp. paratuberculosis
ccgcggccgcugcgcccagcgcg

SEQ ID NO: 2928996 - RNA, 11 nt, Mycobacterium avium subsp. paratuberculosis
ccgcggccggc

SEQ ID NO: 2928997 - RNA, 12 nt, Mycobacterium avium subsp. paratuberculosis
ccgcggccggca

SEQ ID NO: 2928998 - RNA, 13 nt, Mycobacterium avium subsp. paratuberculosis
ccgcggccggcac

SEQ ID NO: 2928999 - RNA, 20 nt, Mycobacterium avium subsp. paratuberculosis
ccgcggccggcacuaccgcc

SEQ ID NO: 2929000 - RNA, 12 nt, Mycobacterium avium subsp. paratuberculosis
ccgcggccggcc

SEQ ID NO: 2929001 - RNA, 15 nt, Mycobacterium avium subsp. paratuberculosis
ccgcggccggcccag

SEQ ID NO: 2929002 - RNA, 19 nt, Mycobacterium avium subsp. paratuberculosis
ccgcggccggcccagcgcg

SEQ ID NO: 2929003 - RNA, 14 nt, Mycobacterium avium subsp. paratuberculosis
ccgcggccggcggc

SEQ ID NO: 2929004 - RNA, 18 nt, Mycobacterium avium subsp. paratuberculosis
ccgcggccggugccacgg

SEQ ID NO: 2929005 - RNA, 14 nt, Mycobacterium avium subsp. paratuberculosis
ccgcggccgucguc

SEQ ID NO: 2929006 - RNA, 22 nt, Mycobacterium avium subsp. paratuberculosis
ccgcggccgucgucgugcacca

SEQ ID NO: 2929007 - RNA, 12 nt, Mycobacterium avium subsp. paratuberculosis
ccgcggccguug

SEQ ID NO: 2929008 - RNA, 15 nt, Mycobacterium avium subsp. paratuberculosis
ccgcggccucggcgu

SEQ ID NO: 2929009 - RNA, 18 nt, Mycobacterium avium subsp. paratuberculosis
ccgcggcgaauccgagca

SEQ ID NO: 2929010 - RNA, 22 nt, Mycobacterium avium subsp. paratuberculosis
ccgcggcgaauccgagcaucgg

SEQ ID NO: 2929011 - RNA, 13 nt, Mycobacterium avium subsp. paratuberculosis
ccgcggcgacacc

SEQ ID NO: 2929012 - RNA, 16 nt, Mycobacterium avium subsp. paratuberculosis
ccgcggcgacacccag

SEQ ID NO: 2929013 - RNA, 18 nt, Mycobacterium avium subsp. paratuberculosis
ccgcggcgacacccagcg

SEQ ID NO: 2929014 - RNA, 23 nt, Mycobacterium avium subsp. paratuberculosis
ccgcggcgaccacgaacaccggc

SEQ ID NO: 2929015 - RNA, 13 nt, Mycobacterium avium subsp. paratuberculosis
ccgcggcgaccgg

SEQ ID NO: 2929016 - RNA, 14 nt, Mycobacterium avium subsp. paratuberculosis
ccgcggcgaccggg

SEQ ID NO: 2929017 - RNA, 21 nt, Mycobacterium avium subsp. paratuberculosis
ccgcggcgaccggggcgguga

SEQ ID NO: 2929018 - RNA, 17 nt, Mycobacterium avium subsp. paratuberculosis
ccgcggcgacgucgugc

SEQ ID NO: 2929019 - RNA, 14 nt, Mycobacterium avium subsp. paratuberculosis
ccgcggcgagccgg

SEQ ID NO: 2929020 - RNA, 15 nt, Mycobacterium avium subsp. paratuberculosis
ccgcggcgaucgccg

SEQ ID NO: 2929021 - RNA, 17 nt, Mycobacterium avium subsp. paratuberculosis
ccgcggcgaucggcggu

SEQ ID NO: 2929022 - RNA, 21 nt, Mycobacterium avium subsp. paratuberculosis
ccgcggcgaucggcgguccgc

SEQ ID NO: 2929023 - RNA, 12 nt, Mycobacterium avium subsp. paratuberculosis
ccgcggcgauga

SEQ ID NO: 2929024 - RNA, 16 nt, Mycobacterium avium subsp. paratuberculosis
ccgcggcgaugaccgg

SEQ ID NO: 2929025 - RNA, 17 nt, Mycobacterium avium subsp. paratuberculosis
ccgcggcgauggcccgc

SEQ ID NO: 2929026 - RNA, 17 nt, Mycobacterium avium subsp. paratuberculosis
ccgcggcgauggugggc

SEQ ID NO: 2929027 - RNA, 21 nt, Mycobacterium avium subsp. paratuberculosis
ccgcggcgauggugggcagcc

SEQ ID NO: 2929028 - RNA, 13 nt, Mycobacterium avium subsp. paratuberculosis
ccgcggcgcaccc

SEQ ID NO: 2929029 - RNA, 13 nt, Mycobacterium avium subsp. paratuberculosis
ccgcggcgcccgg

SEQ ID NO: 2929030 - RNA, 17 nt, Mycobacterium avium subsp. paratuberculosis
ccgcggcgcccggaaug

SEQ ID NO: 2929031 - RNA, 12 nt, Mycobacterium avium subsp. paratuberculosis
ccgcggcgcccu

SEQ ID NO: 2929032 - RNA, 15 nt, Mycobacterium avium subsp. paratuberculosis
ccgcggcgcccucgc

SEQ ID NO: 2929033 - RNA, 17 nt, Mycobacterium avium subsp. paratuberculosis
ccgcggcgcccucgccg

SEQ ID NO: 2929034 - RNA, 18 nt, Mycobacterium avium subsp. paratuberculosis
ccgcggcgcccucgccgg

SEQ ID NO: 2929035 - RNA, 19 nt, Mycobacterium avium subsp. paratuberculosis
ccgcgggacacggcggcgc

SEQ ID NO: 2929036 - RNA, 16 nt, Mycobacterium avium subsp. paratuberculosis
ccgcgggaggcccagu

SEQ ID NO: 2929037 - RNA, 17 nt, Mycobacterium avium subsp. paratuberculosis
ccgcgggaguccacgcc

SEQ ID NO: 2929038 - RNA, 15 nt, Mycobacterium avium subsp. paratuberculosis
ccgcgggaucagcgu

SEQ ID NO: 2929039 - RNA, 17 nt, Mycobacterium avium subsp. paratuberculosis
ccgcgggaucagcgugu

SEQ ID NO: 2929040 - RNA, 21 nt, Mycobacterium avium subsp. paratuberculosis
ccgcgggaugcuuggucgcgg

SEQ ID NO: 2929041 - RNA, 13 nt, Mycobacterium avium subsp. paratuberculosis
ccgcgggcacggc

SEQ ID NO: 2929042 - RNA, 15 nt, Mycobacterium avium subsp. paratuberculosis
ccgcgggcacggcga

SEQ ID NO: 2929043 - RNA, 18 nt, Mycobacterium avium subsp. paratuberculosis
ccgcgggcagcagcuugg

SEQ ID NO: 2929044 - RNA, 13 nt, Mycobacterium avium subsp. paratuberculosis
ccgcgggcagcga

SEQ ID NO: 2929045 - RNA, 15 nt, Mycobacterium avium subsp. paratuberculosis
ccgcgggcagcgagc

SEQ ID NO: 2929046 - RNA, 17 nt, Mycobacterium avium subsp. paratuberculosis
ccgcgggcagcgagcac

SEQ ID NO: 2929047 - RNA, 19 nt, Mycobacterium avium subsp. paratuberculosis
ccgcgggccagacugcgca

SEQ ID NO: 2929048 - RNA, 12 nt, Mycobacterium avium subsp. paratuberculosis
ccgcgggccagc

SEQ ID NO: 2929049 - RNA, 13 nt, Mycobacterium avium subsp. paratuberculosis
ccgcgggccagca

SEQ ID NO: 2929050 - RNA, 15 nt, Mycobacterium avium subsp. paratuberculosis
ccgcgggccagcagc

SEQ ID NO: 2929051 - RNA, 18 nt, Mycobacterium avium subsp. paratuberculosis
ccgcgggccagcagccgg

SEQ ID NO: 2929052 - RNA, 13 nt, Mycobacterium avium subsp. paratuberculosis
ccgcgggccaggc

SEQ ID NO: 2929053 - RNA, 18 nt, Mycobacterium avium subsp. paratuberculosis
ccgcgggccaggcccacc

SEQ ID NO: 2929054 - RNA, 16 nt, Mycobacterium avium subsp. paratuberculosis
ccgcgggcccaccgcc

SEQ ID NO: 2929055 - RNA, 18 nt, Mycobacterium avium subsp. paratuberculosis
ccgcgggcccaccgccac

SEQ ID NO: 2929056 - RNA, 14 nt, Mycobacterium avium subsp. paratuberculosis
ccgcgggccggcac

SEQ ID NO: 2929057 - RNA, 21 nt, Mycobacterium avium subsp. paratuberculosis
ccgcgggccggcacuucgauc

SEQ ID NO: 2929058 - RNA, 20 nt, Mycobacterium avium subsp. paratuberculosis
ccgcgggcgauucccggaug

SEQ ID NO: 2929059 - RNA, 22 nt, Mycobacterium avium subsp. paratuberculosis
ccgcgggcgccguaggccgcgc

SEQ ID NO: 2929060 - RNA, 13 nt, Mycobacterium avium subsp. paratuberculosis
ccgcgggcgcgcc

SEQ ID NO: 2929061 - RNA, 20 nt, Mycobacterium avium subsp. paratuberculosis
ccgcgggcgggccgaaccgg

SEQ ID NO: 2929062 - RNA, 21 nt, Mycobacterium avium subsp. paratuberculosis
ccgcgggcggucgcgcagccg

SEQ ID NO: 2929063 - RNA, 15 nt, Mycobacterium avium subsp. paratuberculosis
ccgcgggcguggcgg

SEQ ID NO: 2929064 - RNA, 21 nt, Mycobacterium avium subsp. paratuberculosis
ccgcgggcguggcggucggug

SEQ ID NO: 2929065 - RNA, 22 nt, Mycobacterium avium subsp. paratuberculosis
ccgcgggcguucaucaccuggu

SEQ ID NO: 2929066 - RNA, 16 nt, Mycobacterium avium subsp. paratuberculosis
ccgcggggccggcgcu

SEQ ID NO: 2929067 - RNA, 23 nt, Mycobacterium avium subsp. paratuberculosis
ccgcggggccggcgcuggcgugc

SEQ ID NO: 2929068 - RNA, 19 nt, Mycobacterium avium subsp. paratuberculosis
ccgcggggcugggcgccau

SEQ ID NO: 2929069 - RNA, 21 nt, Mycobacterium avium subsp. paratuberculosis
ccgcggggcugggcgccaugg

SEQ ID NO: 2929070 - RNA, 18 nt, Mycobacterium avium subsp. paratuberculosis
ccgcgggggcggccgggc

SEQ ID NO: 2929071 - RNA, 21 nt, Mycobacterium avium subsp. paratuberculosis
ccgcgggggcggccgggccgc

SEQ ID NO: 2929072 - RNA, 23 nt, Mycobacterium avium subsp. paratuberculosis
ccgcgggggcggccgggccgcgg

SEQ ID NO: 2929073 - RNA, 17 nt, Mycobacterium avium subsp. paratuberculosis
ccgcggguacggucggc

SEQ ID NO: 2929074 - RNA, 21 nt, Mycobacterium avium subsp. paratuberculosis
ccgcggguagcccgucgacgg

SEQ ID NO: 2929075 - RNA, 23 nt, Mycobacterium avium subsp. paratuberculosis
ccgcggguauccgugaccccgga

SEQ ID NO: 2929076 - RNA, 19 nt, Mycobacterium avium subsp. paratuberculosis
ccgcgggucgauaugcugc

SEQ ID NO: 2929077 - RNA, 16 nt, Mycobacterium avium subsp. paratuberculosis
ccgcgggucgcggccc

SEQ ID NO: 2929078 - RNA, 18 nt, Mycobacterium avium subsp. paratuberculosis
ccgcgggucgcggcccac

SEQ ID NO: 2929079 - RNA, 21 nt, Mycobacterium avium subsp. paratuberculosis
ccgcgggucgcggcccaccgc

SEQ ID NO: 2929080 - RNA, 15 nt, Mycobacterium avium subsp. paratuberculosis
ccgcgggucggcgac

SEQ ID NO: 2929081 - RNA, 20 nt, Mycobacterium avium subsp. paratuberculosis
ccgcgggucgucgacgucgg

SEQ ID NO: 2929082 - RNA, 16 nt, Mycobacterium avium subsp. paratuberculosis
ccgcgggucgucgggc

SEQ ID NO: 2929083 - RNA, 23 nt, Mycobacterium avium subsp. paratuberculosis
ccgcgggugacgaucaccgcugc

SEQ ID NO: 2929084 - RNA, 13 nt, Mycobacterium avium subsp. paratuberculosis
ccgcgggugacgc

SEQ ID NO: 2929085 - RNA, 17 nt, Mycobacterium avium subsp. paratuberculosis
ccgcgggugacgcugac

SEQ ID NO: 2929086 - RNA, 23 nt, Mycobacterium avium subsp. paratuberculosis
ccgcgggugaggggcgcgcgccg

SEQ ID NO: 2929087 - RNA, 19 nt, Mycobacterium avium subsp. paratuberculosis
ccgcgggugcagccggauc

SEQ ID NO: 2929088 - RNA, 17 nt, Mycobacterium avium subsp. paratuberculosis
ccgcgggugcggcacgg

SEQ ID NO: 2929089 - RNA, 16 nt, Mycobacterium avium subsp. paratuberculosis
ccgcgggugcggccca

SEQ ID NO: 2929090 - RNA, 13 nt, Mycobacterium avium subsp. paratuberculosis
ccgcggguggccu

SEQ ID NO: 2929091 - RNA, 17 nt, Mycobacterium avium subsp. paratuberculosis
ccgcggguggccuucau

SEQ ID NO: 2929092 - RNA, 18 nt, Mycobacterium avium subsp. paratuberculosis
ccgcggguggcgccacag

SEQ ID NO: 2929093 - RNA, 20 nt, Mycobacterium avium subsp. paratuberculosis
ccgcggguggcgccacagcc

SEQ ID NO: 2929094 - RNA, 20 nt, Mycobacterium avium subsp. paratuberculosis
ccgcggguguuucggucggc

SEQ ID NO: 2929095 - RNA, 22 nt, Mycobacterium avium subsp. paratuberculosis
ccgcggguguuucggucggcgu

SEQ ID NO: 2929096 - RNA, 19 nt, Mycobacterium avium subsp. paratuberculosis
ccgcgguagacaccgccgu

SEQ ID NO: 2929097 - RNA, 16 nt, Mycobacterium avium subsp. paratuberculosis
ccgcgguagcggaccu

SEQ ID NO: 2929098 - RNA, 19 nt, Mycobacterium avium subsp. paratuberculosis
ccgcggucaccggucggug

SEQ ID NO: 2929099 - RNA, 18 nt, Mycobacterium avium subsp. paratuberculosis
ccgcggucaucgagccgg

SEQ ID NO: 2929100 - RNA, 19 nt, Mycobacterium avium subsp. paratuberculosis
ccgcggucaucgagccggu

SEQ ID NO: 2929101 - RNA, 21 nt, Mycobacterium avium subsp. paratuberculosis
ccgcggucaucgagccgguac

SEQ ID NO: 2929102 - RNA, 21 nt, Mycobacterium avium subsp. paratuberculosis
ccgcggucaugcgcgggcaau

SEQ ID NO: 2929103 - RNA, 14 nt, Mycobacterium avium subsp. paratuberculosis
ccgcggucgaccaa

SEQ ID NO: 2929104 - RNA, 22 nt, Mycobacterium avium subsp. paratuberculosis
ccgcggucgaccaagacggugg

SEQ ID NO: 2929105 - RNA, 18 nt, Mycobacterium avium subsp. paratuberculosis
ccgcggucgccccggccg

SEQ ID NO: 2929106 - RNA, 19 nt, Mycobacterium avium subsp. paratuberculosis
ccgcggucgcggcgccggu

SEQ ID NO: 2929107 - RNA, 17 nt, Mycobacterium avium subsp. paratuberculosis
ccgcggucgcugacccg

SEQ ID NO: 2929108 - RNA, 21 nt, Mycobacterium avium subsp. paratuberculosis
ccgcggucgcugacccgccgc

SEQ ID NO: 2929109 - RNA, 17 nt, Mycobacterium avium subsp. paratuberculosis
ccgcggucucgaccgac

SEQ ID NO: 2929110 - RNA, 17 nt, Mycobacterium avium subsp. paratuberculosis
ccgcggucugcgccagc

SEQ ID NO: 2929111 - RNA, 15 nt, Mycobacterium avium subsp. paratuberculosis
ccgcggugaccgccc

SEQ ID NO: 2929112 - RNA, 18 nt, Mycobacterium avium subsp. paratuberculosis
ccgcggugaccgcccgcu

SEQ ID NO: 2929113 - RNA, 17 nt, Mycobacterium avium subsp. paratuberculosis
ccgcggugaccgcgccg

SEQ ID NO: 2929114 - RNA, 18 nt, Mycobacterium avium subsp. paratuberculosis
ccgcggugaccgcgccgc

SEQ ID NO: 2929115 - RNA, 13 nt, Mycobacterium avium subsp. paratuberculosis
ccgcggugagcac

SEQ ID NO: 2929116 - RNA, 16 nt, Mycobacterium avium subsp. paratuberculosis
ccgcggugagcaccgg

SEQ ID NO: 2929117 - RNA, 18 nt, Mycobacterium avium subsp. paratuberculosis
ccgcggugagcaccggau

SEQ ID NO: 2929118 - RNA, 17 nt, Mycobacterium avium subsp. paratuberculosis
ccgcggugagcggccgc

SEQ ID NO: 2929119 - RNA, 16 nt, Mycobacterium avium subsp. paratuberculosis
ccgcguccugcaggca

SEQ ID NO: 2929120 - RNA, 21 nt, Mycobacterium avium subsp. paratuberculosis
ccgcguccugcaggcaggccg

SEQ ID NO: 2929121 - RNA, 23 nt, Mycobacterium avium subsp. paratuberculosis
ccgcguccugcaggcaggccggc

SEQ ID NO: 2929122 - RNA, 23 nt, Mycobacterium avium subsp. paratuberculosis
ccgcguccuucuccgccgggcug

SEQ ID NO: 2929123 - RNA, 20 nt, Mycobacterium avium subsp. paratuberculosis
ccgcgucgaccaccgccggc

SEQ ID NO: 2929124 - RNA, 14 nt, Mycobacterium avium subsp. paratuberculosis
ccgcgucgaccagc

SEQ ID NO: 2929125 - RNA, 15 nt, Mycobacterium avium subsp. paratuberculosis
ccgcgucgaccagcc

SEQ ID NO: 2929126 - RNA, 15 nt, Mycobacterium avium subsp. paratuberculosis
ccgcgucgacgccgc

SEQ ID NO: 2929127 - RNA, 18 nt, Mycobacterium avium subsp. paratuberculosis
ccgcgucgacgccgcugc

SEQ ID NO: 2929128 - RNA, 19 nt, Mycobacterium avium subsp. paratuberculosis
ccgcgucgacgccgcugcc

SEQ ID NO: 2929129 - RNA, 21 nt, Mycobacterium avium subsp. paratuberculosis
ccgcgucgaugcgggcccgca

SEQ ID NO: 2929130 - RNA, 18 nt, Mycobacterium avium subsp. paratuberculosis
ccgcgucgaugucgucgu

SEQ ID NO: 2929131 - RNA, 19 nt, Mycobacterium avium subsp. paratuberculosis
ccgcgucgaugucgucguu

SEQ ID NO: 2929132 - RNA, 22 nt, Mycobacterium avium subsp. paratuberculosis
ccgcgucgcagugccggugcag

SEQ ID NO: 2929133 - RNA, 13 nt, Mycobacterium avium subsp. paratuberculosis
ccgcgucgccgac

SEQ ID NO: 2929134 - RNA, 14 nt, Mycobacterium avium subsp. paratuberculosis
ccgcgucgccgacc

SEQ ID NO: 2929135 - RNA, 22 nt, Mycobacterium avium subsp. paratuberculosis
ccgcgucgccgaccagcaggac

SEQ ID NO: 2929136 - RNA, 13 nt, Mycobacterium avium subsp. paratuberculosis
ccgcgucgccgau

SEQ ID NO: 2929137 - RNA, 14 nt, Mycobacterium avium subsp. paratuberculosis
ccgcgucgccgauc

SEQ ID NO: 2929138 - RNA, 17 nt, Mycobacterium avium subsp. paratuberculosis
ccgcgucgccgaucgcc

SEQ ID NO: 2929139 - RNA, 20 nt, Mycobacterium avium subsp. paratuberculosis
ccgcgucgccgaucgcccgg

SEQ ID NO: 2929140 - RNA, 17 nt, Mycobacterium avium subsp. paratuberculosis
ccgcgucgccgccgggc

SEQ ID NO: 2929141 - RNA, 18 nt, Mycobacterium avium subsp. paratuberculosis
ccgcgucgccgccgggcg

SEQ ID NO: 2929142 - RNA, 14 nt, Mycobacterium avium subsp. paratuberculosis
ccgcgucgcgcagc

SEQ ID NO: 2929143 - RNA, 15 nt, Mycobacterium avium subsp. paratuberculosis
ccgcgucgcgcagca

SEQ ID NO: 2929144 - RNA, 17 nt, Mycobacterium avium subsp. paratuberculosis
ccgcgucgcgccgccgc

SEQ ID NO: 2929145 - RNA, 15 nt, Mycobacterium avium subsp. paratuberculosis
ccgcgucgcugccca

SEQ ID NO: 2929146 - RNA, 15 nt, Mycobacterium avium subsp. paratuberculosis
ccgcgucggaccccg

SEQ ID NO: 2929147 - RNA, 15 nt, Mycobacterium avium subsp. paratuberculosis
ccgcgucggccccca

SEQ ID NO: 2929148 - RNA, 12 nt, Mycobacterium avium subsp. paratuberculosis
ccgcgucggcgc

SEQ ID NO: 2929149 - RNA, 13 nt, Mycobacterium avium subsp. paratuberculosis
ccgcgucggcgcc

SEQ ID NO: 2929150 - RNA, 14 nt, Mycobacterium avium subsp. paratuberculosis
ccgcgucggcgccg

SEQ ID NO: 2929151 - RNA, 15 nt, Mycobacterium avium subsp. paratuberculosis
ccgcgucggcgccgu

SEQ ID NO: 2929152 - RNA, 23 nt, Mycobacterium avium subsp. paratuberculosis
ccgcgucggcgcuggccagcgcg

SEQ ID NO: 2929153 - RNA, 21 nt, Mycobacterium avium subsp. paratuberculosis
ccgcgucggcggcggcggccg

SEQ ID NO: 2929154 - RNA, 20 nt, Mycobacterium avium subsp. paratuberculosis
ccgcgucggcggucgccagc

SEQ ID NO: 2929155 - RNA, 17 nt, Mycobacterium avium subsp. paratuberculosis
ccgcgucggucagcgcc

SEQ ID NO: 2929156 - RNA, 19 nt, Mycobacterium avium subsp. paratuberculosis
ccgcgucggucagcgccac

SEQ ID NO: 2929157 - RNA, 13 nt, Mycobacterium avium subsp. paratuberculosis
ccgcgucgucauc

SEQ ID NO: 2929158 - RNA, 18 nt, Mycobacterium avium subsp. paratuberculosis
ccgcgucgucgucgaccg

SEQ ID NO: 2929159 - RNA, 20 nt, Mycobacterium avium subsp. paratuberculosis
ccgcgucgucgucgaccguc

SEQ ID NO: 2929160 - RNA, 18 nt, Mycobacterium avium subsp. paratuberculosis
ccgcgucgugccgagcgu

SEQ ID NO: 2929161 - RNA, 18 nt, Mycobacterium avium subsp. paratuberculosis
ccgcgucguggcccugcu

SEQ ID NO: 2929162 - RNA, 19 nt, Mycobacterium avium subsp. paratuberculosis
ccgcgucguggcccugcuc

SEQ ID NO: 2929163 - RNA, 23 nt, Mycobacterium avium subsp. paratuberculosis
ccgcgucuuggacgcccgcgacc

SEQ ID NO: 2929164 - RNA, 13 nt, Mycobacterium avium subsp. paratuberculosis
ccgcgugaaugcc

SEQ ID NO: 2929165 - RNA, 14 nt, Mycobacterium avium subsp. paratuberculosis
ccgcgugaaugccc

SEQ ID NO: 2929166 - RNA, 17 nt, Mycobacterium avium subsp. paratuberculosis
ccgcgugacaagccggc

SEQ ID NO: 2929167 - RNA, 19 nt, Mycobacterium avium subsp. paratuberculosis
ccgcgugacaagccggcgu

SEQ ID NO: 2929168 - RNA, 23 nt, Mycobacterium avium subsp. paratuberculosis
ccgcgugacaagccggcgucgau

SEQ ID NO: 2929169 - RNA, 14 nt, Mycobacterium avium subsp. paratuberculosis
ccgcgugacagggg

SEQ ID NO: 2929170 - RNA, 14 nt, Mycobacterium avium subsp. paratuberculosis
ccgcgugacggccg

SEQ ID NO: 2929171 - RNA, 15 nt, Mycobacterium avium subsp. paratuberculosis
ccgcgugacggccgc

SEQ ID NO: 2929172 - RNA, 17 nt, Mycobacterium avium subsp. paratuberculosis
ccgcgugacggccgcgg

SEQ ID NO: 2929173 - RNA, 18 nt, Mycobacterium avium subsp. paratuberculosis
ccgcgugacggccgcggc

SEQ ID NO: 2929174 - RNA, 19 nt, Mycobacterium avium subsp. paratuberculosis
ccgcgugacggccgcggcg

SEQ ID NO: 2929175 - RNA, 20 nt, Mycobacterium avium subsp. paratuberculosis
ccgcgugacggccgcggcgc

SEQ ID NO: 2929176 - RNA, 22 nt, Mycobacterium avium subsp. paratuberculosis
ccgcgugacggccgcggcgcgg

SEQ ID NO: 2929177 - RNA, 12 nt, Mycobacterium avium subsp. paratuberculosis
ccgcgugcaccu

SEQ ID NO: 2929178 - RNA, 14 nt, Mycobacterium avium subsp. paratuberculosis
ccgcguggccgcca

SEQ ID NO: 2929179 - RNA, 17 nt, Mycobacterium avium subsp. paratuberculosis
ccgcguggccucccggu

SEQ ID NO: 2929180 - RNA, 18 nt, Mycobacterium avium subsp. paratuberculosis
ccgcguggcgcacagcgu

SEQ ID NO: 2929181 - RNA, 19 nt, Mycobacterium avium subsp. paratuberculosis
ccgcgugugcccgccucgc

SEQ ID NO: 2929182 - RNA, 20 nt, Mycobacterium avium subsp. paratuberculosis
ccgcguucacccgcgcccgc

SEQ ID NO: 2929183 - RNA, 19 nt, Mycobacterium avium subsp. paratuberculosis
ccgcguuccaggaccugac

SEQ ID NO: 2929184 - RNA, 15 nt, Mycobacterium avium subsp. paratuberculosis
ccgcguuccccggcg

SEQ ID NO: 2929185 - RNA, 18 nt, Mycobacterium avium subsp. paratuberculosis
ccgcguuccccggcgugg

SEQ ID NO: 2929186 - RNA, 16 nt, Mycobacterium avium subsp. paratuberculosis
ccgcguucggcggcgc

SEQ ID NO: 2929187 - RNA, 19 nt, Mycobacterium avium subsp. paratuberculosis
ccgcguucggcggcgcgcu

SEQ ID NO: 2929188 - RNA, 16 nt, Mycobacterium avium subsp. paratuberculosis
ccgcguugaucagcgc

SEQ ID NO: 2929189 - RNA, 19 nt, Mycobacterium avium subsp. paratuberculosis
ccgcguugaucagcgccag

SEQ ID NO: 2929190 - RNA, 14 nt, Mycobacterium avium subsp. paratuberculosis
ccgcguugcggcgc

SEQ ID NO: 2929191 - RNA, 17 nt, Mycobacterium avium subsp. paratuberculosis
ccgcguugcggcgcagc

SEQ ID NO: 2929192 - RNA, 20 nt, Mycobacterium avium subsp. paratuberculosis
ccgcguugcggcgcagcguc

SEQ ID NO: 2929193 - RNA, 20 nt, Mycobacterium avium subsp. paratuberculosis
ccgcguuggccagcgccucc

SEQ ID NO: 2929194 - RNA, 13 nt, Mycobacterium avium subsp. paratuberculosis
ccgcguuggccgc

SEQ ID NO: 2929195 - RNA, 14 nt, Mycobacterium avium subsp. paratuberculosis
ccgcguuggccgcc

SEQ ID NO: 2929196 - RNA, 16 nt, Mycobacterium avium subsp. paratuberculosis
ccgcguuggccgccac

SEQ ID NO: 2929197 - RNA, 17 nt, Mycobacterium avium subsp. paratuberculosis
ccgcguuggccgccacg

SEQ ID NO: 2929198 - RNA, 14 nt, Mycobacterium avium subsp. paratuberculosis
ccgcguuggcgccg

SEQ ID NO: 2929199 - RNA, 16 nt, Mycobacterium avium subsp. paratuberculosis
ccgcguuggcgccgac

SEQ ID NO: 2929200 - RNA, 19 nt, Mycobacterium avium subsp. paratuberculosis
ccgcguuggcgccgacguc

SEQ ID NO: 2929201 - RNA, 20 nt, Mycobacterium avium subsp. paratuberculosis
ccgcguugucgaccaccagg

SEQ ID NO: 2929202 - RNA, 21 nt, Mycobacterium avium subsp. paratuberculosis
ccgcguugucgaccaccaggu

SEQ ID NO: 2929203 - RNA, 15 nt, Mycobacterium avium subsp. paratuberculosis
ccgcguugucggcga

SEQ ID NO: 2929204 - RNA, 12 nt, Mycobacterium avium subsp. paratuberculosis
ccgcucggcgau

SEQ ID NO: 2929205 - RNA, 13 nt, Mycobacterium avium subsp. paratuberculosis
ccgcucggcgauc

SEQ ID NO: 2929206 - RNA, 15 nt, Mycobacterium avium subsp. paratuberculosis
ccgcucggcgaucug

SEQ ID NO: 2929207 - RNA, 15 nt, Mycobacterium avium subsp. paratuberculosis
ccgcucggcgcucca

SEQ ID NO: 2929208 - RNA, 18 nt, Mycobacterium avium subsp. paratuberculosis
ccgcucggcgcuccagcg

SEQ ID NO: 2929209 - RNA, 21 nt, Mycobacterium avium subsp. paratuberculosis
ccgcucggcgcuccagcgggc

SEQ ID NO: 2929210 - RNA, 11 nt, Mycobacterium avium subsp. paratuberculosis
ccgcucggcgg

SEQ ID NO: 2929211 - RNA, 14 nt, Mycobacterium avium subsp. paratuberculosis
ccgcucggcggcgc

SEQ ID NO: 2929212 - RNA, 15 nt, Mycobacterium avium subsp. paratuberculosis
ccgcucggcggcgcc

SEQ ID NO: 2929213 - RNA, 19 nt, Mycobacterium avium subsp. paratuberculosis
ccgcucggcggcgccgucg

SEQ ID NO: 2929214 - RNA, 12 nt, Mycobacterium avium subsp. paratuberculosis
ccgcucggcggg

SEQ ID NO: 2929215 - RNA, 20 nt, Mycobacterium avium subsp. paratuberculosis
ccgcucgggcccgcgcaccg

SEQ ID NO: 2929216 - RNA, 19 nt, Mycobacterium avium subsp. paratuberculosis
ccgcucgggcgugcgcgug

SEQ ID NO: 2929217 - RNA, 18 nt, Mycobacterium avium subsp. paratuberculosis
ccgcucggggaucccgaa

SEQ ID NO: 2929218 - RNA, 19 nt, Mycobacterium avium subsp. paratuberculosis
ccgcucgggugucgccgag

SEQ ID NO: 2929219 - RNA, 23 nt, Mycobacterium avium subsp. paratuberculosis
ccgcucgggugucgccgagccgc

SEQ ID NO: 2929220 - RNA, 23 nt, Mycobacterium avium subsp. paratuberculosis
ccgcucguaacgccacggcggcc

SEQ ID NO: 2929221 - RNA, 13 nt, Mycobacterium avium subsp. paratuberculosis
ccgcucgucgagu

SEQ ID NO: 2929222 - RNA, 14 nt, Mycobacterium avium subsp. paratuberculosis
ccgcucgucgaguc

SEQ ID NO: 2929223 - RNA, 16 nt, Mycobacterium avium subsp. paratuberculosis
ccgcucgucggccagc

SEQ ID NO: 2929224 - RNA, 18 nt, Mycobacterium avium subsp. paratuberculosis
ccgcucgucggccagcga

SEQ ID NO: 2929225 - RNA, 14 nt, Mycobacterium avium subsp. paratuberculosis
ccgcucgucgggaa

SEQ ID NO: 2929226 - RNA, 16 nt, Mycobacterium avium subsp. paratuberculosis
ccgcucgucgggcaca

SEQ ID NO: 2929227 - RNA, 20 nt, Mycobacterium avium subsp. paratuberculosis
ccgcugaaagcucgcgucga

SEQ ID NO: 2929228 - RNA, 15 nt, Mycobacterium avium subsp. paratuberculosis
ccgcugaacgggcag

SEQ ID NO: 2929229 - RNA, 18 nt, Mycobacterium avium subsp. paratuberculosis
ccgcugaacgggcagcca

SEQ ID NO: 2929230 - RNA, 16 nt, Mycobacterium avium subsp. paratuberculosis
ccgcugaagccgaacg

SEQ ID NO: 2929231 - RNA, 23 nt, Mycobacterium avium subsp. paratuberculosis
ccgcugaagccgaacgcgcuguc

SEQ ID NO: 2929232 - RNA, 18 nt, Mycobacterium avium subsp. paratuberculosis
ccgcugacaaagcacaac

SEQ ID NO: 2929233 - RNA, 22 nt, Mycobacterium avium subsp. paratuberculosis
ccgcugaccaggaagaugccga

SEQ ID NO: 2929234 - RNA, 19 nt, Mycobacterium avium subsp. paratuberculosis
ccgcugaccaggccgauga

SEQ ID NO: 2929235 - RNA, 22 nt, Mycobacterium avium subsp. paratuberculosis
ccgcugacgauggcgaccgcgc

SEQ ID NO: 2929236 - RNA, 14 nt, Mycobacterium avium subsp. paratuberculosis
ccgcugacgcggcg

SEQ ID NO: 2929237 - RNA, 12 nt, Mycobacterium avium subsp. paratuberculosis
ccgcugacgguc

SEQ ID NO: 2929238 - RNA, 20 nt, Mycobacterium avium subsp. paratuberculosis
ccgcugacggucgccgacuc

SEQ ID NO: 2929239 - RNA, 21 nt, Mycobacterium avium subsp. paratuberculosis
ccgcugagcuucugcccggcc

SEQ ID NO: 2929240 - RNA, 23 nt, Mycobacterium avium subsp. paratuberculosis
ccgcugagcuucugcccggccag

SEQ ID NO: 2929241 - RNA, 19 nt, Mycobacterium avium subsp. paratuberculosis
ccgcugaggaugguggugc

SEQ ID NO: 2929242 - RNA, 19 nt, Mycobacterium avium subsp. paratuberculosis
ccgcugagguagucccgcg

SEQ ID NO: 2929243 - RNA, 16 nt, Mycobacterium avium subsp. paratuberculosis
ccgcugauccagcagc

SEQ ID NO: 2929244 - RNA, 19 nt, Mycobacterium avium subsp. paratuberculosis
ccgcugauccagcagcgcc

SEQ ID NO: 2929245 - RNA, 23 nt, Mycobacterium avium subsp. paratuberculosis
ccgcugauccagcagcgccucgg

SEQ ID NO: 2929246 - RNA, 16 nt, Mycobacterium avium subsp. paratuberculosis
ccgcugaugccgccga

SEQ ID NO: 2929247 - RNA, 13 nt, Mycobacterium avium subsp. paratuberculosis
ccgcugaugcggc

SEQ ID NO: 2929248 - RNA, 12 nt, Mycobacterium avium subsp. paratuberculosis
ccgcugcaccag

SEQ ID NO: 2929249 - RNA, 16 nt, Mycobacterium avium subsp. paratuberculosis
ccgcugcaccagcccg

SEQ ID NO: 2929250 - RNA, 20 nt, Mycobacterium avium subsp. paratuberculosis
ccgcugcaccagcccgucgg

SEQ ID NO: 2929251 - RNA, 15 nt, Mycobacterium avium subsp. paratuberculosis
ccgcugcagccgguc

SEQ ID NO: 2929252 - RNA, 18 nt, Mycobacterium avium subsp. paratuberculosis
ccgcugcagccgguccgg

SEQ ID NO: 2929253 - RNA, 19 nt, Mycobacterium avium subsp. paratuberculosis
ccgcugcagccgguccggc

SEQ ID NO: 2929254 - RNA, 21 nt, Mycobacterium avium subsp. paratuberculosis
ccgcugcagccgguccggcgg

SEQ ID NO: 2929255 - RNA, 15 nt, Mycobacterium avium subsp. paratuberculosis
ccgcugcagcgccga

SEQ ID NO: 2929256 - RNA, 16 nt, Mycobacterium avium subsp. paratuberculosis
ccgcugcagcgccgag

SEQ ID NO: 2929257 - RNA, 22 nt, Mycobacterium avium subsp. paratuberculosis
ccgcugcagcgccgaggccagc

SEQ ID NO: 2929258 - RNA, 21 nt, Mycobacterium avium subsp. paratuberculosis
ccgcugcagcgccgcccgcac

SEQ ID NO: 2929259 - RNA, 11 nt, Mycobacterium avium subsp. paratuberculosis
ccgcugcagcu

SEQ ID NO: 2929260 - RNA, 15 nt, Mycobacterium avium subsp. paratuberculosis
ccgcugcagcugcuc

SEQ ID NO: 2929261 - RNA, 16 nt, Mycobacterium avium subsp. paratuberculosis
ccgcugcauccgcagc

SEQ ID NO: 2929262 - RNA, 21 nt, Mycobacterium avium subsp. paratuberculosis
ccgcugcccgccgcguacagc

SEQ ID NO: 2929263 - RNA, 12 nt, Mycobacterium avium subsp. paratuberculosis
ccgcugcccggc

SEQ ID NO: 2929264 - RNA, 15 nt, Mycobacterium avium subsp. paratuberculosis
ccgcugcccggcgcu

SEQ ID NO: 2929265 - RNA, 22 nt, Mycobacterium avium subsp. paratuberculosis
ccgcugcccggcgcuaaagccg

SEQ ID NO: 2929266 - RNA, 14 nt, Mycobacterium avium subsp. paratuberculosis
ccgcugcccgggca

SEQ ID NO: 2929267 - RNA, 13 nt, Mycobacterium avium subsp. paratuberculosis
ccgcugccggccg

SEQ ID NO: 2929268 - RNA, 14 nt, Mycobacterium avium subsp. paratuberculosis
ccgcugccggccga

SEQ ID NO: 2929269 - RNA, 14 nt, Mycobacterium avium subsp. paratuberculosis
ccgcugccggggug

SEQ ID NO: 2929270 - RNA, 15 nt, Mycobacterium avium subsp. paratuberculosis
ccgcugccggggugc

SEQ ID NO: 2929271 - RNA, 16 nt, Mycobacterium avium subsp. paratuberculosis
ccgcugccguucgccg

SEQ ID NO: 2929272 - RNA, 18 nt, Mycobacterium avium subsp. paratuberculosis
ccgcugccguucgccggu

SEQ ID NO: 2929273 - RNA, 17 nt, Mycobacterium avium subsp. paratuberculosis
ccgcugcgcccagcgcg

SEQ ID NO: 2929274 - RNA, 18 nt, Mycobacterium avium subsp. paratuberculosis
ccgcugcgcccagcgcgc

SEQ ID NO: 2929275 - RNA, 12 nt, Mycobacterium avium subsp. paratuberculosis
ccgcugcgccga

SEQ ID NO: 2929276 - RNA, 13 nt, Mycobacterium avium subsp. paratuberculosis
ccgcugcgccgac

SEQ ID NO: 2929277 - RNA, 14 nt, Mycobacterium avium subsp. paratuberculosis
ccgcugcgccgacu

SEQ ID NO: 2929278 - RNA, 15 nt, Mycobacterium avium subsp. paratuberculosis
ccgcugcgccggcgc

SEQ ID NO: 2929279 - RNA, 22 nt, Mycobacterium avium subsp. paratuberculosis
ccgcugcgccggcgcggccagc

SEQ ID NO: 2929280 - RNA, 14 nt, Mycobacterium avium subsp. paratuberculosis
ccgcugcgcggccg

SEQ ID NO: 2929281 - RNA, 14 nt, Mycobacterium avium subsp. paratuberculosis
ccgcugcgcggguc

SEQ ID NO: 2929282 - RNA, 19 nt, Mycobacterium avium subsp. paratuberculosis
ccgcugcgcgggucggcgc

SEQ ID NO: 2929283 - RNA, 22 nt, Mycobacterium avium subsp. paratuberculosis
ccgcugcgcgggucggcgccgg

SEQ ID NO: 2929284 - RNA, 19 nt, Mycobacterium avium subsp. paratuberculosis
ccgcugcggauccgacgaa

SEQ ID NO: 2929285 - RNA, 16 nt, Mycobacterium avium subsp. paratuberculosis
ccgcugcggcacacca

SEQ ID NO: 2929286 - RNA, 22 nt, Mycobacterium avium subsp. paratuberculosis
ccgcugcggcacaccagcguuc

SEQ ID NO: 2929287 - RNA, 14 nt, Mycobacterium avium subsp. paratuberculosis
ccgcugcggcgcag

SEQ ID NO: 2929288 - RNA, 13 nt, Mycobacterium avium subsp. paratuberculosis
ccgcugcggcugg

SEQ ID NO: 2929289 - RNA, 16 nt, Mycobacterium avium subsp. paratuberculosis
ccggaaaaguucggcg

SEQ ID NO: 2929290 - RNA, 14 nt, Mycobacterium avium subsp. paratuberculosis
ccggaaagcgcggg

SEQ ID NO: 2929291 - RNA, 16 nt, Mycobacterium avium subsp. paratuberculosis
ccggaacacaacgccu

SEQ ID NO: 2929292 - RNA, 15 nt, Mycobacterium avium subsp. paratuberculosis
ccggaacacgugauc

SEQ ID NO: 2929293 - RNA, 17 nt, Mycobacterium avium subsp. paratuberculosis
ccggaaccgggcacccg

SEQ ID NO: 2929294 - RNA, 21 nt, Mycobacterium avium subsp. paratuberculosis
ccggaaccgggcacccggcgc

SEQ ID NO: 2929295 - RNA, 19 nt, Mycobacterium avium subsp. paratuberculosis
ccggaaccguuuucggguu

SEQ ID NO: 2929296 - RNA, 18 nt, Mycobacterium avium subsp. paratuberculosis
ccggaacgacgcguccgu

SEQ ID NO: 2929297 - RNA, 18 nt, Mycobacterium avium subsp. paratuberculosis
ccggaacggcgggcccgu

SEQ ID NO: 2929298 - RNA, 20 nt, Mycobacterium avium subsp. paratuberculosis
ccggaacggcuugcgcucgg

SEQ ID NO: 2929299 - RNA, 23 nt, Mycobacterium avium subsp. paratuberculosis
ccggaacggcuugcgcucggccg

SEQ ID NO: 2929300 - RNA, 16 nt, Mycobacterium avium subsp. paratuberculosis
ccggaacucggccggc

SEQ ID NO: 2929301 - RNA, 23 nt, Mycobacterium avium subsp. paratuberculosis
ccggaacucggccggcaccucga

SEQ ID NO: 2929302 - RNA, 13 nt, Mycobacterium avium subsp. paratuberculosis
ccggaagccgucg

SEQ ID NO: 2929303 - RNA, 15 nt, Mycobacterium avium subsp. paratuberculosis
ccggaagccgucggu

SEQ ID NO: 2929304 - RNA, 19 nt, Mycobacterium avium subsp. paratuberculosis
ccggaagccuguuggccag

SEQ ID NO: 2929305 - RNA, 13 nt, Mycobacterium avium subsp. paratuberculosis
ccggaagcgcgca

SEQ ID NO: 2929306 - RNA, 20 nt, Mycobacterium avium subsp. paratuberculosis
ccggaaggccaaggccagca

SEQ ID NO: 2929307 - RNA, 17 nt, Mycobacterium avium subsp. paratuberculosis
ccggaaggccagguugc

SEQ ID NO: 2929308 - RNA, 14 nt, Mycobacterium avium subsp. paratuberculosis
ccggaagugccggc

SEQ ID NO: 2929309 - RNA, 17 nt, Mycobacterium avium subsp. paratuberculosis
ccggaagugccggcgaa

SEQ ID NO: 2929310 - RNA, 17 nt, Mycobacterium avium subsp. paratuberculosis
ccggaaguucucgccgu

SEQ ID NO: 2929311 - RNA, 19 nt, Mycobacterium avium subsp. paratuberculosis
ccggaaucaccuugcccug

SEQ ID NO: 2929312 - RNA, 20 nt, Mycobacterium avium subsp. paratuberculosis
ccggaaucgauuggugcgca

SEQ ID NO: 2929313 - RNA, 14 nt, Mycobacterium avium subsp. paratuberculosis
ccggaaucgucggc

SEQ ID NO: 2929314 - RNA, 20 nt, Mycobacterium avium subsp. paratuberculosis
ccggaauggcaaggccagca

SEQ ID NO: 2929315 - RNA, 23 nt, Mycobacterium avium subsp. paratuberculosis
ccggaauggcaaggccagcaacc

SEQ ID NO: 2929316 - RNA, 22 nt, Mycobacterium avium subsp. paratuberculosis
ccggaauugaagaagcgggcca

SEQ ID NO: 2929317 - RNA, 18 nt, Mycobacterium avium subsp. paratuberculosis
ccggaauugaagcccugc

SEQ ID NO: 2929318 - RNA, 17 nt, Mycobacterium avium subsp. paratuberculosis
ccggacaacggaucgag

SEQ ID NO: 2929319 - RNA, 16 nt, Mycobacterium avium subsp. paratuberculosis
ccggacaccccggcca

SEQ ID NO: 2929320 - RNA, 21 nt, Mycobacterium avium subsp. paratuberculosis
ccggacaccccggccaguccg

SEQ ID NO: 2929321 - RNA, 19 nt, Mycobacterium avium subsp. paratuberculosis
ccggacaccccguaggugc

SEQ ID NO: 2929322 - RNA, 14 nt, Mycobacterium avium subsp. paratuberculosis
ccggacaccggcac

SEQ ID NO: 2929323 - RNA, 20 nt, Mycobacterium avium subsp. paratuberculosis
ccggacaccggcacgucggc

SEQ ID NO: 2929324 - RNA, 15 nt, Mycobacterium avium subsp. paratuberculosis
ccggacaccuggagu

SEQ ID NO: 2929325 - RNA, 14 nt, Mycobacterium avium subsp. paratuberculosis
ccggacacggccag

SEQ ID NO: 2929326 - RNA, 18 nt, Mycobacterium avium subsp. paratuberculosis
ccggacacggccagcgcc

SEQ ID NO: 2929327 - RNA, 18 nt, Mycobacterium avium subsp. paratuberculosis
ccggacagaucgcccauc

SEQ ID NO: 2929328 - RNA, 22 nt, Mycobacterium avium subsp. paratuberculosis
ccggacagccacuccauccgga

SEQ ID NO: 2929329 - RNA, 12 nt, Mycobacterium avium subsp. paratuberculosis
ccggacagccgg

SEQ ID NO: 2929330 - RNA, 13 nt, Mycobacterium avium subsp. paratuberculosis
ccggacagcgcga

SEQ ID NO: 2929331 - RNA, 20 nt, Mycobacterium avium subsp. paratuberculosis
ccggacagcgcgacgcacgc

SEQ ID NO: 2929332 - RNA, 22 nt, Mycobacterium avium subsp. paratuberculosis
ccggacagcgcgacgcacgccg

SEQ ID NO: 2929333 - RNA, 23 nt, Mycobacterium avium subsp. paratuberculosis
ccggacagcgcgacgcacgccgg

SEQ ID NO: 2929334 - RNA, 22 nt, Mycobacterium avium subsp. paratuberculosis
ccggacagcgggccgacccggc

SEQ ID NO: 2929335 - RNA, 19 nt, Mycobacterium avium subsp. paratuberculosis
ccggacagcuggcggucgc

SEQ ID NO: 2929336 - RNA, 22 nt, Mycobacterium avium subsp. paratuberculosis
ccggacaggucgagggugaccc

SEQ ID NO: 2929337 - RNA, 13 nt, Mycobacterium avium subsp. paratuberculosis
ccggacaggucgg

SEQ ID NO: 2929338 - RNA, 21 nt, Mycobacterium avium subsp. paratuberculosis
ccggacauaggcgucgcgguc

SEQ ID NO: 2929339 - RNA, 22 nt, Mycobacterium avium subsp. paratuberculosis
ccggacauaggcgucgcggucg

SEQ ID NO: 2929340 - RNA, 20 nt, Mycobacterium avium subsp. paratuberculosis
ccggacauccauugggccgc

SEQ ID NO: 2929341 - RNA, 16 nt, Mycobacterium avium subsp. paratuberculosis
ccggaccacguccccg

SEQ ID NO: 2929342 - RNA, 21 nt, Mycobacterium avium subsp. paratuberculosis
ccggaccacguccccgggcgu

SEQ ID NO: 2929343 - RNA, 22 nt, Mycobacterium avium subsp. paratuberculosis
ccggaccaggguggccccagcc

SEQ ID NO: 2929344 - RNA, 20 nt, Mycobacterium avium subsp. paratuberculosis
ccggacccauucgucggcgg

SEQ ID NO: 2929345 - RNA, 17 nt, Mycobacterium avium subsp. paratuberculosis
ccggaccccacagcgcg

SEQ ID NO: 2929346 - RNA, 18 nt, Mycobacterium avium subsp. paratuberculosis
ccggaccgauccggcgcc

SEQ ID NO: 2929347 - RNA, 12 nt, Mycobacterium avium subsp. paratuberculosis
ccggaccgccga

SEQ ID NO: 2929348 - RNA, 14 nt, Mycobacterium avium subsp. paratuberculosis
ccggaccgccgaga

SEQ ID NO: 2929349 - RNA, 12 nt, Mycobacterium avium subsp. paratuberculosis
ccggaccgccgc

SEQ ID NO: 2929350 - RNA, 15 nt, Mycobacterium avium subsp. paratuberculosis
ccggaccgccgcggc

SEQ ID NO: 2929351 - RNA, 16 nt, Mycobacterium avium subsp. paratuberculosis
ccggaccgccgcggcg

SEQ ID NO: 2929352 - RNA, 17 nt, Mycobacterium avium subsp. paratuberculosis
ccggaccgccgcggcgc

SEQ ID NO: 2929353 - RNA, 19 nt, Mycobacterium avium subsp. paratuberculosis
ccggaccgccgcggcgccc

SEQ ID NO: 2929354 - RNA, 14 nt, Mycobacterium avium subsp. paratuberculosis
ccggaccgcggucg

SEQ ID NO: 2929355 - RNA, 15 nt, Mycobacterium avium subsp. paratuberculosis
ccggaccgcggucgg

SEQ ID NO: 2929356 - RNA, 17 nt, Mycobacterium avium subsp. paratuberculosis
ccggaccgcggucgggu

SEQ ID NO: 2929357 - RNA, 17 nt, Mycobacterium avium subsp. paratuberculosis
ccggaccgcuugacgcc

SEQ ID NO: 2929358 - RNA, 21 nt, Mycobacterium avium subsp. paratuberculosis
ccggaccgcuugacgccgccg

SEQ ID NO: 2929359 - RNA, 22 nt, Mycobacterium avium subsp. paratuberculosis
ccggaccgcuugacgccgccga

SEQ ID NO: 2929360 - RNA, 14 nt, Mycobacterium avium subsp. paratuberculosis
ccggaccggagacg

SEQ ID NO: 2929361 - RNA, 12 nt, Mycobacterium avium subsp. paratuberculosis
ccggaccggcca

SEQ ID NO: 2929362 - RNA, 12 nt, Mycobacterium avium subsp. paratuberculosis
ccggaccggccg

SEQ ID NO: 2929363 - RNA, 13 nt, Mycobacterium avium subsp. paratuberculosis
ccggaccggccgu

SEQ ID NO: 2929364 - RNA, 14 nt, Mycobacterium avium subsp. paratuberculosis
ccggaccggccgug

SEQ ID NO: 2929365 - RNA, 13 nt, Mycobacterium avium subsp. paratuberculosis
ccggaccggcucg

SEQ ID NO: 2929366 - RNA, 14 nt, Mycobacterium avium subsp. paratuberculosis
ccggaccggcucgu

SEQ ID NO: 2929367 - RNA, 21 nt, Mycobacterium avium subsp. paratuberculosis
ccggaccgggugaccggcgcg

SEQ ID NO: 2929368 - RNA, 13 nt, Mycobacterium avium subsp. paratuberculosis
ccggaccucgacc

SEQ ID NO: 2929369 - RNA, 16 nt, Mycobacterium avium subsp. paratuberculosis
ccggaccucgaccagc

SEQ ID NO: 2929370 - RNA, 17 nt, Mycobacterium avium subsp. paratuberculosis
ccggaccucgaccagcc

SEQ ID NO: 2929371 - RNA, 18 nt, Mycobacterium avium subsp. paratuberculosis
ccggaccucgaccagccg

SEQ ID NO: 2929372 - RNA, 16 nt, Mycobacterium avium subsp. paratuberculosis
ccggaccugccggcga

SEQ ID NO: 2929373 - RNA, 23 nt, Mycobacterium avium subsp. paratuberculosis
ccggacgaacaucgagcccaccg

SEQ ID NO: 2929374 - RNA, 18 nt, Mycobacterium avium subsp. paratuberculosis
ccggaggugccggccggu

SEQ ID NO: 2929375 - RNA, 12 nt, Mycobacterium avium subsp. paratuberculosis
ccggagguucgc

SEQ ID NO: 2929376 - RNA, 16 nt, Mycobacterium avium subsp. paratuberculosis
ccggagguucgccgga

SEQ ID NO: 2929377 - RNA, 16 nt, Mycobacterium avium subsp. paratuberculosis
ccggaguagccgguuc

SEQ ID NO: 2929378 - RNA, 14 nt, Mycobacterium avium subsp. paratuberculosis
ccggaguccggcuc

SEQ ID NO: 2929379 - RNA, 16 nt, Mycobacterium avium subsp. paratuberculosis
ccggaguccggcucgg

SEQ ID NO: 2929380 - RNA, 22 nt, Mycobacterium avium subsp. paratuberculosis
ccggaguccggcucggugccgc

SEQ ID NO: 2929381 - RNA, 17 nt, Mycobacterium avium subsp. paratuberculosis
ccggagugacgucgcgc

SEQ ID NO: 2929382 - RNA, 23 nt, Mycobacterium avium subsp. paratuberculosis
ccggaguucagccugaugccggu

SEQ ID NO: 2929383 - RNA, 17 nt, Mycobacterium avium subsp. paratuberculosis
ccggaguugccgauggc

SEQ ID NO: 2929384 - RNA, 22 nt, Mycobacterium avium subsp. paratuberculosis
ccggauaacgcaaaacggugcg

SEQ ID NO: 2929385 - RNA, 13 nt, Mycobacterium avium subsp. paratuberculosis
ccggauagccguc

SEQ ID NO: 2929386 - RNA, 19 nt, Mycobacterium avium subsp. paratuberculosis
ccggauagccgucggcgga

SEQ ID NO: 2929387 - RNA, 19 nt, Mycobacterium avium subsp. paratuberculosis
ccggaucagcagugccccg

SEQ ID NO: 2929388 - RNA, 22 nt, Mycobacterium avium subsp. paratuberculosis
ccggaucagcagugccccgucc

SEQ ID NO: 2929389 - RNA, 19 nt, Mycobacterium avium subsp. paratuberculosis
ccggaucagcguuccggcg

SEQ ID NO: 2929390 - RNA, 23 nt, Mycobacterium avium subsp. paratuberculosis
ccggaucagcguuccggcggccg

SEQ ID NO: 2929391 - RNA, 13 nt, Mycobacterium avium subsp. paratuberculosis
ccggaucagcuga

SEQ ID NO: 2929392 - RNA, 19 nt, Mycobacterium avium subsp. paratuberculosis
ccggaucagcugaccggcg

SEQ ID NO: 2929393 - RNA, 22 nt, Mycobacterium avium subsp. paratuberculosis
ccggaucaugucguugaugccg

SEQ ID NO: 2929394 - RNA, 12 nt, Mycobacterium avium subsp. paratuberculosis
ccggaucccaga

SEQ ID NO: 2929395 - RNA, 23 nt, Mycobacterium avium subsp. paratuberculosis
ccggaucccagaauucgccgggg

SEQ ID NO: 2929396 - RNA, 21 nt, Mycobacterium avium subsp. paratuberculosis
ccggauccgguaccagaucga

SEQ ID NO: 2929397 - RNA, 22 nt, Mycobacterium avium subsp. paratuberculosis
ccggaucgaccaacuccaccgc

SEQ ID NO: 2929398 - RNA, 23 nt, Mycobacterium avium subsp. paratuberculosis
ccggaucgaccaacuccaccgcc

SEQ ID NO: 2929399 - RNA, 17 nt, Mycobacterium avium subsp. paratuberculosis
ccggaucgagcacccgg

SEQ ID NO: 2929400 - RNA, 12 nt, Mycobacterium avium subsp. paratuberculosis
ccggaucgccga

SEQ ID NO: 2929401 - RNA, 14 nt, Mycobacterium avium subsp. paratuberculosis
ccggaucgcgcagu

SEQ ID NO: 2929402 - RNA, 11 nt, Mycobacterium avium subsp. paratuberculosis
ccggaucggcc

SEQ ID NO: 2929403 - RNA, 15 nt, Mycobacterium avium subsp. paratuberculosis
ccggaucggccagca

SEQ ID NO: 2929404 - RNA, 16 nt, Mycobacterium avium subsp. paratuberculosis
ccggaucggccagcag

SEQ ID NO: 2929405 - RNA, 23 nt, Mycobacterium avium subsp. paratuberculosis
ccggaucggccauggugccgccg

SEQ ID NO: 2929406 - RNA, 20 nt, Mycobacterium avium subsp. paratuberculosis
ccggaucggcccccgggccc

SEQ ID NO: 2929407 - RNA, 21 nt, Mycobacterium avium subsp. paratuberculosis
ccggaucggcuagcagcuccg

SEQ ID NO: 2929408 - RNA, 19 nt, Mycobacterium avium subsp. paratuberculosis
ccggaucggcugcgggcca

SEQ ID NO: 2929409 - RNA, 21 nt, Mycobacterium avium subsp. paratuberculosis
ccggaucggcugcgggccagc

SEQ ID NO: 2929410 - RNA, 19 nt, Mycobacterium avium subsp. paratuberculosis
ccggaucgggaccgggaag

SEQ ID NO: 2929411 - RNA, 14 nt, Mycobacterium avium subsp. paratuberculosis
ccggaucgggcggu

SEQ ID NO: 2929412 - RNA, 17 nt, Mycobacterium avium subsp. paratuberculosis
ccggaucgggcggucca

SEQ ID NO: 2929413 - RNA, 14 nt, Mycobacterium avium subsp. paratuberculosis
ccggaucggggugg

SEQ ID NO: 2929414 - RNA, 19 nt, Mycobacterium avium subsp. paratuberculosis
ccggaucgggguggacgcg

SEQ ID NO: 2929415 - RNA, 22 nt, Mycobacterium avium subsp. paratuberculosis
ccggaucgggguggacgcgacc

SEQ ID NO: 2929416 - RNA, 18 nt, Mycobacterium avium subsp. paratuberculosis
ccggaucgugucccggcg

SEQ ID NO: 2929417 - RNA, 21 nt, Mycobacterium avium subsp. paratuberculosis
ccggaucgugucccggcgccc

SEQ ID NO: 2929418 - RNA, 16 nt, Mycobacterium avium subsp. paratuberculosis
ccggaucucgucgggc

SEQ ID NO: 2929419 - RNA, 21 nt, Mycobacterium avium subsp. paratuberculosis
ccggaucucgucgggcaccgc

SEQ ID NO: 2929420 - RNA, 22 nt, Mycobacterium avium subsp. paratuberculosis
ccggaucucgucgggcaccgcc

SEQ ID NO: 2929421 - RNA, 15 nt, Mycobacterium avium subsp. paratuberculosis
ccggaucuggcccug

SEQ ID NO: 2929422 - RNA, 20 nt, Mycobacterium avium subsp. paratuberculosis
ccggaucuugccgucggccg

SEQ ID NO: 2929423 - RNA, 17 nt, Mycobacterium avium subsp. paratuberculosis
ccggaugaccagggugg

SEQ ID NO: 2929424 - RNA, 21 nt, Mycobacterium avium subsp. paratuberculosis
ccggaugaucaacacgucguc

SEQ ID NO: 2929425 - RNA, 23 nt, Mycobacterium avium subsp. paratuberculosis
ccggaugaucuugaugucggggc

SEQ ID NO: 2929426 - RNA, 22 nt, Mycobacterium avium subsp. paratuberculosis
ccggaugauguucuccggcccg

SEQ ID NO: 2929427 - RNA, 14 nt, Mycobacterium avium subsp. paratuberculosis
ccggaugcaccggc

SEQ ID NO: 2929428 - RNA, 16 nt, Mycobacterium avium subsp. paratuberculosis
ccggaugcaccggcag

SEQ ID NO: 2929429 - RNA, 21 nt, Mycobacterium avium subsp. paratuberculosis
ccggaugcacgugcaccgcgg

SEQ ID NO: 2929430 - RNA, 23 nt, Mycobacterium avium subsp. paratuberculosis
ccggaugcacgugcaccgcggcc

SEQ ID NO: 2929431 - RNA, 12 nt, Mycobacterium avium subsp. paratuberculosis
ccggaugccagc

SEQ ID NO: 2929432 - RNA, 13 nt, Mycobacterium avium subsp. paratuberculosis
ccggaugccagca

SEQ ID NO: 2929433 - RNA, 14 nt, Mycobacterium avium subsp. paratuberculosis
ccggaugccagcag

SEQ ID NO: 2929434 - RNA, 18 nt, Mycobacterium avium subsp. paratuberculosis
ccggaugccagcaggucc

SEQ ID NO: 2929435 - RNA, 22 nt, Mycobacterium avium subsp. paratuberculosis
ccggaugccagcagguccgccg

SEQ ID NO: 2929436 - RNA, 14 nt, Mycobacterium avium subsp. paratuberculosis
ccggaugccgcgcg

SEQ ID NO: 2929437 - RNA, 20 nt, Mycobacterium avium subsp. paratuberculosis
ccggaugccgcgcggcgcca

SEQ ID NO: 2929438 - RNA, 22 nt, Mycobacterium avium subsp. paratuberculosis
ccggaugccgcgcggcgccagc

SEQ ID NO: 2929439 - RNA, 12 nt, Mycobacterium avium subsp. paratuberculosis
ccggaugccggc

SEQ ID NO: 2929440 - RNA, 13 nt, Mycobacterium avium subsp. paratuberculosis
ccggaugccggcg

SEQ ID NO: 2929441 - RNA, 17 nt, Mycobacterium avium subsp. paratuberculosis
ccggaugccggcgccca

SEQ ID NO: 2929442 - RNA, 21 nt, Mycobacterium avium subsp. paratuberculosis
ccggaugccggcgcccagcgg

SEQ ID NO: 2929443 - RNA, 22 nt, Mycobacterium avium subsp. paratuberculosis
ccggaugccggcgcccagcggc

SEQ ID NO: 2929444 - RNA, 13 nt, Mycobacterium avium subsp. paratuberculosis
ccggaugccggcu

SEQ ID NO: 2929445 - RNA, 13 nt, Mycobacterium avium subsp. paratuberculosis
ccggaugcggccg

SEQ ID NO: 2929446 - RNA, 23 nt, Mycobacterium avium subsp. paratuberculosis
ccggaugcggccgaaguccaagu

SEQ ID NO: 2929447 - RNA, 16 nt, Mycobacterium avium subsp. paratuberculosis
ccggaugcucaccggu

SEQ ID NO: 2929448 - RNA, 16 nt, Mycobacterium avium subsp. paratuberculosis
ccggaugcugcggguc

SEQ ID NO: 2929449 - RNA, 23 nt, Mycobacterium avium subsp. paratuberculosis
ccggauggagcgcgacgggcugc

SEQ ID NO: 2929450 - RNA, 16 nt, Mycobacterium avium subsp. paratuberculosis
ccggauggccgggcag

SEQ ID NO: 2929451 - RNA, 21 nt, Mycobacterium avium subsp. paratuberculosis
ccggauggccgggcaggccgg

SEQ ID NO: 2929452 - RNA, 16 nt, Mycobacterium avium subsp. paratuberculosis
ccggauggcgcccggc

SEQ ID NO: 2929453 - RNA, 18 nt, Mycobacterium avium subsp. paratuberculosis
ccggauggcgcccggcag

SEQ ID NO: 2929454 - RNA, 19 nt, Mycobacterium avium subsp. paratuberculosis
ccggauggcgcccggcagc

SEQ ID NO: 2929455 - RNA, 17 nt, Mycobacterium avium subsp. paratuberculosis
ccggauggcggucgcgc

SEQ ID NO: 2929456 - RNA, 18 nt, Mycobacterium avium subsp. paratuberculosis
ccggauggcggucgcgcc

SEQ ID NO: 2929457 - RNA, 16 nt, Mycobacterium avium subsp. paratuberculosis
ccggaugucgggcgag

SEQ ID NO: 2929458 - RNA, 20 nt, Mycobacterium avium subsp. paratuberculosis
ccggcagaucgcggcccgcc

SEQ ID NO: 2929459 - RNA, 22 nt, Mycobacterium avium subsp. paratuberculosis
ccggcagaucgcggcccgccgc

SEQ ID NO: 2929460 - RNA, 23 nt, Mycobacterium avium subsp. paratuberculosis
ccggcagaucgcggcccgccgcu

SEQ ID NO: 2929461 - RNA, 15 nt, Mycobacterium avium subsp. paratuberculosis
ccggcagcaaccgcg

SEQ ID NO: 2929462 - RNA, 12 nt, Mycobacterium avium subsp. paratuberculosis
ccggcagcaccg

SEQ ID NO: 2929463 - RNA, 13 nt, Mycobacterium avium subsp. paratuberculosis
ccggcagcaccgc

SEQ ID NO: 2929464 - RNA, 14 nt, Mycobacterium avium subsp. paratuberculosis
ccggcagcaccggc

SEQ ID NO: 2929465 - RNA, 19 nt, Mycobacterium avium subsp. paratuberculosis
ccggcagcaccggccggau

SEQ ID NO: 2929466 - RNA, 15 nt, Mycobacterium avium subsp. paratuberculosis
ccggcagcagcgagu

SEQ ID NO: 2929467 - RNA, 15 nt, Mycobacterium avium subsp. paratuberculosis
ccggcagcagcgcgu

SEQ ID NO: 2929468 - RNA, 20 nt, Mycobacterium avium subsp. paratuberculosis
ccggcagcagcgcgucgugc

SEQ ID NO: 2929469 - RNA, 14 nt, Mycobacterium avium subsp. paratuberculosis
ccggcagcaggugc

SEQ ID NO: 2929470 - RNA, 19 nt, Mycobacterium avium subsp. paratuberculosis
ccggcagcaggugcaccac

SEQ ID NO: 2929471 - RNA, 13 nt, Mycobacterium avium subsp. paratuberculosis
ccggcagcaucgg

SEQ ID NO: 2929472 - RNA, 20 nt, Mycobacterium avium subsp. paratuberculosis
ccggcagcaucgggacgccu

SEQ ID NO: 2929473 - RNA, 16 nt, Mycobacterium avium subsp. paratuberculosis
ccggcagccagauguc

SEQ ID NO: 2929474 - RNA, 15 nt, Mycobacterium avium subsp. paratuberculosis
ccggcagccgcagcg

SEQ ID NO: 2929475 - RNA, 12 nt, Mycobacterium avium subsp. paratuberculosis
ccggcagccgcu

SEQ ID NO: 2929476 - RNA, 15 nt, Mycobacterium avium subsp. paratuberculosis
ccggcagccggccac

SEQ ID NO: 2929477 - RNA, 16 nt, Mycobacterium avium subsp. paratuberculosis
ccggcagccggccacc

SEQ ID NO: 2929478 - RNA, 19 nt, Mycobacterium avium subsp. paratuberculosis
ccggcagccggccaccucg

SEQ ID NO: 2929479 - RNA, 23 nt, Mycobacterium avium subsp. paratuberculosis
ccggcagccggccaccucguccc

SEQ ID NO: 2929480 - RNA, 14 nt, Mycobacterium avium subsp. paratuberculosis
ccggcagccggcgc

SEQ ID NO: 2929481 - RNA, 15 nt, Mycobacterium avium subsp. paratuberculosis
ccggcagccggcgcg

SEQ ID NO: 2929482 - RNA, 14 nt, Mycobacterium avium subsp. paratuberculosis
ccggcagccggcgu

SEQ ID NO: 2929483 - RNA, 16 nt, Mycobacterium avium subsp. paratuberculosis
ccggcagccggcguac

SEQ ID NO: 2929484 - RNA, 15 nt, Mycobacterium avium subsp. paratuberculosis
ccggcagccggggug

SEQ ID NO: 2929485 - RNA, 16 nt, Mycobacterium avium subsp. paratuberculosis
ccggcagccggggugc

SEQ ID NO: 2929486 - RNA, 11 nt, Mycobacterium avium subsp. paratuberculosis
ccggcagcgcc

SEQ ID NO: 2929487 - RNA, 14 nt, Mycobacterium avium subsp. paratuberculosis
ccggcagcgccacc

SEQ ID NO: 2929488 - RNA, 17 nt, Mycobacterium avium subsp. paratuberculosis
ccggcagcgccaccagc

SEQ ID NO: 2929489 - RNA, 20 nt, Mycobacterium avium subsp. paratuberculosis
ccggcagcgccucccggacc

SEQ ID NO: 2929490 - RNA, 14 nt, Mycobacterium avium subsp. paratuberculosis
ccggcagcgcgccc

SEQ ID NO: 2929491 - RNA, 14 nt, Mycobacterium avium subsp. paratuberculosis
ccggcagcgcucgu

SEQ ID NO: 2929492 - RNA, 16 nt, Mycobacterium avium subsp. paratuberculosis
ccggcagcgcucgucg

SEQ ID NO: 2929493 - RNA, 21 nt, Mycobacterium avium subsp. paratuberculosis
ccggcagcgcucgucgucgga

SEQ ID NO: 2929494 - RNA, 15 nt, Mycobacterium avium subsp. paratuberculosis
ccggcagcggccgca

SEQ ID NO: 2929495 - RNA, 13 nt, Mycobacterium avium subsp. paratuberculosis
ccggcagcggcug

SEQ ID NO: 2929496 - RNA, 23 nt, Mycobacterium avium subsp. paratuberculosis
ccggcagcggcugcugcagcgcc

SEQ ID NO: 2929497 - RNA, 14 nt, Mycobacterium avium subsp. paratuberculosis
ccggcagcggggcg

SEQ ID NO: 2929498 - RNA, 20 nt, Mycobacterium avium subsp. paratuberculosis
ccggcagcggggcgaacccg

SEQ ID NO: 2929499 - RNA, 22 nt, Mycobacterium avium subsp. paratuberculosis
ccggcagcggggcgaacccggc

SEQ ID NO: 2929500 - RNA, 17 nt, Mycobacterium avium subsp. paratuberculosis
ccggcagcggucauuga

SEQ ID NO: 2929501 - RNA, 21 nt, Mycobacterium avium subsp. paratuberculosis
ccggcagcggucauugaugcc

SEQ ID NO: 2929502 - RNA, 12 nt, Mycobacterium avium subsp. paratuberculosis
ccggcagcggug

SEQ ID NO: 2929503 - RNA, 13 nt, Mycobacterium avium subsp. paratuberculosis
ccggcagcggugc

SEQ ID NO: 2929504 - RNA, 15 nt, Mycobacterium avium subsp. paratuberculosis
ccggcagcggugccg

SEQ ID NO: 2929505 - RNA, 16 nt, Mycobacterium avium subsp. paratuberculosis
ccggcagcggugccgc

SEQ ID NO: 2929506 - RNA, 17 nt, Mycobacterium avium subsp. paratuberculosis
ccggcagcggugccgcc

SEQ ID NO: 2929507 - RNA, 19 nt, Mycobacterium avium subsp. paratuberculosis
ccggcagcggugccgcccg

SEQ ID NO: 2929508 - RNA, 22 nt, Mycobacterium avium subsp. paratuberculosis
ccggcagcggugccgcccggag

SEQ ID NO: 2929509 - RNA, 20 nt, Mycobacterium avium subsp. paratuberculosis
ccggcagcgucuuggacgcc

SEQ ID NO: 2929510 - RNA, 14 nt, Mycobacterium avium subsp. paratuberculosis
ccggcaggccgccc

SEQ ID NO: 2929511 - RNA, 15 nt, Mycobacterium avium subsp. paratuberculosis
ccggcaggccgcccg

SEQ ID NO: 2929512 - RNA, 16 nt, Mycobacterium avium subsp. paratuberculosis
ccggcaggccgcccga

SEQ ID NO: 2929513 - RNA, 14 nt, Mycobacterium avium subsp. paratuberculosis
ccggcaggccgcgg

SEQ ID NO: 2929514 - RNA, 16 nt, Mycobacterium avium subsp. paratuberculosis
ccggcaggccgcggcc

SEQ ID NO: 2929515 - RNA, 20 nt, Mycobacterium avium subsp. paratuberculosis
ccggcaggccgcggccgucg

SEQ ID NO: 2929516 - RNA, 15 nt, Mycobacterium avium subsp. paratuberculosis
ccggcaggcgguagc

SEQ ID NO: 2929517 - RNA, 15 nt, Mycobacterium avium subsp. paratuberculosis
ccggcaggcucagca

SEQ ID NO: 2929518 - RNA, 17 nt, Mycobacterium avium subsp. paratuberculosis
ccggcaggcucagcagc

SEQ ID NO: 2929519 - RNA, 15 nt, Mycobacterium avium subsp. paratuberculosis
ccggcaggucgaggc

SEQ ID NO: 2929520 - RNA, 17 nt, Mycobacterium avium subsp. paratuberculosis
ccggcaggucgaggccg

SEQ ID NO: 2929521 - RNA, 20 nt, Mycobacterium avium subsp. paratuberculosis
ccggcaggucgaggccggcc

SEQ ID NO: 2929522 - RNA, 15 nt, Mycobacterium avium subsp. paratuberculosis
ccggcaguacgcgcc

SEQ ID NO: 2929523 - RNA, 17 nt, Mycobacterium avium subsp. paratuberculosis
ccggcaguacgcgccgg

SEQ ID NO: 2929524 - RNA, 18 nt, Mycobacterium avium subsp. paratuberculosis
ccggcaguacgcgccggc

SEQ ID NO: 2929525 - RNA, 19 nt, Mycobacterium avium subsp. paratuberculosis
ccggcaguacgcgccggcc

SEQ ID NO: 2929526 - RNA, 20 nt, Mycobacterium avium subsp. paratuberculosis
ccggcaguacgcgccggccu

SEQ ID NO: 2929527 - RNA, 18 nt, Mycobacterium avium subsp. paratuberculosis
ccggcagugaucggcgga

SEQ ID NO: 2929528 - RNA, 19 nt, Mycobacterium avium subsp. paratuberculosis
ccggcaguuccucgccgga

SEQ ID NO: 2929529 - RNA, 16 nt, Mycobacterium avium subsp. paratuberculosis
ccggcaguugcggccg

SEQ ID NO: 2929530 - RNA, 17 nt, Mycobacterium avium subsp. paratuberculosis
ccggcaguugcggccgc

SEQ ID NO: 2929531 - RNA, 15 nt, Mycobacterium avium subsp. paratuberculosis
ccggcauaggccagc

SEQ ID NO: 2929532 - RNA, 16 nt, Mycobacterium avium subsp. paratuberculosis
ccggcauaggccagca

SEQ ID NO: 2929533 - RNA, 19 nt, Mycobacterium avium subsp. paratuberculosis
ccggcauaggccagcacca

SEQ ID NO: 2929534 - RNA, 22 nt, Mycobacterium avium subsp. paratuberculosis
ccggcauaggccagcaccagcg

SEQ ID NO: 2929535 - RNA, 15 nt, Mycobacterium avium subsp. paratuberculosis
ccggcauccagcacg

SEQ ID NO: 2929536 - RNA, 19 nt, Mycobacterium avium subsp. paratuberculosis
ccggcauccagcacggccg

SEQ ID NO: 2929537 - RNA, 22 nt, Mycobacterium avium subsp. paratuberculosis
ccggcauccagcacggccgcca

SEQ ID NO: 2929538 - RNA, 13 nt, Mycobacterium avium subsp. paratuberculosis
ccggcaucccacc

SEQ ID NO: 2929539 - RNA, 19 nt, Mycobacterium avium subsp. paratuberculosis
ccggcauccucggcgcguc

SEQ ID NO: 2929540 - RNA, 20 nt, Mycobacterium avium subsp. paratuberculosis
ccggcaucgacaugcccggc

SEQ ID NO: 2929541 - RNA, 23 nt, Mycobacterium avium subsp. paratuberculosis
ccggcaucgacaugcccggcgac

SEQ ID NO: 2929542 - RNA, 15 nt, Mycobacterium avium subsp. paratuberculosis
ccggcaucggcucgu

SEQ ID NO: 2929543 - RNA, 15 nt, Mycobacterium avium subsp. paratuberculosis
ccggccagcggcuug

SEQ ID NO: 2929544 - RNA, 21 nt, Mycobacterium avium subsp. paratuberculosis
ccggccagcggcuuggccgug

SEQ ID NO: 2929545 - RNA, 21 nt, Mycobacterium avium subsp. paratuberculosis
ccggccagcgggucgugcauc

SEQ ID NO: 2929546 - RNA, 13 nt, Mycobacterium avium subsp. paratuberculosis
ccggccagcgucg

SEQ ID NO: 2929547 - RNA, 18 nt, Mycobacterium avium subsp. paratuberculosis
ccggccagcgucgcgccg

SEQ ID NO: 2929548 - RNA, 19 nt, Mycobacterium avium subsp. paratuberculosis
ccggccagcgucgcgccgc

SEQ ID NO: 2929549 - RNA, 22 nt, Mycobacterium avium subsp. paratuberculosis
ccggccagcgucgcgccgccac

SEQ ID NO: 2929550 - RNA, 23 nt, Mycobacterium avium subsp. paratuberculosis
ccggccagcgucgcgccgccacc

SEQ ID NO: 2929551 - RNA, 20 nt, Mycobacterium avium subsp. paratuberculosis
ccggccagcgucuccggcgg

SEQ ID NO: 2929552 - RNA, 13 nt, Mycobacterium avium subsp. paratuberculosis
ccggccagcuccg

SEQ ID NO: 2929553 - RNA, 18 nt, Mycobacterium avium subsp. paratuberculosis
ccggccagcuccgccacc

SEQ ID NO: 2929554 - RNA, 22 nt, Mycobacterium avium subsp. paratuberculosis
ccggccagcucgagcaucacga

SEQ ID NO: 2929555 - RNA, 15 nt, Mycobacterium avium subsp. paratuberculosis
ccggccagcucgccg

SEQ ID NO: 2929556 - RNA, 17 nt, Mycobacterium avium subsp. paratuberculosis
ccggccagcucgccgcc

SEQ ID NO: 2929557 - RNA, 18 nt, Mycobacterium avium subsp. paratuberculosis
ccggccagcucgccgccg

SEQ ID NO: 2929558 - RNA, 20 nt, Mycobacterium avium subsp. paratuberculosis
ccggccagcucgccgccgac

SEQ ID NO: 2929559 - RNA, 20 nt, Mycobacterium avium subsp. paratuberculosis
ccggccagcuuuccggccgc

SEQ ID NO: 2929560 - RNA, 21 nt, Mycobacterium avium subsp. paratuberculosis
ccggccagcuuuccggccgcc

SEQ ID NO: 2929561 - RNA, 23 nt, Mycobacterium avium subsp. paratuberculosis
ccggccagcuuuccggccgccuc

SEQ ID NO: 2929562 - RNA, 22 nt, Mycobacterium avium subsp. paratuberculosis
ccggccaggaucuugucggcgg

SEQ ID NO: 2929563 - RNA, 17 nt, Mycobacterium avium subsp. paratuberculosis
ccggccaggcacagcag

SEQ ID NO: 2929564 - RNA, 15 nt, Mycobacterium avium subsp. paratuberculosis
ccggccaggcccagc

SEQ ID NO: 2929565 - RNA, 17 nt, Mycobacterium avium subsp. paratuberculosis
ccggccaggcccagccc

SEQ ID NO: 2929566 - RNA, 15 nt, Mycobacterium avium subsp. paratuberculosis
ccggccaggccggcc

SEQ ID NO: 2929567 - RNA, 17 nt, Mycobacterium avium subsp. paratuberculosis
ccggccaggccggccug

SEQ ID NO: 2929568 - RNA, 14 nt, Mycobacterium avium subsp. paratuberculosis
ccggccagggccgc

SEQ ID NO: 2929569 - RNA, 18 nt, Mycobacterium avium subsp. paratuberculosis
ccggccagggccgccgca

SEQ ID NO: 2929570 - RNA, 13 nt, Mycobacterium avium subsp. paratuberculosis
ccggccagggugc

SEQ ID NO: 2929571 - RNA, 20 nt, Mycobacterium avium subsp. paratuberculosis
ccggccagggugccgacgac

SEQ ID NO: 2929572 - RNA, 13 nt, Mycobacterium avium subsp. paratuberculosis
ccggccaggucca

SEQ ID NO: 2929573 - RNA, 21 nt, Mycobacterium avium subsp. paratuberculosis
ccggccagguccacaccgugg

SEQ ID NO: 2929574 - RNA, 20 nt, Mycobacterium avium subsp. paratuberculosis
ccggccaggucgacgggguc

SEQ ID NO: 2929575 - RNA, 16 nt, Mycobacterium avium subsp. paratuberculosis
ccggccaggucgccgc

SEQ ID NO: 2929576 - RNA, 18 nt, Mycobacterium avium subsp. paratuberculosis
ccggccaggucgccgcgc

SEQ ID NO: 2929577 - RNA, 20 nt, Mycobacterium avium subsp. paratuberculosis
ccggccaggucgccgcgcag

SEQ ID NO: 2929578 - RNA, 21 nt, Mycobacterium avium subsp. paratuberculosis
ccggccaggucgccgcgcagc

SEQ ID NO: 2929579 - RNA, 21 nt, Mycobacterium avium subsp. paratuberculosis
ccggccagguugaccaccagc

SEQ ID NO: 2929580 - RNA, 14 nt, Mycobacterium avium subsp. paratuberculosis
ccggccaguccgcg

SEQ ID NO: 2929581 - RNA, 14 nt, Mycobacterium avium subsp. paratuberculosis
ccggccaguccggc

SEQ ID NO: 2929582 - RNA, 16 nt, Mycobacterium avium subsp. paratuberculosis
ccggccaguccggcag

SEQ ID NO: 2929583 - RNA, 17 nt, Mycobacterium avium subsp. paratuberculosis
ccggccaguucccgggc

SEQ ID NO: 2929584 - RNA, 18 nt, Mycobacterium avium subsp. paratuberculosis
ccggccaguucccgggcg

SEQ ID NO: 2929585 - RNA, 21 nt, Mycobacterium avium subsp. paratuberculosis
ccggccaguugaaguccggcg

SEQ ID NO: 2929586 - RNA, 22 nt, Mycobacterium avium subsp. paratuberculosis
ccggccaguugaaguccggcgg

SEQ ID NO: 2929587 - RNA, 18 nt, Mycobacterium avium subsp. paratuberculosis
ccggccauaaagccgucg

SEQ ID NO: 2929588 - RNA, 21 nt, Mycobacterium avium subsp. paratuberculosis
ccggccaucaugcccaccauc

SEQ ID NO: 2929589 - RNA, 22 nt, Mycobacterium avium subsp. paratuberculosis
ccggccaucaugcccaccaucc

SEQ ID NO: 2929590 - RNA, 20 nt, Mycobacterium avium subsp. paratuberculosis
ccggccaucuccugcacgcg

SEQ ID NO: 2929591 - RNA, 15 nt, Mycobacterium avium subsp. paratuberculosis
ccggccaucucggcg

SEQ ID NO: 2929592 - RNA, 12 nt, Mycobacterium avium subsp. paratuberculosis
ccggccaucuuc

SEQ ID NO: 2929593 - RNA, 15 nt, Mycobacterium avium subsp. paratuberculosis
ccggccaugaccaug

SEQ ID NO: 2929594 - RNA, 22 nt, Mycobacterium avium subsp. paratuberculosis
ccggccaugaccaugucgacgc

SEQ ID NO: 2929595 - RNA, 23 nt, Mycobacterium avium subsp. paratuberculosis
ccggccaugaccaugucgacgcu

SEQ ID NO: 2929596 - RNA, 16 nt, Mycobacterium avium subsp. paratuberculosis
ccggcccaagacccgc

SEQ ID NO: 2929597 - RNA, 13 nt, Mycobacterium avium subsp. paratuberculosis
ccggcccaccacc

SEQ ID NO: 2929598 - RNA, 16 nt, Mycobacterium avium subsp. paratuberculosis
ccggcccaccaccgcc

SEQ ID NO: 2929599 - RNA, 19 nt, Mycobacterium avium subsp. paratuberculosis
ccggcccaccaccgccucg

SEQ ID NO: 2929600 - RNA, 22 nt, Mycobacterium avium subsp. paratuberculosis
ccggcccaccaccgccucgacg

SEQ ID NO: 2929601 - RNA, 13 nt, Mycobacterium avium subsp. paratuberculosis
ccggcccaccggc

SEQ ID NO: 2929602 - RNA, 16 nt, Mycobacterium avium subsp. paratuberculosis
ccggcccaccggcccg

SEQ ID NO: 2929603 - RNA, 18 nt, Mycobacterium avium subsp. paratuberculosis
ccggcccaccggcccggc

SEQ ID NO: 2929604 - RNA, 20 nt, Mycobacterium avium subsp. paratuberculosis
ccggcccaccggcccggcgg

SEQ ID NO: 2929605 - RNA, 13 nt, Mycobacterium avium subsp. paratuberculosis
ccggcccacgccg

SEQ ID NO: 2929606 - RNA, 14 nt, Mycobacterium avium subsp. paratuberculosis
ccggcccagcagcg

SEQ ID NO: 2929607 - RNA, 13 nt, Mycobacterium avium subsp. paratuberculosis
ccggcccagccgg

SEQ ID NO: 2929608 - RNA, 15 nt, Mycobacterium avium subsp. paratuberculosis
ccggcccagccggcg

SEQ ID NO: 2929609 - RNA, 13 nt, Mycobacterium avium subsp. paratuberculosis
ccggcccagcgcg

SEQ ID NO: 2929610 - RNA, 18 nt, Mycobacterium avium subsp. paratuberculosis
ccggcccagcgcgcggcg

SEQ ID NO: 2929611 - RNA, 19 nt, Mycobacterium avium subsp. paratuberculosis
ccggcccagcgcgcggcgg

SEQ ID NO: 2929612 - RNA, 17 nt, Mycobacterium avium subsp. paratuberculosis
ccggcccaggcacagcg

SEQ ID NO: 2929613 - RNA, 16 nt, Mycobacterium avium subsp. paratuberculosis
ccggcccaguggaucg

SEQ ID NO: 2929614 - RNA, 21 nt, Mycobacterium avium subsp. paratuberculosis
ccggcccaucaccggaccggc

SEQ ID NO: 2929615 - RNA, 13 nt, Mycobacterium avium subsp. paratuberculosis
ccggccccaccgc

SEQ ID NO: 2929616 - RNA, 14 nt, Mycobacterium avium subsp. paratuberculosis
ccggccccaccgcc

SEQ ID NO: 2929617 - RNA, 16 nt, Mycobacterium avium subsp. paratuberculosis
ccggccccaccgccgc

SEQ ID NO: 2929618 - RNA, 16 nt, Mycobacterium avium subsp. paratuberculosis
ccggcccccugcucag

SEQ ID NO: 2929619 - RNA, 22 nt, Mycobacterium avium subsp. paratuberculosis
ccggcccccugcucagcggcca

SEQ ID NO: 2929620 - RNA, 23 nt, Mycobacterium avium subsp. paratuberculosis
ccggcccccugcucagcggccau

SEQ ID NO: 2929621 - RNA, 22 nt, Mycobacterium avium subsp. paratuberculosis
ccggccccgagcgucacgccag

SEQ ID NO: 2929622 - RNA, 12 nt, Mycobacterium avium subsp. paratuberculosis
ccggccccgccc

SEQ ID NO: 2929623 - RNA, 22 nt, Mycobacterium avium subsp. paratuberculosis
ccggccccgcccggcgcgcagc

SEQ ID NO: 2929624 - RNA, 15 nt, Mycobacterium avium subsp. paratuberculosis
ccggccccgcccggg

SEQ ID NO: 2929625 - RNA, 22 nt, Mycobacterium avium subsp. paratuberculosis
ccggccccgcccggggcggcga

SEQ ID NO: 2929626 - RNA, 17 nt, Mycobacterium avium subsp. paratuberculosis
ccggccccgcugccguc

SEQ ID NO: 2929627 - RNA, 18 nt, Mycobacterium avium subsp. paratuberculosis
ccggccgcacaccaccac

SEQ ID NO: 2929628 - RNA, 19 nt, Mycobacterium avium subsp. paratuberculosis
ccggccgcacaccaccacg

SEQ ID NO: 2929629 - RNA, 14 nt, Mycobacterium avium subsp. paratuberculosis
ccggccgcagcugc

SEQ ID NO: 2929630 - RNA, 20 nt, Mycobacterium avium subsp. paratuberculosis
ccggccgccagcagugucca

SEQ ID NO: 2929631 - RNA, 14 nt, Mycobacterium avium subsp. paratuberculosis
ccggccgccagcgc

SEQ ID NO: 2929632 - RNA, 15 nt, Mycobacterium avium subsp. paratuberculosis
ccggccgcccgcacc

SEQ ID NO: 2929633 - RNA, 20 nt, Mycobacterium avium subsp. paratuberculosis
ccggccgccgaagccggcuc

SEQ ID NO: 2929634 - RNA, 13 nt, Mycobacterium avium subsp. paratuberculosis
ccggccgccgagg

SEQ ID NO: 2929635 - RNA, 15 nt, Mycobacterium avium subsp. paratuberculosis
ccggccgccgcgcau

SEQ ID NO: 2929636 - RNA, 22 nt, Mycobacterium avium subsp. paratuberculosis
ccggccgccgcgcauccgcacc

SEQ ID NO: 2929637 - RNA, 13 nt, Mycobacterium avium subsp. paratuberculosis
ccggccgccggau

SEQ ID NO: 2929638 - RNA, 14 nt, Mycobacterium avium subsp. paratuberculosis
ccggccgccggauc

SEQ ID NO: 2929639 - RNA, 13 nt, Mycobacterium avium subsp. paratuberculosis
ccggccgccggcg

SEQ ID NO: 2929640 - RNA, 15 nt, Mycobacterium avium subsp. paratuberculosis
ccggccgccggcggc

SEQ ID NO: 2929641 - RNA, 16 nt, Mycobacterium avium subsp. paratuberculosis
ccggccgccggcggcc

SEQ ID NO: 2929642 - RNA, 13 nt, Mycobacterium avium subsp. paratuberculosis
ccggccgccgugg

SEQ ID NO: 2929643 - RNA, 16 nt, Mycobacterium avium subsp. paratuberculosis
ccggccgccguggccc

SEQ ID NO: 2929644 - RNA, 14 nt, Mycobacterium avium subsp. paratuberculosis
ccggccgcgcaccg

SEQ ID NO: 2929645 - RNA, 17 nt, Mycobacterium avium subsp. paratuberculosis
ccggccgcgcaccgccc

SEQ ID NO: 2929646 - RNA, 19 nt, Mycobacterium avium subsp. paratuberculosis
ccggccgcgcaccgccccg

SEQ ID NO: 2929647 - RNA, 20 nt, Mycobacterium avium subsp. paratuberculosis
ccggccgcgcaccgccccgc

SEQ ID NO: 2929648 - RNA, 14 nt, Mycobacterium avium subsp. paratuberculosis
ccggccgcgcccau

SEQ ID NO: 2929649 - RNA, 14 nt, Mycobacterium avium subsp. paratuberculosis
ccggccgcgccggc

SEQ ID NO: 2929650 - RNA, 18 nt, Mycobacterium avium subsp. paratuberculosis
ccggccgcgccggccuug

SEQ ID NO: 2929651 - RNA, 18 nt, Mycobacterium avium subsp. paratuberculosis
ccggccgcgcgcggcgcg

SEQ ID NO: 2929652 - RNA, 13 nt, Mycobacterium avium subsp. paratuberculosis
ccggccgcggccc

SEQ ID NO: 2929653 - RNA, 14 nt, Mycobacterium avium subsp. paratuberculosis
ccggccgcggccca

SEQ ID NO: 2929654 - RNA, 17 nt, Mycobacterium avium subsp. paratuberculosis
ccggccgcggcgugcaa

SEQ ID NO: 2929655 - RNA, 15 nt, Mycobacterium avium subsp. paratuberculosis
ccggccgcgggcgau

SEQ ID NO: 2929656 - RNA, 17 nt, Mycobacterium avium subsp. paratuberculosis
ccggccgcggugaccgc

SEQ ID NO: 2929657 - RNA, 18 nt, Mycobacterium avium subsp. paratuberculosis
ccggccgcggugaccgcg

SEQ ID NO: 2929658 - RNA, 21 nt, Mycobacterium avium subsp. paratuberculosis
ccggccgcggugaccgcgccg

SEQ ID NO: 2929659 - RNA, 15 nt, Mycobacterium avium subsp. paratuberculosis
ccggccgcggugugc

SEQ ID NO: 2929660 - RNA, 23 nt, Mycobacterium avium subsp. paratuberculosis
ccggccgcguacuucgcgcccug

SEQ ID NO: 2929661 - RNA, 17 nt, Mycobacterium avium subsp. paratuberculosis
ccggccgcgucgccgac

SEQ ID NO: 2929662 - RNA, 17 nt, Mycobacterium avium subsp. paratuberculosis
ccggccgcuacccggcg

SEQ ID NO: 2929663 - RNA, 12 nt, Mycobacterium avium subsp. paratuberculosis
ccggccgcucgc

SEQ ID NO: 2929664 - RNA, 18 nt, Mycobacterium avium subsp. paratuberculosis
ccggccgcucgcgggcca

SEQ ID NO: 2929665 - RNA, 14 nt, Mycobacterium avium subsp. paratuberculosis
ccggccggacaccg

SEQ ID NO: 2929666 - RNA, 22 nt, Mycobacterium avium subsp. paratuberculosis
ccggccggacaccgaaccgccc

SEQ ID NO: 2929667 - RNA, 17 nt, Mycobacterium avium subsp. paratuberculosis
ccggccggacagaucgc

SEQ ID NO: 2929668 - RNA, 19 nt, Mycobacterium avium subsp. paratuberculosis
ccggccggacagaucgccc

SEQ ID NO: 2929669 - RNA, 19 nt, Mycobacterium avium subsp. paratuberculosis
ccggccggacaggucgagg

SEQ ID NO: 2929670 - RNA, 16 nt, Mycobacterium avium subsp. paratuberculosis
ccggccggagcggaug

SEQ ID NO: 2929671 - RNA, 22 nt, Mycobacterium avium subsp. paratuberculosis
ccggccggauguuguccggaac

SEQ ID NO: 2929672 - RNA, 14 nt, Mycobacterium avium subsp. paratuberculosis
ccggccggcacgau

SEQ ID NO: 2929673 - RNA, 16 nt, Mycobacterium avium subsp. paratuberculosis
ccggccggcaggucga

SEQ ID NO: 2929674 - RNA, 23 nt, Mycobacterium avium subsp. paratuberculosis
ccggccggcaggucgaggccggc

SEQ ID NO: 2929675 - RNA, 15 nt, Mycobacterium avium subsp. paratuberculosis
ccggccggccccggg

SEQ ID NO: 2929676 - RNA, 21 nt, Mycobacterium avium subsp. paratuberculosis
ccggccggccccuaccgccga

SEQ ID NO: 2929677 - RNA, 14 nt, Mycobacterium avium subsp. paratuberculosis
ccggccggccgaac

SEQ ID NO: 2929678 - RNA, 15 nt, Mycobacterium avium subsp. paratuberculosis
ccggccggccgaaca

SEQ ID NO: 2929679 - RNA, 13 nt, Mycobacterium avium subsp. paratuberculosis
ccggccggccgcc

SEQ ID NO: 2929680 - RNA, 15 nt, Mycobacterium avium subsp. paratuberculosis
ccggccggccgccug

SEQ ID NO: 2929681 - RNA, 18 nt, Mycobacterium avium subsp. paratuberculosis
ccggccggcgcgaccagc

SEQ ID NO: 2929682 - RNA, 22 nt, Mycobacterium avium subsp. paratuberculosis
ccggccggcgcgcacggcagcc

SEQ ID NO: 2929683 - RNA, 16 nt, Mycobacterium avium subsp. paratuberculosis
ccggccggcgcggcgg

SEQ ID NO: 2929684 - RNA, 12 nt, Mycobacterium avium subsp. paratuberculosis
ccggccggcgga

SEQ ID NO: 2929685 - RNA, 20 nt, Mycobacterium avium subsp. paratuberculosis
ccggccggcggacgcggcca

SEQ ID NO: 2929686 - RNA, 21 nt, Mycobacterium avium subsp. paratuberculosis
ccggccggcggacgcggccag

SEQ ID NO: 2929687 - RNA, 12 nt, Mycobacterium avium subsp. paratuberculosis
ccggccggcggc

SEQ ID NO: 2929688 - RNA, 13 nt, Mycobacterium avium subsp. paratuberculosis
ccggccggcgggu

SEQ ID NO: 2929689 - RNA, 14 nt, Mycobacterium avium subsp. paratuberculosis
ccggccggcgguca

SEQ ID NO: 2929690 - RNA, 16 nt, Mycobacterium avium subsp. paratuberculosis
ccggccggcggucagg

SEQ ID NO: 2929691 - RNA, 19 nt, Mycobacterium avium subsp. paratuberculosis
ccggccggcggucaggccg

SEQ ID NO: 2929692 - RNA, 23 nt, Mycobacterium avium subsp. paratuberculosis
ccggccggcggucaggccgucuc

SEQ ID NO: 2929693 - RNA, 13 nt, Mycobacterium avium subsp. paratuberculosis
ccggccggcgugg

SEQ ID NO: 2929694 - RNA, 16 nt, Mycobacterium avium subsp. paratuberculosis
ccggccgggacgcggu

SEQ ID NO: 2929695 - RNA, 14 nt, Mycobacterium avium subsp. paratuberculosis
ccggccgggcgacu

SEQ ID NO: 2929696 - RNA, 20 nt, Mycobacterium avium subsp. paratuberculosis
ccggccgggcgacugcgugc

SEQ ID NO: 2929697 - RNA, 13 nt, Mycobacterium avium subsp. paratuberculosis
ccggccgggcgga

SEQ ID NO: 2929698 - RNA, 20 nt, Mycobacterium avium subsp. paratuberculosis
ccggccgggcggacggcacc

SEQ ID NO: 2929699 - RNA, 19 nt, Mycobacterium avium subsp. paratuberculosis
ccggccgggcugcgcagca

SEQ ID NO: 2929700 - RNA, 14 nt, Mycobacterium avium subsp. paratuberculosis
ccggccggggcgcc

SEQ ID NO: 2929701 - RNA, 15 nt, Mycobacterium avium subsp. paratuberculosis
ccggccggggcgcca

SEQ ID NO: 2929702 - RNA, 15 nt, Mycobacterium avium subsp. paratuberculosis
ccggccgggucacgu

SEQ ID NO: 2929703 - RNA, 15 nt, Mycobacterium avium subsp. paratuberculosis
ccggccgggucgacc

SEQ ID NO: 2929704 - RNA, 21 nt, Mycobacterium avium subsp. paratuberculosis
ccggccgggucgaccgcgaug

SEQ ID NO: 2929705 - RNA, 17 nt, Mycobacterium avium subsp. paratuberculosis
ccggccgguccgcccag

SEQ ID NO: 2929706 - RNA, 12 nt, Mycobacterium avium subsp. paratuberculosis
ccggccggucgc

SEQ ID NO: 2929707 - RNA, 16 nt, Mycobacterium avium subsp. paratuberculosis
ccggccggucgccgau

SEQ ID NO: 2929708 - RNA, 18 nt, Mycobacterium avium subsp. paratuberculosis
ccggccggucgccgaugg

SEQ ID NO: 2929709 - RNA, 19 nt, Mycobacterium avium subsp. paratuberculosis
ccggccggucgccugcuuc

SEQ ID NO: 2929710 - RNA, 17 nt, Mycobacterium avium subsp. paratuberculosis
ccggccggugcuuggcg

SEQ ID NO: 2929711 - RNA, 13 nt, Mycobacterium avium subsp. paratuberculosis
ccggccgguggcc

SEQ ID NO: 2929712 - RNA, 15 nt, Mycobacterium avium subsp. paratuberculosis
ccggcgaccagcccc

SEQ ID NO: 2929713 - RNA, 17 nt, Mycobacterium avium subsp. paratuberculosis
ccggcgaccagccccuc

SEQ ID NO: 2929714 - RNA, 15 nt, Mycobacterium avium subsp. paratuberculosis
ccggcgaccgccacc

SEQ ID NO: 2929715 - RNA, 22 nt, Mycobacterium avium subsp. paratuberculosis
ccggcgaccgccuugucggcga

SEQ ID NO: 2929716 - RNA, 23 nt, Mycobacterium avium subsp. paratuberculosis
ccggcgaccgccuugucggcgau

SEQ ID NO: 2929717 - RNA, 16 nt, Mycobacterium avium subsp. paratuberculosis
ccggcgaccgugccca

SEQ ID NO: 2929718 - RNA, 17 nt, Mycobacterium avium subsp. paratuberculosis
ccggcgaccgugcccac

SEQ ID NO: 2929719 - RNA, 21 nt, Mycobacterium avium subsp. paratuberculosis
ccggcgaccgugcccaccagc

SEQ ID NO: 2929720 - RNA, 23 nt, Mycobacterium avium subsp. paratuberculosis
ccggcgaccgugcccaccagccg

SEQ ID NO: 2929721 - RNA, 17 nt, Mycobacterium avium subsp. paratuberculosis
ccggcgacgaagcagcu

SEQ ID NO: 2929722 - RNA, 18 nt, Mycobacterium avium subsp. paratuberculosis
ccggcgacgaagcagcuc

SEQ ID NO: 2929723 - RNA, 17 nt, Mycobacterium avium subsp. paratuberculosis
ccggcgacgaccgcacc

SEQ ID NO: 2929724 - RNA, 18 nt, Mycobacterium avium subsp. paratuberculosis
ccggcgacgaccgcaccg

SEQ ID NO: 2929725 - RNA, 19 nt, Mycobacterium avium subsp. paratuberculosis
ccggcgacgaccgcaccga

SEQ ID NO: 2929726 - RNA, 19 nt, Mycobacterium avium subsp. paratuberculosis
ccggcgacgauaucggccg

SEQ ID NO: 2929727 - RNA, 20 nt, Mycobacterium avium subsp. paratuberculosis
ccggcgacgauaucggccgc

SEQ ID NO: 2929728 - RNA, 21 nt, Mycobacterium avium subsp. paratuberculosis
ccggcgacgauaucggccgcg

SEQ ID NO: 2929729 - RNA, 22 nt, Mycobacterium avium subsp. paratuberculosis
ccggcgacgauaucggccgcgg

SEQ ID NO: 2929730 - RNA, 13 nt, Mycobacterium avium subsp. paratuberculosis
ccggcgacgccgc

SEQ ID NO: 2929731 - RNA, 14 nt, Mycobacterium avium subsp. paratuberculosis
ccggcgacgccgcg

SEQ ID NO: 2929732 - RNA, 16 nt, Mycobacterium avium subsp. paratuberculosis
ccggcgacgccgcgcu

SEQ ID NO: 2929733 - RNA, 19 nt, Mycobacterium avium subsp. paratuberculosis
ccggcgacgccgcgcuggc

SEQ ID NO: 2929734 - RNA, 21 nt, Mycobacterium avium subsp. paratuberculosis
ccggcgacgccgcgcuggccg

SEQ ID NO: 2929735 - RNA, 15 nt, Mycobacterium avium subsp. paratuberculosis
ccggcgacgccggcg

SEQ ID NO: 2929736 - RNA, 17 nt, Mycobacterium avium subsp. paratuberculosis
ccggcgacgccggcgag

SEQ ID NO: 2929737 - RNA, 15 nt, Mycobacterium avium subsp. paratuberculosis
ccggcgacgcggcgg

SEQ ID NO: 2929738 - RNA, 16 nt, Mycobacterium avium subsp. paratuberculosis
ccggcgacgcggcggg

SEQ ID NO: 2929739 - RNA, 15 nt, Mycobacterium avium subsp. paratuberculosis
ccggcgacggccagc

SEQ ID NO: 2929740 - RNA, 19 nt, Mycobacterium avium subsp. paratuberculosis
ccggcgacggccagcgcgg

SEQ ID NO: 2929741 - RNA, 20 nt, Mycobacterium avium subsp. paratuberculosis
ccggcgacggccagcgcggc

SEQ ID NO: 2929742 - RNA, 15 nt, Mycobacterium avium subsp. paratuberculosis
ccggcgacggcgagu

SEQ ID NO: 2929743 - RNA, 23 nt, Mycobacterium avium subsp. paratuberculosis
ccggcgacggcgaguucgaugac

SEQ ID NO: 2929744 - RNA, 14 nt, Mycobacterium avium subsp. paratuberculosis
ccggcgacggcgcc

SEQ ID NO: 2929745 - RNA, 13 nt, Mycobacterium avium subsp. paratuberculosis
ccggcgacggcgg

SEQ ID NO: 2929746 - RNA, 18 nt, Mycobacterium avium subsp. paratuberculosis
ccggcgacggcggccguc

SEQ ID NO: 2929747 - RNA, 19 nt, Mycobacterium avium subsp. paratuberculosis
ccggcgacgguggcgccca

SEQ ID NO: 2929748 - RNA, 17 nt, Mycobacterium avium subsp. paratuberculosis
ccggcgacgucgccggc

SEQ ID NO: 2929749 - RNA, 14 nt, Mycobacterium avium subsp. paratuberculosis
ccggcgacgucguc

SEQ ID NO: 2929750 - RNA, 16 nt, Mycobacterium avium subsp. paratuberculosis
ccggcgacgucgucga

SEQ ID NO: 2929751 - RNA, 20 nt, Mycobacterium avium subsp. paratuberculosis
ccggcgacgucgucgaugcc

SEQ ID NO: 2929752 - RNA, 23 nt, Mycobacterium avium subsp. paratuberculosis
ccggcgagaucccugcgcucagc

SEQ ID NO: 2929753 - RNA, 22 nt, Mycobacterium avium subsp. paratuberculosis
ccggcgagcacaggaacgcgac

SEQ ID NO: 2929754 - RNA, 17 nt, Mycobacterium avium subsp. paratuberculosis
ccggcgagcacgccgcc

SEQ ID NO: 2929755 - RNA, 19 nt, Mycobacterium avium subsp. paratuberculosis
ccggcgagcacgccgccgg

SEQ ID NO: 2929756 - RNA, 20 nt, Mycobacterium avium subsp. paratuberculosis
ccggcgagcagcccggcgaa

SEQ ID NO: 2929757 - RNA, 15 nt, Mycobacterium avium subsp. paratuberculosis
ccggcgagcgcgcug

SEQ ID NO: 2929758 - RNA, 17 nt, Mycobacterium avium subsp. paratuberculosis
ccggcgagcgcgcugau

SEQ ID NO: 2929759 - RNA, 14 nt, Mycobacterium avium subsp. paratuberculosis
ccggcgagcgcgug

SEQ ID NO: 2929760 - RNA, 15 nt, Mycobacterium avium subsp. paratuberculosis
ccggcgagcggcacc

SEQ ID NO: 2929761 - RNA, 18 nt, Mycobacterium avium subsp. paratuberculosis
ccggcgagcucgcggccg

SEQ ID NO: 2929762 - RNA, 20 nt, Mycobacterium avium subsp. paratuberculosis
ccggcgagcucgcggccgua

SEQ ID NO: 2929763 - RNA, 20 nt, Mycobacterium avium subsp. paratuberculosis
ccggcgaggcggucggcgga

SEQ ID NO: 2929764 - RNA, 18 nt, Mycobacterium avium subsp. paratuberculosis
ccggcgaggugaaccgcg

SEQ ID NO: 2929765 - RNA, 14 nt, Mycobacterium avium subsp. paratuberculosis
ccggcgaggugcgc

SEQ ID NO: 2929766 - RNA, 15 nt, Mycobacterium avium subsp. paratuberculosis
ccggcgaggugcgcc

SEQ ID NO: 2929767 - RNA, 16 nt, Mycobacterium avium subsp. paratuberculosis
ccggcgaggugcgcca

SEQ ID NO: 2929768 - RNA, 22 nt, Mycobacterium avium subsp. paratuberculosis
ccggcgaggugggcaccagcug

SEQ ID NO: 2929769 - RNA, 16 nt, Mycobacterium avium subsp. paratuberculosis
ccggcgaguacccgcc

SEQ ID NO: 2929770 - RNA, 17 nt, Mycobacterium avium subsp. paratuberculosis
ccggcgaguacccgccg

SEQ ID NO: 2929771 - RNA, 18 nt, Mycobacterium avium subsp. paratuberculosis
ccggcgaguacccgccgc

SEQ ID NO: 2929772 - RNA, 19 nt, Mycobacterium avium subsp. paratuberculosis
ccggcgaguacccgccgca

SEQ ID NO: 2929773 - RNA, 17 nt, Mycobacterium avium subsp. paratuberculosis
ccggcgaguccgcggag

SEQ ID NO: 2929774 - RNA, 18 nt, Mycobacterium avium subsp. paratuberculosis
ccggcgagugcgaaucau

SEQ ID NO: 2929775 - RNA, 23 nt, Mycobacterium avium subsp. paratuberculosis
ccggcgagugcgaaucaucgugg

SEQ ID NO: 2929776 - RNA, 21 nt, Mycobacterium avium subsp. paratuberculosis
ccggcgaguggaagucagcgc

SEQ ID NO: 2929777 - RNA, 17 nt, Mycobacterium avium subsp. paratuberculosis
ccggcgauaggcggcca

SEQ ID NO: 2929778 - RNA, 18 nt, Mycobacterium avium subsp. paratuberculosis
ccggcgauaggcggccag

SEQ ID NO: 2929779 - RNA, 19 nt, Mycobacterium avium subsp. paratuberculosis
ccggcgauaggcggccagc

SEQ ID NO: 2929780 - RNA, 20 nt, Mycobacterium avium subsp. paratuberculosis
ccggcgauaggcggccagcu

SEQ ID NO: 2929781 - RNA, 21 nt, Mycobacterium avium subsp. paratuberculosis
ccggcgauaggcggccagcuc

SEQ ID NO: 2929782 - RNA, 16 nt, Mycobacterium avium subsp. paratuberculosis
ccggcgaucaccggga

SEQ ID NO: 2929783 - RNA, 14 nt, Mycobacterium avium subsp. paratuberculosis
ccggcgauccgcgc

SEQ ID NO: 2929784 - RNA, 15 nt, Mycobacterium avium subsp. paratuberculosis
ccggcgauccgcgcg

SEQ ID NO: 2929785 - RNA, 15 nt, Mycobacterium avium subsp. paratuberculosis
ccggcgaucgacguc

SEQ ID NO: 2929786 - RNA, 15 nt, Mycobacterium avium subsp. paratuberculosis
ccggcgaucgucgcc

SEQ ID NO: 2929787 - RNA, 18 nt, Mycobacterium avium subsp. paratuberculosis
ccggcgaucgucgccguc

SEQ ID NO: 2929788 - RNA, 19 nt, Mycobacterium avium subsp. paratuberculosis
ccggcgaucucgucgcgca

SEQ ID NO: 2929789 - RNA, 21 nt, Mycobacterium avium subsp. paratuberculosis
ccggcgaucucgucgcgcagc

SEQ ID NO: 2929790 - RNA, 18 nt, Mycobacterium avium subsp. paratuberculosis
ccggcgaugaacacgccg

SEQ ID NO: 2929791 - RNA, 21 nt, Mycobacterium avium subsp. paratuberculosis
ccggcgaugaacacgccgaua

SEQ ID NO: 2929792 - RNA, 13 nt, Mycobacterium avium subsp. paratuberculosis
ccggcgaugaccg

SEQ ID NO: 2929793 - RNA, 14 nt, Mycobacterium avium subsp. paratuberculosis
ccggcgaugaccgg

SEQ ID NO: 2929794 - RNA, 17 nt, Mycobacterium avium subsp. paratuberculosis
ccggcgaugaccgggac

SEQ ID NO: 2929795 - RNA, 18 nt, Mycobacterium avium subsp. paratuberculosis
ccggcgaugaccgggacg

SEQ ID NO: 2929796 - RNA, 14 nt, Mycobacterium avium subsp. paratuberculosis
ccggcgcccggccg

SEQ ID NO: 2929797 - RNA, 15 nt, Mycobacterium avium subsp. paratuberculosis
ccggcgcccggccgg

SEQ ID NO: 2929798 - RNA, 16 nt, Mycobacterium avium subsp. paratuberculosis
ccggcgcccggccggc

SEQ ID NO: 2929799 - RNA, 16 nt, Mycobacterium avium subsp. paratuberculosis
ccggcgcccggcgcgc

SEQ ID NO: 2929800 - RNA, 17 nt, Mycobacterium avium subsp. paratuberculosis
ccggcgcccggcgcgcc

SEQ ID NO: 2929801 - RNA, 15 nt, Mycobacterium avium subsp. paratuberculosis
ccggcgcccggcucc

SEQ ID NO: 2929802 - RNA, 17 nt, Mycobacterium avium subsp. paratuberculosis
ccggcgcccggcucccc

SEQ ID NO: 2929803 - RNA, 15 nt, Mycobacterium avium subsp. paratuberculosis
ccggcgcccgucacg

SEQ ID NO: 2929804 - RNA, 16 nt, Mycobacterium avium subsp. paratuberculosis
ccggcgcccgucacgc

SEQ ID NO: 2929805 - RNA, 24 nt, Mycobacterium avium subsp. paratuberculosis
ccggcgcccugcacccagccgugc

SEQ ID NO: 2929806 - RNA, 18 nt, Mycobacterium avium subsp. paratuberculosis
ccggcgcccuucggcgcc

SEQ ID NO: 2929807 - RNA, 21 nt, Mycobacterium avium subsp. paratuberculosis
ccggcgccgaagccgucgacc

SEQ ID NO: 2929808 - RNA, 20 nt, Mycobacterium avium subsp. paratuberculosis
ccggcgccgaccaggcucgc

SEQ ID NO: 2929809 - RNA, 20 nt, Mycobacterium avium subsp. paratuberculosis
ccggcgccgacccccgccgc

SEQ ID NO: 2929810 - RNA, 16 nt, Mycobacterium avium subsp. paratuberculosis
ccggcgccgaccgagg

SEQ ID NO: 2929811 - RNA, 21 nt, Mycobacterium avium subsp. paratuberculosis
ccggcgccgacgacgucgcgc

SEQ ID NO: 2929812 - RNA, 12 nt, Mycobacterium avium subsp. paratuberculosis
ccggcgccgauc

SEQ ID NO: 2929813 - RNA, 15 nt, Mycobacterium avium subsp. paratuberculosis
ccggcgccgaucugc

SEQ ID NO: 2929814 - RNA, 21 nt, Mycobacterium avium subsp. paratuberculosis
ccggcgccgaucugcucggcu

SEQ ID NO: 2929815 - RNA, 19 nt, Mycobacterium avium subsp. paratuberculosis
ccggcgccgauuccgucgg

SEQ ID NO: 2929816 - RNA, 13 nt, Mycobacterium avium subsp. paratuberculosis
ccggcgccgccac

SEQ ID NO: 2929817 - RNA, 14 nt, Mycobacterium avium subsp. paratuberculosis
ccggcgccgccacc

SEQ ID NO: 2929818 - RNA, 17 nt, Mycobacterium avium subsp. paratuberculosis
ccggcgccgccaccacg

SEQ ID NO: 2929819 - RNA, 12 nt, Mycobacterium avium subsp. paratuberculosis
ccggcgccgccg

SEQ ID NO: 2929820 - RNA, 13 nt, Mycobacterium avium subsp. paratuberculosis
ccggcgccgccgg

SEQ ID NO: 2929821 - RNA, 21 nt, Mycobacterium avium subsp. paratuberculosis
ccggcgccgccguucgccggc

SEQ ID NO: 2929822 - RNA, 23 nt, Mycobacterium avium subsp. paratuberculosis
ccggcgccgccguucgccggcga

SEQ ID NO: 2929823 - RNA, 12 nt, Mycobacterium avium subsp. paratuberculosis
ccggcgccgcgc

SEQ ID NO: 2929824 - RNA, 17 nt, Mycobacterium avium subsp. paratuberculosis
ccggcgccgcgggcgcc

SEQ ID NO: 2929825 - RNA, 23 nt, Mycobacterium avium subsp. paratuberculosis
ccggcgccgcgggugcggcacgg

SEQ ID NO: 2929826 - RNA, 12 nt, Mycobacterium avium subsp. paratuberculosis
ccggcgccggcc

SEQ ID NO: 2929827 - RNA, 13 nt, Mycobacterium avium subsp. paratuberculosis
ccggcgccggccc

SEQ ID NO: 2929828 - RNA, 15 nt, Mycobacterium avium subsp. paratuberculosis
ccggcgccggcccgc

SEQ ID NO: 2929829 - RNA, 15 nt, Mycobacterium avium subsp. paratuberculosis
ccggcgccggccgac

SEQ ID NO: 2929830 - RNA, 15 nt, Mycobacterium avium subsp. paratuberculosis
ccggcgccggccgcc

SEQ ID NO: 2929831 - RNA, 17 nt, Mycobacterium avium subsp. paratuberculosis
ccggcgccggccgccgg

SEQ ID NO: 2929832 - RNA, 14 nt, Mycobacterium avium subsp. paratuberculosis
ccggcgccggcggc

SEQ ID NO: 2929833 - RNA, 21 nt, Mycobacterium avium subsp. paratuberculosis
ccggcgccggcggucagcuca

SEQ ID NO: 2929834 - RNA, 15 nt, Mycobacterium avium subsp. paratuberculosis
ccggcgccgggcggg

SEQ ID NO: 2929835 - RNA, 18 nt, Mycobacterium avium subsp. paratuberculosis
ccggcgccgggucgcggu

SEQ ID NO: 2929836 - RNA, 12 nt, Mycobacterium avium subsp. paratuberculosis
ccggcgccgguc

SEQ ID NO: 2929837 - RNA, 13 nt, Mycobacterium avium subsp. paratuberculosis
ccggcgccgguca

SEQ ID NO: 2929838 - RNA, 14 nt, Mycobacterium avium subsp. paratuberculosis
ccggcgccggucag

SEQ ID NO: 2929839 - RNA, 16 nt, Mycobacterium avium subsp. paratuberculosis
ccggcgccggucagcg

SEQ ID NO: 2929840 - RNA, 18 nt, Mycobacterium avium subsp. paratuberculosis
ccggcgccggucagcggc

SEQ ID NO: 2929841 - RNA, 20 nt, Mycobacterium avium subsp. paratuberculosis
ccggcgccggucagcggcaa

SEQ ID NO: 2929842 - RNA, 16 nt, Mycobacterium avium subsp. paratuberculosis
ccggcgccggugccgc

SEQ ID NO: 2929843 - RNA, 16 nt, Mycobacterium avium subsp. paratuberculosis
ccggcgccgucgaucc

SEQ ID NO: 2929844 - RNA, 20 nt, Mycobacterium avium subsp. paratuberculosis
ccggcgccucgaugcgggug

SEQ ID NO: 2929845 - RNA, 23 nt, Mycobacterium avium subsp. paratuberculosis
ccggcgccucgaugcggguguug

SEQ ID NO: 2929846 - RNA, 15 nt, Mycobacterium avium subsp. paratuberculosis
ccggcgccucggcgc

SEQ ID NO: 2929847 - RNA, 20 nt, Mycobacterium avium subsp. paratuberculosis
ccggcgccucggcgccucgg

SEQ ID NO: 2929848 - RNA, 23 nt, Mycobacterium avium subsp. paratuberculosis
ccggcgccucggcgccucggcgu

SEQ ID NO: 2929849 - RNA, 12 nt, Mycobacterium avium subsp. paratuberculosis
ccggcgccucgu

SEQ ID NO: 2929850 - RNA, 19 nt, Mycobacterium avium subsp. paratuberculosis
ccggcgcgaccagcggcag

SEQ ID NO: 2929851 - RNA, 20 nt, Mycobacterium avium subsp. paratuberculosis
ccggcgcgaccagcggcagc

SEQ ID NO: 2929852 - RNA, 14 nt, Mycobacterium avium subsp. paratuberculosis
ccggcgcgaccagg

SEQ ID NO: 2929853 - RNA, 15 nt, Mycobacterium avium subsp. paratuberculosis
ccggcgcgaccaggu

SEQ ID NO: 2929854 - RNA, 13 nt, Mycobacterium avium subsp. paratuberculosis
ccggcgcgacggc

SEQ ID NO: 2929855 - RNA, 17 nt, Mycobacterium avium subsp. paratuberculosis
ccggcgcgaucggccgc

SEQ ID NO: 2929856 - RNA, 22 nt, Mycobacterium avium subsp. paratuberculosis
ccggcgcgaucggccgcugccc

SEQ ID NO: 2929857 - RNA, 17 nt, Mycobacterium avium subsp. paratuberculosis
ccggcgcgcaccccggc

SEQ ID NO: 2929858 - RNA, 18 nt, Mycobacterium avium subsp. paratuberculosis
ccggcgcgcaccccggca

SEQ ID NO: 2929859 - RNA, 19 nt, Mycobacterium avium subsp. paratuberculosis
ccggcgcgcaccccggcau

SEQ ID NO: 2929860 - RNA, 15 nt, Mycobacterium avium subsp. paratuberculosis
ccggcgcgcacggca

SEQ ID NO: 2929861 - RNA, 22 nt, Mycobacterium avium subsp. paratuberculosis
ccggcgcgcagcaauugacgcc

SEQ ID NO: 2929862 - RNA, 17 nt, Mycobacterium avium subsp. paratuberculosis
ccggcgcgcagcaucuc

SEQ ID NO: 2929863 - RNA, 14 nt, Mycobacterium avium subsp. paratuberculosis
ccggcgcgcagcca

SEQ ID NO: 2929864 - RNA, 22 nt, Mycobacterium avium subsp. paratuberculosis
ccggcgcgcagccaaugccgga

SEQ ID NO: 2929865 - RNA, 19 nt, Mycobacterium avium subsp. paratuberculosis
ccggcgcgcagccagucgc

SEQ ID NO: 2929866 - RNA, 20 nt, Mycobacterium avium subsp. paratuberculosis
ccggcgcgcagccagucgcc

SEQ ID NO: 2929867 - RNA, 17 nt, Mycobacterium avium subsp. paratuberculosis
ccggcgcgcagcccagc

SEQ ID NO: 2929868 - RNA, 19 nt, Mycobacterium avium subsp. paratuberculosis
ccggcgcgcagcccagcca

SEQ ID NO: 2929869 - RNA, 13 nt, Mycobacterium avium subsp. paratuberculosis
ccggcgcgcagcg

SEQ ID NO: 2929870 - RNA, 16 nt, Mycobacterium avium subsp. paratuberculosis
ccggcgcgcagcgugu

SEQ ID NO: 2929871 - RNA, 12 nt, Mycobacterium avium subsp. paratuberculosis
ccggcgcgccac

SEQ ID NO: 2929872 - RNA, 15 nt, Mycobacterium avium subsp. paratuberculosis
ccggcgcgccacgac

SEQ ID NO: 2929873 - RNA, 16 nt, Mycobacterium avium subsp. paratuberculosis
ccggcgcgccacgacg

SEQ ID NO: 2929874 - RNA, 17 nt, Mycobacterium avium subsp. paratuberculosis
ccggcgcgccacgacgu

SEQ ID NO: 2929875 - RNA, 21 nt, Mycobacterium avium subsp. paratuberculosis
ccggcgcgcccgagucacccg

SEQ ID NO: 2929876 - RNA, 13 nt, Mycobacterium avium subsp. paratuberculosis
ccggcgcgcccgg

SEQ ID NO: 2929877 - RNA, 14 nt, Mycobacterium avium subsp. paratuberculosis
ccggcgcgcccgga

SEQ ID NO: 2929878 - RNA, 19 nt, Mycobacterium avium subsp. paratuberculosis
ccggcgcgccgcguucggc

SEQ ID NO: 2929879 - RNA, 22 nt, Mycobacterium avium subsp. paratuberculosis
ccggcgcgccgcguucggcggc

SEQ ID NO: 2929880 - RNA, 15 nt, Mycobacterium avium subsp. paratuberculosis
ccggcgcgccguccu

SEQ ID NO: 2929881 - RNA, 16 nt, Mycobacterium avium subsp. paratuberculosis
ccggcggccacgcagg

SEQ ID NO: 2929882 - RNA, 22 nt, Mycobacterium avium subsp. paratuberculosis
ccggcggccacgcaggcgucca

SEQ ID NO: 2929883 - RNA, 14 nt, Mycobacterium avium subsp. paratuberculosis
ccggcggccagcau

SEQ ID NO: 2929884 - RNA, 15 nt, Mycobacterium avium subsp. paratuberculosis
ccggcggccagcauc

SEQ ID NO: 2929885 - RNA, 13 nt, Mycobacterium avium subsp. paratuberculosis
ccggcggccagcg

SEQ ID NO: 2929886 - RNA, 13 nt, Mycobacterium avium subsp. paratuberculosis
ccggcggccaugg

SEQ ID NO: 2929887 - RNA, 17 nt, Mycobacterium avium subsp. paratuberculosis
ccggcggccauggucgc

SEQ ID NO: 2929888 - RNA, 19 nt, Mycobacterium avium subsp. paratuberculosis
ccggcggccauggucgcgg

SEQ ID NO: 2929889 - RNA, 22 nt, Mycobacterium avium subsp. paratuberculosis
ccggcggccauggucgcggccg

SEQ ID NO: 2929890 - RNA, 14 nt, Mycobacterium avium subsp. paratuberculosis
ccggcggccccggu

SEQ ID NO: 2929891 - RNA, 12 nt, Mycobacterium avium subsp. paratuberculosis
ccggcggccgac

SEQ ID NO: 2929892 - RNA, 19 nt, Mycobacterium avium subsp. paratuberculosis
ccggcggccgacagggugc

SEQ ID NO: 2929893 - RNA, 15 nt, Mycobacterium avium subsp. paratuberculosis
ccggcggccgccacg

SEQ ID NO: 2929894 - RNA, 16 nt, Mycobacterium avium subsp. paratuberculosis
ccggcggccgccacgc

SEQ ID NO: 2929895 - RNA, 19 nt, Mycobacterium avium subsp. paratuberculosis
ccggcggccgccacgcugg

SEQ ID NO: 2929896 - RNA, 16 nt, Mycobacterium avium subsp. paratuberculosis
ccggcggccgccauca

SEQ ID NO: 2929897 - RNA, 18 nt, Mycobacterium avium subsp. paratuberculosis
ccggcggccgccaucauc

SEQ ID NO: 2929898 - RNA, 13 nt, Mycobacterium avium subsp. paratuberculosis
ccggcggccgccg

SEQ ID NO: 2929899 - RNA, 14 nt, Mycobacterium avium subsp. paratuberculosis
ccggcggccgccgc

SEQ ID NO: 2929900 - RNA, 16 nt, Mycobacterium avium subsp. paratuberculosis
ccggcggccgccgccc

SEQ ID NO: 2929901 - RNA, 17 nt, Mycobacterium avium subsp. paratuberculosis
ccggcggccgccgcccg

SEQ ID NO: 2929902 - RNA, 18 nt, Mycobacterium avium subsp. paratuberculosis
ccggcggccgccgcccgc

SEQ ID NO: 2929903 - RNA, 23 nt, Mycobacterium avium subsp. paratuberculosis
ccggcggccgccgcccgcgcggc

SEQ ID NO: 2929904 - RNA, 18 nt, Mycobacterium avium subsp. paratuberculosis
ccggcggccgccggcacc

SEQ ID NO: 2929905 - RNA, 19 nt, Mycobacterium avium subsp. paratuberculosis
ccggcggccgccggcaccg

SEQ ID NO: 2929906 - RNA, 14 nt, Mycobacterium avium subsp. paratuberculosis
ccggcggccgcgac

SEQ ID NO: 2929907 - RNA, 13 nt, Mycobacterium avium subsp. paratuberculosis
ccggcggccgcgu

SEQ ID NO: 2929908 - RNA, 20 nt, Mycobacterium avium subsp. paratuberculosis
ccggcggccgcgucggcggu

SEQ ID NO: 2929909 - RNA, 13 nt, Mycobacterium avium subsp. paratuberculosis
ccggcggccggcc

SEQ ID NO: 2929910 - RNA, 14 nt, Mycobacterium avium subsp. paratuberculosis
ccggcggccggccc

SEQ ID NO: 2929911 - RNA, 16 nt, Mycobacterium avium subsp. paratuberculosis
ccggcggccggccccg

SEQ ID NO: 2929912 - RNA, 18 nt, Mycobacterium avium subsp. paratuberculosis
ccggcggccggccccggc

SEQ ID NO: 2929913 - RNA, 23 nt, Mycobacterium avium subsp. paratuberculosis
ccggcggccggccccggccgggc

SEQ ID NO: 2929914 - RNA, 17 nt, Mycobacterium avium subsp. paratuberculosis
ccggcggccggccgcgc

SEQ ID NO: 2929915 - RNA, 14 nt, Mycobacterium avium subsp. paratuberculosis
ccggcggccggcgg

SEQ ID NO: 2929916 - RNA, 15 nt, Mycobacterium avium subsp. paratuberculosis
ccggcggcgaagccg

SEQ ID NO: 2929917 - RNA, 21 nt, Mycobacterium avium subsp. paratuberculosis
ccggcggcgaagccggccccg

SEQ ID NO: 2929918 - RNA, 16 nt, Mycobacterium avium subsp. paratuberculosis
ccggcggcgacggcac

SEQ ID NO: 2929919 - RNA, 19 nt, Mycobacterium avium subsp. paratuberculosis
ccggcggcgaucgccgcga

SEQ ID NO: 2929920 - RNA, 22 nt, Mycobacterium avium subsp. paratuberculosis
ccggcggcgaucgccgcgaaca

SEQ ID NO: 2929921 - RNA, 14 nt, Mycobacterium avium subsp. paratuberculosis
ccggcggcgaucgg

SEQ ID NO: 2929922 - RNA, 17 nt, Mycobacterium avium subsp. paratuberculosis
ccggcggcgaucggcgc

SEQ ID NO: 2929923 - RNA, 22 nt, Mycobacterium avium subsp. paratuberculosis
ccggcggcgaucggcgcggcga

SEQ ID NO: 2929924 - RNA, 14 nt, Mycobacterium avium subsp. paratuberculosis
ccggcggcgcccgc

SEQ ID NO: 2929925 - RNA, 17 nt, Mycobacterium avium subsp. paratuberculosis
ccggcggcgcccgcggc

SEQ ID NO: 2929926 - RNA, 18 nt, Mycobacterium avium subsp. paratuberculosis
ccggcggcgcccgcggcc

SEQ ID NO: 2929927 - RNA, 20 nt, Mycobacterium avium subsp. paratuberculosis
ccggcggcgcccgcggccuc

SEQ ID NO: 2929928 - RNA, 19 nt, Mycobacterium avium subsp. paratuberculosis
ccggcggcgccggaggcca

SEQ ID NO: 2929929 - RNA, 23 nt, Mycobacterium avium subsp. paratuberculosis
ccggcggcgccggaggccagcuc

SEQ ID NO: 2929930 - RNA, 14 nt, Mycobacterium avium subsp. paratuberculosis
ccggcggcgcggca

SEQ ID NO: 2929931 - RNA, 15 nt, Mycobacterium avium subsp. paratuberculosis
ccggcggcgcggcag

SEQ ID NO: 2929932 - RNA, 17 nt, Mycobacterium avium subsp. paratuberculosis
ccggcggcgcggcagga

SEQ ID NO: 2929933 - RNA, 15 nt, Mycobacterium avium subsp. paratuberculosis
ccggcggcgcucagc

SEQ ID NO: 2929934 - RNA, 19 nt, Mycobacterium avium subsp. paratuberculosis
ccggcggcgcucagcgcgg

SEQ ID NO: 2929935 - RNA, 22 nt, Mycobacterium avium subsp. paratuberculosis
ccggcggcgcucagcgcggcgg

SEQ ID NO: 2929936 - RNA, 20 nt, Mycobacterium avium subsp. paratuberculosis
ccggcggcgcugccccagcc

SEQ ID NO: 2929937 - RNA, 23 nt, Mycobacterium avium subsp. paratuberculosis
ccggcggcggaccgucggugucg

SEQ ID NO: 2929938 - RNA, 16 nt, Mycobacterium avium subsp. paratuberculosis
ccggcggcggccagcg

SEQ ID NO: 2929939 - RNA, 15 nt, Mycobacterium avium subsp. paratuberculosis
ccggcggcggccuuc

SEQ ID NO: 2929940 - RNA, 15 nt, Mycobacterium avium subsp. paratuberculosis
ccggcggcggcgguc

SEQ ID NO: 2929941 - RNA, 23 nt, Mycobacterium avium subsp. paratuberculosis
ccggcggcggcgguccguucggc

SEQ ID NO: 2929942 - RNA, 20 nt, Mycobacterium avium subsp. paratuberculosis
ccggcggcggcggucggcau

SEQ ID NO: 2929943 - RNA, 16 nt, Mycobacterium avium subsp. paratuberculosis
ccggcggcgggcucgg

SEQ ID NO: 2929944 - RNA, 14 nt, Mycobacterium avium subsp. paratuberculosis
ccggcggcggugag

SEQ ID NO: 2929945 - RNA, 17 nt, Mycobacterium avium subsp. paratuberculosis
ccggcggcggugagcgc

SEQ ID NO: 2929946 - RNA, 18 nt, Mycobacterium avium subsp. paratuberculosis
ccggcggcggugagcgcg

SEQ ID NO: 2929947 - RNA, 13 nt, Mycobacterium avium subsp. paratuberculosis
ccggcggcggugc

SEQ ID NO: 2929948 - RNA, 14 nt, Mycobacterium avium subsp. paratuberculosis
ccggcggcggugcg

SEQ ID NO: 2929949 - RNA, 21 nt, Mycobacterium avium subsp. paratuberculosis
ccggcggcgguuuuggucggc

SEQ ID NO: 2929950 - RNA, 22 nt, Mycobacterium avium subsp. paratuberculosis
ccggcggcgguuuuggucggca

SEQ ID NO: 2929951 - RNA, 14 nt, Mycobacterium avium subsp. paratuberculosis
ccggcggcgucgug

SEQ ID NO: 2929952 - RNA, 17 nt, Mycobacterium avium subsp. paratuberculosis
ccggcggcugugaucgc

SEQ ID NO: 2929953 - RNA, 21 nt, Mycobacterium avium subsp. paratuberculosis
ccggcggcugugaucgcugac

SEQ ID NO: 2929954 - RNA, 13 nt, Mycobacterium avium subsp. paratuberculosis
ccggcgggcaggu

SEQ ID NO: 2929955 - RNA, 16 nt, Mycobacterium avium subsp. paratuberculosis
ccggcgggcaucaucg

SEQ ID NO: 2929956 - RNA, 13 nt, Mycobacterium avium subsp. paratuberculosis
ccggcgggccacg

SEQ ID NO: 2929957 - RNA, 14 nt, Mycobacterium avium subsp. paratuberculosis
ccggcgggccucgc

SEQ ID NO: 2929958 - RNA, 17 nt, Mycobacterium avium subsp. paratuberculosis
ccggcgggccucgccgc

SEQ ID NO: 2929959 - RNA, 22 nt, Mycobacterium avium subsp. paratuberculosis
ccggcgggcgaaaucgcgggcc

SEQ ID NO: 2929960 - RNA, 16 nt, Mycobacterium avium subsp. paratuberculosis
ccggcgggcgccgguc

SEQ ID NO: 2929961 - RNA, 19 nt, Mycobacterium avium subsp. paratuberculosis
ccggcgggcgccggucggc

SEQ ID NO: 2929962 - RNA, 13 nt, Mycobacterium avium subsp. paratuberculosis
ccggcgggcggcc

SEQ ID NO: 2929963 - RNA, 14 nt, Mycobacterium avium subsp. paratuberculosis
ccggcgggcggccg

SEQ ID NO: 2929964 - RNA, 17 nt, Mycobacterium avium subsp. paratuberculosis
ccggcgggcggccgauc

SEQ ID NO: 2929965 - RNA, 16 nt, Mycobacterium avium subsp. paratuberculosis
ccggcgggcggcggcg

SEQ ID NO: 2929966 - RNA, 23 nt, Mycobacterium avium subsp. paratuberculosis
ccggcguccagugcaugccggcc

SEQ ID NO: 2929967 - RNA, 19 nt, Mycobacterium avium subsp. paratuberculosis
ccggcguccaguucggcca

SEQ ID NO: 2929968 - RNA, 20 nt, Mycobacterium avium subsp. paratuberculosis
ccggcguccaguucggccag

SEQ ID NO: 2929969 - RNA, 22 nt, Mycobacterium avium subsp. paratuberculosis
ccggcguccaguucggccagcg

SEQ ID NO: 2929970 - RNA, 14 nt, Mycobacterium avium subsp. paratuberculosis
ccggcguccgcgaa

SEQ ID NO: 2929971 - RNA, 16 nt, Mycobacterium avium subsp. paratuberculosis
ccggcguccgcgaacg

SEQ ID NO: 2929972 - RNA, 19 nt, Mycobacterium avium subsp. paratuberculosis
ccggcguccugcagcagcc

SEQ ID NO: 2929973 - RNA, 23 nt, Mycobacterium avium subsp. paratuberculosis
ccggcgucgaaauagcggcgcac

SEQ ID NO: 2929974 - RNA, 15 nt, Mycobacterium avium subsp. paratuberculosis
ccggcgucgacagcc

SEQ ID NO: 2929975 - RNA, 16 nt, Mycobacterium avium subsp. paratuberculosis
ccggcgucgacagccg

SEQ ID NO: 2929976 - RNA, 19 nt, Mycobacterium avium subsp. paratuberculosis
ccggcgucgacagccgguc

SEQ ID NO: 2929977 - RNA, 21 nt, Mycobacterium avium subsp. paratuberculosis
ccggcgucgacagccggucgc

SEQ ID NO: 2929978 - RNA, 12 nt, Mycobacterium avium subsp. paratuberculosis
ccggcgucgaug

SEQ ID NO: 2929979 - RNA, 16 nt, Mycobacterium avium subsp. paratuberculosis
ccggcgucgaugaugc

SEQ ID NO: 2929980 - RNA, 20 nt, Mycobacterium avium subsp. paratuberculosis
ccggcgucgaugaugccggc

SEQ ID NO: 2929981 - RNA, 21 nt, Mycobacterium avium subsp. paratuberculosis
ccggcgucgaugaugccggcg

SEQ ID NO: 2929982 - RNA, 13 nt, Mycobacterium avium subsp. paratuberculosis
ccggcgucgccgc

SEQ ID NO: 2929983 - RNA, 19 nt, Mycobacterium avium subsp. paratuberculosis
ccggcgucgggaccgucgc

SEQ ID NO: 2929984 - RNA, 21 nt, Mycobacterium avium subsp. paratuberculosis
ccggcgucgggaccgucgcgc

SEQ ID NO: 2929985 - RNA, 22 nt, Mycobacterium avium subsp. paratuberculosis
ccggcgucgggaccgucgcgca

SEQ ID NO: 2929986 - RNA, 19 nt, Mycobacterium avium subsp. paratuberculosis
ccggcgucggugucccgcg

SEQ ID NO: 2929987 - RNA, 21 nt, Mycobacterium avium subsp. paratuberculosis
ccggcgucggugucccgcgcc

SEQ ID NO: 2929988 - RNA, 15 nt, Mycobacterium avium subsp. paratuberculosis
ccggcgucgucgagc

SEQ ID NO: 2929989 - RNA, 19 nt, Mycobacterium avium subsp. paratuberculosis
ccggcgucgucgagcaccg

SEQ ID NO: 2929990 - RNA, 21 nt, Mycobacterium avium subsp. paratuberculosis
ccggcgucgucgagcaccggc

SEQ ID NO: 2929991 - RNA, 23 nt, Mycobacterium avium subsp. paratuberculosis
ccggcgucgucgagcaccggcag

SEQ ID NO: 2929992 - RNA, 20 nt, Mycobacterium avium subsp. paratuberculosis
ccggcgucgucgucgcagug

SEQ ID NO: 2929993 - RNA, 17 nt, Mycobacterium avium subsp. paratuberculosis
ccggcgucucagucggc

SEQ ID NO: 2929994 - RNA, 19 nt, Mycobacterium avium subsp. paratuberculosis
ccggcgucucagucggcca

SEQ ID NO: 2929995 - RNA, 21 nt, Mycobacterium avium subsp. paratuberculosis
ccggcgucucagucggccacc

SEQ ID NO: 2929996 - RNA, 13 nt, Mycobacterium avium subsp. paratuberculosis
ccggcgucucggc

SEQ ID NO: 2929997 - RNA, 15 nt, Mycobacterium avium subsp. paratuberculosis
ccggcgucucggcgu

SEQ ID NO: 2929998 - RNA, 18 nt, Mycobacterium avium subsp. paratuberculosis
ccggcgucugcauccgga

SEQ ID NO: 2929999 - RNA, 20 nt, Mycobacterium avium subsp. paratuberculosis
ccggcgucugcauccggaac

SEQ ID NO: 2930000 - RNA, 23 nt, Mycobacterium avium subsp. paratuberculosis
ccggcgucugcauccggaaccgg

SEQ ID NO: 2930001 - RNA, 17 nt, Mycobacterium avium subsp. paratuberculosis
ccggcgucuugaucucg

SEQ ID NO: 2930002 - RNA, 22 nt, Mycobacterium avium subsp. paratuberculosis
ccggcgucuugaucucggcggc

SEQ ID NO: 2930003 - RNA, 16 nt, Mycobacterium avium subsp. paratuberculosis
ccggcgugagcgagcc

SEQ ID NO: 2930004 - RNA, 19 nt, Mycobacterium avium subsp. paratuberculosis
ccggcgugagcgagccggc

SEQ ID NO: 2930005 - RNA, 18 nt, Mycobacterium avium subsp. paratuberculosis
ccggcgugaugacggcgg

SEQ ID NO: 2930006 - RNA, 20 nt, Mycobacterium avium subsp. paratuberculosis
ccggcgugcacaggccgccg

SEQ ID NO: 2930007 - RNA, 22 nt, Mycobacterium avium subsp. paratuberculosis
ccggcgugcacaggccgccgca

SEQ ID NO: 2930008 - RNA, 15 nt, Mycobacterium avium subsp. paratuberculosis
ccggcgugcagcacg

SEQ ID NO: 2930009 - RNA, 18 nt, Mycobacterium avium subsp. paratuberculosis
ccggcgugcagcacgccc

SEQ ID NO: 2930010 - RNA, 17 nt, Mycobacterium avium subsp. paratuberculosis
ccggcgugccaccgcug

SEQ ID NO: 2930011 - RNA, 18 nt, Mycobacterium avium subsp. paratuberculosis
ccggcgugccaccgcugg

SEQ ID NO: 2930012 - RNA, 16 nt, Mycobacterium avium subsp. paratuberculosis
ccggcgugcuccagca

SEQ ID NO: 2930013 - RNA, 15 nt, Mycobacterium avium subsp. paratuberculosis
ccggcgugcugggcc

SEQ ID NO: 2930014 - RNA, 19 nt, Mycobacterium avium subsp. paratuberculosis
ccggcgugcugggccacga

SEQ ID NO: 2930015 - RNA, 14 nt, Mycobacterium avium subsp. paratuberculosis
ccggcgugggccgc

SEQ ID NO: 2930016 - RNA, 21 nt, Mycobacterium avium subsp. paratuberculosis
ccggcgugggccgcagcgcgg

SEQ ID NO: 2930017 - RNA, 22 nt, Mycobacterium avium subsp. paratuberculosis
ccggcgugggccgcagcgcggc

SEQ ID NO: 2930018 - RNA, 19 nt, Mycobacterium avium subsp. paratuberculosis
ccggcguggggacccccuc

SEQ ID NO: 2930019 - RNA, 16 nt, Mycobacterium avium subsp. paratuberculosis
ccggcgugggugucga

SEQ ID NO: 2930020 - RNA, 15 nt, Mycobacterium avium subsp. paratuberculosis
ccggcguggugggca

SEQ ID NO: 2930021 - RNA, 20 nt, Mycobacterium avium subsp. paratuberculosis
ccggcguggugggcagaugc

SEQ ID NO: 2930022 - RNA, 21 nt, Mycobacterium avium subsp. paratuberculosis
ccggcguuacccgaacccagc

SEQ ID NO: 2930023 - RNA, 23 nt, Mycobacterium avium subsp. paratuberculosis
ccggcguuacccgaacccagcgc

SEQ ID NO: 2930024 - RNA, 17 nt, Mycobacterium avium subsp. paratuberculosis
ccggcguuccagcgcac

SEQ ID NO: 2930025 - RNA, 19 nt, Mycobacterium avium subsp. paratuberculosis
ccggcguugcauuucggcg

SEQ ID NO: 2930026 - RNA, 20 nt, Mycobacterium avium subsp. paratuberculosis
ccggcguuggacagcucgac

SEQ ID NO: 2930027 - RNA, 19 nt, Mycobacterium avium subsp. paratuberculosis
ccggcuaauucgggccgcc

SEQ ID NO: 2930028 - RNA, 20 nt, Mycobacterium avium subsp. paratuberculosis
ccggcuaauucgggccgccg

SEQ ID NO: 2930029 - RNA, 21 nt, Mycobacterium avium subsp. paratuberculosis
ccggcuaauucgggccgccgc

SEQ ID NO: 2930030 - RNA, 16 nt, Mycobacterium avium subsp. paratuberculosis
ccggcuaccgcgcgga

SEQ ID NO: 2930031 - RNA, 13 nt, Mycobacterium avium subsp. paratuberculosis
ccggcuaccggcg

SEQ ID NO: 2930032 - RNA, 17 nt, Mycobacterium avium subsp. paratuberculosis
ccggcuaccggcgcugg

SEQ ID NO: 2930033 - RNA, 18 nt, Mycobacterium avium subsp. paratuberculosis
ccggcuacucggacgccg

SEQ ID NO: 2930034 - RNA, 23 nt, Mycobacterium avium subsp. paratuberculosis
ccggcuacucggacgccggcagc

SEQ ID NO: 2930035 - RNA, 16 nt, Mycobacterium avium subsp. paratuberculosis
ccggcuauucgggccu

SEQ ID NO: 2930036 - RNA, 23 nt, Mycobacterium avium subsp. paratuberculosis
ccggcucaaugccuuugccgugg

SEQ ID NO: 2930037 - RNA, 15 nt, Mycobacterium avium subsp. paratuberculosis
ccggcucagaaggcg

SEQ ID NO: 2930038 - RNA, 13 nt, Mycobacterium avium subsp. paratuberculosis
ccggcucagcccg

SEQ ID NO: 2930039 - RNA, 21 nt, Mycobacterium avium subsp. paratuberculosis
ccggcucagcgcgacgugccg

SEQ ID NO: 2930040 - RNA, 23 nt, Mycobacterium avium subsp. paratuberculosis
ccggcucagcgcgacgugccggc

SEQ ID NO: 2930041 - RNA, 24 nt, Mycobacterium avium subsp. paratuberculosis
ccggcucagcgcgacgugccggcg

SEQ ID NO: 2930042 - RNA, 23 nt, Mycobacterium avium subsp. paratuberculosis
ccggcucagcggcaacugcagga

SEQ ID NO: 2930043 - RNA, 20 nt, Mycobacterium avium subsp. paratuberculosis
ccggcucagggugcgcuggc

SEQ ID NO: 2930044 - RNA, 13 nt, Mycobacterium avium subsp. paratuberculosis
ccggcuccacagc

SEQ ID NO: 2930045 - RNA, 15 nt, Mycobacterium avium subsp. paratuberculosis
ccggcuccaccgcgc

SEQ ID NO: 2930046 - RNA, 16 nt, Mycobacterium avium subsp. paratuberculosis
ccggcuccaccgcgcc

SEQ ID NO: 2930047 - RNA, 20 nt, Mycobacterium avium subsp. paratuberculosis
ccggcuccaccgcgccggcg

SEQ ID NO: 2930048 - RNA, 21 nt, Mycobacterium avium subsp. paratuberculosis
ccggcuccaccgcgccggcgg

SEQ ID NO: 2930049 - RNA, 18 nt, Mycobacterium avium subsp. paratuberculosis
ccggcuccauguccggag

SEQ ID NO: 2930050 - RNA, 21 nt, Mycobacterium avium subsp. paratuberculosis
ccggcuugccgaucgccgcgg

SEQ ID NO: 2930051 - RNA, 15 nt, Mycobacterium avium subsp. paratuberculosis
ccggcuuggccacga

SEQ ID NO: 2930052 - RNA, 16 nt, Mycobacterium avium subsp. paratuberculosis
ccggcuuggccacgau

SEQ ID NO: 2930053 - RNA, 14 nt, Mycobacterium avium subsp. paratuberculosis
ccggcuugggcgaa

SEQ ID NO: 2930054 - RNA, 16 nt, Mycobacterium avium subsp. paratuberculosis
ccggcuuuccgacggc

SEQ ID NO: 2930055 - RNA, 22 nt, Mycobacterium avium subsp. paratuberculosis
ccggcuuucgaagagccggcgu

SEQ ID NO: 2930056 - RNA, 14 nt, Mycobacterium avium subsp. paratuberculosis
ccgggaaacccucg

SEQ ID NO: 2930057 - RNA, 21 nt, Mycobacterium avium subsp. paratuberculosis
ccgggaaagcgggugaccgac

SEQ ID NO: 2930058 - RNA, 23 nt, Mycobacterium avium subsp. paratuberculosis
ccgggaaagcgggugaccgacag

SEQ ID NO: 2930059 - RNA, 21 nt, Mycobacterium avium subsp. paratuberculosis
ccgggaaccagcccaggucgg

SEQ ID NO: 2930060 - RNA, 23 nt, Mycobacterium avium subsp. paratuberculosis
ccgggaaccagcccaggucggga

SEQ ID NO: 2930061 - RNA, 22 nt, Mycobacterium avium subsp. paratuberculosis
ccgggaacgacggugcgcccgu

SEQ ID NO: 2930062 - RNA, 23 nt, Mycobacterium avium subsp. paratuberculosis
ccgggaacgacggugcgcccguc

SEQ ID NO: 2930063 - RNA, 12 nt, Mycobacterium avium subsp. paratuberculosis
ccgggaacgcgg

SEQ ID NO: 2930064 - RNA, 16 nt, Mycobacterium avium subsp. paratuberculosis
ccgggaagcugguggu

SEQ ID NO: 2930065 - RNA, 15 nt, Mycobacterium avium subsp. paratuberculosis
ccgggaaggcggccg

SEQ ID NO: 2930066 - RNA, 16 nt, Mycobacterium avium subsp. paratuberculosis
ccgggaaggcggccgc

SEQ ID NO: 2930067 - RNA, 23 nt, Mycobacterium avium subsp. paratuberculosis
ccgggaaggugguccuggcggug

SEQ ID NO: 2930068 - RNA, 18 nt, Mycobacterium avium subsp. paratuberculosis
ccgggaagucgucguuga

SEQ ID NO: 2930069 - RNA, 18 nt, Mycobacterium avium subsp. paratuberculosis
ccgggaaugucauuugag

SEQ ID NO: 2930070 - RNA, 15 nt, Mycobacterium avium subsp. paratuberculosis
ccgggaaugucgcgc

SEQ ID NO: 2930071 - RNA, 16 nt, Mycobacterium avium subsp. paratuberculosis
ccgggaaugucgcgca

SEQ ID NO: 2930072 - RNA, 19 nt, Mycobacterium avium subsp. paratuberculosis
ccgggacagcccgaacagc

SEQ ID NO: 2930073 - RNA, 15 nt, Mycobacterium avium subsp. paratuberculosis
ccgggacagccgcgc

SEQ ID NO: 2930074 - RNA, 16 nt, Mycobacterium avium subsp. paratuberculosis
ccgggacagccgcgcc

SEQ ID NO: 2930075 - RNA, 19 nt, Mycobacterium avium subsp. paratuberculosis
ccgggacagccgcgccgac

SEQ ID NO: 2930076 - RNA, 18 nt, Mycobacterium avium subsp. paratuberculosis
ccgggacaucgucgcgcc

SEQ ID NO: 2930077 - RNA, 22 nt, Mycobacterium avium subsp. paratuberculosis
ccgggacaucgucgcgcccagg

SEQ ID NO: 2930078 - RNA, 15 nt, Mycobacterium avium subsp. paratuberculosis
ccgggaccagcgcgg

SEQ ID NO: 2930079 - RNA, 22 nt, Mycobacterium avium subsp. paratuberculosis
ccgggacccggaacccgcgugg

SEQ ID NO: 2930080 - RNA, 13 nt, Mycobacterium avium subsp. paratuberculosis
ccgggaccgucgg

SEQ ID NO: 2930081 - RNA, 20 nt, Mycobacterium avium subsp. paratuberculosis
ccgggaccugggucugcggc

SEQ ID NO: 2930082 - RNA, 12 nt, Mycobacterium avium subsp. paratuberculosis
ccgggacgacgg

SEQ ID NO: 2930083 - RNA, 13 nt, Mycobacterium avium subsp. paratuberculosis
ccgggacgacggc

SEQ ID NO: 2930084 - RNA, 17 nt, Mycobacterium avium subsp. paratuberculosis
ccgggacgacggcgccg

SEQ ID NO: 2930085 - RNA, 19 nt, Mycobacterium avium subsp. paratuberculosis
ccgggacgacggcgccgcc

SEQ ID NO: 2930086 - RNA, 21 nt, Mycobacterium avium subsp. paratuberculosis
ccgggacgacggcgccgcccg

SEQ ID NO: 2930087 - RNA, 23 nt, Mycobacterium avium subsp. paratuberculosis
ccgggacgacggcgccgcccggg

SEQ ID NO: 2930088 - RNA, 12 nt, Mycobacterium avium subsp. paratuberculosis
ccgggacgcggu

SEQ ID NO: 2930089 - RNA, 17 nt, Mycobacterium avium subsp. paratuberculosis
ccgggacgggggugccg

SEQ ID NO: 2930090 - RNA, 20 nt, Mycobacterium avium subsp. paratuberculosis
ccgggacgggggugccgacc

SEQ ID NO: 2930091 - RNA, 22 nt, Mycobacterium avium subsp. paratuberculosis
ccgggacgggggugccgaccgc

SEQ ID NO: 2930092 - RNA, 22 nt, Mycobacterium avium subsp. paratuberculosis
ccgggacgggucggugguucgc

SEQ ID NO: 2930093 - RNA, 18 nt, Mycobacterium avium subsp. paratuberculosis
ccgggacggguugcaggc

SEQ ID NO: 2930094 - RNA, 21 nt, Mycobacterium avium subsp. paratuberculosis
ccgggacggguugcaggccac

SEQ ID NO: 2930095 - RNA, 19 nt, Mycobacterium avium subsp. paratuberculosis
ccgggacgucagcccgcgu

SEQ ID NO: 2930096 - RNA, 16 nt, Mycobacterium avium subsp. paratuberculosis
ccgggagaaccucaac

SEQ ID NO: 2930097 - RNA, 19 nt, Mycobacterium avium subsp. paratuberculosis
ccgggagaaccucaacgug

SEQ ID NO: 2930098 - RNA, 22 nt, Mycobacterium avium subsp. paratuberculosis
ccgggagugcuggacggcccga

SEQ ID NO: 2930099 - RNA, 16 nt, Mycobacterium avium subsp. paratuberculosis
ccgggauagagcaccg

SEQ ID NO: 2930100 - RNA, 17 nt, Mycobacterium avium subsp. paratuberculosis
ccgggauagagcaccgc

SEQ ID NO: 2930101 - RNA, 18 nt, Mycobacterium avium subsp. paratuberculosis
ccgggauagagcaccgcg

SEQ ID NO: 2930102 - RNA, 20 nt, Mycobacterium avium subsp. paratuberculosis
ccgggauagagcaccgcgcu

SEQ ID NO: 2930103 - RNA, 17 nt, Mycobacterium avium subsp. paratuberculosis
ccgggauaguucgccgc

SEQ ID NO: 2930104 - RNA, 18 nt, Mycobacterium avium subsp. paratuberculosis
ccgggauaguucgccgcc

SEQ ID NO: 2930105 - RNA, 23 nt, Mycobacterium avium subsp. paratuberculosis
ccgggauaguucgccgccgccag

SEQ ID NO: 2930106 - RNA, 19 nt, Mycobacterium avium subsp. paratuberculosis
ccgggaucacacgcgcgcc

SEQ ID NO: 2930107 - RNA, 14 nt, Mycobacterium avium subsp. paratuberculosis
ccgggauccgaggc

SEQ ID NO: 2930108 - RNA, 17 nt, Mycobacterium avium subsp. paratuberculosis
ccgggauccggcgcgcc

SEQ ID NO: 2930109 - RNA, 18 nt, Mycobacterium avium subsp. paratuberculosis
ccgggauccggcgcgccg

SEQ ID NO: 2930110 - RNA, 19 nt, Mycobacterium avium subsp. paratuberculosis
ccgggauccggcgcgccgc

SEQ ID NO: 2930111 - RNA, 21 nt, Mycobacterium avium subsp. paratuberculosis
ccgggauccggcgcgccgcga

SEQ ID NO: 2930112 - RNA, 18 nt, Mycobacterium avium subsp. paratuberculosis
ccgggaucggcagcgcgc

SEQ ID NO: 2930113 - RNA, 14 nt, Mycobacterium avium subsp. paratuberculosis
ccgggaucggcggc

SEQ ID NO: 2930114 - RNA, 15 nt, Mycobacterium avium subsp. paratuberculosis
ccgggaucggcggcg

SEQ ID NO: 2930115 - RNA, 18 nt, Mycobacterium avium subsp. paratuberculosis
ccgggaucggcggggcgc

SEQ ID NO: 2930116 - RNA, 22 nt, Mycobacterium avium subsp. paratuberculosis
ccgggaucggcggggcgcguuc

SEQ ID NO: 2930117 - RNA, 22 nt, Mycobacterium avium subsp. paratuberculosis
ccgggaucgggcguugcgccgc

SEQ ID NO: 2930118 - RNA, 19 nt, Mycobacterium avium subsp. paratuberculosis
ccgggaucggggugccgcc

SEQ ID NO: 2930119 - RNA, 20 nt, Mycobacterium avium subsp. paratuberculosis
ccgggaucggggugccgccg

SEQ ID NO: 2930120 - RNA, 21 nt, Mycobacterium avium subsp. paratuberculosis
ccgggaucggggugccgccgg

SEQ ID NO: 2930121 - RNA, 13 nt, Mycobacterium avium subsp. paratuberculosis
ccgggaucgugug

SEQ ID NO: 2930122 - RNA, 19 nt, Mycobacterium avium subsp. paratuberculosis
ccgggaucguguggccgcc

SEQ ID NO: 2930123 - RNA, 20 nt, Mycobacterium avium subsp. paratuberculosis
ccgggaucguguggccgccc

SEQ ID NO: 2930124 - RNA, 19 nt, Mycobacterium avium subsp. paratuberculosis
ccgggaucuggccggugag

SEQ ID NO: 2930125 - RNA, 18 nt, Mycobacterium avium subsp. paratuberculosis
ccgggaugacaccgcgga

SEQ ID NO: 2930126 - RNA, 21 nt, Mycobacterium avium subsp. paratuberculosis
ccgggaugacaccgcggacca

SEQ ID NO: 2930127 - RNA, 14 nt, Mycobacterium avium subsp. paratuberculosis
ccgggaugccaguc

SEQ ID NO: 2930128 - RNA, 14 nt, Mycobacterium avium subsp. paratuberculosis
ccgggaugccgccg

SEQ ID NO: 2930129 - RNA, 15 nt, Mycobacterium avium subsp. paratuberculosis
ccgggaugccgccgg

SEQ ID NO: 2930130 - RNA, 16 nt, Mycobacterium avium subsp. paratuberculosis
ccgggaugccgccggu

SEQ ID NO: 2930131 - RNA, 18 nt, Mycobacterium avium subsp. paratuberculosis
ccgggaugccugcccgcg

SEQ ID NO: 2930132 - RNA, 22 nt, Mycobacterium avium subsp. paratuberculosis
ccgggaugccugcccgcgcagg

SEQ ID NO: 2930133 - RNA, 16 nt, Mycobacterium avium subsp. paratuberculosis
ccgggaugcgccaccg

SEQ ID NO: 2930134 - RNA, 17 nt, Mycobacterium avium subsp. paratuberculosis
ccgggccagcagcuuga

SEQ ID NO: 2930135 - RNA, 18 nt, Mycobacterium avium subsp. paratuberculosis
ccgggccagcaggaucug

SEQ ID NO: 2930136 - RNA, 13 nt, Mycobacterium avium subsp. paratuberculosis
ccgggccagcccg

SEQ ID NO: 2930137 - RNA, 17 nt, Mycobacterium avium subsp. paratuberculosis
ccgggccagcugcucgu

SEQ ID NO: 2930138 - RNA, 15 nt, Mycobacterium avium subsp. paratuberculosis
ccgggccaggaccgg

SEQ ID NO: 2930139 - RNA, 13 nt, Mycobacterium avium subsp. paratuberculosis
ccgggccaggaug

SEQ ID NO: 2930140 - RNA, 15 nt, Mycobacterium avium subsp. paratuberculosis
ccgggccaggaugac

SEQ ID NO: 2930141 - RNA, 22 nt, Mycobacterium avium subsp. paratuberculosis
ccgggccaggaugaccgcccag

SEQ ID NO: 2930142 - RNA, 16 nt, Mycobacterium avium subsp. paratuberculosis
ccgggccaggcgcgcg

SEQ ID NO: 2930143 - RNA, 20 nt, Mycobacterium avium subsp. paratuberculosis
ccgggccaggcgcgcguagc

SEQ ID NO: 2930144 - RNA, 16 nt, Mycobacterium avium subsp. paratuberculosis
ccgggccaggucccag

SEQ ID NO: 2930145 - RNA, 18 nt, Mycobacterium avium subsp. paratuberculosis
ccgggccaggucccaggc

SEQ ID NO: 2930146 - RNA, 19 nt, Mycobacterium avium subsp. paratuberculosis
ccgggccaggugugcccgc

SEQ ID NO: 2930147 - RNA, 23 nt, Mycobacterium avium subsp. paratuberculosis
ccgggccaggugugcccgcccuu

SEQ ID NO: 2930148 - RNA, 14 nt, Mycobacterium avium subsp. paratuberculosis
ccgggccagguucg

SEQ ID NO: 2930149 - RNA, 12 nt, Mycobacterium avium subsp. paratuberculosis
ccgggcccacca

SEQ ID NO: 2930150 - RNA, 14 nt, Mycobacterium avium subsp. paratuberculosis
ccgggcccaccagg

SEQ ID NO: 2930151 - RNA, 15 nt, Mycobacterium avium subsp. paratuberculosis
ccgggcccagcacca

SEQ ID NO: 2930152 - RNA, 16 nt, Mycobacterium avium subsp. paratuberculosis
ccgggcccagcaccac

SEQ ID NO: 2930153 - RNA, 15 nt, Mycobacterium avium subsp. paratuberculosis
ccgggcccagcucgg

SEQ ID NO: 2930154 - RNA, 18 nt, Mycobacterium avium subsp. paratuberculosis
ccgggcccgaacaucgcc

SEQ ID NO: 2930155 - RNA, 20 nt, Mycobacterium avium subsp. paratuberculosis
ccgggcccgauggcggccug

SEQ ID NO: 2930156 - RNA, 15 nt, Mycobacterium avium subsp. paratuberculosis
ccgggcccgcugcag

SEQ ID NO: 2930157 - RNA, 16 nt, Mycobacterium avium subsp. paratuberculosis
ccgggcccgcugcagc

SEQ ID NO: 2930158 - RNA, 16 nt, Mycobacterium avium subsp. paratuberculosis
ccgggcccggcgccaa

SEQ ID NO: 2930159 - RNA, 12 nt, Mycobacterium avium subsp. paratuberculosis
ccgggcccgguc

SEQ ID NO: 2930160 - RNA, 17 nt, Mycobacterium avium subsp. paratuberculosis
ccgggcccggucccgcg

SEQ ID NO: 2930161 - RNA, 17 nt, Mycobacterium avium subsp. paratuberculosis
ccgggcccggucgucgc

SEQ ID NO: 2930162 - RNA, 18 nt, Mycobacterium avium subsp. paratuberculosis
ccgggcccggucgucgcc

SEQ ID NO: 2930163 - RNA, 23 nt, Mycobacterium avium subsp. paratuberculosis
ccgggcccguagcucgcgccgac

SEQ ID NO: 2930164 - RNA, 17 nt, Mycobacterium avium subsp. paratuberculosis
ccgggcccucguccgac

SEQ ID NO: 2930165 - RNA, 23 nt, Mycobacterium avium subsp. paratuberculosis
ccgggcccucguccgacagcgcc

SEQ ID NO: 2930166 - RNA, 13 nt, Mycobacterium avium subsp. paratuberculosis
ccgggccgagcgc

SEQ ID NO: 2930167 - RNA, 17 nt, Mycobacterium avium subsp. paratuberculosis
ccgggccgagcgcgccg

SEQ ID NO: 2930168 - RNA, 21 nt, Mycobacterium avium subsp. paratuberculosis
ccgggccgagcgcgccgccgc

SEQ ID NO: 2930169 - RNA, 21 nt, Mycobacterium avium subsp. paratuberculosis
ccgggccgcagcucgcccagc

SEQ ID NO: 2930170 - RNA, 16 nt, Mycobacterium avium subsp. paratuberculosis
ccgggccgcagggugg

SEQ ID NO: 2930171 - RNA, 22 nt, Mycobacterium avium subsp. paratuberculosis
ccgggccgcauccagcgccgcc

SEQ ID NO: 2930172 - RNA, 17 nt, Mycobacterium avium subsp. paratuberculosis
ccgggccgccacggcgc

SEQ ID NO: 2930173 - RNA, 14 nt, Mycobacterium avium subsp. paratuberculosis
ccgggccgccauca

SEQ ID NO: 2930174 - RNA, 21 nt, Mycobacterium avium subsp. paratuberculosis
ccgggccgccaucaccgcgcu

SEQ ID NO: 2930175 - RNA, 14 nt, Mycobacterium avium subsp. paratuberculosis
ccgggccgcccgcg

SEQ ID NO: 2930176 - RNA, 17 nt, Mycobacterium avium subsp. paratuberculosis
ccgggccgcccgcgcgu

SEQ ID NO: 2930177 - RNA, 21 nt, Mycobacterium avium subsp. paratuberculosis
ccgggccgcccgcgcgugguc

SEQ ID NO: 2930178 - RNA, 23 nt, Mycobacterium avium subsp. paratuberculosis
ccgggccgcccgcgcgugguccc

SEQ ID NO: 2930179 - RNA, 17 nt, Mycobacterium avium subsp. paratuberculosis
ccgggccgccgaugcgc

SEQ ID NO: 2930180 - RNA, 13 nt, Mycobacterium avium subsp. paratuberculosis
ccgggccgccgcg

SEQ ID NO: 2930181 - RNA, 14 nt, Mycobacterium avium subsp. paratuberculosis
ccgggccgccgcgg

SEQ ID NO: 2930182 - RNA, 18 nt, Mycobacterium avium subsp. paratuberculosis
ccgggccgccgcggccac

SEQ ID NO: 2930183 - RNA, 21 nt, Mycobacterium avium subsp. paratuberculosis
ccgggccgccgcggccacacu

SEQ ID NO: 2930184 - RNA, 13 nt, Mycobacterium avium subsp. paratuberculosis
ccgggccgccggc

SEQ ID NO: 2930185 - RNA, 15 nt, Mycobacterium avium subsp. paratuberculosis
ccgggccgccggccg

SEQ ID NO: 2930186 - RNA, 12 nt, Mycobacterium avium subsp. paratuberculosis
ccgggccgccuc

SEQ ID NO: 2930187 - RNA, 13 nt, Mycobacterium avium subsp. paratuberculosis
ccgggccgcgccc

SEQ ID NO: 2930188 - RNA, 14 nt, Mycobacterium avium subsp. paratuberculosis
ccgggccgcggcgg

SEQ ID NO: 2930189 - RNA, 16 nt, Mycobacterium avium subsp. paratuberculosis
ccgggccgcggcggua

SEQ ID NO: 2930190 - RNA, 20 nt, Mycobacterium avium subsp. paratuberculosis
ccgggccgcuggccgccccg

SEQ ID NO: 2930191 - RNA, 23 nt, Mycobacterium avium subsp. paratuberculosis
ccgggccgcuggugaggucgcgc

SEQ ID NO: 2930192 - RNA, 18 nt, Mycobacterium avium subsp. paratuberculosis
ccgggccggaacgcccga

SEQ ID NO: 2930193 - RNA, 18 nt, Mycobacterium avium subsp. paratuberculosis
ccgggccggacacggcug

SEQ ID NO: 2930194 - RNA, 15 nt, Mycobacterium avium subsp. paratuberculosis
ccgggccggaggugc

SEQ ID NO: 2930195 - RNA, 22 nt, Mycobacterium avium subsp. paratuberculosis
ccgggccggaggugcgggucuc

SEQ ID NO: 2930196 - RNA, 14 nt, Mycobacterium avium subsp. paratuberculosis
ccgggccggccaga

SEQ ID NO: 2930197 - RNA, 15 nt, Mycobacterium avium subsp. paratuberculosis
ccgggccggcggcca

SEQ ID NO: 2930198 - RNA, 16 nt, Mycobacterium avium subsp. paratuberculosis
ccgggccggcggccag

SEQ ID NO: 2930199 - RNA, 18 nt, Mycobacterium avium subsp. paratuberculosis
ccgggccggcggccaguu

SEQ ID NO: 2930200 - RNA, 21 nt, Mycobacterium avium subsp. paratuberculosis
ccgggccggcggccaguucga

SEQ ID NO: 2930201 - RNA, 13 nt, Mycobacterium avium subsp. paratuberculosis
ccgggccggcggu

SEQ ID NO: 2930202 - RNA, 15 nt, Mycobacterium avium subsp. paratuberculosis
ccgggccggcgucgc

SEQ ID NO: 2930203 - RNA, 18 nt, Mycobacterium avium subsp. paratuberculosis
ccgggccggcgucgcggu

SEQ ID NO: 2930204 - RNA, 14 nt, Mycobacterium avium subsp. paratuberculosis
ccgggccgggucca

SEQ ID NO: 2930205 - RNA, 20 nt, Mycobacterium avium subsp. paratuberculosis
ccgggccgguaaaacuggcc

SEQ ID NO: 2930206 - RNA, 19 nt, Mycobacterium avium subsp. paratuberculosis
ccgggccguaucggccccg

SEQ ID NO: 2930207 - RNA, 21 nt, Mycobacterium avium subsp. paratuberculosis
ccgggccguaucggccccggc

SEQ ID NO: 2930208 - RNA, 22 nt, Mycobacterium avium subsp. paratuberculosis
ccgggccguaucggccccggcc

SEQ ID NO: 2930209 - RNA, 12 nt, Mycobacterium avium subsp. paratuberculosis
ccgggccguccg

SEQ ID NO: 2930210 - RNA, 17 nt, Mycobacterium avium subsp. paratuberculosis
ccgggccguccgggugc

SEQ ID NO: 2930211 - RNA, 23 nt, Mycobacterium avium subsp. paratuberculosis
ccgggccguccgggugcgggcug

SEQ ID NO: 2930212 - RNA, 18 nt, Mycobacterium avium subsp. paratuberculosis
ccgggccguucagcgggc

SEQ ID NO: 2930213 - RNA, 21 nt, Mycobacterium avium subsp. paratuberculosis
ccgggccguucagcgggcggu

SEQ ID NO: 2930214 - RNA, 22 nt, Mycobacterium avium subsp. paratuberculosis
ccgggccuccuguuggcccugc

SEQ ID NO: 2930215 - RNA, 16 nt, Mycobacterium avium subsp. paratuberculosis
ccgggccugcgcgccg

SEQ ID NO: 2930216 - RNA, 15 nt, Mycobacterium avium subsp. paratuberculosis
ccgggccugcggcgc

SEQ ID NO: 2930217 - RNA, 17 nt, Mycobacterium avium subsp. paratuberculosis
ccgggccugcggcggcc

SEQ ID NO: 2930218 - RNA, 18 nt, Mycobacterium avium subsp. paratuberculosis
ccgggccugcggcggccg

SEQ ID NO: 2930219 - RNA, 13 nt, Mycobacterium avium subsp. paratuberculosis
ccgggcggcgccg

SEQ ID NO: 2930220 - RNA, 16 nt, Mycobacterium avium subsp. paratuberculosis
ccgggcggcgccgaac

SEQ ID NO: 2930221 - RNA, 19 nt, Mycobacterium avium subsp. paratuberculosis
ccgggcggcggccuccgga

SEQ ID NO: 2930222 - RNA, 18 nt, Mycobacterium avium subsp. paratuberculosis
ccgggcggcggggcugcc

SEQ ID NO: 2930223 - RNA, 12 nt, Mycobacterium avium subsp. paratuberculosis
ccgggcggcguc

SEQ ID NO: 2930224 - RNA, 21 nt, Mycobacterium avium subsp. paratuberculosis
ccgggcgggcaccccaucggc

SEQ ID NO: 2930225 - RNA, 13 nt, Mycobacterium avium subsp. paratuberculosis
ccgggcgggccgc

SEQ ID NO: 2930226 - RNA, 16 nt, Mycobacterium avium subsp. paratuberculosis
ccgggcgggccgcagc

SEQ ID NO: 2930227 - RNA, 22 nt, Mycobacterium avium subsp. paratuberculosis
ccgggcgggccgcagcaccacc

SEQ ID NO: 2930228 - RNA, 18 nt, Mycobacterium avium subsp. paratuberculosis
ccgggcgggcgcaggugg

SEQ ID NO: 2930229 - RNA, 22 nt, Mycobacterium avium subsp. paratuberculosis
ccgggcgggcgcaggugggcgg

SEQ ID NO: 2930230 - RNA, 18 nt, Mycobacterium avium subsp. paratuberculosis
ccgggcgggcugcgggca

SEQ ID NO: 2930231 - RNA, 19 nt, Mycobacterium avium subsp. paratuberculosis
ccgggcggucgcgucgucg

SEQ ID NO: 2930232 - RNA, 21 nt, Mycobacterium avium subsp. paratuberculosis
ccgggcggucgcgucgucggc

SEQ ID NO: 2930233 - RNA, 22 nt, Mycobacterium avium subsp. paratuberculosis
ccgggcggucgcgucgucggcg

SEQ ID NO: 2930234 - RNA, 18 nt, Mycobacterium avium subsp. paratuberculosis
ccgggcggugaccacgcc

SEQ ID NO: 2930235 - RNA, 22 nt, Mycobacterium avium subsp. paratuberculosis
ccgggcggugaccacgccgugc

SEQ ID NO: 2930236 - RNA, 21 nt, Mycobacterium avium subsp. paratuberculosis
ccgggcgguuuccacgaugac

SEQ ID NO: 2930237 - RNA, 22 nt, Mycobacterium avium subsp. paratuberculosis
ccgggcguagugcagcugcagc

SEQ ID NO: 2930238 - RNA, 12 nt, Mycobacterium avium subsp. paratuberculosis
ccgggcgucacg

SEQ ID NO: 2930239 - RNA, 16 nt, Mycobacterium avium subsp. paratuberculosis
ccgggcgucacgccag

SEQ ID NO: 2930240 - RNA, 20 nt, Mycobacterium avium subsp. paratuberculosis
ccgggcgucacucuggcgug

SEQ ID NO: 2930241 - RNA, 14 nt, Mycobacterium avium subsp. paratuberculosis
ccgggcgucgacga

SEQ ID NO: 2930242 - RNA, 14 nt, Mycobacterium avium subsp. paratuberculosis
ccgggcgucggcgg

SEQ ID NO: 2930243 - RNA, 14 nt, Mycobacterium avium subsp. paratuberculosis
ccgggcgucggggc

SEQ ID NO: 2930244 - RNA, 22 nt, Mycobacterium avium subsp. paratuberculosis
ccgggcgucggggcccuccgcg

SEQ ID NO: 2930245 - RNA, 16 nt, Mycobacterium avium subsp. paratuberculosis
ccgggcgugcccggcg

SEQ ID NO: 2930246 - RNA, 20 nt, Mycobacterium avium subsp. paratuberculosis
ccgggcgugcccggcgcaca

SEQ ID NO: 2930247 - RNA, 21 nt, Mycobacterium avium subsp. paratuberculosis
ccgggcgugccggacaccggc

SEQ ID NO: 2930248 - RNA, 17 nt, Mycobacterium avium subsp. paratuberculosis
ccgggcguugcccgccg

SEQ ID NO: 2930249 - RNA, 19 nt, Mycobacterium avium subsp. paratuberculosis
ccgggcguugcccgccgcg

SEQ ID NO: 2930250 - RNA, 20 nt, Mycobacterium avium subsp. paratuberculosis
ccgggcguugcccgccgcgg

SEQ ID NO: 2930251 - RNA, 23 nt, Mycobacterium avium subsp. paratuberculosis
ccgggcguugcccgccgcggcga

SEQ ID NO: 2930252 - RNA, 23 nt, Mycobacterium avium subsp. paratuberculosis
ccgggcuaagucguugcccgcca

SEQ ID NO: 2930253 - RNA, 24 nt, Mycobacterium avium subsp. paratuberculosis
ccgggcuaagucguugcccgccag

SEQ ID NO: 2930254 - RNA, 17 nt, Mycobacterium avium subsp. paratuberculosis
ccgggcuaucgcccggc

SEQ ID NO: 2930255 - RNA, 19 nt, Mycobacterium avium subsp. paratuberculosis
ccgggcuaucgcccggcgc

SEQ ID NO: 2930256 - RNA, 17 nt, Mycobacterium avium subsp. paratuberculosis
ccgggcuccagcggguc

SEQ ID NO: 2930257 - RNA, 14 nt, Mycobacterium avium subsp. paratuberculosis
ccgggcuccgcguu

SEQ ID NO: 2930258 - RNA, 17 nt, Mycobacterium avium subsp. paratuberculosis
ccgggcuccgcguucga

SEQ ID NO: 2930259 - RNA, 14 nt, Mycobacterium avium subsp. paratuberculosis
ccgggcucgagcac

SEQ ID NO: 2930260 - RNA, 16 nt, Mycobacterium avium subsp. paratuberculosis
ccgggcucgagcaccg

SEQ ID NO: 2930261 - RNA, 19 nt, Mycobacterium avium subsp. paratuberculosis
ccgggcucgagggcggcga

SEQ ID NO: 2930262 - RNA, 23 nt, Mycobacterium avium subsp. paratuberculosis
ccgggcucgagggcggcgaccug

SEQ ID NO: 2930263 - RNA, 18 nt, Mycobacterium avium subsp. paratuberculosis
ccgggcucggucaccccg

SEQ ID NO: 2930264 - RNA, 13 nt, Mycobacterium avium subsp. paratuberculosis
ccgggcugacccg

SEQ ID NO: 2930265 - RNA, 14 nt, Mycobacterium avium subsp. paratuberculosis
ccgggcugaccucg

SEQ ID NO: 2930266 - RNA, 19 nt, Mycobacterium avium subsp. paratuberculosis
ccgggcugagcugugccgc

SEQ ID NO: 2930267 - RNA, 20 nt, Mycobacterium avium subsp. paratuberculosis
ccgggcugagcugugccgcg

SEQ ID NO: 2930268 - RNA, 23 nt, Mycobacterium avium subsp. paratuberculosis
ccgggcugcacgcugcgcacccg

SEQ ID NO: 2930269 - RNA, 13 nt, Mycobacterium avium subsp. paratuberculosis
ccgggcugcagca

SEQ ID NO: 2930270 - RNA, 15 nt, Mycobacterium avium subsp. paratuberculosis
ccgggcugcagcagc

SEQ ID NO: 2930271 - RNA, 19 nt, Mycobacterium avium subsp. paratuberculosis
ccgggcugcccaccaccag

SEQ ID NO: 2930272 - RNA, 20 nt, Mycobacterium avium subsp. paratuberculosis
ccgggcugcccggcgccggu

SEQ ID NO: 2930273 - RNA, 15 nt, Mycobacterium avium subsp. paratuberculosis
ccgggcugccguaga

SEQ ID NO: 2930274 - RNA, 14 nt, Mycobacterium avium subsp. paratuberculosis
ccgggcugcgcagc

SEQ ID NO: 2930275 - RNA, 18 nt, Mycobacterium avium subsp. paratuberculosis
ccgggcugcgcagcaccg

SEQ ID NO: 2930276 - RNA, 14 nt, Mycobacterium avium subsp. paratuberculosis
ccgggcugcgguuc

SEQ ID NO: 2930277 - RNA, 21 nt, Mycobacterium avium subsp. paratuberculosis
ccgggcugcgguuccgggcgc

SEQ ID NO: 2930278 - RNA, 14 nt, Mycobacterium avium subsp. paratuberculosis
ccgggcuggccguc

SEQ ID NO: 2930279 - RNA, 16 nt, Mycobacterium avium subsp. paratuberculosis
ccgggcuggccgucgg

SEQ ID NO: 2930280 - RNA, 17 nt, Mycobacterium avium subsp. paratuberculosis
ccgggcuggccgucggc

SEQ ID NO: 2930281 - RNA, 19 nt, Mycobacterium avium subsp. paratuberculosis
ccgggcuggccgucggcga

SEQ ID NO: 2930282 - RNA, 20 nt, Mycobacterium avium subsp. paratuberculosis
ccgggcuggccgucggcgau

SEQ ID NO: 2930283 - RNA, 14 nt, Mycobacterium avium subsp. paratuberculosis
ccgggcuggcgcug

SEQ ID NO: 2930284 - RNA, 15 nt, Mycobacterium avium subsp. paratuberculosis
ccgggcuggguccga

SEQ ID NO: 2930285 - RNA, 15 nt, Mycobacterium avium subsp. paratuberculosis
ccgggcugucgggca

SEQ ID NO: 2930286 - RNA, 17 nt, Mycobacterium avium subsp. paratuberculosis
ccgggcugugggcgcag

SEQ ID NO: 2930287 - RNA, 21 nt, Mycobacterium avium subsp. paratuberculosis
ccgggcugugggcgcagggcc

SEQ ID NO: 2930288 - RNA, 15 nt, Mycobacterium avium subsp. paratuberculosis
ccggggaacaccggc

SEQ ID NO: 2930289 - RNA, 20 nt, Mycobacterium avium subsp. paratuberculosis
ccggggaacaccggcgaggu

SEQ ID NO: 2930290 - RNA, 14 nt, Mycobacterium avium subsp. paratuberculosis
ccggggacccgcac

SEQ ID NO: 2930291 - RNA, 13 nt, Mycobacterium avium subsp. paratuberculosis
ccggggacggugc

SEQ ID NO: 2930292 - RNA, 15 nt, Mycobacterium avium subsp. paratuberculosis
ccggggacggugcag

SEQ ID NO: 2930293 - RNA, 19 nt, Mycobacterium avium subsp. paratuberculosis
ccggggacggugcagccgg

SEQ ID NO: 2930294 - RNA, 15 nt, Mycobacterium avium subsp. paratuberculosis
ccggggaucaccucg

SEQ ID NO: 2930295 - RNA, 16 nt, Mycobacterium avium subsp. paratuberculosis
ccggggaucgcgcagc

SEQ ID NO: 2930296 - RNA, 19 nt, Mycobacterium avium subsp. paratuberculosis
ccggggcacgcgcgcccgg

SEQ ID NO: 2930297 - RNA, 20 nt, Mycobacterium avium subsp. paratuberculosis
ccggggcacgcgcgcccggc

SEQ ID NO: 2930298 - RNA, 14 nt, Mycobacterium avium subsp. paratuberculosis
ccggggcacggugg

SEQ ID NO: 2930299 - RNA, 15 nt, Mycobacterium avium subsp. paratuberculosis
ccggggcacgguggg

SEQ ID NO: 2930300 - RNA, 13 nt, Mycobacterium avium subsp. paratuberculosis
ccggggcagcacc

SEQ ID NO: 2930301 - RNA, 14 nt, Mycobacterium avium subsp. paratuberculosis
ccggggcagcaccc

SEQ ID NO: 2930302 - RNA, 17 nt, Mycobacterium avium subsp. paratuberculosis
ccggggcagcagcaucg

SEQ ID NO: 2930303 - RNA, 17 nt, Mycobacterium avium subsp. paratuberculosis
ccggggccaacuccggc

SEQ ID NO: 2930304 - RNA, 15 nt, Mycobacterium avium subsp. paratuberculosis
ccggguagggcagcc

SEQ ID NO: 2930305 - RNA, 18 nt, Mycobacterium avium subsp. paratuberculosis
ccggguagggcagccaca

SEQ ID NO: 2930306 - RNA, 15 nt, Mycobacterium avium subsp. paratuberculosis
ccggguaucgacagu

SEQ ID NO: 2930307 - RNA, 17 nt, Mycobacterium avium subsp. paratuberculosis
ccggguauuucgagcac

SEQ ID NO: 2930308 - RNA, 22 nt, Mycobacterium avium subsp. paratuberculosis
ccgggucacgugcacccacgcc

SEQ ID NO: 2930309 - RNA, 15 nt, Mycobacterium avium subsp. paratuberculosis
ccgggucagcaccac

SEQ ID NO: 2930310 - RNA, 23 nt, Mycobacterium avium subsp. paratuberculosis
ccgggucagcaccaccaacagca

SEQ ID NO: 2930311 - RNA, 19 nt, Mycobacterium avium subsp. paratuberculosis
ccgggucaguucgcggcgc

SEQ ID NO: 2930312 - RNA, 19 nt, Mycobacterium avium subsp. paratuberculosis
ccgggucauccagccgugg

SEQ ID NO: 2930313 - RNA, 16 nt, Mycobacterium avium subsp. paratuberculosis
ccgggucauccccgug

SEQ ID NO: 2930314 - RNA, 14 nt, Mycobacterium avium subsp. paratuberculosis
ccggguccacgccg

SEQ ID NO: 2930315 - RNA, 21 nt, Mycobacterium avium subsp. paratuberculosis
ccgggucccccgccgaccggu

SEQ ID NO: 2930316 - RNA, 14 nt, Mycobacterium avium subsp. paratuberculosis
ccggguccccgccg

SEQ ID NO: 2930317 - RNA, 16 nt, Mycobacterium avium subsp. paratuberculosis
ccggguccccgccgcc

SEQ ID NO: 2930318 - RNA, 17 nt, Mycobacterium avium subsp. paratuberculosis
ccggguccccgccgccg

SEQ ID NO: 2930319 - RNA, 21 nt, Mycobacterium avium subsp. paratuberculosis
ccggguccccgccgccgugca

SEQ ID NO: 2930320 - RNA, 19 nt, Mycobacterium avium subsp. paratuberculosis
ccggguccgaggugaucgc

SEQ ID NO: 2930321 - RNA, 15 nt, Mycobacterium avium subsp. paratuberculosis
ccggguccgcgguga

SEQ ID NO: 2930322 - RNA, 18 nt, Mycobacterium avium subsp. paratuberculosis
ccggguccuggcccccgc

SEQ ID NO: 2930323 - RNA, 20 nt, Mycobacterium avium subsp. paratuberculosis
ccggguccuugcgccccggc

SEQ ID NO: 2930324 - RNA, 21 nt, Mycobacterium avium subsp. paratuberculosis
ccggguccuugcgccccggcg

SEQ ID NO: 2930325 - RNA, 13 nt, Mycobacterium avium subsp. paratuberculosis
ccgggucgaacgg

SEQ ID NO: 2930326 - RNA, 14 nt, Mycobacterium avium subsp. paratuberculosis
ccgggucgaacggc

SEQ ID NO: 2930327 - RNA, 13 nt, Mycobacterium avium subsp. paratuberculosis
ccgggucgaccgc

SEQ ID NO: 2930328 - RNA, 17 nt, Mycobacterium avium subsp. paratuberculosis
ccgggucgaccgccucg

SEQ ID NO: 2930329 - RNA, 20 nt, Mycobacterium avium subsp. paratuberculosis
ccgggucgaccgccucggau

SEQ ID NO: 2930330 - RNA, 14 nt, Mycobacterium avium subsp. paratuberculosis
ccgggucgaccgcg

SEQ ID NO: 2930331 - RNA, 14 nt, Mycobacterium avium subsp. paratuberculosis
ccgggucgacgccg

SEQ ID NO: 2930332 - RNA, 13 nt, Mycobacterium avium subsp. paratuberculosis
ccgggucgagcgc

SEQ ID NO: 2930333 - RNA, 14 nt, Mycobacterium avium subsp. paratuberculosis
ccgggucgagcggc

SEQ ID NO: 2930334 - RNA, 18 nt, Mycobacterium avium subsp. paratuberculosis
ccgggucgagcggcccgc

SEQ ID NO: 2930335 - RNA, 19 nt, Mycobacterium avium subsp. paratuberculosis
ccgggucgagcggcccgca

SEQ ID NO: 2930336 - RNA, 22 nt, Mycobacterium avium subsp. paratuberculosis
ccgggucgagcggcccgcaccg

SEQ ID NO: 2930337 - RNA, 21 nt, Mycobacterium avium subsp. paratuberculosis
ccgggucgcacagccgcagca

SEQ ID NO: 2930338 - RNA, 15 nt, Mycobacterium avium subsp. paratuberculosis
ccgggucgcacgccg

SEQ ID NO: 2930339 - RNA, 13 nt, Mycobacterium avium subsp. paratuberculosis
ccgggucgcagcg

SEQ ID NO: 2930340 - RNA, 19 nt, Mycobacterium avium subsp. paratuberculosis
ccgggucgcagcggcacgu

SEQ ID NO: 2930341 - RNA, 15 nt, Mycobacterium avium subsp. paratuberculosis
ccgggucgcaggcag

SEQ ID NO: 2930342 - RNA, 16 nt, Mycobacterium avium subsp. paratuberculosis
ccgggucgcaggcagc

SEQ ID NO: 2930343 - RNA, 13 nt, Mycobacterium avium subsp. paratuberculosis
ccgggucgccgau

SEQ ID NO: 2930344 - RNA, 15 nt, Mycobacterium avium subsp. paratuberculosis
ccgggucgccgauca

SEQ ID NO: 2930345 - RNA, 17 nt, Mycobacterium avium subsp. paratuberculosis
ccgggucgccgaucacg

SEQ ID NO: 2930346 - RNA, 14 nt, Mycobacterium avium subsp. paratuberculosis
ccgggucgccgucg

SEQ ID NO: 2930347 - RNA, 15 nt, Mycobacterium avium subsp. paratuberculosis
ccgggucgccgucga

SEQ ID NO: 2930348 - RNA, 21 nt, Mycobacterium avium subsp. paratuberculosis
ccgggucgcggcuggugccgc

SEQ ID NO: 2930349 - RNA, 12 nt, Mycobacterium avium subsp. paratuberculosis
ccgggucgcggu

SEQ ID NO: 2930350 - RNA, 22 nt, Mycobacterium avium subsp. paratuberculosis
ccgggucgcggugggcucggcg

SEQ ID NO: 2930351 - RNA, 21 nt, Mycobacterium avium subsp. paratuberculosis
ccgggucggcucggcucggcc

SEQ ID NO: 2930352 - RNA, 14 nt, Mycobacterium avium subsp. paratuberculosis
ccgggucguagccg

SEQ ID NO: 2930353 - RNA, 23 nt, Mycobacterium avium subsp. paratuberculosis
ccgggucguagccgaagccgccg

SEQ ID NO: 2930354 - RNA, 17 nt, Mycobacterium avium subsp. paratuberculosis
ccgggucguaggccgga

SEQ ID NO: 2930355 - RNA, 16 nt, Mycobacterium avium subsp. paratuberculosis
ccgggucguccgcgac

SEQ ID NO: 2930356 - RNA, 12 nt, Mycobacterium avium subsp. paratuberculosis
ccgggucgucgc

SEQ ID NO: 2930357 - RNA, 15 nt, Mycobacterium avium subsp. paratuberculosis
ccgggucgucggugc

SEQ ID NO: 2930358 - RNA, 17 nt, Mycobacterium avium subsp. paratuberculosis
ccgggucgucggugccg

SEQ ID NO: 2930359 - RNA, 20 nt, Mycobacterium avium subsp. paratuberculosis
ccgggucuagaucuccaggc

SEQ ID NO: 2930360 - RNA, 19 nt, Mycobacterium avium subsp. paratuberculosis
ccgggucugccacgcccac

SEQ ID NO: 2930361 - RNA, 16 nt, Mycobacterium avium subsp. paratuberculosis
ccgggucuuccacgcc

SEQ ID NO: 2930362 - RNA, 17 nt, Mycobacterium avium subsp. paratuberculosis
ccgggucuuccacgccg

SEQ ID NO: 2930363 - RNA, 15 nt, Mycobacterium avium subsp. paratuberculosis
ccgggugaacccgac

SEQ ID NO: 2930364 - RNA, 14 nt, Mycobacterium avium subsp. paratuberculosis
ccgggugaacgagg

SEQ ID NO: 2930365 - RNA, 20 nt, Mycobacterium avium subsp. paratuberculosis
ccgggugaacgaggccgcgc

SEQ ID NO: 2930366 - RNA, 21 nt, Mycobacterium avium subsp. paratuberculosis
ccgggugaacgaggccgcgcc

SEQ ID NO: 2930367 - RNA, 21 nt, Mycobacterium avium subsp. paratuberculosis
ccgggugacaacggugguggc

SEQ ID NO: 2930368 - RNA, 23 nt, Mycobacterium avium subsp. paratuberculosis
ccgggugacaacggugguggcga

SEQ ID NO: 2930369 - RNA, 22 nt, Mycobacterium avium subsp. paratuberculosis
ccgggugaccgccuuggcgcgc

SEQ ID NO: 2930370 - RNA, 23 nt, Mycobacterium avium subsp. paratuberculosis
ccgggugaccgccuuggcgcgcu

SEQ ID NO: 2930371 - RNA, 14 nt, Mycobacterium avium subsp. paratuberculosis
ccgggugaccggcg

SEQ ID NO: 2930372 - RNA, 19 nt, Mycobacterium avium subsp. paratuberculosis
ccgggugauaccggcccag

SEQ ID NO: 2930373 - RNA, 17 nt, Mycobacterium avium subsp. paratuberculosis
ccgggugaucaacgcgg

SEQ ID NO: 2930374 - RNA, 22 nt, Mycobacterium avium subsp. paratuberculosis
ccgggugaucaacgcggacacg

SEQ ID NO: 2930375 - RNA, 18 nt, Mycobacterium avium subsp. paratuberculosis
ccgggugauggucucccg

SEQ ID NO: 2930376 - RNA, 16 nt, Mycobacterium avium subsp. paratuberculosis
ccgggugaugucgccg

SEQ ID NO: 2930377 - RNA, 18 nt, Mycobacterium avium subsp. paratuberculosis
ccgggugaugucgccgac

SEQ ID NO: 2930378 - RNA, 12 nt, Mycobacterium avium subsp. paratuberculosis
ccgggugcaggc

SEQ ID NO: 2930379 - RNA, 20 nt, Mycobacterium avium subsp. paratuberculosis
ccgggugcaggcccagcugc

SEQ ID NO: 2930380 - RNA, 19 nt, Mycobacterium avium subsp. paratuberculosis
ccgggugcccggcugggcg

SEQ ID NO: 2930381 - RNA, 23 nt, Mycobacterium avium subsp. paratuberculosis
ccgggugcccggcugggcgcgca

SEQ ID NO: 2930382 - RNA, 14 nt, Mycobacterium avium subsp. paratuberculosis
ccgggugcgauggc

SEQ ID NO: 2930383 - RNA, 15 nt, Mycobacterium avium subsp. paratuberculosis
ccgggugcgcgucgc

SEQ ID NO: 2930384 - RNA, 19 nt, Mycobacterium avium subsp. paratuberculosis
ccgggugcguccagaccgg

SEQ ID NO: 2930385 - RNA, 20 nt, Mycobacterium avium subsp. paratuberculosis
ccgggugcguccagaccggc

SEQ ID NO: 2930386 - RNA, 23 nt, Mycobacterium avium subsp. paratuberculosis
ccgggugcguccagaccggccgg

SEQ ID NO: 2930387 - RNA, 21 nt, Mycobacterium avium subsp. paratuberculosis
ccgggugcugaacgccugccg

SEQ ID NO: 2930388 - RNA, 23 nt, Mycobacterium avium subsp. paratuberculosis
ccggguggaacuggacgccgugg

SEQ ID NO: 2930389 - RNA, 22 nt, Mycobacterium avium subsp. paratuberculosis
ccgguaggugaucgccucgacc

SEQ ID NO: 2930390 - RNA, 13 nt, Mycobacterium avium subsp. paratuberculosis
ccgguaucgagca

SEQ ID NO: 2930391 - RNA, 19 nt, Mycobacterium avium subsp. paratuberculosis
ccgguauuggccacgcugg

SEQ ID NO: 2930392 - RNA, 18 nt, Mycobacterium avium subsp. paratuberculosis
ccggucaacgccgcgcgc

SEQ ID NO: 2930393 - RNA, 22 nt, Mycobacterium avium subsp. paratuberculosis
ccggucaacgccgcgcgcagca

SEQ ID NO: 2930394 - RNA, 16 nt, Mycobacterium avium subsp. paratuberculosis
ccggucaacggcucgg

SEQ ID NO: 2930395 - RNA, 22 nt, Mycobacterium avium subsp. paratuberculosis
ccggucaagaacgaaucgucgc

SEQ ID NO: 2930396 - RNA, 22 nt, Mycobacterium avium subsp. paratuberculosis
ccggucaagcgcuuucgccgaa

SEQ ID NO: 2930397 - RNA, 13 nt, Mycobacterium avium subsp. paratuberculosis
ccggucaccccgg

SEQ ID NO: 2930398 - RNA, 14 nt, Mycobacterium avium subsp. paratuberculosis
ccggucaccccggc

SEQ ID NO: 2930399 - RNA, 18 nt, Mycobacterium avium subsp. paratuberculosis
ccggucaccccggccauc

SEQ ID NO: 2930400 - RNA, 16 nt, Mycobacterium avium subsp. paratuberculosis
ccggucacccgugggc

SEQ ID NO: 2930401 - RNA, 15 nt, Mycobacterium avium subsp. paratuberculosis
ccggucaccggucgc

SEQ ID NO: 2930402 - RNA, 14 nt, Mycobacterium avium subsp. paratuberculosis
ccggucacgcccgg

SEQ ID NO: 2930403 - RNA, 17 nt, Mycobacterium avium subsp. paratuberculosis
ccggucacgcccggggu

SEQ ID NO: 2930404 - RNA, 13 nt, Mycobacterium avium subsp. paratuberculosis
ccggucacggcgu

SEQ ID NO: 2930405 - RNA, 17 nt, Mycobacterium avium subsp. paratuberculosis
ccggucacggcgucggc

SEQ ID NO: 2930406 - RNA, 14 nt, Mycobacterium avium subsp. paratuberculosis
ccggucacguagcu

SEQ ID NO: 2930407 - RNA, 22 nt, Mycobacterium avium subsp. paratuberculosis
ccggucagaccccguaccagcg

SEQ ID NO: 2930408 - RNA, 15 nt, Mycobacterium avium subsp. paratuberculosis
ccggucagcaccgcg

SEQ ID NO: 2930409 - RNA, 17 nt, Mycobacterium avium subsp. paratuberculosis
ccggucagcaccgcgcg

SEQ ID NO: 2930410 - RNA, 19 nt, Mycobacterium avium subsp. paratuberculosis
ccggucagcaccgcgcggc

SEQ ID NO: 2930411 - RNA, 21 nt, Mycobacterium avium subsp. paratuberculosis
ccggucagcaccgcgcggcgg

SEQ ID NO: 2930412 - RNA, 22 nt, Mycobacterium avium subsp. paratuberculosis
ccggucagcacgucggucagcg

SEQ ID NO: 2930413 - RNA, 22 nt, Mycobacterium avium subsp. paratuberculosis
ccggucagcccccaccgcgccg

SEQ ID NO: 2930414 - RNA, 13 nt, Mycobacterium avium subsp. paratuberculosis
ccggucagcgacg

SEQ ID NO: 2930415 - RNA, 15 nt, Mycobacterium avium subsp. paratuberculosis
ccggucagcgccagc

SEQ ID NO: 2930416 - RNA, 19 nt, Mycobacterium avium subsp. paratuberculosis
ccggucagcgccagcaugc

SEQ ID NO: 2930417 - RNA, 20 nt, Mycobacterium avium subsp. paratuberculosis
ccggucagcgcgacaucgcc

SEQ ID NO: 2930418 - RNA, 22 nt, Mycobacterium avium subsp. paratuberculosis
ccggucagcgcgacaucgccgg

SEQ ID NO: 2930419 - RNA, 23 nt, Mycobacterium avium subsp. paratuberculosis
ccggucagcgcgacaucgccggc

SEQ ID NO: 2930420 - RNA, 20 nt, Mycobacterium avium subsp. paratuberculosis
ccggucagcggcaacacgcc

SEQ ID NO: 2930421 - RNA, 22 nt, Mycobacterium avium subsp. paratuberculosis
ccggucagcggcaacacgccgg

SEQ ID NO: 2930422 - RNA, 22 nt, Mycobacterium avium subsp. paratuberculosis
ccggucagcguccaguccggcg

SEQ ID NO: 2930423 - RNA, 17 nt, Mycobacterium avium subsp. paratuberculosis
ccggucagcucgccguc

SEQ ID NO: 2930424 - RNA, 12 nt, Mycobacterium avium subsp. paratuberculosis
ccggucagcugg

SEQ ID NO: 2930425 - RNA, 15 nt, Mycobacterium avium subsp. paratuberculosis
ccggucagcuggugc

SEQ ID NO: 2930426 - RNA, 19 nt, Mycobacterium avium subsp. paratuberculosis
ccggucagcuggugcagau

SEQ ID NO: 2930427 - RNA, 21 nt, Mycobacterium avium subsp. paratuberculosis
ccggucaggcauuccaccgcg

SEQ ID NO: 2930428 - RNA, 15 nt, Mycobacterium avium subsp. paratuberculosis
ccggucagggcucgc

SEQ ID NO: 2930429 - RNA, 22 nt, Mycobacterium avium subsp. paratuberculosis
ccggucaggucgcugcgcucgc

SEQ ID NO: 2930430 - RNA, 18 nt, Mycobacterium avium subsp. paratuberculosis
ccggucagucggccuugg

SEQ ID NO: 2930431 - RNA, 16 nt, Mycobacterium avium subsp. paratuberculosis
ccggucaguucgucgg

SEQ ID NO: 2930432 - RNA, 20 nt, Mycobacterium avium subsp. paratuberculosis
ccggucauaggccgcgcaga

SEQ ID NO: 2930433 - RNA, 21 nt, Mycobacterium avium subsp. paratuberculosis
ccggucauccgggccaccacc

SEQ ID NO: 2930434 - RNA, 19 nt, Mycobacterium avium subsp. paratuberculosis
ccggucauccucgccgcgc

SEQ ID NO: 2930435 - RNA, 20 nt, Mycobacterium avium subsp. paratuberculosis
ccggucauccucgccgcgcc

SEQ ID NO: 2930436 - RNA, 21 nt, Mycobacterium avium subsp. paratuberculosis
ccggucauccucgccgcgcca

SEQ ID NO: 2930437 - RNA, 22 nt, Mycobacterium avium subsp. paratuberculosis
ccggucauccucgccgcgccag

SEQ ID NO: 2930438 - RNA, 23 nt, Mycobacterium avium subsp. paratuberculosis
ccggucauccucgccgcgccagc

SEQ ID NO: 2930439 - RNA, 14 nt, Mycobacterium avium subsp. paratuberculosis
ccgguccaccuggc

SEQ ID NO: 2930440 - RNA, 19 nt, Mycobacterium avium subsp. paratuberculosis
ccgguccacucgucggcgg

SEQ ID NO: 2930441 - RNA, 15 nt, Mycobacterium avium subsp. paratuberculosis
ccgguccagaucggc

SEQ ID NO: 2930442 - RNA, 14 nt, Mycobacterium avium subsp. paratuberculosis
ccgguccagccgcc

SEQ ID NO: 2930443 - RNA, 15 nt, Mycobacterium avium subsp. paratuberculosis
ccgguccagccgccg

SEQ ID NO: 2930444 - RNA, 20 nt, Mycobacterium avium subsp. paratuberculosis
ccgguccagccgccgcgugg

SEQ ID NO: 2930445 - RNA, 18 nt, Mycobacterium avium subsp. paratuberculosis
ccgguccaggcgaccggc

SEQ ID NO: 2930446 - RNA, 20 nt, Mycobacterium avium subsp. paratuberculosis
ccgguccaggcgaccggccc

SEQ ID NO: 2930447 - RNA, 21 nt, Mycobacterium avium subsp. paratuberculosis
ccgguccaggcgaccggcccc

SEQ ID NO: 2930448 - RNA, 18 nt, Mycobacterium avium subsp. paratuberculosis
ccgguccaguugugccgc

SEQ ID NO: 2930449 - RNA, 20 nt, Mycobacterium avium subsp. paratuberculosis
ccgguccaguugugccgcaa

SEQ ID NO: 2930450 - RNA, 13 nt, Mycobacterium avium subsp. paratuberculosis
ccgguccaucccg

SEQ ID NO: 2930451 - RNA, 16 nt, Mycobacterium avium subsp. paratuberculosis
ccgguccaugugccgc

SEQ ID NO: 2930452 - RNA, 13 nt, Mycobacterium avium subsp. paratuberculosis
ccgguccccggag

SEQ ID NO: 2930453 - RNA, 21 nt, Mycobacterium avium subsp. paratuberculosis
ccgguccccggagucgucgaa

SEQ ID NO: 2930454 - RNA, 15 nt, Mycobacterium avium subsp. paratuberculosis
ccgguccccggcgac

SEQ ID NO: 2930455 - RNA, 16 nt, Mycobacterium avium subsp. paratuberculosis
ccgguccccggcgacc

SEQ ID NO: 2930456 - RNA, 13 nt, Mycobacterium avium subsp. paratuberculosis
ccggucccgccgg

SEQ ID NO: 2930457 - RNA, 14 nt, Mycobacterium avium subsp. paratuberculosis
ccggucccgcggcg

SEQ ID NO: 2930458 - RNA, 15 nt, Mycobacterium avium subsp. paratuberculosis
ccggucccggggcuc

SEQ ID NO: 2930459 - RNA, 22 nt, Mycobacterium avium subsp. paratuberculosis
ccggucccggggcucgacaggc

SEQ ID NO: 2930460 - RNA, 19 nt, Mycobacterium avium subsp. paratuberculosis
ccggucccguugaucucgg

SEQ ID NO: 2930461 - RNA, 15 nt, Mycobacterium avium subsp. paratuberculosis
ccgguccgaccagcg

SEQ ID NO: 2930462 - RNA, 17 nt, Mycobacterium avium subsp. paratuberculosis
ccgguccgaccagcggc

SEQ ID NO: 2930463 - RNA, 22 nt, Mycobacterium avium subsp. paratuberculosis
ccgguccgaccagcggcccacc

SEQ ID NO: 2930464 - RNA, 12 nt, Mycobacterium avium subsp. paratuberculosis
ccgguccgaccg

SEQ ID NO: 2930465 - RNA, 13 nt, Mycobacterium avium subsp. paratuberculosis
ccgguccgaccgc

SEQ ID NO: 2930466 - RNA, 18 nt, Mycobacterium avium subsp. paratuberculosis
ccgguccgaccgccacca

SEQ ID NO: 2930467 - RNA, 19 nt, Mycobacterium avium subsp. paratuberculosis
ccgguccgaucguccggcg

SEQ ID NO: 2930468 - RNA, 14 nt, Mycobacterium avium subsp. paratuberculosis
ccgguccgccgccg

SEQ ID NO: 2930469 - RNA, 15 nt, Mycobacterium avium subsp. paratuberculosis
ccgguccgccgccgg

SEQ ID NO: 2930470 - RNA, 16 nt, Mycobacterium avium subsp. paratuberculosis
ccgguccgccgccggc

SEQ ID NO: 2930471 - RNA, 17 nt, Mycobacterium avium subsp. paratuberculosis
ccgguccgccgccggcg

SEQ ID NO: 2930472 - RNA, 14 nt, Mycobacterium avium subsp. paratuberculosis
ccgguccgccgucg

SEQ ID NO: 2930473 - RNA, 19 nt, Mycobacterium avium subsp. paratuberculosis
ccggucuuguagucgacca

SEQ ID NO: 2930474 - RNA, 15 nt, Mycobacterium avium subsp. paratuberculosis
ccggugaaaccggcg

SEQ ID NO: 2930475 - RNA, 19 nt, Mycobacterium avium subsp. paratuberculosis
ccggugaaaccggcgccga

SEQ ID NO: 2930476 - RNA, 17 nt, Mycobacterium avium subsp. paratuberculosis
ccggugaagaucagcgc

SEQ ID NO: 2930477 - RNA, 22 nt, Mycobacterium avium subsp. paratuberculosis
ccggugaagaucagcgcgucgg

SEQ ID NO: 2930478 - RNA, 16 nt, Mycobacterium avium subsp. paratuberculosis
ccggugaagaucgccc

SEQ ID NO: 2930479 - RNA, 22 nt, Mycobacterium avium subsp. paratuberculosis
ccggugaagaucgcccgccgcg

SEQ ID NO: 2930480 - RNA, 12 nt, Mycobacterium avium subsp. paratuberculosis
ccggugaccccg

SEQ ID NO: 2930481 - RNA, 13 nt, Mycobacterium avium subsp. paratuberculosis
ccggugaccgccu

SEQ ID NO: 2930482 - RNA, 16 nt, Mycobacterium avium subsp. paratuberculosis
ccggugaccgccucgu

SEQ ID NO: 2930483 - RNA, 19 nt, Mycobacterium avium subsp. paratuberculosis
ccggugaccgccucgucga

SEQ ID NO: 2930484 - RNA, 14 nt, Mycobacterium avium subsp. paratuberculosis
ccggugaccgcgac

SEQ ID NO: 2930485 - RNA, 21 nt, Mycobacterium avium subsp. paratuberculosis
ccggugaccgcgacgcugccg

SEQ ID NO: 2930486 - RNA, 15 nt, Mycobacterium avium subsp. paratuberculosis
ccggugaccgcgccg

SEQ ID NO: 2930487 - RNA, 16 nt, Mycobacterium avium subsp. paratuberculosis
ccggugaccgcgccgg

SEQ ID NO: 2930488 - RNA, 18 nt, Mycobacterium avium subsp. paratuberculosis
ccggugaccucccggaca

SEQ ID NO: 2930489 - RNA, 17 nt, Mycobacterium avium subsp. paratuberculosis
ccggugacgaccggcag

SEQ ID NO: 2930490 - RNA, 20 nt, Mycobacterium avium subsp. paratuberculosis
ccggugacgauccggucgau

SEQ ID NO: 2930491 - RNA, 18 nt, Mycobacterium avium subsp. paratuberculosis
ccggugacggucagggug

SEQ ID NO: 2930492 - RNA, 21 nt, Mycobacterium avium subsp. paratuberculosis
ccggugacuccuccucggcca

SEQ ID NO: 2930493 - RNA, 22 nt, Mycobacterium avium subsp. paratuberculosis
ccggugacuccuccucggccag

SEQ ID NO: 2930494 - RNA, 20 nt, Mycobacterium avium subsp. paratuberculosis
ccggugagcaccgggaacag

SEQ ID NO: 2930495 - RNA, 22 nt, Mycobacterium avium subsp. paratuberculosis
ccggugagcacgaccgccagca

SEQ ID NO: 2930496 - RNA, 23 nt, Mycobacterium avium subsp. paratuberculosis
ccggugagcacgaccgccagcag

SEQ ID NO: 2930497 - RNA, 16 nt, Mycobacterium avium subsp. paratuberculosis
ccggugagcacgguga

SEQ ID NO: 2930498 - RNA, 19 nt, Mycobacterium avium subsp. paratuberculosis
ccggugauccacuccagca

SEQ ID NO: 2930499 - RNA, 19 nt, Mycobacterium avium subsp. paratuberculosis
ccggugaugaacgcgccgu

SEQ ID NO: 2930500 - RNA, 20 nt, Mycobacterium avium subsp. paratuberculosis
ccggugaugaacgcgccguc

SEQ ID NO: 2930501 - RNA, 21 nt, Mycobacterium avium subsp. paratuberculosis
ccggugaugacgucgcccacc

SEQ ID NO: 2930502 - RNA, 14 nt, Mycobacterium avium subsp. paratuberculosis
ccggugaugccggc

SEQ ID NO: 2930503 - RNA, 17 nt, Mycobacterium avium subsp. paratuberculosis
ccggugaugccggcauc

SEQ ID NO: 2930504 - RNA, 15 nt, Mycobacterium avium subsp. paratuberculosis
ccggugauggugauc

SEQ ID NO: 2930505 - RNA, 12 nt, Mycobacterium avium subsp. paratuberculosis
ccggugcaccac

SEQ ID NO: 2930506 - RNA, 14 nt, Mycobacterium avium subsp. paratuberculosis
ccggugcaccgcgc

SEQ ID NO: 2930507 - RNA, 15 nt, Mycobacterium avium subsp. paratuberculosis
ccggugcaccgcgcg

SEQ ID NO: 2930508 - RNA, 19 nt, Mycobacterium avium subsp. paratuberculosis
ccggugcagaucguccauc

SEQ ID NO: 2930509 - RNA, 14 nt, Mycobacterium avium subsp. paratuberculosis
ccggugcagcacgu

SEQ ID NO: 2930510 - RNA, 16 nt, Mycobacterium avium subsp. paratuberculosis
ccggugccacgcggcu

SEQ ID NO: 2930511 - RNA, 17 nt, Mycobacterium avium subsp. paratuberculosis
ccggugccacggucagg

SEQ ID NO: 2930512 - RNA, 19 nt, Mycobacterium avium subsp. paratuberculosis
ccggugccacggucaggcg

SEQ ID NO: 2930513 - RNA, 20 nt, Mycobacterium avium subsp. paratuberculosis
ccggugccacggucaggcgc

SEQ ID NO: 2930514 - RNA, 15 nt, Mycobacterium avium subsp. paratuberculosis
ccggugcccacgccg

SEQ ID NO: 2930515 - RNA, 19 nt, Mycobacterium avium subsp. paratuberculosis
ccggugcccgagaucaccg

SEQ ID NO: 2930516 - RNA, 14 nt, Mycobacterium avium subsp. paratuberculosis
ccggugccgacgau

SEQ ID NO: 2930517 - RNA, 15 nt, Mycobacterium avium subsp. paratuberculosis
ccggugccgacgauc

SEQ ID NO: 2930518 - RNA, 18 nt, Mycobacterium avium subsp. paratuberculosis
ccggugccgagcgcgcuu

SEQ ID NO: 2930519 - RNA, 23 nt, Mycobacterium avium subsp. paratuberculosis
ccggugccgcccaucgaccggau

SEQ ID NO: 2930520 - RNA, 14 nt, Mycobacterium avium subsp. paratuberculosis
ccggugccgccggc

SEQ ID NO: 2930521 - RNA, 15 nt, Mycobacterium avium subsp. paratuberculosis
ccggugccgccggcg

SEQ ID NO: 2930522 - RNA, 17 nt, Mycobacterium avium subsp. paratuberculosis
ccggugccgccggcgca

SEQ ID NO: 2930523 - RNA, 20 nt, Mycobacterium avium subsp. paratuberculosis
ccggugccguugaucagggc

SEQ ID NO: 2930524 - RNA, 23 nt, Mycobacterium avium subsp. paratuberculosis
ccggugcgccagcgugaacagcg

SEQ ID NO: 2930525 - RNA, 13 nt, Mycobacterium avium subsp. paratuberculosis
ccggugcgccgac

SEQ ID NO: 2930526 - RNA, 19 nt, Mycobacterium avium subsp. paratuberculosis
ccggugcgccgaccgcgau

SEQ ID NO: 2930527 - RNA, 20 nt, Mycobacterium avium subsp. paratuberculosis
ccggugcgccgaccgcgauc

SEQ ID NO: 2930528 - RNA, 13 nt, Mycobacterium avium subsp. paratuberculosis
ccggugcgccggu

SEQ ID NO: 2930529 - RNA, 20 nt, Mycobacterium avium subsp. paratuberculosis
ccggugcgcgcaccaggccg

SEQ ID NO: 2930530 - RNA, 18 nt, Mycobacterium avium subsp. paratuberculosis
ccggugcgcgucagccgu

SEQ ID NO: 2930531 - RNA, 19 nt, Mycobacterium avium subsp. paratuberculosis
ccggugcgcgucagccguc

SEQ ID NO: 2930532 - RNA, 15 nt, Mycobacterium avium subsp. paratuberculosis
ccggugcggucggcg

SEQ ID NO: 2930533 - RNA, 16 nt, Mycobacterium avium subsp. paratuberculosis
ccggugcggucggcgu

SEQ ID NO: 2930534 - RNA, 17 nt, Mycobacterium avium subsp. paratuberculosis
ccggugcguccgccggc

SEQ ID NO: 2930535 - RNA, 19 nt, Mycobacterium avium subsp. paratuberculosis
ccggugcguccgccggcgg

SEQ ID NO: 2930536 - RNA, 24 nt, Mycobacterium avium subsp. paratuberculosis
ccggugcucccccggaccugccgg

SEQ ID NO: 2930537 - RNA, 16 nt, Mycobacterium avium subsp. paratuberculosis
ccggugcugacccggu

SEQ ID NO: 2930538 - RNA, 19 nt, Mycobacterium avium subsp. paratuberculosis
ccggugcugacccggucgc

SEQ ID NO: 2930539 - RNA, 14 nt, Mycobacterium avium subsp. paratuberculosis
ccggugcugcucga

SEQ ID NO: 2930540 - RNA, 22 nt, Mycobacterium avium subsp. paratuberculosis
ccggugcugcucgagggccucc

SEQ ID NO: 2930541 - RNA, 20 nt, Mycobacterium avium subsp. paratuberculosis
ccggugcuggucaugccguc

SEQ ID NO: 2930542 - RNA, 22 nt, Mycobacterium avium subsp. paratuberculosis
ccggugcuggucaugccgucga

SEQ ID NO: 2930543 - RNA, 23 nt, Mycobacterium avium subsp. paratuberculosis
ccggugcuggucaugccgucgac

SEQ ID NO: 2930544 - RNA, 24 nt, Mycobacterium avium subsp. paratuberculosis
ccggugcuggucaugccgucgacg

SEQ ID NO: 2930545 - RNA, 17 nt, Mycobacterium avium subsp. paratuberculosis
ccggugcuguccacauc

SEQ ID NO: 2930546 - RNA, 17 nt, Mycobacterium avium subsp. paratuberculosis
ccggugcuuggcguuga

SEQ ID NO: 2930547 - RNA, 22 nt, Mycobacterium avium subsp. paratuberculosis
ccgguggaauucuggccgaccg

SEQ ID NO: 2930548 - RNA, 15 nt, Mycobacterium avium subsp. paratuberculosis
ccgguggacaggugc

SEQ ID NO: 2930549 - RNA, 15 nt, Mycobacterium avium subsp. paratuberculosis
ccgguggacuccagc

SEQ ID NO: 2930550 - RNA, 19 nt, Mycobacterium avium subsp. paratuberculosis
ccgguggacuccagcacca

SEQ ID NO: 2930551 - RNA, 21 nt, Mycobacterium avium subsp. paratuberculosis
ccgguggacuccagcaccagc

SEQ ID NO: 2930552 - RNA, 14 nt, Mycobacterium avium subsp. paratuberculosis
ccgguggagauggc

SEQ ID NO: 2930553 - RNA, 19 nt, Mycobacterium avium subsp. paratuberculosis
ccgguggagauggccagca

SEQ ID NO: 2930554 - RNA, 21 nt, Mycobacterium avium subsp. paratuberculosis
ccgguggagauggccagcacc

SEQ ID NO: 2930555 - RNA, 17 nt, Mycobacterium avium subsp. paratuberculosis
ccgguggaugggcucga

SEQ ID NO: 2930556 - RNA, 18 nt, Mycobacterium avium subsp. paratuberculosis
ccgguggaugggcucgac

SEQ ID NO: 2930557 - RNA, 15 nt, Mycobacterium avium subsp. paratuberculosis
ccgguuggugcgccg

SEQ ID NO: 2930558 - RNA, 16 nt, Mycobacterium avium subsp. paratuberculosis
ccgguuggugcgccgu

SEQ ID NO: 2930559 - RNA, 15 nt, Mycobacterium avium subsp. paratuberculosis
ccgguuugcgccggc

SEQ ID NO: 2930560 - RNA, 16 nt, Mycobacterium avium subsp. paratuberculosis
ccgguuugcgccggcu

SEQ ID NO: 2930561 - RNA, 23 nt, Mycobacterium avium subsp. paratuberculosis
ccgguuugcgccggcuccaccgc

SEQ ID NO: 2930562 - RNA, 14 nt, Mycobacterium avium subsp. paratuberculosis
ccgguuugucggcg

SEQ ID NO: 2930563 - RNA, 20 nt, Mycobacterium avium subsp. paratuberculosis
ccguaaguggcgccgcgguc

SEQ ID NO: 2930564 - RNA, 22 nt, Mycobacterium avium subsp. paratuberculosis
ccguacagcugguccggccggc

SEQ ID NO: 2930565 - RNA, 23 nt, Mycobacterium avium subsp. paratuberculosis
ccguacagcugguccggccggcc

SEQ ID NO: 2930566 - RNA, 22 nt, Mycobacterium avium subsp. paratuberculosis
ccguacauggugaccagcguga

SEQ ID NO: 2930567 - RNA, 22 nt, Mycobacterium avium subsp. paratuberculosis
ccguaccgaggaugaccgcggc

SEQ ID NO: 2930568 - RNA, 17 nt, Mycobacterium avium subsp. paratuberculosis
ccguaccgauccgcggg

SEQ ID NO: 2930569 - RNA, 20 nt, Mycobacterium avium subsp. paratuberculosis
ccguaccgauccgcgggccg

SEQ ID NO: 2930570 - RNA, 16 nt, Mycobacterium avium subsp. paratuberculosis
ccguaccgcaacaccg

SEQ ID NO: 2930571 - RNA, 17 nt, Mycobacterium avium subsp. paratuberculosis
ccguaccgcaacaccga

SEQ ID NO: 2930572 - RNA, 20 nt, Mycobacterium avium subsp. paratuberculosis
ccguaccgcaacaccgaaag

SEQ ID NO: 2930573 - RNA, 17 nt, Mycobacterium avium subsp. paratuberculosis
ccguaccgcuuggccca

SEQ ID NO: 2930574 - RNA, 18 nt, Mycobacterium avium subsp. paratuberculosis
ccguaccgcuuggcccac

SEQ ID NO: 2930575 - RNA, 18 nt, Mycobacterium avium subsp. paratuberculosis
ccguacgcgccggccagc

SEQ ID NO: 2930576 - RNA, 13 nt, Mycobacterium avium subsp. paratuberculosis
ccguacggcccga

SEQ ID NO: 2930577 - RNA, 17 nt, Mycobacterium avium subsp. paratuberculosis
ccguacucgugggccac

SEQ ID NO: 2930578 - RNA, 19 nt, Mycobacterium avium subsp. paratuberculosis
ccguacuucucgaagaagg

SEQ ID NO: 2930579 - RNA, 18 nt, Mycobacterium avium subsp. paratuberculosis
ccguacuugacgugcgac

SEQ ID NO: 2930580 - RNA, 15 nt, Mycobacterium avium subsp. paratuberculosis
ccguagaauccgccg

SEQ ID NO: 2930581 - RNA, 18 nt, Mycobacterium avium subsp. paratuberculosis
ccguagaauccgccguug

SEQ ID NO: 2930582 - RNA, 15 nt, Mycobacterium avium subsp. paratuberculosis
ccguagaccaccucg

SEQ ID NO: 2930583 - RNA, 15 nt, Mycobacterium avium subsp. paratuberculosis
ccguagacccacagc

SEQ ID NO: 2930584 - RNA, 21 nt, Mycobacterium avium subsp. paratuberculosis
ccguagagccguuuggcgccg

SEQ ID NO: 2930585 - RNA, 19 nt, Mycobacterium avium subsp. paratuberculosis
ccguagaucacgccgguga

SEQ ID NO: 2930586 - RNA, 14 nt, Mycobacterium avium subsp. paratuberculosis
ccguagaucgucga

SEQ ID NO: 2930587 - RNA, 23 nt, Mycobacterium avium subsp. paratuberculosis
ccguagaucgucgagugcucgau

SEQ ID NO: 2930588 - RNA, 21 nt, Mycobacterium avium subsp. paratuberculosis
ccguagaucucgcgccgcgca

SEQ ID NO: 2930589 - RNA, 23 nt, Mycobacterium avium subsp. paratuberculosis
ccguagaugccgguacggccgac

SEQ ID NO: 2930590 - RNA, 23 nt, Mycobacterium avium subsp. paratuberculosis
ccguagaugcggcccagcccggc

SEQ ID NO: 2930591 - RNA, 23 nt, Mycobacterium avium subsp. paratuberculosis
ccguagccggaccgcuugacgcc

SEQ ID NO: 2930592 - RNA, 14 nt, Mycobacterium avium subsp. paratuberculosis
ccguagccggcggu

SEQ ID NO: 2930593 - RNA, 21 nt, Mycobacterium avium subsp. paratuberculosis
ccguagcgagcgcuggccuug

SEQ ID NO: 2930594 - RNA, 13 nt, Mycobacterium avium subsp. paratuberculosis
ccguagcgcaaca

SEQ ID NO: 2930595 - RNA, 17 nt, Mycobacterium avium subsp. paratuberculosis
ccguagcggcccaggua

SEQ ID NO: 2930596 - RNA, 16 nt, Mycobacterium avium subsp. paratuberculosis
ccguagcggcucgcca

SEQ ID NO: 2930597 - RNA, 18 nt, Mycobacterium avium subsp. paratuberculosis
ccguagcggucgccccag

SEQ ID NO: 2930598 - RNA, 16 nt, Mycobacterium avium subsp. paratuberculosis
ccguagcggugggcgc

SEQ ID NO: 2930599 - RNA, 17 nt, Mycobacterium avium subsp. paratuberculosis
ccguagcggugggcgcg

SEQ ID NO: 2930600 - RNA, 19 nt, Mycobacterium avium subsp. paratuberculosis
ccguagcggugggcgcgua

SEQ ID NO: 2930601 - RNA, 17 nt, Mycobacterium avium subsp. paratuberculosis
ccguagcucgcgccgac

SEQ ID NO: 2930602 - RNA, 19 nt, Mycobacterium avium subsp. paratuberculosis
ccguagcucgcgccgaccc

SEQ ID NO: 2930603 - RNA, 21 nt, Mycobacterium avium subsp. paratuberculosis
ccguagcucgcgccgacccgc

SEQ ID NO: 2930604 - RNA, 22 nt, Mycobacterium avium subsp. paratuberculosis
ccguagcucgcgccgacccgcc

SEQ ID NO: 2930605 - RNA, 15 nt, Mycobacterium avium subsp. paratuberculosis
ccguaggccagguuc

SEQ ID NO: 2930606 - RNA, 16 nt, Mycobacterium avium subsp. paratuberculosis
ccguagguugccccac

SEQ ID NO: 2930607 - RNA, 16 nt, Mycobacterium avium subsp. paratuberculosis
ccguagucacccggcc

SEQ ID NO: 2930608 - RNA, 18 nt, Mycobacterium avium subsp. paratuberculosis
ccguagucacccggcccc

SEQ ID NO: 2930609 - RNA, 14 nt, Mycobacterium avium subsp. paratuberculosis
ccguagucggcggc

SEQ ID NO: 2930610 - RNA, 15 nt, Mycobacterium avium subsp. paratuberculosis
ccguagucggcggcg

SEQ ID NO: 2930611 - RNA, 17 nt, Mycobacterium avium subsp. paratuberculosis
ccguaucggccccggcc

SEQ ID NO: 2930612 - RNA, 18 nt, Mycobacterium avium subsp. paratuberculosis
ccguauugccgucggcgu

SEQ ID NO: 2930613 - RNA, 19 nt, Mycobacterium avium subsp. paratuberculosis
ccguauuggcaggcgaugu

SEQ ID NO: 2930614 - RNA, 21 nt, Mycobacterium avium subsp. paratuberculosis
ccgucaaugguguagcucagc

SEQ ID NO: 2930615 - RNA, 17 nt, Mycobacterium avium subsp. paratuberculosis
ccgucacaccgcggcca

SEQ ID NO: 2930616 - RNA, 18 nt, Mycobacterium avium subsp. paratuberculosis
ccgucacaccgcggccag

SEQ ID NO: 2930617 - RNA, 21 nt, Mycobacterium avium subsp. paratuberculosis
ccgucacaccgcggccagcgc

SEQ ID NO: 2930618 - RNA, 18 nt, Mycobacterium avium subsp. paratuberculosis
ccgucacccagaucgccc

SEQ ID NO: 2930619 - RNA, 19 nt, Mycobacterium avium subsp. paratuberculosis
ccgucacccccggcgcgac

SEQ ID NO: 2930620 - RNA, 14 nt, Mycobacterium avium subsp. paratuberculosis
ccgucaccgccagg

SEQ ID NO: 2930621 - RNA, 17 nt, Mycobacterium avium subsp. paratuberculosis
ccgucaccgccaggacc

SEQ ID NO: 2930622 - RNA, 23 nt, Mycobacterium avium subsp. paratuberculosis
ccgucaccgccaggaccacccac

SEQ ID NO: 2930623 - RNA, 13 nt, Mycobacterium avium subsp. paratuberculosis
ccgucaccgccgc

SEQ ID NO: 2930624 - RNA, 14 nt, Mycobacterium avium subsp. paratuberculosis
ccgucaccgccucc

SEQ ID NO: 2930625 - RNA, 23 nt, Mycobacterium avium subsp. paratuberculosis
ccgucaccgccuccuggcuggag

SEQ ID NO: 2930626 - RNA, 15 nt, Mycobacterium avium subsp. paratuberculosis
ccgucaccggccauc

SEQ ID NO: 2930627 - RNA, 21 nt, Mycobacterium avium subsp. paratuberculosis
ccgucaccggccauccgcugc

SEQ ID NO: 2930628 - RNA, 15 nt, Mycobacterium avium subsp. paratuberculosis
ccgucaccggcugcc

SEQ ID NO: 2930629 - RNA, 23 nt, Mycobacterium avium subsp. paratuberculosis
ccgucaccggcugcccgacccgc

SEQ ID NO: 2930630 - RNA, 12 nt, Mycobacterium avium subsp. paratuberculosis
ccgucaccgugg

SEQ ID NO: 2930631 - RNA, 15 nt, Mycobacterium avium subsp. paratuberculosis
ccgucaccguggcgg

SEQ ID NO: 2930632 - RNA, 18 nt, Mycobacterium avium subsp. paratuberculosis
ccgucaccuucaccccca

SEQ ID NO: 2930633 - RNA, 14 nt, Mycobacterium avium subsp. paratuberculosis
ccgucacgcccguc

SEQ ID NO: 2930634 - RNA, 18 nt, Mycobacterium avium subsp. paratuberculosis
ccgucacggaucgcccac

SEQ ID NO: 2930635 - RNA, 13 nt, Mycobacterium avium subsp. paratuberculosis
ccgucacggccgu

SEQ ID NO: 2930636 - RNA, 18 nt, Mycobacterium avium subsp. paratuberculosis
ccgucacggccguccagg

SEQ ID NO: 2930637 - RNA, 20 nt, Mycobacterium avium subsp. paratuberculosis
ccgucacggccguccaggcg

SEQ ID NO: 2930638 - RNA, 13 nt, Mycobacterium avium subsp. paratuberculosis
ccgucacggcugc

SEQ ID NO: 2930639 - RNA, 14 nt, Mycobacterium avium subsp. paratuberculosis
ccgucacggcugcc

SEQ ID NO: 2930640 - RNA, 17 nt, Mycobacterium avium subsp. paratuberculosis
ccgucacggcugccgac

SEQ ID NO: 2930641 - RNA, 12 nt, Mycobacterium avium subsp. paratuberculosis
ccguccgacggc

SEQ ID NO: 2930642 - RNA, 15 nt, Mycobacterium avium subsp. paratuberculosis
ccguccgcgcccacc

SEQ ID NO: 2930643 - RNA, 16 nt, Mycobacterium avium subsp. paratuberculosis
ccguccgcggcggcca

SEQ ID NO: 2930644 - RNA, 17 nt, Mycobacterium avium subsp. paratuberculosis
ccguccgcggcggccag

SEQ ID NO: 2930645 - RNA, 22 nt, Mycobacterium avium subsp. paratuberculosis
ccguccggauagccgucggcgg

SEQ ID NO: 2930646 - RNA, 12 nt, Mycobacterium avium subsp. paratuberculosis
ccguccggccgg

SEQ ID NO: 2930647 - RNA, 20 nt, Mycobacterium avium subsp. paratuberculosis
ccguccggccgguuggcggc

SEQ ID NO: 2930648 - RNA, 22 nt, Mycobacterium avium subsp. paratuberculosis
ccguccggccgguuggcggccg

SEQ ID NO: 2930649 - RNA, 13 nt, Mycobacterium avium subsp. paratuberculosis
ccguccggcgcca

SEQ ID NO: 2930650 - RNA, 12 nt, Mycobacterium avium subsp. paratuberculosis
ccguccggcggc

SEQ ID NO: 2930651 - RNA, 16 nt, Mycobacterium avium subsp. paratuberculosis
ccguccgggcacccga

SEQ ID NO: 2930652 - RNA, 17 nt, Mycobacterium avium subsp. paratuberculosis
ccguccgggcacccgac

SEQ ID NO: 2930653 - RNA, 15 nt, Mycobacterium avium subsp. paratuberculosis
ccguccgggccggcc

SEQ ID NO: 2930654 - RNA, 13 nt, Mycobacterium avium subsp. paratuberculosis
ccguccggggccg

SEQ ID NO: 2930655 - RNA, 15 nt, Mycobacterium avium subsp. paratuberculosis
ccguccggggccggu

SEQ ID NO: 2930656 - RNA, 12 nt, Mycobacterium avium subsp. paratuberculosis
ccguccgggucc

SEQ ID NO: 2930657 - RNA, 16 nt, Mycobacterium avium subsp. paratuberculosis
ccguccggguccggcu

SEQ ID NO: 2930658 - RNA, 19 nt, Mycobacterium avium subsp. paratuberculosis
ccguccggguccggcuuca

SEQ ID NO: 2930659 - RNA, 13 nt, Mycobacterium avium subsp. paratuberculosis
ccguccgggucgc

SEQ ID NO: 2930660 - RNA, 21 nt, Mycobacterium avium subsp. paratuberculosis
ccguccgggucgcacagccgc

SEQ ID NO: 2930661 - RNA, 23 nt, Mycobacterium avium subsp. paratuberculosis
ccguccgggucgcacagccgcag

SEQ ID NO: 2930662 - RNA, 23 nt, Mycobacterium avium subsp. paratuberculosis
ccguccgugcauagcuggcgccg

SEQ ID NO: 2930663 - RNA, 15 nt, Mycobacterium avium subsp. paratuberculosis
ccguccucgcgucgc

SEQ ID NO: 2930664 - RNA, 20 nt, Mycobacterium avium subsp. paratuberculosis
ccguccucgcgucgcgcggu

SEQ ID NO: 2930665 - RNA, 17 nt, Mycobacterium avium subsp. paratuberculosis
ccguccucggccgccac

SEQ ID NO: 2930666 - RNA, 20 nt, Mycobacterium avium subsp. paratuberculosis
ccguccucggccgccaccgc

SEQ ID NO: 2930667 - RNA, 21 nt, Mycobacterium avium subsp. paratuberculosis
ccguccuggaugaacagcacg

SEQ ID NO: 2930668 - RNA, 14 nt, Mycobacterium avium subsp. paratuberculosis
ccguccugggccug

SEQ ID NO: 2930669 - RNA, 14 nt, Mycobacterium avium subsp. paratuberculosis
ccguccuggucguc

SEQ ID NO: 2930670 - RNA, 23 nt, Mycobacterium avium subsp. paratuberculosis
ccguccuucucgaaccggggcac

SEQ ID NO: 2930671 - RNA, 15 nt, Mycobacterium avium subsp. paratuberculosis
ccguccuuggccgcc

SEQ ID NO: 2930672 - RNA, 18 nt, Mycobacterium avium subsp. paratuberculosis
ccguccuuggccgccagc

SEQ ID NO: 2930673 - RNA, 20 nt, Mycobacterium avium subsp. paratuberculosis
ccguccuuggccgccagcac

SEQ ID NO: 2930674 - RNA, 23 nt, Mycobacterium avium subsp. paratuberculosis
ccguccuuggccgccagcaccuc

SEQ ID NO: 2930675 - RNA, 15 nt, Mycobacterium avium subsp. paratuberculosis
ccguccuuggugauu

SEQ ID NO: 2930676 - RNA, 19 nt, Mycobacterium avium subsp. paratuberculosis
ccguccuuguaggugaucg

SEQ ID NO: 2930677 - RNA, 23 nt, Mycobacterium avium subsp. paratuberculosis
ccguccuugucgcgcaccgcggc

SEQ ID NO: 2930678 - RNA, 14 nt, Mycobacterium avium subsp. paratuberculosis
ccgucgaaaaaccc

SEQ ID NO: 2930679 - RNA, 16 nt, Mycobacterium avium subsp. paratuberculosis
ccgucgaaacggcugc

SEQ ID NO: 2930680 - RNA, 16 nt, Mycobacterium avium subsp. paratuberculosis
ccgucgaacacguugc

SEQ ID NO: 2930681 - RNA, 19 nt, Mycobacterium avium subsp. paratuberculosis
ccgucgaacacguugcgca

SEQ ID NO: 2930682 - RNA, 16 nt, Mycobacterium avium subsp. paratuberculosis
ccgucgaacagcgggc

SEQ ID NO: 2930683 - RNA, 21 nt, Mycobacterium avium subsp. paratuberculosis
ccgucgaacgagaaggcggcg

SEQ ID NO: 2930684 - RNA, 20 nt, Mycobacterium avium subsp. paratuberculosis
ccgucgaacugcagccggcc

SEQ ID NO: 2930685 - RNA, 21 nt, Mycobacterium avium subsp. paratuberculosis
ccgucgaacugcagccggcca

SEQ ID NO: 2930686 - RNA, 17 nt, Mycobacterium avium subsp. paratuberculosis
ccgucgaagagugcgau

SEQ ID NO: 2930687 - RNA, 17 nt, Mycobacterium avium subsp. paratuberculosis
ccgucgaagaugaccug

SEQ ID NO: 2930688 - RNA, 16 nt, Mycobacterium avium subsp. paratuberculosis
ccgucgaaggccgggc

SEQ ID NO: 2930689 - RNA, 19 nt, Mycobacterium avium subsp. paratuberculosis
ccgucgaaggccgggcugg

SEQ ID NO: 2930690 - RNA, 15 nt, Mycobacterium avium subsp. paratuberculosis
ccgucgaccaacugc

SEQ ID NO: 2930691 - RNA, 15 nt, Mycobacterium avium subsp. paratuberculosis
ccgucgaccaaugcg

SEQ ID NO: 2930692 - RNA, 18 nt, Mycobacterium avium subsp. paratuberculosis
ccgucgaccaaugcgauc

SEQ ID NO: 2930693 - RNA, 22 nt, Mycobacterium avium subsp. paratuberculosis
ccgucgaccagcuugucgaucu

SEQ ID NO: 2930694 - RNA, 19 nt, Mycobacterium avium subsp. paratuberculosis
ccgucgaccaggacgucgg

SEQ ID NO: 2930695 - RNA, 23 nt, Mycobacterium avium subsp. paratuberculosis
ccgucgaccaggacgucggccgg

SEQ ID NO: 2930696 - RNA, 14 nt, Mycobacterium avium subsp. paratuberculosis
ccgucgaccagggu

SEQ ID NO: 2930697 - RNA, 18 nt, Mycobacterium avium subsp. paratuberculosis
ccgucgaccccgccggcc

SEQ ID NO: 2930698 - RNA, 19 nt, Mycobacterium avium subsp. paratuberculosis
ccgucgaccccgccggccc

SEQ ID NO: 2930699 - RNA, 20 nt, Mycobacterium avium subsp. paratuberculosis
ccgucgacccguuccccggc

SEQ ID NO: 2930700 - RNA, 15 nt, Mycobacterium avium subsp. paratuberculosis
ccgucgaccgggucc

SEQ ID NO: 2930701 - RNA, 18 nt, Mycobacterium avium subsp. paratuberculosis
ccgucgaccuccucgacc

SEQ ID NO: 2930702 - RNA, 11 nt, Mycobacterium avium subsp. paratuberculosis
ccgucgacgac

SEQ ID NO: 2930703 - RNA, 14 nt, Mycobacterium avium subsp. paratuberculosis
ccgucgacgacgaa

SEQ ID NO: 2930704 - RNA, 21 nt, Mycobacterium avium subsp. paratuberculosis
ccgucgacgacgaaucccgcc

SEQ ID NO: 2930705 - RNA, 13 nt, Mycobacterium avium subsp. paratuberculosis
ccgucgacgacgg

SEQ ID NO: 2930706 - RNA, 22 nt, Mycobacterium avium subsp. paratuberculosis
ccgucgacgaucugcacacggg

SEQ ID NO: 2930707 - RNA, 21 nt, Mycobacterium avium subsp. paratuberculosis
ccgucgacgcgugcgucaucg

SEQ ID NO: 2930708 - RNA, 22 nt, Mycobacterium avium subsp. paratuberculosis
ccgucgacgcgugcgucaucgc

SEQ ID NO: 2930709 - RNA, 14 nt, Mycobacterium avium subsp. paratuberculosis
ccgucgacgggcca

SEQ ID NO: 2930710 - RNA, 15 nt, Mycobacterium avium subsp. paratuberculosis
ccgucgacgggccac

SEQ ID NO: 2930711 - RNA, 21 nt, Mycobacterium avium subsp. paratuberculosis
ccgucgacgggccaccagcgc

SEQ ID NO: 2930712 - RNA, 17 nt, Mycobacterium avium subsp. paratuberculosis
ccgucgacggugaucag

SEQ ID NO: 2930713 - RNA, 20 nt, Mycobacterium avium subsp. paratuberculosis
ccgucgacucggcggugccg

SEQ ID NO: 2930714 - RNA, 18 nt, Mycobacterium avium subsp. paratuberculosis
ccgucgagcagccgcaac

SEQ ID NO: 2930715 - RNA, 12 nt, Mycobacterium avium subsp. paratuberculosis
ccgucgagcagg

SEQ ID NO: 2930716 - RNA, 20 nt, Mycobacterium avium subsp. paratuberculosis
ccgucgagcagggugacgcg

SEQ ID NO: 2930717 - RNA, 15 nt, Mycobacterium avium subsp. paratuberculosis
ccgucgagcgucacg

SEQ ID NO: 2930718 - RNA, 18 nt, Mycobacterium avium subsp. paratuberculosis
ccgucgagcgucacgccg

SEQ ID NO: 2930719 - RNA, 21 nt, Mycobacterium avium subsp. paratuberculosis
ccgucgagcgucacgccgcgc

SEQ ID NO: 2930720 - RNA, 22 nt, Mycobacterium avium subsp. paratuberculosis
ccgucgagcgucauuccgccgc

SEQ ID NO: 2930721 - RNA, 21 nt, Mycobacterium avium subsp. paratuberculosis
ccgucgaggacugggucaccg

SEQ ID NO: 2930722 - RNA, 19 nt, Mycobacterium avium subsp. paratuberculosis
ccgucgagguucaugugga

SEQ ID NO: 2930723 - RNA, 17 nt, Mycobacterium avium subsp. paratuberculosis
ccgucgaguccgugguc

SEQ ID NO: 2930724 - RNA, 14 nt, Mycobacterium avium subsp. paratuberculosis
ccgucgagucggcc

SEQ ID NO: 2930725 - RNA, 14 nt, Mycobacterium avium subsp. paratuberculosis
ccgucggccagcag

SEQ ID NO: 2930726 - RNA, 22 nt, Mycobacterium avium subsp. paratuberculosis
ccgucggccagcagcgcgucgc

SEQ ID NO: 2930727 - RNA, 12 nt, Mycobacterium avium subsp. paratuberculosis
ccgucggccauc

SEQ ID NO: 2930728 - RNA, 13 nt, Mycobacterium avium subsp. paratuberculosis
ccgucggccauca

SEQ ID NO: 2930729 - RNA, 18 nt, Mycobacterium avium subsp. paratuberculosis
ccgucggccaucagccgc

SEQ ID NO: 2930730 - RNA, 22 nt, Mycobacterium avium subsp. paratuberculosis
ccgucggccaucagccgccguc

SEQ ID NO: 2930731 - RNA, 24 nt, Mycobacterium avium subsp. paratuberculosis
ccgucggccaucagccgccgucgc

SEQ ID NO: 2930732 - RNA, 12 nt, Mycobacterium avium subsp. paratuberculosis
ccgucggcccgc

SEQ ID NO: 2930733 - RNA, 14 nt, Mycobacterium avium subsp. paratuberculosis
ccgucggccuccag

SEQ ID NO: 2930734 - RNA, 17 nt, Mycobacterium avium subsp. paratuberculosis
ccgucggccuccagccg

SEQ ID NO: 2930735 - RNA, 16 nt, Mycobacterium avium subsp. paratuberculosis
ccgucggccucggcgg

SEQ ID NO: 2930736 - RNA, 19 nt, Mycobacterium avium subsp. paratuberculosis
ccgucggccucggcggugg

SEQ ID NO: 2930737 - RNA, 17 nt, Mycobacterium avium subsp. paratuberculosis
ccgucggccugcgcugc

SEQ ID NO: 2930738 - RNA, 22 nt, Mycobacterium avium subsp. paratuberculosis
ccgucggccugcgcugcggcca

SEQ ID NO: 2930739 - RNA, 18 nt, Mycobacterium avium subsp. paratuberculosis
ccgucggccuugcgccac

SEQ ID NO: 2930740 - RNA, 13 nt, Mycobacterium avium subsp. paratuberculosis
ccgucggcgaucg

SEQ ID NO: 2930741 - RNA, 17 nt, Mycobacterium avium subsp. paratuberculosis
ccgucggcgaucgccgg

SEQ ID NO: 2930742 - RNA, 12 nt, Mycobacterium avium subsp. paratuberculosis
ccgucggcgaug

SEQ ID NO: 2930743 - RNA, 16 nt, Mycobacterium avium subsp. paratuberculosis
ccgucggcgaugcggu

SEQ ID NO: 2930744 - RNA, 14 nt, Mycobacterium avium subsp. paratuberculosis
ccgucggcgcccgg

SEQ ID NO: 2930745 - RNA, 15 nt, Mycobacterium avium subsp. paratuberculosis
ccgucggcgcccggc

SEQ ID NO: 2930746 - RNA, 20 nt, Mycobacterium avium subsp. paratuberculosis
ccgucggcgcccggcaccgg

SEQ ID NO: 2930747 - RNA, 13 nt, Mycobacterium avium subsp. paratuberculosis
ccgucggcgccgc

SEQ ID NO: 2930748 - RNA, 17 nt, Mycobacterium avium subsp. paratuberculosis
ccgucggcgccgccgag

SEQ ID NO: 2930749 - RNA, 21 nt, Mycobacterium avium subsp. paratuberculosis
ccgucggcgccgccgagccgc

SEQ ID NO: 2930750 - RNA, 14 nt, Mycobacterium avium subsp. paratuberculosis
ccgucggcgcggcc

SEQ ID NO: 2930751 - RNA, 15 nt, Mycobacterium avium subsp. paratuberculosis
ccgucggcgcggccg

SEQ ID NO: 2930752 - RNA, 15 nt, Mycobacterium avium subsp. paratuberculosis
ccgucggcggccgac

SEQ ID NO: 2930753 - RNA, 14 nt, Mycobacterium avium subsp. paratuberculosis
ccgucggcggccuu

SEQ ID NO: 2930754 - RNA, 21 nt, Mycobacterium avium subsp. paratuberculosis
ccgucggcggccuugaacgcg

SEQ ID NO: 2930755 - RNA, 14 nt, Mycobacterium avium subsp. paratuberculosis
ccgucggcgucgac

SEQ ID NO: 2930756 - RNA, 20 nt, Mycobacterium avium subsp. paratuberculosis
ccgucgggaauggggcccgg

SEQ ID NO: 2930757 - RNA, 14 nt, Mycobacterium avium subsp. paratuberculosis
ccgucgggacgcgg

SEQ ID NO: 2930758 - RNA, 15 nt, Mycobacterium avium subsp. paratuberculosis
ccgucgggacgcggc

SEQ ID NO: 2930759 - RNA, 17 nt, Mycobacterium avium subsp. paratuberculosis
ccgucgggacgcggcag

SEQ ID NO: 2930760 - RNA, 23 nt, Mycobacterium avium subsp. paratuberculosis
ccgucgggacgcggcaggcgccc

SEQ ID NO: 2930761 - RNA, 15 nt, Mycobacterium avium subsp. paratuberculosis
ccgucgggacggcca

SEQ ID NO: 2930762 - RNA, 14 nt, Mycobacterium avium subsp. paratuberculosis
ccgucgggcgcggc

SEQ ID NO: 2930763 - RNA, 16 nt, Mycobacterium avium subsp. paratuberculosis
ccgucgggcgcggcgg

SEQ ID NO: 2930764 - RNA, 16 nt, Mycobacterium avium subsp. paratuberculosis
ccgucgggcggggugg

SEQ ID NO: 2930765 - RNA, 20 nt, Mycobacterium avium subsp. paratuberculosis
ccgucgggcgggguggccac

SEQ ID NO: 2930766 - RNA, 14 nt, Mycobacterium avium subsp. paratuberculosis
ccgucggggcccgg

SEQ ID NO: 2930767 - RNA, 19 nt, Mycobacterium avium subsp. paratuberculosis
ccgucggggcccggcccgg

SEQ ID NO: 2930768 - RNA, 18 nt, Mycobacterium avium subsp. paratuberculosis
ccgucggggcgucggcgg

SEQ ID NO: 2930769 - RNA, 19 nt, Mycobacterium avium subsp. paratuberculosis
ccgucggggcgucggcggc

SEQ ID NO: 2930770 - RNA, 23 nt, Mycobacterium avium subsp. paratuberculosis
ccgucggggcugaguucggugaa

SEQ ID NO: 2930771 - RNA, 15 nt, Mycobacterium avium subsp. paratuberculosis
ccgucggggucgcgc

SEQ ID NO: 2930772 - RNA, 14 nt, Mycobacterium avium subsp. paratuberculosis
ccgucggggugcgc

SEQ ID NO: 2930773 - RNA, 18 nt, Mycobacterium avium subsp. paratuberculosis
ccgucggggugcgccagg

SEQ ID NO: 2930774 - RNA, 19 nt, Mycobacterium avium subsp. paratuberculosis
ccgucggggugcgccaggc

SEQ ID NO: 2930775 - RNA, 21 nt, Mycobacterium avium subsp. paratuberculosis
ccgucgggguggggacgacgc

SEQ ID NO: 2930776 - RNA, 22 nt, Mycobacterium avium subsp. paratuberculosis
ccgucgggguggggacgacgcc

SEQ ID NO: 2930777 - RNA, 18 nt, Mycobacterium avium subsp. paratuberculosis
ccgucgguaucgaggucc

SEQ ID NO: 2930778 - RNA, 15 nt, Mycobacterium avium subsp. paratuberculosis
ccgucggucccgacg

SEQ ID NO: 2930779 - RNA, 21 nt, Mycobacterium avium subsp. paratuberculosis
ccgucggucccgacgcggcgc

SEQ ID NO: 2930780 - RNA, 21 nt, Mycobacterium avium subsp. paratuberculosis
ccgucggugaaguuggcggcg

SEQ ID NO: 2930781 - RNA, 20 nt, Mycobacterium avium subsp. paratuberculosis
ccgucgguggcgguggggcc

SEQ ID NO: 2930782 - RNA, 16 nt, Mycobacterium avium subsp. paratuberculosis
ccgucggugggggcca

SEQ ID NO: 2930783 - RNA, 16 nt, Mycobacterium avium subsp. paratuberculosis
ccgucgguguccaggu

SEQ ID NO: 2930784 - RNA, 22 nt, Mycobacterium avium subsp. paratuberculosis
ccgucggugucgaagacggucc

SEQ ID NO: 2930785 - RNA, 20 nt, Mycobacterium avium subsp. paratuberculosis
ccgucguacucgaccgcgac

SEQ ID NO: 2930786 - RNA, 14 nt, Mycobacterium avium subsp. paratuberculosis
ccgucguagccgcg

SEQ ID NO: 2930787 - RNA, 15 nt, Mycobacterium avium subsp. paratuberculosis
ccgucguaggcgcgg

SEQ ID NO: 2930788 - RNA, 18 nt, Mycobacterium avium subsp. paratuberculosis
ccgucguaggcgcggaca

SEQ ID NO: 2930789 - RNA, 21 nt, Mycobacterium avium subsp. paratuberculosis
ccgucguauucgacggcgacc

SEQ ID NO: 2930790 - RNA, 16 nt, Mycobacterium avium subsp. paratuberculosis
ccgucgucagccgggc

SEQ ID NO: 2930791 - RNA, 18 nt, Mycobacterium avium subsp. paratuberculosis
ccgucgucagccgggcca

SEQ ID NO: 2930792 - RNA, 19 nt, Mycobacterium avium subsp. paratuberculosis
ccgucgucagccgggccag

SEQ ID NO: 2930793 - RNA, 14 nt, Mycobacterium avium subsp. paratuberculosis
ccgucguccacgcc

SEQ ID NO: 2930794 - RNA, 22 nt, Mycobacterium avium subsp. paratuberculosis
ccgucguccacgcccagcgccc

SEQ ID NO: 2930795 - RNA, 22 nt, Mycobacterium avium subsp. paratuberculosis
ccgucguccuugagcccccacc

SEQ ID NO: 2930796 - RNA, 16 nt, Mycobacterium avium subsp. paratuberculosis
ccgucgucgagcacca

SEQ ID NO: 2930797 - RNA, 17 nt, Mycobacterium avium subsp. paratuberculosis
ccgucgucgagcaccac

SEQ ID NO: 2930798 - RNA, 14 nt, Mycobacterium avium subsp. paratuberculosis
ccgucgucgaggcc

SEQ ID NO: 2930799 - RNA, 15 nt, Mycobacterium avium subsp. paratuberculosis
ccgucgucgaggccg

SEQ ID NO: 2930800 - RNA, 12 nt, Mycobacterium avium subsp. paratuberculosis
ccgucgucgaug

SEQ ID NO: 2930801 - RNA, 13 nt, Mycobacterium avium subsp. paratuberculosis
ccgucgucgaugc

SEQ ID NO: 2930802 - RNA, 18 nt, Mycobacterium avium subsp. paratuberculosis
ccgucgucgaugcgcagc

SEQ ID NO: 2930803 - RNA, 14 nt, Mycobacterium avium subsp. paratuberculosis
ccgucgucgcaccg

SEQ ID NO: 2930804 - RNA, 13 nt, Mycobacterium avium subsp. paratuberculosis
ccgucgucggaca

SEQ ID NO: 2930805 - RNA, 22 nt, Mycobacterium avium subsp. paratuberculosis
ccgucgucggacaccagcaugg

SEQ ID NO: 2930806 - RNA, 16 nt, Mycobacterium avium subsp. paratuberculosis
ccgucgucggcgccgc

SEQ ID NO: 2930807 - RNA, 18 nt, Mycobacterium avium subsp. paratuberculosis
ccgucgucggcgccgcgc

SEQ ID NO: 2930808 - RNA, 20 nt, Mycobacterium avium subsp. paratuberculosis
ccgucgucggcgccgcgccg

SEQ ID NO: 2930809 - RNA, 22 nt, Mycobacterium avium subsp. paratuberculosis
ccgucgucgucgcuccacaucu

SEQ ID NO: 2930810 - RNA, 22 nt, Mycobacterium avium subsp. paratuberculosis
ccgugcccgcgggacacggcgg

SEQ ID NO: 2930811 - RNA, 13 nt, Mycobacterium avium subsp. paratuberculosis
ccgugcccggcgc

SEQ ID NO: 2930812 - RNA, 16 nt, Mycobacterium avium subsp. paratuberculosis
ccgugcccggcgcccu

SEQ ID NO: 2930813 - RNA, 17 nt, Mycobacterium avium subsp. paratuberculosis
ccgugccgaugccggcc

SEQ ID NO: 2930814 - RNA, 18 nt, Mycobacterium avium subsp. paratuberculosis
ccgugccgaugccggccu

SEQ ID NO: 2930815 - RNA, 19 nt, Mycobacterium avium subsp. paratuberculosis
ccgugccgauggccaccgg

SEQ ID NO: 2930816 - RNA, 14 nt, Mycobacterium avium subsp. paratuberculosis
ccgugccgcccguc

SEQ ID NO: 2930817 - RNA, 15 nt, Mycobacterium avium subsp. paratuberculosis
ccgugccggaccgcg

SEQ ID NO: 2930818 - RNA, 16 nt, Mycobacterium avium subsp. paratuberculosis
ccgugccggaccgcgc

SEQ ID NO: 2930819 - RNA, 16 nt, Mycobacterium avium subsp. paratuberculosis
ccgugccggcucggcg

SEQ ID NO: 2930820 - RNA, 14 nt, Mycobacterium avium subsp. paratuberculosis
ccgugccguccggc

SEQ ID NO: 2930821 - RNA, 17 nt, Mycobacterium avium subsp. paratuberculosis
ccgugccguccggccgg

SEQ ID NO: 2930822 - RNA, 12 nt, Mycobacterium avium subsp. paratuberculosis
ccgugccgucgg

SEQ ID NO: 2930823 - RNA, 14 nt, Mycobacterium avium subsp. paratuberculosis
ccgugccguggucg

SEQ ID NO: 2930824 - RNA, 14 nt, Mycobacterium avium subsp. paratuberculosis
ccgugccucgccac

SEQ ID NO: 2930825 - RNA, 17 nt, Mycobacterium avium subsp. paratuberculosis
ccgugccucgccacugg

SEQ ID NO: 2930826 - RNA, 15 nt, Mycobacterium avium subsp. paratuberculosis
ccgugcgacggcucu

SEQ ID NO: 2930827 - RNA, 14 nt, Mycobacterium avium subsp. paratuberculosis
ccgugcgccagcga

SEQ ID NO: 2930828 - RNA, 15 nt, Mycobacterium avium subsp. paratuberculosis
ccgugcgccagcgac

SEQ ID NO: 2930829 - RNA, 18 nt, Mycobacterium avium subsp. paratuberculosis
ccgugcgccagcgaccgc

SEQ ID NO: 2930830 - RNA, 20 nt, Mycobacterium avium subsp. paratuberculosis
ccgugcgccagcgaccgcag

SEQ ID NO: 2930831 - RNA, 14 nt, Mycobacterium avium subsp. paratuberculosis
ccgugcgccccgcc

SEQ ID NO: 2930832 - RNA, 13 nt, Mycobacterium avium subsp. paratuberculosis
ccgugcgccucga

SEQ ID NO: 2930833 - RNA, 15 nt, Mycobacterium avium subsp. paratuberculosis
ccgugcgcggcgacc

SEQ ID NO: 2930834 - RNA, 18 nt, Mycobacterium avium subsp. paratuberculosis
ccgugcggcacgccgcag

SEQ ID NO: 2930835 - RNA, 20 nt, Mycobacterium avium subsp. paratuberculosis
ccgugcggcacgccgcagcg

SEQ ID NO: 2930836 - RNA, 14 nt, Mycobacterium avium subsp. paratuberculosis
ccgugcggcggcgg

SEQ ID NO: 2930837 - RNA, 19 nt, Mycobacterium avium subsp. paratuberculosis
ccgugcggcggcggcgguc

SEQ ID NO: 2930838 - RNA, 19 nt, Mycobacterium avium subsp. paratuberculosis
ccgugcggcggggccucga

SEQ ID NO: 2930839 - RNA, 20 nt, Mycobacterium avium subsp. paratuberculosis
ccgugcggcguucggugccc

SEQ ID NO: 2930840 - RNA, 22 nt, Mycobacterium avium subsp. paratuberculosis
ccgugcggggccucgucgccgc

SEQ ID NO: 2930841 - RNA, 23 nt, Mycobacterium avium subsp. paratuberculosis
ccgugcggggccucgucgccgcg

SEQ ID NO: 2930842 - RNA, 15 nt, Mycobacterium avium subsp. paratuberculosis
ccgugcgggucgcgc

SEQ ID NO: 2930843 - RNA, 15 nt, Mycobacterium avium subsp. paratuberculosis
ccgugcgguccacca

SEQ ID NO: 2930844 - RNA, 23 nt, Mycobacterium avium subsp. paratuberculosis
ccgugcgguccaccaauggcggc

SEQ ID NO: 2930845 - RNA, 12 nt, Mycobacterium avium subsp. paratuberculosis
ccgugcucggcg

SEQ ID NO: 2930846 - RNA, 15 nt, Mycobacterium avium subsp. paratuberculosis
ccgugcucggcggcg

SEQ ID NO: 2930847 - RNA, 21 nt, Mycobacterium avium subsp. paratuberculosis
ccgugcugauccacgcccgga

SEQ ID NO: 2930848 - RNA, 13 nt, Mycobacterium avium subsp. paratuberculosis
ccgugcugccggc

SEQ ID NO: 2930849 - RNA, 19 nt, Mycobacterium avium subsp. paratuberculosis
ccgugcugccggccggcag

SEQ ID NO: 2930850 - RNA, 20 nt, Mycobacterium avium subsp. paratuberculosis
ccgugcugccggccggcagc

SEQ ID NO: 2930851 - RNA, 20 nt, Mycobacterium avium subsp. paratuberculosis
ccgugcuggccaccacgggu

SEQ ID NO: 2930852 - RNA, 20 nt, Mycobacterium avium subsp. paratuberculosis
ccgugcuggccaucgcgggu

SEQ ID NO: 2930853 - RNA, 13 nt, Mycobacterium avium subsp. paratuberculosis
ccgugcuggccgg

SEQ ID NO: 2930854 - RNA, 19 nt, Mycobacterium avium subsp. paratuberculosis
ccgugcugugcugccugcc

SEQ ID NO: 2930855 - RNA, 22 nt, Mycobacterium avium subsp. paratuberculosis
ccgugcugugcugccugccguu

SEQ ID NO: 2930856 - RNA, 19 nt, Mycobacterium avium subsp. paratuberculosis
ccgugcuugcccgacgagu

SEQ ID NO: 2930857 - RNA, 24 nt, Mycobacterium avium subsp. paratuberculosis
ccgugcuugcccgacgagucgccg

SEQ ID NO: 2930858 - RNA, 21 nt, Mycobacterium avium subsp. paratuberculosis
ccguggaagauguugccgcca

SEQ ID NO: 2930859 - RNA, 16 nt, Mycobacterium avium subsp. paratuberculosis
ccguggaagucgccgu

SEQ ID NO: 2930860 - RNA, 17 nt, Mycobacterium avium subsp. paratuberculosis
ccguggaagucgccguc

SEQ ID NO: 2930861 - RNA, 23 nt, Mycobacterium avium subsp. paratuberculosis
ccguggaagucgccguccggggc

SEQ ID NO: 2930862 - RNA, 16 nt, Mycobacterium avium subsp. paratuberculosis
ccguggacccgccccg

SEQ ID NO: 2930863 - RNA, 21 nt, Mycobacterium avium subsp. paratuberculosis
ccguggacccgccccgacagc

SEQ ID NO: 2930864 - RNA, 22 nt, Mycobacterium avium subsp. paratuberculosis
ccguggacggcgagcggcccug

SEQ ID NO: 2930865 - RNA, 21 nt, Mycobacterium avium subsp. paratuberculosis
ccguggaggacgaggcccgca

SEQ ID NO: 2930866 - RNA, 17 nt, Mycobacterium avium subsp. paratuberculosis
ccguggaggcguagugc

SEQ ID NO: 2930867 - RNA, 22 nt, Mycobacterium avium subsp. paratuberculosis
ccguggaggcguagugcgccca

SEQ ID NO: 2930868 - RNA, 21 nt, Mycobacterium avium subsp. paratuberculosis
ccguggaucaucccgaccagc

SEQ ID NO: 2930869 - RNA, 16 nt, Mycobacterium avium subsp. paratuberculosis
ccguggcaccgggugg

SEQ ID NO: 2930870 - RNA, 15 nt, Mycobacterium avium subsp. paratuberculosis
ccguggcagggccag

SEQ ID NO: 2930871 - RNA, 20 nt, Mycobacterium avium subsp. paratuberculosis
ccguggcagggccagcagcc

SEQ ID NO: 2930872 - RNA, 17 nt, Mycobacterium avium subsp. paratuberculosis
ccguggccagcgccagc

SEQ ID NO: 2930873 - RNA, 15 nt, Mycobacterium avium subsp. paratuberculosis
ccguggcccacggga

SEQ ID NO: 2930874 - RNA, 15 nt, Mycobacterium avium subsp. paratuberculosis
ccguggcccaugugg

SEQ ID NO: 2930875 - RNA, 19 nt, Mycobacterium avium subsp. paratuberculosis
ccguggcccauguggccug

SEQ ID NO: 2930876 - RNA, 13 nt, Mycobacterium avium subsp. paratuberculosis
ccguggccccagc

SEQ ID NO: 2930877 - RNA, 15 nt, Mycobacterium avium subsp. paratuberculosis
ccguggccccagcca

SEQ ID NO: 2930878 - RNA, 17 nt, Mycobacterium avium subsp. paratuberculosis
ccguggccccagccacc

SEQ ID NO: 2930879 - RNA, 18 nt, Mycobacterium avium subsp. paratuberculosis
ccguggcccggucggagu

SEQ ID NO: 2930880 - RNA, 18 nt, Mycobacterium avium subsp. paratuberculosis
ccguggccgucacgcugg

SEQ ID NO: 2930881 - RNA, 17 nt, Mycobacterium avium subsp. paratuberculosis
ccguggcggcccgacca

SEQ ID NO: 2930882 - RNA, 14 nt, Mycobacterium avium subsp. paratuberculosis
ccguggcggcgggc

SEQ ID NO: 2930883 - RNA, 23 nt, Mycobacterium avium subsp. paratuberculosis
ccguggcgggggagccgugcagc

SEQ ID NO: 2930884 - RNA, 16 nt, Mycobacterium avium subsp. paratuberculosis
ccgugggccgaccggc

SEQ ID NO: 2930885 - RNA, 17 nt, Mycobacterium avium subsp. paratuberculosis
ccgugggccgaccggcc

SEQ ID NO: 2930886 - RNA, 17 nt, Mycobacterium avium subsp. paratuberculosis
ccgugggcggcgcgauc

SEQ ID NO: 2930887 - RNA, 21 nt, Mycobacterium avium subsp. paratuberculosis
ccgugggcggcgcgaucgucg

SEQ ID NO: 2930888 - RNA, 23 nt, Mycobacterium avium subsp. paratuberculosis
ccgugggcgucacgcaucagggc

SEQ ID NO: 2930889 - RNA, 16 nt, Mycobacterium avium subsp. paratuberculosis
ccgugggggucgaccc

SEQ ID NO: 2930890 - RNA, 19 nt, Mycobacterium avium subsp. paratuberculosis
ccgugggggucgacccgcc

SEQ ID NO: 2930891 - RNA, 24 nt, Mycobacterium avium subsp. paratuberculosis
ccgugggggucgacccgccgcagc

SEQ ID NO: 2930892 - RNA, 16 nt, Mycobacterium avium subsp. paratuberculosis
ccgugggugucggcga

SEQ ID NO: 2930893 - RNA, 18 nt, Mycobacterium avium subsp. paratuberculosis
ccgugggugucggcgaag

SEQ ID NO: 2930894 - RNA, 12 nt, Mycobacterium avium subsp. paratuberculosis
ccguugccgccg

SEQ ID NO: 2930895 - RNA, 13 nt, Mycobacterium avium subsp. paratuberculosis
ccguugccgccgc

SEQ ID NO: 2930896 - RNA, 16 nt, Mycobacterium avium subsp. paratuberculosis
ccguugccgccgcgcg

SEQ ID NO: 2930897 - RNA, 13 nt, Mycobacterium avium subsp. paratuberculosis
ccguugccggccc

SEQ ID NO: 2930898 - RNA, 13 nt, Mycobacterium avium subsp. paratuberculosis
ccguugcgcccca

SEQ ID NO: 2930899 - RNA, 17 nt, Mycobacterium avium subsp. paratuberculosis
ccguugcgccccacggu

SEQ ID NO: 2930900 - RNA, 18 nt, Mycobacterium avium subsp. paratuberculosis
ccguugcgccgcaacggc

SEQ ID NO: 2930901 - RNA, 20 nt, Mycobacterium avium subsp. paratuberculosis
ccguugcgggacugggcgau

SEQ ID NO: 2930902 - RNA, 17 nt, Mycobacterium avium subsp. paratuberculosis
ccguugcgggucggcgu

SEQ ID NO: 2930903 - RNA, 18 nt, Mycobacterium avium subsp. paratuberculosis
ccguugcgggucggcguc

SEQ ID NO: 2930904 - RNA, 18 nt, Mycobacterium avium subsp. paratuberculosis
ccguugcgggugucgccg

SEQ ID NO: 2930905 - RNA, 19 nt, Mycobacterium avium subsp. paratuberculosis
ccguugcgggugucgccgg

SEQ ID NO: 2930906 - RNA, 20 nt, Mycobacterium avium subsp. paratuberculosis
ccguugcgggugucgccggu

SEQ ID NO: 2930907 - RNA, 17 nt, Mycobacterium avium subsp. paratuberculosis
ccguugcggugacgaug

SEQ ID NO: 2930908 - RNA, 12 nt, Mycobacterium avium subsp. paratuberculosis
ccguugcggugc

SEQ ID NO: 2930909 - RNA, 19 nt, Mycobacterium avium subsp. paratuberculosis
ccguugcggugcucgucga

SEQ ID NO: 2930910 - RNA, 21 nt, Mycobacterium avium subsp. paratuberculosis
ccguugcggugcucgucgagc

SEQ ID NO: 2930911 - RNA, 22 nt, Mycobacterium avium subsp. paratuberculosis
ccguugcucucggccucccggu

SEQ ID NO: 2930912 - RNA, 14 nt, Mycobacterium avium subsp. paratuberculosis
ccguuggaggugau

SEQ ID NO: 2930913 - RNA, 18 nt, Mycobacterium avium subsp. paratuberculosis
ccguuggcaggcccggua

SEQ ID NO: 2930914 - RNA, 14 nt, Mycobacterium avium subsp. paratuberculosis
ccguuggcgccggu

SEQ ID NO: 2930915 - RNA, 21 nt, Mycobacterium avium subsp. paratuberculosis
ccguuggcguggauggccggc

SEQ ID NO: 2930916 - RNA, 16 nt, Mycobacterium avium subsp. paratuberculosis
ccguuggcuuuucggg

SEQ ID NO: 2930917 - RNA, 22 nt, Mycobacterium avium subsp. paratuberculosis
ccguugggcagcucggcgggcu

SEQ ID NO: 2930918 - RNA, 17 nt, Mycobacterium avium subsp. paratuberculosis
ccguugggccagaacga

SEQ ID NO: 2930919 - RNA, 21 nt, Mycobacterium avium subsp. paratuberculosis
ccguuggggaucgugucgauc

SEQ ID NO: 2930920 - RNA, 19 nt, Mycobacterium avium subsp. paratuberculosis
ccguugggggcgccgcggc

SEQ ID NO: 2930921 - RNA, 20 nt, Mycobacterium avium subsp. paratuberculosis
ccguugggggcgccgcggcg

SEQ ID NO: 2930922 - RNA, 23 nt, Mycobacterium avium subsp. paratuberculosis
ccguugggucucaucccgccgac

SEQ ID NO: 2930923 - RNA, 19 nt, Mycobacterium avium subsp. paratuberculosis
ccguuggugacgcucaccc

SEQ ID NO: 2930924 - RNA, 14 nt, Mycobacterium avium subsp. paratuberculosis
ccguugguggucug

SEQ ID NO: 2930925 - RNA, 21 nt, Mycobacterium avium subsp. paratuberculosis
ccguuguaggccgcgcggugc

SEQ ID NO: 2930926 - RNA, 18 nt, Mycobacterium avium subsp. paratuberculosis
ccguuguaguagaccuug

SEQ ID NO: 2930927 - RNA, 16 nt, Mycobacterium avium subsp. paratuberculosis
ccguugucgaggucgg

SEQ ID NO: 2930928 - RNA, 21 nt, Mycobacterium avium subsp. paratuberculosis
ccguugucucggcgccgucgc

SEQ ID NO: 2930929 - RNA, 13 nt, Mycobacterium avium subsp. paratuberculosis
ccguugugacccg

SEQ ID NO: 2930930 - RNA, 18 nt, Mycobacterium avium subsp. paratuberculosis
ccguugugcaccaucuuc

SEQ ID NO: 2930931 - RNA, 16 nt, Mycobacterium avium subsp. paratuberculosis
ccguugugccaccgcc

SEQ ID NO: 2930932 - RNA, 15 nt, Mycobacterium avium subsp. paratuberculosis
ccguuguggccaccc

SEQ ID NO: 2930933 - RNA, 13 nt, Mycobacterium avium subsp. paratuberculosis
ccguuguggcggc

SEQ ID NO: 2930934 - RNA, 15 nt, Mycobacterium avium subsp. paratuberculosis
ccguuguggcggcca

SEQ ID NO: 2930935 - RNA, 19 nt, Mycobacterium avium subsp. paratuberculosis
ccguuguugaggaugacga

SEQ ID NO: 2930936 - RNA, 14 nt, Mycobacterium avium subsp. paratuberculosis
ccguuucggacgag

SEQ ID NO: 2930937 - RNA, 14 nt, Mycobacterium avium subsp. paratuberculosis
ccguuuucggcgcg

SEQ ID NO: 2930938 - RNA, 14 nt, Mycobacterium avium subsp. paratuberculosis
ccuaacgugcccgg

SEQ ID NO: 2930939 - RNA, 16 nt, Mycobacterium avium subsp. paratuberculosis
ccuacacagcccccac

SEQ ID NO: 2930940 - RNA, 17 nt, Mycobacterium avium subsp. paratuberculosis
ccuacaggugccggcgg

SEQ ID NO: 2930941 - RNA, 18 nt, Mycobacterium avium subsp. paratuberculosis
ccuacaggugccggcggc

SEQ ID NO: 2930942 - RNA, 13 nt, Mycobacterium avium subsp. paratuberculosis
ccuaccggguggc

SEQ ID NO: 2930943 - RNA, 20 nt, Mycobacterium avium subsp. paratuberculosis
ccuaccggguggccagcacc

SEQ ID NO: 2930944 - RNA, 22 nt, Mycobacterium avium subsp. paratuberculosis
ccuaccggguggccagcaccag

SEQ ID NO: 2930945 - RNA, 15 nt, Mycobacterium avium subsp. paratuberculosis
ccuacggcgccggua

SEQ ID NO: 2930946 - RNA, 15 nt, Mycobacterium avium subsp. paratuberculosis
ccuacggcgggugcg

SEQ ID NO: 2930947 - RNA, 17 nt, Mycobacterium avium subsp. paratuberculosis
ccuacuugcggccgcga

SEQ ID NO: 2930948 - RNA, 19 nt, Mycobacterium avium subsp. paratuberculosis
ccuacuugcggccgcgacg

SEQ ID NO: 2930949 - RNA, 22 nt, Mycobacterium avium subsp. paratuberculosis
ccuacuugcguugcgcggcggc

SEQ ID NO: 2930950 - RNA, 22 nt, Mycobacterium avium subsp. paratuberculosis
ccuagccuuggccgcaggcggc

SEQ ID NO: 2930951 - RNA, 22 nt, Mycobacterium avium subsp. paratuberculosis
ccuagcgggccaggauguucac

SEQ ID NO: 2930952 - RNA, 17 nt, Mycobacterium avium subsp. paratuberculosis
ccuaggaccccggcugc

SEQ ID NO: 2930953 - RNA, 15 nt, Mycobacterium avium subsp. paratuberculosis
ccuaggacgccgccc

SEQ ID NO: 2930954 - RNA, 14 nt, Mycobacterium avium subsp. paratuberculosis
ccuagggcccacgc

SEQ ID NO: 2930955 - RNA, 13 nt, Mycobacterium avium subsp. paratuberculosis
ccuagucgacgcc

SEQ ID NO: 2930956 - RNA, 14 nt, Mycobacterium avium subsp. paratuberculosis
ccuagucgacgccg

SEQ ID NO: 2930957 - RNA, 16 nt, Mycobacterium avium subsp. paratuberculosis
ccuaugaggcgacccc

SEQ ID NO: 2930958 - RNA, 17 nt, Mycobacterium avium subsp. paratuberculosis
ccucacaccucgcuacg

SEQ ID NO: 2930959 - RNA, 24 nt, Mycobacterium avium subsp. paratuberculosis
ccucacaccucgcuacgcgagcug

SEQ ID NO: 2930960 - RNA, 19 nt, Mycobacterium avium subsp. paratuberculosis
ccucacagcgacaacgggc

SEQ ID NO: 2930961 - RNA, 17 nt, Mycobacterium avium subsp. paratuberculosis
ccucaccccgcccagcg

SEQ ID NO: 2930962 - RNA, 14 nt, Mycobacterium avium subsp. paratuberculosis
ccucaccgcgggcc

SEQ ID NO: 2930963 - RNA, 17 nt, Mycobacterium avium subsp. paratuberculosis
ccucaccugcguugcgg

SEQ ID NO: 2930964 - RNA, 17 nt, Mycobacterium avium subsp. paratuberculosis
ccucacggucggcgucc

SEQ ID NO: 2930965 - RNA, 15 nt, Mycobacterium avium subsp. paratuberculosis
ccucacuccagcggc

SEQ ID NO: 2930966 - RNA, 15 nt, Mycobacterium avium subsp. paratuberculosis
ccucagcacggccgc

SEQ ID NO: 2930967 - RNA, 16 nt, Mycobacterium avium subsp. paratuberculosis
ccucagcacggccgcg

SEQ ID NO: 2930968 - RNA, 19 nt, Mycobacterium avium subsp. paratuberculosis
ccucagcagggcggcaccg

SEQ ID NO: 2930969 - RNA, 12 nt, Mycobacterium avium subsp. paratuberculosis
ccucagcccggc

SEQ ID NO: 2930970 - RNA, 15 nt, Mycobacterium avium subsp. paratuberculosis
ccucagcccggcagc

SEQ ID NO: 2930971 - RNA, 16 nt, Mycobacterium avium subsp. paratuberculosis
ccucagcccggcagcg

SEQ ID NO: 2930972 - RNA, 17 nt, Mycobacterium avium subsp. paratuberculosis
ccucaggcgagcacccg

SEQ ID NO: 2930973 - RNA, 16 nt, Mycobacterium avium subsp. paratuberculosis
ccucaggcguccagca

SEQ ID NO: 2930974 - RNA, 23 nt, Mycobacterium avium subsp. paratuberculosis
ccucaggcguccagcaccugcuc

SEQ ID NO: 2930975 - RNA, 14 nt, Mycobacterium avium subsp. paratuberculosis
ccucauagccggcc

SEQ ID NO: 2930976 - RNA, 16 nt, Mycobacterium avium subsp. paratuberculosis
ccucauaggcguacac

SEQ ID NO: 2930977 - RNA, 20 nt, Mycobacterium avium subsp. paratuberculosis
ccucauaggcguacaccagg

SEQ ID NO: 2930978 - RNA, 18 nt, Mycobacterium avium subsp. paratuberculosis
ccucaucgcccagccggc

SEQ ID NO: 2930979 - RNA, 20 nt, Mycobacterium avium subsp. paratuberculosis
ccucaucgcccagccggcgg

SEQ ID NO: 2930980 - RNA, 20 nt, Mycobacterium avium subsp. paratuberculosis
ccucaucgucgacccggccg

SEQ ID NO: 2930981 - RNA, 14 nt, Mycobacterium avium subsp. paratuberculosis
ccucaugccagacg

SEQ ID NO: 2930982 - RNA, 17 nt, Mycobacterium avium subsp. paratuberculosis
ccucaugccagacgcgc

SEQ ID NO: 2930983 - RNA, 22 nt, Mycobacterium avium subsp. paratuberculosis
ccuccaacggcaccaccacggu

SEQ ID NO: 2930984 - RNA, 16 nt, Mycobacterium avium subsp. paratuberculosis
ccuccaaugcgcccug

SEQ ID NO: 2930985 - RNA, 17 nt, Mycobacterium avium subsp. paratuberculosis
ccuccacauacgcggcg

SEQ ID NO: 2930986 - RNA, 14 nt, Mycobacterium avium subsp. paratuberculosis
ccuccaccagcggc

SEQ ID NO: 2930987 - RNA, 11 nt, Mycobacterium avium subsp. paratuberculosis
ccuccaccggc

SEQ ID NO: 2930988 - RNA, 23 nt, Mycobacterium avium subsp. paratuberculosis
ccuccaccggcaaucgggacgcc

SEQ ID NO: 2930989 - RNA, 22 nt, Mycobacterium avium subsp. paratuberculosis
ccuccacgacuucacaggccgc

SEQ ID NO: 2930990 - RNA, 13 nt, Mycobacterium avium subsp. paratuberculosis
ccuccacggugcg

SEQ ID NO: 2930991 - RNA, 18 nt, Mycobacterium avium subsp. paratuberculosis
ccuccacggugcgcaccg

SEQ ID NO: 2930992 - RNA, 21 nt, Mycobacterium avium subsp. paratuberculosis
ccuccacggugcgcaccgaca

SEQ ID NO: 2930993 - RNA, 16 nt, Mycobacterium avium subsp. paratuberculosis
ccuccagcagggacau

SEQ ID NO: 2930994 - RNA, 15 nt, Mycobacterium avium subsp. paratuberculosis
ccuccagccagcgcg

SEQ ID NO: 2930995 - RNA, 15 nt, Mycobacterium avium subsp. paratuberculosis
ccuccagcccggcga

SEQ ID NO: 2930996 - RNA, 14 nt, Mycobacterium avium subsp. paratuberculosis
ccuccagccgcgcg

SEQ ID NO: 2930997 - RNA, 24 nt, Mycobacterium avium subsp. paratuberculosis
ccuccagccgcgcggccgccuccg

SEQ ID NO: 2930998 - RNA, 13 nt, Mycobacterium avium subsp. paratuberculosis
ccuccagccgcuc

SEQ ID NO: 2930999 - RNA, 15 nt, Mycobacterium avium subsp. paratuberculosis
ccuccagccgcuccg

SEQ ID NO: 2931000 - RNA, 17 nt, Mycobacterium avium subsp. paratuberculosis
ccuccagccgcuccucg

SEQ ID NO: 2931001 - RNA, 21 nt, Mycobacterium avium subsp. paratuberculosis
ccuccagccgcuccucguuga

SEQ ID NO: 2931002 - RNA, 14 nt, Mycobacterium avium subsp. paratuberculosis
ccuccagcggcagg

SEQ ID NO: 2931003 - RNA, 18 nt, Mycobacterium avium subsp. paratuberculosis
ccuccagcggcaggugga

SEQ ID NO: 2931004 - RNA, 14 nt, Mycobacterium avium subsp. paratuberculosis
ccuccagcuguuga

SEQ ID NO: 2931005 - RNA, 23 nt, Mycobacterium avium subsp. paratuberculosis
ccuccagcuguugacgggccgcg

SEQ ID NO: 2931006 - RNA, 17 nt, Mycobacterium avium subsp. paratuberculosis
ccuccaggaaacggccc

SEQ ID NO: 2931007 - RNA, 21 nt, Mycobacterium avium subsp. paratuberculosis
ccuccaggaaacggcccauca

SEQ ID NO: 2931008 - RNA, 17 nt, Mycobacterium avium subsp. paratuberculosis
ccuccagguucgccgcc

SEQ ID NO: 2931009 - RNA, 18 nt, Mycobacterium avium subsp. paratuberculosis
ccuccagguucgccgccc

SEQ ID NO: 2931010 - RNA, 21 nt, Mycobacterium avium subsp. paratuberculosis
ccuccaguugcgaccccgccg

SEQ ID NO: 2931011 - RNA, 21 nt, Mycobacterium avium subsp. paratuberculosis
ccuccaugucgcaacggucgg

SEQ ID NO: 2931012 - RNA, 19 nt, Mycobacterium avium subsp. paratuberculosis
ccuccauucgggccagcgc

SEQ ID NO: 2931013 - RNA, 23 nt, Mycobacterium avium subsp. paratuberculosis
ccuccauucgggccagcgccgag

SEQ ID NO: 2931014 - RNA, 22 nt, Mycobacterium avium subsp. paratuberculosis
ccucccacaggucgaaacccgu

SEQ ID NO: 2931015 - RNA, 12 nt, Mycobacterium avium subsp. paratuberculosis
ccucccagcccu

SEQ ID NO: 2931016 - RNA, 14 nt, Mycobacterium avium subsp. paratuberculosis
ccucccagcccucg

SEQ ID NO: 2931017 - RNA, 15 nt, Mycobacterium avium subsp. paratuberculosis
ccuccccggccagca

SEQ ID NO: 2931018 - RNA, 15 nt, Mycobacterium avium subsp. paratuberculosis
ccucccgcagcgcca

SEQ ID NO: 2931019 - RNA, 13 nt, Mycobacterium avium subsp. paratuberculosis
ccucccggcgcca

SEQ ID NO: 2931020 - RNA, 17 nt, Mycobacterium avium subsp. paratuberculosis
ccuccgaauccagcgcg

SEQ ID NO: 2931021 - RNA, 21 nt, Mycobacterium avium subsp. paratuberculosis
ccuccgaauccagcgcgccgc

SEQ ID NO: 2931022 - RNA, 17 nt, Mycobacterium avium subsp. paratuberculosis
ccuccgacagcccccgc

SEQ ID NO: 2931023 - RNA, 14 nt, Mycobacterium avium subsp. paratuberculosis
ccuccgacccgucc

SEQ ID NO: 2931024 - RNA, 21 nt, Mycobacterium avium subsp. paratuberculosis
ccuccgacccguccagcgugu

SEQ ID NO: 2931025 - RNA, 21 nt, Mycobacterium avium subsp. paratuberculosis
ccuccgagauggacagcaccu

SEQ ID NO: 2931026 - RNA, 12 nt, Mycobacterium avium subsp. paratuberculosis
ccuccgccaccu

SEQ ID NO: 2931027 - RNA, 14 nt, Mycobacterium avium subsp. paratuberculosis
ccuccgccgccccg

SEQ ID NO: 2931028 - RNA, 17 nt, Mycobacterium avium subsp. paratuberculosis
ccuccgcgaucagcucg

SEQ ID NO: 2931029 - RNA, 22 nt, Mycobacterium avium subsp. paratuberculosis
ccuccgcgaucagcucguggcg

SEQ ID NO: 2931030 - RNA, 14 nt, Mycobacterium avium subsp. paratuberculosis
ccuccgcggcgccg

SEQ ID NO: 2931031 - RNA, 20 nt, Mycobacterium avium subsp. paratuberculosis
ccuccggagaucgccccggg

SEQ ID NO: 2931032 - RNA, 18 nt, Mycobacterium avium subsp. paratuberculosis
ccuccggagugacgucgc

SEQ ID NO: 2931033 - RNA, 23 nt, Mycobacterium avium subsp. paratuberculosis
ccuccggauggcggucgcgccag

SEQ ID NO: 2931034 - RNA, 14 nt, Mycobacterium avium subsp. paratuberculosis
ccuccggcaggccg

SEQ ID NO: 2931035 - RNA, 19 nt, Mycobacterium avium subsp. paratuberculosis
ccuccggcaggccgcggcc

SEQ ID NO: 2931036 - RNA, 19 nt, Mycobacterium avium subsp. paratuberculosis
ccuccggcaguacgcgccg

SEQ ID NO: 2931037 - RNA, 21 nt, Mycobacterium avium subsp. paratuberculosis
ccuccggcaguacgcgccggc

SEQ ID NO: 2931038 - RNA, 22 nt, Mycobacterium avium subsp. paratuberculosis
ccuccggcaguacgcgccggcc

SEQ ID NO: 2931039 - RNA, 12 nt, Mycobacterium avium subsp. paratuberculosis
ccuccggcccga

SEQ ID NO: 2931040 - RNA, 21 nt, Mycobacterium avium subsp. paratuberculosis
ccuccggcccgaucgcggcga

SEQ ID NO: 2931041 - RNA, 23 nt, Mycobacterium avium subsp. paratuberculosis
ccuccgggaaggcggccgcgaau

SEQ ID NO: 2931042 - RNA, 22 nt, Mycobacterium avium subsp. paratuberculosis
ccuccgggcggcaccgcugccg

SEQ ID NO: 2931043 - RNA, 16 nt, Mycobacterium avium subsp. paratuberculosis
ccuccggguccccgcc

SEQ ID NO: 2931044 - RNA, 19 nt, Mycobacterium avium subsp. paratuberculosis
ccuccggguccccgccgcc

SEQ ID NO: 2931045 - RNA, 20 nt, Mycobacterium avium subsp. paratuberculosis
ccuccggguccccgccgccg

SEQ ID NO: 2931046 - RNA, 14 nt, Mycobacterium avium subsp. paratuberculosis
ccuccgguccgggc

SEQ ID NO: 2931047 - RNA, 18 nt, Mycobacterium avium subsp. paratuberculosis
ccuccgguuugcgccggc

SEQ ID NO: 2931048 - RNA, 20 nt, Mycobacterium avium subsp. paratuberculosis
ccuccgguuugcgccggcuc

SEQ ID NO: 2931049 - RNA, 22 nt, Mycobacterium avium subsp. paratuberculosis
ccuccgguuugcgccggcucca

SEQ ID NO: 2931050 - RNA, 13 nt, Mycobacterium avium subsp. paratuberculosis
ccuccgucagcgc

SEQ ID NO: 2931051 - RNA, 16 nt, Mycobacterium avium subsp. paratuberculosis
ccuccgucagcgccgc

SEQ ID NO: 2931052 - RNA, 18 nt, Mycobacterium avium subsp. paratuberculosis
ccuccgucagcgccgccc

SEQ ID NO: 2931053 - RNA, 18 nt, Mycobacterium avium subsp. paratuberculosis
ccuccgugcuggccgggu

SEQ ID NO: 2931054 - RNA, 20 nt, Mycobacterium avium subsp. paratuberculosis
ccuccgugcuggccggguug

SEQ ID NO: 2931055 - RNA, 19 nt, Mycobacterium avium subsp. paratuberculosis
ccuccuccgguccgggcug

SEQ ID NO: 2931056 - RNA, 13 nt, Mycobacterium avium subsp. paratuberculosis
ccuccuccucgcu

SEQ ID NO: 2931057 - RNA, 15 nt, Mycobacterium avium subsp. paratuberculosis
ccuccucgcgccgcc

SEQ ID NO: 2931058 - RNA, 19 nt, Mycobacterium avium subsp. paratuberculosis
ccuccucgcgccgccacgc

SEQ ID NO: 2931059 - RNA, 14 nt, Mycobacterium avium subsp. paratuberculosis
ccuccucggccagc

SEQ ID NO: 2931060 - RNA, 12 nt, Mycobacterium avium subsp. paratuberculosis
ccuccucggcgc

SEQ ID NO: 2931061 - RNA, 18 nt, Mycobacterium avium subsp. paratuberculosis
ccuccucguccgcggcgg

SEQ ID NO: 2931062 - RNA, 19 nt, Mycobacterium avium subsp. paratuberculosis
ccuccucguccgcggcggc

SEQ ID NO: 2931063 - RNA, 18 nt, Mycobacterium avium subsp. paratuberculosis
ccucgaggccgaggucgg

SEQ ID NO: 2931064 - RNA, 16 nt, Mycobacterium avium subsp. paratuberculosis
ccucgagugccugcgc

SEQ ID NO: 2931065 - RNA, 21 nt, Mycobacterium avium subsp. paratuberculosis
ccucgauaauggcggccgccg

SEQ ID NO: 2931066 - RNA, 14 nt, Mycobacterium avium subsp. paratuberculosis
ccucgaucaacgcc

SEQ ID NO: 2931067 - RNA, 18 nt, Mycobacterium avium subsp. paratuberculosis
ccucgaucaacgccgggu

SEQ ID NO: 2931068 - RNA, 19 nt, Mycobacterium avium subsp. paratuberculosis
ccucgaucaacgccggguc

SEQ ID NO: 2931069 - RNA, 21 nt, Mycobacterium avium subsp. paratuberculosis
ccucgaucaccgacagcgcgu

SEQ ID NO: 2931070 - RNA, 17 nt, Mycobacterium avium subsp. paratuberculosis
ccucgaucaccgggcgg

SEQ ID NO: 2931071 - RNA, 19 nt, Mycobacterium avium subsp. paratuberculosis
ccucgaucaccgggcggcc

SEQ ID NO: 2931072 - RNA, 19 nt, Mycobacterium avium subsp. paratuberculosis
ccucgaucagagcgggccg

SEQ ID NO: 2931073 - RNA, 20 nt, Mycobacterium avium subsp. paratuberculosis
ccucgaucagagcgggccga

SEQ ID NO: 2931074 - RNA, 12 nt, Mycobacterium avium subsp. paratuberculosis
ccucgaucagcc

SEQ ID NO: 2931075 - RNA, 13 nt, Mycobacterium avium subsp. paratuberculosis
ccucgaucagcca

SEQ ID NO: 2931076 - RNA, 21 nt, Mycobacterium avium subsp. paratuberculosis
ccucgaucagccacaccgccg

SEQ ID NO: 2931077 - RNA, 17 nt, Mycobacterium avium subsp. paratuberculosis
ccucgaucagcggcauc

SEQ ID NO: 2931078 - RNA, 14 nt, Mycobacterium avium subsp. paratuberculosis
ccucgaucagucgu

SEQ ID NO: 2931079 - RNA, 23 nt, Mycobacterium avium subsp. paratuberculosis
ccucgaucaucaccaccgccgcc

SEQ ID NO: 2931080 - RNA, 14 nt, Mycobacterium avium subsp. paratuberculosis
ccucgaucgacacc

SEQ ID NO: 2931081 - RNA, 14 nt, Mycobacterium avium subsp. paratuberculosis
ccucgaucggggaa

SEQ ID NO: 2931082 - RNA, 22 nt, Mycobacterium avium subsp. paratuberculosis
ccucgaucugguucaccgccac

SEQ ID NO: 2931083 - RNA, 13 nt, Mycobacterium avium subsp. paratuberculosis
ccucgaugacgcc

SEQ ID NO: 2931084 - RNA, 15 nt, Mycobacterium avium subsp. paratuberculosis
ccucgaugcgcaccg

SEQ ID NO: 2931085 - RNA, 17 nt, Mycobacterium avium subsp. paratuberculosis
ccucgauggccgggaag

SEQ ID NO: 2931086 - RNA, 17 nt, Mycobacterium avium subsp. paratuberculosis
ccucgauggcggcggcu

SEQ ID NO: 2931087 - RNA, 16 nt, Mycobacterium avium subsp. paratuberculosis
ccucgauggucgucgg

SEQ ID NO: 2931088 - RNA, 14 nt, Mycobacterium avium subsp. paratuberculosis
ccucgaugucgucg

SEQ ID NO: 2931089 - RNA, 15 nt, Mycobacterium avium subsp. paratuberculosis
ccucgaugucgucga

SEQ ID NO: 2931090 - RNA, 19 nt, Mycobacterium avium subsp. paratuberculosis
ccucgcagaaauccgucga

SEQ ID NO: 2931091 - RNA, 23 nt, Mycobacterium avium subsp. paratuberculosis
ccucgcagcgacaaucggcucgc

SEQ ID NO: 2931092 - RNA, 24 nt, Mycobacterium avium subsp. paratuberculosis
ccucgcagcgacaaucggcucgcc

SEQ ID NO: 2931093 - RNA, 22 nt, Mycobacterium avium subsp. paratuberculosis
ccucgccacugggcgucggcgc

SEQ ID NO: 2931094 - RNA, 14 nt, Mycobacterium avium subsp. paratuberculosis
ccucgccagcccca

SEQ ID NO: 2931095 - RNA, 16 nt, Mycobacterium avium subsp. paratuberculosis
ccucgccagccccacc

SEQ ID NO: 2931096 - RNA, 14 nt, Mycobacterium avium subsp. paratuberculosis
ccucgcccagcgcc

SEQ ID NO: 2931097 - RNA, 12 nt, Mycobacterium avium subsp. paratuberculosis
ccucgcccgccg

SEQ ID NO: 2931098 - RNA, 11 nt, Mycobacterium avium subsp. paratuberculosis
ccucgcccggc

SEQ ID NO: 2931099 - RNA, 21 nt, Mycobacterium avium subsp. paratuberculosis
ccucgcccugcagccgggugg

SEQ ID NO: 2931100 - RNA, 17 nt, Mycobacterium avium subsp. paratuberculosis
ccucgcccugcagcgcg

SEQ ID NO: 2931101 - RNA, 22 nt, Mycobacterium avium subsp. paratuberculosis
ccucgccgaaccggggccgcac

SEQ ID NO: 2931102 - RNA, 12 nt, Mycobacterium avium subsp. paratuberculosis
ccucgccgaccu

SEQ ID NO: 2931103 - RNA, 14 nt, Mycobacterium avium subsp. paratuberculosis
ccucgccgacggug

SEQ ID NO: 2931104 - RNA, 12 nt, Mycobacterium avium subsp. paratuberculosis
ccucgccgagca

SEQ ID NO: 2931105 - RNA, 14 nt, Mycobacterium avium subsp. paratuberculosis
ccucgccgagcaga

SEQ ID NO: 2931106 - RNA, 14 nt, Mycobacterium avium subsp. paratuberculosis
ccucgccgagcagc

SEQ ID NO: 2931107 - RNA, 23 nt, Mycobacterium avium subsp. paratuberculosis
ccucgccgaucucgaccagcgcc

SEQ ID NO: 2931108 - RNA, 15 nt, Mycobacterium avium subsp. paratuberculosis
ccucgccgcaggcgu

SEQ ID NO: 2931109 - RNA, 20 nt, Mycobacterium avium subsp. paratuberculosis
ccucgccgcccucgcccucg

SEQ ID NO: 2931110 - RNA, 16 nt, Mycobacterium avium subsp. paratuberculosis
ccucgccgccgccgau

SEQ ID NO: 2931111 - RNA, 19 nt, Mycobacterium avium subsp. paratuberculosis
ccucgccgcgggccagcca

SEQ ID NO: 2931112 - RNA, 20 nt, Mycobacterium avium subsp. paratuberculosis
ccucgccgcgggccagccag

SEQ ID NO: 2931113 - RNA, 15 nt, Mycobacterium avium subsp. paratuberculosis
ccucgccgcuucgga

SEQ ID NO: 2931114 - RNA, 21 nt, Mycobacterium avium subsp. paratuberculosis
ccucgccggagagcccgucgu

SEQ ID NO: 2931115 - RNA, 13 nt, Mycobacterium avium subsp. paratuberculosis
ccucgccggaguu

SEQ ID NO: 2931116 - RNA, 23 nt, Mycobacterium avium subsp. paratuberculosis
ccucgccggaguucagccugaug

SEQ ID NO: 2931117 - RNA, 13 nt, Mycobacterium avium subsp. paratuberculosis
ccucgccggccgc

SEQ ID NO: 2931118 - RNA, 15 nt, Mycobacterium avium subsp. paratuberculosis
ccucgccggccgccg

SEQ ID NO: 2931119 - RNA, 16 nt, Mycobacterium avium subsp. paratuberculosis
ccucgccggccgccgu

SEQ ID NO: 2931120 - RNA, 22 nt, Mycobacterium avium subsp. paratuberculosis
ccucgccggccgccguggccca

SEQ ID NO: 2931121 - RNA, 14 nt, Mycobacterium avium subsp. paratuberculosis
ccucgccggcgccg

SEQ ID NO: 2931122 - RNA, 15 nt, Mycobacterium avium subsp. paratuberculosis
ccucgccggcgccgg

SEQ ID NO: 2931123 - RNA, 16 nt, Mycobacterium avium subsp. paratuberculosis
ccucgccggcggcgcc

SEQ ID NO: 2931124 - RNA, 15 nt, Mycobacterium avium subsp. paratuberculosis
ccucgccgggcccgc

SEQ ID NO: 2931125 - RNA, 16 nt, Mycobacterium avium subsp. paratuberculosis
ccucgccgggcccgcu

SEQ ID NO: 2931126 - RNA, 18 nt, Mycobacterium avium subsp. paratuberculosis
ccucgccguacgcgccgg

SEQ ID NO: 2931127 - RNA, 20 nt, Mycobacterium avium subsp. paratuberculosis
ccucgccguacgcgccggcc

SEQ ID NO: 2931128 - RNA, 23 nt, Mycobacterium avium subsp. paratuberculosis
ccucgccguacgcgccggccagc

SEQ ID NO: 2931129 - RNA, 24 nt, Mycobacterium avium subsp. paratuberculosis
ccucgccguacgcgccggccagcc

SEQ ID NO: 2931130 - RNA, 22 nt, Mycobacterium avium subsp. paratuberculosis
ccucgccgucgaaggccgggcu

SEQ ID NO: 2931131 - RNA, 16 nt, Mycobacterium avium subsp. paratuberculosis
ccucgccgucgcgauc

SEQ ID NO: 2931132 - RNA, 17 nt, Mycobacterium avium subsp. paratuberculosis
ccucgccguugccggcc

SEQ ID NO: 2931133 - RNA, 18 nt, Mycobacterium avium subsp. paratuberculosis
ccucgccuccagcaggga

SEQ ID NO: 2931134 - RNA, 14 nt, Mycobacterium avium subsp. paratuberculosis
ccucgcgauggcgg

SEQ ID NO: 2931135 - RNA, 20 nt, Mycobacterium avium subsp. paratuberculosis
ccucgcgcaaugccgccgcg

SEQ ID NO: 2931136 - RNA, 19 nt, Mycobacterium avium subsp. paratuberculosis
ccucgcgcaccggcugccc

SEQ ID NO: 2931137 - RNA, 22 nt, Mycobacterium avium subsp. paratuberculosis
ccucgcgcaccggcugccccag

SEQ ID NO: 2931138 - RNA, 15 nt, Mycobacterium avium subsp. paratuberculosis
ccucgcgcagcaccg

SEQ ID NO: 2931139 - RNA, 14 nt, Mycobacterium avium subsp. paratuberculosis
ccucgcgcagcccc

SEQ ID NO: 2931140 - RNA, 14 nt, Mycobacterium avium subsp. paratuberculosis
ccucgcgcagcgcg

SEQ ID NO: 2931141 - RNA, 14 nt, Mycobacterium avium subsp. paratuberculosis
ccucgcgcagggcc

SEQ ID NO: 2931142 - RNA, 15 nt, Mycobacterium avium subsp. paratuberculosis
ccucgcgcaucagca

SEQ ID NO: 2931143 - RNA, 16 nt, Mycobacterium avium subsp. paratuberculosis
ccucgcgcaucagcac

SEQ ID NO: 2931144 - RNA, 13 nt, Mycobacterium avium subsp. paratuberculosis
ccucgcgcccggc

SEQ ID NO: 2931145 - RNA, 16 nt, Mycobacterium avium subsp. paratuberculosis
ccucgcgcccggcgcc

SEQ ID NO: 2931146 - RNA, 14 nt, Mycobacterium avium subsp. paratuberculosis
ccucgcgccgccac

SEQ ID NO: 2931147 - RNA, 18 nt, Mycobacterium avium subsp. paratuberculosis
ccucgcgccgccacgcgg

SEQ ID NO: 2931148 - RNA, 15 nt, Mycobacterium avium subsp. paratuberculosis
ccucggcgagcgagg

SEQ ID NO: 2931149 - RNA, 18 nt, Mycobacterium avium subsp. paratuberculosis
ccucggcgaggucgucga

SEQ ID NO: 2931150 - RNA, 13 nt, Mycobacterium avium subsp. paratuberculosis
ccucggcgaucgg

SEQ ID NO: 2931151 - RNA, 17 nt, Mycobacterium avium subsp. paratuberculosis
ccucggcgaucggccgc

SEQ ID NO: 2931152 - RNA, 18 nt, Mycobacterium avium subsp. paratuberculosis
ccucggcgaucggccgcu

SEQ ID NO: 2931153 - RNA, 15 nt, Mycobacterium avium subsp. paratuberculosis
ccucggcgaucucgu

SEQ ID NO: 2931154 - RNA, 17 nt, Mycobacterium avium subsp. paratuberculosis
ccucggcgaucucgucc

SEQ ID NO: 2931155 - RNA, 11 nt, Mycobacterium avium subsp. paratuberculosis
ccucggcgaug

SEQ ID NO: 2931156 - RNA, 15 nt, Mycobacterium avium subsp. paratuberculosis
ccucggcgaugccga

SEQ ID NO: 2931157 - RNA, 13 nt, Mycobacterium avium subsp. paratuberculosis
ccucggcgccggu

SEQ ID NO: 2931158 - RNA, 14 nt, Mycobacterium avium subsp. paratuberculosis
ccucggcgccucgg

SEQ ID NO: 2931159 - RNA, 15 nt, Mycobacterium avium subsp. paratuberculosis
ccucggcgccucggc

SEQ ID NO: 2931160 - RNA, 16 nt, Mycobacterium avium subsp. paratuberculosis
ccucggcgcgggcgau

SEQ ID NO: 2931161 - RNA, 14 nt, Mycobacterium avium subsp. paratuberculosis
ccucggcgcgucgg

SEQ ID NO: 2931162 - RNA, 19 nt, Mycobacterium avium subsp. paratuberculosis
ccucggcgcucgccgcgcg

SEQ ID NO: 2931163 - RNA, 19 nt, Mycobacterium avium subsp. paratuberculosis
ccucggcgcugcccgccgc

SEQ ID NO: 2931164 - RNA, 15 nt, Mycobacterium avium subsp. paratuberculosis
ccucggcggcaccgc

SEQ ID NO: 2931165 - RNA, 16 nt, Mycobacterium avium subsp. paratuberculosis
ccucggcggcaccgcc

SEQ ID NO: 2931166 - RNA, 13 nt, Mycobacterium avium subsp. paratuberculosis
ccucggcggccag

SEQ ID NO: 2931167 - RNA, 15 nt, Mycobacterium avium subsp. paratuberculosis
ccucggcggccagcg

SEQ ID NO: 2931168 - RNA, 14 nt, Mycobacterium avium subsp. paratuberculosis
ccucggcggccgcc

SEQ ID NO: 2931169 - RNA, 15 nt, Mycobacterium avium subsp. paratuberculosis
ccucggcggccgccc

SEQ ID NO: 2931170 - RNA, 16 nt, Mycobacterium avium subsp. paratuberculosis
ccucggcggccgcccg

SEQ ID NO: 2931171 - RNA, 17 nt, Mycobacterium avium subsp. paratuberculosis
ccucggcggccgcccgg

SEQ ID NO: 2931172 - RNA, 15 nt, Mycobacterium avium subsp. paratuberculosis
ccucggcggccgccu

SEQ ID NO: 2931173 - RNA, 13 nt, Mycobacterium avium subsp. paratuberculosis
ccucggcggccgg

SEQ ID NO: 2931174 - RNA, 15 nt, Mycobacterium avium subsp. paratuberculosis
ccucggcggccggga

SEQ ID NO: 2931175 - RNA, 14 nt, Mycobacterium avium subsp. paratuberculosis
ccucggcggccguc

SEQ ID NO: 2931176 - RNA, 16 nt, Mycobacterium avium subsp. paratuberculosis
ccucggcggccgucgg

SEQ ID NO: 2931177 - RNA, 15 nt, Mycobacterium avium subsp. paratuberculosis
ccucggcggccucgg

SEQ ID NO: 2931178 - RNA, 16 nt, Mycobacterium avium subsp. paratuberculosis
ccucggcggcggcgcg

SEQ ID NO: 2931179 - RNA, 14 nt, Mycobacterium avium subsp. paratuberculosis
ccucggcgggccgc

SEQ ID NO: 2931180 - RNA, 16 nt, Mycobacterium avium subsp. paratuberculosis
ccucggcgggccgccc

SEQ ID NO: 2931181 - RNA, 17 nt, Mycobacterium avium subsp. paratuberculosis
ccucggcgggccgcccg

SEQ ID NO: 2931182 - RNA, 22 nt, Mycobacterium avium subsp. paratuberculosis
ccucggcgggccgcccggcgcg

SEQ ID NO: 2931183 - RNA, 20 nt, Mycobacterium avium subsp. paratuberculosis
ccucggcguagaggugcagc

SEQ ID NO: 2931184 - RNA, 16 nt, Mycobacterium avium subsp. paratuberculosis
ccucggcgucaccgcg

SEQ ID NO: 2931185 - RNA, 19 nt, Mycobacterium avium subsp. paratuberculosis
ccucggcguccgcggcgga

SEQ ID NO: 2931186 - RNA, 23 nt, Mycobacterium avium subsp. paratuberculosis
ccucggcguccgcggcggagggg

SEQ ID NO: 2931187 - RNA, 17 nt, Mycobacterium avium subsp. paratuberculosis
ccucggcgucggcgcgu

SEQ ID NO: 2931188 - RNA, 16 nt, Mycobacterium avium subsp. paratuberculosis
ccucggcguggcaggc

SEQ ID NO: 2931189 - RNA, 22 nt, Mycobacterium avium subsp. paratuberculosis
ccucggcguguuccuugcggcc

SEQ ID NO: 2931190 - RNA, 20 nt, Mycobacterium avium subsp. paratuberculosis
ccucgggauagccgagcggc

SEQ ID NO: 2931191 - RNA, 23 nt, Mycobacterium avium subsp. paratuberculosis
ccucgggauccaggaacggcacc

SEQ ID NO: 2931192 - RNA, 16 nt, Mycobacterium avium subsp. paratuberculosis
ccucgggcacguccag

SEQ ID NO: 2931193 - RNA, 17 nt, Mycobacterium avium subsp. paratuberculosis
ccucgggcauuggcagc

SEQ ID NO: 2931194 - RNA, 21 nt, Mycobacterium avium subsp. paratuberculosis
ccucgggcauuggcagcucgg

SEQ ID NO: 2931195 - RNA, 15 nt, Mycobacterium avium subsp. paratuberculosis
ccucgggccggcagc

SEQ ID NO: 2931196 - RNA, 16 nt, Mycobacterium avium subsp. paratuberculosis
ccucgggccggcagcc

SEQ ID NO: 2931197 - RNA, 18 nt, Mycobacterium avium subsp. paratuberculosis
ccucgggccggcagccgg

SEQ ID NO: 2931198 - RNA, 14 nt, Mycobacterium avium subsp. paratuberculosis
ccucgggccgggcg

SEQ ID NO: 2931199 - RNA, 21 nt, Mycobacterium avium subsp. paratuberculosis
ccucgggccgggcgggcaccc

SEQ ID NO: 2931200 - RNA, 15 nt, Mycobacterium avium subsp. paratuberculosis
ccucggggaucgcca

SEQ ID NO: 2931201 - RNA, 20 nt, Mycobacterium avium subsp. paratuberculosis
ccucggggaucgccaggcgu

SEQ ID NO: 2931202 - RNA, 23 nt, Mycobacterium avium subsp. paratuberculosis
ccucggggaugugcugcagguug

SEQ ID NO: 2931203 - RNA, 16 nt, Mycobacterium avium subsp. paratuberculosis
ccucggggcucaccac

SEQ ID NO: 2931204 - RNA, 19 nt, Mycobacterium avium subsp. paratuberculosis
ccucggggcugcgcggcuu

SEQ ID NO: 2931205 - RNA, 23 nt, Mycobacterium avium subsp. paratuberculosis
ccucgggguacucggcggcgggc

SEQ ID NO: 2931206 - RNA, 22 nt, Mycobacterium avium subsp. paratuberculosis
ccucgggguagccggcccgcag

SEQ ID NO: 2931207 - RNA, 16 nt, Mycobacterium avium subsp. paratuberculosis
ccucggggucggccgg

SEQ ID NO: 2931208 - RNA, 18 nt, Mycobacterium avium subsp. paratuberculosis
ccucggggucggccggau

SEQ ID NO: 2931209 - RNA, 18 nt, Mycobacterium avium subsp. paratuberculosis
ccucgguacccccgccgg

SEQ ID NO: 2931210 - RNA, 13 nt, Mycobacterium avium subsp. paratuberculosis
ccucggucagcgg

SEQ ID NO: 2931211 - RNA, 14 nt, Mycobacterium avium subsp. paratuberculosis
ccucggucagcucg

SEQ ID NO: 2931212 - RNA, 15 nt, Mycobacterium avium subsp. paratuberculosis
ccucggucagcucgg

SEQ ID NO: 2931213 - RNA, 15 nt, Mycobacterium avium subsp. paratuberculosis
ccucggucucgucca

SEQ ID NO: 2931214 - RNA, 16 nt, Mycobacterium avium subsp. paratuberculosis
ccucggucucguccag

SEQ ID NO: 2931215 - RNA, 18 nt, Mycobacterium avium subsp. paratuberculosis
ccucggugaucucaccgg

SEQ ID NO: 2931216 - RNA, 20 nt, Mycobacterium avium subsp. paratuberculosis
ccucggugaucucaccggcg

SEQ ID NO: 2931217 - RNA, 17 nt, Mycobacterium avium subsp. paratuberculosis
ccucggugaugucgacg

SEQ ID NO: 2931218 - RNA, 20 nt, Mycobacterium avium subsp. paratuberculosis
ccucggugaugucgacgucg

SEQ ID NO: 2931219 - RNA, 17 nt, Mycobacterium avium subsp. paratuberculosis
ccucggugcggaacacc

SEQ ID NO: 2931220 - RNA, 13 nt, Mycobacterium avium subsp. paratuberculosis
ccucgguggacgc

SEQ ID NO: 2931221 - RNA, 15 nt, Mycobacterium avium subsp. paratuberculosis
ccucgguggacgccg

SEQ ID NO: 2931222 - RNA, 19 nt, Mycobacterium avium subsp. paratuberculosis
ccucgguggacgccgcgca

SEQ ID NO: 2931223 - RNA, 13 nt, Mycobacterium avium subsp. paratuberculosis
ccucgguggccac

SEQ ID NO: 2931224 - RNA, 12 nt, Mycobacterium avium subsp. paratuberculosis
ccucgguggcgg

SEQ ID NO: 2931225 - RNA, 22 nt, Mycobacterium avium subsp. paratuberculosis
ccucgguggucgacgagcccgc

SEQ ID NO: 2931226 - RNA, 17 nt, Mycobacterium avium subsp. paratuberculosis
ccucgguguacagcgcc

SEQ ID NO: 2931227 - RNA, 18 nt, Mycobacterium avium subsp. paratuberculosis
ccucgguguacagcgcca

SEQ ID NO: 2931228 - RNA, 21 nt, Mycobacterium avium subsp. paratuberculosis
ccucgguguacagcgccaugu

SEQ ID NO: 2931229 - RNA, 16 nt, Mycobacterium avium subsp. paratuberculosis
ccucggugugcugacc

SEQ ID NO: 2931230 - RNA, 14 nt, Mycobacterium avium subsp. paratuberculosis
ccucguagcggccg

SEQ ID NO: 2931231 - RNA, 16 nt, Mycobacterium avium subsp. paratuberculosis
ccucguagcggccgca

SEQ ID NO: 2931232 - RNA, 21 nt, Mycobacterium avium subsp. paratuberculosis
ccucguagcggccgcacgcga

SEQ ID NO: 2931233 - RNA, 17 nt, Mycobacterium avium subsp. paratuberculosis
ccugagggugucggcga

SEQ ID NO: 2931234 - RNA, 21 nt, Mycobacterium avium subsp. paratuberculosis
ccugagucugggucacgcuga

SEQ ID NO: 2931235 - RNA, 22 nt, Mycobacterium avium subsp. paratuberculosis
ccugauacgacguccgggccgc

SEQ ID NO: 2931236 - RNA, 18 nt, Mycobacterium avium subsp. paratuberculosis
ccugaucgaguuccgcgu

SEQ ID NO: 2931237 - RNA, 19 nt, Mycobacterium avium subsp. paratuberculosis
ccugaucgaguuccgcguc

SEQ ID NO: 2931238 - RNA, 21 nt, Mycobacterium avium subsp. paratuberculosis
ccugaucgaguuccgcgucgg

SEQ ID NO: 2931239 - RNA, 12 nt, Mycobacterium avium subsp. paratuberculosis
ccugaucgcggc

SEQ ID NO: 2931240 - RNA, 13 nt, Mycobacterium avium subsp. paratuberculosis
ccugaucggccgc

SEQ ID NO: 2931241 - RNA, 17 nt, Mycobacterium avium subsp. paratuberculosis
ccugauugacggcccac

SEQ ID NO: 2931242 - RNA, 17 nt, Mycobacterium avium subsp. paratuberculosis
ccugauuucaucgcggc

SEQ ID NO: 2931243 - RNA, 23 nt, Mycobacterium avium subsp. paratuberculosis
ccugcaacuggucgugcagcacc

SEQ ID NO: 2931244 - RNA, 24 nt, Mycobacterium avium subsp. paratuberculosis
ccugcaacuggucgugcagcaccg

SEQ ID NO: 2931245 - RNA, 14 nt, Mycobacterium avium subsp. paratuberculosis
ccugcaccaccaca

SEQ ID NO: 2931246 - RNA, 20 nt, Mycobacterium avium subsp. paratuberculosis
ccugcaccaccacacccagc

SEQ ID NO: 2931247 - RNA, 22 nt, Mycobacterium avium subsp. paratuberculosis
ccugcaccacgaagcgggcggc

SEQ ID NO: 2931248 - RNA, 13 nt, Mycobacterium avium subsp. paratuberculosis
ccugcacccgucc

SEQ ID NO: 2931249 - RNA, 19 nt, Mycobacterium avium subsp. paratuberculosis
ccugcaccgacugcggcgc

SEQ ID NO: 2931250 - RNA, 21 nt, Mycobacterium avium subsp. paratuberculosis
ccugcaccgaguugaacgcgu

SEQ ID NO: 2931251 - RNA, 14 nt, Mycobacterium avium subsp. paratuberculosis
ccugcaccggcgac

SEQ ID NO: 2931252 - RNA, 20 nt, Mycobacterium avium subsp. paratuberculosis
ccugcaccggcgacggcggu

SEQ ID NO: 2931253 - RNA, 14 nt, Mycobacterium avium subsp. paratuberculosis
ccugcaccugcggc

SEQ ID NO: 2931254 - RNA, 13 nt, Mycobacterium avium subsp. paratuberculosis
ccugcaccuugcc

SEQ ID NO: 2931255 - RNA, 20 nt, Mycobacterium avium subsp. paratuberculosis
ccugcacgaaauaaccgcgc

SEQ ID NO: 2931256 - RNA, 17 nt, Mycobacterium avium subsp. paratuberculosis
ccugcacgaagucgacc

SEQ ID NO: 2931257 - RNA, 18 nt, Mycobacterium avium subsp. paratuberculosis
ccugcacgaucucggcgg

SEQ ID NO: 2931258 - RNA, 20 nt, Mycobacterium avium subsp. paratuberculosis
ccugcacgaucucggcgguc

SEQ ID NO: 2931259 - RNA, 19 nt, Mycobacterium avium subsp. paratuberculosis
ccugcacgcgcgggucguc

SEQ ID NO: 2931260 - RNA, 21 nt, Mycobacterium avium subsp. paratuberculosis
ccugcacgcgcgggucgucgg

SEQ ID NO: 2931261 - RNA, 15 nt, Mycobacterium avium subsp. paratuberculosis
ccugcacgcuguccg

SEQ ID NO: 2931262 - RNA, 14 nt, Mycobacterium avium subsp. paratuberculosis
ccugcacggugccg

SEQ ID NO: 2931263 - RNA, 20 nt, Mycobacterium avium subsp. paratuberculosis
ccugcacggugcgccggcag

SEQ ID NO: 2931264 - RNA, 21 nt, Mycobacterium avium subsp. paratuberculosis
ccugcacggugcgccggcagc

SEQ ID NO: 2931265 - RNA, 14 nt, Mycobacterium avium subsp. paratuberculosis
ccugcacgucggcg

SEQ ID NO: 2931266 - RNA, 15 nt, Mycobacterium avium subsp. paratuberculosis
ccugcacgucggcgc

SEQ ID NO: 2931267 - RNA, 16 nt, Mycobacterium avium subsp. paratuberculosis
ccugcacuaccccguc

SEQ ID NO: 2931268 - RNA, 19 nt, Mycobacterium avium subsp. paratuberculosis
ccugcagcaacucgcgcuc

SEQ ID NO: 2931269 - RNA, 16 nt, Mycobacterium avium subsp. paratuberculosis
ccugcagcaccgaacc

SEQ ID NO: 2931270 - RNA, 18 nt, Mycobacterium avium subsp. paratuberculosis
ccugcagcaccgaaccgg

SEQ ID NO: 2931271 - RNA, 21 nt, Mycobacterium avium subsp. paratuberculosis
ccugcagcaccgaaccggcgg

SEQ ID NO: 2931272 - RNA, 17 nt, Mycobacterium avium subsp. paratuberculosis
ccugcagccgccgcgcc

SEQ ID NO: 2931273 - RNA, 14 nt, Mycobacterium avium subsp. paratuberculosis
ccugcagcgccguc

SEQ ID NO: 2931274 - RNA, 16 nt, Mycobacterium avium subsp. paratuberculosis
ccugcagcgccguccg

SEQ ID NO: 2931275 - RNA, 22 nt, Mycobacterium avium subsp. paratuberculosis
ccugcagcgccguccgcaccgc

SEQ ID NO: 2931276 - RNA, 23 nt, Mycobacterium avium subsp. paratuberculosis
ccugcagcgccguccgcaccgcg

SEQ ID NO: 2931277 - RNA, 21 nt, Mycobacterium avium subsp. paratuberculosis
ccugcagcgccuuggguccca

SEQ ID NO: 2931278 - RNA, 14 nt, Mycobacterium avium subsp. paratuberculosis
ccugcagcgcgaac

SEQ ID NO: 2931279 - RNA, 14 nt, Mycobacterium avium subsp. paratuberculosis
ccugcagcgcggcg

SEQ ID NO: 2931280 - RNA, 15 nt, Mycobacterium avium subsp. paratuberculosis
ccugcagcgcggcga

SEQ ID NO: 2931281 - RNA, 19 nt, Mycobacterium avium subsp. paratuberculosis
ccugcagcgcggcgaucag

SEQ ID NO: 2931282 - RNA, 21 nt, Mycobacterium avium subsp. paratuberculosis
ccugcagcgcggcgaucagcu

SEQ ID NO: 2931283 - RNA, 13 nt, Mycobacterium avium subsp. paratuberculosis
ccugcagcucgcc

SEQ ID NO: 2931284 - RNA, 17 nt, Mycobacterium avium subsp. paratuberculosis
ccugcagcucgccggcg

SEQ ID NO: 2931285 - RNA, 18 nt, Mycobacterium avium subsp. paratuberculosis
ccugcagcucgccggcgc

SEQ ID NO: 2931286 - RNA, 16 nt, Mycobacterium avium subsp. paratuberculosis
ccugcaggaucagcac

SEQ ID NO: 2931287 - RNA, 15 nt, Mycobacterium avium subsp. paratuberculosis
ccugcaggcaggccg

SEQ ID NO: 2931288 - RNA, 16 nt, Mycobacterium avium subsp. paratuberculosis
ccugcaggcaggccgg

SEQ ID NO: 2931289 - RNA, 17 nt, Mycobacterium avium subsp. paratuberculosis
ccugcaggcaggccggc

SEQ ID NO: 2931290 - RNA, 19 nt, Mycobacterium avium subsp. paratuberculosis
ccugcaggcaggccggcag

SEQ ID NO: 2931291 - RNA, 20 nt, Mycobacterium avium subsp. paratuberculosis
ccugcaggcaggccggcagc

SEQ ID NO: 2931292 - RNA, 21 nt, Mycobacterium avium subsp. paratuberculosis
ccugcaggcaggccggcagcc

SEQ ID NO: 2931293 - RNA, 20 nt, Mycobacterium avium subsp. paratuberculosis
ccugcaggccgagccgccgg

SEQ ID NO: 2931294 - RNA, 18 nt, Mycobacterium avium subsp. paratuberculosis
ccugcagggauucggcca

SEQ ID NO: 2931295 - RNA, 16 nt, Mycobacterium avium subsp. paratuberculosis
ccugcaggucgcggug

SEQ ID NO: 2931296 - RNA, 23 nt, Mycobacterium avium subsp. paratuberculosis
ccugcagguucugcacgugguga

SEQ ID NO: 2931297 - RNA, 22 nt, Mycobacterium avium subsp. paratuberculosis
ccugcagugucggaaucggcgc

SEQ ID NO: 2931298 - RNA, 17 nt, Mycobacterium avium subsp. paratuberculosis
ccugcaguucgaucacc

SEQ ID NO: 2931299 - RNA, 18 nt, Mycobacterium avium subsp. paratuberculosis
ccugcaguucgaucaccg

SEQ ID NO: 2931300 - RNA, 13 nt, Mycobacterium avium subsp. paratuberculosis
ccugcaugccggg

SEQ ID NO: 2931301 - RNA, 14 nt, Mycobacterium avium subsp. paratuberculosis
ccugccaccgcgaa

SEQ ID NO: 2931302 - RNA, 20 nt, Mycobacterium avium subsp. paratuberculosis
ccugccagaagaucugccgg

SEQ ID NO: 2931303 - RNA, 17 nt, Mycobacterium avium subsp. paratuberculosis
ccugccagcgcccgcug

SEQ ID NO: 2931304 - RNA, 18 nt, Mycobacterium avium subsp. paratuberculosis
ccugccagggggaguagu

SEQ ID NO: 2931305 - RNA, 22 nt, Mycobacterium avium subsp. paratuberculosis
ccugccaguugucgaucuccuc

SEQ ID NO: 2931306 - RNA, 18 nt, Mycobacterium avium subsp. paratuberculosis
ccugccccacacgcucgg

SEQ ID NO: 2931307 - RNA, 15 nt, Mycobacterium avium subsp. paratuberculosis
ccugccccacggccc

SEQ ID NO: 2931308 - RNA, 21 nt, Mycobacterium avium subsp. paratuberculosis
ccugccccccuugagccgguc

SEQ ID NO: 2931309 - RNA, 17 nt, Mycobacterium avium subsp. paratuberculosis
ccugcccgaagcugagg

SEQ ID NO: 2931310 - RNA, 19 nt, Mycobacterium avium subsp. paratuberculosis
ccugcccgccgcggccgcu

SEQ ID NO: 2931311 - RNA, 13 nt, Mycobacterium avium subsp. paratuberculosis
ccugcccgcgcag

SEQ ID NO: 2931312 - RNA, 14 nt, Mycobacterium avium subsp. paratuberculosis
ccugcccgcgcagg

SEQ ID NO: 2931313 - RNA, 14 nt, Mycobacterium avium subsp. paratuberculosis
ccugcccgcgggug

SEQ ID NO: 2931314 - RNA, 19 nt, Mycobacterium avium subsp. paratuberculosis
ccugcccggagaaaccguc

SEQ ID NO: 2931315 - RNA, 17 nt, Mycobacterium avium subsp. paratuberculosis
ccugcccggcggugccg

SEQ ID NO: 2931316 - RNA, 16 nt, Mycobacterium avium subsp. paratuberculosis
ccugcccgggcgccga

SEQ ID NO: 2931317 - RNA, 17 nt, Mycobacterium avium subsp. paratuberculosis
ccugcucgucgacgcug

SEQ ID NO: 2931318 - RNA, 12 nt, Mycobacterium avium subsp. paratuberculosis
ccugcucgucgg

SEQ ID NO: 2931319 - RNA, 23 nt, Mycobacterium avium subsp. paratuberculosis
ccugcucgucggggcagccgucg

SEQ ID NO: 2931320 - RNA, 14 nt, Mycobacterium avium subsp. paratuberculosis
ccugcucgucggug

SEQ ID NO: 2931321 - RNA, 15 nt, Mycobacterium avium subsp. paratuberculosis
ccugcucgucgguga

SEQ ID NO: 2931322 - RNA, 17 nt, Mycobacterium avium subsp. paratuberculosis
ccugcucgucggugacg

SEQ ID NO: 2931323 - RNA, 12 nt, Mycobacterium avium subsp. paratuberculosis
ccugcugcagcg

SEQ ID NO: 2931324 - RNA, 14 nt, Mycobacterium avium subsp. paratuberculosis
ccugcugccaggac

SEQ ID NO: 2931325 - RNA, 14 nt, Mycobacterium avium subsp. paratuberculosis
ccugcugcucgucc

SEQ ID NO: 2931326 - RNA, 16 nt, Mycobacterium avium subsp. paratuberculosis
ccugcuggccgggcuc

SEQ ID NO: 2931327 - RNA, 19 nt, Mycobacterium avium subsp. paratuberculosis
ccugcuggcguucgccgag

SEQ ID NO: 2931328 - RNA, 18 nt, Mycobacterium avium subsp. paratuberculosis
ccugcugggagcggccca

SEQ ID NO: 2931329 - RNA, 19 nt, Mycobacterium avium subsp. paratuberculosis
ccugcugggcggcaccacc

SEQ ID NO: 2931330 - RNA, 19 nt, Mycobacterium avium subsp. paratuberculosis
ccugcugggcgggcagccg

SEQ ID NO: 2931331 - RNA, 15 nt, Mycobacterium avium subsp. paratuberculosis
ccugcuucagcucgc

SEQ ID NO: 2931332 - RNA, 17 nt, Mycobacterium avium subsp. paratuberculosis
ccugcuucagcucgcug

SEQ ID NO: 2931333 - RNA, 17 nt, Mycobacterium avium subsp. paratuberculosis
ccugcuucucgccgucg

SEQ ID NO: 2931334 - RNA, 18 nt, Mycobacterium avium subsp. paratuberculosis
ccugcuucucgccgucgu

SEQ ID NO: 2931335 - RNA, 21 nt, Mycobacterium avium subsp. paratuberculosis
ccugcuucuggaugcggucgu

SEQ ID NO: 2931336 - RNA, 22 nt, Mycobacterium avium subsp. paratuberculosis
ccugcuucuggaugcggucguc

SEQ ID NO: 2931337 - RNA, 16 nt, Mycobacterium avium subsp. paratuberculosis
ccugcuugaacagcac

SEQ ID NO: 2931338 - RNA, 17 nt, Mycobacterium avium subsp. paratuberculosis
ccugcuugaacagcacc

SEQ ID NO: 2931339 - RNA, 22 nt, Mycobacterium avium subsp. paratuberculosis
ccugcuugaacagcacccccuc

SEQ ID NO: 2931340 - RNA, 16 nt, Mycobacterium avium subsp. paratuberculosis
ccugcuugaccgccag

SEQ ID NO: 2931341 - RNA, 23 nt, Mycobacterium avium subsp. paratuberculosis
ccugcuugaccgccagacugaug

SEQ ID NO: 2931342 - RNA, 14 nt, Mycobacterium avium subsp. paratuberculosis
ccugcuugaccgcg

SEQ ID NO: 2931343 - RNA, 16 nt, Mycobacterium avium subsp. paratuberculosis
ccugcuugaccgcgac

SEQ ID NO: 2931344 - RNA, 16 nt, Mycobacterium avium subsp. paratuberculosis
ccugcuugagcccguc

SEQ ID NO: 2931345 - RNA, 23 nt, Mycobacterium avium subsp. paratuberculosis
ccugcuugaugaugccggccgcg

SEQ ID NO: 2931346 - RNA, 19 nt, Mycobacterium avium subsp. paratuberculosis
ccugcuuggcggccugcgc

SEQ ID NO: 2931347 - RNA, 18 nt, Mycobacterium avium subsp. paratuberculosis
ccugcuugggcagcagcu

SEQ ID NO: 2931348 - RNA, 19 nt, Mycobacterium avium subsp. paratuberculosis
ccugcuugggcagcagcuc

SEQ ID NO: 2931349 - RNA, 20 nt, Mycobacterium avium subsp. paratuberculosis
ccugcuuggucuccggcccc

SEQ ID NO: 2931350 - RNA, 19 nt, Mycobacterium avium subsp. paratuberculosis
ccuggaacuuguugacgaa

SEQ ID NO: 2931351 - RNA, 18 nt, Mycobacterium avium subsp. paratuberculosis
ccuggaagaagucggugu

SEQ ID NO: 2931352 - RNA, 20 nt, Mycobacterium avium subsp. paratuberculosis
ccuggaagaagucggugucg

SEQ ID NO: 2931353 - RNA, 18 nt, Mycobacterium avium subsp. paratuberculosis
ccuggaagaugacccgcc

SEQ ID NO: 2931354 - RNA, 19 nt, Mycobacterium avium subsp. paratuberculosis
ccuggaagcgcaucgccgg

SEQ ID NO: 2931355 - RNA, 20 nt, Mycobacterium avium subsp. paratuberculosis
ccuggaagcgcaucgccggc

SEQ ID NO: 2931356 - RNA, 21 nt, Mycobacterium avium subsp. paratuberculosis
ccuggaagcgcaucgccggcg

SEQ ID NO: 2931357 - RNA, 22 nt, Mycobacterium avium subsp. paratuberculosis
ccuggaaggacgucaggccggu

SEQ ID NO: 2931358 - RNA, 23 nt, Mycobacterium avium subsp. paratuberculosis
ccuggaaggacgucaggccgguc

SEQ ID NO: 2931359 - RNA, 16 nt, Mycobacterium avium subsp. paratuberculosis
ccuggaaggcgaucac

SEQ ID NO: 2931360 - RNA, 17 nt, Mycobacterium avium subsp. paratuberculosis
ccuggacgaguggucgg

SEQ ID NO: 2931361 - RNA, 21 nt, Mycobacterium avium subsp. paratuberculosis
ccuggacgaguggucggccgc

SEQ ID NO: 2931362 - RNA, 19 nt, Mycobacterium avium subsp. paratuberculosis
ccuggacgccgcacgcgac

SEQ ID NO: 2931363 - RNA, 19 nt, Mycobacterium avium subsp. paratuberculosis
ccuggacgguuucaccgcc

SEQ ID NO: 2931364 - RNA, 20 nt, Mycobacterium avium subsp. paratuberculosis
ccuggacgguuucaccgccg

SEQ ID NO: 2931365 - RNA, 18 nt, Mycobacterium avium subsp. paratuberculosis
ccuggacgucgucgcugu

SEQ ID NO: 2931366 - RNA, 17 nt, Mycobacterium avium subsp. paratuberculosis
ccuggagcggguccgcc

SEQ ID NO: 2931367 - RNA, 19 nt, Mycobacterium avium subsp. paratuberculosis
ccuggagcggguccgcccc

SEQ ID NO: 2931368 - RNA, 19 nt, Mycobacterium avium subsp. paratuberculosis
ccuggagggagcacucgau

SEQ ID NO: 2931369 - RNA, 23 nt, Mycobacterium avium subsp. paratuberculosis
ccuggaucagccaguugaucagc

SEQ ID NO: 2931370 - RNA, 22 nt, Mycobacterium avium subsp. paratuberculosis
ccuggaucccgaacugccgcgc

SEQ ID NO: 2931371 - RNA, 17 nt, Mycobacterium avium subsp. paratuberculosis
ccuggaucgcgcaggug

SEQ ID NO: 2931372 - RNA, 22 nt, Mycobacterium avium subsp. paratuberculosis
ccuggaugucacgguccagguc

SEQ ID NO: 2931373 - RNA, 15 nt, Mycobacterium avium subsp. paratuberculosis
ccuggcacgacgccg

SEQ ID NO: 2931374 - RNA, 20 nt, Mycobacterium avium subsp. paratuberculosis
ccuggcacgacgccgccgag

SEQ ID NO: 2931375 - RNA, 23 nt, Mycobacterium avium subsp. paratuberculosis
ccuggcacggcugcucccgaaag

SEQ ID NO: 2931376 - RNA, 18 nt, Mycobacterium avium subsp. paratuberculosis
ccuggcagcauccgccga

SEQ ID NO: 2931377 - RNA, 19 nt, Mycobacterium avium subsp. paratuberculosis
ccuggcagcauccgccgac

SEQ ID NO: 2931378 - RNA, 13 nt, Mycobacterium avium subsp. paratuberculosis
ccuggcaggugag

SEQ ID NO: 2931379 - RNA, 19 nt, Mycobacterium avium subsp. paratuberculosis
ccuggcaggugagccgggu

SEQ ID NO: 2931380 - RNA, 11 nt, Mycobacterium avium subsp. paratuberculosis
ccuggcauccg

SEQ ID NO: 2931381 - RNA, 19 nt, Mycobacterium avium subsp. paratuberculosis
ccuggccaacucgaccugc

SEQ ID NO: 2931382 - RNA, 13 nt, Mycobacterium avium subsp. paratuberculosis
ccuggccaccagc

SEQ ID NO: 2931383 - RNA, 14 nt, Mycobacterium avium subsp. paratuberculosis
ccuggccaccagca

SEQ ID NO: 2931384 - RNA, 17 nt, Mycobacterium avium subsp. paratuberculosis
ccuggccaccucgacgg

SEQ ID NO: 2931385 - RNA, 18 nt, Mycobacterium avium subsp. paratuberculosis
ccuggccaccucgacggc

SEQ ID NO: 2931386 - RNA, 22 nt, Mycobacterium avium subsp. paratuberculosis
ccuggccaccucgacggcgugg

SEQ ID NO: 2931387 - RNA, 13 nt, Mycobacterium avium subsp. paratuberculosis
ccuggccagcacc

SEQ ID NO: 2931388 - RNA, 14 nt, Mycobacterium avium subsp. paratuberculosis
ccuggccagcaccg

SEQ ID NO: 2931389 - RNA, 17 nt, Mycobacterium avium subsp. paratuberculosis
ccuggccagcaccgcgg

SEQ ID NO: 2931390 - RNA, 21 nt, Mycobacterium avium subsp. paratuberculosis
ccuggcccaaaaacaucguca

SEQ ID NO: 2931391 - RNA, 19 nt, Mycobacterium avium subsp. paratuberculosis
ccuggcccagacaggccgg

SEQ ID NO: 2931392 - RNA, 23 nt, Mycobacterium avium subsp. paratuberculosis
ccuggcccccgccccagcccggc

SEQ ID NO: 2931393 - RNA, 17 nt, Mycobacterium avium subsp. paratuberculosis
ccuggcccuugaccgcc

SEQ ID NO: 2931394 - RNA, 19 nt, Mycobacterium avium subsp. paratuberculosis
ccuggccgccggccgcgca

SEQ ID NO: 2931395 - RNA, 20 nt, Mycobacterium avium subsp. paratuberculosis
ccuggccgccggccgcgcag

SEQ ID NO: 2931396 - RNA, 23 nt, Mycobacterium avium subsp. paratuberculosis
ccuggccgcguuccaggaccuga

SEQ ID NO: 2931397 - RNA, 15 nt, Mycobacterium avium subsp. paratuberculosis
ccuggccggacgggu

SEQ ID NO: 2931398 - RNA, 14 nt, Mycobacterium avium subsp. paratuberculosis
ccuggccggccucg

SEQ ID NO: 2931399 - RNA, 13 nt, Mycobacterium avium subsp. paratuberculosis
ccuggccggugcg

SEQ ID NO: 2931400 - RNA, 14 nt, Mycobacterium avium subsp. paratuberculosis
ccuggccgucggug

SEQ ID NO: 2931401 - RNA, 20 nt, Mycobacterium avium subsp. paratuberculosis
ccugguugacgcccccggug

SEQ ID NO: 2931402 - RNA, 21 nt, Mycobacterium avium subsp. paratuberculosis
ccugguugacgcccccgguga

SEQ ID NO: 2931403 - RNA, 16 nt, Mycobacterium avium subsp. paratuberculosis
ccugguugagcaccgc

SEQ ID NO: 2931404 - RNA, 17 nt, Mycobacterium avium subsp. paratuberculosis
ccugguugagcaccgcg

SEQ ID NO: 2931405 - RNA, 18 nt, Mycobacterium avium subsp. paratuberculosis
ccugguugagcaccgcga

SEQ ID NO: 2931406 - RNA, 16 nt, Mycobacterium avium subsp. paratuberculosis
ccugguugagugccgu

SEQ ID NO: 2931407 - RNA, 15 nt, Mycobacterium avium subsp. paratuberculosis
ccugguugauccagc

SEQ ID NO: 2931408 - RNA, 15 nt, Mycobacterium avium subsp. paratuberculosis
ccugguugccgcccu

SEQ ID NO: 2931409 - RNA, 15 nt, Mycobacterium avium subsp. paratuberculosis
ccugguuggcccgca

SEQ ID NO: 2931410 - RNA, 17 nt, Mycobacterium avium subsp. paratuberculosis
ccugguuggcccgcacc

SEQ ID NO: 2931411 - RNA, 19 nt, Mycobacterium avium subsp. paratuberculosis
ccugguuggcccgcaccac

SEQ ID NO: 2931412 - RNA, 20 nt, Mycobacterium avium subsp. paratuberculosis
ccugguuggcccgcaccacc

SEQ ID NO: 2931413 - RNA, 20 nt, Mycobacterium avium subsp. paratuberculosis
ccuguacgugucccugcggc

SEQ ID NO: 2931414 - RNA, 20 nt, Mycobacterium avium subsp. paratuberculosis
ccugucaacgagacacccuc

SEQ ID NO: 2931415 - RNA, 19 nt, Mycobacterium avium subsp. paratuberculosis
ccugucaguuugcgcgacg

SEQ ID NO: 2931416 - RNA, 20 nt, Mycobacterium avium subsp. paratuberculosis
ccugugaggcaccgaacgcc

SEQ ID NO: 2931417 - RNA, 20 nt, Mycobacterium avium subsp. paratuberculosis
ccugugaggcguuggcccgc

SEQ ID NO: 2931418 - RNA, 19 nt, Mycobacterium avium subsp. paratuberculosis
ccugugcaccgugcugugc

SEQ ID NO: 2931419 - RNA, 21 nt, Mycobacterium avium subsp. paratuberculosis
ccugugcgccccacggcgcgu

SEQ ID NO: 2931420 - RNA, 14 nt, Mycobacterium avium subsp. paratuberculosis
ccugugggucgaca

SEQ ID NO: 2931421 - RNA, 23 nt, Mycobacterium avium subsp. paratuberculosis
ccugugggucgacagaaaagaga

SEQ ID NO: 2931422 - RNA, 16 nt, Mycobacterium avium subsp. paratuberculosis
ccuguuccccggcggg

SEQ ID NO: 2931423 - RNA, 16 nt, Mycobacterium avium subsp. paratuberculosis
ccuguucgcgccggua

SEQ ID NO: 2931424 - RNA, 12 nt, Mycobacterium avium subsp. paratuberculosis
ccuguuggccag

SEQ ID NO: 2931425 - RNA, 13 nt, Mycobacterium avium subsp. paratuberculosis
ccuguuggcccug

SEQ ID NO: 2931426 - RNA, 14 nt, Mycobacterium avium subsp. paratuberculosis
ccuguuugaacacc

SEQ ID NO: 2931427 - RNA, 19 nt, Mycobacterium avium subsp. paratuberculosis
ccuguuuggcugucgcgcu

SEQ ID NO: 2931428 - RNA, 13 nt, Mycobacterium avium subsp. paratuberculosis
ccuuacgccgacg

SEQ ID NO: 2931429 - RNA, 15 nt, Mycobacterium avium subsp. paratuberculosis
ccuuagcccggccgc

SEQ ID NO: 2931430 - RNA, 14 nt, Mycobacterium avium subsp. paratuberculosis
ccuucaccgaccag

SEQ ID NO: 2931431 - RNA, 15 nt, Mycobacterium avium subsp. paratuberculosis
ccuucaccgcgccgg

SEQ ID NO: 2931432 - RNA, 23 nt, Mycobacterium avium subsp. paratuberculosis
ccuucaccucggccuugccgcug

SEQ ID NO: 2931433 - RNA, 16 nt, Mycobacterium avium subsp. paratuberculosis
ccuucacgaccggcag

SEQ ID NO: 2931434 - RNA, 21 nt, Mycobacterium avium subsp. paratuberculosis
ccuucacgaccggcagcaccg

SEQ ID NO: 2931435 - RNA, 20 nt, Mycobacterium avium subsp. paratuberculosis
ccuucaucaccgccccgacg

SEQ ID NO: 2931436 - RNA, 23 nt, Mycobacterium avium subsp. paratuberculosis
ccuucaucagcaccgcgaacauc

SEQ ID NO: 2931437 - RNA, 14 nt, Mycobacterium avium subsp. paratuberculosis
ccuucaucgaucgg

SEQ ID NO: 2931438 - RNA, 17 nt, Mycobacterium avium subsp. paratuberculosis
ccuucaucgccgucgcc

SEQ ID NO: 2931439 - RNA, 15 nt, Mycobacterium avium subsp. paratuberculosis
ccuuccacgaccugg

SEQ ID NO: 2931440 - RNA, 18 nt, Mycobacterium avium subsp. paratuberculosis
ccuuccacgaccuggcgg

SEQ ID NO: 2931441 - RNA, 23 nt, Mycobacterium avium subsp. paratuberculosis
ccuuccacgaccuggcgggccag

SEQ ID NO: 2931442 - RNA, 15 nt, Mycobacterium avium subsp. paratuberculosis
ccuuccaucgacgcu

SEQ ID NO: 2931443 - RNA, 14 nt, Mycobacterium avium subsp. paratuberculosis
ccuuccccggcggc

SEQ ID NO: 2931444 - RNA, 15 nt, Mycobacterium avium subsp. paratuberculosis
ccuuccccggcggcc

SEQ ID NO: 2931445 - RNA, 18 nt, Mycobacterium avium subsp. paratuberculosis
ccuuccggaacgacgcgu

SEQ ID NO: 2931446 - RNA, 16 nt, Mycobacterium avium subsp. paratuberculosis
ccuuccugcgcgugcu

SEQ ID NO: 2931447 - RNA, 16 nt, Mycobacterium avium subsp. paratuberculosis
ccuuccugggacagcc

SEQ ID NO: 2931448 - RNA, 15 nt, Mycobacterium avium subsp. paratuberculosis
ccuucgacggccggc

SEQ ID NO: 2931449 - RNA, 16 nt, Mycobacterium avium subsp. paratuberculosis
ccuucgacggccggcc

SEQ ID NO: 2931450 - RNA, 17 nt, Mycobacterium avium subsp. paratuberculosis
ccuucgacggccggccc

SEQ ID NO: 2931451 - RNA, 14 nt, Mycobacterium avium subsp. paratuberculosis
ccuucgagccgccg

SEQ ID NO: 2931452 - RNA, 17 nt, Mycobacterium avium subsp. paratuberculosis
ccuucgagccgccgccg

SEQ ID NO: 2931453 - RNA, 15 nt, Mycobacterium avium subsp. paratuberculosis
ccuucgaguuuggcc

SEQ ID NO: 2931454 - RNA, 13 nt, Mycobacterium avium subsp. paratuberculosis
ccuucgaugcccu

SEQ ID NO: 2931455 - RNA, 14 nt, Mycobacterium avium subsp. paratuberculosis
ccuucgcggugugc

SEQ ID NO: 2931456 - RNA, 18 nt, Mycobacterium avium subsp. paratuberculosis
ccuucgcggugugcggca

SEQ ID NO: 2931457 - RNA, 15 nt, Mycobacterium avium subsp. paratuberculosis
ccuucggagacgugg

SEQ ID NO: 2931458 - RNA, 19 nt, Mycobacterium avium subsp. paratuberculosis
ccuucggagacguggcggc

SEQ ID NO: 2931459 - RNA, 12 nt, Mycobacterium avium subsp. paratuberculosis
ccuucggccggc

SEQ ID NO: 2931460 - RNA, 17 nt, Mycobacterium avium subsp. paratuberculosis
ccuucggccggcagcgg

SEQ ID NO: 2931461 - RNA, 12 nt, Mycobacterium avium subsp. paratuberculosis
ccuucggcgcca

SEQ ID NO: 2931462 - RNA, 14 nt, Mycobacterium avium subsp. paratuberculosis
ccuucggcgcccgc

SEQ ID NO: 2931463 - RNA, 19 nt, Mycobacterium avium subsp. paratuberculosis
ccuucggcgcccgcuccgg

SEQ ID NO: 2931464 - RNA, 12 nt, Mycobacterium avium subsp. paratuberculosis
ccuucgggccga

SEQ ID NO: 2931465 - RNA, 17 nt, Mycobacterium avium subsp. paratuberculosis
ccuucuccacgcucgga

SEQ ID NO: 2931466 - RNA, 21 nt, Mycobacterium avium subsp. paratuberculosis
ccuucucccgcggcagccggg

SEQ ID NO: 2931467 - RNA, 16 nt, Mycobacterium avium subsp. paratuberculosis
ccuucucgaccaggcu

SEQ ID NO: 2931468 - RNA, 18 nt, Mycobacterium avium subsp. paratuberculosis
ccuucucggacgcccguc

SEQ ID NO: 2931469 - RNA, 18 nt, Mycobacterium avium subsp. paratuberculosis
ccuucugcgcgccgucgg

SEQ ID NO: 2931470 - RNA, 16 nt, Mycobacterium avium subsp. paratuberculosis
ccuucugcgucggcuu

SEQ ID NO: 2931471 - RNA, 16 nt, Mycobacterium avium subsp. paratuberculosis
ccuucuucgccgcagc

SEQ ID NO: 2931472 - RNA, 17 nt, Mycobacterium avium subsp. paratuberculosis
ccuucuucgccgcagcc

SEQ ID NO: 2931473 - RNA, 22 nt, Mycobacterium avium subsp. paratuberculosis
ccuucuucgccgcagccuucuu

SEQ ID NO: 2931474 - RNA, 21 nt, Mycobacterium avium subsp. paratuberculosis
ccuucuucgcgggugccuucu

SEQ ID NO: 2931475 - RNA, 14 nt, Mycobacterium avium subsp. paratuberculosis
ccuucuugaccgca

SEQ ID NO: 2931476 - RNA, 17 nt, Mycobacterium avium subsp. paratuberculosis
ccuucuugaccgcagcc

SEQ ID NO: 2931477 - RNA, 18 nt, Mycobacterium avium subsp. paratuberculosis
ccuucuugaccgcagccu

SEQ ID NO: 2931478 - RNA, 20 nt, Mycobacterium avium subsp. paratuberculosis
ccuucuugaccgcagccuuc

SEQ ID NO: 2931479 - RNA, 22 nt, Mycobacterium avium subsp. paratuberculosis
ccuucuugcugcccgcggccgc

SEQ ID NO: 2931480 - RNA, 12 nt, Mycobacterium avium subsp. paratuberculosis
ccuucuuggccg

SEQ ID NO: 2931481 - RNA, 14 nt, Mycobacterium avium subsp. paratuberculosis
ccuucuuggccgcg

SEQ ID NO: 2931482 - RNA, 18 nt, Mycobacterium avium subsp. paratuberculosis
ccuucuuggccggagccu

SEQ ID NO: 2931483 - RNA, 22 nt, Mycobacterium avium subsp. paratuberculosis
ccuucuuggccggagccuucuu

SEQ ID NO: 2931484 - RNA, 11 nt, Mycobacterium avium subsp. paratuberculosis
ccuucuuggcg

SEQ ID NO: 2931485 - RNA, 15 nt, Mycobacterium avium subsp. paratuberculosis
ccuucuuggcggcgg

SEQ ID NO: 2931486 - RNA, 15 nt, Mycobacterium avium subsp. paratuberculosis
ccuuggcucgggcca

SEQ ID NO: 2931487 - RNA, 23 nt, Mycobacterium avium subsp. paratuberculosis
ccuugggcauccgcucgccgcgg

SEQ ID NO: 2931488 - RNA, 12 nt, Mycobacterium avium subsp. paratuberculosis
ccuugggccggu

SEQ ID NO: 2931489 - RNA, 22 nt, Mycobacterium avium subsp. paratuberculosis
ccuugggcuccucgaccacgca

SEQ ID NO: 2931490 - RNA, 17 nt, Mycobacterium avium subsp. paratuberculosis
ccuuggggcugaccucg

SEQ ID NO: 2931491 - RNA, 20 nt, Mycobacterium avium subsp. paratuberculosis
ccuuggguucggcggcgcgg

SEQ ID NO: 2931492 - RNA, 21 nt, Mycobacterium avium subsp. paratuberculosis
ccuugguagaugcguuccagg

SEQ ID NO: 2931493 - RNA, 15 nt, Mycobacterium avium subsp. paratuberculosis
ccuuggucagcuccc

SEQ ID NO: 2931494 - RNA, 18 nt, Mycobacterium avium subsp. paratuberculosis
ccuuggucagcucccggc

SEQ ID NO: 2931495 - RNA, 11 nt, Mycobacterium avium subsp. paratuberculosis
ccuuggucgcg

SEQ ID NO: 2931496 - RNA, 15 nt, Mycobacterium avium subsp. paratuberculosis
ccuuggugacggccu

SEQ ID NO: 2931497 - RNA, 14 nt, Mycobacterium avium subsp. paratuberculosis
ccuuggugauccgg

SEQ ID NO: 2931498 - RNA, 20 nt, Mycobacterium avium subsp. paratuberculosis
ccuuggugccguugaccacg

SEQ ID NO: 2931499 - RNA, 14 nt, Mycobacterium avium subsp. paratuberculosis
ccuugguggccgcg

SEQ ID NO: 2931500 - RNA, 17 nt, Mycobacterium avium subsp. paratuberculosis
ccuugguggccgcggcc

SEQ ID NO: 2931501 - RNA, 19 nt, Mycobacterium avium subsp. paratuberculosis
ccuugguggccgcggccgc

SEQ ID NO: 2931502 - RNA, 18 nt, Mycobacterium avium subsp. paratuberculosis
ccuuggugucggcgagcu

SEQ ID NO: 2931503 - RNA, 14 nt, Mycobacterium avium subsp. paratuberculosis
ccuugucaccgaac

SEQ ID NO: 2931504 - RNA, 19 nt, Mycobacterium avium subsp. paratuberculosis
ccuugucgcgcaccgcggc

SEQ ID NO: 2931505 - RNA, 20 nt, Mycobacterium avium subsp. paratuberculosis
ccuugucgcugaccaccgag

SEQ ID NO: 2931506 - RNA, 22 nt, Mycobacterium avium subsp. paratuberculosis
ccuugucgcuggcguacgccau

SEQ ID NO: 2931507 - RNA, 13 nt, Mycobacterium avium subsp. paratuberculosis
ccuugucggcgag

SEQ ID NO: 2931508 - RNA, 16 nt, Mycobacterium avium subsp. paratuberculosis
ccuugucgggccgcgg

SEQ ID NO: 2931509 - RNA, 20 nt, Mycobacterium avium subsp. paratuberculosis
ccuugucguccucgaucacc

SEQ ID NO: 2931510 - RNA, 23 nt, Mycobacterium avium subsp. paratuberculosis
ccuuuccgcgcggcgggcccgca

SEQ ID NO: 2931511 - RNA, 20 nt, Mycobacterium avium subsp. paratuberculosis
ccuuugccgugcucggcggc

SEQ ID NO: 2931512 - RNA, 14 nt, Mycobacterium avium subsp. paratuberculosis
ccuuuggcggccag

SEQ ID NO: 2931513 - RNA, 14 nt, Mycobacterium avium subsp. paratuberculosis
ccuuuuccaucugg

SEQ ID NO: 2931514 - RNA, 18 nt, Mycobacterium avium subsp. paratuberculosis
ccuuuuccggcgacaccg

SEQ ID NO: 2931515 - RNA, 15 nt, Mycobacterium avium subsp. paratuberculosis
cgaaaaccagcaccg

SEQ ID NO: 2931516 - RNA, 20 nt, Mycobacterium avium subsp. paratuberculosis
cgaaaacgccugcgccgccg

SEQ ID NO: 2931517 - RNA, 21 nt, Mycobacterium avium subsp. paratuberculosis
cgaaaagcccgccgccucacc

SEQ ID NO: 2931518 - RNA, 14 nt, Mycobacterium avium subsp. paratuberculosis
cgaaaaugcccagu

SEQ ID NO: 2931519 - RNA, 18 nt, Mycobacterium avium subsp. paratuberculosis
cgaaaauggcugcccggc

SEQ ID NO: 2931520 - RNA, 15 nt, Mycobacterium avium subsp. paratuberculosis
cgaaacacagcagca

SEQ ID NO: 2931521 - RNA, 16 nt, Mycobacterium avium subsp. paratuberculosis
cgaaacccaggaacac

SEQ ID NO: 2931522 - RNA, 17 nt, Mycobacterium avium subsp. paratuberculosis
cgaaacccggcggacgg

SEQ ID NO: 2931523 - RNA, 20 nt, Mycobacterium avium subsp. paratuberculosis
cgaaacccguugccaacacc

SEQ ID NO: 2931524 - RNA, 11 nt, Mycobacterium avium subsp. paratuberculosis
cgaaaccgcca

SEQ ID NO: 2931525 - RNA, 18 nt, Mycobacterium avium subsp. paratuberculosis
cgaaaccggucaacggcu

SEQ ID NO: 2931526 - RNA, 19 nt, Mycobacterium avium subsp. paratuberculosis
cgaaaccgucuccggcgcg

SEQ ID NO: 2931527 - RNA, 17 nt, Mycobacterium avium subsp. paratuberculosis
cgaaaccuugaucggcc

SEQ ID NO: 2931528 - RNA, 16 nt, Mycobacterium avium subsp. paratuberculosis
cgaaacgcaacagcga

SEQ ID NO: 2931529 - RNA, 14 nt, Mycobacterium avium subsp. paratuberculosis
cgaaacgcccggcu

SEQ ID NO: 2931530 - RNA, 17 nt, Mycobacterium avium subsp. paratuberculosis
cgaaacggcugcugcgc

SEQ ID NO: 2931531 - RNA, 20 nt, Mycobacterium avium subsp. paratuberculosis
cgaaacggcugcugcgcggc

SEQ ID NO: 2931532 - RNA, 21 nt, Mycobacterium avium subsp. paratuberculosis
cgaaacggcugcugcgcggca

SEQ ID NO: 2931533 - RNA, 21 nt, Mycobacterium avium subsp. paratuberculosis
cgaaacuuguggaaggcgccg

SEQ ID NO: 2931534 - RNA, 22 nt, Mycobacterium avium subsp. paratuberculosis
cgaaacuuguggaaggcgccgg

SEQ ID NO: 2931535 - RNA, 21 nt, Mycobacterium avium subsp. paratuberculosis
cgaaagcagcaacggcggcgg

SEQ ID NO: 2931536 - RNA, 15 nt, Mycobacterium avium subsp. paratuberculosis
cgaaagccacccgcg

SEQ ID NO: 2931537 - RNA, 18 nt, Mycobacterium avium subsp. paratuberculosis
cgaaagcccaggcccggc

SEQ ID NO: 2931538 - RNA, 15 nt, Mycobacterium avium subsp. paratuberculosis
cgaaagcccccagcu

SEQ ID NO: 2931539 - RNA, 14 nt, Mycobacterium avium subsp. paratuberculosis
cgaaagccgacacc

SEQ ID NO: 2931540 - RNA, 23 nt, Mycobacterium avium subsp. paratuberculosis
cgaaagccguaccgcaacaccga

SEQ ID NO: 2931541 - RNA, 23 nt, Mycobacterium avium subsp. paratuberculosis
cgaaagccguagcgcaacaccga

SEQ ID NO: 2931542 - RNA, 17 nt, Mycobacterium avium subsp. paratuberculosis
cgaaagccuccaaccca

SEQ ID NO: 2931543 - RNA, 19 nt, Mycobacterium avium subsp. paratuberculosis
cgaaagccuccgcgaucag

SEQ ID NO: 2931544 - RNA, 22 nt, Mycobacterium avium subsp. paratuberculosis
cgaaagcgcuuggcggagagcg

SEQ ID NO: 2931545 - RNA, 20 nt, Mycobacterium avium subsp. paratuberculosis
cgaaaggacgggcgugacag

SEQ ID NO: 2931546 - RNA, 14 nt, Mycobacterium avium subsp. paratuberculosis
cgaaaggcccaccg

SEQ ID NO: 2931547 - RNA, 22 nt, Mycobacterium avium subsp. paratuberculosis
cgaaagguuuucccggccgccg

SEQ ID NO: 2931548 - RNA, 20 nt, Mycobacterium avium subsp. paratuberculosis
cgaaagugcuacugccgacg

SEQ ID NO: 2931549 - RNA, 21 nt, Mycobacterium avium subsp. paratuberculosis
cgaaauaaccgcgcggcgccc

SEQ ID NO: 2931550 - RNA, 18 nt, Mycobacterium avium subsp. paratuberculosis
cgaaauacgacgagccga

SEQ ID NO: 2931551 - RNA, 22 nt, Mycobacterium avium subsp. paratuberculosis
cgaaauagcggcgcaccuggcg

SEQ ID NO: 2931552 - RNA, 15 nt, Mycobacterium avium subsp. paratuberculosis
cgaaaucaacgcgcc

SEQ ID NO: 2931553 - RNA, 20 nt, Mycobacterium avium subsp. paratuberculosis
cgaaaucggugaagccgacg

SEQ ID NO: 2931554 - RNA, 20 nt, Mycobacterium avium subsp. paratuberculosis
cgaaaucgucgggccggauc

SEQ ID NO: 2931555 - RNA, 15 nt, Mycobacterium avium subsp. paratuberculosis
cgaaaugaccgcgcc

SEQ ID NO: 2931556 - RNA, 18 nt, Mycobacterium avium subsp. paratuberculosis
cgaaaugcaucagcguga

SEQ ID NO: 2931557 - RNA, 19 nt, Mycobacterium avium subsp. paratuberculosis
cgaaaugccuuggcggcgu

SEQ ID NO: 2931558 - RNA, 20 nt, Mycobacterium avium subsp. paratuberculosis
cgaaaugccuuggcggcgug

SEQ ID NO: 2931559 - RNA, 18 nt, Mycobacterium avium subsp. paratuberculosis
cgaacaacagggccgcgc

SEQ ID NO: 2931560 - RNA, 19 nt, Mycobacterium avium subsp. paratuberculosis
cgaacaacagggccgcgcg

SEQ ID NO: 2931561 - RNA, 18 nt, Mycobacterium avium subsp. paratuberculosis
cgaacaacccggccgcga

SEQ ID NO: 2931562 - RNA, 17 nt, Mycobacterium avium subsp. paratuberculosis
cgaacaacgcggugacc

SEQ ID NO: 2931563 - RNA, 19 nt, Mycobacterium avium subsp. paratuberculosis
cgaacaacgcggugaccgc

SEQ ID NO: 2931564 - RNA, 23 nt, Mycobacterium avium subsp. paratuberculosis
cgaacaacgcggugaccgcggcc

SEQ ID NO: 2931565 - RNA, 23 nt, Mycobacterium avium subsp. paratuberculosis
cgaacaacugaccgauggccgcc

SEQ ID NO: 2931566 - RNA, 20 nt, Mycobacterium avium subsp. paratuberculosis
cgaacaaucgcugcgagccc

SEQ ID NO: 2931567 - RNA, 23 nt, Mycobacterium avium subsp. paratuberculosis
cgaacaauuccucugcgcgccaa

SEQ ID NO: 2931568 - RNA, 22 nt, Mycobacterium avium subsp. paratuberculosis
cgaacaccaccggcaaccgcca

SEQ ID NO: 2931569 - RNA, 23 nt, Mycobacterium avium subsp. paratuberculosis
cgaacaccaccggcaaccgccac

SEQ ID NO: 2931570 - RNA, 13 nt, Mycobacterium avium subsp. paratuberculosis
cgaacgccgccgu

SEQ ID NO: 2931571 - RNA, 14 nt, Mycobacterium avium subsp. paratuberculosis
cgaacgccggcauc

SEQ ID NO: 2931572 - RNA, 15 nt, Mycobacterium avium subsp. paratuberculosis
cgaacgccggcauca

SEQ ID NO: 2931573 - RNA, 14 nt, Mycobacterium avium subsp. paratuberculosis
cgaacgccuccgcc

SEQ ID NO: 2931574 - RNA, 17 nt, Mycobacterium avium subsp. paratuberculosis
cgaacgccuccgccgcc

SEQ ID NO: 2931575 - RNA, 14 nt, Mycobacterium avium subsp. paratuberculosis
cgaacgccucgauc

SEQ ID NO: 2931576 - RNA, 14 nt, Mycobacterium avium subsp. paratuberculosis
cgaacgccucggcg

SEQ ID NO: 2931577 - RNA, 15 nt, Mycobacterium avium subsp. paratuberculosis
cgaacgccucggcga

SEQ ID NO: 2931578 - RNA, 17 nt, Mycobacterium avium subsp. paratuberculosis
cgaacgccucggcgagc

SEQ ID NO: 2931579 - RNA, 19 nt, Mycobacterium avium subsp. paratuberculosis
cgaacgccucggcgagccg

SEQ ID NO: 2931580 - RNA, 19 nt, Mycobacterium avium subsp. paratuberculosis
cgaacgccucguuggccag

SEQ ID NO: 2931581 - RNA, 21 nt, Mycobacterium avium subsp. paratuberculosis
cgaacgccucguuggccagcu

SEQ ID NO: 2931582 - RNA, 12 nt, Mycobacterium avium subsp. paratuberculosis
cgaacgcgaccu

SEQ ID NO: 2931583 - RNA, 23 nt, Mycobacterium avium subsp. paratuberculosis
cgaacgcgaccugcaucucgacc

SEQ ID NO: 2931584 - RNA, 12 nt, Mycobacterium avium subsp. paratuberculosis
cgaacgcgacga

SEQ ID NO: 2931585 - RNA, 13 nt, Mycobacterium avium subsp. paratuberculosis
cgaacgcgacgaa

SEQ ID NO: 2931586 - RNA, 21 nt, Mycobacterium avium subsp. paratuberculosis
cgaacgcgacgaagcggucgc

SEQ ID NO: 2931587 - RNA, 14 nt, Mycobacterium avium subsp. paratuberculosis
cgaacgcgacgauc

SEQ ID NO: 2931588 - RNA, 14 nt, Mycobacterium avium subsp. paratuberculosis
cgaacgcgccgauc

SEQ ID NO: 2931589 - RNA, 15 nt, Mycobacterium avium subsp. paratuberculosis
cgaacgcgccgccga

SEQ ID NO: 2931590 - RNA, 12 nt, Mycobacterium avium subsp. paratuberculosis
cgaacgcgccgg

SEQ ID NO: 2931591 - RNA, 20 nt, Mycobacterium avium subsp. paratuberculosis
cgaacgcgccggugaccccg

SEQ ID NO: 2931592 - RNA, 17 nt, Mycobacterium avium subsp. paratuberculosis
cgaacgcgcggucgucg

SEQ ID NO: 2931593 - RNA, 18 nt, Mycobacterium avium subsp. paratuberculosis
cgaacgcgcggucgucgc

SEQ ID NO: 2931594 - RNA, 13 nt, Mycobacterium avium subsp. paratuberculosis
cgaacgcggccag

SEQ ID NO: 2931595 - RNA, 14 nt, Mycobacterium avium subsp. paratuberculosis
cgaacgcggccgcc

SEQ ID NO: 2931596 - RNA, 17 nt, Mycobacterium avium subsp. paratuberculosis
cgaacgcggccgccagc

SEQ ID NO: 2931597 - RNA, 21 nt, Mycobacterium avium subsp. paratuberculosis
cgaacgcggccgccaucgauc

SEQ ID NO: 2931598 - RNA, 15 nt, Mycobacterium avium subsp. paratuberculosis
cgaacgcggcgaaca

SEQ ID NO: 2931599 - RNA, 23 nt, Mycobacterium avium subsp. paratuberculosis
cgaacgcggcgaacaccucggcg

SEQ ID NO: 2931600 - RNA, 17 nt, Mycobacterium avium subsp. paratuberculosis
cgaacgcggcgaagcag

SEQ ID NO: 2931601 - RNA, 18 nt, Mycobacterium avium subsp. paratuberculosis
cgaacgcggcgaagcagg

SEQ ID NO: 2931602 - RNA, 12 nt, Mycobacterium avium subsp. paratuberculosis
cgaacgcggcgg

SEQ ID NO: 2931603 - RNA, 20 nt, Mycobacterium avium subsp. paratuberculosis
cgaacgcggcggaggccugc

SEQ ID NO: 2931604 - RNA, 23 nt, Mycobacterium avium subsp. paratuberculosis
cgaacgcggcggaggccugcgcg

SEQ ID NO: 2931605 - RNA, 16 nt, Mycobacterium avium subsp. paratuberculosis
cgaacgcggcugauca

SEQ ID NO: 2931606 - RNA, 22 nt, Mycobacterium avium subsp. paratuberculosis
cgaacgcggcugaucagccggc

SEQ ID NO: 2931607 - RNA, 22 nt, Mycobacterium avium subsp. paratuberculosis
cgaacgcgguuuugaugccgcc

SEQ ID NO: 2931608 - RNA, 16 nt, Mycobacterium avium subsp. paratuberculosis
cgaacgcguacacggc

SEQ ID NO: 2931609 - RNA, 17 nt, Mycobacterium avium subsp. paratuberculosis
cgaacgcguacacggcc

SEQ ID NO: 2931610 - RNA, 23 nt, Mycobacterium avium subsp. paratuberculosis
cgaacgcguacacggcccgcggc

SEQ ID NO: 2931611 - RNA, 16 nt, Mycobacterium avium subsp. paratuberculosis
cgaacgcgucccgggc

SEQ ID NO: 2931612 - RNA, 17 nt, Mycobacterium avium subsp. paratuberculosis
cgaacgcgucccgggcc

SEQ ID NO: 2931613 - RNA, 23 nt, Mycobacterium avium subsp. paratuberculosis
cgaacgcgucccgggccuuggcc

SEQ ID NO: 2931614 - RNA, 13 nt, Mycobacterium avium subsp. paratuberculosis
cgaacgcgucguc

SEQ ID NO: 2931615 - RNA, 16 nt, Mycobacterium avium subsp. paratuberculosis
cgaacgcguucgucgg

SEQ ID NO: 2931616 - RNA, 21 nt, Mycobacterium avium subsp. paratuberculosis
cgaacgcguucgucggcgcgu

SEQ ID NO: 2931617 - RNA, 16 nt, Mycobacterium avium subsp. paratuberculosis
cgaacgcugccaggcg

SEQ ID NO: 2931618 - RNA, 15 nt, Mycobacterium avium subsp. paratuberculosis
cgaacgcuggcggcg

SEQ ID NO: 2931619 - RNA, 16 nt, Mycobacterium avium subsp. paratuberculosis
cgaacgcuuccagcac

SEQ ID NO: 2931620 - RNA, 15 nt, Mycobacterium avium subsp. paratuberculosis
cgaacggaccgggcg

SEQ ID NO: 2931621 - RNA, 20 nt, Mycobacterium avium subsp. paratuberculosis
cgaacggcaaccugggcggc

SEQ ID NO: 2931622 - RNA, 21 nt, Mycobacterium avium subsp. paratuberculosis
cgaacggcaaccugggcggcg

SEQ ID NO: 2931623 - RNA, 15 nt, Mycobacterium avium subsp. paratuberculosis
cgaacggcaacggcg

SEQ ID NO: 2931624 - RNA, 20 nt, Mycobacterium avium subsp. paratuberculosis
cgaacggcaacggcggcggc

SEQ ID NO: 2931625 - RNA, 17 nt, Mycobacterium avium subsp. paratuberculosis
cgaacggcaccucgauc

SEQ ID NO: 2931626 - RNA, 24 nt, Mycobacterium avium subsp. paratuberculosis
cgaacggccaguccaggccgccgu

SEQ ID NO: 2931627 - RNA, 16 nt, Mycobacterium avium subsp. paratuberculosis
cgaacggcccgccgcc

SEQ ID NO: 2931628 - RNA, 17 nt, Mycobacterium avium subsp. paratuberculosis
cgaacggcccgccgccg

SEQ ID NO: 2931629 - RNA, 13 nt, Mycobacterium avium subsp. paratuberculosis
cgaacggcccgga

SEQ ID NO: 2931630 - RNA, 13 nt, Mycobacterium avium subsp. paratuberculosis
cgaacggccgcga

SEQ ID NO: 2931631 - RNA, 18 nt, Mycobacterium avium subsp. paratuberculosis
cgaacggcgcgaaccggg

SEQ ID NO: 2931632 - RNA, 18 nt, Mycobacterium avium subsp. paratuberculosis
cgaacggcgcucccgaug

SEQ ID NO: 2931633 - RNA, 16 nt, Mycobacterium avium subsp. paratuberculosis
cgaacggcggaaccgg

SEQ ID NO: 2931634 - RNA, 22 nt, Mycobacterium avium subsp. paratuberculosis
cgaacggcggaaccgggccgcu

SEQ ID NO: 2931635 - RNA, 17 nt, Mycobacterium avium subsp. paratuberculosis
cgaacggcggauccagg

SEQ ID NO: 2931636 - RNA, 17 nt, Mycobacterium avium subsp. paratuberculosis
cgaacggcgucuggccg

SEQ ID NO: 2931637 - RNA, 18 nt, Mycobacterium avium subsp. paratuberculosis
cgaacggcgucuggccgg

SEQ ID NO: 2931638 - RNA, 12 nt, Mycobacterium avium subsp. paratuberculosis
cgaacgggccgg

SEQ ID NO: 2931639 - RNA, 15 nt, Mycobacterium avium subsp. paratuberculosis
cgaacgggccgggca

SEQ ID NO: 2931640 - RNA, 17 nt, Mycobacterium avium subsp. paratuberculosis
cgaacgggccgggcacc

SEQ ID NO: 2931641 - RNA, 19 nt, Mycobacterium avium subsp. paratuberculosis
cgaacggguccuugccggc

SEQ ID NO: 2931642 - RNA, 19 nt, Mycobacterium avium subsp. paratuberculosis
cgaacgggucgagggucgc

SEQ ID NO: 2931643 - RNA, 15 nt, Mycobacterium avium subsp. paratuberculosis
cgaacgggucggcga

SEQ ID NO: 2931644 - RNA, 16 nt, Mycobacterium avium subsp. paratuberculosis
cgaacgggucggcgac

SEQ ID NO: 2931645 - RNA, 17 nt, Mycobacterium avium subsp. paratuberculosis
cgaacgggugaccggcg

SEQ ID NO: 2931646 - RNA, 18 nt, Mycobacterium avium subsp. paratuberculosis
cgaacgggugaccggcgg

SEQ ID NO: 2931647 - RNA, 20 nt, Mycobacterium avium subsp. paratuberculosis
cgaacgggugaccggcggcc

SEQ ID NO: 2931648 - RNA, 14 nt, Mycobacterium avium subsp. paratuberculosis
cgaacgggugcggc

SEQ ID NO: 2931649 - RNA, 15 nt, Mycobacterium avium subsp. paratuberculosis
cgaacgggugcggcg

SEQ ID NO: 2931650 - RNA, 20 nt, Mycobacterium avium subsp. paratuberculosis
cgaacgguucgggaaccugg

SEQ ID NO: 2931651 - RNA, 23 nt, Mycobacterium avium subsp. paratuberculosis
cgaacgguucgggaaccuggccg

SEQ ID NO: 2931652 - RNA, 15 nt, Mycobacterium avium subsp. paratuberculosis
cgaacgucaccaaca

SEQ ID NO: 2931653 - RNA, 20 nt, Mycobacterium avium subsp. paratuberculosis
cgaacgucgagcgcggcccg

SEQ ID NO: 2931654 - RNA, 15 nt, Mycobacterium avium subsp. paratuberculosis
cgaacgugauggcga

SEQ ID NO: 2931655 - RNA, 18 nt, Mycobacterium avium subsp. paratuberculosis
cgaagcccgagcgucacg

SEQ ID NO: 2931656 - RNA, 14 nt, Mycobacterium avium subsp. paratuberculosis
cgaagcccgcagcg

SEQ ID NO: 2931657 - RNA, 13 nt, Mycobacterium avium subsp. paratuberculosis
cgaagcccgccgu

SEQ ID NO: 2931658 - RNA, 19 nt, Mycobacterium avium subsp. paratuberculosis
cgaagcccgccgucacgcc

SEQ ID NO: 2931659 - RNA, 14 nt, Mycobacterium avium subsp. paratuberculosis
cgaagcccgugccg

SEQ ID NO: 2931660 - RNA, 20 nt, Mycobacterium avium subsp. paratuberculosis
cgaagcccgugccgaugccg

SEQ ID NO: 2931661 - RNA, 21 nt, Mycobacterium avium subsp. paratuberculosis
cgaagcccgugccgaugccgg

SEQ ID NO: 2931662 - RNA, 15 nt, Mycobacterium avium subsp. paratuberculosis
cgaagccgaagucgc

SEQ ID NO: 2931663 - RNA, 12 nt, Mycobacterium avium subsp. paratuberculosis
cgaagccgacac

SEQ ID NO: 2931664 - RNA, 14 nt, Mycobacterium avium subsp. paratuberculosis
cgaagccgacgucg

SEQ ID NO: 2931665 - RNA, 17 nt, Mycobacterium avium subsp. paratuberculosis
cgaagccgacgucgacc

SEQ ID NO: 2931666 - RNA, 20 nt, Mycobacterium avium subsp. paratuberculosis
cgaagccgaucaccggcgcg

SEQ ID NO: 2931667 - RNA, 14 nt, Mycobacterium avium subsp. paratuberculosis
cgaagccgaucgcg

SEQ ID NO: 2931668 - RNA, 15 nt, Mycobacterium avium subsp. paratuberculosis
cgaagccgaucgcgg

SEQ ID NO: 2931669 - RNA, 17 nt, Mycobacterium avium subsp. paratuberculosis
cgaagccgaucgcggcg

SEQ ID NO: 2931670 - RNA, 18 nt, Mycobacterium avium subsp. paratuberculosis
cgaagccgaucgcggcga

SEQ ID NO: 2931671 - RNA, 17 nt, Mycobacterium avium subsp. paratuberculosis
cgaagccgccgcccucg

SEQ ID NO: 2931672 - RNA, 21 nt, Mycobacterium avium subsp. paratuberculosis
cgaagccgccguccccgcgcg

SEQ ID NO: 2931673 - RNA, 13 nt, Mycobacterium avium subsp. paratuberculosis
cgaagccggcccc

SEQ ID NO: 2931674 - RNA, 15 nt, Mycobacterium avium subsp. paratuberculosis
cgaagccggccccgc

SEQ ID NO: 2931675 - RNA, 14 nt, Mycobacterium avium subsp. paratuberculosis
cgaagccggugccc

SEQ ID NO: 2931676 - RNA, 15 nt, Mycobacterium avium subsp. paratuberculosis
cgaagccggugccca

SEQ ID NO: 2931677 - RNA, 16 nt, Mycobacterium avium subsp. paratuberculosis
cgaagccguccaggcc

SEQ ID NO: 2931678 - RNA, 20 nt, Mycobacterium avium subsp. paratuberculosis
cgaagccguccaggccgcug

SEQ ID NO: 2931679 - RNA, 21 nt, Mycobacterium avium subsp. paratuberculosis
cgaagccguccaggccgcuga

SEQ ID NO: 2931680 - RNA, 14 nt, Mycobacterium avium subsp. paratuberculosis
cgaagccgucgacc

SEQ ID NO: 2931681 - RNA, 21 nt, Mycobacterium avium subsp. paratuberculosis
cgaagccgucgaccccgccgg

SEQ ID NO: 2931682 - RNA, 22 nt, Mycobacterium avium subsp. paratuberculosis
cgaagccguggcaggcacgagc

SEQ ID NO: 2931683 - RNA, 13 nt, Mycobacterium avium subsp. paratuberculosis
cgaagcgcagcac

SEQ ID NO: 2931684 - RNA, 15 nt, Mycobacterium avium subsp. paratuberculosis
cgaagcgcagcagcu

SEQ ID NO: 2931685 - RNA, 18 nt, Mycobacterium avium subsp. paratuberculosis
cgaagcgcagcagcucgu

SEQ ID NO: 2931686 - RNA, 14 nt, Mycobacterium avium subsp. paratuberculosis
cgaagcgccacggg

SEQ ID NO: 2931687 - RNA, 17 nt, Mycobacterium avium subsp. paratuberculosis
cgaagcgccacggggcg

SEQ ID NO: 2931688 - RNA, 18 nt, Mycobacterium avium subsp. paratuberculosis
cgaagcgccacggggcgc

SEQ ID NO: 2931689 - RNA, 20 nt, Mycobacterium avium subsp. paratuberculosis
cgaagcgccacggggcgccg

SEQ ID NO: 2931690 - RNA, 21 nt, Mycobacterium avium subsp. paratuberculosis
cgaagcgccacggggcgccgc

SEQ ID NO: 2931691 - RNA, 14 nt, Mycobacterium avium subsp. paratuberculosis
cgaagcgccgcaug

SEQ ID NO: 2931692 - RNA, 18 nt, Mycobacterium avium subsp. paratuberculosis
cgaagcgcgaugcggcuc

SEQ ID NO: 2931693 - RNA, 22 nt, Mycobacterium avium subsp. paratuberculosis
cgaagcgcgaugcggcucacca

SEQ ID NO: 2931694 - RNA, 20 nt, Mycobacterium avium subsp. paratuberculosis
cgaagcgcuaacaaaagccc

SEQ ID NO: 2931695 - RNA, 14 nt, Mycobacterium avium subsp. paratuberculosis
cgaagcggcgcacg

SEQ ID NO: 2931696 - RNA, 17 nt, Mycobacterium avium subsp. paratuberculosis
cgaagcggcgcacgcag

SEQ ID NO: 2931697 - RNA, 20 nt, Mycobacterium avium subsp. paratuberculosis
cgaagcgggcggcgaacacc

SEQ ID NO: 2931698 - RNA, 19 nt, Mycobacterium avium subsp. paratuberculosis
cgaagcgggucggggagcc

SEQ ID NO: 2931699 - RNA, 15 nt, Mycobacterium avium subsp. paratuberculosis
cgaagcggucgcgga

SEQ ID NO: 2931700 - RNA, 15 nt, Mycobacterium avium subsp. paratuberculosis
cgaagcggugcacca

SEQ ID NO: 2931701 - RNA, 18 nt, Mycobacterium avium subsp. paratuberculosis
cgaagcggugcaccaccg

SEQ ID NO: 2931702 - RNA, 19 nt, Mycobacterium avium subsp. paratuberculosis
cgaagcggugcaccaccgu

SEQ ID NO: 2931703 - RNA, 21 nt, Mycobacterium avium subsp. paratuberculosis
cgaagcguaugccgguggcgu

SEQ ID NO: 2931704 - RNA, 18 nt, Mycobacterium avium subsp. paratuberculosis
cgaagcguuccgccgucc

SEQ ID NO: 2931705 - RNA, 18 nt, Mycobacterium avium subsp. paratuberculosis
cgaagcguuucagcaacc

SEQ ID NO: 2931706 - RNA, 19 nt, Mycobacterium avium subsp. paratuberculosis
cgaagcguuucagcaaccc

SEQ ID NO: 2931707 - RNA, 16 nt, Mycobacterium avium subsp. paratuberculosis
cgaagcucaucaccgg

SEQ ID NO: 2931708 - RNA, 15 nt, Mycobacterium avium subsp. paratuberculosis
cgaagcuggcgaaca

SEQ ID NO: 2931709 - RNA, 18 nt, Mycobacterium avium subsp. paratuberculosis
cgaagcuggcgaacagca

SEQ ID NO: 2931710 - RNA, 15 nt, Mycobacterium avium subsp. paratuberculosis
cgaagcugucgccga

SEQ ID NO: 2931711 - RNA, 21 nt, Mycobacterium avium subsp. paratuberculosis
cgaaggacaauucguuguagc

SEQ ID NO: 2931712 - RNA, 14 nt, Mycobacterium avium subsp. paratuberculosis
cgaaggaggccagc

SEQ ID NO: 2931713 - RNA, 21 nt, Mycobacterium avium subsp. paratuberculosis
cgaaggcaacucgcgaggccg

SEQ ID NO: 2931714 - RNA, 19 nt, Mycobacterium avium subsp. paratuberculosis
cgaaggcaugggcgugccg

SEQ ID NO: 2931715 - RNA, 19 nt, Mycobacterium avium subsp. paratuberculosis
cgaaggccaggugcacgcc

SEQ ID NO: 2931716 - RNA, 16 nt, Mycobacterium avium subsp. paratuberculosis
cgaaggccccggucaa

SEQ ID NO: 2931717 - RNA, 12 nt, Mycobacterium avium subsp. paratuberculosis
cgaaggccgccg

SEQ ID NO: 2931718 - RNA, 14 nt, Mycobacterium avium subsp. paratuberculosis
cgaaggccgggcug

SEQ ID NO: 2931719 - RNA, 15 nt, Mycobacterium avium subsp. paratuberculosis
cgaaggccgggcugg

SEQ ID NO: 2931720 - RNA, 12 nt, Mycobacterium avium subsp. paratuberculosis
cgaaggccgggg

SEQ ID NO: 2931721 - RNA, 15 nt, Mycobacterium avium subsp. paratuberculosis
cgaaggccggggugu

SEQ ID NO: 2931722 - RNA, 13 nt, Mycobacterium avium subsp. paratuberculosis
cgaaggcgcgcag

SEQ ID NO: 2931723 - RNA, 12 nt, Mycobacterium avium subsp. paratuberculosis
cgaaggcggccg

SEQ ID NO: 2931724 - RNA, 12 nt, Mycobacterium avium subsp. paratuberculosis
cgaaggcggcgc

SEQ ID NO: 2931725 - RNA, 14 nt, Mycobacterium avium subsp. paratuberculosis
cgaaggcggcgccg

SEQ ID NO: 2931726 - RNA, 22 nt, Mycobacterium avium subsp. paratuberculosis
cgaaggcggcgucgaugucgcc

SEQ ID NO: 2931727 - RNA, 23 nt, Mycobacterium avium subsp. paratuberculosis
cgaaggcguuggagccgaccagc

SEQ ID NO: 2931728 - RNA, 18 nt, Mycobacterium avium subsp. paratuberculosis
cgaagggaaaggcagcag

SEQ ID NO: 2931729 - RNA, 21 nt, Mycobacterium avium subsp. paratuberculosis
cgaagggaaaggcagcagcca

SEQ ID NO: 2931730 - RNA, 17 nt, Mycobacterium avium subsp. paratuberculosis
cgaagggcgccagcacc

SEQ ID NO: 2931731 - RNA, 18 nt, Mycobacterium avium subsp. paratuberculosis
cgaagggcgccagcaccu

SEQ ID NO: 2931732 - RNA, 21 nt, Mycobacterium avium subsp. paratuberculosis
cgaaggucugaaaugccgggc

SEQ ID NO: 2931733 - RNA, 12 nt, Mycobacterium avium subsp. paratuberculosis
cgaaggugaucu

SEQ ID NO: 2931734 - RNA, 17 nt, Mycobacterium avium subsp. paratuberculosis
cgaaggugaucuuguug

SEQ ID NO: 2931735 - RNA, 16 nt, Mycobacterium avium subsp. paratuberculosis
cgaaggugcccgcauc

SEQ ID NO: 2931736 - RNA, 14 nt, Mycobacterium avium subsp. paratuberculosis
cgaaggugccgcga

SEQ ID NO: 2931737 - RNA, 13 nt, Mycobacterium avium subsp. paratuberculosis
cgaagguggcacg

SEQ ID NO: 2931738 - RNA, 14 nt, Mycobacterium avium subsp. paratuberculosis
cgaagguggcgccg

SEQ ID NO: 2931739 - RNA, 16 nt, Mycobacterium avium subsp. paratuberculosis
cgaagguggcgccggu

SEQ ID NO: 2931740 - RNA, 17 nt, Mycobacterium avium subsp. paratuberculosis
cgaaugagacgacccga

SEQ ID NO: 2931741 - RNA, 13 nt, Mycobacterium avium subsp. paratuberculosis
cgaaugcagcggc

SEQ ID NO: 2931742 - RNA, 11 nt, Mycobacterium avium subsp. paratuberculosis
cgaaugcggcc

SEQ ID NO: 2931743 - RNA, 12 nt, Mycobacterium avium subsp. paratuberculosis
cgaaugcggcca

SEQ ID NO: 2931744 - RNA, 14 nt, Mycobacterium avium subsp. paratuberculosis
cgaaugcggcugcc

SEQ ID NO: 2931745 - RNA, 20 nt, Mycobacterium avium subsp. paratuberculosis
cgaauggcaauacgccucgc

SEQ ID NO: 2931746 - RNA, 16 nt, Mycobacterium avium subsp. paratuberculosis
cgaaugucgaccaccg

SEQ ID NO: 2931747 - RNA, 22 nt, Mycobacterium avium subsp. paratuberculosis
cgaaugucucgaugacauggau

SEQ ID NO: 2931748 - RNA, 22 nt, Mycobacterium avium subsp. paratuberculosis
cgaauuccuugcggaugcgggc

SEQ ID NO: 2931749 - RNA, 23 nt, Mycobacterium avium subsp. paratuberculosis
cgaauucggcgaugaacgggaug

SEQ ID NO: 2931750 - RNA, 20 nt, Mycobacterium avium subsp. paratuberculosis
cgaauugccgguggugcggc

SEQ ID NO: 2931751 - RNA, 18 nt, Mycobacterium avium subsp. paratuberculosis
cgaauugcgcugcaccgc

SEQ ID NO: 2931752 - RNA, 16 nt, Mycobacterium avium subsp. paratuberculosis
cgaauuguggcggccc

SEQ ID NO: 2931753 - RNA, 14 nt, Mycobacterium avium subsp. paratuberculosis
cgaauuguucggcc

SEQ ID NO: 2931754 - RNA, 19 nt, Mycobacterium avium subsp. paratuberculosis
cgaauuguucggccaccgc

SEQ ID NO: 2931755 - RNA, 22 nt, Mycobacterium avium subsp. paratuberculosis
cgaauuguucggccaccgcgcg

SEQ ID NO: 2931756 - RNA, 16 nt, Mycobacterium avium subsp. paratuberculosis
cgacaacagcacgaac

SEQ ID NO: 2931757 - RNA, 14 nt, Mycobacterium avium subsp. paratuberculosis
cgacaacagcgccg

SEQ ID NO: 2931758 - RNA, 14 nt, Mycobacterium avium subsp. paratuberculosis
cgacaacagugccu

SEQ ID NO: 2931759 - RNA, 22 nt, Mycobacterium avium subsp. paratuberculosis
cgacaacauccgcgacgacacc

SEQ ID NO: 2931760 - RNA, 17 nt, Mycobacterium avium subsp. paratuberculosis
cgacaacgacagcaccc

SEQ ID NO: 2931761 - RNA, 22 nt, Mycobacterium avium subsp. paratuberculosis
cgacaagggccgggcgcuggcc

SEQ ID NO: 2931762 - RNA, 22 nt, Mycobacterium avium subsp. paratuberculosis
cgacaaggucgaccgcgcaccg

SEQ ID NO: 2931763 - RNA, 23 nt, Mycobacterium avium subsp. paratuberculosis
cgacaaggucgaccgcgcaccgg

SEQ ID NO: 2931764 - RNA, 17 nt, Mycobacterium avium subsp. paratuberculosis
cgacaaucucgggcacc

SEQ ID NO: 2931765 - RNA, 16 nt, Mycobacterium avium subsp. paratuberculosis
cgacaccaccggccgc

SEQ ID NO: 2931766 - RNA, 22 nt, Mycobacterium avium subsp. paratuberculosis
cgacaccaccggccgcccggcg

SEQ ID NO: 2931767 - RNA, 23 nt, Mycobacterium avium subsp. paratuberculosis
cgacaccaccggccgcccggcga

SEQ ID NO: 2931768 - RNA, 21 nt, Mycobacterium avium subsp. paratuberculosis
cgacaccaccgugcuggccac

SEQ ID NO: 2931769 - RNA, 23 nt, Mycobacterium avium subsp. paratuberculosis
cgacaccaccgugcuggccacca

SEQ ID NO: 2931770 - RNA, 18 nt, Mycobacterium avium subsp. paratuberculosis
cgacaccacggucgccgc

SEQ ID NO: 2931771 - RNA, 22 nt, Mycobacterium avium subsp. paratuberculosis
cgacaccacggucgccgcgccg

SEQ ID NO: 2931772 - RNA, 14 nt, Mycobacterium avium subsp. paratuberculosis
cgacaccagcgcgc

SEQ ID NO: 2931773 - RNA, 20 nt, Mycobacterium avium subsp. paratuberculosis
cgacaccagggugcgcacga

SEQ ID NO: 2931774 - RNA, 16 nt, Mycobacterium avium subsp. paratuberculosis
cgacaccaggucgagg

SEQ ID NO: 2931775 - RNA, 19 nt, Mycobacterium avium subsp. paratuberculosis
cgacaccaggucgaggucc

SEQ ID NO: 2931776 - RNA, 15 nt, Mycobacterium avium subsp. paratuberculosis
cgacacccagcggcg

SEQ ID NO: 2931777 - RNA, 18 nt, Mycobacterium avium subsp. paratuberculosis
cgacacccagcggcgcgg

SEQ ID NO: 2931778 - RNA, 17 nt, Mycobacterium avium subsp. paratuberculosis
cgacaccccacaccguc

SEQ ID NO: 2931779 - RNA, 22 nt, Mycobacterium avium subsp. paratuberculosis
cgacaccccacaccguccgacc

SEQ ID NO: 2931780 - RNA, 22 nt, Mycobacterium avium subsp. paratuberculosis
cgacaccccgcgagucaccggc

SEQ ID NO: 2931781 - RNA, 15 nt, Mycobacterium avium subsp. paratuberculosis
cgacaccccgcucgg

SEQ ID NO: 2931782 - RNA, 21 nt, Mycobacterium avium subsp. paratuberculosis
cgacacccuucaucagcaccg

SEQ ID NO: 2931783 - RNA, 22 nt, Mycobacterium avium subsp. paratuberculosis
cgacacccuucaucagcaccgc

SEQ ID NO: 2931784 - RNA, 14 nt, Mycobacterium avium subsp. paratuberculosis
cgacaccgaaccca

SEQ ID NO: 2931785 - RNA, 20 nt, Mycobacterium avium subsp. paratuberculosis
cgacaccgaacccaccagcg

SEQ ID NO: 2931786 - RNA, 14 nt, Mycobacterium avium subsp. paratuberculosis
cgacaccgacgacc

SEQ ID NO: 2931787 - RNA, 18 nt, Mycobacterium avium subsp. paratuberculosis
cgacaccgcacggcccau

SEQ ID NO: 2931788 - RNA, 19 nt, Mycobacterium avium subsp. paratuberculosis
cgacaccgcacggcccauc

SEQ ID NO: 2931789 - RNA, 18 nt, Mycobacterium avium subsp. paratuberculosis
cgacaccgccagcagcgc

SEQ ID NO: 2931790 - RNA, 21 nt, Mycobacterium avium subsp. paratuberculosis
cgacaccgccagcagcgccgc

SEQ ID NO: 2931791 - RNA, 16 nt, Mycobacterium avium subsp. paratuberculosis
cgacaccgccccgccg

SEQ ID NO: 2931792 - RNA, 20 nt, Mycobacterium avium subsp. paratuberculosis
cgacaccgccccgccgcgcc

SEQ ID NO: 2931793 - RNA, 23 nt, Mycobacterium avium subsp. paratuberculosis
cgacaccgccccgccgcgccggg

SEQ ID NO: 2931794 - RNA, 20 nt, Mycobacterium avium subsp. paratuberculosis
cgacaccgccuucgacggcc

SEQ ID NO: 2931795 - RNA, 22 nt, Mycobacterium avium subsp. paratuberculosis
cgacaccgccuucgacggccgg

SEQ ID NO: 2931796 - RNA, 19 nt, Mycobacterium avium subsp. paratuberculosis
cgacaccgcggcgacgucg

SEQ ID NO: 2931797 - RNA, 14 nt, Mycobacterium avium subsp. paratuberculosis
cgacaccggcgguc

SEQ ID NO: 2931798 - RNA, 15 nt, Mycobacterium avium subsp. paratuberculosis
cgacaccggcgguca

SEQ ID NO: 2931799 - RNA, 18 nt, Mycobacterium avium subsp. paratuberculosis
cgacaccgggucccccgc

SEQ ID NO: 2931800 - RNA, 15 nt, Mycobacterium avium subsp. paratuberculosis
cgacaccgguggcgu

SEQ ID NO: 2931801 - RNA, 21 nt, Mycobacterium avium subsp. paratuberculosis
cgacaccgguggcguugcggg

SEQ ID NO: 2931802 - RNA, 14 nt, Mycobacterium avium subsp. paratuberculosis
cgacaccgucgccg

SEQ ID NO: 2931803 - RNA, 17 nt, Mycobacterium avium subsp. paratuberculosis
cgacaccgugguggcgg

SEQ ID NO: 2931804 - RNA, 20 nt, Mycobacterium avium subsp. paratuberculosis
cgacaccgugguggcggcga

SEQ ID NO: 2931805 - RNA, 16 nt, Mycobacterium avium subsp. paratuberculosis
cgacaccucgccgucc

SEQ ID NO: 2931806 - RNA, 16 nt, Mycobacterium avium subsp. paratuberculosis
cgacacgaucggcaug

SEQ ID NO: 2931807 - RNA, 15 nt, Mycobacterium avium subsp. paratuberculosis
cgacacgauguugau

SEQ ID NO: 2931808 - RNA, 14 nt, Mycobacterium avium subsp. paratuberculosis
cgacacgccgacga

SEQ ID NO: 2931809 - RNA, 23 nt, Mycobacterium avium subsp. paratuberculosis
cgacacgccgacgauccgcgccg

SEQ ID NO: 2931810 - RNA, 14 nt, Mycobacterium avium subsp. paratuberculosis
cgacacgccggccg

SEQ ID NO: 2931811 - RNA, 15 nt, Mycobacterium avium subsp. paratuberculosis
cgacacgccggccgu

SEQ ID NO: 2931812 - RNA, 22 nt, Mycobacterium avium subsp. paratuberculosis
cgacacggaaaccgcugcggca

SEQ ID NO: 2931813 - RNA, 18 nt, Mycobacterium avium subsp. paratuberculosis
cgacacgggccgcgccga

SEQ ID NO: 2931814 - RNA, 18 nt, Mycobacterium avium subsp. paratuberculosis
cgacacguaggccgccug

SEQ ID NO: 2931815 - RNA, 18 nt, Mycobacterium avium subsp. paratuberculosis
cgacacguccagcucucg

SEQ ID NO: 2931816 - RNA, 13 nt, Mycobacterium avium subsp. paratuberculosis
cgacacgucgaca

SEQ ID NO: 2931817 - RNA, 16 nt, Mycobacterium avium subsp. paratuberculosis
cgacacgucgacacgc

SEQ ID NO: 2931818 - RNA, 22 nt, Mycobacterium avium subsp. paratuberculosis
cgacacgucgacacgccggccg

SEQ ID NO: 2931819 - RNA, 19 nt, Mycobacterium avium subsp. paratuberculosis
cgacacguggaccgagcgc

SEQ ID NO: 2931820 - RNA, 20 nt, Mycobacterium avium subsp. paratuberculosis
cgacacguggaccgagcgcg

SEQ ID NO: 2931821 - RNA, 21 nt, Mycobacterium avium subsp. paratuberculosis
cgacacguggaccgagcgcgc

SEQ ID NO: 2931822 - RNA, 19 nt, Mycobacterium avium subsp. paratuberculosis
cgacacugcaacuacgcac

SEQ ID NO: 2931823 - RNA, 21 nt, Mycobacterium avium subsp. paratuberculosis
cgacagaaaagagaucgcccc

SEQ ID NO: 2931824 - RNA, 22 nt, Mycobacterium avium subsp. paratuberculosis
cgacagucgcgggcggggcgcc

SEQ ID NO: 2931825 - RNA, 23 nt, Mycobacterium avium subsp. paratuberculosis
cgacaguuuaccgugccucgcca

SEQ ID NO: 2931826 - RNA, 15 nt, Mycobacterium avium subsp. paratuberculosis
cgacauaggucaggu

SEQ ID NO: 2931827 - RNA, 22 nt, Mycobacterium avium subsp. paratuberculosis
cgacaucaccaccgccggggug

SEQ ID NO: 2931828 - RNA, 16 nt, Mycobacterium avium subsp. paratuberculosis
cgacaucacgaacgcg

SEQ ID NO: 2931829 - RNA, 17 nt, Mycobacterium avium subsp. paratuberculosis
cgacaucagaucgccga

SEQ ID NO: 2931830 - RNA, 17 nt, Mycobacterium avium subsp. paratuberculosis
cgacaucagugcgggca

SEQ ID NO: 2931831 - RNA, 20 nt, Mycobacterium avium subsp. paratuberculosis
cgacauccagaugcccagca

SEQ ID NO: 2931832 - RNA, 22 nt, Mycobacterium avium subsp. paratuberculosis
cgacauccagaugcccagcagg

SEQ ID NO: 2931833 - RNA, 19 nt, Mycobacterium avium subsp. paratuberculosis
cgacauccaggaccgcgcg

SEQ ID NO: 2931834 - RNA, 21 nt, Mycobacterium avium subsp. paratuberculosis
cgacauccaggaccgcgcgcc

SEQ ID NO: 2931835 - RNA, 22 nt, Mycobacterium avium subsp. paratuberculosis
cgacauccaggaccgcgcgccg

SEQ ID NO: 2931836 - RNA, 23 nt, Mycobacterium avium subsp. paratuberculosis
cgacauccaggaccgcgcgccgg

SEQ ID NO: 2931837 - RNA, 16 nt, Mycobacterium avium subsp. paratuberculosis
cgacauccugcgcauc

SEQ ID NO: 2931838 - RNA, 17 nt, Mycobacterium avium subsp. paratuberculosis
cgacauccugcgcaucg

SEQ ID NO: 2931839 - RNA, 18 nt, Mycobacterium avium subsp. paratuberculosis
cgacaucgaugcgaucga

SEQ ID NO: 2931840 - RNA, 21 nt, Mycobacterium avium subsp. paratuberculosis
cgacaucgccaucagcagcgc

SEQ ID NO: 2931841 - RNA, 17 nt, Mycobacterium avium subsp. paratuberculosis
cgacaucgccgcggccg

SEQ ID NO: 2931842 - RNA, 19 nt, Mycobacterium avium subsp. paratuberculosis
cgacaucgccgcggccgga

SEQ ID NO: 2931843 - RNA, 16 nt, Mycobacterium avium subsp. paratuberculosis
cgacaucgccggcgac

SEQ ID NO: 2931844 - RNA, 17 nt, Mycobacterium avium subsp. paratuberculosis
cgacaucgccggcgacc

SEQ ID NO: 2931845 - RNA, 16 nt, Mycobacterium avium subsp. paratuberculosis
cgacaucgcggcgauc

SEQ ID NO: 2931846 - RNA, 13 nt, Mycobacterium avium subsp. paratuberculosis
cgacaucggccgc

SEQ ID NO: 2931847 - RNA, 15 nt, Mycobacterium avium subsp. paratuberculosis
cgacaucggccgccu

SEQ ID NO: 2931848 - RNA, 16 nt, Mycobacterium avium subsp. paratuberculosis
cgacaucggccgccuu

SEQ ID NO: 2931849 - RNA, 13 nt, Mycobacterium avium subsp. paratuberculosis
cgacaucggcgcc

SEQ ID NO: 2931850 - RNA, 14 nt, Mycobacterium avium subsp. paratuberculosis
cgacaucggcgccg

SEQ ID NO: 2931851 - RNA, 23 nt, Mycobacterium avium subsp. paratuberculosis
cgacaucggugaccgucgccgac

SEQ ID NO: 2931852 - RNA, 15 nt, Mycobacterium avium subsp. paratuberculosis
cgacaucucgacggu

SEQ ID NO: 2931853 - RNA, 14 nt, Mycobacterium avium subsp. paratuberculosis
cgacaucugccggg

SEQ ID NO: 2931854 - RNA, 15 nt, Mycobacterium avium subsp. paratuberculosis
cgacaucugccgggc

SEQ ID NO: 2931855 - RNA, 16 nt, Mycobacterium avium subsp. paratuberculosis
cgacaucugccgggcg

SEQ ID NO: 2931856 - RNA, 17 nt, Mycobacterium avium subsp. paratuberculosis
cgacaucugccgggcgg

SEQ ID NO: 2931857 - RNA, 20 nt, Mycobacterium avium subsp. paratuberculosis
cgacaucugccgggcggcga

SEQ ID NO: 2931858 - RNA, 19 nt, Mycobacterium avium subsp. paratuberculosis
cgacaugaccaccgcgucg

SEQ ID NO: 2931859 - RNA, 13 nt, Mycobacterium avium subsp. paratuberculosis
cgacaugcccgcg

SEQ ID NO: 2931860 - RNA, 17 nt, Mycobacterium avium subsp. paratuberculosis
cgacaugcccgcggugc

SEQ ID NO: 2931861 - RNA, 17 nt, Mycobacterium avium subsp. paratuberculosis
cgacaugcgcagcgccc

SEQ ID NO: 2931862 - RNA, 13 nt, Mycobacterium avium subsp. paratuberculosis
cgacaugcugggc

SEQ ID NO: 2931863 - RNA, 22 nt, Mycobacterium avium subsp. paratuberculosis
cgacaugcugggcuaccagccc

SEQ ID NO: 2931864 - RNA, 23 nt, Mycobacterium avium subsp. paratuberculosis
cgacaugcuguuccagacgucgg

SEQ ID NO: 2931865 - RNA, 14 nt, Mycobacterium avium subsp. paratuberculosis
cgacauggacgcgg

SEQ ID NO: 2931866 - RNA, 16 nt, Mycobacterium avium subsp. paratuberculosis
cgacauggacgcggcc

SEQ ID NO: 2931867 - RNA, 19 nt, Mycobacterium avium subsp. paratuberculosis
cgacauggacgcggccuca

SEQ ID NO: 2931868 - RNA, 16 nt, Mycobacterium avium subsp. paratuberculosis
cgacauggccagcacc

SEQ ID NO: 2931869 - RNA, 18 nt, Mycobacterium avium subsp. paratuberculosis
cgacaugucgccgggcgg

SEQ ID NO: 2931870 - RNA, 12 nt, Mycobacterium avium subsp. paratuberculosis
cgacauuggccg

SEQ ID NO: 2931871 - RNA, 14 nt, Mycobacterium avium subsp. paratuberculosis
cgacauuggccgcg

SEQ ID NO: 2931872 - RNA, 18 nt, Mycobacterium avium subsp. paratuberculosis
cgacauuggccgcgcgca

SEQ ID NO: 2931873 - RNA, 19 nt, Mycobacterium avium subsp. paratuberculosis
cgacauuggccgcgcgcag

SEQ ID NO: 2931874 - RNA, 21 nt, Mycobacterium avium subsp. paratuberculosis
cgaccaacacccccgcgcugc

SEQ ID NO: 2931875 - RNA, 13 nt, Mycobacterium avium subsp. paratuberculosis
cgaccaacgccau

SEQ ID NO: 2931876 - RNA, 18 nt, Mycobacterium avium subsp. paratuberculosis
cgaccaacgccaugggca

SEQ ID NO: 2931877 - RNA, 14 nt, Mycobacterium avium subsp. paratuberculosis
cgaccaacgggcgg

SEQ ID NO: 2931878 - RNA, 15 nt, Mycobacterium avium subsp. paratuberculosis
cgaccaacgggcggc

SEQ ID NO: 2931879 - RNA, 14 nt, Mycobacterium avium subsp. paratuberculosis
cgaccaaugcccug

SEQ ID NO: 2931880 - RNA, 18 nt, Mycobacterium avium subsp. paratuberculosis
cgaccaaugcccugaccc

SEQ ID NO: 2931881 - RNA, 21 nt, Mycobacterium avium subsp. paratuberculosis
cgaccaaugcccugaccccgg

SEQ ID NO: 2931882 - RNA, 17 nt, Mycobacterium avium subsp. paratuberculosis
cgaccaauugcgagcag

SEQ ID NO: 2931883 - RNA, 20 nt, Mycobacterium avium subsp. paratuberculosis
cgaccaauugcgagcaggcc

SEQ ID NO: 2931884 - RNA, 14 nt, Mycobacterium avium subsp. paratuberculosis
cgaccacacccgca

SEQ ID NO: 2931885 - RNA, 14 nt, Mycobacterium avium subsp. paratuberculosis
cgaccacaccgccg

SEQ ID NO: 2931886 - RNA, 13 nt, Mycobacterium avium subsp. paratuberculosis
cgaccacaccggc

SEQ ID NO: 2931887 - RNA, 16 nt, Mycobacterium avium subsp. paratuberculosis
cgaccacaccggcgcu

SEQ ID NO: 2931888 - RNA, 19 nt, Mycobacterium avium subsp. paratuberculosis
cgaccacaccgucgacgac

SEQ ID NO: 2931889 - RNA, 22 nt, Mycobacterium avium subsp. paratuberculosis
cgaccacaugccguugccaggc

SEQ ID NO: 2931890 - RNA, 15 nt, Mycobacterium avium subsp. paratuberculosis
cgaccaccaccgccc

SEQ ID NO: 2931891 - RNA, 20 nt, Mycobacterium avium subsp. paratuberculosis
cgaccaccacgaccagugcc

SEQ ID NO: 2931892 - RNA, 13 nt, Mycobacterium avium subsp. paratuberculosis
cgaccaccacggc

SEQ ID NO: 2931893 - RNA, 16 nt, Mycobacterium avium subsp. paratuberculosis
cgaccaccacggccgc

SEQ ID NO: 2931894 - RNA, 18 nt, Mycobacterium avium subsp. paratuberculosis
cgaccaccacggccgcag

SEQ ID NO: 2931895 - RNA, 20 nt, Mycobacterium avium subsp. paratuberculosis
cgaccaccacggccgcagcg

SEQ ID NO: 2931896 - RNA, 16 nt, Mycobacterium avium subsp. paratuberculosis
cgaccaccagccgcag

SEQ ID NO: 2931897 - RNA, 21 nt, Mycobacterium avium subsp. paratuberculosis
cgaccaccaggagcaccugcg

SEQ ID NO: 2931898 - RNA, 23 nt, Mycobacterium avium subsp. paratuberculosis
cgaccaccaggagcaccugcgcg

SEQ ID NO: 2931899 - RNA, 14 nt, Mycobacterium avium subsp. paratuberculosis
cgaccacccccagc

SEQ ID NO: 2931900 - RNA, 17 nt, Mycobacterium avium subsp. paratuberculosis
cgaccacccccagcccg

SEQ ID NO: 2931901 - RNA, 18 nt, Mycobacterium avium subsp. paratuberculosis
cgaccacccccagcccgc

SEQ ID NO: 2931902 - RNA, 14 nt, Mycobacterium avium subsp. paratuberculosis
cgaccacccgcagc

SEQ ID NO: 2931903 - RNA, 20 nt, Mycobacterium avium subsp. paratuberculosis
cgaccacccgcagcucgccg

SEQ ID NO: 2931904 - RNA, 23 nt, Mycobacterium avium subsp. paratuberculosis
cgaccacccgcagcucgccggug

SEQ ID NO: 2931905 - RNA, 15 nt, Mycobacterium avium subsp. paratuberculosis
cgaccacccgcuggu

SEQ ID NO: 2931906 - RNA, 13 nt, Mycobacterium avium subsp. paratuberculosis
cgaccacccggcg

SEQ ID NO: 2931907 - RNA, 14 nt, Mycobacterium avium subsp. paratuberculosis
cgaccacccggcgg

SEQ ID NO: 2931908 - RNA, 17 nt, Mycobacterium avium subsp. paratuberculosis
cgaccacccucaccacg

SEQ ID NO: 2931909 - RNA, 17 nt, Mycobacterium avium subsp. paratuberculosis
cgaccagcgggcugucg

SEQ ID NO: 2931910 - RNA, 20 nt, Mycobacterium avium subsp. paratuberculosis
cgaccagcgggcugucggcg

SEQ ID NO: 2931911 - RNA, 11 nt, Mycobacterium avium subsp. paratuberculosis
cgaccagcggu

SEQ ID NO: 2931912 - RNA, 14 nt, Mycobacterium avium subsp. paratuberculosis
cgaccagcuccugg

SEQ ID NO: 2931913 - RNA, 20 nt, Mycobacterium avium subsp. paratuberculosis
cgaccagcugauuguugacg

SEQ ID NO: 2931914 - RNA, 20 nt, Mycobacterium avium subsp. paratuberculosis
cgaccagcuguugucccgga

SEQ ID NO: 2931915 - RNA, 20 nt, Mycobacterium avium subsp. paratuberculosis
cgaccaggaacacggcucgg

SEQ ID NO: 2931916 - RNA, 21 nt, Mycobacterium avium subsp. paratuberculosis
cgaccaggaacacggcucggg

SEQ ID NO: 2931917 - RNA, 21 nt, Mycobacterium avium subsp. paratuberculosis
cgaccaggaaguacaccaccg

SEQ ID NO: 2931918 - RNA, 21 nt, Mycobacterium avium subsp. paratuberculosis
cgaccaggaaguacucgguca

SEQ ID NO: 2931919 - RNA, 19 nt, Mycobacterium avium subsp. paratuberculosis
cgaccaggacgucggccgg

SEQ ID NO: 2931920 - RNA, 20 nt, Mycobacterium avium subsp. paratuberculosis
cgaccaggacgucggccggc

SEQ ID NO: 2931921 - RNA, 16 nt, Mycobacterium avium subsp. paratuberculosis
cgaccaggaucgggau

SEQ ID NO: 2931922 - RNA, 22 nt, Mycobacterium avium subsp. paratuberculosis
cgaccaggaucgggaucggcuu

SEQ ID NO: 2931923 - RNA, 18 nt, Mycobacterium avium subsp. paratuberculosis
cgaccaggaugcccagga

SEQ ID NO: 2931924 - RNA, 21 nt, Mycobacterium avium subsp. paratuberculosis
cgaccaggaugcccaggauga

SEQ ID NO: 2931925 - RNA, 14 nt, Mycobacterium avium subsp. paratuberculosis
cgaccaggcccagc

SEQ ID NO: 2931926 - RNA, 16 nt, Mycobacterium avium subsp. paratuberculosis
cgaccaggcccagcgg

SEQ ID NO: 2931927 - RNA, 20 nt, Mycobacterium avium subsp. paratuberculosis
cgaccaggcccagcggaucg

SEQ ID NO: 2931928 - RNA, 23 nt, Mycobacterium avium subsp. paratuberculosis
cgaccaggccguuguccgucgaa

SEQ ID NO: 2931929 - RNA, 18 nt, Mycobacterium avium subsp. paratuberculosis
cgaccaggcucacgcugc

SEQ ID NO: 2931930 - RNA, 20 nt, Mycobacterium avium subsp. paratuberculosis
cgaccaggcucgcgagggcg

SEQ ID NO: 2931931 - RNA, 16 nt, Mycobacterium avium subsp. paratuberculosis
cgaccaggcuuggccc

SEQ ID NO: 2931932 - RNA, 17 nt, Mycobacterium avium subsp. paratuberculosis
cgaccaggcuuggcccg

SEQ ID NO: 2931933 - RNA, 21 nt, Mycobacterium avium subsp. paratuberculosis
cgaccaggcuuggcccgccgc

SEQ ID NO: 2931934 - RNA, 22 nt, Mycobacterium avium subsp. paratuberculosis
cgaccaggcuuggcccgccgcc

SEQ ID NO: 2931935 - RNA, 23 nt, Mycobacterium avium subsp. paratuberculosis
cgaccaggcuuggcccgccgccg

SEQ ID NO: 2931936 - RNA, 24 nt, Mycobacterium avium subsp. paratuberculosis
cgaccaggcuuggcccgccgccgg

SEQ ID NO: 2931937 - RNA, 14 nt, Mycobacterium avium subsp. paratuberculosis
cgaccagggcgauc

SEQ ID NO: 2931938 - RNA, 17 nt, Mycobacterium avium subsp. paratuberculosis
cgaccagggcgaucacc

SEQ ID NO: 2931939 - RNA, 23 nt, Mycobacterium avium subsp. paratuberculosis
cgaccaggguuucaugcacggcg

SEQ ID NO: 2931940 - RNA, 17 nt, Mycobacterium avium subsp. paratuberculosis
cgaccagguagcgcugc

SEQ ID NO: 2931941 - RNA, 18 nt, Mycobacterium avium subsp. paratuberculosis
cgaccagguagcgcugca

SEQ ID NO: 2931942 - RNA, 19 nt, Mycobacterium avium subsp. paratuberculosis
cgaccagguaggcgcccug

SEQ ID NO: 2931943 - RNA, 21 nt, Mycobacterium avium subsp. paratuberculosis
cgaccagguccaccccgccaa

SEQ ID NO: 2931944 - RNA, 23 nt, Mycobacterium avium subsp. paratuberculosis
cgaccagguccgguucgaccggc

SEQ ID NO: 2931945 - RNA, 20 nt, Mycobacterium avium subsp. paratuberculosis
cgaccaguagaaguggccga

SEQ ID NO: 2931946 - RNA, 22 nt, Mycobacterium avium subsp. paratuberculosis
cgaccaguagaaguggccgacc

SEQ ID NO: 2931947 - RNA, 20 nt, Mycobacterium avium subsp. paratuberculosis
cgaccaguaggccagcaucu

SEQ ID NO: 2931948 - RNA, 13 nt, Mycobacterium avium subsp. paratuberculosis
cgaccagucggcg

SEQ ID NO: 2931949 - RNA, 15 nt, Mycobacterium avium subsp. paratuberculosis
cgaccagucggcguc

SEQ ID NO: 2931950 - RNA, 19 nt, Mycobacterium avium subsp. paratuberculosis
cgaccagugcaccucgacg

SEQ ID NO: 2931951 - RNA, 16 nt, Mycobacterium avium subsp. paratuberculosis
cgaccagugcccggcc

SEQ ID NO: 2931952 - RNA, 18 nt, Mycobacterium avium subsp. paratuberculosis
cgaccagugcccggccaa

SEQ ID NO: 2931953 - RNA, 18 nt, Mycobacterium avium subsp. paratuberculosis
cgaccaguuccacaccga

SEQ ID NO: 2931954 - RNA, 21 nt, Mycobacterium avium subsp. paratuberculosis
cgaccaguucgcccuggccgc

SEQ ID NO: 2931955 - RNA, 17 nt, Mycobacterium avium subsp. paratuberculosis
cgaccaguucggccacc

SEQ ID NO: 2931956 - RNA, 20 nt, Mycobacterium avium subsp. paratuberculosis
cgaccaguucuucgaugacg

SEQ ID NO: 2931957 - RNA, 21 nt, Mycobacterium avium subsp. paratuberculosis
cgaccaguucuucgaugacgg

SEQ ID NO: 2931958 - RNA, 15 nt, Mycobacterium avium subsp. paratuberculosis
cgaccaucagcccgg

SEQ ID NO: 2931959 - RNA, 15 nt, Mycobacterium avium subsp. paratuberculosis
cgaccaucagcgccc

SEQ ID NO: 2931960 - RNA, 17 nt, Mycobacterium avium subsp. paratuberculosis
cgaccaucauggccucc

SEQ ID NO: 2931961 - RNA, 19 nt, Mycobacterium avium subsp. paratuberculosis
cgaccauccacucgggcca

SEQ ID NO: 2931962 - RNA, 13 nt, Mycobacterium avium subsp. paratuberculosis
cgaccaucugccg

SEQ ID NO: 2931963 - RNA, 19 nt, Mycobacterium avium subsp. paratuberculosis
cgaccaucugccggcgcuu

SEQ ID NO: 2931964 - RNA, 14 nt, Mycobacterium avium subsp. paratuberculosis
cgaccaugcccagc

SEQ ID NO: 2931965 - RNA, 17 nt, Mycobacterium avium subsp. paratuberculosis
cgaccaugcccagcagu

SEQ ID NO: 2931966 - RNA, 14 nt, Mycobacterium avium subsp. paratuberculosis
cgaccaugccgcgg

SEQ ID NO: 2931967 - RNA, 15 nt, Mycobacterium avium subsp. paratuberculosis
cgaccaugccgcggg

SEQ ID NO: 2931968 - RNA, 22 nt, Mycobacterium avium subsp. paratuberculosis
cgaccaugccgcgggccagcag

SEQ ID NO: 2931969 - RNA, 22 nt, Mycobacterium avium subsp. paratuberculosis
cgaccaugccguagcggucgcc

SEQ ID NO: 2931970 - RNA, 13 nt, Mycobacterium avium subsp. paratuberculosis
cgaccauggucag

SEQ ID NO: 2931971 - RNA, 17 nt, Mycobacterium avium subsp. paratuberculosis
cgaccaugucggcgacc

SEQ ID NO: 2931972 - RNA, 19 nt, Mycobacterium avium subsp. paratuberculosis
cgaccaugucggcgacccg

SEQ ID NO: 2931973 - RNA, 20 nt, Mycobacterium avium subsp. paratuberculosis
cgaccaugucggcgacccgc

SEQ ID NO: 2931974 - RNA, 22 nt, Mycobacterium avium subsp. paratuberculosis
cgaccaugucggcgacccgcac

SEQ ID NO: 2931975 - RNA, 13 nt, Mycobacterium avium subsp. paratuberculosis
cgacccaccgucg

SEQ ID NO: 2931976 - RNA, 19 nt, Mycobacterium avium subsp. paratuberculosis
cgacccccaccgcgacacg

SEQ ID NO: 2931977 - RNA, 22 nt, Mycobacterium avium subsp. paratuberculosis
cgacccccaccgcgacacgucg

SEQ ID NO: 2931978 - RNA, 13 nt, Mycobacterium avium subsp. paratuberculosis
cgacccccgccgc

SEQ ID NO: 2931979 - RNA, 16 nt, Mycobacterium avium subsp. paratuberculosis
cgacccccgccgcguc

SEQ ID NO: 2931980 - RNA, 22 nt, Mycobacterium avium subsp. paratuberculosis
cgacccccgccgcgucggucag

SEQ ID NO: 2931981 - RNA, 19 nt, Mycobacterium avium subsp. paratuberculosis
cgaccccgaaggcguugga

SEQ ID NO: 2931982 - RNA, 13 nt, Mycobacterium avium subsp. paratuberculosis
cgaccccgccagc

SEQ ID NO: 2931983 - RNA, 15 nt, Mycobacterium avium subsp. paratuberculosis
cgaccccgccagcac

SEQ ID NO: 2931984 - RNA, 16 nt, Mycobacterium avium subsp. paratuberculosis
cgaccccgccagcacc

SEQ ID NO: 2931985 - RNA, 17 nt, Mycobacterium avium subsp. paratuberculosis
cgaccccgccagcaccg

SEQ ID NO: 2931986 - RNA, 18 nt, Mycobacterium avium subsp. paratuberculosis
cgaccccgccagcaccga

SEQ ID NO: 2931987 - RNA, 14 nt, Mycobacterium avium subsp. paratuberculosis
cgaccccgcccacg

SEQ ID NO: 2931988 - RNA, 14 nt, Mycobacterium avium subsp. paratuberculosis
cgaccccgcccagc

SEQ ID NO: 2931989 - RNA, 16 nt, Mycobacterium avium subsp. paratuberculosis
cgaccccgcccagcga

SEQ ID NO: 2931990 - RNA, 14 nt, Mycobacterium avium subsp. paratuberculosis
cgaccccgccggcc

SEQ ID NO: 2931991 - RNA, 17 nt, Mycobacterium avium subsp. paratuberculosis
cgaccccgccggcccgg

SEQ ID NO: 2931992 - RNA, 23 nt, Mycobacterium avium subsp. paratuberculosis
cgaccccgccggcccggucgacu

SEQ ID NO: 2931993 - RNA, 12 nt, Mycobacterium avium subsp. paratuberculosis
cgaccccgccgu

SEQ ID NO: 2931994 - RNA, 13 nt, Mycobacterium avium subsp. paratuberculosis
cgaccccgccguc

SEQ ID NO: 2931995 - RNA, 21 nt, Mycobacterium avium subsp. paratuberculosis
cgaccccgccgucgacgcgug

SEQ ID NO: 2931996 - RNA, 13 nt, Mycobacterium avium subsp. paratuberculosis
cgaccccggccag

SEQ ID NO: 2931997 - RNA, 15 nt, Mycobacterium avium subsp. paratuberculosis
cgaccccggccagga

SEQ ID NO: 2931998 - RNA, 14 nt, Mycobacterium avium subsp. paratuberculosis
cgaccccggcggca

SEQ ID NO: 2931999 - RNA, 21 nt, Mycobacterium avium subsp. paratuberculosis
cgaccccggcggcaccgccgc

SEQ ID NO: 2932000 - RNA, 23 nt, Mycobacterium avium subsp. paratuberculosis
cgaccccggcggcaccgccgcgg

SEQ ID NO: 2932001 - RNA, 19 nt, Mycobacterium avium subsp. paratuberculosis
cgaccccguucgccgacag

SEQ ID NO: 2932002 - RNA, 14 nt, Mycobacterium avium subsp. paratuberculosis
cgaccccuccaacg

SEQ ID NO: 2932003 - RNA, 21 nt, Mycobacterium avium subsp. paratuberculosis
cgaccccuccaacggccgcac

SEQ ID NO: 2932004 - RNA, 18 nt, Mycobacterium avium subsp. paratuberculosis
cgaccccucggcggccgu

SEQ ID NO: 2932005 - RNA, 22 nt, Mycobacterium avium subsp. paratuberculosis
cgaccccugcacuaccccgucg

SEQ ID NO: 2932006 - RNA, 12 nt, Mycobacterium avium subsp. paratuberculosis
cgacccgaaccg

SEQ ID NO: 2932007 - RNA, 13 nt, Mycobacterium avium subsp. paratuberculosis
cgacccgaacuuc

SEQ ID NO: 2932008 - RNA, 22 nt, Mycobacterium avium subsp. paratuberculosis
cgacccgagagcugcugccgcc

SEQ ID NO: 2932009 - RNA, 23 nt, Mycobacterium avium subsp. paratuberculosis
cgacccgagagcugcugccgccg

SEQ ID NO: 2932010 - RNA, 14 nt, Mycobacterium avium subsp. paratuberculosis
cgacccgcaccacc

SEQ ID NO: 2932011 - RNA, 17 nt, Mycobacterium avium subsp. paratuberculosis
cgacccgcaccaccgcc

SEQ ID NO: 2932012 - RNA, 12 nt, Mycobacterium avium subsp. paratuberculosis
cgacccgcacga

SEQ ID NO: 2932013 - RNA, 20 nt, Mycobacterium avium subsp. paratuberculosis
cgacccgcacgaugccgcgc

SEQ ID NO: 2932014 - RNA, 21 nt, Mycobacterium avium subsp. paratuberculosis
cgacccgcacgaugccgcgcu

SEQ ID NO: 2932015 - RNA, 16 nt, Mycobacterium avium subsp. paratuberculosis
cgacccgcauccgccg

SEQ ID NO: 2932016 - RNA, 19 nt, Mycobacterium avium subsp. paratuberculosis
cgacccgcauccgccgggc

SEQ ID NO: 2932017 - RNA, 21 nt, Mycobacterium avium subsp. paratuberculosis
cgacccgcauccgccgggcgg

SEQ ID NO: 2932018 - RNA, 23 nt, Mycobacterium avium subsp. paratuberculosis
cgacccgcauccgccgggcggcg

SEQ ID NO: 2932019 - RNA, 14 nt, Mycobacterium avium subsp. paratuberculosis
cgacccgcccgccg

SEQ ID NO: 2932020 - RNA, 20 nt, Mycobacterium avium subsp. paratuberculosis
cgacccgcccgccgggcacc

SEQ ID NO: 2932021 - RNA, 11 nt, Mycobacterium avium subsp. paratuberculosis
cgacccgccgc

SEQ ID NO: 2932022 - RNA, 15 nt, Mycobacterium avium subsp. paratuberculosis
cgacccgccgcagcc

SEQ ID NO: 2932023 - RNA, 16 nt, Mycobacterium avium subsp. paratuberculosis
cgacccgccgcagccc

SEQ ID NO: 2932024 - RNA, 15 nt, Mycobacterium avium subsp. paratuberculosis
cgacccgcggcgccg

SEQ ID NO: 2932025 - RNA, 17 nt, Mycobacterium avium subsp. paratuberculosis
cgacccgcggcgccgcg

SEQ ID NO: 2932026 - RNA, 18 nt, Mycobacterium avium subsp. paratuberculosis
cgacccgcggcgccgcgg

SEQ ID NO: 2932027 - RNA, 22 nt, Mycobacterium avium subsp. paratuberculosis
cgacccgcuccccgauccggcu

SEQ ID NO: 2932028 - RNA, 17 nt, Mycobacterium avium subsp. paratuberculosis
cgacccgcuccgacgcg

SEQ ID NO: 2932029 - RNA, 18 nt, Mycobacterium avium subsp. paratuberculosis
cgacccgcuccgacgcgg

SEQ ID NO: 2932030 - RNA, 21 nt, Mycobacterium avium subsp. paratuberculosis
cgacccgcuccgacgcggugg

SEQ ID NO: 2932031 - RNA, 19 nt, Mycobacterium avium subsp. paratuberculosis
cgacccgcucgacgcgcac

SEQ ID NO: 2932032 - RNA, 21 nt, Mycobacterium avium subsp. paratuberculosis
cgacccgcuggaacagcgggc

SEQ ID NO: 2932033 - RNA, 23 nt, Mycobacterium avium subsp. paratuberculosis
cgacccgcuggaacagcgggccg

SEQ ID NO: 2932034 - RNA, 22 nt, Mycobacterium avium subsp. paratuberculosis
cgacccgcuucgcccggcugcg

SEQ ID NO: 2932035 - RNA, 17 nt, Mycobacterium avium subsp. paratuberculosis
cgacccggauacacggu

SEQ ID NO: 2932036 - RNA, 15 nt, Mycobacterium avium subsp. paratuberculosis
cgacccggaugaugu

SEQ ID NO: 2932037 - RNA, 18 nt, Mycobacterium avium subsp. paratuberculosis
cgacccggaugauguucu

SEQ ID NO: 2932038 - RNA, 13 nt, Mycobacterium avium subsp. paratuberculosis
cgacccggccacc

SEQ ID NO: 2932039 - RNA, 14 nt, Mycobacterium avium subsp. paratuberculosis
cgacccggccaccg

SEQ ID NO: 2932040 - RNA, 15 nt, Mycobacterium avium subsp. paratuberculosis
cgacccggccaccgc

SEQ ID NO: 2932041 - RNA, 17 nt, Mycobacterium avium subsp. paratuberculosis
cgacccggccaccgccg

SEQ ID NO: 2932042 - RNA, 17 nt, Mycobacterium avium subsp. paratuberculosis
cgacccggccgagcgcg

SEQ ID NO: 2932043 - RNA, 19 nt, Mycobacterium avium subsp. paratuberculosis
cgacccggccgagcgcgcc

SEQ ID NO: 2932044 - RNA, 16 nt, Mycobacterium avium subsp. paratuberculosis
cgacccggccgcgccg

SEQ ID NO: 2932045 - RNA, 17 nt, Mycobacterium avium subsp. paratuberculosis
cgacccggccgcgccgg

SEQ ID NO: 2932046 - RNA, 14 nt, Mycobacterium avium subsp. paratuberculosis
cgacccgggccagc

SEQ ID NO: 2932047 - RNA, 16 nt, Mycobacterium avium subsp. paratuberculosis
cgacccgggccagcag

SEQ ID NO: 2932048 - RNA, 17 nt, Mycobacterium avium subsp. paratuberculosis
cgacccgggccagcagg

SEQ ID NO: 2932049 - RNA, 18 nt, Mycobacterium avium subsp. paratuberculosis
cgacccgggccagcagga

SEQ ID NO: 2932050 - RNA, 23 nt, Mycobacterium avium subsp. paratuberculosis
cgacccgggccgccacggcgcca

SEQ ID NO: 2932051 - RNA, 23 nt, Mycobacterium avium subsp. paratuberculosis
cgacccgggcuagacgcgcacca

SEQ ID NO: 2932052 - RNA, 18 nt, Mycobacterium avium subsp. paratuberculosis
cgacccgguagcgcagca

SEQ ID NO: 2932053 - RNA, 20 nt, Mycobacterium avium subsp. paratuberculosis
cgacccgguagcgcagcacc

SEQ ID NO: 2932054 - RNA, 22 nt, Mycobacterium avium subsp. paratuberculosis
cgacccggucagcucgccgucc

SEQ ID NO: 2932055 - RNA, 17 nt, Mycobacterium avium subsp. paratuberculosis
cgacccgguccaccugg

SEQ ID NO: 2932056 - RNA, 23 nt, Mycobacterium avium subsp. paratuberculosis
cgacccgguggcccggucgucga

SEQ ID NO: 2932057 - RNA, 18 nt, Mycobacterium avium subsp. paratuberculosis
cgacccguaauugaucgu

SEQ ID NO: 2932058 - RNA, 15 nt, Mycobacterium avium subsp. paratuberculosis
cgacccguccagcag

SEQ ID NO: 2932059 - RNA, 14 nt, Mycobacterium avium subsp. paratuberculosis
cgacccguccagcg

SEQ ID NO: 2932060 - RNA, 16 nt, Mycobacterium avium subsp. paratuberculosis
cgacccguccagcgug

SEQ ID NO: 2932061 - RNA, 12 nt, Mycobacterium avium subsp. paratuberculosis
cgacccgucggg

SEQ ID NO: 2932062 - RNA, 16 nt, Mycobacterium avium subsp. paratuberculosis
cgacccgucggggugc

SEQ ID NO: 2932063 - RNA, 19 nt, Mycobacterium avium subsp. paratuberculosis
cgacccgucggggugcgcc

SEQ ID NO: 2932064 - RNA, 23 nt, Mycobacterium avium subsp. paratuberculosis
cgacccgucggggugcgccaggc

SEQ ID NO: 2932065 - RNA, 18 nt, Mycobacterium avium subsp. paratuberculosis
cgacccguuccccggccg

SEQ ID NO: 2932066 - RNA, 21 nt, Mycobacterium avium subsp. paratuberculosis
cgacccguuccccggccgacg

SEQ ID NO: 2932067 - RNA, 14 nt, Mycobacterium avium subsp. paratuberculosis
cgacccguuccggc

SEQ ID NO: 2932068 - RNA, 16 nt, Mycobacterium avium subsp. paratuberculosis
cgacccguuccggcga

SEQ ID NO: 2932069 - RNA, 18 nt, Mycobacterium avium subsp. paratuberculosis
cgacccguuccggcgaga

SEQ ID NO: 2932070 - RNA, 22 nt, Mycobacterium avium subsp. paratuberculosis
cgacccugcguccggcccggcg

SEQ ID NO: 2932071 - RNA, 13 nt, Mycobacterium avium subsp. paratuberculosis
cgaccgacagccg

SEQ ID NO: 2932072 - RNA, 14 nt, Mycobacterium avium subsp. paratuberculosis
cgaccgacagccgc

SEQ ID NO: 2932073 - RNA, 16 nt, Mycobacterium avium subsp. paratuberculosis
cgaccgacagccgcac

SEQ ID NO: 2932074 - RNA, 23 nt, Mycobacterium avium subsp. paratuberculosis
cgaccgacaguucggcgcgcauc

SEQ ID NO: 2932075 - RNA, 13 nt, Mycobacterium avium subsp. paratuberculosis
cgaccgacccggc

SEQ ID NO: 2932076 - RNA, 14 nt, Mycobacterium avium subsp. paratuberculosis
cgaccgacccggcc

SEQ ID NO: 2932077 - RNA, 15 nt, Mycobacterium avium subsp. paratuberculosis
cgaccgacccggcca

SEQ ID NO: 2932078 - RNA, 20 nt, Mycobacterium avium subsp. paratuberculosis
cgaccgcggcgauggcccgc

SEQ ID NO: 2932079 - RNA, 23 nt, Mycobacterium avium subsp. paratuberculosis
cgaccgcggcgauggcccgcugc

SEQ ID NO: 2932080 - RNA, 13 nt, Mycobacterium avium subsp. paratuberculosis
cgaccgcggcgcc

SEQ ID NO: 2932081 - RNA, 14 nt, Mycobacterium avium subsp. paratuberculosis
cgaccgcggcuccg

SEQ ID NO: 2932082 - RNA, 19 nt, Mycobacterium avium subsp. paratuberculosis
cgaccgcggcuccggccgc

SEQ ID NO: 2932083 - RNA, 20 nt, Mycobacterium avium subsp. paratuberculosis
cgaccgcggcuccggccgcg

SEQ ID NO: 2932084 - RNA, 21 nt, Mycobacterium avium subsp. paratuberculosis
cgaccgcggcuccggccgcgc

SEQ ID NO: 2932085 - RNA, 23 nt, Mycobacterium avium subsp. paratuberculosis
cgaccgcggcuccggccgcgccg

SEQ ID NO: 2932086 - RNA, 16 nt, Mycobacterium avium subsp. paratuberculosis
cgaccgcggucgcggc

SEQ ID NO: 2932087 - RNA, 19 nt, Mycobacterium avium subsp. paratuberculosis
cgaccgcggucgcggcgcc

SEQ ID NO: 2932088 - RNA, 12 nt, Mycobacterium avium subsp. paratuberculosis
cgaccgcggugg

SEQ ID NO: 2932089 - RNA, 19 nt, Mycobacterium avium subsp. paratuberculosis
cgaccgcgguggcggugcg

SEQ ID NO: 2932090 - RNA, 21 nt, Mycobacterium avium subsp. paratuberculosis
cgaccgcgguggcggugcggu

SEQ ID NO: 2932091 - RNA, 20 nt, Mycobacterium avium subsp. paratuberculosis
cgaccgcguacagggcgucg

SEQ ID NO: 2932092 - RNA, 17 nt, Mycobacterium avium subsp. paratuberculosis
cgaccgcguagucguug

SEQ ID NO: 2932093 - RNA, 17 nt, Mycobacterium avium subsp. paratuberculosis
cgaccgcguccgaggcg

SEQ ID NO: 2932094 - RNA, 18 nt, Mycobacterium avium subsp. paratuberculosis
cgaccgcguccgaggcgg

SEQ ID NO: 2932095 - RNA, 14 nt, Mycobacterium avium subsp. paratuberculosis
cgaccgcgucgacg

SEQ ID NO: 2932096 - RNA, 18 nt, Mycobacterium avium subsp. paratuberculosis
cgaccgcgugucggcaca

SEQ ID NO: 2932097 - RNA, 14 nt, Mycobacterium avium subsp. paratuberculosis
cgaccggacgaaca

SEQ ID NO: 2932098 - RNA, 15 nt, Mycobacterium avium subsp. paratuberculosis
cgaccggaugaugcc

SEQ ID NO: 2932099 - RNA, 19 nt, Mycobacterium avium subsp. paratuberculosis
cgaccggcaccagcagcca

SEQ ID NO: 2932100 - RNA, 18 nt, Mycobacterium avium subsp. paratuberculosis
cgaccggcagcaccggcc

SEQ ID NO: 2932101 - RNA, 19 nt, Mycobacterium avium subsp. paratuberculosis
cgaccggcagcaccggccg

SEQ ID NO: 2932102 - RNA, 20 nt, Mycobacterium avium subsp. paratuberculosis
cgaccggcagcaccggccgg

SEQ ID NO: 2932103 - RNA, 21 nt, Mycobacterium avium subsp. paratuberculosis
cgaccggcagcaccggccgga

SEQ ID NO: 2932104 - RNA, 13 nt, Mycobacterium avium subsp. paratuberculosis
cgaccggcagccg

SEQ ID NO: 2932105 - RNA, 16 nt, Mycobacterium avium subsp. paratuberculosis
cgaccggcagccgcgc

SEQ ID NO: 2932106 - RNA, 22 nt, Mycobacterium avium subsp. paratuberculosis
cgaccggccccaacggcgugca

SEQ ID NO: 2932107 - RNA, 14 nt, Mycobacterium avium subsp. paratuberculosis
cgaccggcccgaac

SEQ ID NO: 2932108 - RNA, 17 nt, Mycobacterium avium subsp. paratuberculosis
cgaccggcccgaacacc

SEQ ID NO: 2932109 - RNA, 12 nt, Mycobacterium avium subsp. paratuberculosis
cgaccggccggu

SEQ ID NO: 2932110 - RNA, 22 nt, Mycobacterium avium subsp. paratuberculosis
cgaccggcggaaguagcccgga

SEQ ID NO: 2932111 - RNA, 16 nt, Mycobacterium avium subsp. paratuberculosis
cgaccggcucagcccg

SEQ ID NO: 2932112 - RNA, 19 nt, Mycobacterium avium subsp. paratuberculosis
cgaccggcucagcccggcg

SEQ ID NO: 2932113 - RNA, 14 nt, Mycobacterium avium subsp. paratuberculosis
cgaccggcucgccg

SEQ ID NO: 2932114 - RNA, 16 nt, Mycobacterium avium subsp. paratuberculosis
cgaccggcucgccguu

SEQ ID NO: 2932115 - RNA, 22 nt, Mycobacterium avium subsp. paratuberculosis
cgaccgggaucguguggccgcc

SEQ ID NO: 2932116 - RNA, 13 nt, Mycobacterium avium subsp. paratuberculosis
cgaccggggcgcc

SEQ ID NO: 2932117 - RNA, 16 nt, Mycobacterium avium subsp. paratuberculosis
cgaccggggcgccccg

SEQ ID NO: 2932118 - RNA, 20 nt, Mycobacterium avium subsp. paratuberculosis
cgaccggggcgccccgcugg

SEQ ID NO: 2932119 - RNA, 18 nt, Mycobacterium avium subsp. paratuberculosis
cgaccggguccgagguga

SEQ ID NO: 2932120 - RNA, 20 nt, Mycobacterium avium subsp. paratuberculosis
cgaccggguccgaggugauc

SEQ ID NO: 2932121 - RNA, 18 nt, Mycobacterium avium subsp. paratuberculosis
cgaccgggucugccacgc

SEQ ID NO: 2932122 - RNA, 20 nt, Mycobacterium avium subsp. paratuberculosis
cgaccgggucugccacgccc

SEQ ID NO: 2932123 - RNA, 20 nt, Mycobacterium avium subsp. paratuberculosis
cgaccgggugaacgaggccg

SEQ ID NO: 2932124 - RNA, 23 nt, Mycobacterium avium subsp. paratuberculosis
cgaccgggugaacgaggccgcgc

SEQ ID NO: 2932125 - RNA, 17 nt, Mycobacterium avium subsp. paratuberculosis
cgaccggguuggcgcgc

SEQ ID NO: 2932126 - RNA, 21 nt, Mycobacterium avium subsp. paratuberculosis
cgaccggguuggcgcgcacca

SEQ ID NO: 2932127 - RNA, 18 nt, Mycobacterium avium subsp. paratuberculosis
cgaccgguccgccgccgg

SEQ ID NO: 2932128 - RNA, 21 nt, Mycobacterium avium subsp. paratuberculosis
cgaccgguccgccgccggcgg

SEQ ID NO: 2932129 - RNA, 22 nt, Mycobacterium avium subsp. paratuberculosis
cgaccgguccgccgccggcgga

SEQ ID NO: 2932130 - RNA, 18 nt, Mycobacterium avium subsp. paratuberculosis
cgaccggucucgaccgcg

SEQ ID NO: 2932131 - RNA, 20 nt, Mycobacterium avium subsp. paratuberculosis
cgaccggucucgaccgcggc

SEQ ID NO: 2932132 - RNA, 21 nt, Mycobacterium avium subsp. paratuberculosis
cgaccggucucgaccgcggcg

SEQ ID NO: 2932133 - RNA, 17 nt, Mycobacterium avium subsp. paratuberculosis
cgaccgguucgucaacg

SEQ ID NO: 2932134 - RNA, 21 nt, Mycobacterium avium subsp. paratuberculosis
cgaccgguucgucaacgcccc

SEQ ID NO: 2932135 - RNA, 23 nt, Mycobacterium avium subsp. paratuberculosis
cgaccgguucgucaacgccccgg

SEQ ID NO: 2932136 - RNA, 15 nt, Mycobacterium avium subsp. paratuberculosis
cgaccguagccgguc

SEQ ID NO: 2932137 - RNA, 16 nt, Mycobacterium avium subsp. paratuberculosis
cgaccguagccggucg

SEQ ID NO: 2932138 - RNA, 17 nt, Mycobacterium avium subsp. paratuberculosis
cgaccguagccggucgg

SEQ ID NO: 2932139 - RNA, 20 nt, Mycobacterium avium subsp. paratuberculosis
cgaccguagccggucggccc

SEQ ID NO: 2932140 - RNA, 15 nt, Mycobacterium avium subsp. paratuberculosis
cgaccgucacgcugg

SEQ ID NO: 2932141 - RNA, 20 nt, Mycobacterium avium subsp. paratuberculosis
cgaccgucacgcuggcguga

SEQ ID NO: 2932142 - RNA, 16 nt, Mycobacterium avium subsp. paratuberculosis
cgaccgucagcagggc

SEQ ID NO: 2932143 - RNA, 18 nt, Mycobacterium avium subsp. paratuberculosis
cgaccgucagcagggccu

SEQ ID NO: 2932144 - RNA, 18 nt, Mycobacterium avium subsp. paratuberculosis
cgaccgucaucaucaccg

SEQ ID NO: 2932145 - RNA, 20 nt, Mycobacterium avium subsp. paratuberculosis
cgaccgucaucaucaccggg

SEQ ID NO: 2932146 - RNA, 21 nt, Mycobacterium avium subsp. paratuberculosis
cgaccgucaucaucaccggga

SEQ ID NO: 2932147 - RNA, 23 nt, Mycobacterium avium subsp. paratuberculosis
cgaccgucaucaucaccgggaug

SEQ ID NO: 2932148 - RNA, 12 nt, Mycobacterium avium subsp. paratuberculosis
cgaccgucggga

SEQ ID NO: 2932149 - RNA, 18 nt, Mycobacterium avium subsp. paratuberculosis
cgaccgucgggacggcca

SEQ ID NO: 2932150 - RNA, 19 nt, Mycobacterium avium subsp. paratuberculosis
cgaccgucgggacggccag

SEQ ID NO: 2932151 - RNA, 22 nt, Mycobacterium avium subsp. paratuberculosis
cgaccgucgggacggccagcag

SEQ ID NO: 2932152 - RNA, 15 nt, Mycobacterium avium subsp. paratuberculosis
cgaccgucgucccgg

SEQ ID NO: 2932153 - RNA, 18 nt, Mycobacterium avium subsp. paratuberculosis
cgaccgucgucccgguga

SEQ ID NO: 2932154 - RNA, 21 nt, Mycobacterium avium subsp. paratuberculosis
cgaccgucuucuucagccgca

SEQ ID NO: 2932155 - RNA, 23 nt, Mycobacterium avium subsp. paratuberculosis
cgaccgucuucuucagccgcagc

SEQ ID NO: 2932156 - RNA, 18 nt, Mycobacterium avium subsp. paratuberculosis
cgaccgugaggcccggcg

SEQ ID NO: 2932157 - RNA, 20 nt, Mycobacterium avium subsp. paratuberculosis
cgaccgugaggcccggcgug

SEQ ID NO: 2932158 - RNA, 21 nt, Mycobacterium avium subsp. paratuberculosis
cgaccgugaggcccggcgugg

SEQ ID NO: 2932159 - RNA, 16 nt, Mycobacterium avium subsp. paratuberculosis
cgaccucaccccgcuu

SEQ ID NO: 2932160 - RNA, 18 nt, Mycobacterium avium subsp. paratuberculosis
cgaccucaccccgcuugc

SEQ ID NO: 2932161 - RNA, 19 nt, Mycobacterium avium subsp. paratuberculosis
cgaccuccaaugcgcccug

SEQ ID NO: 2932162 - RNA, 17 nt, Mycobacterium avium subsp. paratuberculosis
cgaccuggucgccgccg

SEQ ID NO: 2932163 - RNA, 16 nt, Mycobacterium avium subsp. paratuberculosis
cgaccuggugcucgau

SEQ ID NO: 2932164 - RNA, 23 nt, Mycobacterium avium subsp. paratuberculosis
cgaccugguugacaccaccgaga

SEQ ID NO: 2932165 - RNA, 20 nt, Mycobacterium avium subsp. paratuberculosis
cgaccuguagggcgagcucg

SEQ ID NO: 2932166 - RNA, 14 nt, Mycobacterium avium subsp. paratuberculosis
cgaccuguccgauc

SEQ ID NO: 2932167 - RNA, 17 nt, Mycobacterium avium subsp. paratuberculosis
cgaccuguccgaucacc

SEQ ID NO: 2932168 - RNA, 23 nt, Mycobacterium avium subsp. paratuberculosis
cgaccuguuuggccagccaguug

SEQ ID NO: 2932169 - RNA, 19 nt, Mycobacterium avium subsp. paratuberculosis
cgaccuucgagccgccgcc

SEQ ID NO: 2932170 - RNA, 23 nt, Mycobacterium avium subsp. paratuberculosis
cgaccuucgagccgccgccggcg

SEQ ID NO: 2932171 - RNA, 22 nt, Mycobacterium avium subsp. paratuberculosis
cgaccuucuggccuugcagccc

SEQ ID NO: 2932172 - RNA, 18 nt, Mycobacterium avium subsp. paratuberculosis
cgaccuucuuguccagga

SEQ ID NO: 2932173 - RNA, 17 nt, Mycobacterium avium subsp. paratuberculosis
cgaccuugacccaggcc

SEQ ID NO: 2932174 - RNA, 18 nt, Mycobacterium avium subsp. paratuberculosis
cgaccuugacccaggccc

SEQ ID NO: 2932175 - RNA, 21 nt, Mycobacterium avium subsp. paratuberculosis
cgaccuugacccaggcccggg

SEQ ID NO: 2932176 - RNA, 15 nt, Mycobacterium avium subsp. paratuberculosis
cgaccuugcgcagcc

SEQ ID NO: 2932177 - RNA, 19 nt, Mycobacterium avium subsp. paratuberculosis
cgaccuugcgcagccggca

SEQ ID NO: 2932178 - RNA, 22 nt, Mycobacterium avium subsp. paratuberculosis
cgaccuugcgcagccggcagca

SEQ ID NO: 2932179 - RNA, 20 nt, Mycobacterium avium subsp. paratuberculosis
cgaccuuggggucaccgucc

SEQ ID NO: 2932180 - RNA, 17 nt, Mycobacterium avium subsp. paratuberculosis
cgaccuuuugcccggcg

SEQ ID NO: 2932181 - RNA, 18 nt, Mycobacterium avium subsp. paratuberculosis
cgaccuuuugcccggcga

SEQ ID NO: 2932182 - RNA, 20 nt, Mycobacterium avium subsp. paratuberculosis
cgaccuuuugcccggcgaug

SEQ ID NO: 2932183 - RNA, 17 nt, Mycobacterium avium subsp. paratuberculosis
cgacgaaaucgucgggc

SEQ ID NO: 2932184 - RNA, 23 nt, Mycobacterium avium subsp. paratuberculosis
cgacgaaaucgucgggccggauc

SEQ ID NO: 2932185 - RNA, 19 nt, Mycobacterium avium subsp. paratuberculosis
cgacgaaauugggcugggu

SEQ ID NO: 2932186 - RNA, 18 nt, Mycobacterium avium subsp. paratuberculosis
cgacgaacaccaccggca

SEQ ID NO: 2932187 - RNA, 16 nt, Mycobacterium avium subsp. paratuberculosis
cgacgaacagcaccgc

SEQ ID NO: 2932188 - RNA, 24 nt, Mycobacterium avium subsp. paratuberculosis
cgacgaaccgugcacgaucgcggu

SEQ ID NO: 2932189 - RNA, 15 nt, Mycobacterium avium subsp. paratuberculosis
cgacgaacgccggca

SEQ ID NO: 2932190 - RNA, 16 nt, Mycobacterium avium subsp. paratuberculosis
cgacgaacgccggcau

SEQ ID NO: 2932191 - RNA, 15 nt, Mycobacterium avium subsp. paratuberculosis
cgacgaacgcggcgg

SEQ ID NO: 2932192 - RNA, 13 nt, Mycobacterium avium subsp. paratuberculosis
cgacgaacgcggu

SEQ ID NO: 2932193 - RNA, 15 nt, Mycobacterium avium subsp. paratuberculosis
cgacgaacgcgguga

SEQ ID NO: 2932194 - RNA, 21 nt, Mycobacterium avium subsp. paratuberculosis
cgacgaacgcggugagcgugc

SEQ ID NO: 2932195 - RNA, 16 nt, Mycobacterium avium subsp. paratuberculosis
cgacgaacuccgcgcg

SEQ ID NO: 2932196 - RNA, 17 nt, Mycobacterium avium subsp. paratuberculosis
cgacgaacuccgcgcgc

SEQ ID NO: 2932197 - RNA, 18 nt, Mycobacterium avium subsp. paratuberculosis
cgacgaacuccgcgcgcg

SEQ ID NO: 2932198 - RNA, 20 nt, Mycobacterium avium subsp. paratuberculosis
cgacgaacuccgcgcgcggc

SEQ ID NO: 2932199 - RNA, 16 nt, Mycobacterium avium subsp. paratuberculosis
cgacgaacugccguug

SEQ ID NO: 2932200 - RNA, 17 nt, Mycobacterium avium subsp. paratuberculosis
cgacgaagaaggacgcc

SEQ ID NO: 2932201 - RNA, 21 nt, Mycobacterium avium subsp. paratuberculosis
cgacgaagaaggacgccucgc

SEQ ID NO: 2932202 - RNA, 14 nt, Mycobacterium avium subsp. paratuberculosis
cgacgaagaugcgc

SEQ ID NO: 2932203 - RNA, 15 nt, Mycobacterium avium subsp. paratuberculosis
cgacgaagaugcgcc

SEQ ID NO: 2932204 - RNA, 18 nt, Mycobacterium avium subsp. paratuberculosis
cgacgaagaugcgcccgg

SEQ ID NO: 2932205 - RNA, 14 nt, Mycobacterium avium subsp. paratuberculosis
cgacgaagcagcuc

SEQ ID NO: 2932206 - RNA, 15 nt, Mycobacterium avium subsp. paratuberculosis
cgacgaagccgccgc

SEQ ID NO: 2932207 - RNA, 17 nt, Mycobacterium avium subsp. paratuberculosis
cgacgaagccgccgccc

SEQ ID NO: 2932208 - RNA, 22 nt, Mycobacterium avium subsp. paratuberculosis
cgacgaagccgccgcccucggu

SEQ ID NO: 2932209 - RNA, 18 nt, Mycobacterium avium subsp. paratuberculosis
cgacgaagccggugccca

SEQ ID NO: 2932210 - RNA, 13 nt, Mycobacterium avium subsp. paratuberculosis
cgacgaagucgac

SEQ ID NO: 2932211 - RNA, 15 nt, Mycobacterium avium subsp. paratuberculosis
cgacgaagucgguca

SEQ ID NO: 2932212 - RNA, 17 nt, Mycobacterium avium subsp. paratuberculosis
cgacgaagucggucagc

SEQ ID NO: 2932213 - RNA, 18 nt, Mycobacterium avium subsp. paratuberculosis
cgacgaaucccgccucgg

SEQ ID NO: 2932214 - RNA, 19 nt, Mycobacterium avium subsp. paratuberculosis
cgacgaaucccgccucggu

SEQ ID NO: 2932215 - RNA, 13 nt, Mycobacterium avium subsp. paratuberculosis
cgacgacaccacc

SEQ ID NO: 2932216 - RNA, 21 nt, Mycobacterium avium subsp. paratuberculosis
cgacgacacccuucaucagca

SEQ ID NO: 2932217 - RNA, 22 nt, Mycobacterium avium subsp. paratuberculosis
cgacgacacccuucaucagcac

SEQ ID NO: 2932218 - RNA, 14 nt, Mycobacterium avium subsp. paratuberculosis
cgacgacaccgugu

SEQ ID NO: 2932219 - RNA, 16 nt, Mycobacterium avium subsp. paratuberculosis
cgacgacaggucgagc

SEQ ID NO: 2932220 - RNA, 18 nt, Mycobacterium avium subsp. paratuberculosis
cgacgaccaccaggagca

SEQ ID NO: 2932221 - RNA, 17 nt, Mycobacterium avium subsp. paratuberculosis
cgacgaccaucagcgcc

SEQ ID NO: 2932222 - RNA, 18 nt, Mycobacterium avium subsp. paratuberculosis
cgacgaccaucagcgccc

SEQ ID NO: 2932223 - RNA, 19 nt, Mycobacterium avium subsp. paratuberculosis
cgacgaccaucagcgcccg

SEQ ID NO: 2932224 - RNA, 12 nt, Mycobacterium avium subsp. paratuberculosis
cgacgacccgau

SEQ ID NO: 2932225 - RNA, 15 nt, Mycobacterium avium subsp. paratuberculosis
cgacgaccgcaccga

SEQ ID NO: 2932226 - RNA, 16 nt, Mycobacterium avium subsp. paratuberculosis
cgacgaccgcaccgac

SEQ ID NO: 2932227 - RNA, 17 nt, Mycobacterium avium subsp. paratuberculosis
cgacgaccgcaccgacc

SEQ ID NO: 2932228 - RNA, 14 nt, Mycobacterium avium subsp. paratuberculosis
cgacgaccgcgacg

SEQ ID NO: 2932229 - RNA, 15 nt, Mycobacterium avium subsp. paratuberculosis
cgacgaccgcgacgg

SEQ ID NO: 2932230 - RNA, 16 nt, Mycobacterium avium subsp. paratuberculosis
cgacgaccgcgacggc

SEQ ID NO: 2932231 - RNA, 15 nt, Mycobacterium avium subsp. paratuberculosis
cgacgaccgucauca

SEQ ID NO: 2932232 - RNA, 21 nt, Mycobacterium avium subsp. paratuberculosis
cgacgaccucccccgacgccg

SEQ ID NO: 2932233 - RNA, 23 nt, Mycobacterium avium subsp. paratuberculosis
cgacgaccucccccgacgccgac

SEQ ID NO: 2932234 - RNA, 14 nt, Mycobacterium avium subsp. paratuberculosis
cgacgaccucgccc

SEQ ID NO: 2932235 - RNA, 17 nt, Mycobacterium avium subsp. paratuberculosis
cgacgaccucgcccgcc

SEQ ID NO: 2932236 - RNA, 18 nt, Mycobacterium avium subsp. paratuberculosis
cgacgaccucgcccgccg

SEQ ID NO: 2932237 - RNA, 19 nt, Mycobacterium avium subsp. paratuberculosis
cgacgaccucgcccgccgc

SEQ ID NO: 2932238 - RNA, 22 nt, Mycobacterium avium subsp. paratuberculosis
cgacgaccucgcccgccgcgac

SEQ ID NO: 2932239 - RNA, 23 nt, Mycobacterium avium subsp. paratuberculosis
cgacgaccucgcccgccgcgacg

SEQ ID NO: 2932240 - RNA, 17 nt, Mycobacterium avium subsp. paratuberculosis
cgacgaccucgccgacg

SEQ ID NO: 2932241 - RNA, 14 nt, Mycobacterium avium subsp. paratuberculosis
cgacgaccucggug

SEQ ID NO: 2932242 - RNA, 19 nt, Mycobacterium avium subsp. paratuberculosis
cgacgacgaagacguacgg

SEQ ID NO: 2932243 - RNA, 15 nt, Mycobacterium avium subsp. paratuberculosis
cgacgacgacgucga

SEQ ID NO: 2932244 - RNA, 14 nt, Mycobacterium avium subsp. paratuberculosis
cgacgacgccagcu

SEQ ID NO: 2932245 - RNA, 17 nt, Mycobacterium avium subsp. paratuberculosis
cgacgacgccgauccgc

SEQ ID NO: 2932246 - RNA, 17 nt, Mycobacterium avium subsp. paratuberculosis
cgacgaugccguagagc

SEQ ID NO: 2932247 - RNA, 14 nt, Mycobacterium avium subsp. paratuberculosis
cgacgaugcggccg

SEQ ID NO: 2932248 - RNA, 19 nt, Mycobacterium avium subsp. paratuberculosis
cgacgaugcggggcggcgg

SEQ ID NO: 2932249 - RNA, 15 nt, Mycobacterium avium subsp. paratuberculosis
cgacgaugcguucgg

SEQ ID NO: 2932250 - RNA, 18 nt, Mycobacterium avium subsp. paratuberculosis
cgacgaugcguucgggau

SEQ ID NO: 2932251 - RNA, 16 nt, Mycobacterium avium subsp. paratuberculosis
cgacgauggccaggcc

SEQ ID NO: 2932252 - RNA, 14 nt, Mycobacterium avium subsp. paratuberculosis
cgacgauggcccgg

SEQ ID NO: 2932253 - RNA, 20 nt, Mycobacterium avium subsp. paratuberculosis
cgacgauggcccggaccgcc

SEQ ID NO: 2932254 - RNA, 21 nt, Mycobacterium avium subsp. paratuberculosis
cgacgauggcccggaccgccg

SEQ ID NO: 2932255 - RNA, 23 nt, Mycobacterium avium subsp. paratuberculosis
cgacgauggcccgggccacaccc

SEQ ID NO: 2932256 - RNA, 15 nt, Mycobacterium avium subsp. paratuberculosis
cgacgauggcgucca

SEQ ID NO: 2932257 - RNA, 19 nt, Mycobacterium avium subsp. paratuberculosis
cgacgauggcguccaccga

SEQ ID NO: 2932258 - RNA, 15 nt, Mycobacterium avium subsp. paratuberculosis
cgacgauggucugga

SEQ ID NO: 2932259 - RNA, 14 nt, Mycobacterium avium subsp. paratuberculosis
cgacgaugucgacc

SEQ ID NO: 2932260 - RNA, 17 nt, Mycobacterium avium subsp. paratuberculosis
cgacgaugucgacccgc

SEQ ID NO: 2932261 - RNA, 21 nt, Mycobacterium avium subsp. paratuberculosis
cgacgaugucgacccgcggcg

SEQ ID NO: 2932262 - RNA, 22 nt, Mycobacterium avium subsp. paratuberculosis
cgacgaugucgacccgcggcgc

SEQ ID NO: 2932263 - RNA, 23 nt, Mycobacterium avium subsp. paratuberculosis
cgacgaugucgacccgcggcgcc

SEQ ID NO: 2932264 - RNA, 15 nt, Mycobacterium avium subsp. paratuberculosis
cgacgaugucgacgc

SEQ ID NO: 2932265 - RNA, 15 nt, Mycobacterium avium subsp. paratuberculosis
cgacgauguuggcga

SEQ ID NO: 2932266 - RNA, 18 nt, Mycobacterium avium subsp. paratuberculosis
cgacgauguuggcgacga

SEQ ID NO: 2932267 - RNA, 21 nt, Mycobacterium avium subsp. paratuberculosis
cgacgauguuggcgacgacgg

SEQ ID NO: 2932268 - RNA, 23 nt, Mycobacterium avium subsp. paratuberculosis
cgacgauguuggcgacgacggcg

SEQ ID NO: 2932269 - RNA, 13 nt, Mycobacterium avium subsp. paratuberculosis
cgacgauugucgg

SEQ ID NO: 2932270 - RNA, 16 nt, Mycobacterium avium subsp. paratuberculosis
cgacgauugucggggc

SEQ ID NO: 2932271 - RNA, 18 nt, Mycobacterium avium subsp. paratuberculosis
cgacgauugucggggccg

SEQ ID NO: 2932272 - RNA, 21 nt, Mycobacterium avium subsp. paratuberculosis
cgacgauugugugccaagcgg

SEQ ID NO: 2932273 - RNA, 14 nt, Mycobacterium avium subsp. paratuberculosis
cgacgcaccacgag

SEQ ID NO: 2932274 - RNA, 15 nt, Mycobacterium avium subsp. paratuberculosis
cgacgcaccucggcc

SEQ ID NO: 2932275 - RNA, 14 nt, Mycobacterium avium subsp. paratuberculosis
cgacgcacgaaacc

SEQ ID NO: 2932276 - RNA, 20 nt, Mycobacterium avium subsp. paratuberculosis
cgacgcacgaaaccgcgugg

SEQ ID NO: 2932277 - RNA, 14 nt, Mycobacterium avium subsp. paratuberculosis
cgacgcacgccggc

SEQ ID NO: 2932278 - RNA, 20 nt, Mycobacterium avium subsp. paratuberculosis
cgacgcacgccggcgggggu

SEQ ID NO: 2932279 - RNA, 15 nt, Mycobacterium avium subsp. paratuberculosis
cgacgcauguccgcc

SEQ ID NO: 2932280 - RNA, 17 nt, Mycobacterium avium subsp. paratuberculosis
cgacgcauguccgccgu

SEQ ID NO: 2932281 - RNA, 20 nt, Mycobacterium avium subsp. paratuberculosis
cgacgcauguccgccgucau

SEQ ID NO: 2932282 - RNA, 24 nt, Mycobacterium avium subsp. paratuberculosis
cgacgccaacaacuacgagcagca

SEQ ID NO: 2932283 - RNA, 12 nt, Mycobacterium avium subsp. paratuberculosis
cgacgccaccgc

SEQ ID NO: 2932284 - RNA, 13 nt, Mycobacterium avium subsp. paratuberculosis
cgacgccaccgcg

SEQ ID NO: 2932285 - RNA, 16 nt, Mycobacterium avium subsp. paratuberculosis
cgacgccacgucguuc

SEQ ID NO: 2932286 - RNA, 14 nt, Mycobacterium avium subsp. paratuberculosis
cgacgccagcaccu

SEQ ID NO: 2932287 - RNA, 22 nt, Mycobacterium avium subsp. paratuberculosis
cgacgccagcaccuucgggccg

SEQ ID NO: 2932288 - RNA, 12 nt, Mycobacterium avium subsp. paratuberculosis
cgacgccagcgg

SEQ ID NO: 2932289 - RNA, 16 nt, Mycobacterium avium subsp. paratuberculosis
cgacgccagcggcagc

SEQ ID NO: 2932290 - RNA, 19 nt, Mycobacterium avium subsp. paratuberculosis
cgacgccagcggcagcgcc

SEQ ID NO: 2932291 - RNA, 13 nt, Mycobacterium avium subsp. paratuberculosis
cgacgccagcggg

SEQ ID NO: 2932292 - RNA, 14 nt, Mycobacterium avium subsp. paratuberculosis
cgacgccagcgggc

SEQ ID NO: 2932293 - RNA, 17 nt, Mycobacterium avium subsp. paratuberculosis
cgacgccagcgggccgu

SEQ ID NO: 2932294 - RNA, 17 nt, Mycobacterium avium subsp. paratuberculosis
cgacgccaguucgucgg

SEQ ID NO: 2932295 - RNA, 20 nt, Mycobacterium avium subsp. paratuberculosis
cgacgccaguucgucggccg

SEQ ID NO: 2932296 - RNA, 23 nt, Mycobacterium avium subsp. paratuberculosis
cgacgccaguucgucggccgucg

SEQ ID NO: 2932297 - RNA, 19 nt, Mycobacterium avium subsp. paratuberculosis
cgacgccaugggcccagca

SEQ ID NO: 2932298 - RNA, 16 nt, Mycobacterium avium subsp. paratuberculosis
cgacgccaugucgaug

SEQ ID NO: 2932299 - RNA, 19 nt, Mycobacterium avium subsp. paratuberculosis
cgacgccaugucgaugucg

SEQ ID NO: 2932300 - RNA, 23 nt, Mycobacterium avium subsp. paratuberculosis
cgacgccaugucgaugucgacgc

SEQ ID NO: 2932301 - RNA, 14 nt, Mycobacterium avium subsp. paratuberculosis
cgacgcccacagcg

SEQ ID NO: 2932302 - RNA, 18 nt, Mycobacterium avium subsp. paratuberculosis
cgacgcccacagcgccag

SEQ ID NO: 2932303 - RNA, 20 nt, Mycobacterium avium subsp. paratuberculosis
cgacgcccacagcgccagca

SEQ ID NO: 2932304 - RNA, 21 nt, Mycobacterium avium subsp. paratuberculosis
cgacgcccacagcgccagcac

SEQ ID NO: 2932305 - RNA, 22 nt, Mycobacterium avium subsp. paratuberculosis
cgacgcccacagcgccagcacg

SEQ ID NO: 2932306 - RNA, 20 nt, Mycobacterium avium subsp. paratuberculosis
cgacgcccagaacgacgcgc

SEQ ID NO: 2932307 - RNA, 16 nt, Mycobacterium avium subsp. paratuberculosis
cgacgcccagcaccga

SEQ ID NO: 2932308 - RNA, 14 nt, Mycobacterium avium subsp. paratuberculosis
cgacgcccagcgcg

SEQ ID NO: 2932309 - RNA, 18 nt, Mycobacterium avium subsp. paratuberculosis
cgacgcccagcgcggcga

SEQ ID NO: 2932310 - RNA, 23 nt, Mycobacterium avium subsp. paratuberculosis
cgacgcccagcgcggcgaacccg

SEQ ID NO: 2932311 - RNA, 18 nt, Mycobacterium avium subsp. paratuberculosis
cgacgcccaggugcaccc

SEQ ID NO: 2932312 - RNA, 19 nt, Mycobacterium avium subsp. paratuberculosis
cgacgcccaggugcacccg

SEQ ID NO: 2932313 - RNA, 13 nt, Mycobacterium avium subsp. paratuberculosis
cgacgccccgcgc

SEQ ID NO: 2932314 - RNA, 20 nt, Mycobacterium avium subsp. paratuberculosis
cgacgcccggcuucgccgcc

SEQ ID NO: 2932315 - RNA, 15 nt, Mycobacterium avium subsp. paratuberculosis
cgacgcccugccaca

SEQ ID NO: 2932316 - RNA, 17 nt, Mycobacterium avium subsp. paratuberculosis
cgacgcccugccacagc

SEQ ID NO: 2932317 - RNA, 18 nt, Mycobacterium avium subsp. paratuberculosis
cgacgcccugccacagcg

SEQ ID NO: 2932318 - RNA, 18 nt, Mycobacterium avium subsp. paratuberculosis
cgacgcccuuggcgccca

SEQ ID NO: 2932319 - RNA, 22 nt, Mycobacterium avium subsp. paratuberculosis
cgacgcccuuggcgcccagcgu

SEQ ID NO: 2932320 - RNA, 16 nt, Mycobacterium avium subsp. paratuberculosis
cgacgccgacaccagc

SEQ ID NO: 2932321 - RNA, 20 nt, Mycobacterium avium subsp. paratuberculosis
cgacgccgacaccagcgcgc

SEQ ID NO: 2932322 - RNA, 15 nt, Mycobacterium avium subsp. paratuberculosis
cgacgccgacaucgc

SEQ ID NO: 2932323 - RNA, 16 nt, Mycobacterium avium subsp. paratuberculosis
cgacgccgacaucgcg

SEQ ID NO: 2932324 - RNA, 19 nt, Mycobacterium avium subsp. paratuberculosis
cgacgccgacaucgcggcg

SEQ ID NO: 2932325 - RNA, 14 nt, Mycobacterium avium subsp. paratuberculosis
cgacgccgaccgcg

SEQ ID NO: 2932326 - RNA, 19 nt, Mycobacterium avium subsp. paratuberculosis
cgacgccgaccgcggucgc

SEQ ID NO: 2932327 - RNA, 21 nt, Mycobacterium avium subsp. paratuberculosis
cgacgccgaguaacucggccu

SEQ ID NO: 2932328 - RNA, 20 nt, Mycobacterium avium subsp. paratuberculosis
cgacgccgauccgcagccgc

SEQ ID NO: 2932329 - RNA, 23 nt, Mycobacterium avium subsp. paratuberculosis
cgacgccgauccgcagccgcugc

SEQ ID NO: 2932330 - RNA, 13 nt, Mycobacterium avium subsp. paratuberculosis
cgacgcggucacc

SEQ ID NO: 2932331 - RNA, 19 nt, Mycobacterium avium subsp. paratuberculosis
cgacgcggucaccggcucg

SEQ ID NO: 2932332 - RNA, 15 nt, Mycobacterium avium subsp. paratuberculosis
cgacgcggucgaaca

SEQ ID NO: 2932333 - RNA, 21 nt, Mycobacterium avium subsp. paratuberculosis
cgacgcggucugcggugcgcc

SEQ ID NO: 2932334 - RNA, 13 nt, Mycobacterium avium subsp. paratuberculosis
cgacgcggugaca

SEQ ID NO: 2932335 - RNA, 18 nt, Mycobacterium avium subsp. paratuberculosis
cgacgcggugagcgcgcc

SEQ ID NO: 2932336 - RNA, 22 nt, Mycobacterium avium subsp. paratuberculosis
cgacgcggugagcgcgccggcc

SEQ ID NO: 2932337 - RNA, 23 nt, Mycobacterium avium subsp. paratuberculosis
cgacgcggugagcgcgccggccc

SEQ ID NO: 2932338 - RNA, 23 nt, Mycobacterium avium subsp. paratuberculosis
cgacgcguccguagugcucggcg

SEQ ID NO: 2932339 - RNA, 22 nt, Mycobacterium avium subsp. paratuberculosis
cgacgcguuguugcucggcggc

SEQ ID NO: 2932340 - RNA, 17 nt, Mycobacterium avium subsp. paratuberculosis
cgacgcucaggcgucca

SEQ ID NO: 2932341 - RNA, 21 nt, Mycobacterium avium subsp. paratuberculosis
cgacgcucaggcguccagcca

SEQ ID NO: 2932342 - RNA, 14 nt, Mycobacterium avium subsp. paratuberculosis
cgacgcucgccacc

SEQ ID NO: 2932343 - RNA, 21 nt, Mycobacterium avium subsp. paratuberculosis
cgacgcucgccaccccgcgcc

SEQ ID NO: 2932344 - RNA, 22 nt, Mycobacterium avium subsp. paratuberculosis
cgacgcucgccaccccgcgcca

SEQ ID NO: 2932345 - RNA, 14 nt, Mycobacterium avium subsp. paratuberculosis
cgacgcucggcgau

SEQ ID NO: 2932346 - RNA, 16 nt, Mycobacterium avium subsp. paratuberculosis
cgacgcucggcgaugg

SEQ ID NO: 2932347 - RNA, 18 nt, Mycobacterium avium subsp. paratuberculosis
cgacgcugaacagcagca

SEQ ID NO: 2932348 - RNA, 19 nt, Mycobacterium avium subsp. paratuberculosis
cgacgcugaacagcagcag

SEQ ID NO: 2932349 - RNA, 20 nt, Mycobacterium avium subsp. paratuberculosis
cgacgcugaacagcagcagc

SEQ ID NO: 2932350 - RNA, 14 nt, Mycobacterium avium subsp. paratuberculosis
cgacgcugaccagc

SEQ ID NO: 2932351 - RNA, 18 nt, Mycobacterium avium subsp. paratuberculosis
cgacgcugacgaugcggc

SEQ ID NO: 2932352 - RNA, 20 nt, Mycobacterium avium subsp. paratuberculosis
cgacgcugacgaugcggccg

SEQ ID NO: 2932353 - RNA, 23 nt, Mycobacterium avium subsp. paratuberculosis
cgacgcugacgaugcggccggcg

SEQ ID NO: 2932354 - RNA, 17 nt, Mycobacterium avium subsp. paratuberculosis
cgacgcugagcacccgc

SEQ ID NO: 2932355 - RNA, 22 nt, Mycobacterium avium subsp. paratuberculosis
cgacgcugagcacccgcccgga

SEQ ID NO: 2932356 - RNA, 24 nt, Mycobacterium avium subsp. paratuberculosis
cgacgcugagcacccgcccggacg

SEQ ID NO: 2932357 - RNA, 13 nt, Mycobacterium avium subsp. paratuberculosis
cgacgcugagccg

SEQ ID NO: 2932358 - RNA, 17 nt, Mycobacterium avium subsp. paratuberculosis
cgacgcugagccgcucg

SEQ ID NO: 2932359 - RNA, 14 nt, Mycobacterium avium subsp. paratuberculosis
cgacgcugagcgcc

SEQ ID NO: 2932360 - RNA, 15 nt, Mycobacterium avium subsp. paratuberculosis
cgacgcugagcgcca

SEQ ID NO: 2932361 - RNA, 17 nt, Mycobacterium avium subsp. paratuberculosis
cgacgcugagcgccagg

SEQ ID NO: 2932362 - RNA, 15 nt, Mycobacterium avium subsp. paratuberculosis
cgacgcugcaggugg

SEQ ID NO: 2932363 - RNA, 21 nt, Mycobacterium avium subsp. paratuberculosis
cgacgcugcagguggcccaca

SEQ ID NO: 2932364 - RNA, 17 nt, Mycobacterium avium subsp. paratuberculosis
cgacgcugcccaaccgu

SEQ ID NO: 2932365 - RNA, 16 nt, Mycobacterium avium subsp. paratuberculosis
cgacgcugccggggcg

SEQ ID NO: 2932366 - RNA, 18 nt, Mycobacterium avium subsp. paratuberculosis
cgacgcugccggggcgca

SEQ ID NO: 2932367 - RNA, 21 nt, Mycobacterium avium subsp. paratuberculosis
cgacgcugccgguggucccgg

SEQ ID NO: 2932368 - RNA, 19 nt, Mycobacterium avium subsp. paratuberculosis
cgacgcuggccgagagccg

SEQ ID NO: 2932369 - RNA, 19 nt, Mycobacterium avium subsp. paratuberculosis
cgacgcugugcucgggagu

SEQ ID NO: 2932370 - RNA, 17 nt, Mycobacterium avium subsp. paratuberculosis
cgacggaccagugcagg

SEQ ID NO: 2932371 - RNA, 18 nt, Mycobacterium avium subsp. paratuberculosis
cgacggaccagugcaggu

SEQ ID NO: 2932372 - RNA, 12 nt, Mycobacterium avium subsp. paratuberculosis
cgacggacgggu

SEQ ID NO: 2932373 - RNA, 15 nt, Mycobacterium avium subsp. paratuberculosis
cgacggacgggucgu

SEQ ID NO: 2932374 - RNA, 15 nt, Mycobacterium avium subsp. paratuberculosis
cgacggagacgacca

SEQ ID NO: 2932375 - RNA, 22 nt, Mycobacterium avium subsp. paratuberculosis
cgacggagacgacgacgaacgc

SEQ ID NO: 2932376 - RNA, 15 nt, Mycobacterium avium subsp. paratuberculosis
cgacggagccgagca

SEQ ID NO: 2932377 - RNA, 17 nt, Mycobacterium avium subsp. paratuberculosis
cgacggagccgagcacc

SEQ ID NO: 2932378 - RNA, 22 nt, Mycobacterium avium subsp. paratuberculosis
cgacggagccgagcaccaggcg

SEQ ID NO: 2932379 - RNA, 15 nt, Mycobacterium avium subsp. paratuberculosis
cgacggagucgucgg

SEQ ID NO: 2932380 - RNA, 13 nt, Mycobacterium avium subsp. paratuberculosis
cgacggaucgccc

SEQ ID NO: 2932381 - RNA, 16 nt, Mycobacterium avium subsp. paratuberculosis
cgacggaucggccgcg

SEQ ID NO: 2932382 - RNA, 17 nt, Mycobacterium avium subsp. paratuberculosis
cgacggaucggccgcgu

SEQ ID NO: 2932383 - RNA, 15 nt, Mycobacterium avium subsp. paratuberculosis
cgacggaucugcucg

SEQ ID NO: 2932384 - RNA, 18 nt, Mycobacterium avium subsp. paratuberculosis
cgacggcaauacggggca

SEQ ID NO: 2932385 - RNA, 20 nt, Mycobacterium avium subsp. paratuberculosis
cgacggcaauccggccccgc

SEQ ID NO: 2932386 - RNA, 23 nt, Mycobacterium avium subsp. paratuberculosis
cgacggcaauccggccccgcugc

SEQ ID NO: 2932387 - RNA, 15 nt, Mycobacterium avium subsp. paratuberculosis
cgacggcacccggcc

SEQ ID NO: 2932388 - RNA, 15 nt, Mycobacterium avium subsp. paratuberculosis
cgacggcaccucucg

SEQ ID NO: 2932389 - RNA, 19 nt, Mycobacterium avium subsp. paratuberculosis
cgacggcaccucucgggaa

SEQ ID NO: 2932390 - RNA, 14 nt, Mycobacterium avium subsp. paratuberculosis
cgacggcagcaccg

SEQ ID NO: 2932391 - RNA, 18 nt, Mycobacterium avium subsp. paratuberculosis
cgacggcagcaccgccga

SEQ ID NO: 2932392 - RNA, 23 nt, Mycobacterium avium subsp. paratuberculosis
cgacggcagcaccgccgacaucg

SEQ ID NO: 2932393 - RNA, 15 nt, Mycobacterium avium subsp. paratuberculosis
cgacggcagcaccuc

SEQ ID NO: 2932394 - RNA, 14 nt, Mycobacterium avium subsp. paratuberculosis
cgacggcagcgcga

SEQ ID NO: 2932395 - RNA, 14 nt, Mycobacterium avium subsp. paratuberculosis
cgacggcagcggca

SEQ ID NO: 2932396 - RNA, 23 nt, Mycobacterium avium subsp. paratuberculosis
cgacggcagcggcaccaacccga

SEQ ID NO: 2932397 - RNA, 23 nt, Mycobacterium avium subsp. paratuberculosis
cgacggcauugcagcggaugccg

SEQ ID NO: 2932398 - RNA, 18 nt, Mycobacterium avium subsp. paratuberculosis
cgacggccaccgcgacgc

SEQ ID NO: 2932399 - RNA, 22 nt, Mycobacterium avium subsp. paratuberculosis
cgacggccaccgcgacgcugcc

SEQ ID NO: 2932400 - RNA, 14 nt, Mycobacterium avium subsp. paratuberculosis
cgacggccagaccg

SEQ ID NO: 2932401 - RNA, 14 nt, Mycobacterium avium subsp. paratuberculosis
cgacggccagcgcg

SEQ ID NO: 2932402 - RNA, 15 nt, Mycobacterium avium subsp. paratuberculosis
cgacggccagcgcgg

SEQ ID NO: 2932403 - RNA, 16 nt, Mycobacterium avium subsp. paratuberculosis
cgacggccagcgcggc

SEQ ID NO: 2932404 - RNA, 22 nt, Mycobacterium avium subsp. paratuberculosis
cgacggccagcgcggcggucgc

SEQ ID NO: 2932405 - RNA, 22 nt, Mycobacterium avium subsp. paratuberculosis
cgacggccagcugauagccgcc

SEQ ID NO: 2932406 - RNA, 15 nt, Mycobacterium avium subsp. paratuberculosis
cgacggccccccggg

SEQ ID NO: 2932407 - RNA, 18 nt, Mycobacterium avium subsp. paratuberculosis
cgacggccccccgggcac

SEQ ID NO: 2932408 - RNA, 21 nt, Mycobacterium avium subsp. paratuberculosis
cgacggccccccgggcaccag

SEQ ID NO: 2932409 - RNA, 13 nt, Mycobacterium avium subsp. paratuberculosis
cgacggcccgccg

SEQ ID NO: 2932410 - RNA, 20 nt, Mycobacterium avium subsp. paratuberculosis
cgacggcccgccggagccga

SEQ ID NO: 2932411 - RNA, 15 nt, Mycobacterium avium subsp. paratuberculosis
cgacggcccggucca

SEQ ID NO: 2932412 - RNA, 21 nt, Mycobacterium avium subsp. paratuberculosis
cgacggccgcaccccacccgc

SEQ ID NO: 2932413 - RNA, 12 nt, Mycobacterium avium subsp. paratuberculosis
cgacggccgccg

SEQ ID NO: 2932414 - RNA, 15 nt, Mycobacterium avium subsp. paratuberculosis
cgacggcgucggcga

SEQ ID NO: 2932415 - RNA, 17 nt, Mycobacterium avium subsp. paratuberculosis
cgacggcgucggcgagc

SEQ ID NO: 2932416 - RNA, 17 nt, Mycobacterium avium subsp. paratuberculosis
cgacggcgucggcggcc

SEQ ID NO: 2932417 - RNA, 20 nt, Mycobacterium avium subsp. paratuberculosis
cgacggcgucggcggccugc

SEQ ID NO: 2932418 - RNA, 21 nt, Mycobacterium avium subsp. paratuberculosis
cgacggcgucggcggccugcu

SEQ ID NO: 2932419 - RNA, 15 nt, Mycobacterium avium subsp. paratuberculosis
cgacggcguugcugg

SEQ ID NO: 2932420 - RNA, 17 nt, Mycobacterium avium subsp. paratuberculosis
cgacggcguugcuggcg

SEQ ID NO: 2932421 - RNA, 18 nt, Mycobacterium avium subsp. paratuberculosis
cgacggcguugcuggcgc

SEQ ID NO: 2932422 - RNA, 18 nt, Mycobacterium avium subsp. paratuberculosis
cgacggcucuucgcggcg

SEQ ID NO: 2932423 - RNA, 20 nt, Mycobacterium avium subsp. paratuberculosis
cgacggcucuucgcggcggg

SEQ ID NO: 2932424 - RNA, 23 nt, Mycobacterium avium subsp. paratuberculosis
cgacggcucuucgcggcggggca

SEQ ID NO: 2932425 - RNA, 15 nt, Mycobacterium avium subsp. paratuberculosis
cgacggcugcccggc

SEQ ID NO: 2932426 - RNA, 19 nt, Mycobacterium avium subsp. paratuberculosis
cgacggcugcccggcccgc

SEQ ID NO: 2932427 - RNA, 21 nt, Mycobacterium avium subsp. paratuberculosis
cgacggcugcccggcccgccg

SEQ ID NO: 2932428 - RNA, 19 nt, Mycobacterium avium subsp. paratuberculosis
cgacggcugcgguuggccg

SEQ ID NO: 2932429 - RNA, 17 nt, Mycobacterium avium subsp. paratuberculosis
cgacggcuggguggcga

SEQ ID NO: 2932430 - RNA, 17 nt, Mycobacterium avium subsp. paratuberculosis
cgacgggaacucggcca

SEQ ID NO: 2932431 - RNA, 18 nt, Mycobacterium avium subsp. paratuberculosis
cgacgggaacucggccag

SEQ ID NO: 2932432 - RNA, 22 nt, Mycobacterium avium subsp. paratuberculosis
cgacgggaacucggccagcugg

SEQ ID NO: 2932433 - RNA, 23 nt, Mycobacterium avium subsp. paratuberculosis
cgacgggaagaucgcagcgguga

SEQ ID NO: 2932434 - RNA, 23 nt, Mycobacterium avium subsp. paratuberculosis
cgacgggauccggauugccgggc

SEQ ID NO: 2932435 - RNA, 12 nt, Mycobacterium avium subsp. paratuberculosis
cgacgggcaccc

SEQ ID NO: 2932436 - RNA, 18 nt, Mycobacterium avium subsp. paratuberculosis
cgacgggcacccgcgcgu

SEQ ID NO: 2932437 - RNA, 20 nt, Mycobacterium avium subsp. paratuberculosis
cgacgggcacccgcgcgucg

SEQ ID NO: 2932438 - RNA, 15 nt, Mycobacterium avium subsp. paratuberculosis
cgacgggcaggguga

SEQ ID NO: 2932439 - RNA, 17 nt, Mycobacterium avium subsp. paratuberculosis
cgacgggcagggugacc

SEQ ID NO: 2932440 - RNA, 20 nt, Mycobacterium avium subsp. paratuberculosis
cgacgggcagggugaccgag

SEQ ID NO: 2932441 - RNA, 14 nt, Mycobacterium avium subsp. paratuberculosis
cgacgggcaugccg

SEQ ID NO: 2932442 - RNA, 19 nt, Mycobacterium avium subsp. paratuberculosis
cgacgggcaugccgucggc

SEQ ID NO: 2932443 - RNA, 20 nt, Mycobacterium avium subsp. paratuberculosis
cgacgggcaugccgucggcg

SEQ ID NO: 2932444 - RNA, 15 nt, Mycobacterium avium subsp. paratuberculosis
cgacgggccaccagc

SEQ ID NO: 2932445 - RNA, 18 nt, Mycobacterium avium subsp. paratuberculosis
cgacgggccaccagcgca

SEQ ID NO: 2932446 - RNA, 16 nt, Mycobacterium avium subsp. paratuberculosis
cgacgggcccagcgcg

SEQ ID NO: 2932447 - RNA, 19 nt, Mycobacterium avium subsp. paratuberculosis
cgacgggcccagcgcgacg

SEQ ID NO: 2932448 - RNA, 23 nt, Mycobacterium avium subsp. paratuberculosis
cgacgggcccagcgcgacgucga

SEQ ID NO: 2932449 - RNA, 12 nt, Mycobacterium avium subsp. paratuberculosis
cgacgggcccgc

SEQ ID NO: 2932450 - RNA, 14 nt, Mycobacterium avium subsp. paratuberculosis
cgacgggcccgcgc

SEQ ID NO: 2932451 - RNA, 15 nt, Mycobacterium avium subsp. paratuberculosis
cgacgggcccgcgcc

SEQ ID NO: 2932452 - RNA, 17 nt, Mycobacterium avium subsp. paratuberculosis
cgacgggcccgcgccuu

SEQ ID NO: 2932453 - RNA, 13 nt, Mycobacterium avium subsp. paratuberculosis
cgacgggccgauc

SEQ ID NO: 2932454 - RNA, 20 nt, Mycobacterium avium subsp. paratuberculosis
cgacgggccgaucacgcgga

SEQ ID NO: 2932455 - RNA, 15 nt, Mycobacterium avium subsp. paratuberculosis
cgacgggccgggcac

SEQ ID NO: 2932456 - RNA, 18 nt, Mycobacterium avium subsp. paratuberculosis
cgacgggccgggcacguc

SEQ ID NO: 2932457 - RNA, 14 nt, Mycobacterium avium subsp. paratuberculosis
cgacgggcgugccg

SEQ ID NO: 2932458 - RNA, 17 nt, Mycobacterium avium subsp. paratuberculosis
cgacgggcgugccggcg

SEQ ID NO: 2932459 - RNA, 19 nt, Mycobacterium avium subsp. paratuberculosis
cgacgggcgugccggcggc

SEQ ID NO: 2932460 - RNA, 20 nt, Mycobacterium avium subsp. paratuberculosis
cgacgggcgugccggcggcg

SEQ ID NO: 2932461 - RNA, 21 nt, Mycobacterium avium subsp. paratuberculosis
cgacgggcgugccggcggcgg

SEQ ID NO: 2932462 - RNA, 14 nt, Mycobacterium avium subsp. paratuberculosis
cgacgggcucggcg

SEQ ID NO: 2932463 - RNA, 20 nt, Mycobacterium avium subsp. paratuberculosis
cgacgggcucggcguacagg

SEQ ID NO: 2932464 - RNA, 20 nt, Mycobacterium avium subsp. paratuberculosis
cgacgggcugucccggccgc

SEQ ID NO: 2932465 - RNA, 23 nt, Mycobacterium avium subsp. paratuberculosis
cgacgggcugucccggccgcgac

SEQ ID NO: 2932466 - RNA, 20 nt, Mycobacterium avium subsp. paratuberculosis
cgacggggugguucguccgg

SEQ ID NO: 2932467 - RNA, 23 nt, Mycobacterium avium subsp. paratuberculosis
cgacgggguucaguagcagcguc

SEQ ID NO: 2932468 - RNA, 15 nt, Mycobacterium avium subsp. paratuberculosis
cgacgggugggugga

SEQ ID NO: 2932469 - RNA, 22 nt, Mycobacterium avium subsp. paratuberculosis
cgacggguucgcgcagccaccg

SEQ ID NO: 2932470 - RNA, 13 nt, Mycobacterium avium subsp. paratuberculosis
cgacggguugcgg

SEQ ID NO: 2932471 - RNA, 16 nt, Mycobacterium avium subsp. paratuberculosis
cgacggucaccggcag

SEQ ID NO: 2932472 - RNA, 18 nt, Mycobacterium avium subsp. paratuberculosis
cgacggucaccggcaggc

SEQ ID NO: 2932473 - RNA, 17 nt, Mycobacterium avium subsp. paratuberculosis
cgacggucacgcuggcg

SEQ ID NO: 2932474 - RNA, 18 nt, Mycobacterium avium subsp. paratuberculosis
cgacggucacggccgcca

SEQ ID NO: 2932475 - RNA, 19 nt, Mycobacterium avium subsp. paratuberculosis
cgacggucacggccgccag

SEQ ID NO: 2932476 - RNA, 21 nt, Mycobacterium avium subsp. paratuberculosis
cgacggucacggccgccagca

SEQ ID NO: 2932477 - RNA, 14 nt, Mycobacterium avium subsp. paratuberculosis
cgacggucagcacg

SEQ ID NO: 2932478 - RNA, 15 nt, Mycobacterium avium subsp. paratuberculosis
cgacggucagcacgc

SEQ ID NO: 2932479 - RNA, 17 nt, Mycobacterium avium subsp. paratuberculosis
cgacggucagcacgcug

SEQ ID NO: 2932480 - RNA, 22 nt, Mycobacterium avium subsp. paratuberculosis
cgacggucagcacgcugaucac

SEQ ID NO: 2932481 - RNA, 16 nt, Mycobacterium avium subsp. paratuberculosis
cgacggucaguccggg

SEQ ID NO: 2932482 - RNA, 17 nt, Mycobacterium avium subsp. paratuberculosis
cgacggucccacucggg

SEQ ID NO: 2932483 - RNA, 22 nt, Mycobacterium avium subsp. paratuberculosis
cgacggucgccaccaccacggg

SEQ ID NO: 2932484 - RNA, 20 nt, Mycobacterium avium subsp. paratuberculosis
cgacggucgugcugggccgg

SEQ ID NO: 2932485 - RNA, 22 nt, Mycobacterium avium subsp. paratuberculosis
cgacggucgugcugggccgggc

SEQ ID NO: 2932486 - RNA, 17 nt, Mycobacterium avium subsp. paratuberculosis
cgacggucugccgggac

SEQ ID NO: 2932487 - RNA, 17 nt, Mycobacterium avium subsp. paratuberculosis
cgacggucuucccgccg

SEQ ID NO: 2932488 - RNA, 15 nt, Mycobacterium avium subsp. paratuberculosis
cgacggugaccggcu

SEQ ID NO: 2932489 - RNA, 17 nt, Mycobacterium avium subsp. paratuberculosis
cgacggugaccggcucg

SEQ ID NO: 2932490 - RNA, 20 nt, Mycobacterium avium subsp. paratuberculosis
cgacggugaccggcucgagc

SEQ ID NO: 2932491 - RNA, 14 nt, Mycobacterium avium subsp. paratuberculosis
cgacggugaccucg

SEQ ID NO: 2932492 - RNA, 17 nt, Mycobacterium avium subsp. paratuberculosis
cgacggugaccucgucg

SEQ ID NO: 2932493 - RNA, 18 nt, Mycobacterium avium subsp. paratuberculosis
cgacggugaccucgucgg

SEQ ID NO: 2932494 - RNA, 20 nt, Mycobacterium avium subsp. paratuberculosis
cgacggugaccucgucgggc

SEQ ID NO: 2932495 - RNA, 22 nt, Mycobacterium avium subsp. paratuberculosis
cgacggugaccucgucgggcgc

SEQ ID NO: 2932496 - RNA, 22 nt, Mycobacterium avium subsp. paratuberculosis
cgacggugagcaacaccggcac

SEQ ID NO: 2932497 - RNA, 15 nt, Mycobacterium avium subsp. paratuberculosis
cgacggugagcaccg

SEQ ID NO: 2932498 - RNA, 14 nt, Mycobacterium avium subsp. paratuberculosis
cgacgucgaacgcg

SEQ ID NO: 2932499 - RNA, 23 nt, Mycobacterium avium subsp. paratuberculosis
cgacgucgaacgcguacacggcc

SEQ ID NO: 2932500 - RNA, 14 nt, Mycobacterium avium subsp. paratuberculosis
cgacgucgaccgcg

SEQ ID NO: 2932501 - RNA, 15 nt, Mycobacterium avium subsp. paratuberculosis
cgacgucgaccgcga

SEQ ID NO: 2932502 - RNA, 17 nt, Mycobacterium avium subsp. paratuberculosis
cgacgucgaccgcgacg

SEQ ID NO: 2932503 - RNA, 21 nt, Mycobacterium avium subsp. paratuberculosis
cgacgucgaccgcgacgaccu

SEQ ID NO: 2932504 - RNA, 16 nt, Mycobacterium avium subsp. paratuberculosis
cgacgucgaccgcgcc

SEQ ID NO: 2932505 - RNA, 12 nt, Mycobacterium avium subsp. paratuberculosis
cgacgucgacga

SEQ ID NO: 2932506 - RNA, 13 nt, Mycobacterium avium subsp. paratuberculosis
cgacgucgacgac

SEQ ID NO: 2932507 - RNA, 16 nt, Mycobacterium avium subsp. paratuberculosis
cgacgucgacgcgggc

SEQ ID NO: 2932508 - RNA, 16 nt, Mycobacterium avium subsp. paratuberculosis
cgacgucgacggcagc

SEQ ID NO: 2932509 - RNA, 17 nt, Mycobacterium avium subsp. paratuberculosis
cgacgucgacggcagcg

SEQ ID NO: 2932510 - RNA, 12 nt, Mycobacterium avium subsp. paratuberculosis
cgacgucgacgu

SEQ ID NO: 2932511 - RNA, 16 nt, Mycobacterium avium subsp. paratuberculosis
cgacgucgacgucgag

SEQ ID NO: 2932512 - RNA, 20 nt, Mycobacterium avium subsp. paratuberculosis
cgacgucgagaaaggccagc

SEQ ID NO: 2932513 - RNA, 23 nt, Mycobacterium avium subsp. paratuberculosis
cgacgucgagaaaggccagcacg

SEQ ID NO: 2932514 - RNA, 21 nt, Mycobacterium avium subsp. paratuberculosis
cgacgucgagccagcgggccg

SEQ ID NO: 2932515 - RNA, 19 nt, Mycobacterium avium subsp. paratuberculosis
cgacgucgccaccagaccg

SEQ ID NO: 2932516 - RNA, 23 nt, Mycobacterium avium subsp. paratuberculosis
cgacgucgccaccagaccggcga

SEQ ID NO: 2932517 - RNA, 14 nt, Mycobacterium avium subsp. paratuberculosis
cgacgucgccggcc

SEQ ID NO: 2932518 - RNA, 14 nt, Mycobacterium avium subsp. paratuberculosis
cgacgucggacgcg

SEQ ID NO: 2932519 - RNA, 20 nt, Mycobacterium avium subsp. paratuberculosis
cgacgucggacgcggccgag

SEQ ID NO: 2932520 - RNA, 15 nt, Mycobacterium avium subsp. paratuberculosis
cgacgucggcgucau

SEQ ID NO: 2932521 - RNA, 17 nt, Mycobacterium avium subsp. paratuberculosis
cgacgucggcgucaucg

SEQ ID NO: 2932522 - RNA, 19 nt, Mycobacterium avium subsp. paratuberculosis
cgacgucggcgucaucgac

SEQ ID NO: 2932523 - RNA, 14 nt, Mycobacterium avium subsp. paratuberculosis
cgacgucggggaug

SEQ ID NO: 2932524 - RNA, 21 nt, Mycobacterium avium subsp. paratuberculosis
cgacgucggggucgucgcggu

SEQ ID NO: 2932525 - RNA, 13 nt, Mycobacterium avium subsp. paratuberculosis
cgacgucggucgg

SEQ ID NO: 2932526 - RNA, 13 nt, Mycobacterium avium subsp. paratuberculosis
cgacgucgguggu

SEQ ID NO: 2932527 - RNA, 14 nt, Mycobacterium avium subsp. paratuberculosis
cgacgucgguggug

SEQ ID NO: 2932528 - RNA, 17 nt, Mycobacterium avium subsp. paratuberculosis
cgacgucgguggugacg

SEQ ID NO: 2932529 - RNA, 23 nt, Mycobacterium avium subsp. paratuberculosis
cgacgucgguguagucggcgauc

SEQ ID NO: 2932530 - RNA, 21 nt, Mycobacterium avium subsp. paratuberculosis
cgacgucguagagcaggaccg

SEQ ID NO: 2932531 - RNA, 14 nt, Mycobacterium avium subsp. paratuberculosis
cgacgucgucgacc

SEQ ID NO: 2932532 - RNA, 16 nt, Mycobacterium avium subsp. paratuberculosis
cgacgucgucgacccg

SEQ ID NO: 2932533 - RNA, 20 nt, Mycobacterium avium subsp. paratuberculosis
cgacgucgucgaugccgauc

SEQ ID NO: 2932534 - RNA, 15 nt, Mycobacterium avium subsp. paratuberculosis
cgacgucgucgccca

SEQ ID NO: 2932535 - RNA, 17 nt, Mycobacterium avium subsp. paratuberculosis
cgacgucgucgcccacc

SEQ ID NO: 2932536 - RNA, 24 nt, Mycobacterium avium subsp. paratuberculosis
cgacgucgucgcccacccgccagc

SEQ ID NO: 2932537 - RNA, 16 nt, Mycobacterium avium subsp. paratuberculosis
cgacgucgucguccuc

SEQ ID NO: 2932538 - RNA, 20 nt, Mycobacterium avium subsp. paratuberculosis
cgacgucgugcacgccgugg

SEQ ID NO: 2932539 - RNA, 12 nt, Mycobacterium avium subsp. paratuberculosis
cgacgucguggc

SEQ ID NO: 2932540 - RNA, 19 nt, Mycobacterium avium subsp. paratuberculosis
cgacgucgugggcgauccg

SEQ ID NO: 2932541 - RNA, 18 nt, Mycobacterium avium subsp. paratuberculosis
cgacgucugcggcucggc

SEQ ID NO: 2932542 - RNA, 19 nt, Mycobacterium avium subsp. paratuberculosis
cgacgucugguuggccggc

SEQ ID NO: 2932543 - RNA, 21 nt, Mycobacterium avium subsp. paratuberculosis
cgacgucugguuggccggcgg

SEQ ID NO: 2932544 - RNA, 19 nt, Mycobacterium avium subsp. paratuberculosis
cgacgugaucuggucggcc

SEQ ID NO: 2932545 - RNA, 23 nt, Mycobacterium avium subsp. paratuberculosis
cgacgugaucuggucggccagcg

SEQ ID NO: 2932546 - RNA, 13 nt, Mycobacterium avium subsp. paratuberculosis
cgacgugcagcgc

SEQ ID NO: 2932547 - RNA, 15 nt, Mycobacterium avium subsp. paratuberculosis
cgacgugcagcgcca

SEQ ID NO: 2932548 - RNA, 19 nt, Mycobacterium avium subsp. paratuberculosis
cgacgugcagcgccagcac

SEQ ID NO: 2932549 - RNA, 21 nt, Mycobacterium avium subsp. paratuberculosis
cgacgugcccgaucucgucgg

SEQ ID NO: 2932550 - RNA, 21 nt, Mycobacterium avium subsp. paratuberculosis
cgacgugcccuuccccggcgg

SEQ ID NO: 2932551 - RNA, 14 nt, Mycobacterium avium subsp. paratuberculosis
cgacgugccggcga

SEQ ID NO: 2932552 - RNA, 16 nt, Mycobacterium avium subsp. paratuberculosis
cgacgugccggcgaug

SEQ ID NO: 2932553 - RNA, 15 nt, Mycobacterium avium subsp. paratuberculosis
cgacgugccggcggc

SEQ ID NO: 2932554 - RNA, 16 nt, Mycobacterium avium subsp. paratuberculosis
cgacgugccggcggca

SEQ ID NO: 2932555 - RNA, 20 nt, Mycobacterium avium subsp. paratuberculosis
cgacgugccguugacgaaca

SEQ ID NO: 2932556 - RNA, 21 nt, Mycobacterium avium subsp. paratuberculosis
cgacgugccguugacgaacag

SEQ ID NO: 2932557 - RNA, 14 nt, Mycobacterium avium subsp. paratuberculosis
cgacgugcgcggcg

SEQ ID NO: 2932558 - RNA, 13 nt, Mycobacterium avium subsp. paratuberculosis
cgacgugcucggc

SEQ ID NO: 2932559 - RNA, 17 nt, Mycobacterium avium subsp. paratuberculosis
cgacgugcucggcggcc

SEQ ID NO: 2932560 - RNA, 21 nt, Mycobacterium avium subsp. paratuberculosis
cgacgugcucggcggccgcca

SEQ ID NO: 2932561 - RNA, 18 nt, Mycobacterium avium subsp. paratuberculosis
cgacgugcuuggccagcu

SEQ ID NO: 2932562 - RNA, 21 nt, Mycobacterium avium subsp. paratuberculosis
cgacgugcuuggccagcucgg

SEQ ID NO: 2932563 - RNA, 22 nt, Mycobacterium avium subsp. paratuberculosis
cgacgugcuuggccagcucggc

SEQ ID NO: 2932564 - RNA, 23 nt, Mycobacterium avium subsp. paratuberculosis
cgacgugcuuggccagcucggcg

SEQ ID NO: 2932565 - RNA, 20 nt, Mycobacterium avium subsp. paratuberculosis
cgacguggagucgaagcggu

SEQ ID NO: 2932566 - RNA, 14 nt, Mycobacterium avium subsp. paratuberculosis
cgacgugggcggcc

SEQ ID NO: 2932567 - RNA, 15 nt, Mycobacterium avium subsp. paratuberculosis
cgacgugggcggcca

SEQ ID NO: 2932568 - RNA, 18 nt, Mycobacterium avium subsp. paratuberculosis
cgacgugggcggccacca

SEQ ID NO: 2932569 - RNA, 13 nt, Mycobacterium avium subsp. paratuberculosis
cgacguggugcac

SEQ ID NO: 2932570 - RNA, 15 nt, Mycobacterium avium subsp. paratuberculosis
cgacguggugcaccg

SEQ ID NO: 2932571 - RNA, 16 nt, Mycobacterium avium subsp. paratuberculosis
cgacguggugcaccgc

SEQ ID NO: 2932572 - RNA, 18 nt, Mycobacterium avium subsp. paratuberculosis
cgacguggugcaccgcca

SEQ ID NO: 2932573 - RNA, 19 nt, Mycobacterium avium subsp. paratuberculosis
cgacguggugcaccgccag

SEQ ID NO: 2932574 - RNA, 21 nt, Mycobacterium avium subsp. paratuberculosis
cgacguggugcaccgccagcg

SEQ ID NO: 2932575 - RNA, 22 nt, Mycobacterium avium subsp. paratuberculosis
cgacguggugcaccgccagcgc

SEQ ID NO: 2932576 - RNA, 24 nt, Mycobacterium avium subsp. paratuberculosis
cgacguggugcaccgccagcgcgg

SEQ ID NO: 2932577 - RNA, 20 nt, Mycobacterium avium subsp. paratuberculosis
cgacgugucgucgucgccgc

SEQ ID NO: 2932578 - RNA, 23 nt, Mycobacterium avium subsp. paratuberculosis
cgacgugucgucgucgccgccgg

SEQ ID NO: 2932579 - RNA, 24 nt, Mycobacterium avium subsp. paratuberculosis
cgacgugucgucgucgccgccggu

SEQ ID NO: 2932580 - RNA, 20 nt, Mycobacterium avium subsp. paratuberculosis
cgacguguucaacgcgccga

SEQ ID NO: 2932581 - RNA, 22 nt, Mycobacterium avium subsp. paratuberculosis
cgacguguucaacgcgccgaug

SEQ ID NO: 2932582 - RNA, 19 nt, Mycobacterium avium subsp. paratuberculosis
cgacuucggcucggcgaca

SEQ ID NO: 2932583 - RNA, 23 nt, Mycobacterium avium subsp. paratuberculosis
cgacuucguugguggucgacgcg

SEQ ID NO: 2932584 - RNA, 18 nt, Mycobacterium avium subsp. paratuberculosis
cgacuucuucgccggcgc

SEQ ID NO: 2932585 - RNA, 20 nt, Mycobacterium avium subsp. paratuberculosis
cgacuucuucgccggcgcuu

SEQ ID NO: 2932586 - RNA, 18 nt, Mycobacterium avium subsp. paratuberculosis
cgacuugaccagcagcug

SEQ ID NO: 2932587 - RNA, 22 nt, Mycobacterium avium subsp. paratuberculosis
cgacuugccaauucacgagucg

SEQ ID NO: 2932588 - RNA, 16 nt, Mycobacterium avium subsp. paratuberculosis
cgacuugccgccgcac

SEQ ID NO: 2932589 - RNA, 18 nt, Mycobacterium avium subsp. paratuberculosis
cgacuugccgccggcgca

SEQ ID NO: 2932590 - RNA, 15 nt, Mycobacterium avium subsp. paratuberculosis
cgacuugcgcgccgu

SEQ ID NO: 2932591 - RNA, 21 nt, Mycobacterium avium subsp. paratuberculosis
cgacuuggccagcagccgcga

SEQ ID NO: 2932592 - RNA, 22 nt, Mycobacterium avium subsp. paratuberculosis
cgacuuggccagcagccgcgac

SEQ ID NO: 2932593 - RNA, 14 nt, Mycobacterium avium subsp. paratuberculosis
cgacuugguggcca

SEQ ID NO: 2932594 - RNA, 18 nt, Mycobacterium avium subsp. paratuberculosis
cgacuugguggccagcac

SEQ ID NO: 2932595 - RNA, 16 nt, Mycobacterium avium subsp. paratuberculosis
cgacuuucaaguccuc

SEQ ID NO: 2932596 - RNA, 15 nt, Mycobacterium avium subsp. paratuberculosis
cgagaaaaucgcccg

SEQ ID NO: 2932597 - RNA, 19 nt, Mycobacterium avium subsp. paratuberculosis
cgagaaaaucgcccgcgaa

SEQ ID NO: 2932598 - RNA, 16 nt, Mycobacterium avium subsp. paratuberculosis
cgagaaacgcgcgcag

SEQ ID NO: 2932599 - RNA, 17 nt, Mycobacterium avium subsp. paratuberculosis
cgagaaacgcgcgcagu

SEQ ID NO: 2932600 - RNA, 15 nt, Mycobacterium avium subsp. paratuberculosis
cgagaaaggccagca

SEQ ID NO: 2932601 - RNA, 19 nt, Mycobacterium avium subsp. paratuberculosis
cgagaacagaugccggugc

SEQ ID NO: 2932602 - RNA, 19 nt, Mycobacterium avium subsp. paratuberculosis
cgagaacaggccgagcgcg

SEQ ID NO: 2932603 - RNA, 20 nt, Mycobacterium avium subsp. paratuberculosis
cgagaagcccgugcgacggc

SEQ ID NO: 2932604 - RNA, 16 nt, Mycobacterium avium subsp. paratuberculosis
cgagaaggcggcgucg

SEQ ID NO: 2932605 - RNA, 15 nt, Mycobacterium avium subsp. paratuberculosis
cgagaagggccgccg

SEQ ID NO: 2932606 - RNA, 14 nt, Mycobacterium avium subsp. paratuberculosis
cgagaagucgccga

SEQ ID NO: 2932607 - RNA, 16 nt, Mycobacterium avium subsp. paratuberculosis
cgagaagucgccgacg

SEQ ID NO: 2932608 - RNA, 18 nt, Mycobacterium avium subsp. paratuberculosis
cgagaagucgccgacgcc

SEQ ID NO: 2932609 - RNA, 19 nt, Mycobacterium avium subsp. paratuberculosis
cgagaagucgccgacgccg

SEQ ID NO: 2932610 - RNA, 20 nt, Mycobacterium avium subsp. paratuberculosis
cgagacacauucgcgugugc

SEQ ID NO: 2932611 - RNA, 22 nt, Mycobacterium avium subsp. paratuberculosis
cgagacaccgucgcgcacccag

SEQ ID NO: 2932612 - RNA, 18 nt, Mycobacterium avium subsp. paratuberculosis
cgagacaccucgucgauc

SEQ ID NO: 2932613 - RNA, 14 nt, Mycobacterium avium subsp. paratuberculosis
cgagacacgcgccg

SEQ ID NO: 2932614 - RNA, 15 nt, Mycobacterium avium subsp. paratuberculosis
cgagacacgcgccgg

SEQ ID NO: 2932615 - RNA, 16 nt, Mycobacterium avium subsp. paratuberculosis
cgagacacgcgccggc

SEQ ID NO: 2932616 - RNA, 17 nt, Mycobacterium avium subsp. paratuberculosis
cgagacacgcgccggcg

SEQ ID NO: 2932617 - RNA, 16 nt, Mycobacterium avium subsp. paratuberculosis
cgagaccaugccgccg

SEQ ID NO: 2932618 - RNA, 17 nt, Mycobacterium avium subsp. paratuberculosis
cgagaccaugucggcca

SEQ ID NO: 2932619 - RNA, 20 nt, Mycobacterium avium subsp. paratuberculosis
cgagaccaugucggccaggu

SEQ ID NO: 2932620 - RNA, 17 nt, Mycobacterium avium subsp. paratuberculosis
cgagaccgcuugcggcu

SEQ ID NO: 2932621 - RNA, 20 nt, Mycobacterium avium subsp. paratuberculosis
cgagaccggcacggugcaca

SEQ ID NO: 2932622 - RNA, 19 nt, Mycobacterium avium subsp. paratuberculosis
cgagaccgucggugcgggg

SEQ ID NO: 2932623 - RNA, 15 nt, Mycobacterium avium subsp. paratuberculosis
cgagaccucccggcg

SEQ ID NO: 2932624 - RNA, 16 nt, Mycobacterium avium subsp. paratuberculosis
cgagaccucccggcgc

SEQ ID NO: 2932625 - RNA, 18 nt, Mycobacterium avium subsp. paratuberculosis
cgagaccucccggcgcca

SEQ ID NO: 2932626 - RNA, 21 nt, Mycobacterium avium subsp. paratuberculosis
cgagaccucccggcgccacgc

SEQ ID NO: 2932627 - RNA, 21 nt, Mycobacterium avium subsp. paratuberculosis
cgagacgaaguccgagccggc

SEQ ID NO: 2932628 - RNA, 14 nt, Mycobacterium avium subsp. paratuberculosis
cgagacgaccagga

SEQ ID NO: 2932629 - RNA, 16 nt, Mycobacterium avium subsp. paratuberculosis
cgagacgaccaggaug

SEQ ID NO: 2932630 - RNA, 15 nt, Mycobacterium avium subsp. paratuberculosis
cgagacgagccgccg

SEQ ID NO: 2932631 - RNA, 14 nt, Mycobacterium avium subsp. paratuberculosis
cgagacggcguggc

SEQ ID NO: 2932632 - RNA, 16 nt, Mycobacterium avium subsp. paratuberculosis
cgagacguggucgggc

SEQ ID NO: 2932633 - RNA, 22 nt, Mycobacterium avium subsp. paratuberculosis
cgagacgugguggugcggacgg

SEQ ID NO: 2932634 - RNA, 13 nt, Mycobacterium avium subsp. paratuberculosis
cgagagccgcauc

SEQ ID NO: 2932635 - RNA, 20 nt, Mycobacterium avium subsp. paratuberculosis
cgagagccgguagggccggu

SEQ ID NO: 2932636 - RNA, 15 nt, Mycobacterium avium subsp. paratuberculosis
cgagagcgcgucgac

SEQ ID NO: 2932637 - RNA, 19 nt, Mycobacterium avium subsp. paratuberculosis
cgagagcggaucggcggcg

SEQ ID NO: 2932638 - RNA, 19 nt, Mycobacterium avium subsp. paratuberculosis
cgagagcucuugcgcccca

SEQ ID NO: 2932639 - RNA, 21 nt, Mycobacterium avium subsp. paratuberculosis
cgagagcucuugcgccccaga

SEQ ID NO: 2932640 - RNA, 15 nt, Mycobacterium avium subsp. paratuberculosis
cgagaguaucgccac

SEQ ID NO: 2932641 - RNA, 20 nt, Mycobacterium avium subsp. paratuberculosis
cgagaguaucgccacgccga

SEQ ID NO: 2932642 - RNA, 23 nt, Mycobacterium avium subsp. paratuberculosis
cgagaguaucgccacgccgacca

SEQ ID NO: 2932643 - RNA, 15 nt, Mycobacterium avium subsp. paratuberculosis
cgagaguccgccgcc

SEQ ID NO: 2932644 - RNA, 16 nt, Mycobacterium avium subsp. paratuberculosis
cgagaguccgccgccg

SEQ ID NO: 2932645 - RNA, 17 nt, Mycobacterium avium subsp. paratuberculosis
cgagaguccgccgccgg

SEQ ID NO: 2932646 - RNA, 18 nt, Mycobacterium avium subsp. paratuberculosis
cgagaguccgccgccggg

SEQ ID NO: 2932647 - RNA, 19 nt, Mycobacterium avium subsp. paratuberculosis
cgagaguccgccgccgggc

SEQ ID NO: 2932648 - RNA, 16 nt, Mycobacterium avium subsp. paratuberculosis
cgagagucgcuggcgc

SEQ ID NO: 2932649 - RNA, 21 nt, Mycobacterium avium subsp. paratuberculosis
cgagagugcaacuagcgacgg

SEQ ID NO: 2932650 - RNA, 20 nt, Mycobacterium avium subsp. paratuberculosis
cgagaguuugcccucgucga

SEQ ID NO: 2932651 - RNA, 22 nt, Mycobacterium avium subsp. paratuberculosis
cgagaguuugcccucgucgacc

SEQ ID NO: 2932652 - RNA, 23 nt, Mycobacterium avium subsp. paratuberculosis
cgagaguuugcccucgucgacca

SEQ ID NO: 2932653 - RNA, 13 nt, Mycobacterium avium subsp. paratuberculosis
cgagaucaccggc

SEQ ID NO: 2932654 - RNA, 22 nt, Mycobacterium avium subsp. paratuberculosis
cgagaucaccggcuuggcggug

SEQ ID NO: 2932655 - RNA, 16 nt, Mycobacterium avium subsp. paratuberculosis
cgagaucagcaccagg

SEQ ID NO: 2932656 - RNA, 14 nt, Mycobacterium avium subsp. paratuberculosis
cgagaucagcaccg

SEQ ID NO: 2932657 - RNA, 17 nt, Mycobacterium avium subsp. paratuberculosis
cgagaucagcaccgggu

SEQ ID NO: 2932658 - RNA, 14 nt, Mycobacterium avium subsp. paratuberculosis
cgagaucagcgcca

SEQ ID NO: 2932659 - RNA, 17 nt, Mycobacterium avium subsp. paratuberculosis
cgagaucagggcgcgca

SEQ ID NO: 2932660 - RNA, 17 nt, Mycobacterium avium subsp. paratuberculosis
cgagaucaugccggcga

SEQ ID NO: 2932661 - RNA, 19 nt, Mycobacterium avium subsp. paratuberculosis
cgagauccaccgcgcggcc

SEQ ID NO: 2932662 - RNA, 14 nt, Mycobacterium avium subsp. paratuberculosis
cgagaucccagcgg

SEQ ID NO: 2932663 - RNA, 16 nt, Mycobacterium avium subsp. paratuberculosis
cgagaucccagcggga

SEQ ID NO: 2932664 - RNA, 22 nt, Mycobacterium avium subsp. paratuberculosis
cgagaucccugcgcucagcacg

SEQ ID NO: 2932665 - RNA, 17 nt, Mycobacterium avium subsp. paratuberculosis
cgagaucgacgcugacc

SEQ ID NO: 2932666 - RNA, 18 nt, Mycobacterium avium subsp. paratuberculosis
cgagcaccgggcgucggg

SEQ ID NO: 2932667 - RNA, 22 nt, Mycobacterium avium subsp. paratuberculosis
cgagcaccgggcgucggggccc

SEQ ID NO: 2932668 - RNA, 18 nt, Mycobacterium avium subsp. paratuberculosis
cgagcaccgggcugucgg

SEQ ID NO: 2932669 - RNA, 13 nt, Mycobacterium avium subsp. paratuberculosis
cgagcaccgugcc

SEQ ID NO: 2932670 - RNA, 23 nt, Mycobacterium avium subsp. paratuberculosis
cgagcaccgugccgucggcgucg

SEQ ID NO: 2932671 - RNA, 15 nt, Mycobacterium avium subsp. paratuberculosis
cgagcaccucgucgc

SEQ ID NO: 2932672 - RNA, 17 nt, Mycobacterium avium subsp. paratuberculosis
cgagcaccucgucgccg

SEQ ID NO: 2932673 - RNA, 21 nt, Mycobacterium avium subsp. paratuberculosis
cgagcaccucgucgccgucgg

SEQ ID NO: 2932674 - RNA, 18 nt, Mycobacterium avium subsp. paratuberculosis
cgagcaccugaacggccg

SEQ ID NO: 2932675 - RNA, 20 nt, Mycobacterium avium subsp. paratuberculosis
cgagcaccugaacggccgcg

SEQ ID NO: 2932676 - RNA, 21 nt, Mycobacterium avium subsp. paratuberculosis
cgagcaccugaacggccgcgc

SEQ ID NO: 2932677 - RNA, 23 nt, Mycobacterium avium subsp. paratuberculosis
cgagcaccugaacggccgcgcag

SEQ ID NO: 2932678 - RNA, 15 nt, Mycobacterium avium subsp. paratuberculosis
cgagcaccuggccgu

SEQ ID NO: 2932679 - RNA, 17 nt, Mycobacterium avium subsp. paratuberculosis
cgagcaccuggccguuc

SEQ ID NO: 2932680 - RNA, 20 nt, Mycobacterium avium subsp. paratuberculosis
cgagcacgaaguacagcguc

SEQ ID NO: 2932681 - RNA, 14 nt, Mycobacterium avium subsp. paratuberculosis
cgagcacgacgucg

SEQ ID NO: 2932682 - RNA, 15 nt, Mycobacterium avium subsp. paratuberculosis
cgagcacgacgucga

SEQ ID NO: 2932683 - RNA, 17 nt, Mycobacterium avium subsp. paratuberculosis
cgagcacgacgucgacg

SEQ ID NO: 2932684 - RNA, 14 nt, Mycobacterium avium subsp. paratuberculosis
cgagcacgcccugc

SEQ ID NO: 2932685 - RNA, 17 nt, Mycobacterium avium subsp. paratuberculosis
cgagcacgcccugcggc

SEQ ID NO: 2932686 - RNA, 23 nt, Mycobacterium avium subsp. paratuberculosis
cgagcacgcccugcggcuggguc

SEQ ID NO: 2932687 - RNA, 13 nt, Mycobacterium avium subsp. paratuberculosis
cgagcacgcggcc

SEQ ID NO: 2932688 - RNA, 17 nt, Mycobacterium avium subsp. paratuberculosis
cgagcacgcggccgcgc

SEQ ID NO: 2932689 - RNA, 19 nt, Mycobacterium avium subsp. paratuberculosis
cgagcacgcggccgcgccg

SEQ ID NO: 2932690 - RNA, 15 nt, Mycobacterium avium subsp. paratuberculosis
cgagcacggcacgcc

SEQ ID NO: 2932691 - RNA, 21 nt, Mycobacterium avium subsp. paratuberculosis
cgagcacgggaugaucggcgc

SEQ ID NO: 2932692 - RNA, 14 nt, Mycobacterium avium subsp. paratuberculosis
cgagcacgucgacg

SEQ ID NO: 2932693 - RNA, 16 nt, Mycobacterium avium subsp. paratuberculosis
cgagcacgucgacgcc

SEQ ID NO: 2932694 - RNA, 20 nt, Mycobacterium avium subsp. paratuberculosis
cgagcacgucgacgccgguc

SEQ ID NO: 2932695 - RNA, 14 nt, Mycobacterium avium subsp. paratuberculosis
cgagcacgucgagc

SEQ ID NO: 2932696 - RNA, 17 nt, Mycobacterium avium subsp. paratuberculosis
cgagcacgucgagcacc

SEQ ID NO: 2932697 - RNA, 18 nt, Mycobacterium avium subsp. paratuberculosis
cgagcacgucgagcaccg

SEQ ID NO: 2932698 - RNA, 20 nt, Mycobacterium avium subsp. paratuberculosis
cgagcacgucgagcaccgcg

SEQ ID NO: 2932699 - RNA, 23 nt, Mycobacterium avium subsp. paratuberculosis
cgagcacguugugcuucuggcuc

SEQ ID NO: 2932700 - RNA, 16 nt, Mycobacterium avium subsp. paratuberculosis
cgagcacucgcgggac

SEQ ID NO: 2932701 - RNA, 23 nt, Mycobacterium avium subsp. paratuberculosis
cgagcacucgcgggacggcggcg

SEQ ID NO: 2932702 - RNA, 23 nt, Mycobacterium avium subsp. paratuberculosis
cgagcagacacaaaagcacccaa

SEQ ID NO: 2932703 - RNA, 16 nt, Mycobacterium avium subsp. paratuberculosis
cgagcagacccgccgc

SEQ ID NO: 2932704 - RNA, 17 nt, Mycobacterium avium subsp. paratuberculosis
cgagcagacccgccgcg

SEQ ID NO: 2932705 - RNA, 19 nt, Mycobacterium avium subsp. paratuberculosis
cgagcagacccgccgcggc

SEQ ID NO: 2932706 - RNA, 20 nt, Mycobacterium avium subsp. paratuberculosis
cgagcagacccgccgcggca

SEQ ID NO: 2932707 - RNA, 21 nt, Mycobacterium avium subsp. paratuberculosis
cgagcagacccgccgcggcaa

SEQ ID NO: 2932708 - RNA, 19 nt, Mycobacterium avium subsp. paratuberculosis
cgagcagacgcaaaagccc

SEQ ID NO: 2932709 - RNA, 21 nt, Mycobacterium avium subsp. paratuberculosis
cgagcagacgcaaaagccccg

SEQ ID NO: 2932710 - RNA, 15 nt, Mycobacterium avium subsp. paratuberculosis
cgagcagacgcgaaa

SEQ ID NO: 2932711 - RNA, 17 nt, Mycobacterium avium subsp. paratuberculosis
cgagcagaucggguccc

SEQ ID NO: 2932712 - RNA, 21 nt, Mycobacterium avium subsp. paratuberculosis
cgagcagaucgggucgcccgg

SEQ ID NO: 2932713 - RNA, 22 nt, Mycobacterium avium subsp. paratuberculosis
cgagcagaucgggucgcccggg

SEQ ID NO: 2932714 - RNA, 15 nt, Mycobacterium avium subsp. paratuberculosis
cgagcagcaagagca

SEQ ID NO: 2932715 - RNA, 12 nt, Mycobacterium avium subsp. paratuberculosis
cgagcagcaccg

SEQ ID NO: 2932716 - RNA, 15 nt, Mycobacterium avium subsp. paratuberculosis
cgagcagcaccgcga

SEQ ID NO: 2932717 - RNA, 17 nt, Mycobacterium avium subsp. paratuberculosis
cgagcagcaccgcgacc

SEQ ID NO: 2932718 - RNA, 17 nt, Mycobacterium avium subsp. paratuberculosis
cgagcagcagccgcagc

SEQ ID NO: 2932719 - RNA, 20 nt, Mycobacterium avium subsp. paratuberculosis
cgagcagcagccgccgggcc

SEQ ID NO: 2932720 - RNA, 15 nt, Mycobacterium avium subsp. paratuberculosis
cgagcagcagcgcgg

SEQ ID NO: 2932721 - RNA, 19 nt, Mycobacterium avium subsp. paratuberculosis
cgagcagcagcgcggugcc

SEQ ID NO: 2932722 - RNA, 22 nt, Mycobacterium avium subsp. paratuberculosis
cgagcagcagcgcggugccgac

SEQ ID NO: 2932723 - RNA, 13 nt, Mycobacterium avium subsp. paratuberculosis
cgagcagccgauc

SEQ ID NO: 2932724 - RNA, 20 nt, Mycobacterium avium subsp. paratuberculosis
cgagcagccgaucuggcggg

SEQ ID NO: 2932725 - RNA, 22 nt, Mycobacterium avium subsp. paratuberculosis
cgagcagccgaucuggcgggcg

SEQ ID NO: 2932726 - RNA, 15 nt, Mycobacterium avium subsp. paratuberculosis
cgagcagccgcaaca

SEQ ID NO: 2932727 - RNA, 14 nt, Mycobacterium avium subsp. paratuberculosis
cgagcagccgcgcc

SEQ ID NO: 2932728 - RNA, 15 nt, Mycobacterium avium subsp. paratuberculosis
cgagcagccgcgccg

SEQ ID NO: 2932729 - RNA, 16 nt, Mycobacterium avium subsp. paratuberculosis
cgagcagccgcgccgg

SEQ ID NO: 2932730 - RNA, 24 nt, Mycobacterium avium subsp. paratuberculosis
cgagcagccgcgccgggcggaugu

SEQ ID NO: 2932731 - RNA, 14 nt, Mycobacterium avium subsp. paratuberculosis
cgagcagccgggcc

SEQ ID NO: 2932732 - RNA, 14 nt, Mycobacterium avium subsp. paratuberculosis
cgagcagccggucc

SEQ ID NO: 2932733 - RNA, 19 nt, Mycobacterium avium subsp. paratuberculosis
cgagcagcgcccggcgauc

SEQ ID NO: 2932734 - RNA, 15 nt, Mycobacterium avium subsp. paratuberculosis
cgagcagcgcccggg

SEQ ID NO: 2932735 - RNA, 18 nt, Mycobacterium avium subsp. paratuberculosis
cgagcagcgcccgggugc

SEQ ID NO: 2932736 - RNA, 16 nt, Mycobacterium avium subsp. paratuberculosis
cgagcagcgcgaugcc

SEQ ID NO: 2932737 - RNA, 14 nt, Mycobacterium avium subsp. paratuberculosis
cgagcagcgcgcgc

SEQ ID NO: 2932738 - RNA, 15 nt, Mycobacterium avium subsp. paratuberculosis
cgagcagcgcgcgcu

SEQ ID NO: 2932739 - RNA, 16 nt, Mycobacterium avium subsp. paratuberculosis
cgagcagcgcgcgcuu

SEQ ID NO: 2932740 - RNA, 22 nt, Mycobacterium avium subsp. paratuberculosis
cgagcagcgcgcgcuugcgcuc

SEQ ID NO: 2932741 - RNA, 18 nt, Mycobacterium avium subsp. paratuberculosis
cgagcagcggggugagca

SEQ ID NO: 2932742 - RNA, 21 nt, Mycobacterium avium subsp. paratuberculosis
cgagcagcggggugagcaccg

SEQ ID NO: 2932743 - RNA, 13 nt, Mycobacterium avium subsp. paratuberculosis
cgagcagcucggc

SEQ ID NO: 2932744 - RNA, 15 nt, Mycobacterium avium subsp. paratuberculosis
cgagcagcucggcgg

SEQ ID NO: 2932745 - RNA, 16 nt, Mycobacterium avium subsp. paratuberculosis
cgagcagcucggcggc

SEQ ID NO: 2932746 - RNA, 18 nt, Mycobacterium avium subsp. paratuberculosis
cgagcagcucggcggccu

SEQ ID NO: 2932747 - RNA, 21 nt, Mycobacterium avium subsp. paratuberculosis
cgagcagcugggacagcguca

SEQ ID NO: 2932748 - RNA, 15 nt, Mycobacterium avium subsp. paratuberculosis
cgagcaggccgaggc

SEQ ID NO: 2932749 - RNA, 16 nt, Mycobacterium avium subsp. paratuberculosis
cgagcaggccgaggcc

SEQ ID NO: 2932750 - RNA, 15 nt, Mycobacterium avium subsp. paratuberculosis
cgagccgcaccgccu

SEQ ID NO: 2932751 - RNA, 16 nt, Mycobacterium avium subsp. paratuberculosis
cgagccgcaccgccuc

SEQ ID NO: 2932752 - RNA, 13 nt, Mycobacterium avium subsp. paratuberculosis
cgagccgcagucg

SEQ ID NO: 2932753 - RNA, 16 nt, Mycobacterium avium subsp. paratuberculosis
cgagccgcagucgauc

SEQ ID NO: 2932754 - RNA, 20 nt, Mycobacterium avium subsp. paratuberculosis
cgagccgcagucgaucaccg

SEQ ID NO: 2932755 - RNA, 12 nt, Mycobacterium avium subsp. paratuberculosis
cgagccgcccac

SEQ ID NO: 2932756 - RNA, 17 nt, Mycobacterium avium subsp. paratuberculosis
cgagccgcccaggcggg

SEQ ID NO: 2932757 - RNA, 16 nt, Mycobacterium avium subsp. paratuberculosis
cgagccgccgccggcg

SEQ ID NO: 2932758 - RNA, 17 nt, Mycobacterium avium subsp. paratuberculosis
cgagccgccgccggcgu

SEQ ID NO: 2932759 - RNA, 19 nt, Mycobacterium avium subsp. paratuberculosis
cgagccgccgccggcgucg

SEQ ID NO: 2932760 - RNA, 22 nt, Mycobacterium avium subsp. paratuberculosis
cgagccgccgccggcgucgccg

SEQ ID NO: 2932761 - RNA, 14 nt, Mycobacterium avium subsp. paratuberculosis
cgagccgccgcggg

SEQ ID NO: 2932762 - RNA, 22 nt, Mycobacterium avium subsp. paratuberculosis
cgagccgccgcgggucggcgac

SEQ ID NO: 2932763 - RNA, 20 nt, Mycobacterium avium subsp. paratuberculosis
cgagccgccggaucggcagc

SEQ ID NO: 2932764 - RNA, 22 nt, Mycobacterium avium subsp. paratuberculosis
cgagccgccggaucggcagcgc

SEQ ID NO: 2932765 - RNA, 17 nt, Mycobacterium avium subsp. paratuberculosis
cgagccgccugcgcgcc

SEQ ID NO: 2932766 - RNA, 18 nt, Mycobacterium avium subsp. paratuberculosis
cgagccgccugcgcgccg

SEQ ID NO: 2932767 - RNA, 24 nt, Mycobacterium avium subsp. paratuberculosis
cgagccgccugcgcgccgucggcg

SEQ ID NO: 2932768 - RNA, 17 nt, Mycobacterium avium subsp. paratuberculosis
cgagccgcgccacgcgc

SEQ ID NO: 2932769 - RNA, 18 nt, Mycobacterium avium subsp. paratuberculosis
cgagccgcgccacgcgca

SEQ ID NO: 2932770 - RNA, 13 nt, Mycobacterium avium subsp. paratuberculosis
cgagccgcgcgcc

SEQ ID NO: 2932771 - RNA, 14 nt, Mycobacterium avium subsp. paratuberculosis
cgagccgcgcgccg

SEQ ID NO: 2932772 - RNA, 15 nt, Mycobacterium avium subsp. paratuberculosis
cgagccgcgcgccga

SEQ ID NO: 2932773 - RNA, 17 nt, Mycobacterium avium subsp. paratuberculosis
cgagccgcggauggccu

SEQ ID NO: 2932774 - RNA, 19 nt, Mycobacterium avium subsp. paratuberculosis
cgagccgcggauggccucg

SEQ ID NO: 2932775 - RNA, 13 nt, Mycobacterium avium subsp. paratuberculosis
cgagccgcggccc

SEQ ID NO: 2932776 - RNA, 14 nt, Mycobacterium avium subsp. paratuberculosis
cgagccgcggcccg

SEQ ID NO: 2932777 - RNA, 22 nt, Mycobacterium avium subsp. paratuberculosis
cgagccgcgggugacgaucacc

SEQ ID NO: 2932778 - RNA, 16 nt, Mycobacterium avium subsp. paratuberculosis
cgagccgcuccaccgc

SEQ ID NO: 2932779 - RNA, 18 nt, Mycobacterium avium subsp. paratuberculosis
cgagccgcuccaccgcgu

SEQ ID NO: 2932780 - RNA, 20 nt, Mycobacterium avium subsp. paratuberculosis
cgagccgcuccaccgcgucc

SEQ ID NO: 2932781 - RNA, 18 nt, Mycobacterium avium subsp. paratuberculosis
cgagccgcucccgcagcg

SEQ ID NO: 2932782 - RNA, 22 nt, Mycobacterium avium subsp. paratuberculosis
cgagccgcucccgcagcggggc

SEQ ID NO: 2932783 - RNA, 19 nt, Mycobacterium avium subsp. paratuberculosis
cgagccgcucgcgcaccgg

SEQ ID NO: 2932784 - RNA, 21 nt, Mycobacterium avium subsp. paratuberculosis
cgagccgcucgcgcaccggga

SEQ ID NO: 2932785 - RNA, 14 nt, Mycobacterium avium subsp. paratuberculosis
cgagccggacaucu

SEQ ID NO: 2932786 - RNA, 21 nt, Mycobacterium avium subsp. paratuberculosis
cgagccggagccuugcuggcg

SEQ ID NO: 2932787 - RNA, 14 nt, Mycobacterium avium subsp. paratuberculosis
cgagccggcacgcg

SEQ ID NO: 2932788 - RNA, 16 nt, Mycobacterium avium subsp. paratuberculosis
cgagccggcacgcgcg

SEQ ID NO: 2932789 - RNA, 17 nt, Mycobacterium avium subsp. paratuberculosis
cgagccggcacgcgcgc

SEQ ID NO: 2932790 - RNA, 18 nt, Mycobacterium avium subsp. paratuberculosis
cgagccggcacgcgcgcc

SEQ ID NO: 2932791 - RNA, 11 nt, Mycobacterium avium subsp. paratuberculosis
cgagccggccc

SEQ ID NO: 2932792 - RNA, 14 nt, Mycobacterium avium subsp. paratuberculosis
cgagccggcccggg

SEQ ID NO: 2932793 - RNA, 17 nt, Mycobacterium avium subsp. paratuberculosis
cgagccggcccggggug

SEQ ID NO: 2932794 - RNA, 13 nt, Mycobacterium avium subsp. paratuberculosis
cgagccggccgga

SEQ ID NO: 2932795 - RNA, 20 nt, Mycobacterium avium subsp. paratuberculosis
cgagccggccggacaccgaa

SEQ ID NO: 2932796 - RNA, 15 nt, Mycobacterium avium subsp. paratuberculosis
cgagccggccguagc

SEQ ID NO: 2932797 - RNA, 12 nt, Mycobacterium avium subsp. paratuberculosis
cgagccggcggc

SEQ ID NO: 2932798 - RNA, 13 nt, Mycobacterium avium subsp. paratuberculosis
cgagccggcggcg

SEQ ID NO: 2932799 - RNA, 14 nt, Mycobacterium avium subsp. paratuberculosis
cgagccggcggcgu

SEQ ID NO: 2932800 - RNA, 21 nt, Mycobacterium avium subsp. paratuberculosis
cgagccggcggcguugaggcg

SEQ ID NO: 2932801 - RNA, 14 nt, Mycobacterium avium subsp. paratuberculosis
cgagccggcguacc

SEQ ID NO: 2932802 - RNA, 13 nt, Mycobacterium avium subsp. paratuberculosis
cgagccggcgucg

SEQ ID NO: 2932803 - RNA, 15 nt, Mycobacterium avium subsp. paratuberculosis
cgagccggcgucgcc

SEQ ID NO: 2932804 - RNA, 16 nt, Mycobacterium avium subsp. paratuberculosis
cgagccggcgucgccg

SEQ ID NO: 2932805 - RNA, 12 nt, Mycobacterium avium subsp. paratuberculosis
cgagccgggacc

SEQ ID NO: 2932806 - RNA, 15 nt, Mycobacterium avium subsp. paratuberculosis
cgagccgggcagcgc

SEQ ID NO: 2932807 - RNA, 16 nt, Mycobacterium avium subsp. paratuberculosis
cgagccgggcagcgcg

SEQ ID NO: 2932808 - RNA, 17 nt, Mycobacterium avium subsp. paratuberculosis
cgagccgggcagcgcga

SEQ ID NO: 2932809 - RNA, 13 nt, Mycobacterium avium subsp. paratuberculosis
cgagccgggccag

SEQ ID NO: 2932810 - RNA, 15 nt, Mycobacterium avium subsp. paratuberculosis
cgagccgggccaggu

SEQ ID NO: 2932811 - RNA, 17 nt, Mycobacterium avium subsp. paratuberculosis
cgagccgggccaggucc

SEQ ID NO: 2932812 - RNA, 16 nt, Mycobacterium avium subsp. paratuberculosis
cgagccgggcccgggu

SEQ ID NO: 2932813 - RNA, 16 nt, Mycobacterium avium subsp. paratuberculosis
cgagccgggccggguc

SEQ ID NO: 2932814 - RNA, 23 nt, Mycobacterium avium subsp. paratuberculosis
cgagccgggccggguccacgccg

SEQ ID NO: 2932815 - RNA, 19 nt, Mycobacterium avium subsp. paratuberculosis
cgagccgggcgcgggcgcc

SEQ ID NO: 2932816 - RNA, 12 nt, Mycobacterium avium subsp. paratuberculosis
cgagccgggcgg

SEQ ID NO: 2932817 - RNA, 14 nt, Mycobacterium avium subsp. paratuberculosis
cgagccgggcggcc

SEQ ID NO: 2932818 - RNA, 15 nt, Mycobacterium avium subsp. paratuberculosis
cgagccgggcggcca

SEQ ID NO: 2932819 - RNA, 18 nt, Mycobacterium avium subsp. paratuberculosis
cgagccgggcggccagcg

SEQ ID NO: 2932820 - RNA, 15 nt, Mycobacterium avium subsp. paratuberculosis
cgagccgggucaucc

SEQ ID NO: 2932821 - RNA, 20 nt, Mycobacterium avium subsp. paratuberculosis
cgagccgggucauccagccg

SEQ ID NO: 2932822 - RNA, 21 nt, Mycobacterium avium subsp. paratuberculosis
cgagccgguccgaccagcggc

SEQ ID NO: 2932823 - RNA, 22 nt, Mycobacterium avium subsp. paratuberculosis
cgagccgguccgaccagcggcc

SEQ ID NO: 2932824 - RNA, 21 nt, Mycobacterium avium subsp. paratuberculosis
cgagccggucgggaucgaucc

SEQ ID NO: 2932825 - RNA, 17 nt, Mycobacterium avium subsp. paratuberculosis
cgagccggucugggcga

SEQ ID NO: 2932826 - RNA, 18 nt, Mycobacterium avium subsp. paratuberculosis
cgagccggucugggcgac

SEQ ID NO: 2932827 - RNA, 20 nt, Mycobacterium avium subsp. paratuberculosis
cgagccggucugggcgacca

SEQ ID NO: 2932828 - RNA, 14 nt, Mycobacterium avium subsp. paratuberculosis
cgagccggugccga

SEQ ID NO: 2932829 - RNA, 19 nt, Mycobacterium avium subsp. paratuberculosis
cgagccggugccgaggcag

SEQ ID NO: 2932830 - RNA, 22 nt, Mycobacterium avium subsp. paratuberculosis
cgagccggugccgaggcaguuc

SEQ ID NO: 2932831 - RNA, 14 nt, Mycobacterium avium subsp. paratuberculosis
cgagccggugccgc

SEQ ID NO: 2932832 - RNA, 21 nt, Mycobacterium avium subsp. paratuberculosis
cgagccggugguuuugcggcc

SEQ ID NO: 2932833 - RNA, 22 nt, Mycobacterium avium subsp. paratuberculosis
cgagccggugguuuugcggccc

SEQ ID NO: 2932834 - RNA, 23 nt, Mycobacterium avium subsp. paratuberculosis
cgagccggugguuuugcggcccu

SEQ ID NO: 2932835 - RNA, 13 nt, Mycobacterium avium subsp. paratuberculosis
cgagcgggcacgc

SEQ ID NO: 2932836 - RNA, 14 nt, Mycobacterium avium subsp. paratuberculosis
cgagcgggcacgcc

SEQ ID NO: 2932837 - RNA, 15 nt, Mycobacterium avium subsp. paratuberculosis
cgagcgggcacgccg

SEQ ID NO: 2932838 - RNA, 17 nt, Mycobacterium avium subsp. paratuberculosis
cgagcgggcacgccgcc

SEQ ID NO: 2932839 - RNA, 21 nt, Mycobacterium avium subsp. paratuberculosis
cgagcgggcacgccgccgcga

SEQ ID NO: 2932840 - RNA, 12 nt, Mycobacterium avium subsp. paratuberculosis
cgagcgggccgu

SEQ ID NO: 2932841 - RNA, 15 nt, Mycobacterium avium subsp. paratuberculosis
cgagcgggccguggc

SEQ ID NO: 2932842 - RNA, 13 nt, Mycobacterium avium subsp. paratuberculosis
cgagcgggcgggc

SEQ ID NO: 2932843 - RNA, 22 nt, Mycobacterium avium subsp. paratuberculosis
cgagcgguccaacgggcucagc

SEQ ID NO: 2932844 - RNA, 20 nt, Mycobacterium avium subsp. paratuberculosis
cgagcgguucgaucucgucg

SEQ ID NO: 2932845 - RNA, 16 nt, Mycobacterium avium subsp. paratuberculosis
cgagcgguuggcgacg

SEQ ID NO: 2932846 - RNA, 18 nt, Mycobacterium avium subsp. paratuberculosis
cgagcgguuggcgacgcu

SEQ ID NO: 2932847 - RNA, 20 nt, Mycobacterium avium subsp. paratuberculosis
cgagcgguuggcgacgcuga

SEQ ID NO: 2932848 - RNA, 16 nt, Mycobacterium avium subsp. paratuberculosis
cgagcgucacgccagc

SEQ ID NO: 2932849 - RNA, 20 nt, Mycobacterium avium subsp. paratuberculosis
cgagcgucacgccagcguga

SEQ ID NO: 2932850 - RNA, 18 nt, Mycobacterium avium subsp. paratuberculosis
cgagcgucacgccagugu

SEQ ID NO: 2932851 - RNA, 14 nt, Mycobacterium avium subsp. paratuberculosis
cgagcgucacgccg

SEQ ID NO: 2932852 - RNA, 15 nt, Mycobacterium avium subsp. paratuberculosis
cgagcgucacgccgc

SEQ ID NO: 2932853 - RNA, 16 nt, Mycobacterium avium subsp. paratuberculosis
cgagcgucacgccgcg

SEQ ID NO: 2932854 - RNA, 17 nt, Mycobacterium avium subsp. paratuberculosis
cgagcgucacgccgcgc

SEQ ID NO: 2932855 - RNA, 22 nt, Mycobacterium avium subsp. paratuberculosis
cgagcgucacgccgcgcccguc

SEQ ID NO: 2932856 - RNA, 16 nt, Mycobacterium avium subsp. paratuberculosis
cgagcgucacgcuagc

SEQ ID NO: 2932857 - RNA, 19 nt, Mycobacterium avium subsp. paratuberculosis
cgagcgucacgcuggcgug

SEQ ID NO: 2932858 - RNA, 20 nt, Mycobacterium avium subsp. paratuberculosis
cgagcgucacgcuggcgugg

SEQ ID NO: 2932859 - RNA, 21 nt, Mycobacterium avium subsp. paratuberculosis
cgagcgucacgcuggcguggc

SEQ ID NO: 2932860 - RNA, 13 nt, Mycobacterium avium subsp. paratuberculosis
cgagcgucauucc

SEQ ID NO: 2932861 - RNA, 18 nt, Mycobacterium avium subsp. paratuberculosis
cgagcgucauuccgccgc

SEQ ID NO: 2932862 - RNA, 19 nt, Mycobacterium avium subsp. paratuberculosis
cgagcgucauuccgccgcg

SEQ ID NO: 2932863 - RNA, 20 nt, Mycobacterium avium subsp. paratuberculosis
cgagcgucauuccgccgcgc

SEQ ID NO: 2932864 - RNA, 21 nt, Mycobacterium avium subsp. paratuberculosis
cgagcgucauuccgccgcgcc

SEQ ID NO: 2932865 - RNA, 17 nt, Mycobacterium avium subsp. paratuberculosis
cgagcgucgccgcgugg

SEQ ID NO: 2932866 - RNA, 20 nt, Mycobacterium avium subsp. paratuberculosis
cgagcgucgugcgggcuccg

SEQ ID NO: 2932867 - RNA, 23 nt, Mycobacterium avium subsp. paratuberculosis
cgagcgugaaacuaguuucacgu

SEQ ID NO: 2932868 - RNA, 15 nt, Mycobacterium avium subsp. paratuberculosis
cgagcgugcccgcgc

SEQ ID NO: 2932869 - RNA, 20 nt, Mycobacterium avium subsp. paratuberculosis
cgagcgugcccgcgcccacc

SEQ ID NO: 2932870 - RNA, 21 nt, Mycobacterium avium subsp. paratuberculosis
cgagcgugcccgcgcccaccu

SEQ ID NO: 2932871 - RNA, 15 nt, Mycobacterium avium subsp. paratuberculosis
cgagcgugggggcca

SEQ ID NO: 2932872 - RNA, 23 nt, Mycobacterium avium subsp. paratuberculosis
cgagcgugggggccauguacgga

SEQ ID NO: 2932873 - RNA, 18 nt, Mycobacterium avium subsp. paratuberculosis
cgagcguucggcgcggau

SEQ ID NO: 2932874 - RNA, 14 nt, Mycobacterium avium subsp. paratuberculosis
cgagcucaacagca

SEQ ID NO: 2932875 - RNA, 14 nt, Mycobacterium avium subsp. paratuberculosis
cgagcucaccgccg

SEQ ID NO: 2932876 - RNA, 17 nt, Mycobacterium avium subsp. paratuberculosis
cgagcucaccgccgaug

SEQ ID NO: 2932877 - RNA, 15 nt, Mycobacterium avium subsp. paratuberculosis
cgagcucaggccggc

SEQ ID NO: 2932878 - RNA, 16 nt, Mycobacterium avium subsp. paratuberculosis
cgagcucaggccggcc

SEQ ID NO: 2932879 - RNA, 24 nt, Mycobacterium avium subsp. paratuberculosis
cgagcucaugguguuccaccagcg

SEQ ID NO: 2932880 - RNA, 17 nt, Mycobacterium avium subsp. paratuberculosis
cgagcuccagcuaggag

SEQ ID NO: 2932881 - RNA, 17 nt, Mycobacterium avium subsp. paratuberculosis
cgagcuccucggccagc

SEQ ID NO: 2932882 - RNA, 18 nt, Mycobacterium avium subsp. paratuberculosis
cgagcuccucggccagcg

SEQ ID NO: 2932883 - RNA, 13 nt, Mycobacterium avium subsp. paratuberculosis
cgagcucgaagcc

SEQ ID NO: 2932884 - RNA, 18 nt, Mycobacterium avium subsp. paratuberculosis
cgagcucgaagcccaggg

SEQ ID NO: 2932885 - RNA, 14 nt, Mycobacterium avium subsp. paratuberculosis
cgagcucgcagucg

SEQ ID NO: 2932886 - RNA, 12 nt, Mycobacterium avium subsp. paratuberculosis
cgagcucgccgc

SEQ ID NO: 2932887 - RNA, 17 nt, Mycobacterium avium subsp. paratuberculosis
cgagcucgccgcugucg

SEQ ID NO: 2932888 - RNA, 23 nt, Mycobacterium avium subsp. paratuberculosis
cgagcucgccgcugucgucgaag

SEQ ID NO: 2932889 - RNA, 18 nt, Mycobacterium avium subsp. paratuberculosis
cgagcucggccaccagcg

SEQ ID NO: 2932890 - RNA, 20 nt, Mycobacterium avium subsp. paratuberculosis
cgagcucggccaccagcgcc

SEQ ID NO: 2932891 - RNA, 21 nt, Mycobacterium avium subsp. paratuberculosis
cgagcucggccaccagcgccc

SEQ ID NO: 2932892 - RNA, 19 nt, Mycobacterium avium subsp. paratuberculosis
cgagcucggccuugagccg

SEQ ID NO: 2932893 - RNA, 18 nt, Mycobacterium avium subsp. paratuberculosis
cgagcucggcgaggucgu

SEQ ID NO: 2932894 - RNA, 15 nt, Mycobacterium avium subsp. paratuberculosis
cgagcucgggcgcga

SEQ ID NO: 2932895 - RNA, 21 nt, Mycobacterium avium subsp. paratuberculosis
cgagcucgggcgcgaacagcg

SEQ ID NO: 2932896 - RNA, 23 nt, Mycobacterium avium subsp. paratuberculosis
cgagcucgggcgcgaacagcgcc

SEQ ID NO: 2932897 - RNA, 23 nt, Mycobacterium avium subsp. paratuberculosis
cgagcucgugaugguccagcacc

SEQ ID NO: 2932898 - RNA, 23 nt, Mycobacterium avium subsp. paratuberculosis
cgagcugaccggccaccucgucg

SEQ ID NO: 2932899 - RNA, 23 nt, Mycobacterium avium subsp. paratuberculosis
cgagcugacgaacgcgccgccca

SEQ ID NO: 2932900 - RNA, 18 nt, Mycobacterium avium subsp. paratuberculosis
cgagcugaucgcggccgg

SEQ ID NO: 2932901 - RNA, 19 nt, Mycobacterium avium subsp. paratuberculosis
cgagcugaucgcggccggc

SEQ ID NO: 2932902 - RNA, 17 nt, Mycobacterium avium subsp. paratuberculosis
cgagcugaucggcguug

SEQ ID NO: 2932903 - RNA, 17 nt, Mycobacterium avium subsp. paratuberculosis
cgagcugcaacgcgucg

SEQ ID NO: 2932904 - RNA, 18 nt, Mycobacterium avium subsp. paratuberculosis
cgagcugcaacgcgucgg

SEQ ID NO: 2932905 - RNA, 23 nt, Mycobacterium avium subsp. paratuberculosis
cgagcugcaacgcgucggcgccg

SEQ ID NO: 2932906 - RNA, 24 nt, Mycobacterium avium subsp. paratuberculosis
cgagcugcaacgcgucggcgccgg

SEQ ID NO: 2932907 - RNA, 14 nt, Mycobacterium avium subsp. paratuberculosis
cgagcugcacgggc

SEQ ID NO: 2932908 - RNA, 19 nt, Mycobacterium avium subsp. paratuberculosis
cgagcugccccuucgcgac

SEQ ID NO: 2932909 - RNA, 15 nt, Mycobacterium avium subsp. paratuberculosis
cgagcugccggcggc

SEQ ID NO: 2932910 - RNA, 18 nt, Mycobacterium avium subsp. paratuberculosis
cgagcugccggcggccgc

SEQ ID NO: 2932911 - RNA, 14 nt, Mycobacterium avium subsp. paratuberculosis
cgagcugcgggugc

SEQ ID NO: 2932912 - RNA, 18 nt, Mycobacterium avium subsp. paratuberculosis
cgagcugcuucgucgccg

SEQ ID NO: 2932913 - RNA, 15 nt, Mycobacterium avium subsp. paratuberculosis
cgagcuggccgccca

SEQ ID NO: 2932914 - RNA, 17 nt, Mycobacterium avium subsp. paratuberculosis
cgagcuggccgcccacc

SEQ ID NO: 2932915 - RNA, 14 nt, Mycobacterium avium subsp. paratuberculosis
cgagcugggcccgc

SEQ ID NO: 2932916 - RNA, 15 nt, Mycobacterium avium subsp. paratuberculosis
cgagcugggcccgcg

SEQ ID NO: 2932917 - RNA, 16 nt, Mycobacterium avium subsp. paratuberculosis
cgagcugggcccgcgc

SEQ ID NO: 2932918 - RNA, 12 nt, Mycobacterium avium subsp. paratuberculosis
cgagcugggccg

SEQ ID NO: 2932919 - RNA, 17 nt, Mycobacterium avium subsp. paratuberculosis
cgaggccggccagcggg

SEQ ID NO: 2932920 - RNA, 12 nt, Mycobacterium avium subsp. paratuberculosis
cgaggccgggcu

SEQ ID NO: 2932921 - RNA, 17 nt, Mycobacterium avium subsp. paratuberculosis
cgaggccgggcuggcgc

SEQ ID NO: 2932922 - RNA, 23 nt, Mycobacterium avium subsp. paratuberculosis
cgaggccuccagguagacgaugc

SEQ ID NO: 2932923 - RNA, 24 nt, Mycobacterium avium subsp. paratuberculosis
cgaggccuccagguagacgaugcc

SEQ ID NO: 2932924 - RNA, 13 nt, Mycobacterium avium subsp. paratuberculosis
cgaggccucgccg

SEQ ID NO: 2932925 - RNA, 21 nt, Mycobacterium avium subsp. paratuberculosis
cgaggcgaguaaggccgaggc

SEQ ID NO: 2932926 - RNA, 21 nt, Mycobacterium avium subsp. paratuberculosis
cgaggcgaucaucgccccgga

SEQ ID NO: 2932927 - RNA, 14 nt, Mycobacterium avium subsp. paratuberculosis
cgaggcgauggugc

SEQ ID NO: 2932928 - RNA, 15 nt, Mycobacterium avium subsp. paratuberculosis
cgaggcgcgaaagcg

SEQ ID NO: 2932929 - RNA, 15 nt, Mycobacterium avium subsp. paratuberculosis
cgaggcgcggggcgc

SEQ ID NO: 2932930 - RNA, 20 nt, Mycobacterium avium subsp. paratuberculosis
cgaggcgcuccugaaucggu

SEQ ID NO: 2932931 - RNA, 17 nt, Mycobacterium avium subsp. paratuberculosis
cgaggcgcucgcacaac

SEQ ID NO: 2932932 - RNA, 14 nt, Mycobacterium avium subsp. paratuberculosis
cgaggcgcugcagc

SEQ ID NO: 2932933 - RNA, 15 nt, Mycobacterium avium subsp. paratuberculosis
cgaggcggccagcgg

SEQ ID NO: 2932934 - RNA, 16 nt, Mycobacterium avium subsp. paratuberculosis
cgaggcggccagcggc

SEQ ID NO: 2932935 - RNA, 20 nt, Mycobacterium avium subsp. paratuberculosis
cgaggcggccagcggcagcg

SEQ ID NO: 2932936 - RNA, 22 nt, Mycobacterium avium subsp. paratuberculosis
cgaggcggccagcggcagcguc

SEQ ID NO: 2932937 - RNA, 23 nt, Mycobacterium avium subsp. paratuberculosis
cgaggcggguaggcgucgcgcag

SEQ ID NO: 2932938 - RNA, 23 nt, Mycobacterium avium subsp. paratuberculosis
cgaggcgggugaggacgcccggc

SEQ ID NO: 2932939 - RNA, 23 nt, Mycobacterium avium subsp. paratuberculosis
cgaggcggguguauucgcccacc

SEQ ID NO: 2932940 - RNA, 20 nt, Mycobacterium avium subsp. paratuberculosis
cgaggcgguuccgguggcgc

SEQ ID NO: 2932941 - RNA, 22 nt, Mycobacterium avium subsp. paratuberculosis
cgaggcgguuccgguggcgcga

SEQ ID NO: 2932942 - RNA, 21 nt, Mycobacterium avium subsp. paratuberculosis
cgaggcgucagggguuggcgc

SEQ ID NO: 2932943 - RNA, 13 nt, Mycobacterium avium subsp. paratuberculosis
cgaggcguccagc

SEQ ID NO: 2932944 - RNA, 14 nt, Mycobacterium avium subsp. paratuberculosis
cgaggcguccagcg

SEQ ID NO: 2932945 - RNA, 15 nt, Mycobacterium avium subsp. paratuberculosis
cgaggcguccagcgc

SEQ ID NO: 2932946 - RNA, 16 nt, Mycobacterium avium subsp. paratuberculosis
cgaggcguccagcgcg

SEQ ID NO: 2932947 - RNA, 17 nt, Mycobacterium avium subsp. paratuberculosis
cgaggcguccagcgcgu

SEQ ID NO: 2932948 - RNA, 19 nt, Mycobacterium avium subsp. paratuberculosis
cgaggcguccagcgcgucg

SEQ ID NO: 2932949 - RNA, 15 nt, Mycobacterium avium subsp. paratuberculosis
cgaggcguccuccuc

SEQ ID NO: 2932950 - RNA, 20 nt, Mycobacterium avium subsp. paratuberculosis
cgaggcguccuccucguccg

SEQ ID NO: 2932951 - RNA, 22 nt, Mycobacterium avium subsp. paratuberculosis
cgaggcguccuccucguccgcg

SEQ ID NO: 2932952 - RNA, 13 nt, Mycobacterium avium subsp. paratuberculosis
cgaggcgugcagc

SEQ ID NO: 2932953 - RNA, 18 nt, Mycobacterium avium subsp. paratuberculosis
cgaggcgugcagcccgca

SEQ ID NO: 2932954 - RNA, 21 nt, Mycobacterium avium subsp. paratuberculosis
cgaggcguucggcgauccggg

SEQ ID NO: 2932955 - RNA, 14 nt, Mycobacterium avium subsp. paratuberculosis
cgaggcugacgauc

SEQ ID NO: 2932956 - RNA, 21 nt, Mycobacterium avium subsp. paratuberculosis
cgaggcugacgaucgucgacg

SEQ ID NO: 2932957 - RNA, 18 nt, Mycobacterium avium subsp. paratuberculosis
cgaggcugugggccagca

SEQ ID NO: 2932958 - RNA, 22 nt, Mycobacterium avium subsp. paratuberculosis
cgaggcugugggccagcagcgu

SEQ ID NO: 2932959 - RNA, 23 nt, Mycobacterium avium subsp. paratuberculosis
cgagggcaacgucuggccaccga

SEQ ID NO: 2932960 - RNA, 12 nt, Mycobacterium avium subsp. paratuberculosis
cgagggccaccg

SEQ ID NO: 2932961 - RNA, 14 nt, Mycobacterium avium subsp. paratuberculosis
cgagggccaccggc

SEQ ID NO: 2932962 - RNA, 17 nt, Mycobacterium avium subsp. paratuberculosis
cgagggccagcagccag

SEQ ID NO: 2932963 - RNA, 21 nt, Mycobacterium avium subsp. paratuberculosis
cgagggccagcagccagcugg

SEQ ID NO: 2932964 - RNA, 15 nt, Mycobacterium avium subsp. paratuberculosis
cgagggcccgggcag

SEQ ID NO: 2932965 - RNA, 18 nt, Mycobacterium avium subsp. paratuberculosis
cgagggccguugcggcca

SEQ ID NO: 2932966 - RNA, 15 nt, Mycobacterium avium subsp. paratuberculosis
cgagggccuccacca

SEQ ID NO: 2932967 - RNA, 19 nt, Mycobacterium avium subsp. paratuberculosis
cgagggccuccaccaccau

SEQ ID NO: 2932968 - RNA, 15 nt, Mycobacterium avium subsp. paratuberculosis
cgagggcgacgaugc

SEQ ID NO: 2932969 - RNA, 16 nt, Mycobacterium avium subsp. paratuberculosis
cgagggcgcgcagcga

SEQ ID NO: 2932970 - RNA, 13 nt, Mycobacterium avium subsp. paratuberculosis
cgagggcgcggcg

SEQ ID NO: 2932971 - RNA, 12 nt, Mycobacterium avium subsp. paratuberculosis
cgagggcggcgg

SEQ ID NO: 2932972 - RNA, 14 nt, Mycobacterium avium subsp. paratuberculosis
cgagggcggcggcu

SEQ ID NO: 2932973 - RNA, 14 nt, Mycobacterium avium subsp. paratuberculosis
cgagggcgggccag

SEQ ID NO: 2932974 - RNA, 14 nt, Mycobacterium avium subsp. paratuberculosis
cgagggcguucgcg

SEQ ID NO: 2932975 - RNA, 15 nt, Mycobacterium avium subsp. paratuberculosis
cgagggcguucgcgg

SEQ ID NO: 2932976 - RNA, 22 nt, Mycobacterium avium subsp. paratuberculosis
cgagggcuucccacgccuugcg

SEQ ID NO: 2932977 - RNA, 14 nt, Mycobacterium avium subsp. paratuberculosis
cgaggggcagcagc

SEQ ID NO: 2932978 - RNA, 18 nt, Mycobacterium avium subsp. paratuberculosis
cgaggggcagcagcgccc

SEQ ID NO: 2932979 - RNA, 21 nt, Mycobacterium avium subsp. paratuberculosis
cgaggggcuugagcgcgucgu

SEQ ID NO: 2932980 - RNA, 14 nt, Mycobacterium avium subsp. paratuberculosis
cgaggggcuuggcg

SEQ ID NO: 2932981 - RNA, 22 nt, Mycobacterium avium subsp. paratuberculosis
cgagggggucaucagugaccgc

SEQ ID NO: 2932982 - RNA, 18 nt, Mycobacterium avium subsp. paratuberculosis
cgaggggguggguccggu

SEQ ID NO: 2932983 - RNA, 23 nt, Mycobacterium avium subsp. paratuberculosis
cgaggggguggguccggucagca

SEQ ID NO: 2932984 - RNA, 17 nt, Mycobacterium avium subsp. paratuberculosis
cgagggucgagacaccg

SEQ ID NO: 2932985 - RNA, 14 nt, Mycobacterium avium subsp. paratuberculosis
cgagggucgccagg

SEQ ID NO: 2932986 - RNA, 17 nt, Mycobacterium avium subsp. paratuberculosis
cgagggucgccaggcca

SEQ ID NO: 2932987 - RNA, 18 nt, Mycobacterium avium subsp. paratuberculosis
cgagggucgccaggccac

SEQ ID NO: 2932988 - RNA, 21 nt, Mycobacterium avium subsp. paratuberculosis
cgagggucgccaggccaccgc

SEQ ID NO: 2932989 - RNA, 20 nt, Mycobacterium avium subsp. paratuberculosis
cgagggugacccgggcgaug

SEQ ID NO: 2932990 - RNA, 19 nt, Mycobacterium avium subsp. paratuberculosis
cgagggugaugucgcugcc

SEQ ID NO: 2932991 - RNA, 15 nt, Mycobacterium avium subsp. paratuberculosis
cgagggugccggcca

SEQ ID NO: 2932992 - RNA, 20 nt, Mycobacterium avium subsp. paratuberculosis
cgagggugccggccaccggc

SEQ ID NO: 2932993 - RNA, 22 nt, Mycobacterium avium subsp. paratuberculosis
cgagggugccggccaccggcgc

SEQ ID NO: 2932994 - RNA, 23 nt, Mycobacterium avium subsp. paratuberculosis
cgagggugccggccaccggcgcg

SEQ ID NO: 2932995 - RNA, 15 nt, Mycobacterium avium subsp. paratuberculosis
cgaggguucgguggc

SEQ ID NO: 2932996 - RNA, 20 nt, Mycobacterium avium subsp. paratuberculosis
cgagguaauggugggcgugg

SEQ ID NO: 2932997 - RNA, 16 nt, Mycobacterium avium subsp. paratuberculosis
cgagguacugcagcag

SEQ ID NO: 2932998 - RNA, 18 nt, Mycobacterium avium subsp. paratuberculosis
cgagguaggccaccgggu

SEQ ID NO: 2932999 - RNA, 20 nt, Mycobacterium avium subsp. paratuberculosis
cgagguagguuucguugucc

SEQ ID NO: 2933000 - RNA, 17 nt, Mycobacterium avium subsp. paratuberculosis
cgagguagucggccucc

SEQ ID NO: 2933001 - RNA, 23 nt, Mycobacterium avium subsp. paratuberculosis
cgagguagugcgcgauggcgugc

SEQ ID NO: 2933002 - RNA, 16 nt, Mycobacterium avium subsp. paratuberculosis
cgaggucaccaacgcg

SEQ ID NO: 2933003 - RNA, 24 nt, Mycobacterium avium subsp. paratuberculosis
cgagguugaaucgccuacugcgcc

SEQ ID NO: 2933004 - RNA, 17 nt, Mycobacterium avium subsp. paratuberculosis
cgagguugaugccgacg

SEQ ID NO: 2933005 - RNA, 21 nt, Mycobacterium avium subsp. paratuberculosis
cgagguugaugccgacgucgg

SEQ ID NO: 2933006 - RNA, 20 nt, Mycobacterium avium subsp. paratuberculosis
cgagguuguagaccgggaug

SEQ ID NO: 2933007 - RNA, 17 nt, Mycobacterium avium subsp. paratuberculosis
cgagguugucccgggcg

SEQ ID NO: 2933008 - RNA, 24 nt, Mycobacterium avium subsp. paratuberculosis
cgagguugucccgggcgaacgucg

SEQ ID NO: 2933009 - RNA, 15 nt, Mycobacterium avium subsp. paratuberculosis
cgaguaacucggccu

SEQ ID NO: 2933010 - RNA, 17 nt, Mycobacterium avium subsp. paratuberculosis
cgaguacccgccgcacc

SEQ ID NO: 2933011 - RNA, 22 nt, Mycobacterium avium subsp. paratuberculosis
cgaguacccgccgcaccucgcc

SEQ ID NO: 2933012 - RNA, 21 nt, Mycobacterium avium subsp. paratuberculosis
cgaguagaacuucgccagcgg

SEQ ID NO: 2933013 - RNA, 19 nt, Mycobacterium avium subsp. paratuberculosis
cgaguauccgcgcagcguc

SEQ ID NO: 2933014 - RNA, 19 nt, Mycobacterium avium subsp. paratuberculosis
cgagucacccggcuggccg

SEQ ID NO: 2933015 - RNA, 15 nt, Mycobacterium avium subsp. paratuberculosis
cgagucaccggcucg

SEQ ID NO: 2933016 - RNA, 19 nt, Mycobacterium avium subsp. paratuberculosis
cgagucaccggcucgcggg

SEQ ID NO: 2933017 - RNA, 14 nt, Mycobacterium avium subsp. paratuberculosis
cgagucaucgccac

SEQ ID NO: 2933018 - RNA, 21 nt, Mycobacterium avium subsp. paratuberculosis
cgagucaucgccacccgcacc

SEQ ID NO: 2933019 - RNA, 22 nt, Mycobacterium avium subsp. paratuberculosis
cgaguccacgacguccucgacg

SEQ ID NO: 2933020 - RNA, 16 nt, Mycobacterium avium subsp. paratuberculosis
cgaguccagccagccg

SEQ ID NO: 2933021 - RNA, 17 nt, Mycobacterium avium subsp. paratuberculosis
cgaguccagccagccgc

SEQ ID NO: 2933022 - RNA, 18 nt, Mycobacterium avium subsp. paratuberculosis
cgaguccagccagccgcg

SEQ ID NO: 2933023 - RNA, 21 nt, Mycobacterium avium subsp. paratuberculosis
cgaguccagccagccgcgccg

SEQ ID NO: 2933024 - RNA, 15 nt, Mycobacterium avium subsp. paratuberculosis
cgagucccgcgcggc

SEQ ID NO: 2933025 - RNA, 16 nt, Mycobacterium avium subsp. paratuberculosis
cgagucccgcgcggcg

SEQ ID NO: 2933026 - RNA, 14 nt, Mycobacterium avium subsp. paratuberculosis
cgagucccggcgca

SEQ ID NO: 2933027 - RNA, 20 nt, Mycobacterium avium subsp. paratuberculosis
cgaguccgcggaggcgagca

SEQ ID NO: 2933028 - RNA, 15 nt, Mycobacterium avium subsp. paratuberculosis
cgaguccggccaggu

SEQ ID NO: 2933029 - RNA, 17 nt, Mycobacterium avium subsp. paratuberculosis
cgaguccggccaggucg

SEQ ID NO: 2933030 - RNA, 22 nt, Mycobacterium avium subsp. paratuberculosis
cgaguccggccaggucgccgcg

SEQ ID NO: 2933031 - RNA, 23 nt, Mycobacterium avium subsp. paratuberculosis
cgaguccggccaggucgccgcgc

SEQ ID NO: 2933032 - RNA, 18 nt, Mycobacterium avium subsp. paratuberculosis
cgaguccgggccgccggc

SEQ ID NO: 2933033 - RNA, 15 nt, Mycobacterium avium subsp. paratuberculosis
cgagucgaagccgug

SEQ ID NO: 2933034 - RNA, 16 nt, Mycobacterium avium subsp. paratuberculosis
cgagucgaagccgugg

SEQ ID NO: 2933035 - RNA, 17 nt, Mycobacterium avium subsp. paratuberculosis
cgagucgaagccguggc

SEQ ID NO: 2933036 - RNA, 17 nt, Mycobacterium avium subsp. paratuberculosis
cgagucgaaggcgcggg

SEQ ID NO: 2933037 - RNA, 18 nt, Mycobacterium avium subsp. paratuberculosis
cgagucgaaggcgcgggc

SEQ ID NO: 2933038 - RNA, 17 nt, Mycobacterium avium subsp. paratuberculosis
cgagucgacgugcucgg

SEQ ID NO: 2933039 - RNA, 19 nt, Mycobacterium avium subsp. paratuberculosis
cgagucgacgugcucggcg

SEQ ID NO: 2933040 - RNA, 21 nt, Mycobacterium avium subsp. paratuberculosis
cgagucgagaaacgcgcgcag

SEQ ID NO: 2933041 - RNA, 23 nt, Mycobacterium avium subsp. paratuberculosis
cgagucgagcaccgcgaccacgc

SEQ ID NO: 2933042 - RNA, 14 nt, Mycobacterium avium subsp. paratuberculosis
cgagucgaugaccu

SEQ ID NO: 2933043 - RNA, 18 nt, Mycobacterium avium subsp. paratuberculosis
cgagucgaugaccucgcg

SEQ ID NO: 2933044 - RNA, 19 nt, Mycobacterium avium subsp. paratuberculosis
cgagucgcgccgcgucgcg

SEQ ID NO: 2933045 - RNA, 14 nt, Mycobacterium avium subsp. paratuberculosis
cgagucggagaccc

SEQ ID NO: 2933046 - RNA, 16 nt, Mycobacterium avium subsp. paratuberculosis
cgagucggccaccgcg

SEQ ID NO: 2933047 - RNA, 19 nt, Mycobacterium avium subsp. paratuberculosis
cgagucggcgaaggcgcgc

SEQ ID NO: 2933048 - RNA, 21 nt, Mycobacterium avium subsp. paratuberculosis
cgagucggcgaaggcgcgcag

SEQ ID NO: 2933049 - RNA, 14 nt, Mycobacterium avium subsp. paratuberculosis
cgagucggcgucgg

SEQ ID NO: 2933050 - RNA, 19 nt, Mycobacterium avium subsp. paratuberculosis
cgagucggugaccaccugc

SEQ ID NO: 2933051 - RNA, 20 nt, Mycobacterium avium subsp. paratuberculosis
cgagucguacuucgcccccg

SEQ ID NO: 2933052 - RNA, 23 nt, Mycobacterium avium subsp. paratuberculosis
cgagucguacuucgcccccggaa

SEQ ID NO: 2933053 - RNA, 20 nt, Mycobacterium avium subsp. paratuberculosis
cgagucguagaggggccgga

SEQ ID NO: 2933054 - RNA, 22 nt, Mycobacterium avium subsp. paratuberculosis
cgagucguagaggggccggacg

SEQ ID NO: 2933055 - RNA, 12 nt, Mycobacterium avium subsp. paratuberculosis
cgagucgucgcg

SEQ ID NO: 2933056 - RNA, 14 nt, Mycobacterium avium subsp. paratuberculosis
cgagucgucgcgca

SEQ ID NO: 2933057 - RNA, 15 nt, Mycobacterium avium subsp. paratuberculosis
cgagucgucgcgcac

SEQ ID NO: 2933058 - RNA, 18 nt, Mycobacterium avium subsp. paratuberculosis
cgagucgucgcgcaccag

SEQ ID NO: 2933059 - RNA, 16 nt, Mycobacterium avium subsp. paratuberculosis
cgagugaggacgaggc

SEQ ID NO: 2933060 - RNA, 18 nt, Mycobacterium avium subsp. paratuberculosis
cgagugaggccgaggcga

SEQ ID NO: 2933061 - RNA, 13 nt, Mycobacterium avium subsp. paratuberculosis
cgagugccggcag

SEQ ID NO: 2933062 - RNA, 14 nt, Mycobacterium avium subsp. paratuberculosis
cgagugccggccag

SEQ ID NO: 2933063 - RNA, 17 nt, Mycobacterium avium subsp. paratuberculosis
cgagugcgaaacucacc

SEQ ID NO: 2933064 - RNA, 19 nt, Mycobacterium avium subsp. paratuberculosis
cgagugcgaaucaucgugg

SEQ ID NO: 2933065 - RNA, 15 nt, Mycobacterium avium subsp. paratuberculosis
cgagugcggcgcggu

SEQ ID NO: 2933066 - RNA, 17 nt, Mycobacterium avium subsp. paratuberculosis
cgagugcggcgcggugc

SEQ ID NO: 2933067 - RNA, 21 nt, Mycobacterium avium subsp. paratuberculosis
cgagugcucgauggccagcgc

SEQ ID NO: 2933068 - RNA, 21 nt, Mycobacterium avium subsp. paratuberculosis
cgaguggaagucagcgcguga

SEQ ID NO: 2933069 - RNA, 14 nt, Mycobacterium avium subsp. paratuberculosis
cgaguggcgaacgg

SEQ ID NO: 2933070 - RNA, 15 nt, Mycobacterium avium subsp. paratuberculosis
cgaguggcgccgucg

SEQ ID NO: 2933071 - RNA, 17 nt, Mycobacterium avium subsp. paratuberculosis
cgagugggaccgucggc

SEQ ID NO: 2933072 - RNA, 21 nt, Mycobacterium avium subsp. paratuberculosis
cgagugguaccggguggccgu

SEQ ID NO: 2933073 - RNA, 14 nt, Mycobacterium avium subsp. paratuberculosis
cgaguggucggccg

SEQ ID NO: 2933074 - RNA, 17 nt, Mycobacterium avium subsp. paratuberculosis
cgaguggucggccgccc

SEQ ID NO: 2933075 - RNA, 18 nt, Mycobacterium avium subsp. paratuberculosis
cgaguggucggccgccca

SEQ ID NO: 2933076 - RNA, 13 nt, Mycobacterium avium subsp. paratuberculosis
cgaguucacccga

SEQ ID NO: 2933077 - RNA, 18 nt, Mycobacterium avium subsp. paratuberculosis
cgaguucagaagucgccc

SEQ ID NO: 2933078 - RNA, 22 nt, Mycobacterium avium subsp. paratuberculosis
cgaguucagaagucgcccgcgu

SEQ ID NO: 2933079 - RNA, 19 nt, Mycobacterium avium subsp. paratuberculosis
cgaguuccaccucgggccg

SEQ ID NO: 2933080 - RNA, 20 nt, Mycobacterium avium subsp. paratuberculosis
cgaguuccaccucgggccgg

SEQ ID NO: 2933081 - RNA, 23 nt, Mycobacterium avium subsp. paratuberculosis
cgaguuccaccucgggccgggcg

SEQ ID NO: 2933082 - RNA, 14 nt, Mycobacterium avium subsp. paratuberculosis
cgaguuccagcucc

SEQ ID NO: 2933083 - RNA, 14 nt, Mycobacterium avium subsp. paratuberculosis
cgaguuccgcgucg

SEQ ID NO: 2933084 - RNA, 17 nt, Mycobacterium avium subsp. paratuberculosis
cgaguuccgcgucggcc

SEQ ID NO: 2933085 - RNA, 22 nt, Mycobacterium avium subsp. paratuberculosis
cgaguuccugcgaccgccgccg

SEQ ID NO: 2933086 - RNA, 20 nt, Mycobacterium avium subsp. paratuberculosis
cgaguucgaccuccacccgc

SEQ ID NO: 2933087 - RNA, 14 nt, Mycobacterium avium subsp. paratuberculosis
cgaucaccggcgcg

SEQ ID NO: 2933088 - RNA, 15 nt, Mycobacterium avium subsp. paratuberculosis
cgaucaccggcgcgu

SEQ ID NO: 2933089 - RNA, 22 nt, Mycobacterium avium subsp. paratuberculosis
cgaucaccggcgcguuggcccg

SEQ ID NO: 2933090 - RNA, 16 nt, Mycobacterium avium subsp. paratuberculosis
cgaucaccgggcggcc

SEQ ID NO: 2933091 - RNA, 17 nt, Mycobacterium avium subsp. paratuberculosis
cgaucaccgggcggccg

SEQ ID NO: 2933092 - RNA, 19 nt, Mycobacterium avium subsp. paratuberculosis
cgaucaccgggcggccgug

SEQ ID NO: 2933093 - RNA, 16 nt, Mycobacterium avium subsp. paratuberculosis
cgaucaccucgccggc

SEQ ID NO: 2933094 - RNA, 17 nt, Mycobacterium avium subsp. paratuberculosis
cgaucaccucgccggcc

SEQ ID NO: 2933095 - RNA, 14 nt, Mycobacterium avium subsp. paratuberculosis
cgaucaccucgucg

SEQ ID NO: 2933096 - RNA, 15 nt, Mycobacterium avium subsp. paratuberculosis
cgaucaccugcgggc

SEQ ID NO: 2933097 - RNA, 12 nt, Mycobacterium avium subsp. paratuberculosis
cgaucaccuugc

SEQ ID NO: 2933098 - RNA, 19 nt, Mycobacterium avium subsp. paratuberculosis
cgaucaccuugcggccggc

SEQ ID NO: 2933099 - RNA, 17 nt, Mycobacterium avium subsp. paratuberculosis
cgaucacgaacaggucc

SEQ ID NO: 2933100 - RNA, 20 nt, Mycobacterium avium subsp. paratuberculosis
cgaucacgacgcgaccgagg

SEQ ID NO: 2933101 - RNA, 19 nt, Mycobacterium avium subsp. paratuberculosis
cgaucacgccgccggggcg

SEQ ID NO: 2933102 - RNA, 14 nt, Mycobacterium avium subsp. paratuberculosis
cgaucacgucggug

SEQ ID NO: 2933103 - RNA, 16 nt, Mycobacterium avium subsp. paratuberculosis
cgaucagagcgggccg

SEQ ID NO: 2933104 - RNA, 15 nt, Mycobacterium avium subsp. paratuberculosis
cgaucagaugcucgu

SEQ ID NO: 2933105 - RNA, 23 nt, Mycobacterium avium subsp. paratuberculosis
cgaucagcaccagguugucgccg

SEQ ID NO: 2933106 - RNA, 14 nt, Mycobacterium avium subsp. paratuberculosis
cgaucagcaccgcc

SEQ ID NO: 2933107 - RNA, 16 nt, Mycobacterium avium subsp. paratuberculosis
cgaucagcacgucgcg

SEQ ID NO: 2933108 - RNA, 18 nt, Mycobacterium avium subsp. paratuberculosis
cgaucagcacgucgcggc

SEQ ID NO: 2933109 - RNA, 20 nt, Mycobacterium avium subsp. paratuberculosis
cgaucagcacgucgcggccc

SEQ ID NO: 2933110 - RNA, 22 nt, Mycobacterium avium subsp. paratuberculosis
cgaucagcagaugcgugcggug

SEQ ID NO: 2933111 - RNA, 12 nt, Mycobacterium avium subsp. paratuberculosis
cgaucagcagca

SEQ ID NO: 2933112 - RNA, 14 nt, Mycobacterium avium subsp. paratuberculosis
cgaucagcagcacc

SEQ ID NO: 2933113 - RNA, 16 nt, Mycobacterium avium subsp. paratuberculosis
cgaucagcagcacccg

SEQ ID NO: 2933114 - RNA, 20 nt, Mycobacterium avium subsp. paratuberculosis
cgaucagcagcacccgggcc

SEQ ID NO: 2933115 - RNA, 15 nt, Mycobacterium avium subsp. paratuberculosis
cgaucagcagcaccu

SEQ ID NO: 2933116 - RNA, 17 nt, Mycobacterium avium subsp. paratuberculosis
cgaucagcagccgggcc

SEQ ID NO: 2933117 - RNA, 20 nt, Mycobacterium avium subsp. paratuberculosis
cgaucagcagccgggccugc

SEQ ID NO: 2933118 - RNA, 13 nt, Mycobacterium avium subsp. paratuberculosis
cgaucagcaugac

SEQ ID NO: 2933119 - RNA, 17 nt, Mycobacterium avium subsp. paratuberculosis
cgaucagcaugacgaac

SEQ ID NO: 2933120 - RNA, 14 nt, Mycobacterium avium subsp. paratuberculosis
cgaucagccacacc

SEQ ID NO: 2933121 - RNA, 15 nt, Mycobacterium avium subsp. paratuberculosis
cgaucagccacaccg

SEQ ID NO: 2933122 - RNA, 17 nt, Mycobacterium avium subsp. paratuberculosis
cgaucagccacaccgcc

SEQ ID NO: 2933123 - RNA, 18 nt, Mycobacterium avium subsp. paratuberculosis
cgaucagccacaccgccg

SEQ ID NO: 2933124 - RNA, 22 nt, Mycobacterium avium subsp. paratuberculosis
cgaucagccacaccgccggcgc

SEQ ID NO: 2933125 - RNA, 21 nt, Mycobacterium avium subsp. paratuberculosis
cgaucagccccagggugcgcc

SEQ ID NO: 2933126 - RNA, 12 nt, Mycobacterium avium subsp. paratuberculosis
cgaucagcccgc

SEQ ID NO: 2933127 - RNA, 13 nt, Mycobacterium avium subsp. paratuberculosis
cgaucagcccgcc

SEQ ID NO: 2933128 - RNA, 13 nt, Mycobacterium avium subsp. paratuberculosis
cgaucagcccggc

SEQ ID NO: 2933129 - RNA, 10 nt, Mycobacterium avium subsp. paratuberculosis
cgaucagccg

SEQ ID NO: 2933130 - RNA, 19 nt, Mycobacterium avium subsp. paratuberculosis
cgaucagccgcgacagccg

SEQ ID NO: 2933131 - RNA, 22 nt, Mycobacterium avium subsp. paratuberculosis
cgaucagccggguagcgccgcc

SEQ ID NO: 2933132 - RNA, 15 nt, Mycobacterium avium subsp. paratuberculosis
cgaucagcgacggcc

SEQ ID NO: 2933133 - RNA, 17 nt, Mycobacterium avium subsp. paratuberculosis
cgaucagcgacggcccg

SEQ ID NO: 2933134 - RNA, 17 nt, Mycobacterium avium subsp. paratuberculosis
cgaucagcgacucgacc

SEQ ID NO: 2933135 - RNA, 19 nt, Mycobacterium avium subsp. paratuberculosis
cgaucagcgacucgacccc

SEQ ID NO: 2933136 - RNA, 13 nt, Mycobacterium avium subsp. paratuberculosis
cgaucagcgcgaa

SEQ ID NO: 2933137 - RNA, 17 nt, Mycobacterium avium subsp. paratuberculosis
cgaucagcgcgcacagc

SEQ ID NO: 2933138 - RNA, 18 nt, Mycobacterium avium subsp. paratuberculosis
cgaucagcgcgcacagcg

SEQ ID NO: 2933139 - RNA, 19 nt, Mycobacterium avium subsp. paratuberculosis
cgaucagcgcgcacagcgc

SEQ ID NO: 2933140 - RNA, 13 nt, Mycobacterium avium subsp. paratuberculosis
cgaucagcgcgcc

SEQ ID NO: 2933141 - RNA, 14 nt, Mycobacterium avium subsp. paratuberculosis
cgaucagcgcgccg

SEQ ID NO: 2933142 - RNA, 18 nt, Mycobacterium avium subsp. paratuberculosis
cgaucagcgcgucgaggu

SEQ ID NO: 2933143 - RNA, 13 nt, Mycobacterium avium subsp. paratuberculosis
cgaucagcggcgg

SEQ ID NO: 2933144 - RNA, 15 nt, Mycobacterium avium subsp. paratuberculosis
cgaucagcggcgggc

SEQ ID NO: 2933145 - RNA, 18 nt, Mycobacterium avium subsp. paratuberculosis
cgaucagcggcgggccca

SEQ ID NO: 2933146 - RNA, 17 nt, Mycobacterium avium subsp. paratuberculosis
cgaucagcgucagcacc

SEQ ID NO: 2933147 - RNA, 21 nt, Mycobacterium avium subsp. paratuberculosis
cgaucagcgucagcaccgcga

SEQ ID NO: 2933148 - RNA, 14 nt, Mycobacterium avium subsp. paratuberculosis
cgaucagcgucauc

SEQ ID NO: 2933149 - RNA, 18 nt, Mycobacterium avium subsp. paratuberculosis
cgaucagcgucaucacgu

SEQ ID NO: 2933150 - RNA, 15 nt, Mycobacterium avium subsp. paratuberculosis
cgaucagcuccuccu

SEQ ID NO: 2933151 - RNA, 15 nt, Mycobacterium avium subsp. paratuberculosis
cgaucagcucguggc

SEQ ID NO: 2933152 - RNA, 21 nt, Mycobacterium avium subsp. paratuberculosis
cgaucagcucguggcgggccc

SEQ ID NO: 2933153 - RNA, 22 nt, Mycobacterium avium subsp. paratuberculosis
cgaucagcucguggcgggcccg

SEQ ID NO: 2933154 - RNA, 16 nt, Mycobacterium avium subsp. paratuberculosis
cgaucagcugcucggc

SEQ ID NO: 2933155 - RNA, 17 nt, Mycobacterium avium subsp. paratuberculosis
cgaucagcugcucggcc

SEQ ID NO: 2933156 - RNA, 19 nt, Mycobacterium avium subsp. paratuberculosis
cgaucagcugcucggccac

SEQ ID NO: 2933157 - RNA, 17 nt, Mycobacterium avium subsp. paratuberculosis
cgaucagcuggcugaca

SEQ ID NO: 2933158 - RNA, 18 nt, Mycobacterium avium subsp. paratuberculosis
cgaucaggaucggcgggc

SEQ ID NO: 2933159 - RNA, 14 nt, Mycobacterium avium subsp. paratuberculosis
cgaucaggccggcc

SEQ ID NO: 2933160 - RNA, 16 nt, Mycobacterium avium subsp. paratuberculosis
cgaucaggccggccac

SEQ ID NO: 2933161 - RNA, 17 nt, Mycobacterium avium subsp. paratuberculosis
cgaucaggccggccacc

SEQ ID NO: 2933162 - RNA, 18 nt, Mycobacterium avium subsp. paratuberculosis
cgaucaggccggccacca

SEQ ID NO: 2933163 - RNA, 13 nt, Mycobacterium avium subsp. paratuberculosis
cgaucaggcgcag

SEQ ID NO: 2933164 - RNA, 17 nt, Mycobacterium avium subsp. paratuberculosis
cgaucaggcgcagcccg

SEQ ID NO: 2933165 - RNA, 18 nt, Mycobacterium avium subsp. paratuberculosis
cgaucaggcgcagcccga

SEQ ID NO: 2933166 - RNA, 22 nt, Mycobacterium avium subsp. paratuberculosis
cgaucaggcugccgcugcgccg

SEQ ID NO: 2933167 - RNA, 23 nt, Mycobacterium avium subsp. paratuberculosis
cgaucaggcugccgcugcgccgg

SEQ ID NO: 2933168 - RNA, 15 nt, Mycobacterium avium subsp. paratuberculosis
cgaucaggcuggaca

SEQ ID NO: 2933169 - RNA, 15 nt, Mycobacterium avium subsp. paratuberculosis
cgaucagggcccaca

SEQ ID NO: 2933170 - RNA, 22 nt, Mycobacterium avium subsp. paratuberculosis
cgaucagggcccacagcagccg

SEQ ID NO: 2933171 - RNA, 14 nt, Mycobacterium avium subsp. paratuberculosis
cgaucagggccgcg

SEQ ID NO: 2933172 - RNA, 15 nt, Mycobacterium avium subsp. paratuberculosis
cgauccggccggcgg

SEQ ID NO: 2933173 - RNA, 16 nt, Mycobacterium avium subsp. paratuberculosis
cgauccggccggcggc

SEQ ID NO: 2933174 - RNA, 18 nt, Mycobacterium avium subsp. paratuberculosis
cgauccggccggcggcgg

SEQ ID NO: 2933175 - RNA, 12 nt, Mycobacterium avium subsp. paratuberculosis
cgauccggcgcc

SEQ ID NO: 2933176 - RNA, 16 nt, Mycobacterium avium subsp. paratuberculosis
cgauccggcgcccgau

SEQ ID NO: 2933177 - RNA, 15 nt, Mycobacterium avium subsp. paratuberculosis
cgauccggcgccgcg

SEQ ID NO: 2933178 - RNA, 13 nt, Mycobacterium avium subsp. paratuberculosis
cgauccggcgcgu

SEQ ID NO: 2933179 - RNA, 22 nt, Mycobacterium avium subsp. paratuberculosis
cgauccggcgucucagucggcc

SEQ ID NO: 2933180 - RNA, 18 nt, Mycobacterium avium subsp. paratuberculosis
cgauccgggcacgcagcg

SEQ ID NO: 2933181 - RNA, 17 nt, Mycobacterium avium subsp. paratuberculosis
cgauccgggcaugguca

SEQ ID NO: 2933182 - RNA, 13 nt, Mycobacterium avium subsp. paratuberculosis
cgauccgggcgcc

SEQ ID NO: 2933183 - RNA, 22 nt, Mycobacterium avium subsp. paratuberculosis
cgauccgggcgccggccggcgc

SEQ ID NO: 2933184 - RNA, 18 nt, Mycobacterium avium subsp. paratuberculosis
cgauccggggggcggggu

SEQ ID NO: 2933185 - RNA, 19 nt, Mycobacterium avium subsp. paratuberculosis
cgauccggggggcgggguc

SEQ ID NO: 2933186 - RNA, 21 nt, Mycobacterium avium subsp. paratuberculosis
cgauccgguagaagaccaccu

SEQ ID NO: 2933187 - RNA, 14 nt, Mycobacterium avium subsp. paratuberculosis
cgauccgguccagc

SEQ ID NO: 2933188 - RNA, 16 nt, Mycobacterium avium subsp. paratuberculosis
cgauccgguccagccc

SEQ ID NO: 2933189 - RNA, 21 nt, Mycobacterium avium subsp. paratuberculosis
cgauccgguccagcccggugu

SEQ ID NO: 2933190 - RNA, 15 nt, Mycobacterium avium subsp. paratuberculosis
cgauccggucgauga

SEQ ID NO: 2933191 - RNA, 18 nt, Mycobacterium avium subsp. paratuberculosis
cgauccugugcaccgugc

SEQ ID NO: 2933192 - RNA, 19 nt, Mycobacterium avium subsp. paratuberculosis
cgaucgaauacaccugccg

SEQ ID NO: 2933193 - RNA, 22 nt, Mycobacterium avium subsp. paratuberculosis
cgaucgaauacaccugccgcac

SEQ ID NO: 2933194 - RNA, 15 nt, Mycobacterium avium subsp. paratuberculosis
cgaucgacaccagcg

SEQ ID NO: 2933195 - RNA, 18 nt, Mycobacterium avium subsp. paratuberculosis
cgaucgacgacgccagcu

SEQ ID NO: 2933196 - RNA, 14 nt, Mycobacterium avium subsp. paratuberculosis
cgaucgacgccgac

SEQ ID NO: 2933197 - RNA, 13 nt, Mycobacterium avium subsp. paratuberculosis
cgaucgacgucag

SEQ ID NO: 2933198 - RNA, 21 nt, Mycobacterium avium subsp. paratuberculosis
cgaucgagaccaugucggcca

SEQ ID NO: 2933199 - RNA, 22 nt, Mycobacterium avium subsp. paratuberculosis
cgaucgagaccaugucggccag

SEQ ID NO: 2933200 - RNA, 16 nt, Mycobacterium avium subsp. paratuberculosis
cgaucgagccgguggu

SEQ ID NO: 2933201 - RNA, 15 nt, Mycobacterium avium subsp. paratuberculosis
cgaucgaggacaccg

SEQ ID NO: 2933202 - RNA, 22 nt, Mycobacterium avium subsp. paratuberculosis
cgaucgaggugauguuggccgc

SEQ ID NO: 2933203 - RNA, 15 nt, Mycobacterium avium subsp. paratuberculosis
cgaucgaucaucgcc

SEQ ID NO: 2933204 - RNA, 16 nt, Mycobacterium avium subsp. paratuberculosis
cgaucgaucaucgccu

SEQ ID NO: 2933205 - RNA, 19 nt, Mycobacterium avium subsp. paratuberculosis
cgaucgaucaucgccucgg

SEQ ID NO: 2933206 - RNA, 15 nt, Mycobacterium avium subsp. paratuberculosis
cgaucgaugcccagc

SEQ ID NO: 2933207 - RNA, 20 nt, Mycobacterium avium subsp. paratuberculosis
cgaucgaugcccagcgcgcg

SEQ ID NO: 2933208 - RNA, 15 nt, Mycobacterium avium subsp. paratuberculosis
cgaucgccaccgaga

SEQ ID NO: 2933209 - RNA, 18 nt, Mycobacterium avium subsp. paratuberculosis
cgaucgccagcacggugu

SEQ ID NO: 2933210 - RNA, 13 nt, Mycobacterium avium subsp. paratuberculosis
cgaucgccagcgc

SEQ ID NO: 2933211 - RNA, 14 nt, Mycobacterium avium subsp. paratuberculosis
cgaucgccagcgcc

SEQ ID NO: 2933212 - RNA, 15 nt, Mycobacterium avium subsp. paratuberculosis
cgaucgccagcgccc

SEQ ID NO: 2933213 - RNA, 17 nt, Mycobacterium avium subsp. paratuberculosis
cgaucgccagcgcccga

SEQ ID NO: 2933214 - RNA, 22 nt, Mycobacterium avium subsp. paratuberculosis
cgaucgccagcgcgcagaacac

SEQ ID NO: 2933215 - RNA, 16 nt, Mycobacterium avium subsp. paratuberculosis
cgaucgccagcgcggu

SEQ ID NO: 2933216 - RNA, 13 nt, Mycobacterium avium subsp. paratuberculosis
cgaucgcccgcuc

SEQ ID NO: 2933217 - RNA, 19 nt, Mycobacterium avium subsp. paratuberculosis
cgaucgcccgcuccgcggg

SEQ ID NO: 2933218 - RNA, 20 nt, Mycobacterium avium subsp. paratuberculosis
cgaucgcccgcuccgcgggc

SEQ ID NO: 2933219 - RNA, 22 nt, Mycobacterium avium subsp. paratuberculosis
cgaucgcccgguaggccgccgc

SEQ ID NO: 2933220 - RNA, 23 nt, Mycobacterium avium subsp. paratuberculosis
cgaucgcccgguaggccgccgcg

SEQ ID NO: 2933221 - RNA, 15 nt, Mycobacterium avium subsp. paratuberculosis
cgaucgccgacgcca

SEQ ID NO: 2933222 - RNA, 16 nt, Mycobacterium avium subsp. paratuberculosis
cgaucgccgacgccag

SEQ ID NO: 2933223 - RNA, 17 nt, Mycobacterium avium subsp. paratuberculosis
cgaucgccgacgccagc

SEQ ID NO: 2933224 - RNA, 18 nt, Mycobacterium avium subsp. paratuberculosis
cgaucgccgacgccagca

SEQ ID NO: 2933225 - RNA, 18 nt, Mycobacterium avium subsp. paratuberculosis
cgaucgccgauccggcgc

SEQ ID NO: 2933226 - RNA, 21 nt, Mycobacterium avium subsp. paratuberculosis
cgaucgccgcgcauucaccag

SEQ ID NO: 2933227 - RNA, 22 nt, Mycobacterium avium subsp. paratuberculosis
cgaucgccgcgcauucaccagc

SEQ ID NO: 2933228 - RNA, 13 nt, Mycobacterium avium subsp. paratuberculosis
cgaucgccgcgcc

SEQ ID NO: 2933229 - RNA, 14 nt, Mycobacterium avium subsp. paratuberculosis
cgaucgccgcgccc

SEQ ID NO: 2933230 - RNA, 18 nt, Mycobacterium avium subsp. paratuberculosis
cgaucgccgcgcccagca

SEQ ID NO: 2933231 - RNA, 14 nt, Mycobacterium avium subsp. paratuberculosis
cgaucgccgcggcg

SEQ ID NO: 2933232 - RNA, 15 nt, Mycobacterium avium subsp. paratuberculosis
cgaucgccgcggcga

SEQ ID NO: 2933233 - RNA, 15 nt, Mycobacterium avium subsp. paratuberculosis
cgaucgccggggauc

SEQ ID NO: 2933234 - RNA, 18 nt, Mycobacterium avium subsp. paratuberculosis
cgaucgccggugcggccg

SEQ ID NO: 2933235 - RNA, 21 nt, Mycobacterium avium subsp. paratuberculosis
cgaucgccggugcggccgcga

SEQ ID NO: 2933236 - RNA, 23 nt, Mycobacterium avium subsp. paratuberculosis
cgaucgccgucacguagcgcggc

SEQ ID NO: 2933237 - RNA, 23 nt, Mycobacterium avium subsp. paratuberculosis
cgaucgccgugagauccagcagc

SEQ ID NO: 2933238 - RNA, 23 nt, Mycobacterium avium subsp. paratuberculosis
cgaucgccuccgucagcgccgcc

SEQ ID NO: 2933239 - RNA, 14 nt, Mycobacterium avium subsp. paratuberculosis
cgaucgccucggcc

SEQ ID NO: 2933240 - RNA, 20 nt, Mycobacterium avium subsp. paratuberculosis
cgaucgccucggccuuggcc

SEQ ID NO: 2933241 - RNA, 12 nt, Mycobacterium avium subsp. paratuberculosis
cgaucgcgacca

SEQ ID NO: 2933242 - RNA, 15 nt, Mycobacterium avium subsp. paratuberculosis
cgaucgcgaccaccg

SEQ ID NO: 2933243 - RNA, 19 nt, Mycobacterium avium subsp. paratuberculosis
cgaucgcgaccaccggccg

SEQ ID NO: 2933244 - RNA, 22 nt, Mycobacterium avium subsp. paratuberculosis
cgaucgcgaccaccggccgacc

SEQ ID NO: 2933245 - RNA, 15 nt, Mycobacterium avium subsp. paratuberculosis
cgaucgcgacggccg

SEQ ID NO: 2933246 - RNA, 16 nt, Mycobacterium avium subsp. paratuberculosis
cgaucgcgacggccgg

SEQ ID NO: 2933247 - RNA, 15 nt, Mycobacterium avium subsp. paratuberculosis
cgaucgcgagggccg

SEQ ID NO: 2933248 - RNA, 13 nt, Mycobacterium avium subsp. paratuberculosis
cgaucgcgaucac

SEQ ID NO: 2933249 - RNA, 14 nt, Mycobacterium avium subsp. paratuberculosis
cgaucgcgaucacc

SEQ ID NO: 2933250 - RNA, 15 nt, Mycobacterium avium subsp. paratuberculosis
cgaucgcgaucaccg

SEQ ID NO: 2933251 - RNA, 17 nt, Mycobacterium avium subsp. paratuberculosis
cgaucgcgaucaccgcg

SEQ ID NO: 2933252 - RNA, 19 nt, Mycobacterium avium subsp. paratuberculosis
cgaucgcgaucaccgcggc

SEQ ID NO: 2933253 - RNA, 21 nt, Mycobacterium avium subsp. paratuberculosis
cgaucgcgaucaccgcggcca

SEQ ID NO: 2933254 - RNA, 13 nt, Mycobacterium avium subsp. paratuberculosis
cgaucgcgaucgc

SEQ ID NO: 2933255 - RNA, 15 nt, Mycobacterium avium subsp. paratuberculosis
cgaucgcgaucgccg

SEQ ID NO: 2933256 - RNA, 14 nt, Mycobacterium avium subsp. paratuberculosis
cgaucgcgccggcc

SEQ ID NO: 2933257 - RNA, 24 nt, Mycobacterium avium subsp. paratuberculosis
cgaucuccaccgagugcggcgcgg

SEQ ID NO: 2933258 - RNA, 15 nt, Mycobacterium avium subsp. paratuberculosis
cgaucuccagcggcc

SEQ ID NO: 2933259 - RNA, 20 nt, Mycobacterium avium subsp. paratuberculosis
cgaucuccagcggccgggcg

SEQ ID NO: 2933260 - RNA, 21 nt, Mycobacterium avium subsp. paratuberculosis
cgaucuccagcggccgggcga

SEQ ID NO: 2933261 - RNA, 18 nt, Mycobacterium avium subsp. paratuberculosis
cgaucuccaucccgcuga

SEQ ID NO: 2933262 - RNA, 13 nt, Mycobacterium avium subsp. paratuberculosis
cgaucuccucgcg

SEQ ID NO: 2933263 - RNA, 14 nt, Mycobacterium avium subsp. paratuberculosis
cgaucuccucggcg

SEQ ID NO: 2933264 - RNA, 17 nt, Mycobacterium avium subsp. paratuberculosis
cgaucuccuuguugacg

SEQ ID NO: 2933265 - RNA, 17 nt, Mycobacterium avium subsp. paratuberculosis
cgaucucgaccagcgcc

SEQ ID NO: 2933266 - RNA, 16 nt, Mycobacterium avium subsp. paratuberculosis
cgaucucgaccaggcc

SEQ ID NO: 2933267 - RNA, 21 nt, Mycobacterium avium subsp. paratuberculosis
cgaucucgauggacgcggugg

SEQ ID NO: 2933268 - RNA, 17 nt, Mycobacterium avium subsp. paratuberculosis
cgaucucgauggccacg

SEQ ID NO: 2933269 - RNA, 17 nt, Mycobacterium avium subsp. paratuberculosis
cgaucucgauggccucg

SEQ ID NO: 2933270 - RNA, 20 nt, Mycobacterium avium subsp. paratuberculosis
cgaucucgauggccucgucg

SEQ ID NO: 2933271 - RNA, 21 nt, Mycobacterium avium subsp. paratuberculosis
cgaucucgauggccucgucga

SEQ ID NO: 2933272 - RNA, 23 nt, Mycobacterium avium subsp. paratuberculosis
cgaucucgauggccucgucgaug

SEQ ID NO: 2933273 - RNA, 14 nt, Mycobacterium avium subsp. paratuberculosis
cgaucucgauguag

SEQ ID NO: 2933274 - RNA, 13 nt, Mycobacterium avium subsp. paratuberculosis
cgaucucgccgaa

SEQ ID NO: 2933275 - RNA, 18 nt, Mycobacterium avium subsp. paratuberculosis
cgaucucgccgaaggccg

SEQ ID NO: 2933276 - RNA, 20 nt, Mycobacterium avium subsp. paratuberculosis
cgaucucgccgaaggccggg

SEQ ID NO: 2933277 - RNA, 14 nt, Mycobacterium avium subsp. paratuberculosis
cgaucucgccgucc

SEQ ID NO: 2933278 - RNA, 15 nt, Mycobacterium avium subsp. paratuberculosis
cgaucucgccguccu

SEQ ID NO: 2933279 - RNA, 13 nt, Mycobacterium avium subsp. paratuberculosis
cgaucucgcgcgg

SEQ ID NO: 2933280 - RNA, 13 nt, Mycobacterium avium subsp. paratuberculosis
cgaucucgcgguc

SEQ ID NO: 2933281 - RNA, 21 nt, Mycobacterium avium subsp. paratuberculosis
cgaucucggagaccuuggcgc

SEQ ID NO: 2933282 - RNA, 21 nt, Mycobacterium avium subsp. paratuberculosis
cgaucucggccaccgucagcg

SEQ ID NO: 2933283 - RNA, 13 nt, Mycobacterium avium subsp. paratuberculosis
cgaucucggccag

SEQ ID NO: 2933284 - RNA, 14 nt, Mycobacterium avium subsp. paratuberculosis
cgaucucggccagc

SEQ ID NO: 2933285 - RNA, 18 nt, Mycobacterium avium subsp. paratuberculosis
cgaucucggccagcgggc

SEQ ID NO: 2933286 - RNA, 21 nt, Mycobacterium avium subsp. paratuberculosis
cgaucucggccagcgggcggc

SEQ ID NO: 2933287 - RNA, 14 nt, Mycobacterium avium subsp. paratuberculosis
cgaucucggcgcag

SEQ ID NO: 2933288 - RNA, 13 nt, Mycobacterium avium subsp. paratuberculosis
cgaucucggcgga

SEQ ID NO: 2933289 - RNA, 21 nt, Mycobacterium avium subsp. paratuberculosis
cgaucucggcggacucggcga

SEQ ID NO: 2933290 - RNA, 15 nt, Mycobacterium avium subsp. paratuberculosis
cgaucucggcggccg

SEQ ID NO: 2933291 - RNA, 18 nt, Mycobacterium avium subsp. paratuberculosis
cgaucucggcggccgcgu

SEQ ID NO: 2933292 - RNA, 20 nt, Mycobacterium avium subsp. paratuberculosis
cgaucucggcggccgcgucc

SEQ ID NO: 2933293 - RNA, 15 nt, Mycobacterium avium subsp. paratuberculosis
cgaucucggcggucu

SEQ ID NO: 2933294 - RNA, 22 nt, Mycobacterium avium subsp. paratuberculosis
cgaucucggucaccgagcggcc

SEQ ID NO: 2933295 - RNA, 14 nt, Mycobacterium avium subsp. paratuberculosis
cgaucucggucgcc

SEQ ID NO: 2933296 - RNA, 15 nt, Mycobacterium avium subsp. paratuberculosis
cgaucucggugagcc

SEQ ID NO: 2933297 - RNA, 16 nt, Mycobacterium avium subsp. paratuberculosis
cgaucucggugagccg

SEQ ID NO: 2933298 - RNA, 20 nt, Mycobacterium avium subsp. paratuberculosis
cgaucucggugagccgcugg

SEQ ID NO: 2933299 - RNA, 22 nt, Mycobacterium avium subsp. paratuberculosis
cgaucucgguuuccacgucgcg

SEQ ID NO: 2933300 - RNA, 18 nt, Mycobacterium avium subsp. paratuberculosis
cgaucucguagcccaccu

SEQ ID NO: 2933301 - RNA, 20 nt, Mycobacterium avium subsp. paratuberculosis
cgaucucguagguggccagc

SEQ ID NO: 2933302 - RNA, 18 nt, Mycobacterium avium subsp. paratuberculosis
cgaucucgucccacggcg

SEQ ID NO: 2933303 - RNA, 15 nt, Mycobacterium avium subsp. paratuberculosis
cgaucucgucgcaca

SEQ ID NO: 2933304 - RNA, 13 nt, Mycobacterium avium subsp. paratuberculosis
cgaucucgucgcg

SEQ ID NO: 2933305 - RNA, 14 nt, Mycobacterium avium subsp. paratuberculosis
cgaucucuucgccg

SEQ ID NO: 2933306 - RNA, 20 nt, Mycobacterium avium subsp. paratuberculosis
cgaucucuucgccggacagc

SEQ ID NO: 2933307 - RNA, 15 nt, Mycobacterium avium subsp. paratuberculosis
cgaucugaccgagca

SEQ ID NO: 2933308 - RNA, 17 nt, Mycobacterium avium subsp. paratuberculosis
cgaucugaccgagcagc

SEQ ID NO: 2933309 - RNA, 15 nt, Mycobacterium avium subsp. paratuberculosis
cgaucugcaccagcg

SEQ ID NO: 2933310 - RNA, 17 nt, Mycobacterium avium subsp. paratuberculosis
cgaucugcaccagcgcg

SEQ ID NO: 2933311 - RNA, 18 nt, Mycobacterium avium subsp. paratuberculosis
cgaucugcaccagcgcgg

SEQ ID NO: 2933312 - RNA, 23 nt, Mycobacterium avium subsp. paratuberculosis
cgaucugcaccagcgcggacacc

SEQ ID NO: 2933313 - RNA, 14 nt, Mycobacterium avium subsp. paratuberculosis
cgaucugcagccgg

SEQ ID NO: 2933314 - RNA, 17 nt, Mycobacterium avium subsp. paratuberculosis
cgaucugcagccggcgc

SEQ ID NO: 2933315 - RNA, 19 nt, Mycobacterium avium subsp. paratuberculosis
cgaucugcagccggcgcgg

SEQ ID NO: 2933316 - RNA, 13 nt, Mycobacterium avium subsp. paratuberculosis
cgaucugcaggcc

SEQ ID NO: 2933317 - RNA, 17 nt, Mycobacterium avium subsp. paratuberculosis
cgaucugcaggccccag

SEQ ID NO: 2933318 - RNA, 15 nt, Mycobacterium avium subsp. paratuberculosis
cgaucugcggcacgg

SEQ ID NO: 2933319 - RNA, 16 nt, Mycobacterium avium subsp. paratuberculosis
cgaucugcggcacggu

SEQ ID NO: 2933320 - RNA, 18 nt, Mycobacterium avium subsp. paratuberculosis
cgaucugcggcacggugc

SEQ ID NO: 2933321 - RNA, 15 nt, Mycobacterium avium subsp. paratuberculosis
cgaucugcgucaugg

SEQ ID NO: 2933322 - RNA, 17 nt, Mycobacterium avium subsp. paratuberculosis
cgaucugcucggugucg

SEQ ID NO: 2933323 - RNA, 20 nt, Mycobacterium avium subsp. paratuberculosis
cgaucugcucggugucgauc

SEQ ID NO: 2933324 - RNA, 17 nt, Mycobacterium avium subsp. paratuberculosis
cgaucuggcgcagcguc

SEQ ID NO: 2933325 - RNA, 18 nt, Mycobacterium avium subsp. paratuberculosis
cgaucuggcgcagcguca

SEQ ID NO: 2933326 - RNA, 21 nt, Mycobacterium avium subsp. paratuberculosis
cgaucuggcgcagcgucaacg

SEQ ID NO: 2933327 - RNA, 18 nt, Mycobacterium avium subsp. paratuberculosis
cgaucuggcgcaucagcg

SEQ ID NO: 2933328 - RNA, 16 nt, Mycobacterium avium subsp. paratuberculosis
cgaucuggcggacccg

SEQ ID NO: 2933329 - RNA, 20 nt, Mycobacterium avium subsp. paratuberculosis
cgaucuggcggauggcgccc

SEQ ID NO: 2933330 - RNA, 15 nt, Mycobacterium avium subsp. paratuberculosis
cgaucuggcgggcgg

SEQ ID NO: 2933331 - RNA, 16 nt, Mycobacterium avium subsp. paratuberculosis
cgaucuggcgggcggu

SEQ ID NO: 2933332 - RNA, 22 nt, Mycobacterium avium subsp. paratuberculosis
cgaucuggcgguuggacaggcc

SEQ ID NO: 2933333 - RNA, 15 nt, Mycobacterium avium subsp. paratuberculosis
cgaucugggccagga

SEQ ID NO: 2933334 - RNA, 14 nt, Mycobacterium avium subsp. paratuberculosis
cgaucugguccagc

SEQ ID NO: 2933335 - RNA, 13 nt, Mycobacterium avium subsp. paratuberculosis
cgaucugucgcgc

SEQ ID NO: 2933336 - RNA, 14 nt, Mycobacterium avium subsp. paratuberculosis
cgaucugucgcgcu

SEQ ID NO: 2933337 - RNA, 16 nt, Mycobacterium avium subsp. paratuberculosis
cgaucugucgcgcuca

SEQ ID NO: 2933338 - RNA, 20 nt, Mycobacterium avium subsp. paratuberculosis
cgaucuucgcggcguacugc

SEQ ID NO: 2933339 - RNA, 18 nt, Mycobacterium avium subsp. paratuberculosis
cgaucuugacguggaaau

SEQ ID NO: 2933340 - RNA, 20 nt, Mycobacterium avium subsp. paratuberculosis
cgaucuugcguuccucgacg

SEQ ID NO: 2933341 - RNA, 15 nt, Mycobacterium avium subsp. paratuberculosis
cgaucuugucgaccu

SEQ ID NO: 2933342 - RNA, 20 nt, Mycobacterium avium subsp. paratuberculosis
cgaugauggcgucgacgugc

SEQ ID NO: 2933343 - RNA, 15 nt, Mycobacterium avium subsp. paratuberculosis
cgaugaugguggcgg

SEQ ID NO: 2933344 - RNA, 17 nt, Mycobacterium avium subsp. paratuberculosis
cgaugaugguggcggcc

SEQ ID NO: 2933345 - RNA, 15 nt, Mycobacterium avium subsp. paratuberculosis
cgaugaugucggccg

SEQ ID NO: 2933346 - RNA, 17 nt, Mycobacterium avium subsp. paratuberculosis
cgaugaugucggccggc

SEQ ID NO: 2933347 - RNA, 19 nt, Mycobacterium avium subsp. paratuberculosis
cgaugaugucggccggcag

SEQ ID NO: 2933348 - RNA, 22 nt, Mycobacterium avium subsp. paratuberculosis
cgaugcacggucggccccgcgc

SEQ ID NO: 2933349 - RNA, 17 nt, Mycobacterium avium subsp. paratuberculosis
cgaugcagaucaccacg

SEQ ID NO: 2933350 - RNA, 21 nt, Mycobacterium avium subsp. paratuberculosis
cgaugcagaucaccacggugg

SEQ ID NO: 2933351 - RNA, 12 nt, Mycobacterium avium subsp. paratuberculosis
cgaugcagggcc

SEQ ID NO: 2933352 - RNA, 13 nt, Mycobacterium avium subsp. paratuberculosis
cgaugcagggccg

SEQ ID NO: 2933353 - RNA, 15 nt, Mycobacterium avium subsp. paratuberculosis
cgaugcauucgucca

SEQ ID NO: 2933354 - RNA, 17 nt, Mycobacterium avium subsp. paratuberculosis
cgaugcauucguccauc

SEQ ID NO: 2933355 - RNA, 20 nt, Mycobacterium avium subsp. paratuberculosis
cgaugcauuggugcacgccg

SEQ ID NO: 2933356 - RNA, 15 nt, Mycobacterium avium subsp. paratuberculosis
cgaugccagacgcuc

SEQ ID NO: 2933357 - RNA, 18 nt, Mycobacterium avium subsp. paratuberculosis
cgaugccagacgcucuug

SEQ ID NO: 2933358 - RNA, 21 nt, Mycobacterium avium subsp. paratuberculosis
cgaugccagcgcaccgggccc

SEQ ID NO: 2933359 - RNA, 23 nt, Mycobacterium avium subsp. paratuberculosis
cgaugcccaagccggccaggccc

SEQ ID NO: 2933360 - RNA, 15 nt, Mycobacterium avium subsp. paratuberculosis
cgaugcccagcagcg

SEQ ID NO: 2933361 - RNA, 14 nt, Mycobacterium avium subsp. paratuberculosis
cgaugcccagcccc

SEQ ID NO: 2933362 - RNA, 16 nt, Mycobacterium avium subsp. paratuberculosis
cgaugcccagccccuc

SEQ ID NO: 2933363 - RNA, 16 nt, Mycobacterium avium subsp. paratuberculosis
cgaugcccagcgcgcg

SEQ ID NO: 2933364 - RNA, 18 nt, Mycobacterium avium subsp. paratuberculosis
cgaugcccagcgcgcggu

SEQ ID NO: 2933365 - RNA, 19 nt, Mycobacterium avium subsp. paratuberculosis
cgaugcccagcgcgcggug

SEQ ID NO: 2933366 - RNA, 21 nt, Mycobacterium avium subsp. paratuberculosis
cgaugcccgacaccgccccgc

SEQ ID NO: 2933367 - RNA, 16 nt, Mycobacterium avium subsp. paratuberculosis
cgaugcccgccccgga

SEQ ID NO: 2933368 - RNA, 13 nt, Mycobacterium avium subsp. paratuberculosis
cgaugcccgcgcc

SEQ ID NO: 2933369 - RNA, 17 nt, Mycobacterium avium subsp. paratuberculosis
cgaugcccgcgccgacc

SEQ ID NO: 2933370 - RNA, 23 nt, Mycobacterium avium subsp. paratuberculosis
cgaugcccgcgccgaccagcgcg

SEQ ID NO: 2933371 - RNA, 16 nt, Mycobacterium avium subsp. paratuberculosis
cgaugcccgcguccug

SEQ ID NO: 2933372 - RNA, 19 nt, Mycobacterium avium subsp. paratuberculosis
cgaugcccggggugcuggc

SEQ ID NO: 2933373 - RNA, 14 nt, Mycobacterium avium subsp. paratuberculosis
cgaugcccgucacg

SEQ ID NO: 2933374 - RNA, 15 nt, Mycobacterium avium subsp. paratuberculosis
cgaugcccgucacgg

SEQ ID NO: 2933375 - RNA, 23 nt, Mycobacterium avium subsp. paratuberculosis
cgaugcccgucacggccguccag

SEQ ID NO: 2933376 - RNA, 14 nt, Mycobacterium avium subsp. paratuberculosis
cgaugcccgugauc

SEQ ID NO: 2933377 - RNA, 20 nt, Mycobacterium avium subsp. paratuberculosis
cgaugcccgugaucgccacg

SEQ ID NO: 2933378 - RNA, 22 nt, Mycobacterium avium subsp. paratuberculosis
cgaugcccgugaucgccacggc

SEQ ID NO: 2933379 - RNA, 22 nt, Mycobacterium avium subsp. paratuberculosis
cgaugccgaacgucaccaacau

SEQ ID NO: 2933380 - RNA, 19 nt, Mycobacterium avium subsp. paratuberculosis
cgaugccgaacuccgccga

SEQ ID NO: 2933381 - RNA, 21 nt, Mycobacterium avium subsp. paratuberculosis
cgaugccgaacuccgccgaac

SEQ ID NO: 2933382 - RNA, 20 nt, Mycobacterium avium subsp. paratuberculosis
cgaugccgacaccccacacc

SEQ ID NO: 2933383 - RNA, 17 nt, Mycobacterium avium subsp. paratuberculosis
cgaugccgaccaacacc

SEQ ID NO: 2933384 - RNA, 22 nt, Mycobacterium avium subsp. paratuberculosis
cgaugccgaccaacacccccgc

SEQ ID NO: 2933385 - RNA, 17 nt, Mycobacterium avium subsp. paratuberculosis
cgaugccgaccgacagc

SEQ ID NO: 2933386 - RNA, 18 nt, Mycobacterium avium subsp. paratuberculosis
cgaugccgaccgacagcc

SEQ ID NO: 2933387 - RNA, 22 nt, Mycobacterium avium subsp. paratuberculosis
cgaugccgaccgacagccgcac

SEQ ID NO: 2933388 - RNA, 15 nt, Mycobacterium avium subsp. paratuberculosis
cgaugccgagccggc

SEQ ID NO: 2933389 - RNA, 20 nt, Mycobacterium avium subsp. paratuberculosis
cgaugccgaggauuucgcga

SEQ ID NO: 2933390 - RNA, 22 nt, Mycobacterium avium subsp. paratuberculosis
cgaugccgaggauuucgcgauc

SEQ ID NO: 2933391 - RNA, 20 nt, Mycobacterium avium subsp. paratuberculosis
cgaugccgaucacggugauc

SEQ ID NO: 2933392 - RNA, 21 nt, Mycobacterium avium subsp. paratuberculosis
cgaugccgaucggggcgcagc

SEQ ID NO: 2933393 - RNA, 14 nt, Mycobacterium avium subsp. paratuberculosis
cgaugccgccgacg

SEQ ID NO: 2933394 - RNA, 15 nt, Mycobacterium avium subsp. paratuberculosis
cgaugccgccgaggg

SEQ ID NO: 2933395 - RNA, 14 nt, Mycobacterium avium subsp. paratuberculosis
cgaugccgcgcagg

SEQ ID NO: 2933396 - RNA, 12 nt, Mycobacterium avium subsp. paratuberculosis
cgaugccgcgcu

SEQ ID NO: 2933397 - RNA, 13 nt, Mycobacterium avium subsp. paratuberculosis
cgaugccggaaaa

SEQ ID NO: 2933398 - RNA, 21 nt, Mycobacterium avium subsp. paratuberculosis
cgaugccggaaaaguucggcg

SEQ ID NO: 2933399 - RNA, 20 nt, Mycobacterium avium subsp. paratuberculosis
cgaugccggccagcggccag

SEQ ID NO: 2933400 - RNA, 21 nt, Mycobacterium avium subsp. paratuberculosis
cgaugccggccaggcacagca

SEQ ID NO: 2933401 - RNA, 12 nt, Mycobacterium avium subsp. paratuberculosis
cgaugccggccu

SEQ ID NO: 2933402 - RNA, 20 nt, Mycobacterium avium subsp. paratuberculosis
cgaugccggccuggcccagc

SEQ ID NO: 2933403 - RNA, 22 nt, Mycobacterium avium subsp. paratuberculosis
cgaugccggccuggcccagccg

SEQ ID NO: 2933404 - RNA, 23 nt, Mycobacterium avium subsp. paratuberculosis
cgaugccggccuggcccagccgc

SEQ ID NO: 2933405 - RNA, 12 nt, Mycobacterium avium subsp. paratuberculosis
cgaugccggcga

SEQ ID NO: 2933406 - RNA, 23 nt, Mycobacterium avium subsp. paratuberculosis
cgaugccggcgauccgcgcggcg

SEQ ID NO: 2933407 - RNA, 18 nt, Mycobacterium avium subsp. paratuberculosis
cgaugccggcgucgucgu

SEQ ID NO: 2933408 - RNA, 11 nt, Mycobacterium avium subsp. paratuberculosis
cgaugccgggc

SEQ ID NO: 2933409 - RNA, 14 nt, Mycobacterium avium subsp. paratuberculosis
cgaugccgguggcc

SEQ ID NO: 2933410 - RNA, 18 nt, Mycobacterium avium subsp. paratuberculosis
cgaugccgguggccuugc

SEQ ID NO: 2933411 - RNA, 17 nt, Mycobacterium avium subsp. paratuberculosis
cgaugccguagaccagc

SEQ ID NO: 2933412 - RNA, 16 nt, Mycobacterium avium subsp. paratuberculosis
cgaugccgugcugggc

SEQ ID NO: 2933413 - RNA, 22 nt, Mycobacterium avium subsp. paratuberculosis
cgaugccgugcugggcggacgg

SEQ ID NO: 2933414 - RNA, 14 nt, Mycobacterium avium subsp. paratuberculosis
cgaugccguggugc

SEQ ID NO: 2933415 - RNA, 17 nt, Mycobacterium avium subsp. paratuberculosis
cgaugccguucgcgccg

SEQ ID NO: 2933416 - RNA, 18 nt, Mycobacterium avium subsp. paratuberculosis
cgaugcgacgcaccucgg

SEQ ID NO: 2933417 - RNA, 20 nt, Mycobacterium avium subsp. paratuberculosis
cgaugcgacgcaccucggcc

SEQ ID NO: 2933418 - RNA, 22 nt, Mycobacterium avium subsp. paratuberculosis
cgaugcgacgcaccucggccgg

SEQ ID NO: 2933419 - RNA, 17 nt, Mycobacterium avium subsp. paratuberculosis
cgaugcgcaccaucacc

SEQ ID NO: 2933420 - RNA, 19 nt, Mycobacterium avium subsp. paratuberculosis
cgaugcgcacccccggggc

SEQ ID NO: 2933421 - RNA, 18 nt, Mycobacterium avium subsp. paratuberculosis
cgaugcgcaccgugccgc

SEQ ID NO: 2933422 - RNA, 23 nt, Mycobacterium avium subsp. paratuberculosis
cgaugcgcaccgugccgcccguc

SEQ ID NO: 2933423 - RNA, 19 nt, Mycobacterium avium subsp. paratuberculosis
cgaugcgcacgucggccgc

SEQ ID NO: 2933424 - RNA, 12 nt, Mycobacterium avium subsp. paratuberculosis
cgaugcgcccgc

SEQ ID NO: 2933425 - RNA, 14 nt, Mycobacterium avium subsp. paratuberculosis
cgaugcgcccgcgc

SEQ ID NO: 2933426 - RNA, 16 nt, Mycobacterium avium subsp. paratuberculosis
cgauggcccggaccgc

SEQ ID NO: 2933427 - RNA, 17 nt, Mycobacterium avium subsp. paratuberculosis
cgauggcccggaccgcc

SEQ ID NO: 2933428 - RNA, 19 nt, Mycobacterium avium subsp. paratuberculosis
cgauggcccggaccgccgc

SEQ ID NO: 2933429 - RNA, 22 nt, Mycobacterium avium subsp. paratuberculosis
cgauggcccggaccgccgcggc

SEQ ID NO: 2933430 - RNA, 16 nt, Mycobacterium avium subsp. paratuberculosis
cgauggcccgggccac

SEQ ID NO: 2933431 - RNA, 14 nt, Mycobacterium avium subsp. paratuberculosis
cgauggccgggaag

SEQ ID NO: 2933432 - RNA, 14 nt, Mycobacterium avium subsp. paratuberculosis
cgauggccuccgac

SEQ ID NO: 2933433 - RNA, 16 nt, Mycobacterium avium subsp. paratuberculosis
cgauggccuccgaccc

SEQ ID NO: 2933434 - RNA, 21 nt, Mycobacterium avium subsp. paratuberculosis
cgauggccuccgacccgucca

SEQ ID NO: 2933435 - RNA, 15 nt, Mycobacterium avium subsp. paratuberculosis
cgauggccucgucga

SEQ ID NO: 2933436 - RNA, 16 nt, Mycobacterium avium subsp. paratuberculosis
cgauggccucgucgau

SEQ ID NO: 2933437 - RNA, 17 nt, Mycobacterium avium subsp. paratuberculosis
cgauggccucgucgaug

SEQ ID NO: 2933438 - RNA, 20 nt, Mycobacterium avium subsp. paratuberculosis
cgauggccucgucgaugucg

SEQ ID NO: 2933439 - RNA, 15 nt, Mycobacterium avium subsp. paratuberculosis
cgauggccucgucgc

SEQ ID NO: 2933440 - RNA, 23 nt, Mycobacterium avium subsp. paratuberculosis
cgauggccugguggcccaggcag

SEQ ID NO: 2933441 - RNA, 11 nt, Mycobacterium avium subsp. paratuberculosis
cgauggcgacc

SEQ ID NO: 2933442 - RNA, 13 nt, Mycobacterium avium subsp. paratuberculosis
cgauggcgaccgc

SEQ ID NO: 2933443 - RNA, 15 nt, Mycobacterium avium subsp. paratuberculosis
cgauggcgaccgcgc

SEQ ID NO: 2933444 - RNA, 18 nt, Mycobacterium avium subsp. paratuberculosis
cgauggcgacgcacgaaa

SEQ ID NO: 2933445 - RNA, 16 nt, Mycobacterium avium subsp. paratuberculosis
cgauggcgacggggug

SEQ ID NO: 2933446 - RNA, 14 nt, Mycobacterium avium subsp. paratuberculosis
cgauggcgcccagc

SEQ ID NO: 2933447 - RNA, 22 nt, Mycobacterium avium subsp. paratuberculosis
cgauggcgcccagcgucucggc

SEQ ID NO: 2933448 - RNA, 14 nt, Mycobacterium avium subsp. paratuberculosis
cgauggcgccgauc

SEQ ID NO: 2933449 - RNA, 22 nt, Mycobacterium avium subsp. paratuberculosis
cgauggcgccgaucgcgcgcag

SEQ ID NO: 2933450 - RNA, 23 nt, Mycobacterium avium subsp. paratuberculosis
cgauggcgcggccggccgacacc

SEQ ID NO: 2933451 - RNA, 13 nt, Mycobacterium avium subsp. paratuberculosis
cgauggcgcggcg

SEQ ID NO: 2933452 - RNA, 13 nt, Mycobacterium avium subsp. paratuberculosis
cgauggcgcuggc

SEQ ID NO: 2933453 - RNA, 18 nt, Mycobacterium avium subsp. paratuberculosis
cgauggcgcuggccgcga

SEQ ID NO: 2933454 - RNA, 12 nt, Mycobacterium avium subsp. paratuberculosis
cgauggcggcgg

SEQ ID NO: 2933455 - RNA, 17 nt, Mycobacterium avium subsp. paratuberculosis
cgauggcggcggcccgc

SEQ ID NO: 2933456 - RNA, 16 nt, Mycobacterium avium subsp. paratuberculosis
cgauggcggcggcugc

SEQ ID NO: 2933457 - RNA, 12 nt, Mycobacterium avium subsp. paratuberculosis
cgauggcggcgu

SEQ ID NO: 2933458 - RNA, 14 nt, Mycobacterium avium subsp. paratuberculosis
cgauggcggcgucg

SEQ ID NO: 2933459 - RNA, 15 nt, Mycobacterium avium subsp. paratuberculosis
cgauggcggcgugca

SEQ ID NO: 2933460 - RNA, 16 nt, Mycobacterium avium subsp. paratuberculosis
cgauggcgggcgcgcc

SEQ ID NO: 2933461 - RNA, 18 nt, Mycobacterium avium subsp. paratuberculosis
cgauggcgggcgcgccgg

SEQ ID NO: 2933462 - RNA, 19 nt, Mycobacterium avium subsp. paratuberculosis
cgauggcgggcgcgccggc

SEQ ID NO: 2933463 - RNA, 20 nt, Mycobacterium avium subsp. paratuberculosis
cgauggcgggcgcgccggcg

SEQ ID NO: 2933464 - RNA, 23 nt, Mycobacterium avium subsp. paratuberculosis
cgauggcggguuggugucgaaca

SEQ ID NO: 2933465 - RNA, 16 nt, Mycobacterium avium subsp. paratuberculosis
cgauggcgguccacca

SEQ ID NO: 2933466 - RNA, 17 nt, Mycobacterium avium subsp. paratuberculosis
cgauggcgguccaccac

SEQ ID NO: 2933467 - RNA, 19 nt, Mycobacterium avium subsp. paratuberculosis
cgauggcgguccaccacca

SEQ ID NO: 2933468 - RNA, 17 nt, Mycobacterium avium subsp. paratuberculosis
cgauggcguccaccgac

SEQ ID NO: 2933469 - RNA, 18 nt, Mycobacterium avium subsp. paratuberculosis
cgauggcguccaccgaca

SEQ ID NO: 2933470 - RNA, 23 nt, Mycobacterium avium subsp. paratuberculosis
cgauggcguccaccgacaucgaa

SEQ ID NO: 2933471 - RNA, 13 nt, Mycobacterium avium subsp. paratuberculosis
cgauggcgucggc

SEQ ID NO: 2933472 - RNA, 15 nt, Mycobacterium avium subsp. paratuberculosis
cgauggcgucggcca

SEQ ID NO: 2933473 - RNA, 16 nt, Mycobacterium avium subsp. paratuberculosis
cgauggcgucggccag

SEQ ID NO: 2933474 - RNA, 19 nt, Mycobacterium avium subsp. paratuberculosis
cgauggcgucggccagcgg

SEQ ID NO: 2933475 - RNA, 20 nt, Mycobacterium avium subsp. paratuberculosis
cgauggcgucggccagcggc

SEQ ID NO: 2933476 - RNA, 22 nt, Mycobacterium avium subsp. paratuberculosis
cgauggcgucggccagcggcag

SEQ ID NO: 2933477 - RNA, 13 nt, Mycobacterium avium subsp. paratuberculosis
cgauggcgugccg

SEQ ID NO: 2933478 - RNA, 14 nt, Mycobacterium avium subsp. paratuberculosis
cgauggcgugccgg

SEQ ID NO: 2933479 - RNA, 17 nt, Mycobacterium avium subsp. paratuberculosis
cgauggcgugccggcgc

SEQ ID NO: 2933480 - RNA, 20 nt, Mycobacterium avium subsp. paratuberculosis
cgauggcgugccggcgcugc

SEQ ID NO: 2933481 - RNA, 20 nt, Mycobacterium avium subsp. paratuberculosis
cgauggcguucaucguccac

SEQ ID NO: 2933482 - RNA, 15 nt, Mycobacterium avium subsp. paratuberculosis
cgaugggccgcccgc

SEQ ID NO: 2933483 - RNA, 17 nt, Mycobacterium avium subsp. paratuberculosis
cgaugggcgcgaucagg

SEQ ID NO: 2933484 - RNA, 16 nt, Mycobacterium avium subsp. paratuberculosis
cgauggggacgucgac

SEQ ID NO: 2933485 - RNA, 22 nt, Mycobacterium avium subsp. paratuberculosis
cgauggggacgucgacgugggc

SEQ ID NO: 2933486 - RNA, 18 nt, Mycobacterium avium subsp. paratuberculosis
cgauggggauggugcgcc

SEQ ID NO: 2933487 - RNA, 19 nt, Mycobacterium avium subsp. paratuberculosis
cgauggggauggugcgccg

SEQ ID NO: 2933488 - RNA, 18 nt, Mycobacterium avium subsp. paratuberculosis
cgauggguguggcgucga

SEQ ID NO: 2933489 - RNA, 20 nt, Mycobacterium avium subsp. paratuberculosis
cgauggguguggcgucgaug

SEQ ID NO: 2933490 - RNA, 20 nt, Mycobacterium avium subsp. paratuberculosis
cgauggguucuucgaccacg

SEQ ID NO: 2933491 - RNA, 22 nt, Mycobacterium avium subsp. paratuberculosis
cgauggguucuucgaccacgcg

SEQ ID NO: 2933492 - RNA, 14 nt, Mycobacterium avium subsp. paratuberculosis
cgaugguacgcgag

SEQ ID NO: 2933493 - RNA, 14 nt, Mycobacterium avium subsp. paratuberculosis
cgauggucagcugc

SEQ ID NO: 2933494 - RNA, 17 nt, Mycobacterium avium subsp. paratuberculosis
cgauggucagcugccgc

SEQ ID NO: 2933495 - RNA, 17 nt, Mycobacterium avium subsp. paratuberculosis
cgauggucgccuuguug

SEQ ID NO: 2933496 - RNA, 21 nt, Mycobacterium avium subsp. paratuberculosis
cgauggucgucggguuggcca

SEQ ID NO: 2933497 - RNA, 17 nt, Mycobacterium avium subsp. paratuberculosis
cgauggucugcccgccg

SEQ ID NO: 2933498 - RNA, 15 nt, Mycobacterium avium subsp. paratuberculosis
cgauggugaccucgg

SEQ ID NO: 2933499 - RNA, 18 nt, Mycobacterium avium subsp. paratuberculosis
cgauggugaccucggucg

SEQ ID NO: 2933500 - RNA, 18 nt, Mycobacterium avium subsp. paratuberculosis
cgauggugacggugccgc

SEQ ID NO: 2933501 - RNA, 22 nt, Mycobacterium avium subsp. paratuberculosis
cgauggugacggugccgccgug

SEQ ID NO: 2933502 - RNA, 20 nt, Mycobacterium avium subsp. paratuberculosis
cgauggugccgaagcgccgc

SEQ ID NO: 2933503 - RNA, 17 nt, Mycobacterium avium subsp. paratuberculosis
cgauggugccgccggug

SEQ ID NO: 2933504 - RNA, 18 nt, Mycobacterium avium subsp. paratuberculosis
cgauggugccgccgguga

SEQ ID NO: 2933505 - RNA, 15 nt, Mycobacterium avium subsp. paratuberculosis
cgauggugccggcca

SEQ ID NO: 2933506 - RNA, 15 nt, Mycobacterium avium subsp. paratuberculosis
cgauggugccgucgg

SEQ ID NO: 2933507 - RNA, 19 nt, Mycobacterium avium subsp. paratuberculosis
cgauggugcugcccggcgc

SEQ ID NO: 2933508 - RNA, 20 nt, Mycobacterium avium subsp. paratuberculosis
cgauggugcugcccggcgcg

SEQ ID NO: 2933509 - RNA, 23 nt, Mycobacterium avium subsp. paratuberculosis
cgaugguggcgcugccgagcacc

SEQ ID NO: 2933510 - RNA, 17 nt, Mycobacterium avium subsp. paratuberculosis
cgauggugggcagccgg

SEQ ID NO: 2933511 - RNA, 12 nt, Mycobacterium avium subsp. paratuberculosis
cgauucgcgauc

SEQ ID NO: 2933512 - RNA, 19 nt, Mycobacterium avium subsp. paratuberculosis
cgauucggcgccgcgaccc

SEQ ID NO: 2933513 - RNA, 19 nt, Mycobacterium avium subsp. paratuberculosis
cgauucgguaccagggcag

SEQ ID NO: 2933514 - RNA, 22 nt, Mycobacterium avium subsp. paratuberculosis
cgauucgguaccagggcagcgc

SEQ ID NO: 2933515 - RNA, 16 nt, Mycobacterium avium subsp. paratuberculosis
cgauucuugaccaccu

SEQ ID NO: 2933516 - RNA, 19 nt, Mycobacterium avium subsp. paratuberculosis
cgauucuugaccaccuugg

SEQ ID NO: 2933517 - RNA, 12 nt, Mycobacterium avium subsp. paratuberculosis
cgauugcccgac

SEQ ID NO: 2933518 - RNA, 18 nt, Mycobacterium avium subsp. paratuberculosis
cgauugcccgacuccuca

SEQ ID NO: 2933519 - RNA, 19 nt, Mycobacterium avium subsp. paratuberculosis
cgauugcccgacuccucac

SEQ ID NO: 2933520 - RNA, 14 nt, Mycobacterium avium subsp. paratuberculosis
cgauugccgcggcc

SEQ ID NO: 2933521 - RNA, 17 nt, Mycobacterium avium subsp. paratuberculosis
cgauugccggacgagga

SEQ ID NO: 2933522 - RNA, 17 nt, Mycobacterium avium subsp. paratuberculosis
cgauugcggccgccggc

SEQ ID NO: 2933523 - RNA, 18 nt, Mycobacterium avium subsp. paratuberculosis
cgauugcggccgccggcc

SEQ ID NO: 2933524 - RNA, 21 nt, Mycobacterium avium subsp. paratuberculosis
cgauugcggccgccggccagc

SEQ ID NO: 2933525 - RNA, 14 nt, Mycobacterium avium subsp. paratuberculosis
cgauugcguugauc

SEQ ID NO: 2933526 - RNA, 23 nt, Mycobacterium avium subsp. paratuberculosis
cgauuggugcgcaauggcgaaca

SEQ ID NO: 2933527 - RNA, 19 nt, Mycobacterium avium subsp. paratuberculosis
cgauugguggcccggucgu

SEQ ID NO: 2933528 - RNA, 18 nt, Mycobacterium avium subsp. paratuberculosis
cgauugucggggccgcac

SEQ ID NO: 2933529 - RNA, 23 nt, Mycobacterium avium subsp. paratuberculosis
cgauuucauauugguucgcucgu

SEQ ID NO: 2933530 - RNA, 16 nt, Mycobacterium avium subsp. paratuberculosis
cgauuucccgacuccu

SEQ ID NO: 2933531 - RNA, 18 nt, Mycobacterium avium subsp. paratuberculosis
cgauuucccgacuccuca

SEQ ID NO: 2933532 - RNA, 19 nt, Mycobacterium avium subsp. paratuberculosis
cgauuuccgguuccucggc

SEQ ID NO: 2933533 - RNA, 19 nt, Mycobacterium avium subsp. paratuberculosis
cgauuucgccugcagccgc

SEQ ID NO: 2933534 - RNA, 20 nt, Mycobacterium avium subsp. paratuberculosis
cgauuucgccugcagccgcc

SEQ ID NO: 2933535 - RNA, 14 nt, Mycobacterium avium subsp. paratuberculosis
cgauuucgcggccg

SEQ ID NO: 2933536 - RNA, 14 nt, Mycobacterium avium subsp. paratuberculosis
cgauuucggccagc

SEQ ID NO: 2933537 - RNA, 16 nt, Mycobacterium avium subsp. paratuberculosis
cgauuucggccagccg

SEQ ID NO: 2933538 - RNA, 17 nt, Mycobacterium avium subsp. paratuberculosis
cgauuucgucggcggug

SEQ ID NO: 2933539 - RNA, 19 nt, Mycobacterium avium subsp. paratuberculosis
cgcaaacgaaucgagccgc

SEQ ID NO: 2933540 - RNA, 20 nt, Mycobacterium avium subsp. paratuberculosis
cgcaaagacauucggggcca

SEQ ID NO: 2933541 - RNA, 19 nt, Mycobacterium avium subsp. paratuberculosis
cgcaaaucagccgagccgg

SEQ ID NO: 2933542 - RNA, 13 nt, Mycobacterium avium subsp. paratuberculosis
cgcaacaccagca

SEQ ID NO: 2933543 - RNA, 13 nt, Mycobacterium avium subsp. paratuberculosis
cgcaacaccgaaa

SEQ ID NO: 2933544 - RNA, 18 nt, Mycobacterium avium subsp. paratuberculosis
cgcaacacggccucgauc

SEQ ID NO: 2933545 - RNA, 11 nt, Mycobacterium avium subsp. paratuberculosis
cgcaacagcac

SEQ ID NO: 2933546 - RNA, 13 nt, Mycobacterium avium subsp. paratuberculosis
cgcaacagcaccu

SEQ ID NO: 2933547 - RNA, 13 nt, Mycobacterium avium subsp. paratuberculosis
cgcaacagccggc

SEQ ID NO: 2933548 - RNA, 17 nt, Mycobacterium avium subsp. paratuberculosis
cgcaacagccggcccga

SEQ ID NO: 2933549 - RNA, 20 nt, Mycobacterium avium subsp. paratuberculosis
cgcaacagcgucucgacggc

SEQ ID NO: 2933550 - RNA, 19 nt, Mycobacterium avium subsp. paratuberculosis
cgcaacagggccaccgcgu

SEQ ID NO: 2933551 - RNA, 21 nt, Mycobacterium avium subsp. paratuberculosis
cgcaaccaaaaagcuagcggg

SEQ ID NO: 2933552 - RNA, 15 nt, Mycobacterium avium subsp. paratuberculosis
cgcaaccaacucgcg

SEQ ID NO: 2933553 - RNA, 18 nt, Mycobacterium avium subsp. paratuberculosis
cgcaaccaacucgcgaug

SEQ ID NO: 2933554 - RNA, 20 nt, Mycobacterium avium subsp. paratuberculosis
cgcaaccagugcacgcucgg

SEQ ID NO: 2933555 - RNA, 12 nt, Mycobacterium avium subsp. paratuberculosis
cgcaaccgccgg

SEQ ID NO: 2933556 - RNA, 13 nt, Mycobacterium avium subsp. paratuberculosis
cgcaaccgccggc

SEQ ID NO: 2933557 - RNA, 17 nt, Mycobacterium avium subsp. paratuberculosis
cgcaaccgcggcggcgg

SEQ ID NO: 2933558 - RNA, 13 nt, Mycobacterium avium subsp. paratuberculosis
cgcaaccggucca

SEQ ID NO: 2933559 - RNA, 22 nt, Mycobacterium avium subsp. paratuberculosis
cgcaaccgguccaguccggccg

SEQ ID NO: 2933560 - RNA, 16 nt, Mycobacterium avium subsp. paratuberculosis
cgcaaccgucaguucg

SEQ ID NO: 2933561 - RNA, 19 nt, Mycobacterium avium subsp. paratuberculosis
cgcaaccucuucgggggug

SEQ ID NO: 2933562 - RNA, 19 nt, Mycobacterium avium subsp. paratuberculosis
cgcaaccuucuuggccgga

SEQ ID NO: 2933563 - RNA, 12 nt, Mycobacterium avium subsp. paratuberculosis
cgcaacgagcug

SEQ ID NO: 2933564 - RNA, 21 nt, Mycobacterium avium subsp. paratuberculosis
cgcaacgauucacccagcgag

SEQ ID NO: 2933565 - RNA, 14 nt, Mycobacterium avium subsp. paratuberculosis
cgcaacgccggcgu

SEQ ID NO: 2933566 - RNA, 15 nt, Mycobacterium avium subsp. paratuberculosis
cgcaacgccggcgug

SEQ ID NO: 2933567 - RNA, 18 nt, Mycobacterium avium subsp. paratuberculosis
cgcaacgcgcgcgacggc

SEQ ID NO: 2933568 - RNA, 13 nt, Mycobacterium avium subsp. paratuberculosis
cgcaacgcggcgg

SEQ ID NO: 2933569 - RNA, 15 nt, Mycobacterium avium subsp. paratuberculosis
cgcaacgcggcggug

SEQ ID NO: 2933570 - RNA, 16 nt, Mycobacterium avium subsp. paratuberculosis
cgcaacgcggcgguga

SEQ ID NO: 2933571 - RNA, 16 nt, Mycobacterium avium subsp. paratuberculosis
cgcaacgcugaccgca

SEQ ID NO: 2933572 - RNA, 19 nt, Mycobacterium avium subsp. paratuberculosis
cgcaacgcuuucgggucga

SEQ ID NO: 2933573 - RNA, 22 nt, Mycobacterium avium subsp. paratuberculosis
cgcaacggauuggucagagccc

SEQ ID NO: 2933574 - RNA, 13 nt, Mycobacterium avium subsp. paratuberculosis
cgcaacggcgcaa

SEQ ID NO: 2933575 - RNA, 12 nt, Mycobacterium avium subsp. paratuberculosis
cgcaacggcggu

SEQ ID NO: 2933576 - RNA, 13 nt, Mycobacterium avium subsp. paratuberculosis
cgcaacggcgguc

SEQ ID NO: 2933577 - RNA, 22 nt, Mycobacterium avium subsp. paratuberculosis
cgcaacggcggucgugcggcug

SEQ ID NO: 2933578 - RNA, 14 nt, Mycobacterium avium subsp. paratuberculosis
cgcaacggcgucga

SEQ ID NO: 2933579 - RNA, 23 nt, Mycobacterium avium subsp. paratuberculosis
cgcaacggcgucgacacccgggc

SEQ ID NO: 2933580 - RNA, 14 nt, Mycobacterium avium subsp. paratuberculosis
cgcaacgggccgca

SEQ ID NO: 2933581 - RNA, 19 nt, Mycobacterium avium subsp. paratuberculosis
cgcaacgggccgcagccgc

SEQ ID NO: 2933582 - RNA, 22 nt, Mycobacterium avium subsp. paratuberculosis
cgcaacgggccgcagccgcgcg

SEQ ID NO: 2933583 - RNA, 22 nt, Mycobacterium avium subsp. paratuberculosis
cgcaacgugcgccggccuaccu

SEQ ID NO: 2933584 - RNA, 21 nt, Mycobacterium avium subsp. paratuberculosis
cgcaacguguacucggcgucg

SEQ ID NO: 2933585 - RNA, 21 nt, Mycobacterium avium subsp. paratuberculosis
cgcaacuggguggucacaccg

SEQ ID NO: 2933586 - RNA, 20 nt, Mycobacterium avium subsp. paratuberculosis
cgcaacuguucgcggcuggc

SEQ ID NO: 2933587 - RNA, 22 nt, Mycobacterium avium subsp. paratuberculosis
cgcaacuguucgcggcuggccg

SEQ ID NO: 2933588 - RNA, 23 nt, Mycobacterium avium subsp. paratuberculosis
cgcaacuguucgcggcuggccgc

SEQ ID NO: 2933589 - RNA, 14 nt, Mycobacterium avium subsp. paratuberculosis
cgcaagaagggcga

SEQ ID NO: 2933590 - RNA, 15 nt, Mycobacterium avium subsp. paratuberculosis
cgcaagaagucggug

SEQ ID NO: 2933591 - RNA, 17 nt, Mycobacterium avium subsp. paratuberculosis
cgcaagaagucgguguu

SEQ ID NO: 2933592 - RNA, 18 nt, Mycobacterium avium subsp. paratuberculosis
cgcaagcaccggcuggcc

SEQ ID NO: 2933593 - RNA, 15 nt, Mycobacterium avium subsp. paratuberculosis
cgcaagcaccucgcg

SEQ ID NO: 2933594 - RNA, 20 nt, Mycobacterium avium subsp. paratuberculosis
cgcaagcugauucgggauca

SEQ ID NO: 2933595 - RNA, 14 nt, Mycobacterium avium subsp. paratuberculosis
cgcaaggccgccag

SEQ ID NO: 2933596 - RNA, 16 nt, Mycobacterium avium subsp. paratuberculosis
cgcaccaccucggcga

SEQ ID NO: 2933597 - RNA, 19 nt, Mycobacterium avium subsp. paratuberculosis
cgcaccaccucggcgaucu

SEQ ID NO: 2933598 - RNA, 22 nt, Mycobacterium avium subsp. paratuberculosis
cgcaccaccucggcgaucugcu

SEQ ID NO: 2933599 - RNA, 19 nt, Mycobacterium avium subsp. paratuberculosis
cgcaccaccucuucgugca

SEQ ID NO: 2933600 - RNA, 18 nt, Mycobacterium avium subsp. paratuberculosis
cgcaccacgagcagccga

SEQ ID NO: 2933601 - RNA, 12 nt, Mycobacterium avium subsp. paratuberculosis
cgcaccacgccc

SEQ ID NO: 2933602 - RNA, 19 nt, Mycobacterium avium subsp. paratuberculosis
cgcaccacgguggcgccgc

SEQ ID NO: 2933603 - RNA, 23 nt, Mycobacterium avium subsp. paratuberculosis
cgcaccacgguggcgccgcgcag

SEQ ID NO: 2933604 - RNA, 13 nt, Mycobacterium avium subsp. paratuberculosis
cgcaccacgucgg

SEQ ID NO: 2933605 - RNA, 15 nt, Mycobacterium avium subsp. paratuberculosis
cgcaccacgucgggu

SEQ ID NO: 2933606 - RNA, 22 nt, Mycobacterium avium subsp. paratuberculosis
cgcaccacgucggguucgccgg

SEQ ID NO: 2933607 - RNA, 17 nt, Mycobacterium avium subsp. paratuberculosis
cgcaccacgugcgcgaa

SEQ ID NO: 2933608 - RNA, 16 nt, Mycobacterium avium subsp. paratuberculosis
cgcaccagaucgucgg

SEQ ID NO: 2933609 - RNA, 18 nt, Mycobacterium avium subsp. paratuberculosis
cgcaccagaucgucgggc

SEQ ID NO: 2933610 - RNA, 20 nt, Mycobacterium avium subsp. paratuberculosis
cgcaccagauucaccagcgc

SEQ ID NO: 2933611 - RNA, 19 nt, Mycobacterium avium subsp. paratuberculosis
cgcaccagcaccccgccgc

SEQ ID NO: 2933612 - RNA, 12 nt, Mycobacterium avium subsp. paratuberculosis
cgcaccagcucg

SEQ ID NO: 2933613 - RNA, 13 nt, Mycobacterium avium subsp. paratuberculosis
cgcaccagcucga

SEQ ID NO: 2933614 - RNA, 13 nt, Mycobacterium avium subsp. paratuberculosis
cgcaccagcucgg

SEQ ID NO: 2933615 - RNA, 15 nt, Mycobacterium avium subsp. paratuberculosis
cgcaccagcucggcg

SEQ ID NO: 2933616 - RNA, 16 nt, Mycobacterium avium subsp. paratuberculosis
cgcaccagcucggcgc

SEQ ID NO: 2933617 - RNA, 16 nt, Mycobacterium avium subsp. paratuberculosis
cgcaccaggccgacgc

SEQ ID NO: 2933618 - RNA, 15 nt, Mycobacterium avium subsp. paratuberculosis
cgcaccaggcgccac

SEQ ID NO: 2933619 - RNA, 16 nt, Mycobacterium avium subsp. paratuberculosis
cgcaccaggcgccaca

SEQ ID NO: 2933620 - RNA, 14 nt, Mycobacterium avium subsp. paratuberculosis
cgcaccagggccgc

SEQ ID NO: 2933621 - RNA, 15 nt, Mycobacterium avium subsp. paratuberculosis
cgcaccagggccgcg

SEQ ID NO: 2933622 - RNA, 17 nt, Mycobacterium avium subsp. paratuberculosis
cgcaccagggccgcgag

SEQ ID NO: 2933623 - RNA, 15 nt, Mycobacterium avium subsp. paratuberculosis
cgcaccagggugucg

SEQ ID NO: 2933624 - RNA, 11 nt, Mycobacterium avium subsp. paratuberculosis
cgcaccaucac

SEQ ID NO: 2933625 - RNA, 19 nt, Mycobacterium avium subsp. paratuberculosis
cgcaccauccgcgacgcca

SEQ ID NO: 2933626 - RNA, 21 nt, Mycobacterium avium subsp. paratuberculosis
cgcaccauccgcgacgccagc

SEQ ID NO: 2933627 - RNA, 16 nt, Mycobacterium avium subsp. paratuberculosis
cgcaccaucgcgaugg

SEQ ID NO: 2933628 - RNA, 17 nt, Mycobacterium avium subsp. paratuberculosis
cgcaccaucgcgaugga

SEQ ID NO: 2933629 - RNA, 20 nt, Mycobacterium avium subsp. paratuberculosis
cgcacccagaaacgacauca

SEQ ID NO: 2933630 - RNA, 16 nt, Mycobacterium avium subsp. paratuberculosis
cgcacccagccgcauu

SEQ ID NO: 2933631 - RNA, 14 nt, Mycobacterium avium subsp. paratuberculosis
cgcacccagcgggc

SEQ ID NO: 2933632 - RNA, 16 nt, Mycobacterium avium subsp. paratuberculosis
cgcacccagcgggcga

SEQ ID NO: 2933633 - RNA, 18 nt, Mycobacterium avium subsp. paratuberculosis
cgcacccagcgggcgacg

SEQ ID NO: 2933634 - RNA, 21 nt, Mycobacterium avium subsp. paratuberculosis
cgcacccagcgggcgacgucg

SEQ ID NO: 2933635 - RNA, 22 nt, Mycobacterium avium subsp. paratuberculosis
cgcacccagcgggcgacgucgg

SEQ ID NO: 2933636 - RNA, 14 nt, Mycobacterium avium subsp. paratuberculosis
cgcaccccacccgc

SEQ ID NO: 2933637 - RNA, 16 nt, Mycobacterium avium subsp. paratuberculosis
cgcaccccaccgacag

SEQ ID NO: 2933638 - RNA, 15 nt, Mycobacterium avium subsp. paratuberculosis
cgcacccccagcucg

SEQ ID NO: 2933639 - RNA, 15 nt, Mycobacterium avium subsp. paratuberculosis
cgcacccccggggcc

SEQ ID NO: 2933640 - RNA, 14 nt, Mycobacterium avium subsp. paratuberculosis
cgcacccccuccac

SEQ ID NO: 2933641 - RNA, 20 nt, Mycobacterium avium subsp. paratuberculosis
cgcacccccuccacacggca

SEQ ID NO: 2933642 - RNA, 14 nt, Mycobacterium avium subsp. paratuberculosis
cgcaccccggcaua

SEQ ID NO: 2933643 - RNA, 15 nt, Mycobacterium avium subsp. paratuberculosis
cgcaccccggcauag

SEQ ID NO: 2933644 - RNA, 13 nt, Mycobacterium avium subsp. paratuberculosis
cgcaccccgucca

SEQ ID NO: 2933645 - RNA, 15 nt, Mycobacterium avium subsp. paratuberculosis
cgcaccccguccagg

SEQ ID NO: 2933646 - RNA, 12 nt, Mycobacterium avium subsp. paratuberculosis
cgcaccccgucg

SEQ ID NO: 2933647 - RNA, 14 nt, Mycobacterium avium subsp. paratuberculosis
cgcaccccgucgcg

SEQ ID NO: 2933648 - RNA, 18 nt, Mycobacterium avium subsp. paratuberculosis
cgcaccccgucgcggacc

SEQ ID NO: 2933649 - RNA, 22 nt, Mycobacterium avium subsp. paratuberculosis
cgcaccccguugccgccggcgc

SEQ ID NO: 2933650 - RNA, 16 nt, Mycobacterium avium subsp. paratuberculosis
cgcacccgacacgccg

SEQ ID NO: 2933651 - RNA, 20 nt, Mycobacterium avium subsp. paratuberculosis
cgcacccgacacgccgaucg

SEQ ID NO: 2933652 - RNA, 18 nt, Mycobacterium avium subsp. paratuberculosis
cgcacccgauccacggcg

SEQ ID NO: 2933653 - RNA, 13 nt, Mycobacterium avium subsp. paratuberculosis
cgcacccgccgcc

SEQ ID NO: 2933654 - RNA, 14 nt, Mycobacterium avium subsp. paratuberculosis
cgcacccgccgccc

SEQ ID NO: 2933655 - RNA, 20 nt, Mycobacterium avium subsp. paratuberculosis
cgcacccgcgggucgucggg

SEQ ID NO: 2933656 - RNA, 21 nt, Mycobacterium avium subsp. paratuberculosis
cgcacccggccacgccggguu

SEQ ID NO: 2933657 - RNA, 12 nt, Mycobacterium avium subsp. paratuberculosis
cgcacccgggca

SEQ ID NO: 2933658 - RNA, 20 nt, Mycobacterium avium subsp. paratuberculosis
cgcacccgguccggcugguc

SEQ ID NO: 2933659 - RNA, 20 nt, Mycobacterium avium subsp. paratuberculosis
cgcacccguaacacgaucac

SEQ ID NO: 2933660 - RNA, 16 nt, Mycobacterium avium subsp. paratuberculosis
cgcacccguucggcgu

SEQ ID NO: 2933661 - RNA, 13 nt, Mycobacterium avium subsp. paratuberculosis
cgcacccuugacu

SEQ ID NO: 2933662 - RNA, 20 nt, Mycobacterium avium subsp. paratuberculosis
cgcacccuugacuaccgcgc

SEQ ID NO: 2933663 - RNA, 22 nt, Mycobacterium avium subsp. paratuberculosis
cgcacccuugacuaccgcgccc

SEQ ID NO: 2933664 - RNA, 16 nt, Mycobacterium avium subsp. paratuberculosis
cgcaccgacaucacca

SEQ ID NO: 2933665 - RNA, 14 nt, Mycobacterium avium subsp. paratuberculosis
cgcaccgaccagcg

SEQ ID NO: 2933666 - RNA, 17 nt, Mycobacterium avium subsp. paratuberculosis
cgcaccgaccagcggga

SEQ ID NO: 2933667 - RNA, 19 nt, Mycobacterium avium subsp. paratuberculosis
cgcaccgacgaaaucgucg

SEQ ID NO: 2933668 - RNA, 17 nt, Mycobacterium avium subsp. paratuberculosis
cgcaccgagucggugac

SEQ ID NO: 2933669 - RNA, 17 nt, Mycobacterium avium subsp. paratuberculosis
cgcaccgauggguuggc

SEQ ID NO: 2933670 - RNA, 18 nt, Mycobacterium avium subsp. paratuberculosis
cgcaccgcaaagcaccgc

SEQ ID NO: 2933671 - RNA, 19 nt, Mycobacterium avium subsp. paratuberculosis
cgcaccgcauagcgggagc

SEQ ID NO: 2933672 - RNA, 23 nt, Mycobacterium avium subsp. paratuberculosis
cgcaccgcauagcgggagccggc

SEQ ID NO: 2933673 - RNA, 15 nt, Mycobacterium avium subsp. paratuberculosis
cgcaccgccaccgcc

SEQ ID NO: 2933674 - RNA, 16 nt, Mycobacterium avium subsp. paratuberculosis
cgcaccgccaccgccc

SEQ ID NO: 2933675 - RNA, 21 nt, Mycobacterium avium subsp. paratuberculosis
cgcaccgccaccgcccgcuga

SEQ ID NO: 2933676 - RNA, 13 nt, Mycobacterium avium subsp. paratuberculosis
cgcaccgccagca

SEQ ID NO: 2933677 - RNA, 16 nt, Mycobacterium avium subsp. paratuberculosis
cgcaccgccagcaccg

SEQ ID NO: 2933678 - RNA, 18 nt, Mycobacterium avium subsp. paratuberculosis
cgcaccgccagcaccgac

SEQ ID NO: 2933679 - RNA, 20 nt, Mycobacterium avium subsp. paratuberculosis
cgcaccgccaggcuggccag

SEQ ID NO: 2933680 - RNA, 13 nt, Mycobacterium avium subsp. paratuberculosis
cgcaccgccgcgg

SEQ ID NO: 2933681 - RNA, 19 nt, Mycobacterium avium subsp. paratuberculosis
cgcaccuucccggccgcca

SEQ ID NO: 2933682 - RNA, 20 nt, Mycobacterium avium subsp. paratuberculosis
cgcaccuugcgcccguagcg

SEQ ID NO: 2933683 - RNA, 20 nt, Mycobacterium avium subsp. paratuberculosis
cgcacgaaaccgcguggcgc

SEQ ID NO: 2933684 - RNA, 17 nt, Mycobacterium avium subsp. paratuberculosis
cgcacgaaaugcgggcg

SEQ ID NO: 2933685 - RNA, 21 nt, Mycobacterium avium subsp. paratuberculosis
cgcacgaaaugcgggcgaugg

SEQ ID NO: 2933686 - RNA, 21 nt, Mycobacterium avium subsp. paratuberculosis
cgcacgaacggcgcgaaccgg

SEQ ID NO: 2933687 - RNA, 17 nt, Mycobacterium avium subsp. paratuberculosis
cgcacgaauugccggug

SEQ ID NO: 2933688 - RNA, 16 nt, Mycobacterium avium subsp. paratuberculosis
cgcacgaccaugucgg

SEQ ID NO: 2933689 - RNA, 18 nt, Mycobacterium avium subsp. paratuberculosis
cgcacgaccaugucggcg

SEQ ID NO: 2933690 - RNA, 21 nt, Mycobacterium avium subsp. paratuberculosis
cgcacgaccaugucggcgacc

SEQ ID NO: 2933691 - RNA, 16 nt, Mycobacterium avium subsp. paratuberculosis
cgcacgagcacccaga

SEQ ID NO: 2933692 - RNA, 18 nt, Mycobacterium avium subsp. paratuberculosis
cgcacgaucugcaggccg

SEQ ID NO: 2933693 - RNA, 19 nt, Mycobacterium avium subsp. paratuberculosis
cgcacgaucugcaggccga

SEQ ID NO: 2933694 - RNA, 23 nt, Mycobacterium avium subsp. paratuberculosis
cgcacgaucugcaggccgaggcu

SEQ ID NO: 2933695 - RNA, 16 nt, Mycobacterium avium subsp. paratuberculosis
cgcacgaugccgcgcu

SEQ ID NO: 2933696 - RNA, 21 nt, Mycobacterium avium subsp. paratuberculosis
cgcacgaugccgcgcucgaac

SEQ ID NO: 2933697 - RNA, 22 nt, Mycobacterium avium subsp. paratuberculosis
cgcacgcagugccgcaccagca

SEQ ID NO: 2933698 - RNA, 14 nt, Mycobacterium avium subsp. paratuberculosis
cgcacgccagcauc

SEQ ID NO: 2933699 - RNA, 17 nt, Mycobacterium avium subsp. paratuberculosis
cgcacgccagcaucgag

SEQ ID NO: 2933700 - RNA, 20 nt, Mycobacterium avium subsp. paratuberculosis
cgcacgccaucgccucggcc

SEQ ID NO: 2933701 - RNA, 21 nt, Mycobacterium avium subsp. paratuberculosis
cgcacgcccaugaucacaccg

SEQ ID NO: 2933702 - RNA, 13 nt, Mycobacterium avium subsp. paratuberculosis
cgcacgcccgggc

SEQ ID NO: 2933703 - RNA, 22 nt, Mycobacterium avium subsp. paratuberculosis
cgcacgccggguugggcggcgg

SEQ ID NO: 2933704 - RNA, 22 nt, Mycobacterium avium subsp. paratuberculosis
cgcacgcgaacaccagaugccg

SEQ ID NO: 2933705 - RNA, 13 nt, Mycobacterium avium subsp. paratuberculosis
cgcacgcgaccgc

SEQ ID NO: 2933706 - RNA, 17 nt, Mycobacterium avium subsp. paratuberculosis
cgcacgcgaccgcgucg

SEQ ID NO: 2933707 - RNA, 18 nt, Mycobacterium avium subsp. paratuberculosis
cgcacgcgaccgcgucga

SEQ ID NO: 2933708 - RNA, 15 nt, Mycobacterium avium subsp. paratuberculosis
cgcacgcggacacga

SEQ ID NO: 2933709 - RNA, 16 nt, Mycobacterium avium subsp. paratuberculosis
cgcacgcucgcggugc

SEQ ID NO: 2933710 - RNA, 22 nt, Mycobacterium avium subsp. paratuberculosis
cgcacgcugaucccacauucgg

SEQ ID NO: 2933711 - RNA, 14 nt, Mycobacterium avium subsp. paratuberculosis
cgcacgcuggccgg

SEQ ID NO: 2933712 - RNA, 16 nt, Mycobacterium avium subsp. paratuberculosis
cgcacgcuggccggca

SEQ ID NO: 2933713 - RNA, 19 nt, Mycobacterium avium subsp. paratuberculosis
cgcacgcuggccggcagcg

SEQ ID NO: 2933714 - RNA, 20 nt, Mycobacterium avium subsp. paratuberculosis
cgcacgcuggccggcagcgu

SEQ ID NO: 2933715 - RNA, 21 nt, Mycobacterium avium subsp. paratuberculosis
cgcacgcuggccggcagcguc

SEQ ID NO: 2933716 - RNA, 19 nt, Mycobacterium avium subsp. paratuberculosis
cgcacgcugucggggucgc

SEQ ID NO: 2933717 - RNA, 22 nt, Mycobacterium avium subsp. paratuberculosis
cgcacgcuuuuucgcgaacuuc

SEQ ID NO: 2933718 - RNA, 14 nt, Mycobacterium avium subsp. paratuberculosis
cgcacggcagcccg

SEQ ID NO: 2933719 - RNA, 16 nt, Mycobacterium avium subsp. paratuberculosis
cgcacggcagcccgac

SEQ ID NO: 2933720 - RNA, 20 nt, Mycobacterium avium subsp. paratuberculosis
cgcacggcccaucaccagcg

SEQ ID NO: 2933721 - RNA, 15 nt, Mycobacterium avium subsp. paratuberculosis
cgcacggccgccagg

SEQ ID NO: 2933722 - RNA, 22 nt, Mycobacterium avium subsp. paratuberculosis
cgcacggcgaacggccgcgaug

SEQ ID NO: 2933723 - RNA, 22 nt, Mycobacterium avium subsp. paratuberculosis
cgcacggcgcccagguccacca

SEQ ID NO: 2933724 - RNA, 20 nt, Mycobacterium avium subsp. paratuberculosis
cgcacggcgcgcaccgcggg

SEQ ID NO: 2933725 - RNA, 22 nt, Mycobacterium avium subsp. paratuberculosis
cgcacggcgcgcaccgcgggca

SEQ ID NO: 2933726 - RNA, 14 nt, Mycobacterium avium subsp. paratuberculosis
cgcacgggcggcgg

SEQ ID NO: 2933727 - RNA, 15 nt, Mycobacterium avium subsp. paratuberculosis
cgcacgggcggcggg

SEQ ID NO: 2933728 - RNA, 22 nt, Mycobacterium avium subsp. paratuberculosis
cgcacgggcggcgggggcgaga

SEQ ID NO: 2933729 - RNA, 14 nt, Mycobacterium avium subsp. paratuberculosis
cgcacggucgcggu

SEQ ID NO: 2933730 - RNA, 15 nt, Mycobacterium avium subsp. paratuberculosis
cgcacggucgcggug

SEQ ID NO: 2933731 - RNA, 17 nt, Mycobacterium avium subsp. paratuberculosis
cgcacggucgcgguguc

SEQ ID NO: 2933732 - RNA, 20 nt, Mycobacterium avium subsp. paratuberculosis
cgcacggucgcggugucggc

SEQ ID NO: 2933733 - RNA, 14 nt, Mycobacterium avium subsp. paratuberculosis
cgcacggugcagca

SEQ ID NO: 2933734 - RNA, 15 nt, Mycobacterium avium subsp. paratuberculosis
cgcacggugcagcag

SEQ ID NO: 2933735 - RNA, 17 nt, Mycobacterium avium subsp. paratuberculosis
cgcacggugcagcagcg

SEQ ID NO: 2933736 - RNA, 19 nt, Mycobacterium avium subsp. paratuberculosis
cgcacggugcagcagcgcc

SEQ ID NO: 2933737 - RNA, 20 nt, Mycobacterium avium subsp. paratuberculosis
cgcacggugcagcagcgccg

SEQ ID NO: 2933738 - RNA, 14 nt, Mycobacterium avium subsp. paratuberculosis
cgcacggugcccgu

SEQ ID NO: 2933739 - RNA, 19 nt, Mycobacterium avium subsp. paratuberculosis
cgcacggugcccgucggca

SEQ ID NO: 2933740 - RNA, 16 nt, Mycobacterium avium subsp. paratuberculosis
cgcacguagcccagcg

SEQ ID NO: 2933741 - RNA, 18 nt, Mycobacterium avium subsp. paratuberculosis
cgcacguagcccagcgcg

SEQ ID NO: 2933742 - RNA, 17 nt, Mycobacterium avium subsp. paratuberculosis
cgcacguauccgcgguc

SEQ ID NO: 2933743 - RNA, 18 nt, Mycobacterium avium subsp. paratuberculosis
cgcacguauccgcggucg

SEQ ID NO: 2933744 - RNA, 21 nt, Mycobacterium avium subsp. paratuberculosis
cgcacguauccgcggucgacc

SEQ ID NO: 2933745 - RNA, 15 nt, Mycobacterium avium subsp. paratuberculosis
cgcacgucaccgcgc

SEQ ID NO: 2933746 - RNA, 15 nt, Mycobacterium avium subsp. paratuberculosis
cgcacgucccgcccg

SEQ ID NO: 2933747 - RNA, 11 nt, Mycobacterium avium subsp. paratuberculosis
cgcacgucgag

SEQ ID NO: 2933748 - RNA, 12 nt, Mycobacterium avium subsp. paratuberculosis
cgcacgucgagg

SEQ ID NO: 2933749 - RNA, 16 nt, Mycobacterium avium subsp. paratuberculosis
cgcacgucgaggucgg

SEQ ID NO: 2933750 - RNA, 14 nt, Mycobacterium avium subsp. paratuberculosis
cgcacgucgccgcc

SEQ ID NO: 2933751 - RNA, 15 nt, Mycobacterium avium subsp. paratuberculosis
cgcacgucgccgccg

SEQ ID NO: 2933752 - RNA, 15 nt, Mycobacterium avium subsp. paratuberculosis
cgcacgucggcaggu

SEQ ID NO: 2933753 - RNA, 14 nt, Mycobacterium avium subsp. paratuberculosis
cgcacgucggccgc

SEQ ID NO: 2933754 - RNA, 15 nt, Mycobacterium avium subsp. paratuberculosis
cgcacgucggccgcc

SEQ ID NO: 2933755 - RNA, 16 nt, Mycobacterium avium subsp. paratuberculosis
cgcacgucggccgcca

SEQ ID NO: 2933756 - RNA, 18 nt, Mycobacterium avium subsp. paratuberculosis
cgcacgucggccgccagg

SEQ ID NO: 2933757 - RNA, 22 nt, Mycobacterium avium subsp. paratuberculosis
cgcacgucggccgccagggcca

SEQ ID NO: 2933758 - RNA, 15 nt, Mycobacterium avium subsp. paratuberculosis
cgcacgugcgcgccg

SEQ ID NO: 2933759 - RNA, 17 nt, Mycobacterium avium subsp. paratuberculosis
cgcacgugcgcgccgac

SEQ ID NO: 2933760 - RNA, 22 nt, Mycobacterium avium subsp. paratuberculosis
cgcacgugcgcgccgaccgcga

SEQ ID NO: 2933761 - RNA, 15 nt, Mycobacterium avium subsp. paratuberculosis
cgcacguggcugacc

SEQ ID NO: 2933762 - RNA, 18 nt, Mycobacterium avium subsp. paratuberculosis
cgcacguggcugaccgac

SEQ ID NO: 2933763 - RNA, 21 nt, Mycobacterium avium subsp. paratuberculosis
cgcacguggcugaccgacggc

SEQ ID NO: 2933764 - RNA, 23 nt, Mycobacterium avium subsp. paratuberculosis
cgcacguggcugaccgacggcga

SEQ ID NO: 2933765 - RNA, 18 nt, Mycobacterium avium subsp. paratuberculosis
cgcagccgcuggccgcgc

SEQ ID NO: 2933766 - RNA, 19 nt, Mycobacterium avium subsp. paratuberculosis
cgcagccgcuggccgcgcc

SEQ ID NO: 2933767 - RNA, 20 nt, Mycobacterium avium subsp. paratuberculosis
cgcagccgcuggccgcgcca

SEQ ID NO: 2933768 - RNA, 13 nt, Mycobacterium avium subsp. paratuberculosis
cgcagccggcagc

SEQ ID NO: 2933769 - RNA, 14 nt, Mycobacterium avium subsp. paratuberculosis
cgcagccggcagca

SEQ ID NO: 2933770 - RNA, 22 nt, Mycobacterium avium subsp. paratuberculosis
cgcagccggccaccgccccagc

SEQ ID NO: 2933771 - RNA, 14 nt, Mycobacterium avium subsp. paratuberculosis
cgcagccggccgac

SEQ ID NO: 2933772 - RNA, 16 nt, Mycobacterium avium subsp. paratuberculosis
cgcagccggccgaccg

SEQ ID NO: 2933773 - RNA, 13 nt, Mycobacterium avium subsp. paratuberculosis
cgcagccggccgu

SEQ ID NO: 2933774 - RNA, 22 nt, Mycobacterium avium subsp. paratuberculosis
cgcagccggccguccacggcgg

SEQ ID NO: 2933775 - RNA, 11 nt, Mycobacterium avium subsp. paratuberculosis
cgcagccgggc

SEQ ID NO: 2933776 - RNA, 15 nt, Mycobacterium avium subsp. paratuberculosis
cgcagccgggcggcg

SEQ ID NO: 2933777 - RNA, 16 nt, Mycobacterium avium subsp. paratuberculosis
cgcagccgggcggcgc

SEQ ID NO: 2933778 - RNA, 15 nt, Mycobacterium avium subsp. paratuberculosis
cgcagccgggcggug

SEQ ID NO: 2933779 - RNA, 16 nt, Mycobacterium avium subsp. paratuberculosis
cgcagccgggcgguga

SEQ ID NO: 2933780 - RNA, 13 nt, Mycobacterium avium subsp. paratuberculosis
cgcagccggucaa

SEQ ID NO: 2933781 - RNA, 14 nt, Mycobacterium avium subsp. paratuberculosis
cgcagccgucgauc

SEQ ID NO: 2933782 - RNA, 20 nt, Mycobacterium avium subsp. paratuberculosis
cgcagccgucgaucuugacg

SEQ ID NO: 2933783 - RNA, 18 nt, Mycobacterium avium subsp. paratuberculosis
cgcagccuucuucgccgg

SEQ ID NO: 2933784 - RNA, 19 nt, Mycobacterium avium subsp. paratuberculosis
cgcagccuucuucgccggg

SEQ ID NO: 2933785 - RNA, 20 nt, Mycobacterium avium subsp. paratuberculosis
cgcagccuucuucgccgggg

SEQ ID NO: 2933786 - RNA, 22 nt, Mycobacterium avium subsp. paratuberculosis
cgcagccuucuucgccggggcc

SEQ ID NO: 2933787 - RNA, 16 nt, Mycobacterium avium subsp. paratuberculosis
cgcagcgaacgcggcu

SEQ ID NO: 2933788 - RNA, 17 nt, Mycobacterium avium subsp. paratuberculosis
cgcagcgaacgcggcug

SEQ ID NO: 2933789 - RNA, 16 nt, Mycobacterium avium subsp. paratuberculosis
cgcagcgaacgucagg

SEQ ID NO: 2933790 - RNA, 18 nt, Mycobacterium avium subsp. paratuberculosis
cgcagcgaagcgaggcgc

SEQ ID NO: 2933791 - RNA, 21 nt, Mycobacterium avium subsp. paratuberculosis
cgcagcgaagcgaggcgccac

SEQ ID NO: 2933792 - RNA, 22 nt, Mycobacterium avium subsp. paratuberculosis
cgcagcgacaaucggcucgccu

SEQ ID NO: 2933793 - RNA, 21 nt, Mycobacterium avium subsp. paratuberculosis
cgcagcgaccugguccaccgc

SEQ ID NO: 2933794 - RNA, 16 nt, Mycobacterium avium subsp. paratuberculosis
cgcagcgacuccuggu

SEQ ID NO: 2933795 - RNA, 19 nt, Mycobacterium avium subsp. paratuberculosis
cgcagcgaggcgauggugc

SEQ ID NO: 2933796 - RNA, 13 nt, Mycobacterium avium subsp. paratuberculosis
cgcagcgagucgg

SEQ ID NO: 2933797 - RNA, 15 nt, Mycobacterium avium subsp. paratuberculosis
cgcagcgagucggcg

SEQ ID NO: 2933798 - RNA, 17 nt, Mycobacterium avium subsp. paratuberculosis
cgcagcgaucggcggcu

SEQ ID NO: 2933799 - RNA, 22 nt, Mycobacterium avium subsp. paratuberculosis
cgcagcgaucggcggcucgccg

SEQ ID NO: 2933800 - RNA, 19 nt, Mycobacterium avium subsp. paratuberculosis
cgcagcgcacgucgccgcc

SEQ ID NO: 2933801 - RNA, 15 nt, Mycobacterium avium subsp. paratuberculosis
cgcagcgcagcacca

SEQ ID NO: 2933802 - RNA, 17 nt, Mycobacterium avium subsp. paratuberculosis
cgcagcgcagcaccauc

SEQ ID NO: 2933803 - RNA, 16 nt, Mycobacterium avium subsp. paratuberculosis
cgcagcgcagcgucgg

SEQ ID NO: 2933804 - RNA, 19 nt, Mycobacterium avium subsp. paratuberculosis
cgcagcgcauccgacaccg

SEQ ID NO: 2933805 - RNA, 22 nt, Mycobacterium avium subsp. paratuberculosis
cgcagcgcauccgacaccgccu

SEQ ID NO: 2933806 - RNA, 12 nt, Mycobacterium avium subsp. paratuberculosis
cgcagcgcaucg

SEQ ID NO: 2933807 - RNA, 16 nt, Mycobacterium avium subsp. paratuberculosis
cgcagcgcaucgccgg

SEQ ID NO: 2933808 - RNA, 18 nt, Mycobacterium avium subsp. paratuberculosis
cgcagcgcaucgccggcg

SEQ ID NO: 2933809 - RNA, 19 nt, Mycobacterium avium subsp. paratuberculosis
cgcagcgcaucgccggcga

SEQ ID NO: 2933810 - RNA, 21 nt, Mycobacterium avium subsp. paratuberculosis
cgcagcgcaucgccggcgaug

SEQ ID NO: 2933811 - RNA, 16 nt, Mycobacterium avium subsp. paratuberculosis
cgcagcgcaucgguga

SEQ ID NO: 2933812 - RNA, 15 nt, Mycobacterium avium subsp. paratuberculosis
cgcagcgccagcgcg

SEQ ID NO: 2933813 - RNA, 15 nt, Mycobacterium avium subsp. paratuberculosis
cgcagcgccaggcag

SEQ ID NO: 2933814 - RNA, 16 nt, Mycobacterium avium subsp. paratuberculosis
cgcagcgccaggcaga

SEQ ID NO: 2933815 - RNA, 12 nt, Mycobacterium avium subsp. paratuberculosis
cgcagcgcccgg

SEQ ID NO: 2933816 - RNA, 16 nt, Mycobacterium avium subsp. paratuberculosis
cgcagcgcccggcagc

SEQ ID NO: 2933817 - RNA, 19 nt, Mycobacterium avium subsp. paratuberculosis
cgcagcgcccggcagcggu

SEQ ID NO: 2933818 - RNA, 12 nt, Mycobacterium avium subsp. paratuberculosis
cgcagcgccgcg

SEQ ID NO: 2933819 - RNA, 15 nt, Mycobacterium avium subsp. paratuberculosis
cgcagcgccgcgccg

SEQ ID NO: 2933820 - RNA, 16 nt, Mycobacterium avium subsp. paratuberculosis
cgcagcgccgcgccga

SEQ ID NO: 2933821 - RNA, 21 nt, Mycobacterium avium subsp. paratuberculosis
cgcagcgccgucucgacccgg

SEQ ID NO: 2933822 - RNA, 13 nt, Mycobacterium avium subsp. paratuberculosis
cgcagcgccucgg

SEQ ID NO: 2933823 - RNA, 14 nt, Mycobacterium avium subsp. paratuberculosis
cgcagcgccucggc

SEQ ID NO: 2933824 - RNA, 16 nt, Mycobacterium avium subsp. paratuberculosis
cgcagcgccucggcgg

SEQ ID NO: 2933825 - RNA, 19 nt, Mycobacterium avium subsp. paratuberculosis
cgcagcgccucggcggccc

SEQ ID NO: 2933826 - RNA, 17 nt, Mycobacterium avium subsp. paratuberculosis
cgcagcgccucggcgug

SEQ ID NO: 2933827 - RNA, 18 nt, Mycobacterium avium subsp. paratuberculosis
cgcagcgccucggcgugg

SEQ ID NO: 2933828 - RNA, 21 nt, Mycobacterium avium subsp. paratuberculosis
cgcagcgccucggcguggcag

SEQ ID NO: 2933829 - RNA, 12 nt, Mycobacterium avium subsp. paratuberculosis
cgcagcgcgacg

SEQ ID NO: 2933830 - RNA, 21 nt, Mycobacterium avium subsp. paratuberculosis
cgcagcgcgacgaacagcacc

SEQ ID NO: 2933831 - RNA, 22 nt, Mycobacterium avium subsp. paratuberculosis
cgcagcgcgacgaacagcaccg

SEQ ID NO: 2933832 - RNA, 23 nt, Mycobacterium avium subsp. paratuberculosis
cgcagcgcgacgaacagcaccgc

SEQ ID NO: 2933833 - RNA, 11 nt, Mycobacterium avium subsp. paratuberculosis
cgcagcgcgau

SEQ ID NO: 2933834 - RNA, 21 nt, Mycobacterium avium subsp. paratuberculosis
cgcagcgcgauguccgacagc

SEQ ID NO: 2933835 - RNA, 14 nt, Mycobacterium avium subsp. paratuberculosis
cgcagcgcgcgacc

SEQ ID NO: 2933836 - RNA, 15 nt, Mycobacterium avium subsp. paratuberculosis
cgcagcgcgcgaccg

SEQ ID NO: 2933837 - RNA, 22 nt, Mycobacterium avium subsp. paratuberculosis
cgcagcgcgcgcucggucagca

SEQ ID NO: 2933838 - RNA, 14 nt, Mycobacterium avium subsp. paratuberculosis
cgcagcgcgcggcg

SEQ ID NO: 2933839 - RNA, 18 nt, Mycobacterium avium subsp. paratuberculosis
cgcagcgcgcggcgcaga

SEQ ID NO: 2933840 - RNA, 15 nt, Mycobacterium avium subsp. paratuberculosis
cgcagcgcgcgggug

SEQ ID NO: 2933841 - RNA, 13 nt, Mycobacterium avium subsp. paratuberculosis
cgcagcgcggcga

SEQ ID NO: 2933842 - RNA, 15 nt, Mycobacterium avium subsp. paratuberculosis
cgcagcgcggcgaca

SEQ ID NO: 2933843 - RNA, 16 nt, Mycobacterium avium subsp. paratuberculosis
cgcagcgcggcgacau

SEQ ID NO: 2933844 - RNA, 13 nt, Mycobacterium avium subsp. paratuberculosis
cgcagcgcggcgg

SEQ ID NO: 2933845 - RNA, 15 nt, Mycobacterium avium subsp. paratuberculosis
cgcagcgcggcggag

SEQ ID NO: 2933846 - RNA, 15 nt, Mycobacterium avium subsp. paratuberculosis
cgcagcgcgucgcgc

SEQ ID NO: 2933847 - RNA, 13 nt, Mycobacterium avium subsp. paratuberculosis
cgcagcgcgucgg

SEQ ID NO: 2933848 - RNA, 16 nt, Mycobacterium avium subsp. paratuberculosis
cgcagcgcgucgggcu

SEQ ID NO: 2933849 - RNA, 21 nt, Mycobacterium avium subsp. paratuberculosis
cgcagcgcgucgggcucggcc

SEQ ID NO: 2933850 - RNA, 12 nt, Mycobacterium avium subsp. paratuberculosis
cgcaggccgccc

SEQ ID NO: 2933851 - RNA, 13 nt, Mycobacterium avium subsp. paratuberculosis
cgcaggccgcccg

SEQ ID NO: 2933852 - RNA, 16 nt, Mycobacterium avium subsp. paratuberculosis
cgcaggccgcccggcc

SEQ ID NO: 2933853 - RNA, 12 nt, Mycobacterium avium subsp. paratuberculosis
cgcaggccgccg

SEQ ID NO: 2933854 - RNA, 22 nt, Mycobacterium avium subsp. paratuberculosis
cgcaggccgccgacgacggcga

SEQ ID NO: 2933855 - RNA, 16 nt, Mycobacterium avium subsp. paratuberculosis
cgcaggccgcgagccc

SEQ ID NO: 2933856 - RNA, 18 nt, Mycobacterium avium subsp. paratuberculosis
cgcaggccgcgagcccgc

SEQ ID NO: 2933857 - RNA, 11 nt, Mycobacterium avium subsp. paratuberculosis
cgcaggccguc

SEQ ID NO: 2933858 - RNA, 19 nt, Mycobacterium avium subsp. paratuberculosis
cgcaggccguccagcagca

SEQ ID NO: 2933859 - RNA, 20 nt, Mycobacterium avium subsp. paratuberculosis
cgcaggccguccagcagcag

SEQ ID NO: 2933860 - RNA, 23 nt, Mycobacterium avium subsp. paratuberculosis
cgcaggccguccagcagcagcgc

SEQ ID NO: 2933861 - RNA, 15 nt, Mycobacterium avium subsp. paratuberculosis
cgcaggccgucgccg

SEQ ID NO: 2933862 - RNA, 16 nt, Mycobacterium avium subsp. paratuberculosis
cgcaggccgucgccgg

SEQ ID NO: 2933863 - RNA, 17 nt, Mycobacterium avium subsp. paratuberculosis
cgcaggccgucgccggu

SEQ ID NO: 2933864 - RNA, 20 nt, Mycobacterium avium subsp. paratuberculosis
cgcaggccucuacucagccg

SEQ ID NO: 2933865 - RNA, 13 nt, Mycobacterium avium subsp. paratuberculosis
cgcaggcgagccg

SEQ ID NO: 2933866 - RNA, 17 nt, Mycobacterium avium subsp. paratuberculosis
cgcaggcgagccgacag

SEQ ID NO: 2933867 - RNA, 18 nt, Mycobacterium avium subsp. paratuberculosis
cgcaggcgagccgacagu

SEQ ID NO: 2933868 - RNA, 14 nt, Mycobacterium avium subsp. paratuberculosis
cgcaggcgagccgg

SEQ ID NO: 2933869 - RNA, 15 nt, Mycobacterium avium subsp. paratuberculosis
cgcaggcgagccggu

SEQ ID NO: 2933870 - RNA, 14 nt, Mycobacterium avium subsp. paratuberculosis
cgcaggcgcaccac

SEQ ID NO: 2933871 - RNA, 14 nt, Mycobacterium avium subsp. paratuberculosis
cgcaggcgcgcacc

SEQ ID NO: 2933872 - RNA, 17 nt, Mycobacterium avium subsp. paratuberculosis
cgcaggcgcgcaccauc

SEQ ID NO: 2933873 - RNA, 20 nt, Mycobacterium avium subsp. paratuberculosis
cgcaggcgcgcaccaucgcg

SEQ ID NO: 2933874 - RNA, 14 nt, Mycobacterium avium subsp. paratuberculosis
cgcaggcgcgcggc

SEQ ID NO: 2933875 - RNA, 17 nt, Mycobacterium avium subsp. paratuberculosis
cgcaggcgcgcggccag

SEQ ID NO: 2933876 - RNA, 20 nt, Mycobacterium avium subsp. paratuberculosis
cgcaggcgcgcggccagccc

SEQ ID NO: 2933877 - RNA, 21 nt, Mycobacterium avium subsp. paratuberculosis
cgcaggcgcgcggccagcccc

SEQ ID NO: 2933878 - RNA, 22 nt, Mycobacterium avium subsp. paratuberculosis
cgcaggcgcgcggccagccccg

SEQ ID NO: 2933879 - RNA, 19 nt, Mycobacterium avium subsp. paratuberculosis
cgcaggcggccagcaccag

SEQ ID NO: 2933880 - RNA, 20 nt, Mycobacterium avium subsp. paratuberculosis
cgcaggcggccagcaccagu

SEQ ID NO: 2933881 - RNA, 20 nt, Mycobacterium avium subsp. paratuberculosis
cgcaggcggcgacggccguc

SEQ ID NO: 2933882 - RNA, 14 nt, Mycobacterium avium subsp. paratuberculosis
cgcaggcggcgcgc

SEQ ID NO: 2933883 - RNA, 16 nt, Mycobacterium avium subsp. paratuberculosis
cgcaggcggcgcgcag

SEQ ID NO: 2933884 - RNA, 21 nt, Mycobacterium avium subsp. paratuberculosis
cgcaggcggcgcgcagccggc

SEQ ID NO: 2933885 - RNA, 22 nt, Mycobacterium avium subsp. paratuberculosis
cgcaggcggcgcgcagccggcc

SEQ ID NO: 2933886 - RNA, 19 nt, Mycobacterium avium subsp. paratuberculosis
cgcaggcguccagggccac

SEQ ID NO: 2933887 - RNA, 22 nt, Mycobacterium avium subsp. paratuberculosis
cgcaggcguccagggccaccgc

SEQ ID NO: 2933888 - RNA, 17 nt, Mycobacterium avium subsp. paratuberculosis
cgcaggcguggcccagc

SEQ ID NO: 2933889 - RNA, 18 nt, Mycobacterium avium subsp. paratuberculosis
cgcaggcguggcccagcc

SEQ ID NO: 2933890 - RNA, 21 nt, Mycobacterium avium subsp. paratuberculosis
cgcaggcguggcccagccggu

SEQ ID NO: 2933891 - RNA, 12 nt, Mycobacterium avium subsp. paratuberculosis
cgcaggcuggca

SEQ ID NO: 2933892 - RNA, 20 nt, Mycobacterium avium subsp. paratuberculosis
cgcaggcuggcaucgucggc

SEQ ID NO: 2933893 - RNA, 20 nt, Mycobacterium avium subsp. paratuberculosis
cgcagggccagcgccucggc

SEQ ID NO: 2933894 - RNA, 21 nt, Mycobacterium avium subsp. paratuberculosis
cgcagggccagcgccucggcg

SEQ ID NO: 2933895 - RNA, 12 nt, Mycobacterium avium subsp. paratuberculosis
cgcagggccgcu

SEQ ID NO: 2933896 - RNA, 13 nt, Mycobacterium avium subsp. paratuberculosis
cgcagggcgccgg

SEQ ID NO: 2933897 - RNA, 14 nt, Mycobacterium avium subsp. paratuberculosis
cgcagggcgccggu

SEQ ID NO: 2933898 - RNA, 16 nt, Mycobacterium avium subsp. paratuberculosis
cgcagggcgccgguga

SEQ ID NO: 2933899 - RNA, 13 nt, Mycobacterium avium subsp. paratuberculosis
cgcagggcggccg

SEQ ID NO: 2933900 - RNA, 15 nt, Mycobacterium avium subsp. paratuberculosis
cgcagggcggccggc

SEQ ID NO: 2933901 - RNA, 17 nt, Mycobacterium avium subsp. paratuberculosis
cgcagggcggccggcca

SEQ ID NO: 2933902 - RNA, 20 nt, Mycobacterium avium subsp. paratuberculosis
cgcagggcguucgacgucca

SEQ ID NO: 2933903 - RNA, 23 nt, Mycobacterium avium subsp. paratuberculosis
cgcagggucagcgcuuccagcgc

SEQ ID NO: 2933904 - RNA, 20 nt, Mycobacterium avium subsp. paratuberculosis
cgcaggguggccagcaccgc

SEQ ID NO: 2933905 - RNA, 21 nt, Mycobacterium avium subsp. paratuberculosis
cgcaggguggccagcaccgcg

SEQ ID NO: 2933906 - RNA, 16 nt, Mycobacterium avium subsp. paratuberculosis
cgcagguacgcggcgu

SEQ ID NO: 2933907 - RNA, 17 nt, Mycobacterium avium subsp. paratuberculosis
cgcagguagccgccgua

SEQ ID NO: 2933908 - RNA, 18 nt, Mycobacterium avium subsp. paratuberculosis
cgcagguagccgccguag

SEQ ID NO: 2933909 - RNA, 19 nt, Mycobacterium avium subsp. paratuberculosis
cgcagguccacccgccccg

SEQ ID NO: 2933910 - RNA, 21 nt, Mycobacterium avium subsp. paratuberculosis
cgcagguccacccgccccgcc

SEQ ID NO: 2933911 - RNA, 17 nt, Mycobacterium avium subsp. paratuberculosis
cgcagguccggcagcgc

SEQ ID NO: 2933912 - RNA, 21 nt, Mycobacterium avium subsp. paratuberculosis
cgcagguccggcagcgcgccc

SEQ ID NO: 2933913 - RNA, 22 nt, Mycobacterium avium subsp. paratuberculosis
cgcagguccggcagcgcgccca

SEQ ID NO: 2933914 - RNA, 22 nt, Mycobacterium avium subsp. paratuberculosis
cgcagguccguggugaucgccg

SEQ ID NO: 2933915 - RNA, 13 nt, Mycobacterium avium subsp. paratuberculosis
cgcagguccucgg

SEQ ID NO: 2933916 - RNA, 15 nt, Mycobacterium avium subsp. paratuberculosis
cgcaggucgggccgg

SEQ ID NO: 2933917 - RNA, 17 nt, Mycobacterium avium subsp. paratuberculosis
cgcaggucgggccggcc

SEQ ID NO: 2933918 - RNA, 19 nt, Mycobacterium avium subsp. paratuberculosis
cgcaggucgggccggccga

SEQ ID NO: 2933919 - RNA, 20 nt, Mycobacterium avium subsp. paratuberculosis
cgcaggucgggccggccgau

SEQ ID NO: 2933920 - RNA, 18 nt, Mycobacterium avium subsp. paratuberculosis
cgcaggucguccgacagg

SEQ ID NO: 2933921 - RNA, 21 nt, Mycobacterium avium subsp. paratuberculosis
cgcaggugaucuugcccagcc

SEQ ID NO: 2933922 - RNA, 15 nt, Mycobacterium avium subsp. paratuberculosis
cgcaggugaugcggc

SEQ ID NO: 2933923 - RNA, 12 nt, Mycobacterium avium subsp. paratuberculosis
cgcaggugccgg

SEQ ID NO: 2933924 - RNA, 17 nt, Mycobacterium avium subsp. paratuberculosis
cgcaggugccggugacg

SEQ ID NO: 2933925 - RNA, 15 nt, Mycobacterium avium subsp. paratuberculosis
cgcaggugcgccgcu

SEQ ID NO: 2933926 - RNA, 18 nt, Mycobacterium avium subsp. paratuberculosis
cgcaggugcgccgcucgu

SEQ ID NO: 2933927 - RNA, 15 nt, Mycobacterium avium subsp. paratuberculosis
cgcaggugcucgccg

SEQ ID NO: 2933928 - RNA, 16 nt, Mycobacterium avium subsp. paratuberculosis
cgcaggugcucgccgg

SEQ ID NO: 2933929 - RNA, 17 nt, Mycobacterium avium subsp. paratuberculosis
cgcaggugcucgccggc

SEQ ID NO: 2933930 - RNA, 20 nt, Mycobacterium avium subsp. paratuberculosis
cgcaggugcucgccggcgcg

SEQ ID NO: 2933931 - RNA, 22 nt, Mycobacterium avium subsp. paratuberculosis
cgcaggugcucgccggcgcgga

SEQ ID NO: 2933932 - RNA, 23 nt, Mycobacterium avium subsp. paratuberculosis
cgcaggugcucgccggcgcggaa

SEQ ID NO: 2933933 - RNA, 13 nt, Mycobacterium avium subsp. paratuberculosis
cgcaggugggcgg

SEQ ID NO: 2933934 - RNA, 17 nt, Mycobacterium avium subsp. paratuberculosis
cgcagguggugggcgug

SEQ ID NO: 2933935 - RNA, 16 nt, Mycobacterium avium subsp. paratuberculosis
cgcaucgccggcgaug

SEQ ID NO: 2933936 - RNA, 15 nt, Mycobacterium avium subsp. paratuberculosis
cgcaucgccggcgcg

SEQ ID NO: 2933937 - RNA, 17 nt, Mycobacterium avium subsp. paratuberculosis
cgcaucgccggcgcgcu

SEQ ID NO: 2933938 - RNA, 12 nt, Mycobacterium avium subsp. paratuberculosis
cgcaucgccguc

SEQ ID NO: 2933939 - RNA, 13 nt, Mycobacterium avium subsp. paratuberculosis
cgcaucgccucgg

SEQ ID NO: 2933940 - RNA, 16 nt, Mycobacterium avium subsp. paratuberculosis
cgcaucgccucggcgg

SEQ ID NO: 2933941 - RNA, 18 nt, Mycobacterium avium subsp. paratuberculosis
cgcaucgccucggcggcc

SEQ ID NO: 2933942 - RNA, 19 nt, Mycobacterium avium subsp. paratuberculosis
cgcaucgccucggcggccg

SEQ ID NO: 2933943 - RNA, 20 nt, Mycobacterium avium subsp. paratuberculosis
cgcaucgccucggcggccgc

SEQ ID NO: 2933944 - RNA, 22 nt, Mycobacterium avium subsp. paratuberculosis
cgcaucgccucggcggccgccc

SEQ ID NO: 2933945 - RNA, 14 nt, Mycobacterium avium subsp. paratuberculosis
cgcaucgcggcgau

SEQ ID NO: 2933946 - RNA, 15 nt, Mycobacterium avium subsp. paratuberculosis
cgcaucgcggcgaug

SEQ ID NO: 2933947 - RNA, 17 nt, Mycobacterium avium subsp. paratuberculosis
cgcaucgcgggccaccg

SEQ ID NO: 2933948 - RNA, 23 nt, Mycobacterium avium subsp. paratuberculosis
cgcaucgcgggccaccggcgcca

SEQ ID NO: 2933949 - RNA, 15 nt, Mycobacterium avium subsp. paratuberculosis
cgcaucggcgacgcc

SEQ ID NO: 2933950 - RNA, 17 nt, Mycobacterium avium subsp. paratuberculosis
cgcaucggcgacgccgc

SEQ ID NO: 2933951 - RNA, 18 nt, Mycobacterium avium subsp. paratuberculosis
cgcaucggcgacgccgcc

SEQ ID NO: 2933952 - RNA, 19 nt, Mycobacterium avium subsp. paratuberculosis
cgcaucggcgacgccgccg

SEQ ID NO: 2933953 - RNA, 23 nt, Mycobacterium avium subsp. paratuberculosis
cgcaucggcgacgccgccgucgu

SEQ ID NO: 2933954 - RNA, 14 nt, Mycobacterium avium subsp. paratuberculosis
cgcaucggcgccgg

SEQ ID NO: 2933955 - RNA, 18 nt, Mycobacterium avium subsp. paratuberculosis
cgcaucggucaccagcuc

SEQ ID NO: 2933956 - RNA, 19 nt, Mycobacterium avium subsp. paratuberculosis
cgcaucggugagacgaccc

SEQ ID NO: 2933957 - RNA, 16 nt, Mycobacterium avium subsp. paratuberculosis
cgcaucgucgcggcgc

SEQ ID NO: 2933958 - RNA, 23 nt, Mycobacterium avium subsp. paratuberculosis
cgcaucgucgcggcgcuaaagcc

SEQ ID NO: 2933959 - RNA, 18 nt, Mycobacterium avium subsp. paratuberculosis
cgcaucguugccggcggc

SEQ ID NO: 2933960 - RNA, 20 nt, Mycobacterium avium subsp. paratuberculosis
cgcaucguugccggcggcga

SEQ ID NO: 2933961 - RNA, 22 nt, Mycobacterium avium subsp. paratuberculosis
cgcaucguugccggcggcgaag

SEQ ID NO: 2933962 - RNA, 19 nt, Mycobacterium avium subsp. paratuberculosis
cgcaucguugguccaggcg

SEQ ID NO: 2933963 - RNA, 19 nt, Mycobacterium avium subsp. paratuberculosis
cgcaucucgaaugcggcug

SEQ ID NO: 2933964 - RNA, 14 nt, Mycobacterium avium subsp. paratuberculosis
cgcaucugcucggc

SEQ ID NO: 2933965 - RNA, 18 nt, Mycobacterium avium subsp. paratuberculosis
cgcaucugcucggcgucc

SEQ ID NO: 2933966 - RNA, 19 nt, Mycobacterium avium subsp. paratuberculosis
cgcaucugguauucgaugg

SEQ ID NO: 2933967 - RNA, 19 nt, Mycobacterium avium subsp. paratuberculosis
cgcaugaccgauccgccgg

SEQ ID NO: 2933968 - RNA, 20 nt, Mycobacterium avium subsp. paratuberculosis
cgcaugacggccugcaccac

SEQ ID NO: 2933969 - RNA, 22 nt, Mycobacterium avium subsp. paratuberculosis
cgcaugacggccugcaccacca

SEQ ID NO: 2933970 - RNA, 20 nt, Mycobacterium avium subsp. paratuberculosis
cgcaugaugcccaggcccac

SEQ ID NO: 2933971 - RNA, 13 nt, Mycobacterium avium subsp. paratuberculosis
cgcaugcaccggu

SEQ ID NO: 2933972 - RNA, 18 nt, Mycobacterium avium subsp. paratuberculosis
cgcaugcaccggugcacc

SEQ ID NO: 2933973 - RNA, 19 nt, Mycobacterium avium subsp. paratuberculosis
cgcaugcaccggugcaccg

SEQ ID NO: 2933974 - RNA, 19 nt, Mycobacterium avium subsp. paratuberculosis
cgcaugccacuugcgcacg

SEQ ID NO: 2933975 - RNA, 13 nt, Mycobacterium avium subsp. paratuberculosis
cgcaugccagacc

SEQ ID NO: 2933976 - RNA, 16 nt, Mycobacterium avium subsp. paratuberculosis
cgcaugccagaccaca

SEQ ID NO: 2933977 - RNA, 16 nt, Mycobacterium avium subsp. paratuberculosis
cgcaugcccgggcgac

SEQ ID NO: 2933978 - RNA, 19 nt, Mycobacterium avium subsp. paratuberculosis
cgcaugcccuugucgcugg

SEQ ID NO: 2933979 - RNA, 22 nt, Mycobacterium avium subsp. paratuberculosis
cgcaugcuuccgaucaacggca

SEQ ID NO: 2933980 - RNA, 23 nt, Mycobacterium avium subsp. paratuberculosis
cgcauggagaugcuucagcccuc

SEQ ID NO: 2933981 - RNA, 21 nt, Mycobacterium avium subsp. paratuberculosis
cgcauggcgugcugaugcugu

SEQ ID NO: 2933982 - RNA, 22 nt, Mycobacterium avium subsp. paratuberculosis
cgcauggucagguaggcgucga

SEQ ID NO: 2933983 - RNA, 23 nt, Mycobacterium avium subsp. paratuberculosis
cgcauggugcggguguccgagcg

SEQ ID NO: 2933984 - RNA, 13 nt, Mycobacterium avium subsp. paratuberculosis
cgcauguccgccg

SEQ ID NO: 2933985 - RNA, 14 nt, Mycobacterium avium subsp. paratuberculosis
cgcauguccgccgu

SEQ ID NO: 2933986 - RNA, 15 nt, Mycobacterium avium subsp. paratuberculosis
cgcauguccggggug

SEQ ID NO: 2933987 - RNA, 22 nt, Mycobacterium avium subsp. paratuberculosis
cgcaugucgaccucggccacca

SEQ ID NO: 2933988 - RNA, 23 nt, Mycobacterium avium subsp. paratuberculosis
cgcaugucgaccucggccaccac

SEQ ID NO: 2933989 - RNA, 19 nt, Mycobacterium avium subsp. paratuberculosis
cgcauguucucgagcccga

SEQ ID NO: 2933990 - RNA, 17 nt, Mycobacterium avium subsp. paratuberculosis
cgcauguugugcccgac

SEQ ID NO: 2933991 - RNA, 19 nt, Mycobacterium avium subsp. paratuberculosis
cgcauguugugcccgacgg

SEQ ID NO: 2933992 - RNA, 20 nt, Mycobacterium avium subsp. paratuberculosis
cgcauguugugcccgacggc

SEQ ID NO: 2933993 - RNA, 22 nt, Mycobacterium avium subsp. paratuberculosis
cgcauguugugcccgacggcgc

SEQ ID NO: 2933994 - RNA, 15 nt, Mycobacterium avium subsp. paratuberculosis
cgcauucaccagcug

SEQ ID NO: 2933995 - RNA, 23 nt, Mycobacterium avium subsp. paratuberculosis
cgcauuccucggccagcucaccg

SEQ ID NO: 2933996 - RNA, 15 nt, Mycobacterium avium subsp. paratuberculosis
cgcauucggccgcca

SEQ ID NO: 2933997 - RNA, 18 nt, Mycobacterium avium subsp. paratuberculosis
cgcauucggccgccaccg

SEQ ID NO: 2933998 - RNA, 19 nt, Mycobacterium avium subsp. paratuberculosis
cgcauucggccgccaccga

SEQ ID NO: 2933999 - RNA, 13 nt, Mycobacterium avium subsp. paratuberculosis
cgcauucggcgac

SEQ ID NO: 2934000 - RNA, 14 nt, Mycobacterium avium subsp. paratuberculosis
cgcauucggcgacg

SEQ ID NO: 2934001 - RNA, 21 nt, Mycobacterium avium subsp. paratuberculosis
cgcauucggcgacgcucaggc

SEQ ID NO: 2934002 - RNA, 21 nt, Mycobacterium avium subsp. paratuberculosis
cgcauuggugccggccucguc

SEQ ID NO: 2934003 - RNA, 23 nt, Mycobacterium avium subsp. paratuberculosis
cgcauuggugccggccucgucgg

SEQ ID NO: 2934004 - RNA, 18 nt, Mycobacterium avium subsp. paratuberculosis
cgccaaaucgaucaccca

SEQ ID NO: 2934005 - RNA, 18 nt, Mycobacterium avium subsp. paratuberculosis
cgccaacaacucgacgcu

SEQ ID NO: 2934006 - RNA, 21 nt, Mycobacterium avium subsp. paratuberculosis
cgccaacagguuuccgaguug

SEQ ID NO: 2934007 - RNA, 13 nt, Mycobacterium avium subsp. paratuberculosis
cgccaaccagguc

SEQ ID NO: 2934008 - RNA, 19 nt, Mycobacterium avium subsp. paratuberculosis
cgccaaccaggucgcggcg

SEQ ID NO: 2934009 - RNA, 20 nt, Mycobacterium avium subsp. paratuberculosis
cgccaaccaggucgcggcgc

SEQ ID NO: 2934010 - RNA, 21 nt, Mycobacterium avium subsp. paratuberculosis
cgccaaccaggucgcggcgcu

SEQ ID NO: 2934011 - RNA, 24 nt, Mycobacterium avium subsp. paratuberculosis
cgccaacgaggcacggcccgcucg

SEQ ID NO: 2934012 - RNA, 20 nt, Mycobacterium avium subsp. paratuberculosis
cgccaacgcuuuugcggguc

SEQ ID NO: 2934013 - RNA, 23 nt, Mycobacterium avium subsp. paratuberculosis
cgccaacggauucagcgucgcca

SEQ ID NO: 2934014 - RNA, 21 nt, Mycobacterium avium subsp. paratuberculosis
cgccaacugaauuccuggccg

SEQ ID NO: 2934015 - RNA, 16 nt, Mycobacterium avium subsp. paratuberculosis
cgccaacugguccugc

SEQ ID NO: 2934016 - RNA, 21 nt, Mycobacterium avium subsp. paratuberculosis
cgccaacugguccugcggcug

SEQ ID NO: 2934017 - RNA, 15 nt, Mycobacterium avium subsp. paratuberculosis
cgccaaggcgcugug

SEQ ID NO: 2934018 - RNA, 14 nt, Mycobacterium avium subsp. paratuberculosis
cgccaagugcggug

SEQ ID NO: 2934019 - RNA, 18 nt, Mycobacterium avium subsp. paratuberculosis
cgccaccgagucgcgcga

SEQ ID NO: 2934020 - RNA, 21 nt, Mycobacterium avium subsp. paratuberculosis
cgccaccgagucgcgcgacca

SEQ ID NO: 2934021 - RNA, 22 nt, Mycobacterium avium subsp. paratuberculosis
cgccaccgagucgcgcgaccag

SEQ ID NO: 2934022 - RNA, 23 nt, Mycobacterium avium subsp. paratuberculosis
cgccaccgagucgcgcgaccagu

SEQ ID NO: 2934023 - RNA, 16 nt, Mycobacterium avium subsp. paratuberculosis
cgccaccgaugcgggc

SEQ ID NO: 2934024 - RNA, 19 nt, Mycobacterium avium subsp. paratuberculosis
cgccaccgaugcgggccag

SEQ ID NO: 2934025 - RNA, 18 nt, Mycobacterium avium subsp. paratuberculosis
cgccaccgcccgcugacc

SEQ ID NO: 2934026 - RNA, 11 nt, Mycobacterium avium subsp. paratuberculosis
cgccaccgcga

SEQ ID NO: 2934027 - RNA, 20 nt, Mycobacterium avium subsp. paratuberculosis
cgccaccgcgaaagcgucgg

SEQ ID NO: 2934028 - RNA, 21 nt, Mycobacterium avium subsp. paratuberculosis
cgccaccgcgaaagcgucggc

SEQ ID NO: 2934029 - RNA, 14 nt, Mycobacterium avium subsp. paratuberculosis
cgccaccgcgcaac

SEQ ID NO: 2934030 - RNA, 21 nt, Mycobacterium avium subsp. paratuberculosis
cgccaccgcgcaaccgggccg

SEQ ID NO: 2934031 - RNA, 13 nt, Mycobacterium avium subsp. paratuberculosis
cgccaccgcgggg

SEQ ID NO: 2934032 - RNA, 19 nt, Mycobacterium avium subsp. paratuberculosis
cgccaccgcggggcugggc

SEQ ID NO: 2934033 - RNA, 15 nt, Mycobacterium avium subsp. paratuberculosis
cgccaccggcccggc

SEQ ID NO: 2934034 - RNA, 17 nt, Mycobacterium avium subsp. paratuberculosis
cgccaccggcccggccg

SEQ ID NO: 2934035 - RNA, 18 nt, Mycobacterium avium subsp. paratuberculosis
cgccaccggcccggccgg

SEQ ID NO: 2934036 - RNA, 12 nt, Mycobacterium avium subsp. paratuberculosis
cgccaccggccg

SEQ ID NO: 2934037 - RNA, 16 nt, Mycobacterium avium subsp. paratuberculosis
cgccaccggccggucc

SEQ ID NO: 2934038 - RNA, 17 nt, Mycobacterium avium subsp. paratuberculosis
cgccaccggccgguccg

SEQ ID NO: 2934039 - RNA, 20 nt, Mycobacterium avium subsp. paratuberculosis
cgccaccggccgguccgccc

SEQ ID NO: 2934040 - RNA, 12 nt, Mycobacterium avium subsp. paratuberculosis
cgccaccggcug

SEQ ID NO: 2934041 - RNA, 16 nt, Mycobacterium avium subsp. paratuberculosis
cgccaccggcuggccg

SEQ ID NO: 2934042 - RNA, 20 nt, Mycobacterium avium subsp. paratuberculosis
cgccaccgggaccugcugcu

SEQ ID NO: 2934043 - RNA, 14 nt, Mycobacterium avium subsp. paratuberculosis
cgccaccgucgccg

SEQ ID NO: 2934044 - RNA, 15 nt, Mycobacterium avium subsp. paratuberculosis
cgccaccgucgccgg

SEQ ID NO: 2934045 - RNA, 19 nt, Mycobacterium avium subsp. paratuberculosis
cgccaccgucgccggcuga

SEQ ID NO: 2934046 - RNA, 13 nt, Mycobacterium avium subsp. paratuberculosis
cgccaccgucguc

SEQ ID NO: 2934047 - RNA, 14 nt, Mycobacterium avium subsp. paratuberculosis
cgccaccgucgucg

SEQ ID NO: 2934048 - RNA, 13 nt, Mycobacterium avium subsp. paratuberculosis
cgccaccuccucc

SEQ ID NO: 2934049 - RNA, 14 nt, Mycobacterium avium subsp. paratuberculosis
cgccaccuccuccg

SEQ ID NO: 2934050 - RNA, 15 nt, Mycobacterium avium subsp. paratuberculosis
cgccaccuccuccgg

SEQ ID NO: 2934051 - RNA, 18 nt, Mycobacterium avium subsp. paratuberculosis
cgccaccuccuccggucc

SEQ ID NO: 2934052 - RNA, 14 nt, Mycobacterium avium subsp. paratuberculosis
cgccaccucgagcu

SEQ ID NO: 2934053 - RNA, 16 nt, Mycobacterium avium subsp. paratuberculosis
cgccaccucggagaug

SEQ ID NO: 2934054 - RNA, 22 nt, Mycobacterium avium subsp. paratuberculosis
cgccaccucggagaugauggcc

SEQ ID NO: 2934055 - RNA, 23 nt, Mycobacterium avium subsp. paratuberculosis
cgccaccucggagaugauggccg

SEQ ID NO: 2934056 - RNA, 18 nt, Mycobacterium avium subsp. paratuberculosis
cgccaccuggaagcgcau

SEQ ID NO: 2934057 - RNA, 13 nt, Mycobacterium avium subsp. paratuberculosis
cgccaccuucacc

SEQ ID NO: 2934058 - RNA, 14 nt, Mycobacterium avium subsp. paratuberculosis
cgccaccuucaccg

SEQ ID NO: 2934059 - RNA, 17 nt, Mycobacterium avium subsp. paratuberculosis
cgccaccuucaccgcgc

SEQ ID NO: 2934060 - RNA, 20 nt, Mycobacterium avium subsp. paratuberculosis
cgccaccuucaccgcgccgg

SEQ ID NO: 2934061 - RNA, 21 nt, Mycobacterium avium subsp. paratuberculosis
cgccacgacauccccgcaaac

SEQ ID NO: 2934062 - RNA, 14 nt, Mycobacterium avium subsp. paratuberculosis
cgccacgaccagcg

SEQ ID NO: 2934063 - RNA, 16 nt, Mycobacterium avium subsp. paratuberculosis
cgccacgaccagcggc

SEQ ID NO: 2934064 - RNA, 18 nt, Mycobacterium avium subsp. paratuberculosis
cgccacgacugcgcggcc

SEQ ID NO: 2934065 - RNA, 21 nt, Mycobacterium avium subsp. paratuberculosis
cgccacgacugcgcggccggc

SEQ ID NO: 2934066 - RNA, 14 nt, Mycobacterium avium subsp. paratuberculosis
cgccacgaucacca

SEQ ID NO: 2934067 - RNA, 18 nt, Mycobacterium avium subsp. paratuberculosis
cgccacgaucaccaccac

SEQ ID NO: 2934068 - RNA, 20 nt, Mycobacterium avium subsp. paratuberculosis
cgccacgaucaccaccaccg

SEQ ID NO: 2934069 - RNA, 13 nt, Mycobacterium avium subsp. paratuberculosis
cgccacgaucugg

SEQ ID NO: 2934070 - RNA, 16 nt, Mycobacterium avium subsp. paratuberculosis
cgccacgcacaccgcg

SEQ ID NO: 2934071 - RNA, 20 nt, Mycobacterium avium subsp. paratuberculosis
cgccacgcacaccgcgcgca

SEQ ID NO: 2934072 - RNA, 14 nt, Mycobacterium avium subsp. paratuberculosis
cgccacgccccggc

SEQ ID NO: 2934073 - RNA, 15 nt, Mycobacterium avium subsp. paratuberculosis
cgccacgccccggcg

SEQ ID NO: 2934074 - RNA, 16 nt, Mycobacterium avium subsp. paratuberculosis
cgccacgccccggcgc

SEQ ID NO: 2934075 - RNA, 18 nt, Mycobacterium avium subsp. paratuberculosis
cgccacgccccggcgccg

SEQ ID NO: 2934076 - RNA, 15 nt, Mycobacterium avium subsp. paratuberculosis
cgccacgcccgcagc

SEQ ID NO: 2934077 - RNA, 16 nt, Mycobacterium avium subsp. paratuberculosis
cgccacgcccgcagcg

SEQ ID NO: 2934078 - RNA, 18 nt, Mycobacterium avium subsp. paratuberculosis
cgccacgcccgcagcgca

SEQ ID NO: 2934079 - RNA, 23 nt, Mycobacterium avium subsp. paratuberculosis
cgccacgcccgcagcgcaucggu

SEQ ID NO: 2934080 - RNA, 13 nt, Mycobacterium avium subsp. paratuberculosis
cgccacgccgacc

SEQ ID NO: 2934081 - RNA, 14 nt, Mycobacterium avium subsp. paratuberculosis
cgccacgccgacca

SEQ ID NO: 2934082 - RNA, 15 nt, Mycobacterium avium subsp. paratuberculosis
cgccacgccgaccag

SEQ ID NO: 2934083 - RNA, 20 nt, Mycobacterium avium subsp. paratuberculosis
cgccacgccgcccccgccgc

SEQ ID NO: 2934084 - RNA, 13 nt, Mycobacterium avium subsp. paratuberculosis
cgccacgccgcga

SEQ ID NO: 2934085 - RNA, 15 nt, Mycobacterium avium subsp. paratuberculosis
cgccacgccgcgauc

SEQ ID NO: 2934086 - RNA, 17 nt, Mycobacterium avium subsp. paratuberculosis
cgccacgccgcgauccg

SEQ ID NO: 2934087 - RNA, 19 nt, Mycobacterium avium subsp. paratuberculosis
cgccacgccguggcccgcc

SEQ ID NO: 2934088 - RNA, 20 nt, Mycobacterium avium subsp. paratuberculosis
cgccacgccguggcccgccc

SEQ ID NO: 2934089 - RNA, 17 nt, Mycobacterium avium subsp. paratuberculosis
cgccacgcgcagggcga

SEQ ID NO: 2934090 - RNA, 13 nt, Mycobacterium avium subsp. paratuberculosis
cgccacgcggcgc

SEQ ID NO: 2934091 - RNA, 14 nt, Mycobacterium avium subsp. paratuberculosis
cgccacgcggcgcg

SEQ ID NO: 2934092 - RNA, 15 nt, Mycobacterium avium subsp. paratuberculosis
cgccacgcggcgcgc

SEQ ID NO: 2934093 - RNA, 14 nt, Mycobacterium avium subsp. paratuberculosis
cgccacgcgucagg

SEQ ID NO: 2934094 - RNA, 16 nt, Mycobacterium avium subsp. paratuberculosis
cgccacgcgucaggcg

SEQ ID NO: 2934095 - RNA, 20 nt, Mycobacterium avium subsp. paratuberculosis
cgccacgcgucaggcgucgu

SEQ ID NO: 2934096 - RNA, 12 nt, Mycobacterium avium subsp. paratuberculosis
cgccacgcuggu

SEQ ID NO: 2934097 - RNA, 22 nt, Mycobacterium avium subsp. paratuberculosis
cgccacgcuggugugacgcucg

SEQ ID NO: 2934098 - RNA, 13 nt, Mycobacterium avium subsp. paratuberculosis
cgccacggcacgu

SEQ ID NO: 2934099 - RNA, 15 nt, Mycobacterium avium subsp. paratuberculosis
cgccacggcacgucg

SEQ ID NO: 2934100 - RNA, 18 nt, Mycobacterium avium subsp. paratuberculosis
cgccacggcacgucgagg

SEQ ID NO: 2934101 - RNA, 12 nt, Mycobacterium avium subsp. paratuberculosis
cgccacggccac

SEQ ID NO: 2934102 - RNA, 17 nt, Mycobacterium avium subsp. paratuberculosis
cgccacggccaccgccg

SEQ ID NO: 2934103 - RNA, 14 nt, Mycobacterium avium subsp. paratuberculosis
cgccacggccagca

SEQ ID NO: 2934104 - RNA, 17 nt, Mycobacterium avium subsp. paratuberculosis
cgccagcaaccccgcgg

SEQ ID NO: 2934105 - RNA, 22 nt, Mycobacterium avium subsp. paratuberculosis
cgccagcaaccccgcggugcac

SEQ ID NO: 2934106 - RNA, 15 nt, Mycobacterium avium subsp. paratuberculosis
cgccagcaacgaccc

SEQ ID NO: 2934107 - RNA, 18 nt, Mycobacterium avium subsp. paratuberculosis
cgccagcaacgacccggc

SEQ ID NO: 2934108 - RNA, 19 nt, Mycobacterium avium subsp. paratuberculosis
cgccagcaacgacccggcc

SEQ ID NO: 2934109 - RNA, 20 nt, Mycobacterium avium subsp. paratuberculosis
cgccagcaacgacccggcca

SEQ ID NO: 2934110 - RNA, 21 nt, Mycobacterium avium subsp. paratuberculosis
cgccagcaacgacccggccac

SEQ ID NO: 2934111 - RNA, 14 nt, Mycobacterium avium subsp. paratuberculosis
cgccagcaccaccu

SEQ ID NO: 2934112 - RNA, 22 nt, Mycobacterium avium subsp. paratuberculosis
cgccagcaccaccucgcgcggg

SEQ ID NO: 2934113 - RNA, 14 nt, Mycobacterium avium subsp. paratuberculosis
cgccagcaccgacg

SEQ ID NO: 2934114 - RNA, 15 nt, Mycobacterium avium subsp. paratuberculosis
cgccagcaccgccac

SEQ ID NO: 2934115 - RNA, 19 nt, Mycobacterium avium subsp. paratuberculosis
cgccagcaccgccaccggc

SEQ ID NO: 2934116 - RNA, 22 nt, Mycobacterium avium subsp. paratuberculosis
cgccagcaccgccaccggcccg

SEQ ID NO: 2934117 - RNA, 24 nt, Mycobacterium avium subsp. paratuberculosis
cgccagcaccgccaccggcccggc

SEQ ID NO: 2934118 - RNA, 18 nt, Mycobacterium avium subsp. paratuberculosis
cgccagcaccgcgggggc

SEQ ID NO: 2934119 - RNA, 13 nt, Mycobacterium avium subsp. paratuberculosis
cgccagcaccggc

SEQ ID NO: 2934120 - RNA, 15 nt, Mycobacterium avium subsp. paratuberculosis
cgccagcaccggcgc

SEQ ID NO: 2934121 - RNA, 19 nt, Mycobacterium avium subsp. paratuberculosis
cgccagcaccggcgcgccg

SEQ ID NO: 2934122 - RNA, 22 nt, Mycobacterium avium subsp. paratuberculosis
cgccagcaccgggcccagcucg

SEQ ID NO: 2934123 - RNA, 16 nt, Mycobacterium avium subsp. paratuberculosis
cgccagcaccucgaac

SEQ ID NO: 2934124 - RNA, 22 nt, Mycobacterium avium subsp. paratuberculosis
cgccagcaccucgaacgccggu

SEQ ID NO: 2934125 - RNA, 17 nt, Mycobacterium avium subsp. paratuberculosis
cgccagcaccucgcggc

SEQ ID NO: 2934126 - RNA, 20 nt, Mycobacterium avium subsp. paratuberculosis
cgccagcaccucgcggcagc

SEQ ID NO: 2934127 - RNA, 19 nt, Mycobacterium avium subsp. paratuberculosis
cgccagcaccucggcgacc

SEQ ID NO: 2934128 - RNA, 15 nt, Mycobacterium avium subsp. paratuberculosis
cgccagcacggccac

SEQ ID NO: 2934129 - RNA, 16 nt, Mycobacterium avium subsp. paratuberculosis
cgccagcacggccacc

SEQ ID NO: 2934130 - RNA, 20 nt, Mycobacterium avium subsp. paratuberculosis
cgccagcacggccaccagca

SEQ ID NO: 2934131 - RNA, 24 nt, Mycobacterium avium subsp. paratuberculosis
cgccagcacggccaccagcagcga

SEQ ID NO: 2934132 - RNA, 14 nt, Mycobacterium avium subsp. paratuberculosis
cgccagcacgugau

SEQ ID NO: 2934133 - RNA, 14 nt, Mycobacterium avium subsp. paratuberculosis
cgccagcacguggc

SEQ ID NO: 2934134 - RNA, 20 nt, Mycobacterium avium subsp. paratuberculosis
cgccagcacguggccgggcu

SEQ ID NO: 2934135 - RNA, 22 nt, Mycobacterium avium subsp. paratuberculosis
cgccagcacguggccgggcucg

SEQ ID NO: 2934136 - RNA, 23 nt, Mycobacterium avium subsp. paratuberculosis
cgccagcacguggccgggcucga

SEQ ID NO: 2934137 - RNA, 16 nt, Mycobacterium avium subsp. paratuberculosis
cgccagcagaugccgc

SEQ ID NO: 2934138 - RNA, 19 nt, Mycobacterium avium subsp. paratuberculosis
cgccagcagaugccgccca

SEQ ID NO: 2934139 - RNA, 22 nt, Mycobacterium avium subsp. paratuberculosis
cgccagcagaugccgcccaggu

SEQ ID NO: 2934140 - RNA, 11 nt, Mycobacterium avium subsp. paratuberculosis
cgccagcagca

SEQ ID NO: 2934141 - RNA, 14 nt, Mycobacterium avium subsp. paratuberculosis
cgccagcagcaccu

SEQ ID NO: 2934142 - RNA, 16 nt, Mycobacterium avium subsp. paratuberculosis
cgccagcagcacggca

SEQ ID NO: 2934143 - RNA, 19 nt, Mycobacterium avium subsp. paratuberculosis
cgccagcagcacggcaaug

SEQ ID NO: 2934144 - RNA, 15 nt, Mycobacterium avium subsp. paratuberculosis
cgccagcagcagccg

SEQ ID NO: 2934145 - RNA, 18 nt, Mycobacterium avium subsp. paratuberculosis
cgccagcagcagccgcgc

SEQ ID NO: 2934146 - RNA, 20 nt, Mycobacterium avium subsp. paratuberculosis
cgccagcagcagccgcgccg

SEQ ID NO: 2934147 - RNA, 22 nt, Mycobacterium avium subsp. paratuberculosis
cgccagcagcagccgcgccgcc

SEQ ID NO: 2934148 - RNA, 14 nt, Mycobacterium avium subsp. paratuberculosis
cgccagcagcagcg

SEQ ID NO: 2934149 - RNA, 17 nt, Mycobacterium avium subsp. paratuberculosis
cgccagcagcagcgccg

SEQ ID NO: 2934150 - RNA, 18 nt, Mycobacterium avium subsp. paratuberculosis
cgccagcagcagcgccgc

SEQ ID NO: 2934151 - RNA, 22 nt, Mycobacterium avium subsp. paratuberculosis
cgccagcagcagcgccgccacc

SEQ ID NO: 2934152 - RNA, 20 nt, Mycobacterium avium subsp. paratuberculosis
cgccagcagcagcgcggcau

SEQ ID NO: 2934153 - RNA, 21 nt, Mycobacterium avium subsp. paratuberculosis
cgccagcagcagcgcggcaug

SEQ ID NO: 2934154 - RNA, 11 nt, Mycobacterium avium subsp. paratuberculosis
cgccagcagcc

SEQ ID NO: 2934155 - RNA, 12 nt, Mycobacterium avium subsp. paratuberculosis
cgccagcagccg

SEQ ID NO: 2934156 - RNA, 14 nt, Mycobacterium avium subsp. paratuberculosis
cgccagcagcgccg

SEQ ID NO: 2934157 - RNA, 15 nt, Mycobacterium avium subsp. paratuberculosis
cgccagcagcgccgc

SEQ ID NO: 2934158 - RNA, 16 nt, Mycobacterium avium subsp. paratuberculosis
cgccagcagcgcgccg

SEQ ID NO: 2934159 - RNA, 20 nt, Mycobacterium avium subsp. paratuberculosis
cgccagcagcgcgccgcgcu

SEQ ID NO: 2934160 - RNA, 14 nt, Mycobacterium avium subsp. paratuberculosis
cgccagcagcggca

SEQ ID NO: 2934161 - RNA, 16 nt, Mycobacterium avium subsp. paratuberculosis
cgccagcagcggcacc

SEQ ID NO: 2934162 - RNA, 17 nt, Mycobacterium avium subsp. paratuberculosis
cgccagcagcggcaccc

SEQ ID NO: 2934163 - RNA, 19 nt, Mycobacterium avium subsp. paratuberculosis
cgccagcagggcaucuccc

SEQ ID NO: 2934164 - RNA, 22 nt, Mycobacterium avium subsp. paratuberculosis
cgccagcagggcaucucccgcg

SEQ ID NO: 2934165 - RNA, 23 nt, Mycobacterium avium subsp. paratuberculosis
cgccagcagggcaucucccgcgc

SEQ ID NO: 2934166 - RNA, 18 nt, Mycobacterium avium subsp. paratuberculosis
cgccagcaguguccaguc

SEQ ID NO: 2934167 - RNA, 20 nt, Mycobacterium avium subsp. paratuberculosis
cgccagcaguguccagucgg

SEQ ID NO: 2934168 - RNA, 20 nt, Mycobacterium avium subsp. paratuberculosis
cgccagcaucgagaugcugu

SEQ ID NO: 2934169 - RNA, 22 nt, Mycobacterium avium subsp. paratuberculosis
cgccagcaugcgaugaccaccc

SEQ ID NO: 2934170 - RNA, 13 nt, Mycobacterium avium subsp. paratuberculosis
cgccagccaccac

SEQ ID NO: 2934171 - RNA, 14 nt, Mycobacterium avium subsp. paratuberculosis
cgccagccagaaca

SEQ ID NO: 2934172 - RNA, 24 nt, Mycobacterium avium subsp. paratuberculosis
cgccagccagccggugcggucggc

SEQ ID NO: 2934173 - RNA, 14 nt, Mycobacterium avium subsp. paratuberculosis
cgccagccaggcga

SEQ ID NO: 2934174 - RNA, 16 nt, Mycobacterium avium subsp. paratuberculosis
cgccagccccaccggc

SEQ ID NO: 2934175 - RNA, 18 nt, Mycobacterium avium subsp. paratuberculosis
cgccagccccaccggcca

SEQ ID NO: 2934176 - RNA, 19 nt, Mycobacterium avium subsp. paratuberculosis
cgccagccccaccggccac

SEQ ID NO: 2934177 - RNA, 21 nt, Mycobacterium avium subsp. paratuberculosis
cgccagcccgaaaguccccgg

SEQ ID NO: 2934178 - RNA, 12 nt, Mycobacterium avium subsp. paratuberculosis
cgccagcccgcc

SEQ ID NO: 2934179 - RNA, 13 nt, Mycobacterium avium subsp. paratuberculosis
cgccagcccgccc

SEQ ID NO: 2934180 - RNA, 14 nt, Mycobacterium avium subsp. paratuberculosis
cgccagcccgccca

SEQ ID NO: 2934181 - RNA, 15 nt, Mycobacterium avium subsp. paratuberculosis
cgccagcccgcccag

SEQ ID NO: 2934182 - RNA, 16 nt, Mycobacterium avium subsp. paratuberculosis
cgccagcccgcccagc

SEQ ID NO: 2934183 - RNA, 17 nt, Mycobacterium avium subsp. paratuberculosis
cgccagcccgcccagcg

SEQ ID NO: 2934184 - RNA, 19 nt, Mycobacterium avium subsp. paratuberculosis
cgccagcccgcccagcgcc

SEQ ID NO: 2934185 - RNA, 20 nt, Mycobacterium avium subsp. paratuberculosis
cgccagcccgcccagcgcca

SEQ ID NO: 2934186 - RNA, 16 nt, Mycobacterium avium subsp. paratuberculosis
cgccagcccgccgaac

SEQ ID NO: 2934187 - RNA, 18 nt, Mycobacterium avium subsp. paratuberculosis
cgccagcccgccgaacca

SEQ ID NO: 2934188 - RNA, 19 nt, Mycobacterium avium subsp. paratuberculosis
cgccagcggcagcgccagc

SEQ ID NO: 2934189 - RNA, 12 nt, Mycobacterium avium subsp. paratuberculosis
cgccagcggccg

SEQ ID NO: 2934190 - RNA, 14 nt, Mycobacterium avium subsp. paratuberculosis
cgccagcggccgau

SEQ ID NO: 2934191 - RNA, 20 nt, Mycobacterium avium subsp. paratuberculosis
cgccagcggcuugccguugu

SEQ ID NO: 2934192 - RNA, 14 nt, Mycobacterium avium subsp. paratuberculosis
cgccagcgggccga

SEQ ID NO: 2934193 - RNA, 15 nt, Mycobacterium avium subsp. paratuberculosis
cgccagcgggccgac

SEQ ID NO: 2934194 - RNA, 21 nt, Mycobacterium avium subsp. paratuberculosis
cgccagcgggccgugccgcca

SEQ ID NO: 2934195 - RNA, 23 nt, Mycobacterium avium subsp. paratuberculosis
cgccagcggguguguuugggcag

SEQ ID NO: 2934196 - RNA, 13 nt, Mycobacterium avium subsp. paratuberculosis
cgccagcggucca

SEQ ID NO: 2934197 - RNA, 16 nt, Mycobacterium avium subsp. paratuberculosis
cgccagcgucugcugc

SEQ ID NO: 2934198 - RNA, 18 nt, Mycobacterium avium subsp. paratuberculosis
cgccagcgucugcugcgc

SEQ ID NO: 2934199 - RNA, 20 nt, Mycobacterium avium subsp. paratuberculosis
cgccagcgugaacagcgccc

SEQ ID NO: 2934200 - RNA, 17 nt, Mycobacterium avium subsp. paratuberculosis
cgccagcgugacgcccg

SEQ ID NO: 2934201 - RNA, 21 nt, Mycobacterium avium subsp. paratuberculosis
cgccagcgugacgcccggcgc

SEQ ID NO: 2934202 - RNA, 22 nt, Mycobacterium avium subsp. paratuberculosis
cgccagcgugacgcccggcgcc

SEQ ID NO: 2934203 - RNA, 18 nt, Mycobacterium avium subsp. paratuberculosis
cgccagcgugacgccggg

SEQ ID NO: 2934204 - RNA, 19 nt, Mycobacterium avium subsp. paratuberculosis
cgccagcgugacgccgggc

SEQ ID NO: 2934205 - RNA, 20 nt, Mycobacterium avium subsp. paratuberculosis
cgccagcgugacgccgggcc

SEQ ID NO: 2934206 - RNA, 21 nt, Mycobacterium avium subsp. paratuberculosis
cgccagcgugacgccgggccg

SEQ ID NO: 2934207 - RNA, 20 nt, Mycobacterium avium subsp. paratuberculosis
cgccagcgugacgcucgggc

SEQ ID NO: 2934208 - RNA, 13 nt, Mycobacterium avium subsp. paratuberculosis
cgccagcgugagc

SEQ ID NO: 2934209 - RNA, 19 nt, Mycobacterium avium subsp. paratuberculosis
cgccagcguggccagcacc

SEQ ID NO: 2934210 - RNA, 13 nt, Mycobacterium avium subsp. paratuberculosis
cgccagcguggcg

SEQ ID NO: 2934211 - RNA, 16 nt, Mycobacterium avium subsp. paratuberculosis
cgccagcguggcgaac

SEQ ID NO: 2934212 - RNA, 23 nt, Mycobacterium avium subsp. paratuberculosis
cgccagcguggcgaacgcgaccu

SEQ ID NO: 2934213 - RNA, 14 nt, Mycobacterium avium subsp. paratuberculosis
cgccagcuccagca

SEQ ID NO: 2934214 - RNA, 15 nt, Mycobacterium avium subsp. paratuberculosis
cgccagcuccagcag

SEQ ID NO: 2934215 - RNA, 16 nt, Mycobacterium avium subsp. paratuberculosis
cgccagcuccagcagc

SEQ ID NO: 2934216 - RNA, 17 nt, Mycobacterium avium subsp. paratuberculosis
cgccagcuccagcagcc

SEQ ID NO: 2934217 - RNA, 19 nt, Mycobacterium avium subsp. paratuberculosis
cgccagcuccagcagcccg

SEQ ID NO: 2934218 - RNA, 15 nt, Mycobacterium avium subsp. paratuberculosis
cgccagcucggcggc

SEQ ID NO: 2934219 - RNA, 18 nt, Mycobacterium avium subsp. paratuberculosis
cgccagcucggcggccgg

SEQ ID NO: 2934220 - RNA, 16 nt, Mycobacterium avium subsp. paratuberculosis
cgccagcucguccagc

SEQ ID NO: 2934221 - RNA, 22 nt, Mycobacterium avium subsp. paratuberculosis
cgccagcucguccagcgugccg

SEQ ID NO: 2934222 - RNA, 14 nt, Mycobacterium avium subsp. paratuberculosis
cgccagcugccgcg

SEQ ID NO: 2934223 - RNA, 15 nt, Mycobacterium avium subsp. paratuberculosis
cgccagcugccgcga

SEQ ID NO: 2934224 - RNA, 17 nt, Mycobacterium avium subsp. paratuberculosis
cgccagcugcggaucgg

SEQ ID NO: 2934225 - RNA, 18 nt, Mycobacterium avium subsp. paratuberculosis
cgccagcugcggaucggg

SEQ ID NO: 2934226 - RNA, 19 nt, Mycobacterium avium subsp. paratuberculosis
cgccagcugcggaucgggc

SEQ ID NO: 2934227 - RNA, 22 nt, Mycobacterium avium subsp. paratuberculosis
cgccagcugcggaucgggcgug

SEQ ID NO: 2934228 - RNA, 14 nt, Mycobacterium avium subsp. paratuberculosis
cgccagcugggcag

SEQ ID NO: 2934229 - RNA, 17 nt, Mycobacterium avium subsp. paratuberculosis
cgccagcugggcagcca

SEQ ID NO: 2934230 - RNA, 22 nt, Mycobacterium avium subsp. paratuberculosis
cgccagcuggguggucaccagc

SEQ ID NO: 2934231 - RNA, 23 nt, Mycobacterium avium subsp. paratuberculosis
cgccagcuggguggucaccagcg

SEQ ID NO: 2934232 - RNA, 17 nt, Mycobacterium avium subsp. paratuberculosis
cgccaggaaccacaccc

SEQ ID NO: 2934233 - RNA, 22 nt, Mycobacterium avium subsp. paratuberculosis
cgccaggaagacguaggcggcc

SEQ ID NO: 2934234 - RNA, 16 nt, Mycobacterium avium subsp. paratuberculosis
cgccaggaaggccagu

SEQ ID NO: 2934235 - RNA, 21 nt, Mycobacterium avium subsp. paratuberculosis
cgccaggaauaacgccggccc

SEQ ID NO: 2934236 - RNA, 16 nt, Mycobacterium avium subsp. paratuberculosis
cgccaggaccacccac

SEQ ID NO: 2934237 - RNA, 15 nt, Mycobacterium avium subsp. paratuberculosis
cgccaggaccagcgg

SEQ ID NO: 2934238 - RNA, 16 nt, Mycobacterium avium subsp. paratuberculosis
cgccaggaccagcggg

SEQ ID NO: 2934239 - RNA, 19 nt, Mycobacterium avium subsp. paratuberculosis
cgccaggaccagcgggucg

SEQ ID NO: 2934240 - RNA, 17 nt, Mycobacterium avium subsp. paratuberculosis
cgccaggauccgcccgc

SEQ ID NO: 2934241 - RNA, 22 nt, Mycobacterium avium subsp. paratuberculosis
cgccaggauccgcccgccggug

SEQ ID NO: 2934242 - RNA, 14 nt, Mycobacterium avium subsp. paratuberculosis
cgccaggaucugcu

SEQ ID NO: 2934243 - RNA, 19 nt, Mycobacterium avium subsp. paratuberculosis
cgccaggaucugcucggcg

SEQ ID NO: 2934244 - RNA, 20 nt, Mycobacterium avium subsp. paratuberculosis
cgccaggaucugcucggcgu

SEQ ID NO: 2934245 - RNA, 22 nt, Mycobacterium avium subsp. paratuberculosis
cgccaggaucugcucggcgucg

SEQ ID NO: 2934246 - RNA, 22 nt, Mycobacterium avium subsp. paratuberculosis
cgccaggauguacccgcaggcc

SEQ ID NO: 2934247 - RNA, 18 nt, Mycobacterium avium subsp. paratuberculosis
cgccaggcagaagcucca

SEQ ID NO: 2934248 - RNA, 21 nt, Mycobacterium avium subsp. paratuberculosis
cgccaggcagaagcuccacgc

SEQ ID NO: 2934249 - RNA, 12 nt, Mycobacterium avium subsp. paratuberculosis
cgccaggcaggc

SEQ ID NO: 2934250 - RNA, 18 nt, Mycobacterium avium subsp. paratuberculosis
cgccaggcaggcggccag

SEQ ID NO: 2934251 - RNA, 14 nt, Mycobacterium avium subsp. paratuberculosis
cgccaggccaccgc

SEQ ID NO: 2934252 - RNA, 20 nt, Mycobacterium avium subsp. paratuberculosis
cgccaggccauggcgcaccg

SEQ ID NO: 2934253 - RNA, 16 nt, Mycobacterium avium subsp. paratuberculosis
cgccaggccggcgacg

SEQ ID NO: 2934254 - RNA, 21 nt, Mycobacterium avium subsp. paratuberculosis
cgccaggccggcgacgccggc

SEQ ID NO: 2934255 - RNA, 17 nt, Mycobacterium avium subsp. paratuberculosis
cgccaggcggcgacgaa

SEQ ID NO: 2934256 - RNA, 18 nt, Mycobacterium avium subsp. paratuberculosis
cgccaggcuggccaggcu

SEQ ID NO: 2934257 - RNA, 24 nt, Mycobacterium avium subsp. paratuberculosis
cgccaggcuggccaggcuggcguc

SEQ ID NO: 2934258 - RNA, 15 nt, Mycobacterium avium subsp. paratuberculosis
cgccagggccccguu

SEQ ID NO: 2934259 - RNA, 17 nt, Mycobacterium avium subsp. paratuberculosis
cgccagggcgacgccgc

SEQ ID NO: 2934260 - RNA, 14 nt, Mycobacterium avium subsp. paratuberculosis
cgccagggcgcggc

SEQ ID NO: 2934261 - RNA, 15 nt, Mycobacterium avium subsp. paratuberculosis
cgccagggcgcggcg

SEQ ID NO: 2934262 - RNA, 16 nt, Mycobacterium avium subsp. paratuberculosis
cgccagggcgcggcgc

SEQ ID NO: 2934263 - RNA, 20 nt, Mycobacterium avium subsp. paratuberculosis
cgccagggcgcggcgcaccg

SEQ ID NO: 2934264 - RNA, 19 nt, Mycobacterium avium subsp. paratuberculosis
cgccagggucucgggcagc

SEQ ID NO: 2934265 - RNA, 21 nt, Mycobacterium avium subsp. paratuberculosis
cgccagggucucgggcagcag

SEQ ID NO: 2934266 - RNA, 23 nt, Mycobacterium avium subsp. paratuberculosis
cgccagggucucgggcagcagca

SEQ ID NO: 2934267 - RNA, 14 nt, Mycobacterium avium subsp. paratuberculosis
cgccagggucuggc

SEQ ID NO: 2934268 - RNA, 18 nt, Mycobacterium avium subsp. paratuberculosis
cgccagggucuggcccgg

SEQ ID NO: 2934269 - RNA, 19 nt, Mycobacterium avium subsp. paratuberculosis
cgccagggucuggcccggu

SEQ ID NO: 2934270 - RNA, 16 nt, Mycobacterium avium subsp. paratuberculosis
cgccagggugccgcug

SEQ ID NO: 2934271 - RNA, 17 nt, Mycobacterium avium subsp. paratuberculosis
cgccagggugccgcugc

SEQ ID NO: 2934272 - RNA, 17 nt, Mycobacterium avium subsp. paratuberculosis
cgccaugaacucgucca

SEQ ID NO: 2934273 - RNA, 23 nt, Mycobacterium avium subsp. paratuberculosis
cgccaugaacucguccaccgaca

SEQ ID NO: 2934274 - RNA, 14 nt, Mycobacterium avium subsp. paratuberculosis
cgccaugccgccga

SEQ ID NO: 2934275 - RNA, 15 nt, Mycobacterium avium subsp. paratuberculosis
cgccaugccgccgac

SEQ ID NO: 2934276 - RNA, 18 nt, Mycobacterium avium subsp. paratuberculosis
cgccaugccgccgaccgc

SEQ ID NO: 2934277 - RNA, 13 nt, Mycobacterium avium subsp. paratuberculosis
cgccaugccgucg

SEQ ID NO: 2934278 - RNA, 16 nt, Mycobacterium avium subsp. paratuberculosis
cgccaugccgucgcgc

SEQ ID NO: 2934279 - RNA, 20 nt, Mycobacterium avium subsp. paratuberculosis
cgccaugccgucgcgcaccg

SEQ ID NO: 2934280 - RNA, 14 nt, Mycobacterium avium subsp. paratuberculosis
cgccaugcgaccac

SEQ ID NO: 2934281 - RNA, 17 nt, Mycobacterium avium subsp. paratuberculosis
cgccaugcgaccacgac

SEQ ID NO: 2934282 - RNA, 23 nt, Mycobacterium avium subsp. paratuberculosis
cgccaugcgaccacgaccggguc

SEQ ID NO: 2934283 - RNA, 16 nt, Mycobacterium avium subsp. paratuberculosis
cgccauggcccacgac

SEQ ID NO: 2934284 - RNA, 20 nt, Mycobacterium avium subsp. paratuberculosis
cgccauggcggcauccccag

SEQ ID NO: 2934285 - RNA, 19 nt, Mycobacterium avium subsp. paratuberculosis
cgccaugggcaucgucucg

SEQ ID NO: 2934286 - RNA, 19 nt, Mycobacterium avium subsp. paratuberculosis
cgccauguacagaccccac

SEQ ID NO: 2934287 - RNA, 17 nt, Mycobacterium avium subsp. paratuberculosis
cgccauguccggcaggc

SEQ ID NO: 2934288 - RNA, 20 nt, Mycobacterium avium subsp. paratuberculosis
cgccauguccggcaggcuca

SEQ ID NO: 2934289 - RNA, 17 nt, Mycobacterium avium subsp. paratuberculosis
cgccaugucgaugucga

SEQ ID NO: 2934290 - RNA, 16 nt, Mycobacterium avium subsp. paratuberculosis
cgccaugugccggcgc

SEQ ID NO: 2934291 - RNA, 17 nt, Mycobacterium avium subsp. paratuberculosis
cgccaugugccggcgcu

SEQ ID NO: 2934292 - RNA, 20 nt, Mycobacterium avium subsp. paratuberculosis
cgccaugugccggcgcucgu

SEQ ID NO: 2934293 - RNA, 21 nt, Mycobacterium avium subsp. paratuberculosis
cgccaugugccggcgcucguc

SEQ ID NO: 2934294 - RNA, 23 nt, Mycobacterium avium subsp. paratuberculosis
cgccauugucggaucgcuugacc

SEQ ID NO: 2934295 - RNA, 23 nt, Mycobacterium avium subsp. paratuberculosis
cgcccaaaacgugauagcggccg

SEQ ID NO: 2934296 - RNA, 18 nt, Mycobacterium avium subsp. paratuberculosis
cgcccaacgacgucggcg

SEQ ID NO: 2934297 - RNA, 19 nt, Mycobacterium avium subsp. paratuberculosis
cgcccaacgacgucggcgu

SEQ ID NO: 2934298 - RNA, 20 nt, Mycobacterium avium subsp. paratuberculosis
cgcccaacgacgucggcguc

SEQ ID NO: 2934299 - RNA, 17 nt, Mycobacterium avium subsp. paratuberculosis
cgcccaacuacccgccg

SEQ ID NO: 2934300 - RNA, 18 nt, Mycobacterium avium subsp. paratuberculosis
cgcccaacuacccgccga

SEQ ID NO: 2934301 - RNA, 20 nt, Mycobacterium avium subsp. paratuberculosis
cgcccaacuacccgccgacg

SEQ ID NO: 2934302 - RNA, 22 nt, Mycobacterium avium subsp. paratuberculosis
cgcccaacuacccgccgacgcc

SEQ ID NO: 2934303 - RNA, 16 nt, Mycobacterium avium subsp. paratuberculosis
cgcccacaccgacacc

SEQ ID NO: 2934304 - RNA, 19 nt, Mycobacterium avium subsp. paratuberculosis
cgcccacaccgacaccggc

SEQ ID NO: 2934305 - RNA, 21 nt, Mycobacterium avium subsp. paratuberculosis
cgcccacaccgacaccggccg

SEQ ID NO: 2934306 - RNA, 13 nt, Mycobacterium avium subsp. paratuberculosis
cgcccacagcaac

SEQ ID NO: 2934307 - RNA, 13 nt, Mycobacterium avium subsp. paratuberculosis
cgcccacagcagg

SEQ ID NO: 2934308 - RNA, 14 nt, Mycobacterium avium subsp. paratuberculosis
cgcccacagcgcca

SEQ ID NO: 2934309 - RNA, 17 nt, Mycobacterium avium subsp. paratuberculosis
cgcccacagcgccagca

SEQ ID NO: 2934310 - RNA, 19 nt, Mycobacterium avium subsp. paratuberculosis
cgcccacagcgccagcacg

SEQ ID NO: 2934311 - RNA, 21 nt, Mycobacterium avium subsp. paratuberculosis
cgcccacagguccagcguccg

SEQ ID NO: 2934312 - RNA, 13 nt, Mycobacterium avium subsp. paratuberculosis
cgcccaccacgaa

SEQ ID NO: 2934313 - RNA, 14 nt, Mycobacterium avium subsp. paratuberculosis
cgcccaccacgaac

SEQ ID NO: 2934314 - RNA, 22 nt, Mycobacterium avium subsp. paratuberculosis
cgcccaccacgaaccaggcgcc

SEQ ID NO: 2934315 - RNA, 15 nt, Mycobacterium avium subsp. paratuberculosis
cgcccaccacgaacg

SEQ ID NO: 2934316 - RNA, 18 nt, Mycobacterium avium subsp. paratuberculosis
cgcccaccacgaacgcgc

SEQ ID NO: 2934317 - RNA, 23 nt, Mycobacterium avium subsp. paratuberculosis
cgcccaccacgaacgcgccgccg

SEQ ID NO: 2934318 - RNA, 13 nt, Mycobacterium avium subsp. paratuberculosis
cgcccaccacgac

SEQ ID NO: 2934319 - RNA, 15 nt, Mycobacterium avium subsp. paratuberculosis
cgcccaccacgacga

SEQ ID NO: 2934320 - RNA, 19 nt, Mycobacterium avium subsp. paratuberculosis
cgcccaccagcacaccgga

SEQ ID NO: 2934321 - RNA, 12 nt, Mycobacterium avium subsp. paratuberculosis
cgcccaccccgg

SEQ ID NO: 2934322 - RNA, 16 nt, Mycobacterium avium subsp. paratuberculosis
cgcccaccccggcguc

SEQ ID NO: 2934323 - RNA, 23 nt, Mycobacterium avium subsp. paratuberculosis
cgcccaccccggcguccacgccg

SEQ ID NO: 2934324 - RNA, 13 nt, Mycobacterium avium subsp. paratuberculosis
cgcccacccgaug

SEQ ID NO: 2934325 - RNA, 24 nt, Mycobacterium avium subsp. paratuberculosis
cgcccacccgaugaccggcccggc

SEQ ID NO: 2934326 - RNA, 20 nt, Mycobacterium avium subsp. paratuberculosis
cgcccacccgcacgcccggg

SEQ ID NO: 2934327 - RNA, 21 nt, Mycobacterium avium subsp. paratuberculosis
cgcccacccgcacgcccgggc

SEQ ID NO: 2934328 - RNA, 14 nt, Mycobacterium avium subsp. paratuberculosis
cgcccacccgccag

SEQ ID NO: 2934329 - RNA, 17 nt, Mycobacterium avium subsp. paratuberculosis
cgcccacccgccagccc

SEQ ID NO: 2934330 - RNA, 21 nt, Mycobacterium avium subsp. paratuberculosis
cgcccacccgccagcccgcgu

SEQ ID NO: 2934331 - RNA, 15 nt, Mycobacterium avium subsp. paratuberculosis
cgcccacccgcgccg

SEQ ID NO: 2934332 - RNA, 14 nt, Mycobacterium avium subsp. paratuberculosis
cgcccacccggggc

SEQ ID NO: 2934333 - RNA, 16 nt, Mycobacterium avium subsp. paratuberculosis
cgcccacccggggccg

SEQ ID NO: 2934334 - RNA, 20 nt, Mycobacterium avium subsp. paratuberculosis
cgcccacccggggccguccg

SEQ ID NO: 2934335 - RNA, 12 nt, Mycobacterium avium subsp. paratuberculosis
cgcccaccgacg

SEQ ID NO: 2934336 - RNA, 14 nt, Mycobacterium avium subsp. paratuberculosis
cgcccaccgacgcg

SEQ ID NO: 2934337 - RNA, 17 nt, Mycobacterium avium subsp. paratuberculosis
cgcccaccgacgcggcg

SEQ ID NO: 2934338 - RNA, 18 nt, Mycobacterium avium subsp. paratuberculosis
cgcccaccgacgcggcgg

SEQ ID NO: 2934339 - RNA, 19 nt, Mycobacterium avium subsp. paratuberculosis
cgcccaccgacgcggcggc

SEQ ID NO: 2934340 - RNA, 14 nt, Mycobacterium avium subsp. paratuberculosis
cgcccaccgcggcg

SEQ ID NO: 2934341 - RNA, 18 nt, Mycobacterium avium subsp. paratuberculosis
cgcccaccgcucgucggg

SEQ ID NO: 2934342 - RNA, 22 nt, Mycobacterium avium subsp. paratuberculosis
cgcccaccuggaggccaacgag

SEQ ID NO: 2934343 - RNA, 21 nt, Mycobacterium avium subsp. paratuberculosis
cgcccaccugguucucccguc

SEQ ID NO: 2934344 - RNA, 20 nt, Mycobacterium avium subsp. paratuberculosis
cgcccaccugguuggcccgc

SEQ ID NO: 2934345 - RNA, 21 nt, Mycobacterium avium subsp. paratuberculosis
cgcccaccugguuggcccgca

SEQ ID NO: 2934346 - RNA, 22 nt, Mycobacterium avium subsp. paratuberculosis
cgcccaccugguuggcccgcac

SEQ ID NO: 2934347 - RNA, 23 nt, Mycobacterium avium subsp. paratuberculosis
cgcccaccugguuggcccgcacc

SEQ ID NO: 2934348 - RNA, 18 nt, Mycobacterium avium subsp. paratuberculosis
cgcccaccuucccaaccc

SEQ ID NO: 2934349 - RNA, 13 nt, Mycobacterium avium subsp. paratuberculosis
cgcccaccuuggc

SEQ ID NO: 2934350 - RNA, 19 nt, Mycobacterium avium subsp. paratuberculosis
cgcccaccuuggcgucgau

SEQ ID NO: 2934351 - RNA, 14 nt, Mycobacterium avium subsp. paratuberculosis
cgcccacgccgagg

SEQ ID NO: 2934352 - RNA, 15 nt, Mycobacterium avium subsp. paratuberculosis
cgcccacggccacca

SEQ ID NO: 2934353 - RNA, 14 nt, Mycobacterium avium subsp. paratuberculosis
cgcccacgggucgc

SEQ ID NO: 2934354 - RNA, 19 nt, Mycobacterium avium subsp. paratuberculosis
cgcccacgggucgccgauc

SEQ ID NO: 2934355 - RNA, 23 nt, Mycobacterium avium subsp. paratuberculosis
cgcccacgggucgccgaucucgg

SEQ ID NO: 2934356 - RNA, 20 nt, Mycobacterium avium subsp. paratuberculosis
cgcccagcugggccagcgcg

SEQ ID NO: 2934357 - RNA, 22 nt, Mycobacterium avium subsp. paratuberculosis
cgcccaggaacgcgccggcgca

SEQ ID NO: 2934358 - RNA, 18 nt, Mycobacterium avium subsp. paratuberculosis
cgcccaggaacuggucga

SEQ ID NO: 2934359 - RNA, 17 nt, Mycobacterium avium subsp. paratuberculosis
cgcccaggccccggccg

SEQ ID NO: 2934360 - RNA, 18 nt, Mycobacterium avium subsp. paratuberculosis
cgcccaggccccggccga

SEQ ID NO: 2934361 - RNA, 19 nt, Mycobacterium avium subsp. paratuberculosis
cgcccaggccccggccgag

SEQ ID NO: 2934362 - RNA, 15 nt, Mycobacterium avium subsp. paratuberculosis
cgcccaggccgagcg

SEQ ID NO: 2934363 - RNA, 18 nt, Mycobacterium avium subsp. paratuberculosis
cgcccaggccgagcgcaa

SEQ ID NO: 2934364 - RNA, 14 nt, Mycobacterium avium subsp. paratuberculosis
cgcccaggccgcca

SEQ ID NO: 2934365 - RNA, 16 nt, Mycobacterium avium subsp. paratuberculosis
cgcccaggcgggccag

SEQ ID NO: 2934366 - RNA, 13 nt, Mycobacterium avium subsp. paratuberculosis
cgcccaggcgugc

SEQ ID NO: 2934367 - RNA, 14 nt, Mycobacterium avium subsp. paratuberculosis
cgcccaggcgugcg

SEQ ID NO: 2934368 - RNA, 11 nt, Mycobacterium avium subsp. paratuberculosis
cgcccaggcuc

SEQ ID NO: 2934369 - RNA, 14 nt, Mycobacterium avium subsp. paratuberculosis
cgcccaggcucagg

SEQ ID NO: 2934370 - RNA, 22 nt, Mycobacterium avium subsp. paratuberculosis
cgcccagggcgccagauuccga

SEQ ID NO: 2934371 - RNA, 13 nt, Mycobacterium avium subsp. paratuberculosis
cgcccagggcgug

SEQ ID NO: 2934372 - RNA, 18 nt, Mycobacterium avium subsp. paratuberculosis
cgcccagggcgugcgcgg

SEQ ID NO: 2934373 - RNA, 21 nt, Mycobacterium avium subsp. paratuberculosis
cgcccagggcgugcgcggccg

SEQ ID NO: 2934374 - RNA, 22 nt, Mycobacterium avium subsp. paratuberculosis
cgcccagggcgugcgcggccgc

SEQ ID NO: 2934375 - RNA, 16 nt, Mycobacterium avium subsp. paratuberculosis
cgcccaggggagcggc

SEQ ID NO: 2934376 - RNA, 16 nt, Mycobacterium avium subsp. paratuberculosis
cgcccaggugcacccg

SEQ ID NO: 2934377 - RNA, 19 nt, Mycobacterium avium subsp. paratuberculosis
cgcccaggugcacccgaug

SEQ ID NO: 2934378 - RNA, 16 nt, Mycobacterium avium subsp. paratuberculosis
cgcccagucgccgccg

SEQ ID NO: 2934379 - RNA, 18 nt, Mycobacterium avium subsp. paratuberculosis
cgcccagugcgcgccgug

SEQ ID NO: 2934380 - RNA, 16 nt, Mycobacterium avium subsp. paratuberculosis
cgcccaguugcacggu

SEQ ID NO: 2934381 - RNA, 20 nt, Mycobacterium avium subsp. paratuberculosis
cgcccaguugcacgguguag

SEQ ID NO: 2934382 - RNA, 20 nt, Mycobacterium avium subsp. paratuberculosis
cgcccaucaccagcagaccc

SEQ ID NO: 2934383 - RNA, 17 nt, Mycobacterium avium subsp. paratuberculosis
cgcccaucaccgcaccg

SEQ ID NO: 2934384 - RNA, 15 nt, Mycobacterium avium subsp. paratuberculosis
cgcccaucgaccgga

SEQ ID NO: 2934385 - RNA, 19 nt, Mycobacterium avium subsp. paratuberculosis
cgcccaucgcggccgcccg

SEQ ID NO: 2934386 - RNA, 14 nt, Mycobacterium avium subsp. paratuberculosis
cgcccaucggcagc

SEQ ID NO: 2934387 - RNA, 15 nt, Mycobacterium avium subsp. paratuberculosis
cgcccaucggcagcc

SEQ ID NO: 2934388 - RNA, 17 nt, Mycobacterium avium subsp. paratuberculosis
cgcccaucggcagcccg

SEQ ID NO: 2934389 - RNA, 18 nt, Mycobacterium avium subsp. paratuberculosis
cgcccaugaacgcgucgc

SEQ ID NO: 2934390 - RNA, 19 nt, Mycobacterium avium subsp. paratuberculosis
cgcccaugaacgcgucgcc

SEQ ID NO: 2934391 - RNA, 20 nt, Mycobacterium avium subsp. paratuberculosis
cgcccaugaacgcgucgccg

SEQ ID NO: 2934392 - RNA, 21 nt, Mycobacterium avium subsp. paratuberculosis
cgcccaugaacgcgucgccgu

SEQ ID NO: 2934393 - RNA, 23 nt, Mycobacterium avium subsp. paratuberculosis
cgcccaugaacgcgucgccgugc

SEQ ID NO: 2934394 - RNA, 17 nt, Mycobacterium avium subsp. paratuberculosis
cgcccaugaucacaccg

SEQ ID NO: 2934395 - RNA, 18 nt, Mycobacterium avium subsp. paratuberculosis
cgcccaugcacgaucucc

SEQ ID NO: 2934396 - RNA, 19 nt, Mycobacterium avium subsp. paratuberculosis
cgcccaugcacgaucuccc

SEQ ID NO: 2934397 - RNA, 15 nt, Mycobacterium avium subsp. paratuberculosis
cgcccaugcccaugu

SEQ ID NO: 2934398 - RNA, 23 nt, Mycobacterium avium subsp. paratuberculosis
cgcccaugcccaugucgaucggc

SEQ ID NO: 2934399 - RNA, 14 nt, Mycobacterium avium subsp. paratuberculosis
cgccccacgccugg

SEQ ID NO: 2934400 - RNA, 22 nt, Mycobacterium avium subsp. paratuberculosis
cgccccacggucuuugccggcc

SEQ ID NO: 2934401 - RNA, 23 nt, Mycobacterium avium subsp. paratuberculosis
cgccccacggucuuugccggcca

SEQ ID NO: 2934402 - RNA, 24 nt, Mycobacterium avium subsp. paratuberculosis
cgccccagacguuuccguccggcg

SEQ ID NO: 2934403 - RNA, 21 nt, Mycobacterium avium subsp. paratuberculosis
cgccccagcacgaucccgccg

SEQ ID NO: 2934404 - RNA, 22 nt, Mycobacterium avium subsp. paratuberculosis
cgccccagcacgaucccgccgc

SEQ ID NO: 2934405 - RNA, 22 nt, Mycobacterium avium subsp. paratuberculosis
cgccccagccccucgccgggcg

SEQ ID NO: 2934406 - RNA, 12 nt, Mycobacterium avium subsp. paratuberculosis
cgccccagcccg

SEQ ID NO: 2934407 - RNA, 14 nt, Mycobacterium avium subsp. paratuberculosis
cgccccagccgacc

SEQ ID NO: 2934408 - RNA, 16 nt, Mycobacterium avium subsp. paratuberculosis
cgccccagccgaccag

SEQ ID NO: 2934409 - RNA, 14 nt, Mycobacterium avium subsp. paratuberculosis
cgccccaggcgccc

SEQ ID NO: 2934410 - RNA, 17 nt, Mycobacterium avium subsp. paratuberculosis
cgccccaggcgcccugc

SEQ ID NO: 2934411 - RNA, 16 nt, Mycobacterium avium subsp. paratuberculosis
cgccccagggccucgg

SEQ ID NO: 2934412 - RNA, 20 nt, Mycobacterium avium subsp. paratuberculosis
cgccccagguuccggugucg

SEQ ID NO: 2934413 - RNA, 13 nt, Mycobacterium avium subsp. paratuberculosis
cgccccagugcag

SEQ ID NO: 2934414 - RNA, 21 nt, Mycobacterium avium subsp. paratuberculosis
cgccccagugcaggcaggccc

SEQ ID NO: 2934415 - RNA, 19 nt, Mycobacterium avium subsp. paratuberculosis
cgccccaguuggcgucguc

SEQ ID NO: 2934416 - RNA, 23 nt, Mycobacterium avium subsp. paratuberculosis
cgccccaguuggcgucgucggcg

SEQ ID NO: 2934417 - RNA, 18 nt, Mycobacterium avium subsp. paratuberculosis
cgccccauugccgcgccg

SEQ ID NO: 2934418 - RNA, 20 nt, Mycobacterium avium subsp. paratuberculosis
cgccccauugccgcgccggg

SEQ ID NO: 2934419 - RNA, 22 nt, Mycobacterium avium subsp. paratuberculosis
cgccccauugccgcgccggggu

SEQ ID NO: 2934420 - RNA, 20 nt, Mycobacterium avium subsp. paratuberculosis
cgcccccgaggagacgucgg

SEQ ID NO: 2934421 - RNA, 22 nt, Mycobacterium avium subsp. paratuberculosis
cgcccccgauagccccgccagg

SEQ ID NO: 2934422 - RNA, 14 nt, Mycobacterium avium subsp. paratuberculosis
cgcccccgcccaca

SEQ ID NO: 2934423 - RNA, 13 nt, Mycobacterium avium subsp. paratuberculosis
cgcccccgcgacg

SEQ ID NO: 2934424 - RNA, 14 nt, Mycobacterium avium subsp. paratuberculosis
cgcccccgcgacgu

SEQ ID NO: 2934425 - RNA, 21 nt, Mycobacterium avium subsp. paratuberculosis
cgcccccgcgacguccaucgg

SEQ ID NO: 2934426 - RNA, 14 nt, Mycobacterium avium subsp. paratuberculosis
cgcccccgcggcgg

SEQ ID NO: 2934427 - RNA, 17 nt, Mycobacterium avium subsp. paratuberculosis
cgcccccgcggcggcca

SEQ ID NO: 2934428 - RNA, 16 nt, Mycobacterium avium subsp. paratuberculosis
cgcccccgcggcgucc

SEQ ID NO: 2934429 - RNA, 13 nt, Mycobacterium avium subsp. paratuberculosis
cgcccccucggcc

SEQ ID NO: 2934430 - RNA, 14 nt, Mycobacterium avium subsp. paratuberculosis
cgcccccucggccg

SEQ ID NO: 2934431 - RNA, 13 nt, Mycobacterium avium subsp. paratuberculosis
cgcccccugggac

SEQ ID NO: 2934432 - RNA, 16 nt, Mycobacterium avium subsp. paratuberculosis
cgccccgaacagcgcc

SEQ ID NO: 2934433 - RNA, 21 nt, Mycobacterium avium subsp. paratuberculosis
cgccccgaaguucgacacggu

SEQ ID NO: 2934434 - RNA, 18 nt, Mycobacterium avium subsp. paratuberculosis
cgccccgacagcaacgcc

SEQ ID NO: 2934435 - RNA, 19 nt, Mycobacterium avium subsp. paratuberculosis
cgccccgacagcaacgcca

SEQ ID NO: 2934436 - RNA, 17 nt, Mycobacterium avium subsp. paratuberculosis
cgccccgacaucgccau

SEQ ID NO: 2934437 - RNA, 20 nt, Mycobacterium avium subsp. paratuberculosis
cgccccgacaucgccaucag

SEQ ID NO: 2934438 - RNA, 20 nt, Mycobacterium avium subsp. paratuberculosis
cgccccgacgaucgcgccgg

SEQ ID NO: 2934439 - RNA, 22 nt, Mycobacterium avium subsp. paratuberculosis
cgccccgacgaucgcgccggcc

SEQ ID NO: 2934440 - RNA, 22 nt, Mycobacterium avium subsp. paratuberculosis
cgcccgaucugggaucggugcg

SEQ ID NO: 2934441 - RNA, 20 nt, Mycobacterium avium subsp. paratuberculosis
cgcccgaugaaguacccggu

SEQ ID NO: 2934442 - RNA, 24 nt, Mycobacterium avium subsp. paratuberculosis
cgcccgauggaggugccgcgcagc

SEQ ID NO: 2934443 - RNA, 19 nt, Mycobacterium avium subsp. paratuberculosis
cgcccgauuccccggcgug

SEQ ID NO: 2934444 - RNA, 20 nt, Mycobacterium avium subsp. paratuberculosis
cgcccgauuccccggcgugu

SEQ ID NO: 2934445 - RNA, 17 nt, Mycobacterium avium subsp. paratuberculosis
cgcccgauucgcggcca

SEQ ID NO: 2934446 - RNA, 19 nt, Mycobacterium avium subsp. paratuberculosis
cgcccgauucgcggccacc

SEQ ID NO: 2934447 - RNA, 12 nt, Mycobacterium avium subsp. paratuberculosis
cgcccgcaccac

SEQ ID NO: 2934448 - RNA, 15 nt, Mycobacterium avium subsp. paratuberculosis
cgcccgcaccagcag

SEQ ID NO: 2934449 - RNA, 23 nt, Mycobacterium avium subsp. paratuberculosis
cgcccgcaccagcagguccaugg

SEQ ID NO: 2934450 - RNA, 16 nt, Mycobacterium avium subsp. paratuberculosis
cgcccgcaccugcgcg

SEQ ID NO: 2934451 - RNA, 19 nt, Mycobacterium avium subsp. paratuberculosis
cgcccgcaccugcgcgccg

SEQ ID NO: 2934452 - RNA, 22 nt, Mycobacterium avium subsp. paratuberculosis
cgcccgcaccugcgcgccguug

SEQ ID NO: 2934453 - RNA, 15 nt, Mycobacterium avium subsp. paratuberculosis
cgcccgcagcggcgg

SEQ ID NO: 2934454 - RNA, 13 nt, Mycobacterium avium subsp. paratuberculosis
cgcccgcaggccg

SEQ ID NO: 2934455 - RNA, 18 nt, Mycobacterium avium subsp. paratuberculosis
cgcccgcaggccgcgagc

SEQ ID NO: 2934456 - RNA, 15 nt, Mycobacterium avium subsp. paratuberculosis
cgcccgcaguucggc

SEQ ID NO: 2934457 - RNA, 18 nt, Mycobacterium avium subsp. paratuberculosis
cgcccgcaguucggccgc

SEQ ID NO: 2934458 - RNA, 20 nt, Mycobacterium avium subsp. paratuberculosis
cgcccgcaguucggccgccg

SEQ ID NO: 2934459 - RNA, 22 nt, Mycobacterium avium subsp. paratuberculosis
cgcccgcaguucggccgccgug

SEQ ID NO: 2934460 - RNA, 12 nt, Mycobacterium avium subsp. paratuberculosis
cgcccgccaucu

SEQ ID NO: 2934461 - RNA, 14 nt, Mycobacterium avium subsp. paratuberculosis
cgcccgccaucugg

SEQ ID NO: 2934462 - RNA, 14 nt, Mycobacterium avium subsp. paratuberculosis
cgcccgcccaggcc

SEQ ID NO: 2934463 - RNA, 15 nt, Mycobacterium avium subsp. paratuberculosis
cgcccgcccaggccg

SEQ ID NO: 2934464 - RNA, 14 nt, Mycobacterium avium subsp. paratuberculosis
cgcccgccccgacg

SEQ ID NO: 2934465 - RNA, 14 nt, Mycobacterium avium subsp. paratuberculosis
cgcccgcccgagcg

SEQ ID NO: 2934466 - RNA, 14 nt, Mycobacterium avium subsp. paratuberculosis
cgcccgcccggcac

SEQ ID NO: 2934467 - RNA, 15 nt, Mycobacterium avium subsp. paratuberculosis
cgcccgcccggcacg

SEQ ID NO: 2934468 - RNA, 15 nt, Mycobacterium avium subsp. paratuberculosis
cgcccgcccggcccg

SEQ ID NO: 2934469 - RNA, 17 nt, Mycobacterium avium subsp. paratuberculosis
cgcccgcccggcccggc

SEQ ID NO: 2934470 - RNA, 15 nt, Mycobacterium avium subsp. paratuberculosis
cgcccgccgaacacc

SEQ ID NO: 2934471 - RNA, 18 nt, Mycobacterium avium subsp. paratuberculosis
cgcccgccgaacaccggc

SEQ ID NO: 2934472 - RNA, 20 nt, Mycobacterium avium subsp. paratuberculosis
cgcccgccgaacaccggcag

SEQ ID NO: 2934473 - RNA, 14 nt, Mycobacterium avium subsp. paratuberculosis
cgcccgccgacggc

SEQ ID NO: 2934474 - RNA, 17 nt, Mycobacterium avium subsp. paratuberculosis
cgcccgccgacggcugc

SEQ ID NO: 2934475 - RNA, 13 nt, Mycobacterium avium subsp. paratuberculosis
cgcccgccgcaac

SEQ ID NO: 2934476 - RNA, 12 nt, Mycobacterium avium subsp. paratuberculosis
cgcccgccgcca

SEQ ID NO: 2934477 - RNA, 13 nt, Mycobacterium avium subsp. paratuberculosis
cgcccgccgccac

SEQ ID NO: 2934478 - RNA, 14 nt, Mycobacterium avium subsp. paratuberculosis
cgcccgccgccacc

SEQ ID NO: 2934479 - RNA, 15 nt, Mycobacterium avium subsp. paratuberculosis
cgcccgccgccacca

SEQ ID NO: 2934480 - RNA, 14 nt, Mycobacterium avium subsp. paratuberculosis
cgcccgccgcgacg

SEQ ID NO: 2934481 - RNA, 15 nt, Mycobacterium avium subsp. paratuberculosis
cgcccgccgcgacgg

SEQ ID NO: 2934482 - RNA, 14 nt, Mycobacterium avium subsp. paratuberculosis
cgcccgccgcgagc

SEQ ID NO: 2934483 - RNA, 16 nt, Mycobacterium avium subsp. paratuberculosis
cgcccgccgcgagccg

SEQ ID NO: 2934484 - RNA, 12 nt, Mycobacterium avium subsp. paratuberculosis
cgcccgccgcgu

SEQ ID NO: 2934485 - RNA, 19 nt, Mycobacterium avium subsp. paratuberculosis
cgcccgccgggcacccggg

SEQ ID NO: 2934486 - RNA, 19 nt, Mycobacterium avium subsp. paratuberculosis
cgcccgcgaacacgcgaug

SEQ ID NO: 2934487 - RNA, 14 nt, Mycobacterium avium subsp. paratuberculosis
cgcccgcgacccga

SEQ ID NO: 2934488 - RNA, 16 nt, Mycobacterium avium subsp. paratuberculosis
cgcccgcgacccgaac

SEQ ID NO: 2934489 - RNA, 20 nt, Mycobacterium avium subsp. paratuberculosis
cgcccgcgacugucggcucg

SEQ ID NO: 2934490 - RNA, 18 nt, Mycobacterium avium subsp. paratuberculosis
cgcccgcgaucaacaccg

SEQ ID NO: 2934491 - RNA, 13 nt, Mycobacterium avium subsp. paratuberculosis
cgcccgcgaucgg

SEQ ID NO: 2934492 - RNA, 15 nt, Mycobacterium avium subsp. paratuberculosis
cgcccgcgaucggcg

SEQ ID NO: 2934493 - RNA, 14 nt, Mycobacterium avium subsp. paratuberculosis
cgcccgcgccaccc

SEQ ID NO: 2934494 - RNA, 16 nt, Mycobacterium avium subsp. paratuberculosis
cgcccgcgccaccccg

SEQ ID NO: 2934495 - RNA, 18 nt, Mycobacterium avium subsp. paratuberculosis
cgcccgcgcgaucggcga

SEQ ID NO: 2934496 - RNA, 22 nt, Mycobacterium avium subsp. paratuberculosis
cgcccgcgcgaucggcgagccg

SEQ ID NO: 2934497 - RNA, 15 nt, Mycobacterium avium subsp. paratuberculosis
cgcccgcgcgaugcg

SEQ ID NO: 2934498 - RNA, 16 nt, Mycobacterium avium subsp. paratuberculosis
cgcccgcgcgcucggg

SEQ ID NO: 2934499 - RNA, 20 nt, Mycobacterium avium subsp. paratuberculosis
cgcccgcgcgcucgggggug

SEQ ID NO: 2934500 - RNA, 13 nt, Mycobacterium avium subsp. paratuberculosis
cgcccgcgcggcg

SEQ ID NO: 2934501 - RNA, 22 nt, Mycobacterium avium subsp. paratuberculosis
cgcccgcgcggcggccaacgcg

SEQ ID NO: 2934502 - RNA, 14 nt, Mycobacterium avium subsp. paratuberculosis
cgcccgcgcgggcu

SEQ ID NO: 2934503 - RNA, 15 nt, Mycobacterium avium subsp. paratuberculosis
cgcccgcgcgggcug

SEQ ID NO: 2934504 - RNA, 14 nt, Mycobacterium avium subsp. paratuberculosis
cgcccgcgcuggug

SEQ ID NO: 2934505 - RNA, 12 nt, Mycobacterium avium subsp. paratuberculosis
cgcccgcggcca

SEQ ID NO: 2934506 - RNA, 17 nt, Mycobacterium avium subsp. paratuberculosis
cgcccgcggccaucgcc

SEQ ID NO: 2934507 - RNA, 19 nt, Mycobacterium avium subsp. paratuberculosis
cgcccgcggccuccagccg

SEQ ID NO: 2934508 - RNA, 22 nt, Mycobacterium avium subsp. paratuberculosis
cgcccgcggccuccagccgcuc

SEQ ID NO: 2934509 - RNA, 14 nt, Mycobacterium avium subsp. paratuberculosis
cgcccgcggcgcgc

SEQ ID NO: 2934510 - RNA, 13 nt, Mycobacterium avium subsp. paratuberculosis
cgcccgcgggugc

SEQ ID NO: 2934511 - RNA, 18 nt, Mycobacterium avium subsp. paratuberculosis
cgcccgcgggugcagccg

SEQ ID NO: 2934512 - RNA, 20 nt, Mycobacterium avium subsp. paratuberculosis
cgcccgcggugugcuggcca

SEQ ID NO: 2934513 - RNA, 23 nt, Mycobacterium avium subsp. paratuberculosis
cgcccgcggugugcuggccagca

SEQ ID NO: 2934514 - RNA, 17 nt, Mycobacterium avium subsp. paratuberculosis
cgcccgcguacagcagu

SEQ ID NO: 2934515 - RNA, 17 nt, Mycobacterium avium subsp. paratuberculosis
cgcccgcgucguggccc

SEQ ID NO: 2934516 - RNA, 14 nt, Mycobacterium avium subsp. paratuberculosis
cgcccgcuccgcgg

SEQ ID NO: 2934517 - RNA, 22 nt, Mycobacterium avium subsp. paratuberculosis
cgcccgcuccgcgggcagcgag

SEQ ID NO: 2934518 - RNA, 16 nt, Mycobacterium avium subsp. paratuberculosis
cgcccgcuccggcgga

SEQ ID NO: 2934519 - RNA, 17 nt, Mycobacterium avium subsp. paratuberculosis
cgcccgcuccggcggac

SEQ ID NO: 2934520 - RNA, 13 nt, Mycobacterium avium subsp. paratuberculosis
cgcccgcuccugc

SEQ ID NO: 2934521 - RNA, 22 nt, Mycobacterium avium subsp. paratuberculosis
cgcccgcuccugcaggccgagc

SEQ ID NO: 2934522 - RNA, 16 nt, Mycobacterium avium subsp. paratuberculosis
cgcccgcucgacggcc

SEQ ID NO: 2934523 - RNA, 19 nt, Mycobacterium avium subsp. paratuberculosis
cgcccgcucgaggggcuug

SEQ ID NO: 2934524 - RNA, 16 nt, Mycobacterium avium subsp. paratuberculosis
cgcccgcugaccgccg

SEQ ID NO: 2934525 - RNA, 13 nt, Mycobacterium avium subsp. paratuberculosis
cgcccggcgucgg

SEQ ID NO: 2934526 - RNA, 20 nt, Mycobacterium avium subsp. paratuberculosis
cgcccggcuccacgaugccc

SEQ ID NO: 2934527 - RNA, 14 nt, Mycobacterium avium subsp. paratuberculosis
cgcccggcucgccg

SEQ ID NO: 2934528 - RNA, 15 nt, Mycobacterium avium subsp. paratuberculosis
cgcccggcugcgccg

SEQ ID NO: 2934529 - RNA, 19 nt, Mycobacterium avium subsp. paratuberculosis
cgcccggcugcgccgcgcu

SEQ ID NO: 2934530 - RNA, 18 nt, Mycobacterium avium subsp. paratuberculosis
cgcccggcuucgccgccg

SEQ ID NO: 2934531 - RNA, 19 nt, Mycobacterium avium subsp. paratuberculosis
cgcccggcuucgccgcgcu

SEQ ID NO: 2934532 - RNA, 21 nt, Mycobacterium avium subsp. paratuberculosis
cgcccggcuucgccgcgcuug

SEQ ID NO: 2934533 - RNA, 17 nt, Mycobacterium avium subsp. paratuberculosis
cgcccgggaagcuggug

SEQ ID NO: 2934534 - RNA, 12 nt, Mycobacterium avium subsp. paratuberculosis
cgcccgggccag

SEQ ID NO: 2934535 - RNA, 16 nt, Mycobacterium avium subsp. paratuberculosis
cgcccgggccaggacc

SEQ ID NO: 2934536 - RNA, 17 nt, Mycobacterium avium subsp. paratuberculosis
cgcccgggccaggcgcg

SEQ ID NO: 2934537 - RNA, 17 nt, Mycobacterium avium subsp. paratuberculosis
cgcccgggccgcgccca

SEQ ID NO: 2934538 - RNA, 18 nt, Mycobacterium avium subsp. paratuberculosis
cgcccgggcgcgugcaca

SEQ ID NO: 2934539 - RNA, 15 nt, Mycobacterium avium subsp. paratuberculosis
cgcccgggcggcccg

SEQ ID NO: 2934540 - RNA, 17 nt, Mycobacterium avium subsp. paratuberculosis
cgcccgggcggcccgca

SEQ ID NO: 2934541 - RNA, 20 nt, Mycobacterium avium subsp. paratuberculosis
cgcccgggcggcccgcaucg

SEQ ID NO: 2934542 - RNA, 16 nt, Mycobacterium avium subsp. paratuberculosis
cgcccgggcggcccgg

SEQ ID NO: 2934543 - RNA, 14 nt, Mycobacterium avium subsp. paratuberculosis
cgcccgggcggcgg

SEQ ID NO: 2934544 - RNA, 19 nt, Mycobacterium avium subsp. paratuberculosis
cgcccgggcggcggggcug

SEQ ID NO: 2934545 - RNA, 19 nt, Mycobacterium avium subsp. paratuberculosis
cgcccgggcguucccgcgc

SEQ ID NO: 2934546 - RNA, 22 nt, Mycobacterium avium subsp. paratuberculosis
cgcccgggcguucccgcgcgcg

SEQ ID NO: 2934547 - RNA, 18 nt, Mycobacterium avium subsp. paratuberculosis
cgcccgggcuaucgcccg

SEQ ID NO: 2934548 - RNA, 20 nt, Mycobacterium avium subsp. paratuberculosis
cgcccgggcuaucgcccggc

SEQ ID NO: 2934549 - RNA, 22 nt, Mycobacterium avium subsp. paratuberculosis
cgcccgggcuaucgcccggcgc

SEQ ID NO: 2934550 - RNA, 23 nt, Mycobacterium avium subsp. paratuberculosis
cgcccgggcuaucgcccggcgcc

SEQ ID NO: 2934551 - RNA, 13 nt, Mycobacterium avium subsp. paratuberculosis
cgcccggggcgcg

SEQ ID NO: 2934552 - RNA, 17 nt, Mycobacterium avium subsp. paratuberculosis
cgcccggggcgcggacc

SEQ ID NO: 2934553 - RNA, 18 nt, Mycobacterium avium subsp. paratuberculosis
cgcccggggcgcggaccg

SEQ ID NO: 2934554 - RNA, 20 nt, Mycobacterium avium subsp. paratuberculosis
cgcccggggcgcggaccgca

SEQ ID NO: 2934555 - RNA, 15 nt, Mycobacterium avium subsp. paratuberculosis
cgcccggggcggcga

SEQ ID NO: 2934556 - RNA, 17 nt, Mycobacterium avium subsp. paratuberculosis
cgcccggggcggcgaug

SEQ ID NO: 2934557 - RNA, 15 nt, Mycobacterium avium subsp. paratuberculosis
cgcccggguagggca

SEQ ID NO: 2934558 - RNA, 17 nt, Mycobacterium avium subsp. paratuberculosis
cgcccggguagggcagc

SEQ ID NO: 2934559 - RNA, 16 nt, Mycobacterium avium subsp. paratuberculosis
cgcccgggucgucggu

SEQ ID NO: 2934560 - RNA, 17 nt, Mycobacterium avium subsp. paratuberculosis
cgcccgggugacaacgg

SEQ ID NO: 2934561 - RNA, 17 nt, Mycobacterium avium subsp. paratuberculosis
cgcccgggugcaggccc

SEQ ID NO: 2934562 - RNA, 18 nt, Mycobacterium avium subsp. paratuberculosis
cgcccgggugcaggccca

SEQ ID NO: 2934563 - RNA, 23 nt, Mycobacterium avium subsp. paratuberculosis
cgcccgggugcgcuugucggcgu

SEQ ID NO: 2934564 - RNA, 17 nt, Mycobacterium avium subsp. paratuberculosis
cgcccgggugcugcggc

SEQ ID NO: 2934565 - RNA, 21 nt, Mycobacterium avium subsp. paratuberculosis
cgcccgggugcugcggcucca

SEQ ID NO: 2934566 - RNA, 21 nt, Mycobacterium avium subsp. paratuberculosis
cgcccgggugugggcgccguc

SEQ ID NO: 2934567 - RNA, 22 nt, Mycobacterium avium subsp. paratuberculosis
cgcccgggugugggcgccguca

SEQ ID NO: 2934568 - RNA, 21 nt, Mycobacterium avium subsp. paratuberculosis
cgcccggguugcacaggucga

SEQ ID NO: 2934569 - RNA, 18 nt, Mycobacterium avium subsp. paratuberculosis
cgcccggguugucgacgu

SEQ ID NO: 2934570 - RNA, 19 nt, Mycobacterium avium subsp. paratuberculosis
cgcccggguugucgacgug

SEQ ID NO: 2934571 - RNA, 21 nt, Mycobacterium avium subsp. paratuberculosis
cgcccggguugucgacguggu

SEQ ID NO: 2934572 - RNA, 20 nt, Mycobacterium avium subsp. paratuberculosis
cgcccgguaggccgccgcga

SEQ ID NO: 2934573 - RNA, 16 nt, Mycobacterium avium subsp. paratuberculosis
cgcccggucacccgug

SEQ ID NO: 2934574 - RNA, 16 nt, Mycobacterium avium subsp. paratuberculosis
cgcccgguccgggucg

SEQ ID NO: 2934575 - RNA, 21 nt, Mycobacterium avium subsp. paratuberculosis
cgcccgguccgggucgcugag

SEQ ID NO: 2934576 - RNA, 16 nt, Mycobacterium avium subsp. paratuberculosis
cgcccggucgaccagg

SEQ ID NO: 2934577 - RNA, 20 nt, Mycobacterium avium subsp. paratuberculosis
cgcccggucgaggucggcca

SEQ ID NO: 2934578 - RNA, 21 nt, Mycobacterium avium subsp. paratuberculosis
cgcccggucgaggucggccag

SEQ ID NO: 2934579 - RNA, 22 nt, Mycobacterium avium subsp. paratuberculosis
cgcccggucgaggucggccagc

SEQ ID NO: 2934580 - RNA, 21 nt, Mycobacterium avium subsp. paratuberculosis
cgcccggucgaugaucuggcg

SEQ ID NO: 2934581 - RNA, 18 nt, Mycobacterium avium subsp. paratuberculosis
cgcccggugcgccagcgu

SEQ ID NO: 2934582 - RNA, 23 nt, Mycobacterium avium subsp. paratuberculosis
cgcccguagaacaguucgacgua

SEQ ID NO: 2934583 - RNA, 22 nt, Mycobacterium avium subsp. paratuberculosis
cgcccguagacccacagcugcc

SEQ ID NO: 2934584 - RNA, 14 nt, Mycobacterium avium subsp. paratuberculosis
cgcccguagccgcg

SEQ ID NO: 2934585 - RNA, 19 nt, Mycobacterium avium subsp. paratuberculosis
cgcccguagcggugggcgc

SEQ ID NO: 2934586 - RNA, 15 nt, Mycobacterium avium subsp. paratuberculosis
cgcccguccagcgca

SEQ ID NO: 2934587 - RNA, 14 nt, Mycobacterium avium subsp. paratuberculosis
cgcccgucccgccg

SEQ ID NO: 2934588 - RNA, 17 nt, Mycobacterium avium subsp. paratuberculosis
cgcccgucccgccgacg

SEQ ID NO: 2934589 - RNA, 13 nt, Mycobacterium avium subsp. paratuberculosis
cgcccgucccugc

SEQ ID NO: 2934590 - RNA, 15 nt, Mycobacterium avium subsp. paratuberculosis
cgcccguccgggccg

SEQ ID NO: 2934591 - RNA, 16 nt, Mycobacterium avium subsp. paratuberculosis
cgcccguccgggccgg

SEQ ID NO: 2934592 - RNA, 17 nt, Mycobacterium avium subsp. paratuberculosis
cgcccguccgggccggc

SEQ ID NO: 2934593 - RNA, 18 nt, Mycobacterium avium subsp. paratuberculosis
cgcccguccgggccggcc

SEQ ID NO: 2934594 - RNA, 24 nt, Mycobacterium avium subsp. paratuberculosis
cgcccgucgagcgucacgccgcgc

SEQ ID NO: 2934595 - RNA, 23 nt, Mycobacterium avium subsp. paratuberculosis
cgcccgucgagcgucacgcuggc

SEQ ID NO: 2934596 - RNA, 19 nt, Mycobacterium avium subsp. paratuberculosis
cgcccgucgagcgucauuc

SEQ ID NO: 2934597 - RNA, 13 nt, Mycobacterium avium subsp. paratuberculosis
cgcccgucgccuc

SEQ ID NO: 2934598 - RNA, 14 nt, Mycobacterium avium subsp. paratuberculosis
cgcccgucgcgcaa

SEQ ID NO: 2934599 - RNA, 18 nt, Mycobacterium avium subsp. paratuberculosis
cgcccgucggggcccggc

SEQ ID NO: 2934600 - RNA, 21 nt, Mycobacterium avium subsp. paratuberculosis
cgcccgucggggcccggcccg

SEQ ID NO: 2934601 - RNA, 17 nt, Mycobacterium avium subsp. paratuberculosis
cgcccgucucggcgugc

SEQ ID NO: 2934602 - RNA, 15 nt, Mycobacterium avium subsp. paratuberculosis
cgcccguggcccacg

SEQ ID NO: 2934603 - RNA, 18 nt, Mycobacterium avium subsp. paratuberculosis
cgcccguucgagcgccgg

SEQ ID NO: 2934604 - RNA, 20 nt, Mycobacterium avium subsp. paratuberculosis
cgcccguucgagcgccggac

SEQ ID NO: 2934605 - RNA, 17 nt, Mycobacterium avium subsp. paratuberculosis
cgcccuaacgugcccgg

SEQ ID NO: 2934606 - RNA, 15 nt, Mycobacterium avium subsp. paratuberculosis
cgcccuagcgggcca

SEQ ID NO: 2934607 - RNA, 16 nt, Mycobacterium avium subsp. paratuberculosis
cgcccuagcgggccag

SEQ ID NO: 2934608 - RNA, 20 nt, Mycobacterium avium subsp. paratuberculosis
cgcccuagucgacgccgaug

SEQ ID NO: 2934609 - RNA, 18 nt, Mycobacterium avium subsp. paratuberculosis
cgccgaaaaacgcgacgg

SEQ ID NO: 2934610 - RNA, 20 nt, Mycobacterium avium subsp. paratuberculosis
cgccgaaaaacgcgacggcc

SEQ ID NO: 2934611 - RNA, 17 nt, Mycobacterium avium subsp. paratuberculosis
cgccgaaacaccggcuu

SEQ ID NO: 2934612 - RNA, 13 nt, Mycobacterium avium subsp. paratuberculosis
cgccgaaacccgc

SEQ ID NO: 2934613 - RNA, 17 nt, Mycobacterium avium subsp. paratuberculosis
cgccgaaagccuccgcg

SEQ ID NO: 2934614 - RNA, 22 nt, Mycobacterium avium subsp. paratuberculosis
cgccgaaagguuuucccggccg

SEQ ID NO: 2934615 - RNA, 18 nt, Mycobacterium avium subsp. paratuberculosis
cgccgaacaacggcggac

SEQ ID NO: 2934616 - RNA, 22 nt, Mycobacterium avium subsp. paratuberculosis
cgccgaacaacggcggaccggc

SEQ ID NO: 2934617 - RNA, 23 nt, Mycobacterium avium subsp. paratuberculosis
cgccgaacaacggcggaccggcg

SEQ ID NO: 2934618 - RNA, 19 nt, Mycobacterium avium subsp. paratuberculosis
cgccgaacaccacgccgag

SEQ ID NO: 2934619 - RNA, 15 nt, Mycobacterium avium subsp. paratuberculosis
cgccgaacaccggca

SEQ ID NO: 2934620 - RNA, 16 nt, Mycobacterium avium subsp. paratuberculosis
cgccgaacaccggcag

SEQ ID NO: 2934621 - RNA, 17 nt, Mycobacterium avium subsp. paratuberculosis
cgccgaacaccggcagc

SEQ ID NO: 2934622 - RNA, 18 nt, Mycobacterium avium subsp. paratuberculosis
cgccgaacaccggcagcg

SEQ ID NO: 2934623 - RNA, 22 nt, Mycobacterium avium subsp. paratuberculosis
cgccgaacaccggcagcgccac

SEQ ID NO: 2934624 - RNA, 13 nt, Mycobacterium avium subsp. paratuberculosis
cgccgaacaccug

SEQ ID NO: 2934625 - RNA, 19 nt, Mycobacterium avium subsp. paratuberculosis
cgccgaacaccugcggcgg

SEQ ID NO: 2934626 - RNA, 21 nt, Mycobacterium avium subsp. paratuberculosis
cgccgaacaccugcggcggca

SEQ ID NO: 2934627 - RNA, 16 nt, Mycobacterium avium subsp. paratuberculosis
cgccgaacagcagcgc

SEQ ID NO: 2934628 - RNA, 22 nt, Mycobacterium avium subsp. paratuberculosis
cgccgaacagcagcgcgccgac

SEQ ID NO: 2934629 - RNA, 23 nt, Mycobacterium avium subsp. paratuberculosis
cgccgaacagcagcgcgccgacc

SEQ ID NO: 2934630 - RNA, 24 nt, Mycobacterium avium subsp. paratuberculosis
cgccgaacagcagcgcgccgacca

SEQ ID NO: 2934631 - RNA, 13 nt, Mycobacterium avium subsp. paratuberculosis
cgccgaacagccg

SEQ ID NO: 2934632 - RNA, 17 nt, Mycobacterium avium subsp. paratuberculosis
cgccgaacagccgggug

SEQ ID NO: 2934633 - RNA, 18 nt, Mycobacterium avium subsp. paratuberculosis
cgccgaaccagaucggcg

SEQ ID NO: 2934634 - RNA, 20 nt, Mycobacterium avium subsp. paratuberculosis
cgccgaaccagaucggcggg

SEQ ID NO: 2934635 - RNA, 18 nt, Mycobacterium avium subsp. paratuberculosis
cgccgaaccccagcuccg

SEQ ID NO: 2934636 - RNA, 15 nt, Mycobacterium avium subsp. paratuberculosis
cgccgaacccgcccu

SEQ ID NO: 2934637 - RNA, 23 nt, Mycobacterium avium subsp. paratuberculosis
cgccgaacccgcccucgccccgg

SEQ ID NO: 2934638 - RNA, 16 nt, Mycobacterium avium subsp. paratuberculosis
cgccgaaccgaucacc

SEQ ID NO: 2934639 - RNA, 21 nt, Mycobacterium avium subsp. paratuberculosis
cgccgaaccgaucaccggcag

SEQ ID NO: 2934640 - RNA, 22 nt, Mycobacterium avium subsp. paratuberculosis
cgccgaaccgaucaccggcagc

SEQ ID NO: 2934641 - RNA, 14 nt, Mycobacterium avium subsp. paratuberculosis
cgccgaaccgggcg

SEQ ID NO: 2934642 - RNA, 19 nt, Mycobacterium avium subsp. paratuberculosis
cgccgaaccgggcgcgcag

SEQ ID NO: 2934643 - RNA, 19 nt, Mycobacterium avium subsp. paratuberculosis
cgccgaaccggggccgcac

SEQ ID NO: 2934644 - RNA, 20 nt, Mycobacterium avium subsp. paratuberculosis
cgccgaaccggggccgcacc

SEQ ID NO: 2934645 - RNA, 18 nt, Mycobacterium avium subsp. paratuberculosis
cgccgaaccgggugacga

SEQ ID NO: 2934646 - RNA, 22 nt, Mycobacterium avium subsp. paratuberculosis
cgccgaaccgucccacacgggu

SEQ ID NO: 2934647 - RNA, 22 nt, Mycobacterium avium subsp. paratuberculosis
cgccgaacgcaccaccgcggug

SEQ ID NO: 2934648 - RNA, 14 nt, Mycobacterium avium subsp. paratuberculosis
cgccgaacgccacc

SEQ ID NO: 2934649 - RNA, 15 nt, Mycobacterium avium subsp. paratuberculosis
cgccgaacgccacca

SEQ ID NO: 2934650 - RNA, 18 nt, Mycobacterium avium subsp. paratuberculosis
cgccgaacgccaccaccu

SEQ ID NO: 2934651 - RNA, 19 nt, Mycobacterium avium subsp. paratuberculosis
cgccgaacgccaccaccuc

SEQ ID NO: 2934652 - RNA, 17 nt, Mycobacterium avium subsp. paratuberculosis
cgccgaacgucgagcgc

SEQ ID NO: 2934653 - RNA, 21 nt, Mycobacterium avium subsp. paratuberculosis
cgccgaacgugcacucagggc

SEQ ID NO: 2934654 - RNA, 17 nt, Mycobacterium avium subsp. paratuberculosis
cgccgaacgugcgcggc

SEQ ID NO: 2934655 - RNA, 19 nt, Mycobacterium avium subsp. paratuberculosis
cgccgaacgugcgcggcgc

SEQ ID NO: 2934656 - RNA, 21 nt, Mycobacterium avium subsp. paratuberculosis
cgccgaacgugcgcggcgcgc

SEQ ID NO: 2934657 - RNA, 15 nt, Mycobacterium avium subsp. paratuberculosis
cgccgaacucggcgc

SEQ ID NO: 2934658 - RNA, 18 nt, Mycobacterium avium subsp. paratuberculosis
cgccgaacucggcgccgc

SEQ ID NO: 2934659 - RNA, 19 nt, Mycobacterium avium subsp. paratuberculosis
cgccgaacucggcgccgcc

SEQ ID NO: 2934660 - RNA, 21 nt, Mycobacterium avium subsp. paratuberculosis
cgccgaacucggcgccgccgg

SEQ ID NO: 2934661 - RNA, 17 nt, Mycobacterium avium subsp. paratuberculosis
cgccgaacugccggacc

SEQ ID NO: 2934662 - RNA, 14 nt, Mycobacterium avium subsp. paratuberculosis
cgccgaagaucagc

SEQ ID NO: 2934663 - RNA, 15 nt, Mycobacterium avium subsp. paratuberculosis
cgccgaagaucagcg

SEQ ID NO: 2934664 - RNA, 18 nt, Mycobacterium avium subsp. paratuberculosis
cgccgaagaucagcgcgu

SEQ ID NO: 2934665 - RNA, 19 nt, Mycobacterium avium subsp. paratuberculosis
cgccgaagaucagcgcguc

SEQ ID NO: 2934666 - RNA, 20 nt, Mycobacterium avium subsp. paratuberculosis
cgccgaagauggccagcgcg

SEQ ID NO: 2934667 - RNA, 22 nt, Mycobacterium avium subsp. paratuberculosis
cgccgaagauggccagcgcggc

SEQ ID NO: 2934668 - RNA, 16 nt, Mycobacterium avium subsp. paratuberculosis
cgccgaagcccgacau

SEQ ID NO: 2934669 - RNA, 19 nt, Mycobacterium avium subsp. paratuberculosis
cgccgaagcccgagcguca

SEQ ID NO: 2934670 - RNA, 16 nt, Mycobacterium avium subsp. paratuberculosis
cgccgaagcccgcagc

SEQ ID NO: 2934671 - RNA, 15 nt, Mycobacterium avium subsp. paratuberculosis
cgccgaagccggcuc

SEQ ID NO: 2934672 - RNA, 17 nt, Mycobacterium avium subsp. paratuberculosis
cgccgaagccggcucga

SEQ ID NO: 2934673 - RNA, 20 nt, Mycobacterium avium subsp. paratuberculosis
cgccgaagccggcucgaaau

SEQ ID NO: 2934674 - RNA, 14 nt, Mycobacterium avium subsp. paratuberculosis
cgccgaagccgucg

SEQ ID NO: 2934675 - RNA, 17 nt, Mycobacterium avium subsp. paratuberculosis
cgccgaagccgucgacc

SEQ ID NO: 2934676 - RNA, 18 nt, Mycobacterium avium subsp. paratuberculosis
cgccgaagcggcgcacgc

SEQ ID NO: 2934677 - RNA, 19 nt, Mycobacterium avium subsp. paratuberculosis
cgccgaagcggcgcacgca

SEQ ID NO: 2934678 - RNA, 16 nt, Mycobacterium avium subsp. paratuberculosis
cgccgaaggccggguc

SEQ ID NO: 2934679 - RNA, 17 nt, Mycobacterium avium subsp. paratuberculosis
cgccgaaggccgggucg

SEQ ID NO: 2934680 - RNA, 17 nt, Mycobacterium avium subsp. paratuberculosis
cgccgaaguuccagccg

SEQ ID NO: 2934681 - RNA, 20 nt, Mycobacterium avium subsp. paratuberculosis
cgccgaaguuccagccgauc

SEQ ID NO: 2934682 - RNA, 21 nt, Mycobacterium avium subsp. paratuberculosis
cgccgaaguuccagccgaucg

SEQ ID NO: 2934683 - RNA, 15 nt, Mycobacterium avium subsp. paratuberculosis
cgccgaauccggcgg

SEQ ID NO: 2934684 - RNA, 18 nt, Mycobacterium avium subsp. paratuberculosis
cgccgaauccggcgggga

SEQ ID NO: 2934685 - RNA, 17 nt, Mycobacterium avium subsp. paratuberculosis
cgccgaauccgggcaug

SEQ ID NO: 2934686 - RNA, 16 nt, Mycobacterium avium subsp. paratuberculosis
cgccgaaugccacgcc

SEQ ID NO: 2934687 - RNA, 19 nt, Mycobacterium avium subsp. paratuberculosis
cgccgaaugccacgccgau

SEQ ID NO: 2934688 - RNA, 21 nt, Mycobacterium avium subsp. paratuberculosis
cgccgaaugccacgccgaugg

SEQ ID NO: 2934689 - RNA, 18 nt, Mycobacterium avium subsp. paratuberculosis
cgccgaauuguucggcca

SEQ ID NO: 2934690 - RNA, 21 nt, Mycobacterium avium subsp. paratuberculosis
cgccgaauuguucggccaccg

SEQ ID NO: 2934691 - RNA, 22 nt, Mycobacterium avium subsp. paratuberculosis
cgccgaauuguucggccaccgc

SEQ ID NO: 2934692 - RNA, 18 nt, Mycobacterium avium subsp. paratuberculosis
cgccgacaccaccacgaa

SEQ ID NO: 2934693 - RNA, 16 nt, Mycobacterium avium subsp. paratuberculosis
cgccgacgacgucgcg

SEQ ID NO: 2934694 - RNA, 22 nt, Mycobacterium avium subsp. paratuberculosis
cgccgacgauacgugcucccgc

SEQ ID NO: 2934695 - RNA, 18 nt, Mycobacterium avium subsp. paratuberculosis
cgccgacgaucccggcga

SEQ ID NO: 2934696 - RNA, 19 nt, Mycobacterium avium subsp. paratuberculosis
cgccgacgaucccggcgag

SEQ ID NO: 2934697 - RNA, 21 nt, Mycobacterium avium subsp. paratuberculosis
cgccgacgaucccggcgagca

SEQ ID NO: 2934698 - RNA, 23 nt, Mycobacterium avium subsp. paratuberculosis
cgccgacgaucccggcgagcacg

SEQ ID NO: 2934699 - RNA, 15 nt, Mycobacterium avium subsp. paratuberculosis
cgccgacgauccgcg

SEQ ID NO: 2934700 - RNA, 16 nt, Mycobacterium avium subsp. paratuberculosis
cgccgacgauccgcgc

SEQ ID NO: 2934701 - RNA, 22 nt, Mycobacterium avium subsp. paratuberculosis
cgccgacgauccgcgcccuggu

SEQ ID NO: 2934702 - RNA, 18 nt, Mycobacterium avium subsp. paratuberculosis
cgccgacgauccgcgccg

SEQ ID NO: 2934703 - RNA, 19 nt, Mycobacterium avium subsp. paratuberculosis
cgccgacgauccgcgccgc

SEQ ID NO: 2934704 - RNA, 20 nt, Mycobacterium avium subsp. paratuberculosis
cgccgacgaugcugucgcgg

SEQ ID NO: 2934705 - RNA, 22 nt, Mycobacterium avium subsp. paratuberculosis
cgccgacgaugcugucgcgggu

SEQ ID NO: 2934706 - RNA, 19 nt, Mycobacterium avium subsp. paratuberculosis
cgccgacgcauguccgccg

SEQ ID NO: 2934707 - RNA, 20 nt, Mycobacterium avium subsp. paratuberculosis
cgccgacgcauguccgccgu

SEQ ID NO: 2934708 - RNA, 15 nt, Mycobacterium avium subsp. paratuberculosis
cgccgacgccagcac

SEQ ID NO: 2934709 - RNA, 16 nt, Mycobacterium avium subsp. paratuberculosis
cgccgacgccagcacg

SEQ ID NO: 2934710 - RNA, 14 nt, Mycobacterium avium subsp. paratuberculosis
cgccgacgcccaca

SEQ ID NO: 2934711 - RNA, 16 nt, Mycobacterium avium subsp. paratuberculosis
cgccgacgcccacagc

SEQ ID NO: 2934712 - RNA, 18 nt, Mycobacterium avium subsp. paratuberculosis
cgccgacgcccacagcgc

SEQ ID NO: 2934713 - RNA, 20 nt, Mycobacterium avium subsp. paratuberculosis
cgccgacgcccacagcgcca

SEQ ID NO: 2934714 - RNA, 23 nt, Mycobacterium avium subsp. paratuberculosis
cgccgacgcccacagcgccagca

SEQ ID NO: 2934715 - RNA, 19 nt, Mycobacterium avium subsp. paratuberculosis
cgccgacgcccagcgcggc

SEQ ID NO: 2934716 - RNA, 20 nt, Mycobacterium avium subsp. paratuberculosis
cgccgacgcccagcgcggcg

SEQ ID NO: 2934717 - RNA, 21 nt, Mycobacterium avium subsp. paratuberculosis
cgccgacgcccagcgcggcga

SEQ ID NO: 2934718 - RNA, 22 nt, Mycobacterium avium subsp. paratuberculosis
cgccgacgcccagcgcggcgaa

SEQ ID NO: 2934719 - RNA, 16 nt, Mycobacterium avium subsp. paratuberculosis
cgccgacgcccaggcu

SEQ ID NO: 2934720 - RNA, 17 nt, Mycobacterium avium subsp. paratuberculosis
cgccgacgcccaggcuc

SEQ ID NO: 2934721 - RNA, 14 nt, Mycobacterium avium subsp. paratuberculosis
cgccgacgccgucg

SEQ ID NO: 2934722 - RNA, 16 nt, Mycobacterium avium subsp. paratuberculosis
cgccgacgccugcgcg

SEQ ID NO: 2934723 - RNA, 17 nt, Mycobacterium avium subsp. paratuberculosis
cgccgacgccugcgcga

SEQ ID NO: 2934724 - RNA, 22 nt, Mycobacterium avium subsp. paratuberculosis
cgccgacgccugcgcgaacagc

SEQ ID NO: 2934725 - RNA, 12 nt, Mycobacterium avium subsp. paratuberculosis
cgccgacgcgcu

SEQ ID NO: 2934726 - RNA, 14 nt, Mycobacterium avium subsp. paratuberculosis
cgccgacgcgcugc

SEQ ID NO: 2934727 - RNA, 21 nt, Mycobacterium avium subsp. paratuberculosis
cgccgacgcgcugcgcgccgc

SEQ ID NO: 2934728 - RNA, 16 nt, Mycobacterium avium subsp. paratuberculosis
cgccgacggagacgac

SEQ ID NO: 2934729 - RNA, 12 nt, Mycobacterium avium subsp. paratuberculosis
cgccgacggcca

SEQ ID NO: 2934730 - RNA, 14 nt, Mycobacterium avium subsp. paratuberculosis
cgccgacggccagc

SEQ ID NO: 2934731 - RNA, 15 nt, Mycobacterium avium subsp. paratuberculosis
cgccgacggccagca

SEQ ID NO: 2934732 - RNA, 16 nt, Mycobacterium avium subsp. paratuberculosis
cgccgacggccagcag

SEQ ID NO: 2934733 - RNA, 17 nt, Mycobacterium avium subsp. paratuberculosis
cgccgacggccagcagg

SEQ ID NO: 2934734 - RNA, 17 nt, Mycobacterium avium subsp. paratuberculosis
cgccgacggccgcgccg

SEQ ID NO: 2934735 - RNA, 18 nt, Mycobacterium avium subsp. paratuberculosis
cgccgacggccgcgccgu

SEQ ID NO: 2934736 - RNA, 20 nt, Mycobacterium avium subsp. paratuberculosis
cgccgacggccgcgccguug

SEQ ID NO: 2934737 - RNA, 16 nt, Mycobacterium avium subsp. paratuberculosis
cgccgacggcugcccg

SEQ ID NO: 2934738 - RNA, 20 nt, Mycobacterium avium subsp. paratuberculosis
cgccgacggcugcccggccc

SEQ ID NO: 2934739 - RNA, 21 nt, Mycobacterium avium subsp. paratuberculosis
cgccgacggcugcccggcccg

SEQ ID NO: 2934740 - RNA, 22 nt, Mycobacterium avium subsp. paratuberculosis
cgccgacggcugcccggcccgc

SEQ ID NO: 2934741 - RNA, 16 nt, Mycobacterium avium subsp. paratuberculosis
cgccgacgggcccagc

SEQ ID NO: 2934742 - RNA, 18 nt, Mycobacterium avium subsp. paratuberculosis
cgccgacgggcccagcgc

SEQ ID NO: 2934743 - RNA, 20 nt, Mycobacterium avium subsp. paratuberculosis
cgccgacgggcccagcgcga

SEQ ID NO: 2934744 - RNA, 21 nt, Mycobacterium avium subsp. paratuberculosis
cgccgacgggcccagcgcgac

SEQ ID NO: 2934745 - RNA, 22 nt, Mycobacterium avium subsp. paratuberculosis
cgccgacgggcccagcgcgacg

SEQ ID NO: 2934746 - RNA, 19 nt, Mycobacterium avium subsp. paratuberculosis
cgccgacgggcccgcgccu

SEQ ID NO: 2934747 - RNA, 20 nt, Mycobacterium avium subsp. paratuberculosis
cgccgacggucugcggugug

SEQ ID NO: 2934748 - RNA, 18 nt, Mycobacterium avium subsp. paratuberculosis
cgccgacggugagcaccg

SEQ ID NO: 2934749 - RNA, 19 nt, Mycobacterium avium subsp. paratuberculosis
cgccgacggugagcaccgc

SEQ ID NO: 2934750 - RNA, 21 nt, Mycobacterium avium subsp. paratuberculosis
cgccgacggugagcaccgccg

SEQ ID NO: 2934751 - RNA, 14 nt, Mycobacterium avium subsp. paratuberculosis
cgccgacgguggcc

SEQ ID NO: 2934752 - RNA, 19 nt, Mycobacterium avium subsp. paratuberculosis
cgccgacgguggcccccac

SEQ ID NO: 2934753 - RNA, 19 nt, Mycobacterium avium subsp. paratuberculosis
cgccgacgguggcgaagca

SEQ ID NO: 2934754 - RNA, 18 nt, Mycobacterium avium subsp. paratuberculosis
cgccgacgguguccgcgg

SEQ ID NO: 2934755 - RNA, 21 nt, Mycobacterium avium subsp. paratuberculosis
cgccgacgguguccgcgggca

SEQ ID NO: 2934756 - RNA, 19 nt, Mycobacterium avium subsp. paratuberculosis
cgccgacguagacgagccg

SEQ ID NO: 2934757 - RNA, 22 nt, Mycobacterium avium subsp. paratuberculosis
cgccgacguaggacagcaccac

SEQ ID NO: 2934758 - RNA, 23 nt, Mycobacterium avium subsp. paratuberculosis
cgccgacguaggacagcaccaca

SEQ ID NO: 2934759 - RNA, 16 nt, Mycobacterium avium subsp. paratuberculosis
cgccgacgucaggggu

SEQ ID NO: 2934760 - RNA, 23 nt, Mycobacterium avium subsp. paratuberculosis
cgccgacgucaggguggccucgu

SEQ ID NO: 2934761 - RNA, 14 nt, Mycobacterium avium subsp. paratuberculosis
cgccgacguccugg

SEQ ID NO: 2934762 - RNA, 22 nt, Mycobacterium avium subsp. paratuberculosis
cgccgacgucgugggcgauccg

SEQ ID NO: 2934763 - RNA, 20 nt, Mycobacterium avium subsp. paratuberculosis
cgccgacgucugguuggccg

SEQ ID NO: 2934764 - RNA, 13 nt, Mycobacterium avium subsp. paratuberculosis
cgccgacuagcgc

SEQ ID NO: 2934765 - RNA, 18 nt, Mycobacterium avium subsp. paratuberculosis
cgccgacuagcgcggcgg

SEQ ID NO: 2934766 - RNA, 19 nt, Mycobacterium avium subsp. paratuberculosis
cgccgacuagcgcggcggc

SEQ ID NO: 2934767 - RNA, 21 nt, Mycobacterium avium subsp. paratuberculosis
cgccgacuagcgcggcggccu

SEQ ID NO: 2934768 - RNA, 23 nt, Mycobacterium avium subsp. paratuberculosis
cgccgacuagcgcggcggccucg

SEQ ID NO: 2934769 - RNA, 18 nt, Mycobacterium avium subsp. paratuberculosis
cgccgacuccccgcccgg

SEQ ID NO: 2934770 - RNA, 22 nt, Mycobacterium avium subsp. paratuberculosis
cgccgacucgcaggugccggug

SEQ ID NO: 2934771 - RNA, 23 nt, Mycobacterium avium subsp. paratuberculosis
cgccgacugugcgaugucggugc

SEQ ID NO: 2934772 - RNA, 16 nt, Mycobacterium avium subsp. paratuberculosis
cgccgacuugaucgcg

SEQ ID NO: 2934773 - RNA, 17 nt, Mycobacterium avium subsp. paratuberculosis
cgccgacuugaucgcgg

SEQ ID NO: 2934774 - RNA, 19 nt, Mycobacterium avium subsp. paratuberculosis
cgccgacuugaucgcggcg

SEQ ID NO: 2934775 - RNA, 20 nt, Mycobacterium avium subsp. paratuberculosis
cgccgacuugaucgcggcgu

SEQ ID NO: 2934776 - RNA, 14 nt, Mycobacterium avium subsp. paratuberculosis
cgccgacuuggugc

SEQ ID NO: 2934777 - RNA, 15 nt, Mycobacterium avium subsp. paratuberculosis
cgccgaggcgcagga

SEQ ID NO: 2934778 - RNA, 16 nt, Mycobacterium avium subsp. paratuberculosis
cgccgaggcgcucggc

SEQ ID NO: 2934779 - RNA, 20 nt, Mycobacterium avium subsp. paratuberculosis
cgccgaggcgcucggcccgc

SEQ ID NO: 2934780 - RNA, 15 nt, Mycobacterium avium subsp. paratuberculosis
cgccgaggcgugccg

SEQ ID NO: 2934781 - RNA, 18 nt, Mycobacterium avium subsp. paratuberculosis
cgccgaggcgugccgcug

SEQ ID NO: 2934782 - RNA, 21 nt, Mycobacterium avium subsp. paratuberculosis
cgccgaggcgugccgcuggga

SEQ ID NO: 2934783 - RNA, 23 nt, Mycobacterium avium subsp. paratuberculosis
cgccgaggcgugccgcugggagc

SEQ ID NO: 2934784 - RNA, 16 nt, Mycobacterium avium subsp. paratuberculosis
cgccgagggccagcag

SEQ ID NO: 2934785 - RNA, 17 nt, Mycobacterium avium subsp. paratuberculosis
cgccgagggccagcagc

SEQ ID NO: 2934786 - RNA, 23 nt, Mycobacterium avium subsp. paratuberculosis
cgccgagggggaagucgaccggg

SEQ ID NO: 2934787 - RNA, 17 nt, Mycobacterium avium subsp. paratuberculosis
cgccgagggugccggcc

SEQ ID NO: 2934788 - RNA, 18 nt, Mycobacterium avium subsp. paratuberculosis
cgccgagggugccggcca

SEQ ID NO: 2934789 - RNA, 14 nt, Mycobacterium avium subsp. paratuberculosis
cgccgagguagccg

SEQ ID NO: 2934790 - RNA, 21 nt, Mycobacterium avium subsp. paratuberculosis
cgccgagguagccgcgcacca

SEQ ID NO: 2934791 - RNA, 16 nt, Mycobacterium avium subsp. paratuberculosis
cgccgaggucaccgcg

SEQ ID NO: 2934792 - RNA, 18 nt, Mycobacterium avium subsp. paratuberculosis
cgccgaggucaccgcggg

SEQ ID NO: 2934793 - RNA, 15 nt, Mycobacterium avium subsp. paratuberculosis
cgccgagguccucga

SEQ ID NO: 2934794 - RNA, 17 nt, Mycobacterium avium subsp. paratuberculosis
cgccgaggugcaacacu

SEQ ID NO: 2934795 - RNA, 19 nt, Mycobacterium avium subsp. paratuberculosis
cgccgaggugcugucgucg

SEQ ID NO: 2934796 - RNA, 17 nt, Mycobacterium avium subsp. paratuberculosis
cgccgagguggcccgcc

SEQ ID NO: 2934797 - RNA, 19 nt, Mycobacterium avium subsp. paratuberculosis
cgccgagguggcccgccac

SEQ ID NO: 2934798 - RNA, 23 nt, Mycobacterium avium subsp. paratuberculosis
cgccgagguggcccgccacgugc

SEQ ID NO: 2934799 - RNA, 17 nt, Mycobacterium avium subsp. paratuberculosis
cgccgagguggccgcca

SEQ ID NO: 2934800 - RNA, 19 nt, Mycobacterium avium subsp. paratuberculosis
cgccgagguggccgccagc

SEQ ID NO: 2934801 - RNA, 22 nt, Mycobacterium avium subsp. paratuberculosis
cgccgagguggccgccagcacc

SEQ ID NO: 2934802 - RNA, 24 nt, Mycobacterium avium subsp. paratuberculosis
cgccgagguggccgccagcaccuc

SEQ ID NO: 2934803 - RNA, 18 nt, Mycobacterium avium subsp. paratuberculosis
cgccgaguaacucggccu

SEQ ID NO: 2934804 - RNA, 14 nt, Mycobacterium avium subsp. paratuberculosis
cgccgaguccgggc

SEQ ID NO: 2934805 - RNA, 16 nt, Mycobacterium avium subsp. paratuberculosis
cgccgaguccgggccg

SEQ ID NO: 2934806 - RNA, 23 nt, Mycobacterium avium subsp. paratuberculosis
cgccgaguccgggccgccggccg

SEQ ID NO: 2934807 - RNA, 19 nt, Mycobacterium avium subsp. paratuberculosis
cgccgagucgaucgccagc

SEQ ID NO: 2934808 - RNA, 22 nt, Mycobacterium avium subsp. paratuberculosis
cgccgagucgaucgccagcgcg

SEQ ID NO: 2934809 - RNA, 16 nt, Mycobacterium avium subsp. paratuberculosis
cgccgagucgcgccgc

SEQ ID NO: 2934810 - RNA, 17 nt, Mycobacterium avium subsp. paratuberculosis
cgccgagucgcgccgcg

SEQ ID NO: 2934811 - RNA, 19 nt, Mycobacterium avium subsp. paratuberculosis
cgccgagucgcgccgcguc

SEQ ID NO: 2934812 - RNA, 20 nt, Mycobacterium avium subsp. paratuberculosis
cgccgagucgcgccgcgucg

SEQ ID NO: 2934813 - RNA, 20 nt, Mycobacterium avium subsp. paratuberculosis
cgccgaucaacaggcccagc

SEQ ID NO: 2934814 - RNA, 21 nt, Mycobacterium avium subsp. paratuberculosis
cgccgaucaacaggcccagca

SEQ ID NO: 2934815 - RNA, 23 nt, Mycobacterium avium subsp. paratuberculosis
cgccgaucaacaggcccagcagc

SEQ ID NO: 2934816 - RNA, 14 nt, Mycobacterium avium subsp. paratuberculosis
cgccgaucaccgcg

SEQ ID NO: 2934817 - RNA, 15 nt, Mycobacterium avium subsp. paratuberculosis
cgccgaucaccgcgu

SEQ ID NO: 2934818 - RNA, 18 nt, Mycobacterium avium subsp. paratuberculosis
cgccgaucaccgcguugu

SEQ ID NO: 2934819 - RNA, 19 nt, Mycobacterium avium subsp. paratuberculosis
cgccgaucaccgcguuguc

SEQ ID NO: 2934820 - RNA, 14 nt, Mycobacterium avium subsp. paratuberculosis
cgccgaucaccggc

SEQ ID NO: 2934821 - RNA, 17 nt, Mycobacterium avium subsp. paratuberculosis
cgccgaucaccggcacg

SEQ ID NO: 2934822 - RNA, 15 nt, Mycobacterium avium subsp. paratuberculosis
cgccgaucaccugac

SEQ ID NO: 2934823 - RNA, 15 nt, Mycobacterium avium subsp. paratuberculosis
cgccgaucacggugu

SEQ ID NO: 2934824 - RNA, 20 nt, Mycobacterium avium subsp. paratuberculosis
cgccgaucagcaccagguug

SEQ ID NO: 2934825 - RNA, 15 nt, Mycobacterium avium subsp. paratuberculosis
cgccgauccagccgu

SEQ ID NO: 2934826 - RNA, 16 nt, Mycobacterium avium subsp. paratuberculosis
cgccgauccagccguc

SEQ ID NO: 2934827 - RNA, 19 nt, Mycobacterium avium subsp. paratuberculosis
cgccgauccagccgucguu

SEQ ID NO: 2934828 - RNA, 15 nt, Mycobacterium avium subsp. paratuberculosis
cgccgauccgcagcc

SEQ ID NO: 2934829 - RNA, 18 nt, Mycobacterium avium subsp. paratuberculosis
cgccgauccgcagccgcu

SEQ ID NO: 2934830 - RNA, 19 nt, Mycobacterium avium subsp. paratuberculosis
cgccgauccgcagccgcug

SEQ ID NO: 2934831 - RNA, 20 nt, Mycobacterium avium subsp. paratuberculosis
cgccgauccgcagccgcugc

SEQ ID NO: 2934832 - RNA, 13 nt, Mycobacterium avium subsp. paratuberculosis
cgccgauccgcug

SEQ ID NO: 2934833 - RNA, 20 nt, Mycobacterium avium subsp. paratuberculosis
cgccgauccgcugcggaucc

SEQ ID NO: 2934834 - RNA, 21 nt, Mycobacterium avium subsp. paratuberculosis
cgccgauccgcugcggauccg

SEQ ID NO: 2934835 - RNA, 14 nt, Mycobacterium avium subsp. paratuberculosis
cgccgauccggcgc

SEQ ID NO: 2934836 - RNA, 15 nt, Mycobacterium avium subsp. paratuberculosis
cgccgauccggcgcc

SEQ ID NO: 2934837 - RNA, 22 nt, Mycobacterium avium subsp. paratuberculosis
cgccgauccggcgccgcgggcg

SEQ ID NO: 2934838 - RNA, 15 nt, Mycobacterium avium subsp. paratuberculosis
cgccgauccggcucc

SEQ ID NO: 2934839 - RNA, 17 nt, Mycobacterium avium subsp. paratuberculosis
cgccgauccgggcggca

SEQ ID NO: 2934840 - RNA, 18 nt, Mycobacterium avium subsp. paratuberculosis
cgccgauccgggcggcag

SEQ ID NO: 2934841 - RNA, 23 nt, Mycobacterium avium subsp. paratuberculosis
cgccgaucgaucagccgcgacag

SEQ ID NO: 2934842 - RNA, 14 nt, Mycobacterium avium subsp. paratuberculosis
cgccgaucgcccgg

SEQ ID NO: 2934843 - RNA, 15 nt, Mycobacterium avium subsp. paratuberculosis
cgccgaucgcccggu

SEQ ID NO: 2934844 - RNA, 13 nt, Mycobacterium avium subsp. paratuberculosis
cgccgaucgcgcg

SEQ ID NO: 2934845 - RNA, 15 nt, Mycobacterium avium subsp. paratuberculosis
cgccgaucgcgcgca

SEQ ID NO: 2934846 - RNA, 14 nt, Mycobacterium avium subsp. paratuberculosis
cgccgaucgugacg

SEQ ID NO: 2934847 - RNA, 21 nt, Mycobacterium avium subsp. paratuberculosis
cgccgaucgugacgccguccg

SEQ ID NO: 2934848 - RNA, 23 nt, Mycobacterium avium subsp. paratuberculosis
cgccgaucgugacgccguccgac

SEQ ID NO: 2934849 - RNA, 15 nt, Mycobacterium avium subsp. paratuberculosis
cgccgaucucgacca

SEQ ID NO: 2934850 - RNA, 18 nt, Mycobacterium avium subsp. paratuberculosis
cgccgaucucgaccagcg

SEQ ID NO: 2934851 - RNA, 19 nt, Mycobacterium avium subsp. paratuberculosis
cgccgaucucgaccagcgc

SEQ ID NO: 2934852 - RNA, 21 nt, Mycobacterium avium subsp. paratuberculosis
cgccgaucucgaccagcgccg

SEQ ID NO: 2934853 - RNA, 16 nt, Mycobacterium avium subsp. paratuberculosis
cgccgaucucggccaa

SEQ ID NO: 2934854 - RNA, 17 nt, Mycobacterium avium subsp. paratuberculosis
cgccgaucucggccaac

SEQ ID NO: 2934855 - RNA, 19 nt, Mycobacterium avium subsp. paratuberculosis
cgccgaucucggccaaccg

SEQ ID NO: 2934856 - RNA, 20 nt, Mycobacterium avium subsp. paratuberculosis
cgccgaucucggccaaccgg

SEQ ID NO: 2934857 - RNA, 22 nt, Mycobacterium avium subsp. paratuberculosis
cgccgaucucggccaaccgggc

SEQ ID NO: 2934858 - RNA, 18 nt, Mycobacterium avium subsp. paratuberculosis
cgccgaucugaccgagca

SEQ ID NO: 2934859 - RNA, 21 nt, Mycobacterium avium subsp. paratuberculosis
cgccgaucugcucggcugcag

SEQ ID NO: 2934860 - RNA, 16 nt, Mycobacterium avium subsp. paratuberculosis
cgccgaucuggcgcag

SEQ ID NO: 2934861 - RNA, 17 nt, Mycobacterium avium subsp. paratuberculosis
cgccgcacagccggcgg

SEQ ID NO: 2934862 - RNA, 18 nt, Mycobacterium avium subsp. paratuberculosis
cgccgcacagccggcggc

SEQ ID NO: 2934863 - RNA, 14 nt, Mycobacterium avium subsp. paratuberculosis
cgccgcaccaguuc

SEQ ID NO: 2934864 - RNA, 22 nt, Mycobacterium avium subsp. paratuberculosis
cgccgcaccaguuccugcaugc

SEQ ID NO: 2934865 - RNA, 15 nt, Mycobacterium avium subsp. paratuberculosis
cgccgcacccagcgg

SEQ ID NO: 2934866 - RNA, 13 nt, Mycobacterium avium subsp. paratuberculosis
cgccgcaccggcc

SEQ ID NO: 2934867 - RNA, 16 nt, Mycobacterium avium subsp. paratuberculosis
cgccgcaccggccggc

SEQ ID NO: 2934868 - RNA, 22 nt, Mycobacterium avium subsp. paratuberculosis
cgccgcaccggccggccccggg

SEQ ID NO: 2934869 - RNA, 12 nt, Mycobacterium avium subsp. paratuberculosis
cgccgcaccguc

SEQ ID NO: 2934870 - RNA, 17 nt, Mycobacterium avium subsp. paratuberculosis
cgccgcaccgucgugcc

SEQ ID NO: 2934871 - RNA, 21 nt, Mycobacterium avium subsp. paratuberculosis
cgccgcaccgucgugccagcg

SEQ ID NO: 2934872 - RNA, 16 nt, Mycobacterium avium subsp. paratuberculosis
cgccgcaccucgccgg

SEQ ID NO: 2934873 - RNA, 17 nt, Mycobacterium avium subsp. paratuberculosis
cgccgcaccucgccggc

SEQ ID NO: 2934874 - RNA, 21 nt, Mycobacterium avium subsp. paratuberculosis
cgccgcaccucgccggccgcc

SEQ ID NO: 2934875 - RNA, 21 nt, Mycobacterium avium subsp. paratuberculosis
cgccgcacgaauugccggugg

SEQ ID NO: 2934876 - RNA, 13 nt, Mycobacterium avium subsp. paratuberculosis
cgccgcacgccca

SEQ ID NO: 2934877 - RNA, 17 nt, Mycobacterium avium subsp. paratuberculosis
cgccgcacgcccacagc

SEQ ID NO: 2934878 - RNA, 14 nt, Mycobacterium avium subsp. paratuberculosis
cgccgcacgcgacc

SEQ ID NO: 2934879 - RNA, 17 nt, Mycobacterium avium subsp. paratuberculosis
cgccgcacgcgaccgcg

SEQ ID NO: 2934880 - RNA, 20 nt, Mycobacterium avium subsp. paratuberculosis
cgccgcacgcgaccgcgucg

SEQ ID NO: 2934881 - RNA, 18 nt, Mycobacterium avium subsp. paratuberculosis
cgccgcacugcacggccu

SEQ ID NO: 2934882 - RNA, 23 nt, Mycobacterium avium subsp. paratuberculosis
cgccgcacugcacggccucgguc

SEQ ID NO: 2934883 - RNA, 18 nt, Mycobacterium avium subsp. paratuberculosis
cgccgcagaucagggcga

SEQ ID NO: 2934884 - RNA, 16 nt, Mycobacterium avium subsp. paratuberculosis
cgccgcagcacgcuga

SEQ ID NO: 2934885 - RNA, 21 nt, Mycobacterium avium subsp. paratuberculosis
cgccgcagcacgcugaagccc

SEQ ID NO: 2934886 - RNA, 18 nt, Mycobacterium avium subsp. paratuberculosis
cgccgcagcagccgcgcc

SEQ ID NO: 2934887 - RNA, 13 nt, Mycobacterium avium subsp. paratuberculosis
cgccgcagcaggu

SEQ ID NO: 2934888 - RNA, 23 nt, Mycobacterium avium subsp. paratuberculosis
cgccgcagcaggugcaucgccac

SEQ ID NO: 2934889 - RNA, 21 nt, Mycobacterium avium subsp. paratuberculosis
cgccgcagcccaggcccagca

SEQ ID NO: 2934890 - RNA, 22 nt, Mycobacterium avium subsp. paratuberculosis
cgccgcagcccaggcccagcag

SEQ ID NO: 2934891 - RNA, 15 nt, Mycobacterium avium subsp. paratuberculosis
cgccgcagcccgcca

SEQ ID NO: 2934892 - RNA, 16 nt, Mycobacterium avium subsp. paratuberculosis
cgccgcagcccgccag

SEQ ID NO: 2934893 - RNA, 12 nt, Mycobacterium avium subsp. paratuberculosis
cgccgcagcgca

SEQ ID NO: 2934894 - RNA, 13 nt, Mycobacterium avium subsp. paratuberculosis
cgccgcagcgcgc

SEQ ID NO: 2934895 - RNA, 13 nt, Mycobacterium avium subsp. paratuberculosis
cgccgcagcggcg

SEQ ID NO: 2934896 - RNA, 14 nt, Mycobacterium avium subsp. paratuberculosis
cgccgcagcggcgc

SEQ ID NO: 2934897 - RNA, 15 nt, Mycobacterium avium subsp. paratuberculosis
cgccgcagcggcgcc

SEQ ID NO: 2934898 - RNA, 17 nt, Mycobacterium avium subsp. paratuberculosis
cgccgcagcggcgccgc

SEQ ID NO: 2934899 - RNA, 20 nt, Mycobacterium avium subsp. paratuberculosis
cgccgcagcggcgccgcagc

SEQ ID NO: 2934900 - RNA, 18 nt, Mycobacterium avium subsp. paratuberculosis
cgccgcagcggcgccggg

SEQ ID NO: 2934901 - RNA, 22 nt, Mycobacterium avium subsp. paratuberculosis
cgccgcagcggcgccgggaucg

SEQ ID NO: 2934902 - RNA, 12 nt, Mycobacterium avium subsp. paratuberculosis
cgccgcagcggu

SEQ ID NO: 2934903 - RNA, 12 nt, Mycobacterium avium subsp. paratuberculosis
cgccgcaggcgu

SEQ ID NO: 2934904 - RNA, 22 nt, Mycobacterium avium subsp. paratuberculosis
cgccgcauacaccuugucggcg

SEQ ID NO: 2934905 - RNA, 16 nt, Mycobacterium avium subsp. paratuberculosis
cgccgcaugaugcggc

SEQ ID NO: 2934906 - RNA, 19 nt, Mycobacterium avium subsp. paratuberculosis
cgccgcaugaugcggccau

SEQ ID NO: 2934907 - RNA, 20 nt, Mycobacterium avium subsp. paratuberculosis
cgccgcaugaugcggccaug

SEQ ID NO: 2934908 - RNA, 21 nt, Mycobacterium avium subsp. paratuberculosis
cgccgcaugcccuugucgcug

SEQ ID NO: 2934909 - RNA, 22 nt, Mycobacterium avium subsp. paratuberculosis
cgccgcaugcccuugucgcugg

SEQ ID NO: 2934910 - RNA, 15 nt, Mycobacterium avium subsp. paratuberculosis
cgccgcauuccucgg

SEQ ID NO: 2934911 - RNA, 16 nt, Mycobacterium avium subsp. paratuberculosis
cgccgcauuccucggc

SEQ ID NO: 2934912 - RNA, 18 nt, Mycobacterium avium subsp. paratuberculosis
cgccgcauuccucggcca

SEQ ID NO: 2934913 - RNA, 20 nt, Mycobacterium avium subsp. paratuberculosis
cgccgcauuccucggccagc

SEQ ID NO: 2934914 - RNA, 22 nt, Mycobacterium avium subsp. paratuberculosis
cgccgcauuggcaccgucgacc

SEQ ID NO: 2934915 - RNA, 18 nt, Mycobacterium avium subsp. paratuberculosis
cgccgcauuggugccggc

SEQ ID NO: 2934916 - RNA, 19 nt, Mycobacterium avium subsp. paratuberculosis
cgccgcauuggugccggcc

SEQ ID NO: 2934917 - RNA, 22 nt, Mycobacterium avium subsp. paratuberculosis
cgccgcauuggugccggccucg

SEQ ID NO: 2934918 - RNA, 23 nt, Mycobacterium avium subsp. paratuberculosis
cgccgcauuggugccggccucgu

SEQ ID NO: 2934919 - RNA, 14 nt, Mycobacterium avium subsp. paratuberculosis
cgccgccaaccagg

SEQ ID NO: 2934920 - RNA, 22 nt, Mycobacterium avium subsp. paratuberculosis
cgccgccaaccaggucgcggcg

SEQ ID NO: 2934921 - RNA, 24 nt, Mycobacterium avium subsp. paratuberculosis
cgccgccaaccaggucgcggcgcu

SEQ ID NO: 2934922 - RNA, 14 nt, Mycobacterium avium subsp. paratuberculosis
cgccgccaacgcga

SEQ ID NO: 2934923 - RNA, 16 nt, Mycobacterium avium subsp. paratuberculosis
cgccgccacaccucgg

SEQ ID NO: 2934924 - RNA, 18 nt, Mycobacterium avium subsp. paratuberculosis
cgccgccacaccucggcg

SEQ ID NO: 2934925 - RNA, 15 nt, Mycobacterium avium subsp. paratuberculosis
cgccgccaccacggc

SEQ ID NO: 2934926 - RNA, 14 nt, Mycobacterium avium subsp. paratuberculosis
cgccgccaccggcc

SEQ ID NO: 2934927 - RNA, 15 nt, Mycobacterium avium subsp. paratuberculosis
cgccgccaccggccg

SEQ ID NO: 2934928 - RNA, 16 nt, Mycobacterium avium subsp. paratuberculosis
cgccgccaccggccgg

SEQ ID NO: 2934929 - RNA, 17 nt, Mycobacterium avium subsp. paratuberculosis
cgccgccaccggccggu

SEQ ID NO: 2934930 - RNA, 18 nt, Mycobacterium avium subsp. paratuberculosis
cgccgccaccgucgccgg

SEQ ID NO: 2934931 - RNA, 22 nt, Mycobacterium avium subsp. paratuberculosis
cgccgccaccgucgccggcuga

SEQ ID NO: 2934932 - RNA, 16 nt, Mycobacterium avium subsp. paratuberculosis
cgccgccacgcggcgc

SEQ ID NO: 2934933 - RNA, 17 nt, Mycobacterium avium subsp. paratuberculosis
cgccgccacgcggcgcg

SEQ ID NO: 2934934 - RNA, 18 nt, Mycobacterium avium subsp. paratuberculosis
cgccgccacgcggcgcgc

SEQ ID NO: 2934935 - RNA, 12 nt, Mycobacterium avium subsp. paratuberculosis
cgccgccacggc

SEQ ID NO: 2934936 - RNA, 16 nt, Mycobacterium avium subsp. paratuberculosis
cgccgccacggccacc

SEQ ID NO: 2934937 - RNA, 22 nt, Mycobacterium avium subsp. paratuberculosis
cgccgccagcaaccccgcggug

SEQ ID NO: 2934938 - RNA, 13 nt, Mycobacterium avium subsp. paratuberculosis
cgccgccagcacc

SEQ ID NO: 2934939 - RNA, 14 nt, Mycobacterium avium subsp. paratuberculosis
cgccgccagcacca

SEQ ID NO: 2934940 - RNA, 16 nt, Mycobacterium avium subsp. paratuberculosis
cgccgccagcaccacc

SEQ ID NO: 2934941 - RNA, 19 nt, Mycobacterium avium subsp. paratuberculosis
cgccgccagcacgugaugc

SEQ ID NO: 2934942 - RNA, 23 nt, Mycobacterium avium subsp. paratuberculosis
cgccgccagcacgugaugcagcu

SEQ ID NO: 2934943 - RNA, 16 nt, Mycobacterium avium subsp. paratuberculosis
cgccgccagcagcagc

SEQ ID NO: 2934944 - RNA, 21 nt, Mycobacterium avium subsp. paratuberculosis
cgccgccagcagcagcgccgc

SEQ ID NO: 2934945 - RNA, 13 nt, Mycobacterium avium subsp. paratuberculosis
cgccgccagccag

SEQ ID NO: 2934946 - RNA, 14 nt, Mycobacterium avium subsp. paratuberculosis
cgccgccgacgaag

SEQ ID NO: 2934947 - RNA, 15 nt, Mycobacterium avium subsp. paratuberculosis
cgccgccgacgaaga

SEQ ID NO: 2934948 - RNA, 20 nt, Mycobacterium avium subsp. paratuberculosis
cgccgccgagccgcggguga

SEQ ID NO: 2934949 - RNA, 21 nt, Mycobacterium avium subsp. paratuberculosis
cgccgccgcaauacaccgcga

SEQ ID NO: 2934950 - RNA, 12 nt, Mycobacterium avium subsp. paratuberculosis
cgccgccgcacc

SEQ ID NO: 2934951 - RNA, 13 nt, Mycobacterium avium subsp. paratuberculosis
cgccgccgcaccg

SEQ ID NO: 2934952 - RNA, 15 nt, Mycobacterium avium subsp. paratuberculosis
cgccgccgcaccggc

SEQ ID NO: 2934953 - RNA, 12 nt, Mycobacterium avium subsp. paratuberculosis
cgccgccgccag

SEQ ID NO: 2934954 - RNA, 17 nt, Mycobacterium avium subsp. paratuberculosis
cgccgccgccagcacca

SEQ ID NO: 2934955 - RNA, 15 nt, Mycobacterium avium subsp. paratuberculosis
cgccgccgccagcca

SEQ ID NO: 2934956 - RNA, 16 nt, Mycobacterium avium subsp. paratuberculosis
cgccgccgccagccag

SEQ ID NO: 2934957 - RNA, 14 nt, Mycobacterium avium subsp. paratuberculosis
cgccgccgcccugg

SEQ ID NO: 2934958 - RNA, 15 nt, Mycobacterium avium subsp. paratuberculosis
cgccgccgcccuggc

SEQ ID NO: 2934959 - RNA, 14 nt, Mycobacterium avium subsp. paratuberculosis
cgccgccgccgagc

SEQ ID NO: 2934960 - RNA, 14 nt, Mycobacterium avium subsp. paratuberculosis
cgccgccgccgauc

SEQ ID NO: 2934961 - RNA, 14 nt, Mycobacterium avium subsp. paratuberculosis
cgccgccgcgaacu

SEQ ID NO: 2934962 - RNA, 16 nt, Mycobacterium avium subsp. paratuberculosis
cgccgccgcgaacuca

SEQ ID NO: 2934963 - RNA, 14 nt, Mycobacterium avium subsp. paratuberculosis
cgccgccgcgacca

SEQ ID NO: 2934964 - RNA, 14 nt, Mycobacterium avium subsp. paratuberculosis
cgccgccgcggccg

SEQ ID NO: 2934965 - RNA, 12 nt, Mycobacterium avium subsp. paratuberculosis
cgccgccgcggg

SEQ ID NO: 2934966 - RNA, 14 nt, Mycobacterium avium subsp. paratuberculosis
cgccgccggcgcug

SEQ ID NO: 2934967 - RNA, 17 nt, Mycobacterium avium subsp. paratuberculosis
cgccgccggcgcuggcg

SEQ ID NO: 2934968 - RNA, 13 nt, Mycobacterium avium subsp. paratuberculosis
cgccgccggcgga

SEQ ID NO: 2934969 - RNA, 13 nt, Mycobacterium avium subsp. paratuberculosis
cgccgccggcggu

SEQ ID NO: 2934970 - RNA, 13 nt, Mycobacterium avium subsp. paratuberculosis
cgccgccggcguc

SEQ ID NO: 2934971 - RNA, 14 nt, Mycobacterium avium subsp. paratuberculosis
cgccgccggcgucg

SEQ ID NO: 2934972 - RNA, 16 nt, Mycobacterium avium subsp. paratuberculosis
cgccgccggcgucgac

SEQ ID NO: 2934973 - RNA, 18 nt, Mycobacterium avium subsp. paratuberculosis
cgccgccggcgucgacgu

SEQ ID NO: 2934974 - RNA, 20 nt, Mycobacterium avium subsp. paratuberculosis
cgccgccggcgucgacgucg

SEQ ID NO: 2934975 - RNA, 20 nt, Mycobacterium avium subsp. paratuberculosis
cgccgccggcgucgccgcuc

SEQ ID NO: 2934976 - RNA, 15 nt, Mycobacterium avium subsp. paratuberculosis
cgccgccggcuagac

SEQ ID NO: 2934977 - RNA, 22 nt, Mycobacterium avium subsp. paratuberculosis
cgccgccggcuagacgcgcagc

SEQ ID NO: 2934978 - RNA, 15 nt, Mycobacterium avium subsp. paratuberculosis
cgccgccgggaacag

SEQ ID NO: 2934979 - RNA, 22 nt, Mycobacterium avium subsp. paratuberculosis
cgccgccgggccuguccagccg

SEQ ID NO: 2934980 - RNA, 14 nt, Mycobacterium avium subsp. paratuberculosis
cgccgccgggcgcc

SEQ ID NO: 2934981 - RNA, 13 nt, Mycobacterium avium subsp. paratuberculosis
cgccgccggggcg

SEQ ID NO: 2934982 - RNA, 17 nt, Mycobacterium avium subsp. paratuberculosis
cgccgccggggcgcaga

SEQ ID NO: 2934983 - RNA, 15 nt, Mycobacterium avium subsp. paratuberculosis
cgccgccggggcguc

SEQ ID NO: 2934984 - RNA, 21 nt, Mycobacterium avium subsp. paratuberculosis
cgccgccggggcgucggacgc

SEQ ID NO: 2934985 - RNA, 16 nt, Mycobacterium avium subsp. paratuberculosis
cgccgccggucgcccc

SEQ ID NO: 2934986 - RNA, 22 nt, Mycobacterium avium subsp. paratuberculosis
cgccgccggugaccacgcugag

SEQ ID NO: 2934987 - RNA, 15 nt, Mycobacterium avium subsp. paratuberculosis
cgccgccggugccga

SEQ ID NO: 2934988 - RNA, 22 nt, Mycobacterium avium subsp. paratuberculosis
cgccgccgguggagauggccag

SEQ ID NO: 2934989 - RNA, 18 nt, Mycobacterium avium subsp. paratuberculosis
cgccgccgucccaccggc

SEQ ID NO: 2934990 - RNA, 14 nt, Mycobacterium avium subsp. paratuberculosis
cgccgccgucggug

SEQ ID NO: 2934991 - RNA, 20 nt, Mycobacterium avium subsp. paratuberculosis
cgccgccgucguagccgcgg

SEQ ID NO: 2934992 - RNA, 22 nt, Mycobacterium avium subsp. paratuberculosis
cgccgccgucguagccgcgggu

SEQ ID NO: 2934993 - RNA, 22 nt, Mycobacterium avium subsp. paratuberculosis
cgccgccguguaggccgcgcug

SEQ ID NO: 2934994 - RNA, 17 nt, Mycobacterium avium subsp. paratuberculosis
cgccgccguucgccggc

SEQ ID NO: 2934995 - RNA, 19 nt, Mycobacterium avium subsp. paratuberculosis
cgccgccguucgccggcga

SEQ ID NO: 2934996 - RNA, 15 nt, Mycobacterium avium subsp. paratuberculosis
cgccgccucaccgaa

SEQ ID NO: 2934997 - RNA, 16 nt, Mycobacterium avium subsp. paratuberculosis
cgccgccuccgacagc

SEQ ID NO: 2934998 - RNA, 17 nt, Mycobacterium avium subsp. paratuberculosis
cgccgccuccgacagcc

SEQ ID NO: 2934999 - RNA, 22 nt, Mycobacterium avium subsp. paratuberculosis
cgccgccuccgacagccgcacc

SEQ ID NO: 2935000 - RNA, 23 nt, Mycobacterium avium subsp. paratuberculosis
cgccgccuccgacagccgcaccg

SEQ ID NO: 2935001 - RNA, 14 nt, Mycobacterium avium subsp. paratuberculosis
cgccgccuccgggc

SEQ ID NO: 2935002 - RNA, 18 nt, Mycobacterium avium subsp. paratuberculosis
cgccgccuccgggcugcc

SEQ ID NO: 2935003 - RNA, 15 nt, Mycobacterium avium subsp. paratuberculosis
cgccgccugagcccg

SEQ ID NO: 2935004 - RNA, 18 nt, Mycobacterium avium subsp. paratuberculosis
cgccgccuucuugcgcgg

SEQ ID NO: 2935005 - RNA, 21 nt, Mycobacterium avium subsp. paratuberculosis
cgccgccuucuugcgcggcgc

SEQ ID NO: 2935006 - RNA, 22 nt, Mycobacterium avium subsp. paratuberculosis
cgccgccuucuugcgcggcgcg

SEQ ID NO: 2935007 - RNA, 19 nt, Mycobacterium avium subsp. paratuberculosis
cgccgccuugacgccgggc

SEQ ID NO: 2935008 - RNA, 20 nt, Mycobacterium avium subsp. paratuberculosis
cgccgcgaacaauuccucug

SEQ ID NO: 2935009 - RNA, 12 nt, Mycobacterium avium subsp. paratuberculosis
cgccgcgaacga

SEQ ID NO: 2935010 - RNA, 17 nt, Mycobacterium avium subsp. paratuberculosis
cgccgcgaacgacgacc

SEQ ID NO: 2935011 - RNA, 23 nt, Mycobacterium avium subsp. paratuberculosis
cgccgcgaacucaggcgcgcacg

SEQ ID NO: 2935012 - RNA, 17 nt, Mycobacterium avium subsp. paratuberculosis
cgccgcgacacccgcga

SEQ ID NO: 2935013 - RNA, 18 nt, Mycobacterium avium subsp. paratuberculosis
cgccgcgacacccgcgac

SEQ ID NO: 2935014 - RNA, 15 nt, Mycobacterium avium subsp. paratuberculosis
cgccgcgaccacagc

SEQ ID NO: 2935015 - RNA, 13 nt, Mycobacterium avium subsp. paratuberculosis
cgccgcgaccccg

SEQ ID NO: 2935016 - RNA, 13 nt, Mycobacterium avium subsp. paratuberculosis
cgccgcgacccgg

SEQ ID NO: 2935017 - RNA, 16 nt, Mycobacterium avium subsp. paratuberculosis
cgccgcgaccgcgauc

SEQ ID NO: 2935018 - RNA, 22 nt, Mycobacterium avium subsp. paratuberculosis
cgccgcgaccgcgaucagggcc

SEQ ID NO: 2935019 - RNA, 16 nt, Mycobacterium avium subsp. paratuberculosis
cgccgcgaccgucagc

SEQ ID NO: 2935020 - RNA, 18 nt, Mycobacterium avium subsp. paratuberculosis
cgccgcgaccgucagcag

SEQ ID NO: 2935021 - RNA, 13 nt, Mycobacterium avium subsp. paratuberculosis
cgccgcgacgaug

SEQ ID NO: 2935022 - RNA, 22 nt, Mycobacterium avium subsp. paratuberculosis
cgccgcgacgaugccggcgucg

SEQ ID NO: 2935023 - RNA, 23 nt, Mycobacterium avium subsp. paratuberculosis
cgccgcgacgaugucgacccgcg

SEQ ID NO: 2935024 - RNA, 14 nt, Mycobacterium avium subsp. paratuberculosis
cgccgcgacgccgu

SEQ ID NO: 2935025 - RNA, 15 nt, Mycobacterium avium subsp. paratuberculosis
cgccgcgacggccgc

SEQ ID NO: 2935026 - RNA, 16 nt, Mycobacterium avium subsp. paratuberculosis
cgccgcgagccgccca

SEQ ID NO: 2935027 - RNA, 19 nt, Mycobacterium avium subsp. paratuberculosis
cgccgcgagccgcccaggc

SEQ ID NO: 2935028 - RNA, 13 nt, Mycobacterium avium subsp. paratuberculosis
cgccgcgagcgca

SEQ ID NO: 2935029 - RNA, 16 nt, Mycobacterium avium subsp. paratuberculosis
cgccgcgagcgcagca

SEQ ID NO: 2935030 - RNA, 17 nt, Mycobacterium avium subsp. paratuberculosis
cgccgcgauccgggcau

SEQ ID NO: 2935031 - RNA, 19 nt, Mycobacterium avium subsp. paratuberculosis
cgccgcggaagccccaggc

SEQ ID NO: 2935032 - RNA, 22 nt, Mycobacterium avium subsp. paratuberculosis
cgccgcggaagccccaggcccg

SEQ ID NO: 2935033 - RNA, 18 nt, Mycobacterium avium subsp. paratuberculosis
cgccgcggagcggcgguc

SEQ ID NO: 2935034 - RNA, 12 nt, Mycobacterium avium subsp. paratuberculosis
cgccgcggaucg

SEQ ID NO: 2935035 - RNA, 18 nt, Mycobacterium avium subsp. paratuberculosis
cgccgcggaucuucuccg

SEQ ID NO: 2935036 - RNA, 20 nt, Mycobacterium avium subsp. paratuberculosis
cgccgcggauguggaggcga

SEQ ID NO: 2935037 - RNA, 21 nt, Mycobacterium avium subsp. paratuberculosis
cgccgcggauguggaggcgag

SEQ ID NO: 2935038 - RNA, 20 nt, Mycobacterium avium subsp. paratuberculosis
cgccgcggcaacgccagcca

SEQ ID NO: 2935039 - RNA, 21 nt, Mycobacterium avium subsp. paratuberculosis
cgccgcggcaacgccagccag

SEQ ID NO: 2935040 - RNA, 13 nt, Mycobacterium avium subsp. paratuberculosis
cgccgcggcaccu

SEQ ID NO: 2935041 - RNA, 15 nt, Mycobacterium avium subsp. paratuberculosis
cgccgcggcaccuuc

SEQ ID NO: 2935042 - RNA, 12 nt, Mycobacterium avium subsp. paratuberculosis
cgccgcggccac

SEQ ID NO: 2935043 - RNA, 13 nt, Mycobacterium avium subsp. paratuberculosis
cgccgcggccaca

SEQ ID NO: 2935044 - RNA, 15 nt, Mycobacterium avium subsp. paratuberculosis
cgccgcggccacacu

SEQ ID NO: 2935045 - RNA, 14 nt, Mycobacterium avium subsp. paratuberculosis
cgccgcggccaccg

SEQ ID NO: 2935046 - RNA, 15 nt, Mycobacterium avium subsp. paratuberculosis
cgccgcggccaccgg

SEQ ID NO: 2935047 - RNA, 13 nt, Mycobacterium avium subsp. paratuberculosis
cgccgcggccacg

SEQ ID NO: 2935048 - RNA, 13 nt, Mycobacterium avium subsp. paratuberculosis
cgccgcggccagc

SEQ ID NO: 2935049 - RNA, 15 nt, Mycobacterium avium subsp. paratuberculosis
cgccgcggccagccg

SEQ ID NO: 2935050 - RNA, 16 nt, Mycobacterium avium subsp. paratuberculosis
cgccgcggccagccgg

SEQ ID NO: 2935051 - RNA, 19 nt, Mycobacterium avium subsp. paratuberculosis
cgccgcggccagccggucg

SEQ ID NO: 2935052 - RNA, 17 nt, Mycobacterium avium subsp. paratuberculosis
cgccgcggccagcgccc

SEQ ID NO: 2935053 - RNA, 21 nt, Mycobacterium avium subsp. paratuberculosis
cgccgcggccagcgccccgcc

SEQ ID NO: 2935054 - RNA, 22 nt, Mycobacterium avium subsp. paratuberculosis
cgccgcggccagcgccccgccg

SEQ ID NO: 2935055 - RNA, 16 nt, Mycobacterium avium subsp. paratuberculosis
cgccgcggccaggucg

SEQ ID NO: 2935056 - RNA, 17 nt, Mycobacterium avium subsp. paratuberculosis
cgccgcggccaggucga

SEQ ID NO: 2935057 - RNA, 20 nt, Mycobacterium avium subsp. paratuberculosis
cgccgcggcccugcagcgcc

SEQ ID NO: 2935058 - RNA, 13 nt, Mycobacterium avium subsp. paratuberculosis
cgccgcggccgaa

SEQ ID NO: 2935059 - RNA, 21 nt, Mycobacterium avium subsp. paratuberculosis
cgccgcggccgaaccgcugca

SEQ ID NO: 2935060 - RNA, 14 nt, Mycobacterium avium subsp. paratuberculosis
cgccgcggccgccu

SEQ ID NO: 2935061 - RNA, 14 nt, Mycobacterium avium subsp. paratuberculosis
cgccgcggccgcga

SEQ ID NO: 2935062 - RNA, 17 nt, Mycobacterium avium subsp. paratuberculosis
cgccgcggccgcggcgg

SEQ ID NO: 2935063 - RNA, 22 nt, Mycobacterium avium subsp. paratuberculosis
cgccgcggccgcggcgggcgcg

SEQ ID NO: 2935064 - RNA, 13 nt, Mycobacterium avium subsp. paratuberculosis
cgccgcggccgcu

SEQ ID NO: 2935065 - RNA, 17 nt, Mycobacterium avium subsp. paratuberculosis
cgccgcggccgcuggcg

SEQ ID NO: 2935066 - RNA, 14 nt, Mycobacterium avium subsp. paratuberculosis
cgccgcggccggug

SEQ ID NO: 2935067 - RNA, 15 nt, Mycobacterium avium subsp. paratuberculosis
cgccgcggccguugc

SEQ ID NO: 2935068 - RNA, 22 nt, Mycobacterium avium subsp. paratuberculosis
cgccgcggccguugcucucggc

SEQ ID NO: 2935069 - RNA, 14 nt, Mycobacterium avium subsp. paratuberculosis
cgccgcggcgacca

SEQ ID NO: 2935070 - RNA, 14 nt, Mycobacterium avium subsp. paratuberculosis
cgccgcggcgaccg

SEQ ID NO: 2935071 - RNA, 19 nt, Mycobacterium avium subsp. paratuberculosis
cgccgcggcgaccggggcg

SEQ ID NO: 2935072 - RNA, 12 nt, Mycobacterium avium subsp. paratuberculosis
cgccgcggcgag

SEQ ID NO: 2935073 - RNA, 14 nt, Mycobacterium avium subsp. paratuberculosis
cgccgcggcgagcc

SEQ ID NO: 2935074 - RNA, 17 nt, Mycobacterium avium subsp. paratuberculosis
cgccgcggcgagccggc

SEQ ID NO: 2935075 - RNA, 19 nt, Mycobacterium avium subsp. paratuberculosis
cgccgcggcgagccggccg

SEQ ID NO: 2935076 - RNA, 13 nt, Mycobacterium avium subsp. paratuberculosis
cgccgcggcgauc

SEQ ID NO: 2935077 - RNA, 14 nt, Mycobacterium avium subsp. paratuberculosis
cgccgcggcgcccu

SEQ ID NO: 2935078 - RNA, 16 nt, Mycobacterium avium subsp. paratuberculosis
cgccgcggcgcccucg

SEQ ID NO: 2935079 - RNA, 21 nt, Mycobacterium avium subsp. paratuberculosis
cgccgcggcgcccucgccggc

SEQ ID NO: 2935080 - RNA, 13 nt, Mycobacterium avium subsp. paratuberculosis
cgccgcggcgccg

SEQ ID NO: 2935081 - RNA, 17 nt, Mycobacterium avium subsp. paratuberculosis
cgccgcggcgccgccac

SEQ ID NO: 2935082 - RNA, 22 nt, Mycobacterium avium subsp. paratuberculosis
cgccgcggcgcuugaccucgcc

SEQ ID NO: 2935083 - RNA, 11 nt, Mycobacterium avium subsp. paratuberculosis
cgccgcggcgg

SEQ ID NO: 2935084 - RNA, 12 nt, Mycobacterium avium subsp. paratuberculosis
cgccgcggcggc

SEQ ID NO: 2935085 - RNA, 13 nt, Mycobacterium avium subsp. paratuberculosis
cgccgcggcggca

SEQ ID NO: 2935086 - RNA, 18 nt, Mycobacterium avium subsp. paratuberculosis
cgccgcggcggcaagucc

SEQ ID NO: 2935087 - RNA, 21 nt, Mycobacterium avium subsp. paratuberculosis
cgccgcggcggcaaguccggg

SEQ ID NO: 2935088 - RNA, 16 nt, Mycobacterium avium subsp. paratuberculosis
cgccgcggcggcaccc

SEQ ID NO: 2935089 - RNA, 17 nt, Mycobacterium avium subsp. paratuberculosis
cgccgcggcggcaccca

SEQ ID NO: 2935090 - RNA, 13 nt, Mycobacterium avium subsp. paratuberculosis
cgccgcggcggcc

SEQ ID NO: 2935091 - RNA, 14 nt, Mycobacterium avium subsp. paratuberculosis
cgccgcggcggccu

SEQ ID NO: 2935092 - RNA, 13 nt, Mycobacterium avium subsp. paratuberculosis
cgccgcggcggcu

SEQ ID NO: 2935093 - RNA, 14 nt, Mycobacterium avium subsp. paratuberculosis
cgccgcggcggcuc

SEQ ID NO: 2935094 - RNA, 15 nt, Mycobacterium avium subsp. paratuberculosis
cgccgcggcggcucg

SEQ ID NO: 2935095 - RNA, 16 nt, Mycobacterium avium subsp. paratuberculosis
cgccgcggcggcucgg

SEQ ID NO: 2935096 - RNA, 19 nt, Mycobacterium avium subsp. paratuberculosis
cgccgcggcggcucggcgg

SEQ ID NO: 2935097 - RNA, 21 nt, Mycobacterium avium subsp. paratuberculosis
cgccgcggcggcucggcggcg

SEQ ID NO: 2935098 - RNA, 14 nt, Mycobacterium avium subsp. paratuberculosis
cgccgcggcggugg

SEQ ID NO: 2935099 - RNA, 18 nt, Mycobacterium avium subsp. paratuberculosis
cgccgcggcgguggccug

SEQ ID NO: 2935100 - RNA, 19 nt, Mycobacterium avium subsp. paratuberculosis
cgccgcggcgguggccugc

SEQ ID NO: 2935101 - RNA, 21 nt, Mycobacterium avium subsp. paratuberculosis
cgccgcggcgguggccugccc

SEQ ID NO: 2935102 - RNA, 15 nt, Mycobacterium avium subsp. paratuberculosis
cgccgcggcuccagc

SEQ ID NO: 2935103 - RNA, 18 nt, Mycobacterium avium subsp. paratuberculosis
cgccgcggcuccagcagc

SEQ ID NO: 2935104 - RNA, 13 nt, Mycobacterium avium subsp. paratuberculosis
cgccgcgggccag

SEQ ID NO: 2935105 - RNA, 13 nt, Mycobacterium avium subsp. paratuberculosis
cgccgcgggcgcc

SEQ ID NO: 2935106 - RNA, 14 nt, Mycobacterium avium subsp. paratuberculosis
cgccgcgggcgccg

SEQ ID NO: 2935107 - RNA, 15 nt, Mycobacterium avium subsp. paratuberculosis
cgccgcgggcggucg

SEQ ID NO: 2935108 - RNA, 20 nt, Mycobacterium avium subsp. paratuberculosis
cgccgcgggcucccgcucgc

SEQ ID NO: 2935109 - RNA, 13 nt, Mycobacterium avium subsp. paratuberculosis
cgccgcgggucgg

SEQ ID NO: 2935110 - RNA, 15 nt, Mycobacterium avium subsp. paratuberculosis
cgccgcgggucggcg

SEQ ID NO: 2935111 - RNA, 16 nt, Mycobacterium avium subsp. paratuberculosis
cgccgcgggucggcga

SEQ ID NO: 2935112 - RNA, 17 nt, Mycobacterium avium subsp. paratuberculosis
cgccgcgggucggcgac

SEQ ID NO: 2935113 - RNA, 18 nt, Mycobacterium avium subsp. paratuberculosis
cgccgcgggucggcgacg

SEQ ID NO: 2935114 - RNA, 22 nt, Mycobacterium avium subsp. paratuberculosis
cgccgcgggucggcgacggcgc

SEQ ID NO: 2935115 - RNA, 15 nt, Mycobacterium avium subsp. paratuberculosis
cgccgcgggugacga

SEQ ID NO: 2935116 - RNA, 20 nt, Mycobacterium avium subsp. paratuberculosis
cgccgcgggugacgaucugg

SEQ ID NO: 2935117 - RNA, 17 nt, Mycobacterium avium subsp. paratuberculosis
cgccgcucggccagcag

SEQ ID NO: 2935118 - RNA, 21 nt, Mycobacterium avium subsp. paratuberculosis
cgccgcucggccagcagcacc

SEQ ID NO: 2935119 - RNA, 22 nt, Mycobacterium avium subsp. paratuberculosis
cgccgcucggccagcagcacca

SEQ ID NO: 2935120 - RNA, 13 nt, Mycobacterium avium subsp. paratuberculosis
cgccgcucggccg

SEQ ID NO: 2935121 - RNA, 13 nt, Mycobacterium avium subsp. paratuberculosis
cgccgcucgucgg

SEQ ID NO: 2935122 - RNA, 14 nt, Mycobacterium avium subsp. paratuberculosis
cgccgcucgucggc

SEQ ID NO: 2935123 - RNA, 20 nt, Mycobacterium avium subsp. paratuberculosis
cgccgcucgucggccagcga

SEQ ID NO: 2935124 - RNA, 15 nt, Mycobacterium avium subsp. paratuberculosis
cgccgcucgucgggc

SEQ ID NO: 2935125 - RNA, 16 nt, Mycobacterium avium subsp. paratuberculosis
cgccgcucgucgggca

SEQ ID NO: 2935126 - RNA, 18 nt, Mycobacterium avium subsp. paratuberculosis
cgccgcucgucgggcaca

SEQ ID NO: 2935127 - RNA, 17 nt, Mycobacterium avium subsp. paratuberculosis
cgccgcucuucgacgac

SEQ ID NO: 2935128 - RNA, 22 nt, Mycobacterium avium subsp. paratuberculosis
cgccgcucuucgacgacccgau

SEQ ID NO: 2935129 - RNA, 19 nt, Mycobacterium avium subsp. paratuberculosis
cgccgcugacugcgaucgc

SEQ ID NO: 2935130 - RNA, 21 nt, Mycobacterium avium subsp. paratuberculosis
cgccgcugacugcgaucgccg

SEQ ID NO: 2935131 - RNA, 16 nt, Mycobacterium avium subsp. paratuberculosis
cgccgcugcagcugcu

SEQ ID NO: 2935132 - RNA, 17 nt, Mycobacterium avium subsp. paratuberculosis
cgccgcugccggggugc

SEQ ID NO: 2935133 - RNA, 19 nt, Mycobacterium avium subsp. paratuberculosis
cgccgcugccggggugcag

SEQ ID NO: 2935134 - RNA, 21 nt, Mycobacterium avium subsp. paratuberculosis
cgccgcugccggggugcagca

SEQ ID NO: 2935135 - RNA, 13 nt, Mycobacterium avium subsp. paratuberculosis
cgccgcugcgcgc

SEQ ID NO: 2935136 - RNA, 15 nt, Mycobacterium avium subsp. paratuberculosis
cgccgcugcgcgcgc

SEQ ID NO: 2935137 - RNA, 17 nt, Mycobacterium avium subsp. paratuberculosis
cgccgcugcgcgcgcga

SEQ ID NO: 2935138 - RNA, 22 nt, Mycobacterium avium subsp. paratuberculosis
cgccgcugcgcgcgcgaucggu

SEQ ID NO: 2935139 - RNA, 15 nt, Mycobacterium avium subsp. paratuberculosis
cgccgcugcgggcca

SEQ ID NO: 2935140 - RNA, 13 nt, Mycobacterium avium subsp. paratuberculosis
cgccgcugcgugc

SEQ ID NO: 2935141 - RNA, 21 nt, Mycobacterium avium subsp. paratuberculosis
cgccgcugcgugcccggaucg

SEQ ID NO: 2935142 - RNA, 23 nt, Mycobacterium avium subsp. paratuberculosis
cgccgcugcgugcccggaucgcc

SEQ ID NO: 2935143 - RNA, 14 nt, Mycobacterium avium subsp. paratuberculosis
cgccgcugggcgug

SEQ ID NO: 2935144 - RNA, 16 nt, Mycobacterium avium subsp. paratuberculosis
cgccgcugggcguggu

SEQ ID NO: 2935145 - RNA, 22 nt, Mycobacterium avium subsp. paratuberculosis
cgccgcuggugaacucgccgau

SEQ ID NO: 2935146 - RNA, 23 nt, Mycobacterium avium subsp. paratuberculosis
cgccgcuggugaacucgccgauc

SEQ ID NO: 2935147 - RNA, 16 nt, Mycobacterium avium subsp. paratuberculosis
cgccgcuguccucguc

SEQ ID NO: 2935148 - RNA, 18 nt, Mycobacterium avium subsp. paratuberculosis
cgccgcuguccucgucgg

SEQ ID NO: 2935149 - RNA, 23 nt, Mycobacterium avium subsp. paratuberculosis
cgccgcuguccucgucggaggcg

SEQ ID NO: 2935150 - RNA, 15 nt, Mycobacterium avium subsp. paratuberculosis
cgccgcuucgucgcc

SEQ ID NO: 2935151 - RNA, 18 nt, Mycobacterium avium subsp. paratuberculosis
cgccgcuucgucgccggc

SEQ ID NO: 2935152 - RNA, 19 nt, Mycobacterium avium subsp. paratuberculosis
cgccgcuucgucgccggcc

SEQ ID NO: 2935153 - RNA, 13 nt, Mycobacterium avium subsp. paratuberculosis
cgccggaacggga

SEQ ID NO: 2935154 - RNA, 22 nt, Mycobacterium avium subsp. paratuberculosis
cgccggaacgggaagaucgucg

SEQ ID NO: 2935155 - RNA, 23 nt, Mycobacterium avium subsp. paratuberculosis
cgccggaacgggaagaucgucgu

SEQ ID NO: 2935156 - RNA, 15 nt, Mycobacterium avium subsp. paratuberculosis
cgccggaacucggcc

SEQ ID NO: 2935157 - RNA, 17 nt, Mycobacterium avium subsp. paratuberculosis
cgccggaacucggccgg

SEQ ID NO: 2935158 - RNA, 18 nt, Mycobacterium avium subsp. paratuberculosis
cgccggaacucggccggc

SEQ ID NO: 2935159 - RNA, 19 nt, Mycobacterium avium subsp. paratuberculosis
cgccggaacucggccggca

SEQ ID NO: 2935160 - RNA, 20 nt, Mycobacterium avium subsp. paratuberculosis
cgccggaacucggccggcac

SEQ ID NO: 2935161 - RNA, 17 nt, Mycobacterium avium subsp. paratuberculosis
cgccggaauggcaaggc

SEQ ID NO: 2935162 - RNA, 22 nt, Mycobacterium avium subsp. paratuberculosis
cgccggaauggcaaggccagca

SEQ ID NO: 2935163 - RNA, 23 nt, Mycobacterium avium subsp. paratuberculosis
cgccggaauggcaaggccagcaa

SEQ ID NO: 2935164 - RNA, 15 nt, Mycobacterium avium subsp. paratuberculosis
cgccggacaccaccg

SEQ ID NO: 2935165 - RNA, 20 nt, Mycobacterium avium subsp. paratuberculosis
cgccggacaccaccgcggug

SEQ ID NO: 2935166 - RNA, 12 nt, Mycobacterium avium subsp. paratuberculosis
cgccggacagcc

SEQ ID NO: 2935167 - RNA, 15 nt, Mycobacterium avium subsp. paratuberculosis
cgccggacagccggg

SEQ ID NO: 2935168 - RNA, 19 nt, Mycobacterium avium subsp. paratuberculosis
cgccggacagccggggcag

SEQ ID NO: 2935169 - RNA, 15 nt, Mycobacterium avium subsp. paratuberculosis
cgccggacagcgggc

SEQ ID NO: 2935170 - RNA, 20 nt, Mycobacterium avium subsp. paratuberculosis
cgccggacagcgggccgacc

SEQ ID NO: 2935171 - RNA, 14 nt, Mycobacterium avium subsp. paratuberculosis
cgccggacagcugg

SEQ ID NO: 2935172 - RNA, 16 nt, Mycobacterium avium subsp. paratuberculosis
cgccggacagcuggcg

SEQ ID NO: 2935173 - RNA, 22 nt, Mycobacterium avium subsp. paratuberculosis
cgccggacagcuggcggucgcu

SEQ ID NO: 2935174 - RNA, 16 nt, Mycobacterium avium subsp. paratuberculosis
cgccggaccccacagc

SEQ ID NO: 2935175 - RNA, 21 nt, Mycobacterium avium subsp. paratuberculosis
cgccggaccccacagcgcgcc

SEQ ID NO: 2935176 - RNA, 22 nt, Mycobacterium avium subsp. paratuberculosis
cgccggaccccacagcgcgccc

SEQ ID NO: 2935177 - RNA, 18 nt, Mycobacterium avium subsp. paratuberculosis
cgccggaccgauccggcg

SEQ ID NO: 2935178 - RNA, 21 nt, Mycobacterium avium subsp. paratuberculosis
cgccggaccgauccggcgccc

SEQ ID NO: 2935179 - RNA, 22 nt, Mycobacterium avium subsp. paratuberculosis
cgccggaccgauccggcgcccg

SEQ ID NO: 2935180 - RNA, 23 nt, Mycobacterium avium subsp. paratuberculosis
cgccggaccgauccggcgcccga

SEQ ID NO: 2935181 - RNA, 14 nt, Mycobacterium avium subsp. paratuberculosis
cgccggacggcccg

SEQ ID NO: 2935182 - RNA, 19 nt, Mycobacterium avium subsp. paratuberculosis
cgccggacucgaucgccac

SEQ ID NO: 2935183 - RNA, 14 nt, Mycobacterium avium subsp. paratuberculosis
cgccggagaccagc

SEQ ID NO: 2935184 - RNA, 16 nt, Mycobacterium avium subsp. paratuberculosis
cgccggagaccagcag

SEQ ID NO: 2935185 - RNA, 17 nt, Mycobacterium avium subsp. paratuberculosis
cgccggagagcccgucg

SEQ ID NO: 2935186 - RNA, 21 nt, Mycobacterium avium subsp. paratuberculosis
cgccggagagcccgucgucgg

SEQ ID NO: 2935187 - RNA, 20 nt, Mycobacterium avium subsp. paratuberculosis
cgccggagaugaucaugucg

SEQ ID NO: 2935188 - RNA, 17 nt, Mycobacterium avium subsp. paratuberculosis
cgccggagccgaucgcc

SEQ ID NO: 2935189 - RNA, 17 nt, Mycobacterium avium subsp. paratuberculosis
cgccggaggccagcucg

SEQ ID NO: 2935190 - RNA, 19 nt, Mycobacterium avium subsp. paratuberculosis
cgccggaggccagcucgac

SEQ ID NO: 2935191 - RNA, 17 nt, Mycobacterium avium subsp. paratuberculosis
cgccggaggcgaucagg

SEQ ID NO: 2935192 - RNA, 15 nt, Mycobacterium avium subsp. paratuberculosis
cgccggaggggcgac

SEQ ID NO: 2935193 - RNA, 14 nt, Mycobacterium avium subsp. paratuberculosis
cgccggaguucagc

SEQ ID NO: 2935194 - RNA, 20 nt, Mycobacterium avium subsp. paratuberculosis
cgccggaguugccgauggcg

SEQ ID NO: 2935195 - RNA, 15 nt, Mycobacterium avium subsp. paratuberculosis
cgccggaucaugucg

SEQ ID NO: 2935196 - RNA, 14 nt, Mycobacterium avium subsp. paratuberculosis
cgccggaucgagca

SEQ ID NO: 2935197 - RNA, 16 nt, Mycobacterium avium subsp. paratuberculosis
cgccggaucgagcacc

SEQ ID NO: 2935198 - RNA, 17 nt, Mycobacterium avium subsp. paratuberculosis
cgccggaucgagcaccc

SEQ ID NO: 2935199 - RNA, 20 nt, Mycobacterium avium subsp. paratuberculosis
cgccggaucgagcacccggc

SEQ ID NO: 2935200 - RNA, 23 nt, Mycobacterium avium subsp. paratuberculosis
cgccggaucgagcacccggcggg

SEQ ID NO: 2935201 - RNA, 16 nt, Mycobacterium avium subsp. paratuberculosis
cgccggccccggcgac

SEQ ID NO: 2935202 - RNA, 17 nt, Mycobacterium avium subsp. paratuberculosis
cgccggccccggcgacg

SEQ ID NO: 2935203 - RNA, 17 nt, Mycobacterium avium subsp. paratuberculosis
cgccggcccgcggcgga

SEQ ID NO: 2935204 - RNA, 12 nt, Mycobacterium avium subsp. paratuberculosis
cgccggcccggc

SEQ ID NO: 2935205 - RNA, 14 nt, Mycobacterium avium subsp. paratuberculosis
cgccggcccggcgu

SEQ ID NO: 2935206 - RNA, 16 nt, Mycobacterium avium subsp. paratuberculosis
cgccggcccggucgac

SEQ ID NO: 2935207 - RNA, 17 nt, Mycobacterium avium subsp. paratuberculosis
cgccggcccggucgacu

SEQ ID NO: 2935208 - RNA, 12 nt, Mycobacterium avium subsp. paratuberculosis
cgccggccgcca

SEQ ID NO: 2935209 - RNA, 13 nt, Mycobacterium avium subsp. paratuberculosis
cgccggccgccag

SEQ ID NO: 2935210 - RNA, 14 nt, Mycobacterium avium subsp. paratuberculosis
cgccggccgccagc

SEQ ID NO: 2935211 - RNA, 19 nt, Mycobacterium avium subsp. paratuberculosis
cgccggccgccagcgcccg

SEQ ID NO: 2935212 - RNA, 12 nt, Mycobacterium avium subsp. paratuberculosis
cgccggccgccg

SEQ ID NO: 2935213 - RNA, 13 nt, Mycobacterium avium subsp. paratuberculosis
cgccggccgccgc

SEQ ID NO: 2935214 - RNA, 14 nt, Mycobacterium avium subsp. paratuberculosis
cgccggccgccgga

SEQ ID NO: 2935215 - RNA, 16 nt, Mycobacterium avium subsp. paratuberculosis
cgccggccgccggauc

SEQ ID NO: 2935216 - RNA, 13 nt, Mycobacterium avium subsp. paratuberculosis
cgccggccgccgu

SEQ ID NO: 2935217 - RNA, 11 nt, Mycobacterium avium subsp. paratuberculosis
cgccggccgcg

SEQ ID NO: 2935218 - RNA, 12 nt, Mycobacterium avium subsp. paratuberculosis
cgccggccgcgc

SEQ ID NO: 2935219 - RNA, 14 nt, Mycobacterium avium subsp. paratuberculosis
cgccggccgcggcg

SEQ ID NO: 2935220 - RNA, 16 nt, Mycobacterium avium subsp. paratuberculosis
cgccggccgcggcgug

SEQ ID NO: 2935221 - RNA, 18 nt, Mycobacterium avium subsp. paratuberculosis
cgccggccgcggcgugca

SEQ ID NO: 2935222 - RNA, 13 nt, Mycobacterium avium subsp. paratuberculosis
cgccggccgcggg

SEQ ID NO: 2935223 - RNA, 22 nt, Mycobacterium avium subsp. paratuberculosis
cgccggccgcggugugcccggc

SEQ ID NO: 2935224 - RNA, 15 nt, Mycobacterium avium subsp. paratuberculosis
cgccggccgcucgcg

SEQ ID NO: 2935225 - RNA, 20 nt, Mycobacterium avium subsp. paratuberculosis
cgccggccgcucgcgggcca

SEQ ID NO: 2935226 - RNA, 12 nt, Mycobacterium avium subsp. paratuberculosis
cgccggccggac

SEQ ID NO: 2935227 - RNA, 23 nt, Mycobacterium avium subsp. paratuberculosis
cgccggccggacagaucgcccau

SEQ ID NO: 2935228 - RNA, 21 nt, Mycobacterium avium subsp. paratuberculosis
cgccggccggagcggauggcg

SEQ ID NO: 2935229 - RNA, 12 nt, Mycobacterium avium subsp. paratuberculosis
cgccggccggca

SEQ ID NO: 2935230 - RNA, 14 nt, Mycobacterium avium subsp. paratuberculosis
cgccggccggcacg

SEQ ID NO: 2935231 - RNA, 15 nt, Mycobacterium avium subsp. paratuberculosis
cgccggccggcgguc

SEQ ID NO: 2935232 - RNA, 15 nt, Mycobacterium avium subsp. paratuberculosis
cgccggccggcgugg

SEQ ID NO: 2935233 - RNA, 18 nt, Mycobacterium avium subsp. paratuberculosis
cgccggccggcgugggaa

SEQ ID NO: 2935234 - RNA, 15 nt, Mycobacterium avium subsp. paratuberculosis
cgccggccgggcggg

SEQ ID NO: 2935235 - RNA, 22 nt, Mycobacterium avium subsp. paratuberculosis
cgccggccgggcgggggcuguc

SEQ ID NO: 2935236 - RNA, 13 nt, Mycobacterium avium subsp. paratuberculosis
cgccggccgggcu

SEQ ID NO: 2935237 - RNA, 15 nt, Mycobacterium avium subsp. paratuberculosis
cgccggccgggcugc

SEQ ID NO: 2935238 - RNA, 17 nt, Mycobacterium avium subsp. paratuberculosis
cgccggccgggcugcgc

SEQ ID NO: 2935239 - RNA, 19 nt, Mycobacterium avium subsp. paratuberculosis
cgccggccgggcugcgcag

SEQ ID NO: 2935240 - RNA, 22 nt, Mycobacterium avium subsp. paratuberculosis
cgccggccgguccucugcgacc

SEQ ID NO: 2935241 - RNA, 18 nt, Mycobacterium avium subsp. paratuberculosis
cgccggccgucacgcugg

SEQ ID NO: 2935242 - RNA, 19 nt, Mycobacterium avium subsp. paratuberculosis
cgccggccgucacgcuggc

SEQ ID NO: 2935243 - RNA, 21 nt, Mycobacterium avium subsp. paratuberculosis
cgccggccgucacgcuggcgu

SEQ ID NO: 2935244 - RNA, 20 nt, Mycobacterium avium subsp. paratuberculosis
cgccggccguucgccggcca

SEQ ID NO: 2935245 - RNA, 21 nt, Mycobacterium avium subsp. paratuberculosis
cgccggccguucgccggccag

SEQ ID NO: 2935246 - RNA, 12 nt, Mycobacterium avium subsp. paratuberculosis
cgccggccucca

SEQ ID NO: 2935247 - RNA, 16 nt, Mycobacterium avium subsp. paratuberculosis
cgccggccuccagcug

SEQ ID NO: 2935248 - RNA, 16 nt, Mycobacterium avium subsp. paratuberculosis
cgccggccugcccgcc

SEQ ID NO: 2935249 - RNA, 23 nt, Mycobacterium avium subsp. paratuberculosis
cgccggccugcccgccgcggccg

SEQ ID NO: 2935250 - RNA, 22 nt, Mycobacterium avium subsp. paratuberculosis
cgccggccuuggcccgcgcccg

SEQ ID NO: 2935251 - RNA, 19 nt, Mycobacterium avium subsp. paratuberculosis
cgccggcgaacgacgucga

SEQ ID NO: 2935252 - RNA, 20 nt, Mycobacterium avium subsp. paratuberculosis
cgccggcgaacgacgucgag

SEQ ID NO: 2935253 - RNA, 17 nt, Mycobacterium avium subsp. paratuberculosis
cgccggcgaagcucgac

SEQ ID NO: 2935254 - RNA, 22 nt, Mycobacterium avium subsp. paratuberculosis
cgccggcgaccgccaccucgag

SEQ ID NO: 2935255 - RNA, 16 nt, Mycobacterium avium subsp. paratuberculosis
cgccggcgaccgccuu

SEQ ID NO: 2935256 - RNA, 18 nt, Mycobacterium avium subsp. paratuberculosis
cgccggcgacggccagcg

SEQ ID NO: 2935257 - RNA, 21 nt, Mycobacterium avium subsp. paratuberculosis
cgccggcgacggccagcgcgg

SEQ ID NO: 2935258 - RNA, 17 nt, Mycobacterium avium subsp. paratuberculosis
cgccggcgaggcggucg

SEQ ID NO: 2935259 - RNA, 14 nt, Mycobacterium avium subsp. paratuberculosis
cgccggcgaucgac

SEQ ID NO: 2935260 - RNA, 15 nt, Mycobacterium avium subsp. paratuberculosis
cgccggcgaucgacg

SEQ ID NO: 2935261 - RNA, 15 nt, Mycobacterium avium subsp. paratuberculosis
cgccggcgaucucca

SEQ ID NO: 2935262 - RNA, 18 nt, Mycobacterium avium subsp. paratuberculosis
cgccggcgaucuccaccg

SEQ ID NO: 2935263 - RNA, 20 nt, Mycobacterium avium subsp. paratuberculosis
cgccggcgaucucgucgcgc

SEQ ID NO: 2935264 - RNA, 22 nt, Mycobacterium avium subsp. paratuberculosis
cgccggcgaucucgucgcgcag

SEQ ID NO: 2935265 - RNA, 12 nt, Mycobacterium avium subsp. paratuberculosis
cgccggcgauga

SEQ ID NO: 2935266 - RNA, 20 nt, Mycobacterium avium subsp. paratuberculosis
cgccggcgaugaacacgccg

SEQ ID NO: 2935267 - RNA, 18 nt, Mycobacterium avium subsp. paratuberculosis
cgccggcgaugcgcgccu

SEQ ID NO: 2935268 - RNA, 20 nt, Mycobacterium avium subsp. paratuberculosis
cgccggcgcaacucguccag

SEQ ID NO: 2935269 - RNA, 17 nt, Mycobacterium avium subsp. paratuberculosis
cgccggcgcacaucgug

SEQ ID NO: 2935270 - RNA, 21 nt, Mycobacterium avium subsp. paratuberculosis
cgccggcgcacaucguggcga

SEQ ID NO: 2935271 - RNA, 13 nt, Mycobacterium avium subsp. paratuberculosis
cgccggcgcagcg

SEQ ID NO: 2935272 - RNA, 19 nt, Mycobacterium avium subsp. paratuberculosis
cgccggcgcagcggcccga

SEQ ID NO: 2935273 - RNA, 15 nt, Mycobacterium avium subsp. paratuberculosis
cgccggcgcagucca

SEQ ID NO: 2935274 - RNA, 23 nt, Mycobacterium avium subsp. paratuberculosis
cgccggcgcaguccaggguggug

SEQ ID NO: 2935275 - RNA, 14 nt, Mycobacterium avium subsp. paratuberculosis
cgccggcgcccugc

SEQ ID NO: 2935276 - RNA, 21 nt, Mycobacterium avium subsp. paratuberculosis
cgccggcgcccugcgcgcccu

SEQ ID NO: 2935277 - RNA, 12 nt, Mycobacterium avium subsp. paratuberculosis
cgccggcgccgg

SEQ ID NO: 2935278 - RNA, 13 nt, Mycobacterium avium subsp. paratuberculosis
cgccggcgccgga

SEQ ID NO: 2935279 - RNA, 14 nt, Mycobacterium avium subsp. paratuberculosis
cgccggcgccgggc

SEQ ID NO: 2935280 - RNA, 15 nt, Mycobacterium avium subsp. paratuberculosis
cgccggcgccgggcg

SEQ ID NO: 2935281 - RNA, 17 nt, Mycobacterium avium subsp. paratuberculosis
cgccggcgccgggcggg

SEQ ID NO: 2935282 - RNA, 18 nt, Mycobacterium avium subsp. paratuberculosis
cgccggcgccgggcgggc

SEQ ID NO: 2935283 - RNA, 17 nt, Mycobacterium avium subsp. paratuberculosis
cgccggcgcgcaacagc

SEQ ID NO: 2935284 - RNA, 13 nt, Mycobacterium avium subsp. paratuberculosis
cgccggcgcgcag

SEQ ID NO: 2935285 - RNA, 15 nt, Mycobacterium avium subsp. paratuberculosis
cgccggcgcgcagcc

SEQ ID NO: 2935286 - RNA, 20 nt, Mycobacterium avium subsp. paratuberculosis
cgccggcuccaccgcgccgg

SEQ ID NO: 2935287 - RNA, 21 nt, Mycobacterium avium subsp. paratuberculosis
cgccggcuccaccgcgccggc

SEQ ID NO: 2935288 - RNA, 22 nt, Mycobacterium avium subsp. paratuberculosis
cgccggcuccaccgcgccggcg

SEQ ID NO: 2935289 - RNA, 12 nt, Mycobacterium avium subsp. paratuberculosis
cgccggcucggu

SEQ ID NO: 2935290 - RNA, 20 nt, Mycobacterium avium subsp. paratuberculosis
cgccggcugacugccggcga

SEQ ID NO: 2935291 - RNA, 14 nt, Mycobacterium avium subsp. paratuberculosis
cgccggcugcccgc

SEQ ID NO: 2935292 - RNA, 15 nt, Mycobacterium avium subsp. paratuberculosis
cgccggcugcccgcg

SEQ ID NO: 2935293 - RNA, 14 nt, Mycobacterium avium subsp. paratuberculosis
cgccggcuggcggg

SEQ ID NO: 2935294 - RNA, 17 nt, Mycobacterium avium subsp. paratuberculosis
cgccggcuggcgggcga

SEQ ID NO: 2935295 - RNA, 20 nt, Mycobacterium avium subsp. paratuberculosis
cgccggcuuaccgaccucga

SEQ ID NO: 2935296 - RNA, 16 nt, Mycobacterium avium subsp. paratuberculosis
cgccggcuugccccgg

SEQ ID NO: 2935297 - RNA, 17 nt, Mycobacterium avium subsp. paratuberculosis
cgccggcuugccccggu

SEQ ID NO: 2935298 - RNA, 18 nt, Mycobacterium avium subsp. paratuberculosis
cgccggcuugccccgguc

SEQ ID NO: 2935299 - RNA, 17 nt, Mycobacterium avium subsp. paratuberculosis
cgccggcuuucgaagag

SEQ ID NO: 2935300 - RNA, 23 nt, Mycobacterium avium subsp. paratuberculosis
cgccggcuuucgaagagccggcg

SEQ ID NO: 2935301 - RNA, 15 nt, Mycobacterium avium subsp. paratuberculosis
cgccgggaaaguugu

SEQ ID NO: 2935302 - RNA, 17 nt, Mycobacterium avium subsp. paratuberculosis
cgccgggaacagcgacg

SEQ ID NO: 2935303 - RNA, 24 nt, Mycobacterium avium subsp. paratuberculosis
cgccgggacgggcauccggcucag

SEQ ID NO: 2935304 - RNA, 20 nt, Mycobacterium avium subsp. paratuberculosis
cgccgggauaacccagcacc

SEQ ID NO: 2935305 - RNA, 23 nt, Mycobacterium avium subsp. paratuberculosis
cgccgggauaacccagcaccacc

SEQ ID NO: 2935306 - RNA, 24 nt, Mycobacterium avium subsp. paratuberculosis
cgccgggauaacccagcaccacca

SEQ ID NO: 2935307 - RNA, 18 nt, Mycobacterium avium subsp. paratuberculosis
cgccgggauauucgccca

SEQ ID NO: 2935308 - RNA, 22 nt, Mycobacterium avium subsp. paratuberculosis
cgccgggauauucgcccagcgg

SEQ ID NO: 2935309 - RNA, 23 nt, Mycobacterium avium subsp. paratuberculosis
cgccgggauauucgcccagcggc

SEQ ID NO: 2935310 - RNA, 19 nt, Mycobacterium avium subsp. paratuberculosis
cgccgggaucacacgcgcg

SEQ ID NO: 2935311 - RNA, 20 nt, Mycobacterium avium subsp. paratuberculosis
cgccgggaucacacgcgcgc

SEQ ID NO: 2935312 - RNA, 14 nt, Mycobacterium avium subsp. paratuberculosis
cgccgggaucggca

SEQ ID NO: 2935313 - RNA, 20 nt, Mycobacterium avium subsp. paratuberculosis
cgccgggaucggcagcgcgc

SEQ ID NO: 2935314 - RNA, 22 nt, Mycobacterium avium subsp. paratuberculosis
cgccgggaucggcagcgcgccc

SEQ ID NO: 2935315 - RNA, 17 nt, Mycobacterium avium subsp. paratuberculosis
cgccgggaucggcgggg

SEQ ID NO: 2935316 - RNA, 20 nt, Mycobacterium avium subsp. paratuberculosis
cgccgggaucggcggggcgc

SEQ ID NO: 2935317 - RNA, 17 nt, Mycobacterium avium subsp. paratuberculosis
cgccgggcaacagcgcg

SEQ ID NO: 2935318 - RNA, 18 nt, Mycobacterium avium subsp. paratuberculosis
cgccgggcaacagcgcgc

SEQ ID NO: 2935319 - RNA, 23 nt, Mycobacterium avium subsp. paratuberculosis
cgccgggcaacagcgcgccggcc

SEQ ID NO: 2935320 - RNA, 14 nt, Mycobacterium avium subsp. paratuberculosis
cgccgggcaccacc

SEQ ID NO: 2935321 - RNA, 15 nt, Mycobacterium avium subsp. paratuberculosis
cgccgggcaccacca

SEQ ID NO: 2935322 - RNA, 16 nt, Mycobacterium avium subsp. paratuberculosis
cgccgggcaccaccac

SEQ ID NO: 2935323 - RNA, 18 nt, Mycobacterium avium subsp. paratuberculosis
cgccgggcaccaccaccg

SEQ ID NO: 2935324 - RNA, 19 nt, Mycobacterium avium subsp. paratuberculosis
cgccgggcaccaccaccga

SEQ ID NO: 2935325 - RNA, 20 nt, Mycobacterium avium subsp. paratuberculosis
cgccgggcaccaccaccgac

SEQ ID NO: 2935326 - RNA, 14 nt, Mycobacterium avium subsp. paratuberculosis
cgccgggcacccgg

SEQ ID NO: 2935327 - RNA, 17 nt, Mycobacterium avium subsp. paratuberculosis
cgccgggcacccgggug

SEQ ID NO: 2935328 - RNA, 19 nt, Mycobacterium avium subsp. paratuberculosis
cgccgggcaccucggcguc

SEQ ID NO: 2935329 - RNA, 21 nt, Mycobacterium avium subsp. paratuberculosis
cgccgggcaccucggcgucgg

SEQ ID NO: 2935330 - RNA, 22 nt, Mycobacterium avium subsp. paratuberculosis
cgccgggcaccucggcgucggc

SEQ ID NO: 2935331 - RNA, 17 nt, Mycobacterium avium subsp. paratuberculosis
cgccgggcagcccgccg

SEQ ID NO: 2935332 - RNA, 15 nt, Mycobacterium avium subsp. paratuberculosis
cgccgggcagcccgg

SEQ ID NO: 2935333 - RNA, 17 nt, Mycobacterium avium subsp. paratuberculosis
cgccgggcagcccgggu

SEQ ID NO: 2935334 - RNA, 18 nt, Mycobacterium avium subsp. paratuberculosis
cgccgggcagguggucgg

SEQ ID NO: 2935335 - RNA, 20 nt, Mycobacterium avium subsp. paratuberculosis
cgccgggcagguggucggcg

SEQ ID NO: 2935336 - RNA, 21 nt, Mycobacterium avium subsp. paratuberculosis
cgccgggcagguggucggcga

SEQ ID NO: 2935337 - RNA, 22 nt, Mycobacterium avium subsp. paratuberculosis
cgccgggcagguggucggcgaa

SEQ ID NO: 2935338 - RNA, 16 nt, Mycobacterium avium subsp. paratuberculosis
cgccgggcauccgccc

SEQ ID NO: 2935339 - RNA, 17 nt, Mycobacterium avium subsp. paratuberculosis
cgccgggcauccgggcc

SEQ ID NO: 2935340 - RNA, 14 nt, Mycobacterium avium subsp. paratuberculosis
cgccgggcaugccg

SEQ ID NO: 2935341 - RNA, 18 nt, Mycobacterium avium subsp. paratuberculosis
cgccgggcaugccguuca

SEQ ID NO: 2935342 - RNA, 22 nt, Mycobacterium avium subsp. paratuberculosis
cgccgggccaggugugcccgcc

SEQ ID NO: 2935343 - RNA, 23 nt, Mycobacterium avium subsp. paratuberculosis
cgccgggccaggugugcccgccc

SEQ ID NO: 2935344 - RNA, 12 nt, Mycobacterium avium subsp. paratuberculosis
cgccgggcccgc

SEQ ID NO: 2935345 - RNA, 21 nt, Mycobacterium avium subsp. paratuberculosis
cgccgggcccgcucaccugcg

SEQ ID NO: 2935346 - RNA, 14 nt, Mycobacterium avium subsp. paratuberculosis
cgccgggcccgguc

SEQ ID NO: 2935347 - RNA, 12 nt, Mycobacterium avium subsp. paratuberculosis
cgccgggccgcc

SEQ ID NO: 2935348 - RNA, 14 nt, Mycobacterium avium subsp. paratuberculosis
cgccgggccgccga

SEQ ID NO: 2935349 - RNA, 16 nt, Mycobacterium avium subsp. paratuberculosis
cgccgggccgccgaug

SEQ ID NO: 2935350 - RNA, 18 nt, Mycobacterium avium subsp. paratuberculosis
cgccgggccgccgaugcg

SEQ ID NO: 2935351 - RNA, 19 nt, Mycobacterium avium subsp. paratuberculosis
cgccgggccgccgaugcgc

SEQ ID NO: 2935352 - RNA, 23 nt, Mycobacterium avium subsp. paratuberculosis
cgccgggccgccgaugcgcccgc

SEQ ID NO: 2935353 - RNA, 17 nt, Mycobacterium avium subsp. paratuberculosis
cgccgggccgccgcggc

SEQ ID NO: 2935354 - RNA, 19 nt, Mycobacterium avium subsp. paratuberculosis
cgccgggccgccgcggcca

SEQ ID NO: 2935355 - RNA, 14 nt, Mycobacterium avium subsp. paratuberculosis
cgccgggccggauc

SEQ ID NO: 2935356 - RNA, 17 nt, Mycobacterium avium subsp. paratuberculosis
cgccgggccggaucgcg

SEQ ID NO: 2935357 - RNA, 14 nt, Mycobacterium avium subsp. paratuberculosis
cgccgggccggccg

SEQ ID NO: 2935358 - RNA, 13 nt, Mycobacterium avium subsp. paratuberculosis
cgccgggccggcg

SEQ ID NO: 2935359 - RNA, 16 nt, Mycobacterium avium subsp. paratuberculosis
cgccgggccggcggcc

SEQ ID NO: 2935360 - RNA, 17 nt, Mycobacterium avium subsp. paratuberculosis
cgccgggccggcggcca

SEQ ID NO: 2935361 - RNA, 15 nt, Mycobacterium avium subsp. paratuberculosis
cgccgggccugucca

SEQ ID NO: 2935362 - RNA, 19 nt, Mycobacterium avium subsp. paratuberculosis
cgccgggccuguccagccg

SEQ ID NO: 2935363 - RNA, 21 nt, Mycobacterium avium subsp. paratuberculosis
cgccgggccuguccagccggu

SEQ ID NO: 2935364 - RNA, 16 nt, Mycobacterium avium subsp. paratuberculosis
cgccgggcgaagucgc

SEQ ID NO: 2935365 - RNA, 20 nt, Mycobacterium avium subsp. paratuberculosis
cgccgggcgaagucgccggc

SEQ ID NO: 2935366 - RNA, 21 nt, Mycobacterium avium subsp. paratuberculosis
cgccgggcgaagucgccggcc

SEQ ID NO: 2935367 - RNA, 13 nt, Mycobacterium avium subsp. paratuberculosis
cgccgggcgccac

SEQ ID NO: 2935368 - RNA, 15 nt, Mycobacterium avium subsp. paratuberculosis
cgccgggcgccaccc

SEQ ID NO: 2935369 - RNA, 14 nt, Mycobacterium avium subsp. paratuberculosis
cgccgggcgcccga

SEQ ID NO: 2935370 - RNA, 20 nt, Mycobacterium avium subsp. paratuberculosis
cgccgggucaccggaugcac

SEQ ID NO: 2935371 - RNA, 15 nt, Mycobacterium avium subsp. paratuberculosis
cgccggguccagccg

SEQ ID NO: 2935372 - RNA, 16 nt, Mycobacterium avium subsp. paratuberculosis
cgccggguccagccgc

SEQ ID NO: 2935373 - RNA, 19 nt, Mycobacterium avium subsp. paratuberculosis
cgccggguccagccgcggu

SEQ ID NO: 2935374 - RNA, 19 nt, Mycobacterium avium subsp. paratuberculosis
cgccggguccuugcgcccc

SEQ ID NO: 2935375 - RNA, 21 nt, Mycobacterium avium subsp. paratuberculosis
cgccggguccuugcgccccgg

SEQ ID NO: 2935376 - RNA, 22 nt, Mycobacterium avium subsp. paratuberculosis
cgccggguccuugcgccccggc

SEQ ID NO: 2935377 - RNA, 21 nt, Mycobacterium avium subsp. paratuberculosis
cgccgggucgcggugggcucg

SEQ ID NO: 2935378 - RNA, 23 nt, Mycobacterium avium subsp. paratuberculosis
cgccgggucgcggugggcucggc

SEQ ID NO: 2935379 - RNA, 16 nt, Mycobacterium avium subsp. paratuberculosis
cgccgggucuuccacg

SEQ ID NO: 2935380 - RNA, 20 nt, Mycobacterium avium subsp. paratuberculosis
cgccgggucuuccacgccgg

SEQ ID NO: 2935381 - RNA, 21 nt, Mycobacterium avium subsp. paratuberculosis
cgccgggucuuccacgccggu

SEQ ID NO: 2935382 - RNA, 16 nt, Mycobacterium avium subsp. paratuberculosis
cgccggguggccgcca

SEQ ID NO: 2935383 - RNA, 21 nt, Mycobacterium avium subsp. paratuberculosis
cgccggguggccgccacgucc

SEQ ID NO: 2935384 - RNA, 22 nt, Mycobacterium avium subsp. paratuberculosis
cgccggguggccgccacguccg

SEQ ID NO: 2935385 - RNA, 14 nt, Mycobacterium avium subsp. paratuberculosis
cgccggguggccgg

SEQ ID NO: 2935386 - RNA, 17 nt, Mycobacterium avium subsp. paratuberculosis
cgccggguggcggggcg

SEQ ID NO: 2935387 - RNA, 20 nt, Mycobacterium avium subsp. paratuberculosis
cgccggguggcggggcguug

SEQ ID NO: 2935388 - RNA, 18 nt, Mycobacterium avium subsp. paratuberculosis
cgccggguugggcggcgg

SEQ ID NO: 2935389 - RNA, 21 nt, Mycobacterium avium subsp. paratuberculosis
cgccggguugggcggcggcca

SEQ ID NO: 2935390 - RNA, 21 nt, Mycobacterium avium subsp. paratuberculosis
cgccggguuuguccggccagg

SEQ ID NO: 2935391 - RNA, 15 nt, Mycobacterium avium subsp. paratuberculosis
cgccgguaaugggcg

SEQ ID NO: 2935392 - RNA, 19 nt, Mycobacterium avium subsp. paratuberculosis
cgccgguaaugggcgaucg

SEQ ID NO: 2935393 - RNA, 13 nt, Mycobacterium avium subsp. paratuberculosis
cgccgguaccgcc

SEQ ID NO: 2935394 - RNA, 14 nt, Mycobacterium avium subsp. paratuberculosis
cgccgguaccgccg

SEQ ID NO: 2935395 - RNA, 16 nt, Mycobacterium avium subsp. paratuberculosis
cgccgguaccgccggc

SEQ ID NO: 2935396 - RNA, 18 nt, Mycobacterium avium subsp. paratuberculosis
cgccgguaccgccggcca

SEQ ID NO: 2935397 - RNA, 20 nt, Mycobacterium avium subsp. paratuberculosis
cgccgguaccgccggccagg

SEQ ID NO: 2935398 - RNA, 14 nt, Mycobacterium avium subsp. paratuberculosis
cgccgguagagcgc

SEQ ID NO: 2935399 - RNA, 15 nt, Mycobacterium avium subsp. paratuberculosis
cgccgguagccgcuc

SEQ ID NO: 2935400 - RNA, 16 nt, Mycobacterium avium subsp. paratuberculosis
cgccgguagccgcucg

SEQ ID NO: 2935401 - RNA, 21 nt, Mycobacterium avium subsp. paratuberculosis
cgccgguagccgcucgcccag

SEQ ID NO: 2935402 - RNA, 22 nt, Mycobacterium avium subsp. paratuberculosis
cgccgguagccgcucgcccagc

SEQ ID NO: 2935403 - RNA, 19 nt, Mycobacterium avium subsp. paratuberculosis
cgccgguagcgacacggaa

SEQ ID NO: 2935404 - RNA, 16 nt, Mycobacterium avium subsp. paratuberculosis
cgccgguaggccgcgc

SEQ ID NO: 2935405 - RNA, 18 nt, Mycobacterium avium subsp. paratuberculosis
cgccgguaggccgcgccg

SEQ ID NO: 2935406 - RNA, 19 nt, Mycobacterium avium subsp. paratuberculosis
cgccgguaggccgcgccga

SEQ ID NO: 2935407 - RNA, 21 nt, Mycobacterium avium subsp. paratuberculosis
cgccgguaggccgcgccgauc

SEQ ID NO: 2935408 - RNA, 17 nt, Mycobacterium avium subsp. paratuberculosis
cgccgguaggcgcgggu

SEQ ID NO: 2935409 - RNA, 18 nt, Mycobacterium avium subsp. paratuberculosis
cgccgguaggcgcgggug

SEQ ID NO: 2935410 - RNA, 19 nt, Mycobacterium avium subsp. paratuberculosis
cgccgguaggcgcggguga

SEQ ID NO: 2935411 - RNA, 21 nt, Mycobacterium avium subsp. paratuberculosis
cgccgguaggcgcgggugauu

SEQ ID NO: 2935412 - RNA, 15 nt, Mycobacterium avium subsp. paratuberculosis
cgccgguaggcggcc

SEQ ID NO: 2935413 - RNA, 17 nt, Mycobacterium avium subsp. paratuberculosis
cgccgguaggcggccag

SEQ ID NO: 2935414 - RNA, 19 nt, Mycobacterium avium subsp. paratuberculosis
cgccgguaggcggccagcg

SEQ ID NO: 2935415 - RNA, 22 nt, Mycobacterium avium subsp. paratuberculosis
cgccgguaggcggccagcgccc

SEQ ID NO: 2935416 - RNA, 23 nt, Mycobacterium avium subsp. paratuberculosis
cgccgguaggcggccagcgcccg

SEQ ID NO: 2935417 - RNA, 19 nt, Mycobacterium avium subsp. paratuberculosis
cgccgguauauucgcgaug

SEQ ID NO: 2935418 - RNA, 18 nt, Mycobacterium avium subsp. paratuberculosis
cgccgguaucgagcacca

SEQ ID NO: 2935419 - RNA, 22 nt, Mycobacterium avium subsp. paratuberculosis
cgccgguaucgagcaccagcaa

SEQ ID NO: 2935420 - RNA, 13 nt, Mycobacterium avium subsp. paratuberculosis
cgccggucacggc

SEQ ID NO: 2935421 - RNA, 16 nt, Mycobacterium avium subsp. paratuberculosis
cgccggucacggcguc

SEQ ID NO: 2935422 - RNA, 20 nt, Mycobacterium avium subsp. paratuberculosis
cgccggucacggcgucggcg

SEQ ID NO: 2935423 - RNA, 14 nt, Mycobacterium avium subsp. paratuberculosis
cgccggucagcacg

SEQ ID NO: 2935424 - RNA, 18 nt, Mycobacterium avium subsp. paratuberculosis
cgccggucagcacgucgg

SEQ ID NO: 2935425 - RNA, 19 nt, Mycobacterium avium subsp. paratuberculosis
cgccggucagcacgucggu

SEQ ID NO: 2935426 - RNA, 14 nt, Mycobacterium avium subsp. paratuberculosis
cgccggucagcgca

SEQ ID NO: 2935427 - RNA, 19 nt, Mycobacterium avium subsp. paratuberculosis
cgccgguccagugccggcg

SEQ ID NO: 2935428 - RNA, 14 nt, Mycobacterium avium subsp. paratuberculosis
cgccggucccgcgg

SEQ ID NO: 2935429 - RNA, 15 nt, Mycobacterium avium subsp. paratuberculosis
cgccggucccgcggc

SEQ ID NO: 2935430 - RNA, 17 nt, Mycobacterium avium subsp. paratuberculosis
cgccggucccgcggcgg

SEQ ID NO: 2935431 - RNA, 19 nt, Mycobacterium avium subsp. paratuberculosis
cgccggucccgcggcggcg

SEQ ID NO: 2935432 - RNA, 22 nt, Mycobacterium avium subsp. paratuberculosis
cgccggucccgcggcggcgcca

SEQ ID NO: 2935433 - RNA, 14 nt, Mycobacterium avium subsp. paratuberculosis
cgccgguccggccc

SEQ ID NO: 2935434 - RNA, 15 nt, Mycobacterium avium subsp. paratuberculosis
cgccgguccggcccu

SEQ ID NO: 2935435 - RNA, 18 nt, Mycobacterium avium subsp. paratuberculosis
cgccgguccggcccuggu

SEQ ID NO: 2935436 - RNA, 20 nt, Mycobacterium avium subsp. paratuberculosis
cgccgguccggcccuggucg

SEQ ID NO: 2935437 - RNA, 13 nt, Mycobacterium avium subsp. paratuberculosis
cgccggucgacgc

SEQ ID NO: 2935438 - RNA, 20 nt, Mycobacterium avium subsp. paratuberculosis
cgccggucgacgcggggcgg

SEQ ID NO: 2935439 - RNA, 19 nt, Mycobacterium avium subsp. paratuberculosis
cgccggucgcccccucggc

SEQ ID NO: 2935440 - RNA, 19 nt, Mycobacterium avium subsp. paratuberculosis
cgccggucgcugcgaugau

SEQ ID NO: 2935441 - RNA, 13 nt, Mycobacterium avium subsp. paratuberculosis
cgccggucggcgg

SEQ ID NO: 2935442 - RNA, 17 nt, Mycobacterium avium subsp. paratuberculosis
cgccggucuccaugucg

SEQ ID NO: 2935443 - RNA, 21 nt, Mycobacterium avium subsp. paratuberculosis
cgccggucucgaacacgccgu

SEQ ID NO: 2935444 - RNA, 20 nt, Mycobacterium avium subsp. paratuberculosis
cgccggugaagaucagcgcg

SEQ ID NO: 2935445 - RNA, 23 nt, Mycobacterium avium subsp. paratuberculosis
cgccggugaagaucagcgcgucg

SEQ ID NO: 2935446 - RNA, 24 nt, Mycobacterium avium subsp. paratuberculosis
cgccggugaagaucagcgcgucgg

SEQ ID NO: 2935447 - RNA, 20 nt, Mycobacterium avium subsp. paratuberculosis
cgccggugaagaucgcccgc

SEQ ID NO: 2935448 - RNA, 22 nt, Mycobacterium avium subsp. paratuberculosis
cgccggugaagaucgcccgccg

SEQ ID NO: 2935449 - RNA, 18 nt, Mycobacterium avium subsp. paratuberculosis
cgccggugaagcgggaca

SEQ ID NO: 2935450 - RNA, 19 nt, Mycobacterium avium subsp. paratuberculosis
cgccggugaccacgcugag

SEQ ID NO: 2935451 - RNA, 15 nt, Mycobacterium avium subsp. paratuberculosis
cgccggugaccccgu

SEQ ID NO: 2935452 - RNA, 20 nt, Mycobacterium avium subsp. paratuberculosis
cgccggugaccccgucgaac

SEQ ID NO: 2935453 - RNA, 15 nt, Mycobacterium avium subsp. paratuberculosis
cgccggugaccgcgc

SEQ ID NO: 2935454 - RNA, 21 nt, Mycobacterium avium subsp. paratuberculosis
cgccguauuggcaggcgaugu

SEQ ID NO: 2935455 - RNA, 17 nt, Mycobacterium avium subsp. paratuberculosis
cgccgucacaccgcggc

SEQ ID NO: 2935456 - RNA, 20 nt, Mycobacterium avium subsp. paratuberculosis
cgccgucacaccgcggccag

SEQ ID NO: 2935457 - RNA, 13 nt, Mycobacterium avium subsp. paratuberculosis
cgccgucaccgcc

SEQ ID NO: 2935458 - RNA, 15 nt, Mycobacterium avium subsp. paratuberculosis
cgccgucaccgccag

SEQ ID NO: 2935459 - RNA, 12 nt, Mycobacterium avium subsp. paratuberculosis
cgccgucaccgg

SEQ ID NO: 2935460 - RNA, 13 nt, Mycobacterium avium subsp. paratuberculosis
cgccgucaccggc

SEQ ID NO: 2935461 - RNA, 14 nt, Mycobacterium avium subsp. paratuberculosis
cgccgucaccggcu

SEQ ID NO: 2935462 - RNA, 15 nt, Mycobacterium avium subsp. paratuberculosis
cgccgucaccggcug

SEQ ID NO: 2935463 - RNA, 20 nt, Mycobacterium avium subsp. paratuberculosis
cgccgucaccggcugcccga

SEQ ID NO: 2935464 - RNA, 15 nt, Mycobacterium avium subsp. paratuberculosis
cgccgucaccucgag

SEQ ID NO: 2935465 - RNA, 15 nt, Mycobacterium avium subsp. paratuberculosis
cgccgucacggaucg

SEQ ID NO: 2935466 - RNA, 17 nt, Mycobacterium avium subsp. paratuberculosis
cgccgucacggaucgcc

SEQ ID NO: 2935467 - RNA, 19 nt, Mycobacterium avium subsp. paratuberculosis
cgccgucacggaucgccca

SEQ ID NO: 2935468 - RNA, 19 nt, Mycobacterium avium subsp. paratuberculosis
cgccgucacguagcgcggc

SEQ ID NO: 2935469 - RNA, 22 nt, Mycobacterium avium subsp. paratuberculosis
cgccgucacguagcgcggccgc

SEQ ID NO: 2935470 - RNA, 23 nt, Mycobacterium avium subsp. paratuberculosis
cgccgucacugcacgcacggcga

SEQ ID NO: 2935471 - RNA, 17 nt, Mycobacterium avium subsp. paratuberculosis
cgccgucaucaccgccg

SEQ ID NO: 2935472 - RNA, 21 nt, Mycobacterium avium subsp. paratuberculosis
cgccgucaucaccgccgaggg

SEQ ID NO: 2935473 - RNA, 19 nt, Mycobacterium avium subsp. paratuberculosis
cgccgucauccccaucucg

SEQ ID NO: 2935474 - RNA, 20 nt, Mycobacterium avium subsp. paratuberculosis
cgccgucauccccaucucga

SEQ ID NO: 2935475 - RNA, 16 nt, Mycobacterium avium subsp. paratuberculosis
cgccgucaucgacacc

SEQ ID NO: 2935476 - RNA, 17 nt, Mycobacterium avium subsp. paratuberculosis
cgccgucaucgacaccg

SEQ ID NO: 2935477 - RNA, 16 nt, Mycobacterium avium subsp. paratuberculosis
cgccgucaucggcgga

SEQ ID NO: 2935478 - RNA, 17 nt, Mycobacterium avium subsp. paratuberculosis
cgccgucaucggcggaa

SEQ ID NO: 2935479 - RNA, 19 nt, Mycobacterium avium subsp. paratuberculosis
cgccgucaucggcggaagc

SEQ ID NO: 2935480 - RNA, 22 nt, Mycobacterium avium subsp. paratuberculosis
cgccguccacgggucgccgugg

SEQ ID NO: 2935481 - RNA, 23 nt, Mycobacterium avium subsp. paratuberculosis
cgccguccacgggucgccguggc

SEQ ID NO: 2935482 - RNA, 15 nt, Mycobacterium avium subsp. paratuberculosis
cgccguccagcguca

SEQ ID NO: 2935483 - RNA, 14 nt, Mycobacterium avium subsp. paratuberculosis
cgccguccagcucg

SEQ ID NO: 2935484 - RNA, 16 nt, Mycobacterium avium subsp. paratuberculosis
cgccguccagcucgcg

SEQ ID NO: 2935485 - RNA, 14 nt, Mycobacterium avium subsp. paratuberculosis
cgccgucccaccgg

SEQ ID NO: 2935486 - RNA, 16 nt, Mycobacterium avium subsp. paratuberculosis
cgccgucccaccggcg

SEQ ID NO: 2935487 - RNA, 18 nt, Mycobacterium avium subsp. paratuberculosis
cgccgucccaccggcgau

SEQ ID NO: 2935488 - RNA, 19 nt, Mycobacterium avium subsp. paratuberculosis
cgccgucccaccggcgaug

SEQ ID NO: 2935489 - RNA, 19 nt, Mycobacterium avium subsp. paratuberculosis
cgccgucccagccggacag

SEQ ID NO: 2935490 - RNA, 17 nt, Mycobacterium avium subsp. paratuberculosis
cgccguccccgcgcggc

SEQ ID NO: 2935491 - RNA, 18 nt, Mycobacterium avium subsp. paratuberculosis
cgccguccccgcgcggcu

SEQ ID NO: 2935492 - RNA, 18 nt, Mycobacterium avium subsp. paratuberculosis
cgccgucccggacgcugc

SEQ ID NO: 2935493 - RNA, 15 nt, Mycobacterium avium subsp. paratuberculosis
cgccgucccgucacg

SEQ ID NO: 2935494 - RNA, 17 nt, Mycobacterium avium subsp. paratuberculosis
cgccgucccgucacggc

SEQ ID NO: 2935495 - RNA, 18 nt, Mycobacterium avium subsp. paratuberculosis
cgccgucccgucacggcu

SEQ ID NO: 2935496 - RNA, 21 nt, Mycobacterium avium subsp. paratuberculosis
cgccgucccgucacggcugcc

SEQ ID NO: 2935497 - RNA, 14 nt, Mycobacterium avium subsp. paratuberculosis
cgccgucccguccg

SEQ ID NO: 2935498 - RNA, 15 nt, Mycobacterium avium subsp. paratuberculosis
cgccgucccguccga

SEQ ID NO: 2935499 - RNA, 17 nt, Mycobacterium avium subsp. paratuberculosis
cgccgucccguccgacg

SEQ ID NO: 2935500 - RNA, 18 nt, Mycobacterium avium subsp. paratuberculosis
cgccgucccguccgacgg

SEQ ID NO: 2935501 - RNA, 21 nt, Mycobacterium avium subsp. paratuberculosis
cgccgucccguccgacggcua

SEQ ID NO: 2935502 - RNA, 15 nt, Mycobacterium avium subsp. paratuberculosis
cgccguccgacgugc

SEQ ID NO: 2935503 - RNA, 14 nt, Mycobacterium avium subsp. paratuberculosis
cgccguccgcaccg

SEQ ID NO: 2935504 - RNA, 19 nt, Mycobacterium avium subsp. paratuberculosis
cgccguccgcaccgcgacg

SEQ ID NO: 2935505 - RNA, 22 nt, Mycobacterium avium subsp. paratuberculosis
cgccguccgcaccgcgacgaga

SEQ ID NO: 2935506 - RNA, 14 nt, Mycobacterium avium subsp. paratuberculosis
cgccguccgcggcg

SEQ ID NO: 2935507 - RNA, 18 nt, Mycobacterium avium subsp. paratuberculosis
cgccguccgcggcggcca

SEQ ID NO: 2935508 - RNA, 15 nt, Mycobacterium avium subsp. paratuberculosis
cgccguccggccacg

SEQ ID NO: 2935509 - RNA, 22 nt, Mycobacterium avium subsp. paratuberculosis
cgccguccggccacgaccucgg

SEQ ID NO: 2935510 - RNA, 18 nt, Mycobacterium avium subsp. paratuberculosis
cgccguccgggcacccga

SEQ ID NO: 2935511 - RNA, 24 nt, Mycobacterium avium subsp. paratuberculosis
cgccguccgggcacccgacgucga

SEQ ID NO: 2935512 - RNA, 13 nt, Mycobacterium avium subsp. paratuberculosis
cgccguccggggc

SEQ ID NO: 2935513 - RNA, 15 nt, Mycobacterium avium subsp. paratuberculosis
cgccguccggggccg

SEQ ID NO: 2935514 - RNA, 22 nt, Mycobacterium avium subsp. paratuberculosis
cgccguccucgcgucgcgcggu

SEQ ID NO: 2935515 - RNA, 23 nt, Mycobacterium avium subsp. paratuberculosis
cgccguccugagguauucgucga

SEQ ID NO: 2935516 - RNA, 14 nt, Mycobacterium avium subsp. paratuberculosis
cgccguccuugacg

SEQ ID NO: 2935517 - RNA, 15 nt, Mycobacterium avium subsp. paratuberculosis
cgccguccuuggccg

SEQ ID NO: 2935518 - RNA, 20 nt, Mycobacterium avium subsp. paratuberculosis
cgccguccuuggccgccagc

SEQ ID NO: 2935519 - RNA, 22 nt, Mycobacterium avium subsp. paratuberculosis
cgccguccuuggccgccagcac

SEQ ID NO: 2935520 - RNA, 20 nt, Mycobacterium avium subsp. paratuberculosis
cgccgucgaaggccgggcug

SEQ ID NO: 2935521 - RNA, 14 nt, Mycobacterium avium subsp. paratuberculosis
cgccgucgaccagc

SEQ ID NO: 2935522 - RNA, 15 nt, Mycobacterium avium subsp. paratuberculosis
cgccgucgaccagcu

SEQ ID NO: 2935523 - RNA, 18 nt, Mycobacterium avium subsp. paratuberculosis
cgccgucgacccguuccc

SEQ ID NO: 2935524 - RNA, 21 nt, Mycobacterium avium subsp. paratuberculosis
cgccgucgacccguuccccgg

SEQ ID NO: 2935525 - RNA, 14 nt, Mycobacterium avium subsp. paratuberculosis
cgccgucgacgacg

SEQ ID NO: 2935526 - RNA, 13 nt, Mycobacterium avium subsp. paratuberculosis
cgccgucgacgau

SEQ ID NO: 2935527 - RNA, 18 nt, Mycobacterium avium subsp. paratuberculosis
cgccgucgacgcgugcgu

SEQ ID NO: 2935528 - RNA, 12 nt, Mycobacterium avium subsp. paratuberculosis
cgccgucgacgg

SEQ ID NO: 2935529 - RNA, 15 nt, Mycobacterium avium subsp. paratuberculosis
cgccgucgacgguga

SEQ ID NO: 2935530 - RNA, 14 nt, Mycobacterium avium subsp. paratuberculosis
cgccgucgagccug

SEQ ID NO: 2935531 - RNA, 14 nt, Mycobacterium avium subsp. paratuberculosis
cgccgucgaggggg

SEQ ID NO: 2935532 - RNA, 16 nt, Mycobacterium avium subsp. paratuberculosis
cgccgucgaugacgcg

SEQ ID NO: 2935533 - RNA, 14 nt, Mycobacterium avium subsp. paratuberculosis
cgccgucgauggcg

SEQ ID NO: 2935534 - RNA, 17 nt, Mycobacterium avium subsp. paratuberculosis
cgccgucgauggcgcgg

SEQ ID NO: 2935535 - RNA, 11 nt, Mycobacterium avium subsp. paratuberculosis
cgccgucgcca

SEQ ID NO: 2935536 - RNA, 14 nt, Mycobacterium avium subsp. paratuberculosis
cgccgucgccacca

SEQ ID NO: 2935537 - RNA, 17 nt, Mycobacterium avium subsp. paratuberculosis
cgccgucgccaccaccg

SEQ ID NO: 2935538 - RNA, 20 nt, Mycobacterium avium subsp. paratuberculosis
cgccgucgccaccaccgcgc

SEQ ID NO: 2935539 - RNA, 23 nt, Mycobacterium avium subsp. paratuberculosis
cgccgugcauccagccguccagc

SEQ ID NO: 2935540 - RNA, 17 nt, Mycobacterium avium subsp. paratuberculosis
cgccgugcccaacacgc

SEQ ID NO: 2935541 - RNA, 13 nt, Mycobacterium avium subsp. paratuberculosis
cgccgugccgcgc

SEQ ID NO: 2935542 - RNA, 16 nt, Mycobacterium avium subsp. paratuberculosis
cgccgugccgcgcggc

SEQ ID NO: 2935543 - RNA, 17 nt, Mycobacterium avium subsp. paratuberculosis
cgccgugccgcgcggcg

SEQ ID NO: 2935544 - RNA, 20 nt, Mycobacterium avium subsp. paratuberculosis
cgccgugccgcgcggcgaug

SEQ ID NO: 2935545 - RNA, 23 nt, Mycobacterium avium subsp. paratuberculosis
cgccgugccgcgcggcgauggcc

SEQ ID NO: 2935546 - RNA, 13 nt, Mycobacterium avium subsp. paratuberculosis
cgccgugccggac

SEQ ID NO: 2935547 - RNA, 18 nt, Mycobacterium avium subsp. paratuberculosis
cgccgugccggaccgcgc

SEQ ID NO: 2935548 - RNA, 20 nt, Mycobacterium avium subsp. paratuberculosis
cgccgugccggaccgcgcgg

SEQ ID NO: 2935549 - RNA, 19 nt, Mycobacterium avium subsp. paratuberculosis
cgccgugcgccagcgaccg

SEQ ID NO: 2935550 - RNA, 15 nt, Mycobacterium avium subsp. paratuberculosis
cgccgugcgccccgc

SEQ ID NO: 2935551 - RNA, 14 nt, Mycobacterium avium subsp. paratuberculosis
cgccgugcgccucg

SEQ ID NO: 2935552 - RNA, 15 nt, Mycobacterium avium subsp. paratuberculosis
cgccgugcgccucga

SEQ ID NO: 2935553 - RNA, 14 nt, Mycobacterium avium subsp. paratuberculosis
cgccgugcgcggcg

SEQ ID NO: 2935554 - RNA, 16 nt, Mycobacterium avium subsp. paratuberculosis
cgccgugcgcggcgac

SEQ ID NO: 2935555 - RNA, 17 nt, Mycobacterium avium subsp. paratuberculosis
cgccgugcgcggcgacc

SEQ ID NO: 2935556 - RNA, 14 nt, Mycobacterium avium subsp. paratuberculosis
cgccgugcggcguu

SEQ ID NO: 2935557 - RNA, 15 nt, Mycobacterium avium subsp. paratuberculosis
cgccgugcggcguuc

SEQ ID NO: 2935558 - RNA, 13 nt, Mycobacterium avium subsp. paratuberculosis
cgccgugcgucca

SEQ ID NO: 2935559 - RNA, 14 nt, Mycobacterium avium subsp. paratuberculosis
cgccgugcguccag

SEQ ID NO: 2935560 - RNA, 17 nt, Mycobacterium avium subsp. paratuberculosis
cgccgugcguccagucg

SEQ ID NO: 2935561 - RNA, 22 nt, Mycobacterium avium subsp. paratuberculosis
cgccguggaagauguugccgcc

SEQ ID NO: 2935562 - RNA, 16 nt, Mycobacterium avium subsp. paratuberculosis
cgccguggcagggcca

SEQ ID NO: 2935563 - RNA, 19 nt, Mycobacterium avium subsp. paratuberculosis
cgccguggcagggccagca

SEQ ID NO: 2935564 - RNA, 20 nt, Mycobacterium avium subsp. paratuberculosis
cgccguggcagggccagcag

SEQ ID NO: 2935565 - RNA, 15 nt, Mycobacterium avium subsp. paratuberculosis
cgccguggcccacgc

SEQ ID NO: 2935566 - RNA, 13 nt, Mycobacterium avium subsp. paratuberculosis
cgccguggcccau

SEQ ID NO: 2935567 - RNA, 13 nt, Mycobacterium avium subsp. paratuberculosis
cgccguggcccgg

SEQ ID NO: 2935568 - RNA, 14 nt, Mycobacterium avium subsp. paratuberculosis
cgccguggcccggu

SEQ ID NO: 2935569 - RNA, 15 nt, Mycobacterium avium subsp. paratuberculosis
cgccguggcccgguc

SEQ ID NO: 2935570 - RNA, 16 nt, Mycobacterium avium subsp. paratuberculosis
cgccguggcccggucg

SEQ ID NO: 2935571 - RNA, 16 nt, Mycobacterium avium subsp. paratuberculosis
cgccguggccgaacgg

SEQ ID NO: 2935572 - RNA, 20 nt, Mycobacterium avium subsp. paratuberculosis
cgccguggccgaacggcaug

SEQ ID NO: 2935573 - RNA, 13 nt, Mycobacterium avium subsp. paratuberculosis
cgccguggccugc

SEQ ID NO: 2935574 - RNA, 16 nt, Mycobacterium avium subsp. paratuberculosis
cgccguggccugcgac

SEQ ID NO: 2935575 - RNA, 14 nt, Mycobacterium avium subsp. paratuberculosis
cgccguggcggccc

SEQ ID NO: 2935576 - RNA, 17 nt, Mycobacterium avium subsp. paratuberculosis
cgccguggcggcccgac

SEQ ID NO: 2935577 - RNA, 20 nt, Mycobacterium avium subsp. paratuberculosis
cgccguggcggcccgaccag

SEQ ID NO: 2935578 - RNA, 22 nt, Mycobacterium avium subsp. paratuberculosis
cgccguggcggcccgaccagcg

SEQ ID NO: 2935579 - RNA, 23 nt, Mycobacterium avium subsp. paratuberculosis
cgccguggcggcccgaccagcgg

SEQ ID NO: 2935580 - RNA, 14 nt, Mycobacterium avium subsp. paratuberculosis
cgccguggcggcgg

SEQ ID NO: 2935581 - RNA, 15 nt, Mycobacterium avium subsp. paratuberculosis
cgccguggcggcggg

SEQ ID NO: 2935582 - RNA, 21 nt, Mycobacterium avium subsp. paratuberculosis
cgccguggcguuacacccgcg

SEQ ID NO: 2935583 - RNA, 19 nt, Mycobacterium avium subsp. paratuberculosis
cgccguggucaacggcacc

SEQ ID NO: 2935584 - RNA, 20 nt, Mycobacterium avium subsp. paratuberculosis
cgccguggucaacggcaccg

SEQ ID NO: 2935585 - RNA, 16 nt, Mycobacterium avium subsp. paratuberculosis
cgccgugguccagccg

SEQ ID NO: 2935586 - RNA, 17 nt, Mycobacterium avium subsp. paratuberculosis
cgccguguaggccgcgc

SEQ ID NO: 2935587 - RNA, 23 nt, Mycobacterium avium subsp. paratuberculosis
cgccguguaggccgcgcuggcca

SEQ ID NO: 2935588 - RNA, 15 nt, Mycobacterium avium subsp. paratuberculosis
cgccguguuccaggu

SEQ ID NO: 2935589 - RNA, 22 nt, Mycobacterium avium subsp. paratuberculosis
cgccguguugacguaacacccu

SEQ ID NO: 2935590 - RNA, 14 nt, Mycobacterium avium subsp. paratuberculosis
cgccguucgccggc

SEQ ID NO: 2935591 - RNA, 16 nt, Mycobacterium avium subsp. paratuberculosis
cgccguucgccggcga

SEQ ID NO: 2935592 - RNA, 18 nt, Mycobacterium avium subsp. paratuberculosis
cgccguucgccggcgacg

SEQ ID NO: 2935593 - RNA, 20 nt, Mycobacterium avium subsp. paratuberculosis
cgccguucgccggcgacggc

SEQ ID NO: 2935594 - RNA, 14 nt, Mycobacterium avium subsp. paratuberculosis
cgccguucucgcgc

SEQ ID NO: 2935595 - RNA, 17 nt, Mycobacterium avium subsp. paratuberculosis
cgccguucucgcgcagg

SEQ ID NO: 2935596 - RNA, 21 nt, Mycobacterium avium subsp. paratuberculosis
cgccguucucgcgcaggucac

SEQ ID NO: 2935597 - RNA, 15 nt, Mycobacterium avium subsp. paratuberculosis
cgccguucuugucga

SEQ ID NO: 2935598 - RNA, 16 nt, Mycobacterium avium subsp. paratuberculosis
cgccguugacaccggg

SEQ ID NO: 2935599 - RNA, 17 nt, Mycobacterium avium subsp. paratuberculosis
cgccguugacaccgggu

SEQ ID NO: 2935600 - RNA, 20 nt, Mycobacterium avium subsp. paratuberculosis
cgccguugaccccgacggcg

SEQ ID NO: 2935601 - RNA, 23 nt, Mycobacterium avium subsp. paratuberculosis
cgccguugaccccgacggcgccg

SEQ ID NO: 2935602 - RNA, 14 nt, Mycobacterium avium subsp. paratuberculosis
cgccguugaccgcg

SEQ ID NO: 2935603 - RNA, 17 nt, Mycobacterium avium subsp. paratuberculosis
cgccguugaccgcggcg

SEQ ID NO: 2935604 - RNA, 21 nt, Mycobacterium avium subsp. paratuberculosis
cgccguugaccgcggcgaugg

SEQ ID NO: 2935605 - RNA, 16 nt, Mycobacterium avium subsp. paratuberculosis
cgccguugaccggccg

SEQ ID NO: 2935606 - RNA, 17 nt, Mycobacterium avium subsp. paratuberculosis
cgccguugaccggccgg

SEQ ID NO: 2935607 - RNA, 19 nt, Mycobacterium avium subsp. paratuberculosis
cgccguugaccggccgguc

SEQ ID NO: 2935608 - RNA, 15 nt, Mycobacterium avium subsp. paratuberculosis
cgccguugaccggug

SEQ ID NO: 2935609 - RNA, 17 nt, Mycobacterium avium subsp. paratuberculosis
cgccguugaccggugcg

SEQ ID NO: 2935610 - RNA, 19 nt, Mycobacterium avium subsp. paratuberculosis
cgccguugaccggugcgcc

SEQ ID NO: 2935611 - RNA, 14 nt, Mycobacterium avium subsp. paratuberculosis
cgccguugccggcc

SEQ ID NO: 2935612 - RNA, 15 nt, Mycobacterium avium subsp. paratuberculosis
cgccguugccggccc

SEQ ID NO: 2935613 - RNA, 16 nt, Mycobacterium avium subsp. paratuberculosis
cgccguugccggcccg

SEQ ID NO: 2935614 - RNA, 19 nt, Mycobacterium avium subsp. paratuberculosis
cgccguugccggcccgcag

SEQ ID NO: 2935615 - RNA, 20 nt, Mycobacterium avium subsp. paratuberculosis
cgccguugccggcccgcagc

SEQ ID NO: 2935616 - RNA, 21 nt, Mycobacterium avium subsp. paratuberculosis
cgccguugcgagucaucgcca

SEQ ID NO: 2935617 - RNA, 16 nt, Mycobacterium avium subsp. paratuberculosis
cgccguugcggcccac

SEQ ID NO: 2935618 - RNA, 14 nt, Mycobacterium avium subsp. paratuberculosis
cgccguugcggguc

SEQ ID NO: 2935619 - RNA, 19 nt, Mycobacterium avium subsp. paratuberculosis
cgccguugcgggucggcgu

SEQ ID NO: 2935620 - RNA, 21 nt, Mycobacterium avium subsp. paratuberculosis
cgccguugcgggucggcguca

SEQ ID NO: 2935621 - RNA, 22 nt, Mycobacterium avium subsp. paratuberculosis
cgccguugcgggucggcgucac

SEQ ID NO: 2935622 - RNA, 15 nt, Mycobacterium avium subsp. paratuberculosis
cgccguuggccuggu

SEQ ID NO: 2935623 - RNA, 11 nt, Mycobacterium avium subsp. paratuberculosis
cgccguuggcg

SEQ ID NO: 2935624 - RNA, 14 nt, Mycobacterium avium subsp. paratuberculosis
cgccucgcgcagcg

SEQ ID NO: 2935625 - RNA, 16 nt, Mycobacterium avium subsp. paratuberculosis
cgccucgcgcagcgcg

SEQ ID NO: 2935626 - RNA, 15 nt, Mycobacterium avium subsp. paratuberculosis
cgccucgcggucgac

SEQ ID NO: 2935627 - RNA, 22 nt, Mycobacterium avium subsp. paratuberculosis
cgccucgcuaaucgccgcgcgu

SEQ ID NO: 2935628 - RNA, 16 nt, Mycobacterium avium subsp. paratuberculosis
cgccucggaggccacc

SEQ ID NO: 2935629 - RNA, 22 nt, Mycobacterium avium subsp. paratuberculosis
cgccucggaggccaccgcgccg

SEQ ID NO: 2935630 - RNA, 24 nt, Mycobacterium avium subsp. paratuberculosis
cgccucggaggccaccgcgccguc

SEQ ID NO: 2935631 - RNA, 20 nt, Mycobacterium avium subsp. paratuberculosis
cgccucggaucccggggcgc

SEQ ID NO: 2935632 - RNA, 21 nt, Mycobacterium avium subsp. paratuberculosis
cgccucggaucccggggcgcg

SEQ ID NO: 2935633 - RNA, 23 nt, Mycobacterium avium subsp. paratuberculosis
cgccucggaucccggggcgcgcu

SEQ ID NO: 2935634 - RNA, 13 nt, Mycobacterium avium subsp. paratuberculosis
cgccucggccacc

SEQ ID NO: 2935635 - RNA, 16 nt, Mycobacterium avium subsp. paratuberculosis
cgccucggccaccuug

SEQ ID NO: 2935636 - RNA, 12 nt, Mycobacterium avium subsp. paratuberculosis
cgccucggccgc

SEQ ID NO: 2935637 - RNA, 13 nt, Mycobacterium avium subsp. paratuberculosis
cgccucggccgcg

SEQ ID NO: 2935638 - RNA, 17 nt, Mycobacterium avium subsp. paratuberculosis
cgccucggccgcggucu

SEQ ID NO: 2935639 - RNA, 18 nt, Mycobacterium avium subsp. paratuberculosis
cgccucggccucgucgac

SEQ ID NO: 2935640 - RNA, 16 nt, Mycobacterium avium subsp. paratuberculosis
cgccucggccugcgcc

SEQ ID NO: 2935641 - RNA, 20 nt, Mycobacterium avium subsp. paratuberculosis
cgccucggccuuggccaccg

SEQ ID NO: 2935642 - RNA, 15 nt, Mycobacterium avium subsp. paratuberculosis
cgccucggcgagccg

SEQ ID NO: 2935643 - RNA, 19 nt, Mycobacterium avium subsp. paratuberculosis
cgccucggcgaggucgucg

SEQ ID NO: 2935644 - RNA, 20 nt, Mycobacterium avium subsp. paratuberculosis
cgccucggcgaggucgucga

SEQ ID NO: 2935645 - RNA, 22 nt, Mycobacterium avium subsp. paratuberculosis
cgccucggcgaggucgucgagg

SEQ ID NO: 2935646 - RNA, 15 nt, Mycobacterium avium subsp. paratuberculosis
cgccucggcgaucgg

SEQ ID NO: 2935647 - RNA, 16 nt, Mycobacterium avium subsp. paratuberculosis
cgccucggcgaucggc

SEQ ID NO: 2935648 - RNA, 20 nt, Mycobacterium avium subsp. paratuberculosis
cgccucggcgaucggccgcu

SEQ ID NO: 2935649 - RNA, 13 nt, Mycobacterium avium subsp. paratuberculosis
cgccucggcgccu

SEQ ID NO: 2935650 - RNA, 14 nt, Mycobacterium avium subsp. paratuberculosis
cgccucggcggccc

SEQ ID NO: 2935651 - RNA, 15 nt, Mycobacterium avium subsp. paratuberculosis
cgccucggcggcccc

SEQ ID NO: 2935652 - RNA, 18 nt, Mycobacterium avium subsp. paratuberculosis
cgccucggcggccgcccg

SEQ ID NO: 2935653 - RNA, 19 nt, Mycobacterium avium subsp. paratuberculosis
cgccucggcggccgcccgg

SEQ ID NO: 2935654 - RNA, 15 nt, Mycobacterium avium subsp. paratuberculosis
cgccucggcgggccg

SEQ ID NO: 2935655 - RNA, 18 nt, Mycobacterium avium subsp. paratuberculosis
cgccucggcgggccgccc

SEQ ID NO: 2935656 - RNA, 16 nt, Mycobacterium avium subsp. paratuberculosis
cgccucggcgucaccg

SEQ ID NO: 2935657 - RNA, 18 nt, Mycobacterium avium subsp. paratuberculosis
cgccucggcgucaccgcg

SEQ ID NO: 2935658 - RNA, 14 nt, Mycobacterium avium subsp. paratuberculosis
cgccucggcguccc

SEQ ID NO: 2935659 - RNA, 18 nt, Mycobacterium avium subsp. paratuberculosis
cgccucggcgucccggcg

SEQ ID NO: 2935660 - RNA, 18 nt, Mycobacterium avium subsp. paratuberculosis
cgccucgggccggcagcc

SEQ ID NO: 2935661 - RNA, 21 nt, Mycobacterium avium subsp. paratuberculosis
cgccucgggccggcagccggc

SEQ ID NO: 2935662 - RNA, 22 nt, Mycobacterium avium subsp. paratuberculosis
cgccucgggccggcagccggcc

SEQ ID NO: 2935663 - RNA, 23 nt, Mycobacterium avium subsp. paratuberculosis
cgccucgggccggcagccggcca

SEQ ID NO: 2935664 - RNA, 18 nt, Mycobacterium avium subsp. paratuberculosis
cgccucggggaucgccag

SEQ ID NO: 2935665 - RNA, 20 nt, Mycobacterium avium subsp. paratuberculosis
cgccucggggaucgccaggc

SEQ ID NO: 2935666 - RNA, 22 nt, Mycobacterium avium subsp. paratuberculosis
cgccucggucgcgugaccggcg

SEQ ID NO: 2935667 - RNA, 18 nt, Mycobacterium avium subsp. paratuberculosis
cgccucggugagcagcuc

SEQ ID NO: 2935668 - RNA, 12 nt, Mycobacterium avium subsp. paratuberculosis
cgccucggugcg

SEQ ID NO: 2935669 - RNA, 20 nt, Mycobacterium avium subsp. paratuberculosis
cgccucggugcggaacaccg

SEQ ID NO: 2935670 - RNA, 23 nt, Mycobacterium avium subsp. paratuberculosis
cgccucggugcggaacaccgccu

SEQ ID NO: 2935671 - RNA, 17 nt, Mycobacterium avium subsp. paratuberculosis
cgccucgguggucgacg

SEQ ID NO: 2935672 - RNA, 20 nt, Mycobacterium avium subsp. paratuberculosis
cgccucgucgaccgcggccu

SEQ ID NO: 2935673 - RNA, 15 nt, Mycobacterium avium subsp. paratuberculosis
cgccucgucgagcag

SEQ ID NO: 2935674 - RNA, 20 nt, Mycobacterium avium subsp. paratuberculosis
cgccucgucgagcagcgccc

SEQ ID NO: 2935675 - RNA, 16 nt, Mycobacterium avium subsp. paratuberculosis
cgccucgucgagccgg

SEQ ID NO: 2935676 - RNA, 19 nt, Mycobacterium avium subsp. paratuberculosis
cgccucgucgagccgggcc

SEQ ID NO: 2935677 - RNA, 20 nt, Mycobacterium avium subsp. paratuberculosis
cgccucgucgagccgggccc

SEQ ID NO: 2935678 - RNA, 20 nt, Mycobacterium avium subsp. paratuberculosis
cgccucgugcaugugcucgg

SEQ ID NO: 2935679 - RNA, 21 nt, Mycobacterium avium subsp. paratuberculosis
cgccucgugcaugugcucggc

SEQ ID NO: 2935680 - RNA, 23 nt, Mycobacterium avium subsp. paratuberculosis
cgccucgugcaugugcucggcga

SEQ ID NO: 2935681 - RNA, 17 nt, Mycobacterium avium subsp. paratuberculosis
cgccucguuggccagcu

SEQ ID NO: 2935682 - RNA, 21 nt, Mycobacterium avium subsp. paratuberculosis
cgccucguuggccagcucggc

SEQ ID NO: 2935683 - RNA, 18 nt, Mycobacterium avium subsp. paratuberculosis
cgccugagcaaccgguuc

SEQ ID NO: 2935684 - RNA, 12 nt, Mycobacterium avium subsp. paratuberculosis
cgccugagcccg

SEQ ID NO: 2935685 - RNA, 16 nt, Mycobacterium avium subsp. paratuberculosis
cgccugauacgacguc

SEQ ID NO: 2935686 - RNA, 18 nt, Mycobacterium avium subsp. paratuberculosis
cgccugauacgacguccg

SEQ ID NO: 2935687 - RNA, 21 nt, Mycobacterium avium subsp. paratuberculosis
cgccugauacgacguccgggc

SEQ ID NO: 2935688 - RNA, 23 nt, Mycobacterium avium subsp. paratuberculosis
cgccugauacgacguccgggccg

SEQ ID NO: 2935689 - RNA, 15 nt, Mycobacterium avium subsp. paratuberculosis
cgccugcaccggcga

SEQ ID NO: 2935690 - RNA, 17 nt, Mycobacterium avium subsp. paratuberculosis
cgccugcaccggcgacg

SEQ ID NO: 2935691 - RNA, 23 nt, Mycobacterium avium subsp. paratuberculosis
cgccugcaccggcgacggcgguu

SEQ ID NO: 2935692 - RNA, 15 nt, Mycobacterium avium subsp. paratuberculosis
cgccugcacggugcc

SEQ ID NO: 2935693 - RNA, 15 nt, Mycobacterium avium subsp. paratuberculosis
cgccugcagccgccg

SEQ ID NO: 2935694 - RNA, 16 nt, Mycobacterium avium subsp. paratuberculosis
cgccugcagccgccgc

SEQ ID NO: 2935695 - RNA, 21 nt, Mycobacterium avium subsp. paratuberculosis
cgccugcagccgccgcgccac

SEQ ID NO: 2935696 - RNA, 16 nt, Mycobacterium avium subsp. paratuberculosis
cgccugcccgggcgcc

SEQ ID NO: 2935697 - RNA, 17 nt, Mycobacterium avium subsp. paratuberculosis
cgccugcccgggcgccg

SEQ ID NO: 2935698 - RNA, 18 nt, Mycobacterium avium subsp. paratuberculosis
cgccugcccgggcgccga

SEQ ID NO: 2935699 - RNA, 13 nt, Mycobacterium avium subsp. paratuberculosis
cgccugccgccuu

SEQ ID NO: 2935700 - RNA, 13 nt, Mycobacterium avium subsp. paratuberculosis
cgccugccggcgc

SEQ ID NO: 2935701 - RNA, 17 nt, Mycobacterium avium subsp. paratuberculosis
cgccugccggcgccgga

SEQ ID NO: 2935702 - RNA, 21 nt, Mycobacterium avium subsp. paratuberculosis
cgccugccuggccacgugguc

SEQ ID NO: 2935703 - RNA, 13 nt, Mycobacterium avium subsp. paratuberculosis
cgccugcgccgcc

SEQ ID NO: 2935704 - RNA, 14 nt, Mycobacterium avium subsp. paratuberculosis
cgccugcgccgccg

SEQ ID NO: 2935705 - RNA, 17 nt, Mycobacterium avium subsp. paratuberculosis
cgccugcgcgaucgccg

SEQ ID NO: 2935706 - RNA, 22 nt, Mycobacterium avium subsp. paratuberculosis
cgccugcgcgaucgccggaucg

SEQ ID NO: 2935707 - RNA, 14 nt, Mycobacterium avium subsp. paratuberculosis
cgccugcgcgccgu

SEQ ID NO: 2935708 - RNA, 20 nt, Mycobacterium avium subsp. paratuberculosis
cgccuuugagcgacaaccgu

SEQ ID NO: 2935709 - RNA, 17 nt, Mycobacterium avium subsp. paratuberculosis
cgccuuuugcacccgcc

SEQ ID NO: 2935710 - RNA, 19 nt, Mycobacterium avium subsp. paratuberculosis
cgcgaaaaaacggcggcgg

SEQ ID NO: 2935711 - RNA, 14 nt, Mycobacterium avium subsp. paratuberculosis
cgcgaaaacagcga

SEQ ID NO: 2935712 - RNA, 15 nt, Mycobacterium avium subsp. paratuberculosis
cgcgaaaaccagcac

SEQ ID NO: 2935713 - RNA, 17 nt, Mycobacterium avium subsp. paratuberculosis
cgcgaaaaccagcaccg

SEQ ID NO: 2935714 - RNA, 18 nt, Mycobacterium avium subsp. paratuberculosis
cgcgaaaaccagcaccgg

SEQ ID NO: 2935715 - RNA, 19 nt, Mycobacterium avium subsp. paratuberculosis
cgcgaaaaccagcaccggc

SEQ ID NO: 2935716 - RNA, 21 nt, Mycobacterium avium subsp. paratuberculosis
cgcgaaaaccagcaccggcac

SEQ ID NO: 2935717 - RNA, 21 nt, Mycobacterium avium subsp. paratuberculosis
cgcgaaaauaccgccggccgc

SEQ ID NO: 2935718 - RNA, 18 nt, Mycobacterium avium subsp. paratuberculosis
cgcgaaacgcaacagcga

SEQ ID NO: 2935719 - RNA, 14 nt, Mycobacterium avium subsp. paratuberculosis
cgcgaaagcacccg

SEQ ID NO: 2935720 - RNA, 18 nt, Mycobacterium avium subsp. paratuberculosis
cgcgaaagcacccgacac

SEQ ID NO: 2935721 - RNA, 16 nt, Mycobacterium avium subsp. paratuberculosis
cgcgaaagcagcaacg

SEQ ID NO: 2935722 - RNA, 22 nt, Mycobacterium avium subsp. paratuberculosis
cgcgaaagcagcaacggcggcg

SEQ ID NO: 2935723 - RNA, 23 nt, Mycobacterium avium subsp. paratuberculosis
cgcgaaagcagcaacggcggcgg

SEQ ID NO: 2935724 - RNA, 15 nt, Mycobacterium avium subsp. paratuberculosis
cgcgaaagcgucggc

SEQ ID NO: 2935725 - RNA, 16 nt, Mycobacterium avium subsp. paratuberculosis
cgcgaaaggcccaccg

SEQ ID NO: 2935726 - RNA, 21 nt, Mycobacterium avium subsp. paratuberculosis
cgcgaaagugcaacugccgac

SEQ ID NO: 2935727 - RNA, 21 nt, Mycobacterium avium subsp. paratuberculosis
cgcgaaagugcuacugccgac

SEQ ID NO: 2935728 - RNA, 24 nt, Mycobacterium avium subsp. paratuberculosis
cgcgaaagugcuacugccgacgca

SEQ ID NO: 2935729 - RNA, 21 nt, Mycobacterium avium subsp. paratuberculosis
cgcgaacaccagaugccgcuc

SEQ ID NO: 2935730 - RNA, 13 nt, Mycobacterium avium subsp. paratuberculosis
cgcgaacacgcga

SEQ ID NO: 2935731 - RNA, 13 nt, Mycobacterium avium subsp. paratuberculosis
cgcgaacagccga

SEQ ID NO: 2935732 - RNA, 14 nt, Mycobacterium avium subsp. paratuberculosis
cgcgaacagccgac

SEQ ID NO: 2935733 - RNA, 15 nt, Mycobacterium avium subsp. paratuberculosis
cgcgaacagccgacc

SEQ ID NO: 2935734 - RNA, 16 nt, Mycobacterium avium subsp. paratuberculosis
cgcgaacagccgaccg

SEQ ID NO: 2935735 - RNA, 13 nt, Mycobacterium avium subsp. paratuberculosis
cgcgaacagcgcc

SEQ ID NO: 2935736 - RNA, 14 nt, Mycobacterium avium subsp. paratuberculosis
cgcgaacagcgccg

SEQ ID NO: 2935737 - RNA, 15 nt, Mycobacterium avium subsp. paratuberculosis
cgcgaacagcgccga

SEQ ID NO: 2935738 - RNA, 17 nt, Mycobacterium avium subsp. paratuberculosis
cgcgaacagcgccgacu

SEQ ID NO: 2935739 - RNA, 19 nt, Mycobacterium avium subsp. paratuberculosis
cgcgaacagcgcggccacc

SEQ ID NO: 2935740 - RNA, 23 nt, Mycobacterium avium subsp. paratuberculosis
cgcgaacagguccuugcccagca

SEQ ID NO: 2935741 - RNA, 17 nt, Mycobacterium avium subsp. paratuberculosis
cgcgaacaucgccagca

SEQ ID NO: 2935742 - RNA, 18 nt, Mycobacterium avium subsp. paratuberculosis
cgcgaacaucgccagcaa

SEQ ID NO: 2935743 - RNA, 19 nt, Mycobacterium avium subsp. paratuberculosis
cgcgaacgacgaccucccc

SEQ ID NO: 2935744 - RNA, 21 nt, Mycobacterium avium subsp. paratuberculosis
cgcgaacgacgaccucccccg

SEQ ID NO: 2935745 - RNA, 22 nt, Mycobacterium avium subsp. paratuberculosis
cgcgaacgcaacagggccaccg

SEQ ID NO: 2935746 - RNA, 15 nt, Mycobacterium avium subsp. paratuberculosis
cgcgaacgcagucca

SEQ ID NO: 2935747 - RNA, 17 nt, Mycobacterium avium subsp. paratuberculosis
cgcgaacgccucggcga

SEQ ID NO: 2935748 - RNA, 18 nt, Mycobacterium avium subsp. paratuberculosis
cgcgaacgccucggcgag

SEQ ID NO: 2935749 - RNA, 20 nt, Mycobacterium avium subsp. paratuberculosis
cgcgaacgccucggcgagcc

SEQ ID NO: 2935750 - RNA, 18 nt, Mycobacterium avium subsp. paratuberculosis
cgcgaacgccucguuggc

SEQ ID NO: 2935751 - RNA, 16 nt, Mycobacterium avium subsp. paratuberculosis
cgcgaacgcgccccgc

SEQ ID NO: 2935752 - RNA, 14 nt, Mycobacterium avium subsp. paratuberculosis
cgcgaacggcccgc

SEQ ID NO: 2935753 - RNA, 15 nt, Mycobacterium avium subsp. paratuberculosis
cgcgaacggcccgcc

SEQ ID NO: 2935754 - RNA, 18 nt, Mycobacterium avium subsp. paratuberculosis
cgcgaacggcccgccgcc

SEQ ID NO: 2935755 - RNA, 22 nt, Mycobacterium avium subsp. paratuberculosis
cgcgaacggcccgccgccggcg

SEQ ID NO: 2935756 - RNA, 15 nt, Mycobacterium avium subsp. paratuberculosis
cgcgaacggguagcc

SEQ ID NO: 2935757 - RNA, 19 nt, Mycobacterium avium subsp. paratuberculosis
cgcgaacgggucgggggug

SEQ ID NO: 2935758 - RNA, 21 nt, Mycobacterium avium subsp. paratuberculosis
cgcgaacgggugaccggcggc

SEQ ID NO: 2935759 - RNA, 22 nt, Mycobacterium avium subsp. paratuberculosis
cgcgaacgggugaccggcggcc

SEQ ID NO: 2935760 - RNA, 14 nt, Mycobacterium avium subsp. paratuberculosis
cgcgaacgggugcg

SEQ ID NO: 2935761 - RNA, 15 nt, Mycobacterium avium subsp. paratuberculosis
cgcgaacgggugcgg

SEQ ID NO: 2935762 - RNA, 17 nt, Mycobacterium avium subsp. paratuberculosis
cgcgaacgggugcggcg

SEQ ID NO: 2935763 - RNA, 22 nt, Mycobacterium avium subsp. paratuberculosis
cgcgaacgggugcggcgcucgg

SEQ ID NO: 2935764 - RNA, 23 nt, Mycobacterium avium subsp. paratuberculosis
cgcgaacuacuucgucagcagcg

SEQ ID NO: 2935765 - RNA, 18 nt, Mycobacterium avium subsp. paratuberculosis
cgcgaacucgucgacgcc

SEQ ID NO: 2935766 - RNA, 19 nt, Mycobacterium avium subsp. paratuberculosis
cgcgaacucgucgacgccc

SEQ ID NO: 2935767 - RNA, 22 nt, Mycobacterium avium subsp. paratuberculosis
cgcgaacucgucgaugcacgcc

SEQ ID NO: 2935768 - RNA, 16 nt, Mycobacterium avium subsp. paratuberculosis
cgcgaagaacgacgcc

SEQ ID NO: 2935769 - RNA, 20 nt, Mycobacterium avium subsp. paratuberculosis
cgcgaagaacgacgccaccg

SEQ ID NO: 2935770 - RNA, 19 nt, Mycobacterium avium subsp. paratuberculosis
cgcgaagaacggugucacg

SEQ ID NO: 2935771 - RNA, 19 nt, Mycobacterium avium subsp. paratuberculosis
cgcgaagcccucgaagcag

SEQ ID NO: 2935772 - RNA, 19 nt, Mycobacterium avium subsp. paratuberculosis
cgcgaagcguaugccggug

SEQ ID NO: 2935773 - RNA, 22 nt, Mycobacterium avium subsp. paratuberculosis
cgcgaagcguaugccgguggcg

SEQ ID NO: 2935774 - RNA, 23 nt, Mycobacterium avium subsp. paratuberculosis
cgcgaagcugggguaguucugcu

SEQ ID NO: 2935775 - RNA, 16 nt, Mycobacterium avium subsp. paratuberculosis
cgcgaaggcggcgucg

SEQ ID NO: 2935776 - RNA, 17 nt, Mycobacterium avium subsp. paratuberculosis
cgcgaaggcggcgucga

SEQ ID NO: 2935777 - RNA, 18 nt, Mycobacterium avium subsp. paratuberculosis
cgcgaagguggcacgcca

SEQ ID NO: 2935778 - RNA, 23 nt, Mycobacterium avium subsp. paratuberculosis
cgcgaaguagacgagcucaccgc

SEQ ID NO: 2935779 - RNA, 17 nt, Mycobacterium avium subsp. paratuberculosis
cgcgaagucccacugcc

SEQ ID NO: 2935780 - RNA, 14 nt, Mycobacterium avium subsp. paratuberculosis
cgcgaaguccgacg

SEQ ID NO: 2935781 - RNA, 17 nt, Mycobacterium avium subsp. paratuberculosis
cgcgaagucgagcaggu

SEQ ID NO: 2935782 - RNA, 14 nt, Mycobacterium avium subsp. paratuberculosis
cgcgaagucgccgc

SEQ ID NO: 2935783 - RNA, 17 nt, Mycobacterium avium subsp. paratuberculosis
cgcgaaucccggccucg

SEQ ID NO: 2935784 - RNA, 18 nt, Mycobacterium avium subsp. paratuberculosis
cgcgaaucccggccucgu

SEQ ID NO: 2935785 - RNA, 20 nt, Mycobacterium avium subsp. paratuberculosis
cgcgaaucgauaacgcgcgc

SEQ ID NO: 2935786 - RNA, 24 nt, Mycobacterium avium subsp. paratuberculosis
cgcgaaucgauaacgcgcgcgccg

SEQ ID NO: 2935787 - RNA, 15 nt, Mycobacterium avium subsp. paratuberculosis
cgcgaaugucgacca

SEQ ID NO: 2935788 - RNA, 21 nt, Mycobacterium avium subsp. paratuberculosis
cgcgaauuccucagcgcccca

SEQ ID NO: 2935789 - RNA, 19 nt, Mycobacterium avium subsp. paratuberculosis
cgcgaauugagguagucgg

SEQ ID NO: 2935790 - RNA, 21 nt, Mycobacterium avium subsp. paratuberculosis
cgcgaauugagguagucggcc

SEQ ID NO: 2935791 - RNA, 22 nt, Mycobacterium avium subsp. paratuberculosis
cgcgacaagcagauucgagguc

SEQ ID NO: 2935792 - RNA, 13 nt, Mycobacterium avium subsp. paratuberculosis
cgcgaccgcgcgg

SEQ ID NO: 2935793 - RNA, 15 nt, Mycobacterium avium subsp. paratuberculosis
cgcgaccgcgcggcg

SEQ ID NO: 2935794 - RNA, 16 nt, Mycobacterium avium subsp. paratuberculosis
cgcgaccgcgcggcga

SEQ ID NO: 2935795 - RNA, 15 nt, Mycobacterium avium subsp. paratuberculosis
cgcgaccgcgucgac

SEQ ID NO: 2935796 - RNA, 14 nt, Mycobacterium avium subsp. paratuberculosis
cgcgaccggcccga

SEQ ID NO: 2935797 - RNA, 16 nt, Mycobacterium avium subsp. paratuberculosis
cgcgaccggcccgaac

SEQ ID NO: 2935798 - RNA, 21 nt, Mycobacterium avium subsp. paratuberculosis
cgcgaccgguccgugccacgg

SEQ ID NO: 2935799 - RNA, 16 nt, Mycobacterium avium subsp. paratuberculosis
cgcgaccgucagcagg

SEQ ID NO: 2935800 - RNA, 23 nt, Mycobacterium avium subsp. paratuberculosis
cgcgaccgucagcagggccucgc

SEQ ID NO: 2935801 - RNA, 19 nt, Mycobacterium avium subsp. paratuberculosis
cgcgaccgucgggacggcc

SEQ ID NO: 2935802 - RNA, 20 nt, Mycobacterium avium subsp. paratuberculosis
cgcgaccgucgggacggcca

SEQ ID NO: 2935803 - RNA, 21 nt, Mycobacterium avium subsp. paratuberculosis
cgcgaccgucgggacggccag

SEQ ID NO: 2935804 - RNA, 22 nt, Mycobacterium avium subsp. paratuberculosis
cgcgaccgucgggacggccagc

SEQ ID NO: 2935805 - RNA, 11 nt, Mycobacterium avium subsp. paratuberculosis
cgcgaccucgg

SEQ ID NO: 2935806 - RNA, 15 nt, Mycobacterium avium subsp. paratuberculosis
cgcgaccucgguggu

SEQ ID NO: 2935807 - RNA, 16 nt, Mycobacterium avium subsp. paratuberculosis
cgcgaccucgguggug

SEQ ID NO: 2935808 - RNA, 17 nt, Mycobacterium avium subsp. paratuberculosis
cgcgaccucgguggugc

SEQ ID NO: 2935809 - RNA, 17 nt, Mycobacterium avium subsp. paratuberculosis
cgcgaccugcaucucga

SEQ ID NO: 2935810 - RNA, 20 nt, Mycobacterium avium subsp. paratuberculosis
cgcgaccugcaucucgaccc

SEQ ID NO: 2935811 - RNA, 22 nt, Mycobacterium avium subsp. paratuberculosis
cgcgaccuguuugaacaccucg

SEQ ID NO: 2935812 - RNA, 14 nt, Mycobacterium avium subsp. paratuberculosis
cgcgacgaacagca

SEQ ID NO: 2935813 - RNA, 16 nt, Mycobacterium avium subsp. paratuberculosis
cgcgacgaacagcacc

SEQ ID NO: 2935814 - RNA, 18 nt, Mycobacterium avium subsp. paratuberculosis
cgcgacgaacagcaccgc

SEQ ID NO: 2935815 - RNA, 19 nt, Mycobacterium avium subsp. paratuberculosis
cgcgacgaacagcaccgcc

SEQ ID NO: 2935816 - RNA, 19 nt, Mycobacterium avium subsp. paratuberculosis
cgcgacgaaccgccacacg

SEQ ID NO: 2935817 - RNA, 14 nt, Mycobacterium avium subsp. paratuberculosis
cgcgacgaagccgg

SEQ ID NO: 2935818 - RNA, 17 nt, Mycobacterium avium subsp. paratuberculosis
cgcgacgaagccggugc

SEQ ID NO: 2935819 - RNA, 19 nt, Mycobacterium avium subsp. paratuberculosis
cgcgacgaagccggugccc

SEQ ID NO: 2935820 - RNA, 14 nt, Mycobacterium avium subsp. paratuberculosis
cgcgacgaagcggu

SEQ ID NO: 2935821 - RNA, 17 nt, Mycobacterium avium subsp. paratuberculosis
cgcgacgaagcggucgc

SEQ ID NO: 2935822 - RNA, 18 nt, Mycobacterium avium subsp. paratuberculosis
cgcgacgaauccggugac

SEQ ID NO: 2935823 - RNA, 22 nt, Mycobacterium avium subsp. paratuberculosis
cgcgacgaauugcagauccaga

SEQ ID NO: 2935824 - RNA, 16 nt, Mycobacterium avium subsp. paratuberculosis
cgcgacgacaccaccg

SEQ ID NO: 2935825 - RNA, 15 nt, Mycobacterium avium subsp. paratuberculosis
cgcgacgagcgggcc

SEQ ID NO: 2935826 - RNA, 16 nt, Mycobacterium avium subsp. paratuberculosis
cgcgacgagcgggccg

SEQ ID NO: 2935827 - RNA, 17 nt, Mycobacterium avium subsp. paratuberculosis
cgcgacgagcgggccga

SEQ ID NO: 2935828 - RNA, 18 nt, Mycobacterium avium subsp. paratuberculosis
cgcgacgagcgggccgau

SEQ ID NO: 2935829 - RNA, 22 nt, Mycobacterium avium subsp. paratuberculosis
cgcgacgaucagcagccgggcc

SEQ ID NO: 2935830 - RNA, 12 nt, Mycobacterium avium subsp. paratuberculosis
cgcgacgaucgc

SEQ ID NO: 2935831 - RNA, 13 nt, Mycobacterium avium subsp. paratuberculosis
cgcgacgaugccg

SEQ ID NO: 2935832 - RNA, 14 nt, Mycobacterium avium subsp. paratuberculosis
cgcgacgaugccgg

SEQ ID NO: 2935833 - RNA, 16 nt, Mycobacterium avium subsp. paratuberculosis
cgcgacgaugccggcg

SEQ ID NO: 2935834 - RNA, 20 nt, Mycobacterium avium subsp. paratuberculosis
cgcgacgaugucgacccgcg

SEQ ID NO: 2935835 - RNA, 13 nt, Mycobacterium avium subsp. paratuberculosis
cgcgacgcacgcc

SEQ ID NO: 2935836 - RNA, 16 nt, Mycobacterium avium subsp. paratuberculosis
cgcgacgcacgccggc

SEQ ID NO: 2935837 - RNA, 17 nt, Mycobacterium avium subsp. paratuberculosis
cgcgacgcacgccggcg

SEQ ID NO: 2935838 - RNA, 13 nt, Mycobacterium avium subsp. paratuberculosis
cgcgacgccagca

SEQ ID NO: 2935839 - RNA, 14 nt, Mycobacterium avium subsp. paratuberculosis
cgcgacgccagcac

SEQ ID NO: 2935840 - RNA, 15 nt, Mycobacterium avium subsp. paratuberculosis
cgcgacgccagcacc

SEQ ID NO: 2935841 - RNA, 18 nt, Mycobacterium avium subsp. paratuberculosis
cgcgacgccagcaccuuc

SEQ ID NO: 2935842 - RNA, 12 nt, Mycobacterium avium subsp. paratuberculosis
cgcgacgcccag

SEQ ID NO: 2935843 - RNA, 12 nt, Mycobacterium avium subsp. paratuberculosis
cgcgacgccgac

SEQ ID NO: 2935844 - RNA, 16 nt, Mycobacterium avium subsp. paratuberculosis
cgcgacgccgacgccc

SEQ ID NO: 2935845 - RNA, 17 nt, Mycobacterium avium subsp. paratuberculosis
cgcgacgccgacgccca

SEQ ID NO: 2935846 - RNA, 20 nt, Mycobacterium avium subsp. paratuberculosis
cgcgacgccgacgcccagcg

SEQ ID NO: 2935847 - RNA, 14 nt, Mycobacterium avium subsp. paratuberculosis
cgcgacgccgccgc

SEQ ID NO: 2935848 - RNA, 23 nt, Mycobacterium avium subsp. paratuberculosis
cgcgacgccguagaucacgccgg

SEQ ID NO: 2935849 - RNA, 13 nt, Mycobacterium avium subsp. paratuberculosis
cgcgacgccguca

SEQ ID NO: 2935850 - RNA, 14 nt, Mycobacterium avium subsp. paratuberculosis
cgcgacgcgaucga

SEQ ID NO: 2935851 - RNA, 12 nt, Mycobacterium avium subsp. paratuberculosis
cgcgacgcgcgg

SEQ ID NO: 2935852 - RNA, 15 nt, Mycobacterium avium subsp. paratuberculosis
cgcgacgcgcggucg

SEQ ID NO: 2935853 - RNA, 15 nt, Mycobacterium avium subsp. paratuberculosis
cgcgacgcgcucggc

SEQ ID NO: 2935854 - RNA, 20 nt, Mycobacterium avium subsp. paratuberculosis
cgcgacgcgcucggcgaccg

SEQ ID NO: 2935855 - RNA, 13 nt, Mycobacterium avium subsp. paratuberculosis
cgcgacgcgggau

SEQ ID NO: 2935856 - RNA, 22 nt, Mycobacterium avium subsp. paratuberculosis
cgcgacgcugagcgccaggcca

SEQ ID NO: 2935857 - RNA, 20 nt, Mycobacterium avium subsp. paratuberculosis
cgcgacgcugauggcgagga

SEQ ID NO: 2935858 - RNA, 14 nt, Mycobacterium avium subsp. paratuberculosis
cgcgacgcugccgg

SEQ ID NO: 2935859 - RNA, 17 nt, Mycobacterium avium subsp. paratuberculosis
cgcgacgcugccggggc

SEQ ID NO: 2935860 - RNA, 20 nt, Mycobacterium avium subsp. paratuberculosis
cgcgacgcugccggggcgca

SEQ ID NO: 2935861 - RNA, 17 nt, Mycobacterium avium subsp. paratuberculosis
cgcgacgcugccggugg

SEQ ID NO: 2935862 - RNA, 18 nt, Mycobacterium avium subsp. paratuberculosis
cgcgacgcugccgguggu

SEQ ID NO: 2935863 - RNA, 15 nt, Mycobacterium avium subsp. paratuberculosis
cgcgacggaccagug

SEQ ID NO: 2935864 - RNA, 17 nt, Mycobacterium avium subsp. paratuberculosis
cgcgacggaccagugca

SEQ ID NO: 2935865 - RNA, 20 nt, Mycobacterium avium subsp. paratuberculosis
cgcgacggaccagugcaggu

SEQ ID NO: 2935866 - RNA, 13 nt, Mycobacterium avium subsp. paratuberculosis
cgcgacggcccgg

SEQ ID NO: 2935867 - RNA, 12 nt, Mycobacterium avium subsp. paratuberculosis
cgcgacggccgc

SEQ ID NO: 2935868 - RNA, 13 nt, Mycobacterium avium subsp. paratuberculosis
cgcgacggccgcc

SEQ ID NO: 2935869 - RNA, 17 nt, Mycobacterium avium subsp. paratuberculosis
cgcgacggccggggcca

SEQ ID NO: 2935870 - RNA, 20 nt, Mycobacterium avium subsp. paratuberculosis
cgcgacggccggggccagca

SEQ ID NO: 2935871 - RNA, 13 nt, Mycobacterium avium subsp. paratuberculosis
cgcgacggccucg

SEQ ID NO: 2935872 - RNA, 14 nt, Mycobacterium avium subsp. paratuberculosis
cgcgacggccucgc

SEQ ID NO: 2935873 - RNA, 15 nt, Mycobacterium avium subsp. paratuberculosis
cgcgacggccucgcc

SEQ ID NO: 2935874 - RNA, 19 nt, Mycobacterium avium subsp. paratuberculosis
cgcgacggccucgccgucg

SEQ ID NO: 2935875 - RNA, 20 nt, Mycobacterium avium subsp. paratuberculosis
cgcgacggccucgccgucgc

SEQ ID NO: 2935876 - RNA, 14 nt, Mycobacterium avium subsp. paratuberculosis
cgcgacggcgagcc

SEQ ID NO: 2935877 - RNA, 12 nt, Mycobacterium avium subsp. paratuberculosis
cgcgagcgcgcg

SEQ ID NO: 2935878 - RNA, 14 nt, Mycobacterium avium subsp. paratuberculosis
cgcgagcgcgcggu

SEQ ID NO: 2935879 - RNA, 16 nt, Mycobacterium avium subsp. paratuberculosis
cgcgagcgcgcgguga

SEQ ID NO: 2935880 - RNA, 14 nt, Mycobacterium avium subsp. paratuberculosis
cgcgagcgcgcugu

SEQ ID NO: 2935881 - RNA, 13 nt, Mycobacterium avium subsp. paratuberculosis
cgcgagcgcuacc

SEQ ID NO: 2935882 - RNA, 19 nt, Mycobacterium avium subsp. paratuberculosis
cgcgagcgcuaccgcgcuc

SEQ ID NO: 2935883 - RNA, 13 nt, Mycobacterium avium subsp. paratuberculosis
cgcgagcggacgg

SEQ ID NO: 2935884 - RNA, 12 nt, Mycobacterium avium subsp. paratuberculosis
cgcgagcgggug

SEQ ID NO: 2935885 - RNA, 15 nt, Mycobacterium avium subsp. paratuberculosis
cgcgagcgucacgcu

SEQ ID NO: 2935886 - RNA, 17 nt, Mycobacterium avium subsp. paratuberculosis
cgcgagcgucacgcugg

SEQ ID NO: 2935887 - RNA, 18 nt, Mycobacterium avium subsp. paratuberculosis
cgcgagcgucacgcuggc

SEQ ID NO: 2935888 - RNA, 22 nt, Mycobacterium avium subsp. paratuberculosis
cgcgagcugcuucgucgccggg

SEQ ID NO: 2935889 - RNA, 18 nt, Mycobacterium avium subsp. paratuberculosis
cgcgaggaaucgcggcag

SEQ ID NO: 2935890 - RNA, 21 nt, Mycobacterium avium subsp. paratuberculosis
cgcgaggaaucgcggcaggcg

SEQ ID NO: 2935891 - RNA, 22 nt, Mycobacterium avium subsp. paratuberculosis
cgcgaggaaucgcggcaggcga

SEQ ID NO: 2935892 - RNA, 14 nt, Mycobacterium avium subsp. paratuberculosis
cgcgaggacgaugg

SEQ ID NO: 2935893 - RNA, 16 nt, Mycobacterium avium subsp. paratuberculosis
cgcgaggaggggucgg

SEQ ID NO: 2935894 - RNA, 17 nt, Mycobacterium avium subsp. paratuberculosis
cgcgaggaggggucggu

SEQ ID NO: 2935895 - RNA, 20 nt, Mycobacterium avium subsp. paratuberculosis
cgcgaggaggggucggugcg

SEQ ID NO: 2935896 - RNA, 16 nt, Mycobacterium avium subsp. paratuberculosis
cgcgaggcgcggggcg

SEQ ID NO: 2935897 - RNA, 19 nt, Mycobacterium avium subsp. paratuberculosis
cgcgaggcgcggggcgcga

SEQ ID NO: 2935898 - RNA, 20 nt, Mycobacterium avium subsp. paratuberculosis
cgcgaggcggguaggcgucg

SEQ ID NO: 2935899 - RNA, 20 nt, Mycobacterium avium subsp. paratuberculosis
cgcgagggccguugcggcca

SEQ ID NO: 2935900 - RNA, 20 nt, Mycobacterium avium subsp. paratuberculosis
cgcgagggcucaacaggcga

SEQ ID NO: 2935901 - RNA, 23 nt, Mycobacterium avium subsp. paratuberculosis
cgcgaggucgacggagucgucgg

SEQ ID NO: 2935902 - RNA, 15 nt, Mycobacterium avium subsp. paratuberculosis
cgcgaggugucgacg

SEQ ID NO: 2935903 - RNA, 17 nt, Mycobacterium avium subsp. paratuberculosis
cgcgaggugucgacgcu

SEQ ID NO: 2935904 - RNA, 16 nt, Mycobacterium avium subsp. paratuberculosis
cgcgagucaccggcuc

SEQ ID NO: 2935905 - RNA, 15 nt, Mycobacterium avium subsp. paratuberculosis
cgcgagucgagcacc

SEQ ID NO: 2935906 - RNA, 16 nt, Mycobacterium avium subsp. paratuberculosis
cgcgagucgagcaccg

SEQ ID NO: 2935907 - RNA, 21 nt, Mycobacterium avium subsp. paratuberculosis
cgcgagucgagcaccgcgacc

SEQ ID NO: 2935908 - RNA, 22 nt, Mycobacterium avium subsp. paratuberculosis
cgcgagucgagcaccgcgacca

SEQ ID NO: 2935909 - RNA, 18 nt, Mycobacterium avium subsp. paratuberculosis
cgcgauagaccucacggu

SEQ ID NO: 2935910 - RNA, 23 nt, Mycobacterium avium subsp. paratuberculosis
cgcgauagaccucacggucggcg

SEQ ID NO: 2935911 - RNA, 14 nt, Mycobacterium avium subsp. paratuberculosis
cgcgauagccggug

SEQ ID NO: 2935912 - RNA, 18 nt, Mycobacterium avium subsp. paratuberculosis
cgcgauagggccggccgg

SEQ ID NO: 2935913 - RNA, 20 nt, Mycobacterium avium subsp. paratuberculosis
cgcgauagggccggccggac

SEQ ID NO: 2935914 - RNA, 17 nt, Mycobacterium avium subsp. paratuberculosis
cgcgaucaacaccgguc

SEQ ID NO: 2935915 - RNA, 16 nt, Mycobacterium avium subsp. paratuberculosis
cgcgaucaacgggucg

SEQ ID NO: 2935916 - RNA, 16 nt, Mycobacterium avium subsp. paratuberculosis
cgcgaucacaccacca

SEQ ID NO: 2935917 - RNA, 21 nt, Mycobacterium avium subsp. paratuberculosis
cgcgaucacaccaccacgcga

SEQ ID NO: 2935918 - RNA, 14 nt, Mycobacterium avium subsp. paratuberculosis
cgcgaucaccaccc

SEQ ID NO: 2935919 - RNA, 18 nt, Mycobacterium avium subsp. paratuberculosis
cgcgaucaccaccccggu

SEQ ID NO: 2935920 - RNA, 22 nt, Mycobacterium avium subsp. paratuberculosis
cgcgaucaccaccccggugccg

SEQ ID NO: 2935921 - RNA, 15 nt, Mycobacterium avium subsp. paratuberculosis
cgcgaucaccgcggc

SEQ ID NO: 2935922 - RNA, 17 nt, Mycobacterium avium subsp. paratuberculosis
cgcgaucaccgcggcca

SEQ ID NO: 2935923 - RNA, 22 nt, Mycobacterium avium subsp. paratuberculosis
cgcgaucaccgcggccaccacc

SEQ ID NO: 2935924 - RNA, 21 nt, Mycobacterium avium subsp. paratuberculosis
cgcgaucagccccagggugcg

SEQ ID NO: 2935925 - RNA, 13 nt, Mycobacterium avium subsp. paratuberculosis
cgcgaucagcgcc

SEQ ID NO: 2935926 - RNA, 14 nt, Mycobacterium avium subsp. paratuberculosis
cgcgaucagcgccg

SEQ ID NO: 2935927 - RNA, 16 nt, Mycobacterium avium subsp. paratuberculosis
cgcgaucagcgccguc

SEQ ID NO: 2935928 - RNA, 17 nt, Mycobacterium avium subsp. paratuberculosis
cgcgaucagcgccgucu

SEQ ID NO: 2935929 - RNA, 13 nt, Mycobacterium avium subsp. paratuberculosis
cgcgaucagcucg

SEQ ID NO: 2935930 - RNA, 19 nt, Mycobacterium avium subsp. paratuberculosis
cgcgaucagcucguggcgg

SEQ ID NO: 2935931 - RNA, 21 nt, Mycobacterium avium subsp. paratuberculosis
cgcgaucaggccggccaccag

SEQ ID NO: 2935932 - RNA, 23 nt, Mycobacterium avium subsp. paratuberculosis
cgcgaucaggccggccaccaggu

SEQ ID NO: 2935933 - RNA, 13 nt, Mycobacterium avium subsp. paratuberculosis
cgcgaucaggcug

SEQ ID NO: 2935934 - RNA, 17 nt, Mycobacterium avium subsp. paratuberculosis
cgcgaucaggcugccgc

SEQ ID NO: 2935935 - RNA, 18 nt, Mycobacterium avium subsp. paratuberculosis
cgcgaucaggcugccgcu

SEQ ID NO: 2935936 - RNA, 19 nt, Mycobacterium avium subsp. paratuberculosis
cgcgaucaggcugccgcug

SEQ ID NO: 2935937 - RNA, 23 nt, Mycobacterium avium subsp. paratuberculosis
cgcgaucagggcccacagcagcc

SEQ ID NO: 2935938 - RNA, 17 nt, Mycobacterium avium subsp. paratuberculosis
cgcgaucagggccgcgg

SEQ ID NO: 2935939 - RNA, 18 nt, Mycobacterium avium subsp. paratuberculosis
cgcgaucagggccgcggc

SEQ ID NO: 2935940 - RNA, 23 nt, Mycobacterium avium subsp. paratuberculosis
cgcgaucagggccgcggccgccg

SEQ ID NO: 2935941 - RNA, 17 nt, Mycobacterium avium subsp. paratuberculosis
cgcgaucagguccggaa

SEQ ID NO: 2935942 - RNA, 14 nt, Mycobacterium avium subsp. paratuberculosis
cgcgauccacuccg

SEQ ID NO: 2935943 - RNA, 22 nt, Mycobacterium avium subsp. paratuberculosis
cgcgauccacuccgaggucagc

SEQ ID NO: 2935944 - RNA, 15 nt, Mycobacterium avium subsp. paratuberculosis
cgcgauccagcgcug

SEQ ID NO: 2935945 - RNA, 23 nt, Mycobacterium avium subsp. paratuberculosis
cgcgauccagcgcuggccggcca

SEQ ID NO: 2935946 - RNA, 21 nt, Mycobacterium avium subsp. paratuberculosis
cgcgauccagguguaccagug

SEQ ID NO: 2935947 - RNA, 13 nt, Mycobacterium avium subsp. paratuberculosis
cgcgauccgcgcg

SEQ ID NO: 2935948 - RNA, 17 nt, Mycobacterium avium subsp. paratuberculosis
cgcgauccgcgcgucgg

SEQ ID NO: 2935949 - RNA, 18 nt, Mycobacterium avium subsp. paratuberculosis
cgcgauccgcgcgucggg

SEQ ID NO: 2935950 - RNA, 23 nt, Mycobacterium avium subsp. paratuberculosis
cgcgauccgggcauggucaccgg

SEQ ID NO: 2935951 - RNA, 14 nt, Mycobacterium avium subsp. paratuberculosis
cgcgauccgggcgc

SEQ ID NO: 2935952 - RNA, 15 nt, Mycobacterium avium subsp. paratuberculosis
cgcgauccgggcgcc

SEQ ID NO: 2935953 - RNA, 17 nt, Mycobacterium avium subsp. paratuberculosis
cgcgauccgggcgccgg

SEQ ID NO: 2935954 - RNA, 22 nt, Mycobacterium avium subsp. paratuberculosis
cgcgauccgggcgccggccggc

SEQ ID NO: 2935955 - RNA, 15 nt, Mycobacterium avium subsp. paratuberculosis
cgcgauccggggggc

SEQ ID NO: 2935956 - RNA, 16 nt, Mycobacterium avium subsp. paratuberculosis
cgcgauccggggggcg

SEQ ID NO: 2935957 - RNA, 16 nt, Mycobacterium avium subsp. paratuberculosis
cgcgaucgacagcucc

SEQ ID NO: 2935958 - RNA, 17 nt, Mycobacterium avium subsp. paratuberculosis
cgcgaucgacagcucca

SEQ ID NO: 2935959 - RNA, 21 nt, Mycobacterium avium subsp. paratuberculosis
cgcgaucgaggaucucccggg

SEQ ID NO: 2935960 - RNA, 19 nt, Mycobacterium avium subsp. paratuberculosis
cgcgaucgaguaguccggg

SEQ ID NO: 2935961 - RNA, 16 nt, Mycobacterium avium subsp. paratuberculosis
cgcgcaacagcgucuc

SEQ ID NO: 2935962 - RNA, 14 nt, Mycobacterium avium subsp. paratuberculosis
cgcgcaaccgggcc

SEQ ID NO: 2935963 - RNA, 16 nt, Mycobacterium avium subsp. paratuberculosis
cgcgcaaccgggccgc

SEQ ID NO: 2935964 - RNA, 19 nt, Mycobacterium avium subsp. paratuberculosis
cgcgcaacgaggcgguggu

SEQ ID NO: 2935965 - RNA, 18 nt, Mycobacterium avium subsp. paratuberculosis
cgcgcaacucguccacca

SEQ ID NO: 2935966 - RNA, 20 nt, Mycobacterium avium subsp. paratuberculosis
cgcgcaacucguccaccagc

SEQ ID NO: 2935967 - RNA, 21 nt, Mycobacterium avium subsp. paratuberculosis
cgcgcaacuggguggucacac

SEQ ID NO: 2935968 - RNA, 24 nt, Mycobacterium avium subsp. paratuberculosis
cgcgcaacuggguggucacaccgc

SEQ ID NO: 2935969 - RNA, 21 nt, Mycobacterium avium subsp. paratuberculosis
cgcgcaauaacggagcggccu

SEQ ID NO: 2935970 - RNA, 19 nt, Mycobacterium avium subsp. paratuberculosis
cgcgcaauacccgaccagc

SEQ ID NO: 2935971 - RNA, 22 nt, Mycobacterium avium subsp. paratuberculosis
cgcgcaauacccgaccagcacc

SEQ ID NO: 2935972 - RNA, 15 nt, Mycobacterium avium subsp. paratuberculosis
cgcgcaauccugccc

SEQ ID NO: 2935973 - RNA, 18 nt, Mycobacterium avium subsp. paratuberculosis
cgcgcaauccugcccggu

SEQ ID NO: 2935974 - RNA, 16 nt, Mycobacterium avium subsp. paratuberculosis
cgcgcaaugccaucgu

SEQ ID NO: 2935975 - RNA, 18 nt, Mycobacterium avium subsp. paratuberculosis
cgcgcaaugccaucguca

SEQ ID NO: 2935976 - RNA, 15 nt, Mycobacterium avium subsp. paratuberculosis
cgcgcaaugccgccg

SEQ ID NO: 2935977 - RNA, 16 nt, Mycobacterium avium subsp. paratuberculosis
cgcgcaaugccgccgc

SEQ ID NO: 2935978 - RNA, 18 nt, Mycobacterium avium subsp. paratuberculosis
cgcgcaaugccgccgcga

SEQ ID NO: 2935979 - RNA, 20 nt, Mycobacterium avium subsp. paratuberculosis
cgcgcaaugccgccgcgacg

SEQ ID NO: 2935980 - RNA, 14 nt, Mycobacterium avium subsp. paratuberculosis
cgcgcacacggccu

SEQ ID NO: 2935981 - RNA, 13 nt, Mycobacterium avium subsp. paratuberculosis
cgcgcacagcgcc

SEQ ID NO: 2935982 - RNA, 17 nt, Mycobacterium avium subsp. paratuberculosis
cgcgcacagcgccacac

SEQ ID NO: 2935983 - RNA, 24 nt, Mycobacterium avium subsp. paratuberculosis
cgcgcacaucacgguggccgccac

SEQ ID NO: 2935984 - RNA, 11 nt, Mycobacterium avium subsp. paratuberculosis
cgcgcaccacc

SEQ ID NO: 2935985 - RNA, 13 nt, Mycobacterium avium subsp. paratuberculosis
cgcgcaccaccuc

SEQ ID NO: 2935986 - RNA, 15 nt, Mycobacterium avium subsp. paratuberculosis
cgcgcaccaccucga

SEQ ID NO: 2935987 - RNA, 21 nt, Mycobacterium avium subsp. paratuberculosis
cgcgcaccaccucggcgaucu

SEQ ID NO: 2935988 - RNA, 15 nt, Mycobacterium avium subsp. paratuberculosis
cgcgcaccagcucga

SEQ ID NO: 2935989 - RNA, 21 nt, Mycobacterium avium subsp. paratuberculosis
cgcgcaccagcucgaggccgc

SEQ ID NO: 2935990 - RNA, 17 nt, Mycobacterium avium subsp. paratuberculosis
cgcgcaccagcucggcg

SEQ ID NO: 2935991 - RNA, 14 nt, Mycobacterium avium subsp. paratuberculosis
cgcgcaccaggccg

SEQ ID NO: 2935992 - RNA, 21 nt, Mycobacterium avium subsp. paratuberculosis
cgcgcaccaggccgacgcugg

SEQ ID NO: 2935993 - RNA, 14 nt, Mycobacterium avium subsp. paratuberculosis
cgcgcaccagggcc

SEQ ID NO: 2935994 - RNA, 18 nt, Mycobacterium avium subsp. paratuberculosis
cgcgcaccagggccgcga

SEQ ID NO: 2935995 - RNA, 17 nt, Mycobacterium avium subsp. paratuberculosis
cgcgcaccagggccugc

SEQ ID NO: 2935996 - RNA, 23 nt, Mycobacterium avium subsp. paratuberculosis
cgcgcaccagggccugcagcacc

SEQ ID NO: 2935997 - RNA, 13 nt, Mycobacterium avium subsp. paratuberculosis
cgcgcaccauccg

SEQ ID NO: 2935998 - RNA, 14 nt, Mycobacterium avium subsp. paratuberculosis
cgcgcaccauccgc

SEQ ID NO: 2935999 - RNA, 17 nt, Mycobacterium avium subsp. paratuberculosis
cgcgcaccaucgcgaug

SEQ ID NO: 2936000 - RNA, 15 nt, Mycobacterium avium subsp. paratuberculosis
cgcgcacccagacgu

SEQ ID NO: 2936001 - RNA, 17 nt, Mycobacterium avium subsp. paratuberculosis
cgcgcacccccuucucc

SEQ ID NO: 2936002 - RNA, 20 nt, Mycobacterium avium subsp. paratuberculosis
cgcgcacccccuucuccacg

SEQ ID NO: 2936003 - RNA, 22 nt, Mycobacterium avium subsp. paratuberculosis
cgcgcacccccuucuccacgcu

SEQ ID NO: 2936004 - RNA, 13 nt, Mycobacterium avium subsp. paratuberculosis
cgcgcaccccggc

SEQ ID NO: 2936005 - RNA, 14 nt, Mycobacterium avium subsp. paratuberculosis
cgcgcaccccggca

SEQ ID NO: 2936006 - RNA, 15 nt, Mycobacterium avium subsp. paratuberculosis
cgcgcaccccggcau

SEQ ID NO: 2936007 - RNA, 11 nt, Mycobacterium avium subsp. paratuberculosis
cgcgcacccgc

SEQ ID NO: 2936008 - RNA, 20 nt, Mycobacterium avium subsp. paratuberculosis
cgcgcacccggccacgccgg

SEQ ID NO: 2936009 - RNA, 15 nt, Mycobacterium avium subsp. paratuberculosis
cgcgcacccgggacc

SEQ ID NO: 2936010 - RNA, 19 nt, Mycobacterium avium subsp. paratuberculosis
cgcgcacccguaacacgau

SEQ ID NO: 2936011 - RNA, 22 nt, Mycobacterium avium subsp. paratuberculosis
cgcgcacccguaacacgaucac

SEQ ID NO: 2936012 - RNA, 12 nt, Mycobacterium avium subsp. paratuberculosis
cgcgcaccgcca

SEQ ID NO: 2936013 - RNA, 14 nt, Mycobacterium avium subsp. paratuberculosis
cgcgcaccgccacc

SEQ ID NO: 2936014 - RNA, 17 nt, Mycobacterium avium subsp. paratuberculosis
cgcgcaccgccaccgcc

SEQ ID NO: 2936015 - RNA, 12 nt, Mycobacterium avium subsp. paratuberculosis
cgcgcaccgccc

SEQ ID NO: 2936016 - RNA, 18 nt, Mycobacterium avium subsp. paratuberculosis
cgcgcaccgccccgcccu

SEQ ID NO: 2936017 - RNA, 14 nt, Mycobacterium avium subsp. paratuberculosis
cgcgcaccgcgaaa

SEQ ID NO: 2936018 - RNA, 13 nt, Mycobacterium avium subsp. paratuberculosis
cgcgcaccgcggc

SEQ ID NO: 2936019 - RNA, 16 nt, Mycobacterium avium subsp. paratuberculosis
cgcgcaccgcgggcag

SEQ ID NO: 2936020 - RNA, 17 nt, Mycobacterium avium subsp. paratuberculosis
cgcgcaccgcgggcucg

SEQ ID NO: 2936021 - RNA, 13 nt, Mycobacterium avium subsp. paratuberculosis
cgcgcaccggcgc

SEQ ID NO: 2936022 - RNA, 15 nt, Mycobacterium avium subsp. paratuberculosis
cgcgcaccggcgcug

SEQ ID NO: 2936023 - RNA, 15 nt, Mycobacterium avium subsp. paratuberculosis
cgcgcaccgggacca

SEQ ID NO: 2936024 - RNA, 21 nt, Mycobacterium avium subsp. paratuberculosis
cgcgcaccgggaccagcgcgg

SEQ ID NO: 2936025 - RNA, 15 nt, Mycobacterium avium subsp. paratuberculosis
cgcgcaccgucaucg

SEQ ID NO: 2936026 - RNA, 16 nt, Mycobacterium avium subsp. paratuberculosis
cgcgcaccuggucggu

SEQ ID NO: 2936027 - RNA, 19 nt, Mycobacterium avium subsp. paratuberculosis
cgcgcaccuggucggucag

SEQ ID NO: 2936028 - RNA, 20 nt, Mycobacterium avium subsp. paratuberculosis
cgcgcaccuggucggucagc

SEQ ID NO: 2936029 - RNA, 21 nt, Mycobacterium avium subsp. paratuberculosis
cgcgcaccuucccggccgcca

SEQ ID NO: 2936030 - RNA, 16 nt, Mycobacterium avium subsp. paratuberculosis
cgcgcacgccaucgcc

SEQ ID NO: 2936031 - RNA, 18 nt, Mycobacterium avium subsp. paratuberculosis
cgcgcacgccaucgccuc

SEQ ID NO: 2936032 - RNA, 23 nt, Mycobacterium avium subsp. paratuberculosis
cgcgcacgccaucgccucggcca

SEQ ID NO: 2936033 - RNA, 14 nt, Mycobacterium avium subsp. paratuberculosis
cgcgcacgcucgcg

SEQ ID NO: 2936034 - RNA, 15 nt, Mycobacterium avium subsp. paratuberculosis
cgcgcacgcuggccg

SEQ ID NO: 2936035 - RNA, 16 nt, Mycobacterium avium subsp. paratuberculosis
cgcgcacgcuggccgg

SEQ ID NO: 2936036 - RNA, 17 nt, Mycobacterium avium subsp. paratuberculosis
cgcgcacgcuggccggc

SEQ ID NO: 2936037 - RNA, 20 nt, Mycobacterium avium subsp. paratuberculosis
cgcgcacgcuggccggcagc

SEQ ID NO: 2936038 - RNA, 15 nt, Mycobacterium avium subsp. paratuberculosis
cgcgcacggcagccc

SEQ ID NO: 2936039 - RNA, 17 nt, Mycobacterium avium subsp. paratuberculosis
cgcgcacggcagcccga

SEQ ID NO: 2936040 - RNA, 15 nt, Mycobacterium avium subsp. paratuberculosis
cgcgcacggcgcgca

SEQ ID NO: 2936041 - RNA, 18 nt, Mycobacterium avium subsp. paratuberculosis
cgcgcacgucaccgcgcu

SEQ ID NO: 2936042 - RNA, 14 nt, Mycobacterium avium subsp. paratuberculosis
cgcgcacgucgagg

SEQ ID NO: 2936043 - RNA, 15 nt, Mycobacterium avium subsp. paratuberculosis
cgcgcacguuggcgg

SEQ ID NO: 2936044 - RNA, 18 nt, Mycobacterium avium subsp. paratuberculosis
cgcgcacguuggcggcca

SEQ ID NO: 2936045 - RNA, 20 nt, Mycobacterium avium subsp. paratuberculosis
cgcgcacguuggcggccagc

SEQ ID NO: 2936046 - RNA, 17 nt, Mycobacterium avium subsp. paratuberculosis
cgcgcaggccccggcgc

SEQ ID NO: 2936047 - RNA, 21 nt, Mycobacterium avium subsp. paratuberculosis
cgcgcaggccccggcgcgcgu

SEQ ID NO: 2936048 - RNA, 14 nt, Mycobacterium avium subsp. paratuberculosis
cgcgcaggccgccg

SEQ ID NO: 2936049 - RNA, 16 nt, Mycobacterium avium subsp. paratuberculosis
cgcgcaggccgccgac

SEQ ID NO: 2936050 - RNA, 18 nt, Mycobacterium avium subsp. paratuberculosis
cgcgcaggccguccagca

SEQ ID NO: 2936051 - RNA, 20 nt, Mycobacterium avium subsp. paratuberculosis
cgcgcaggccguccagcagc

SEQ ID NO: 2936052 - RNA, 14 nt, Mycobacterium avium subsp. paratuberculosis
cgcgcaggcgcacc

SEQ ID NO: 2936053 - RNA, 15 nt, Mycobacterium avium subsp. paratuberculosis
cgcgcaggcgcacca

SEQ ID NO: 2936054 - RNA, 19 nt, Mycobacterium avium subsp. paratuberculosis
cgcgcaggcgcaccaccag

SEQ ID NO: 2936055 - RNA, 18 nt, Mycobacterium avium subsp. paratuberculosis
cgcgcaggcgcgcggcca

SEQ ID NO: 2936056 - RNA, 20 nt, Mycobacterium avium subsp. paratuberculosis
cgcgcaggcgcgcggccagc

SEQ ID NO: 2936057 - RNA, 15 nt, Mycobacterium avium subsp. paratuberculosis
cgcgcaggcggcgac

SEQ ID NO: 2936058 - RNA, 16 nt, Mycobacterium avium subsp. paratuberculosis
cgcgcaggcggcgacg

SEQ ID NO: 2936059 - RNA, 17 nt, Mycobacterium avium subsp. paratuberculosis
cgcgcaggcggcgacgg

SEQ ID NO: 2936060 - RNA, 17 nt, Mycobacterium avium subsp. paratuberculosis
cgcgcaggcuggcaucg

SEQ ID NO: 2936061 - RNA, 16 nt, Mycobacterium avium subsp. paratuberculosis
cgcgcagggacgggcg

SEQ ID NO: 2936062 - RNA, 19 nt, Mycobacterium avium subsp. paratuberculosis
cgcgcagggacgggcguga

SEQ ID NO: 2936063 - RNA, 21 nt, Mycobacterium avium subsp. paratuberculosis
cgcgcagggacgggcgugacg

SEQ ID NO: 2936064 - RNA, 16 nt, Mycobacterium avium subsp. paratuberculosis
cgcgcagggccagcgc

SEQ ID NO: 2936065 - RNA, 23 nt, Mycobacterium avium subsp. paratuberculosis
cgcgcagggccagcgccucggcg

SEQ ID NO: 2936066 - RNA, 14 nt, Mycobacterium avium subsp. paratuberculosis
cgcgcagggucagc

SEQ ID NO: 2936067 - RNA, 17 nt, Mycobacterium avium subsp. paratuberculosis
cgcgcagggucagcgcu

SEQ ID NO: 2936068 - RNA, 24 nt, Mycobacterium avium subsp. paratuberculosis
cgcgcagguccguggugaucgccg

SEQ ID NO: 2936069 - RNA, 21 nt, Mycobacterium avium subsp. paratuberculosis
cgcgcaggucgggccggccga

SEQ ID NO: 2936070 - RNA, 22 nt, Mycobacterium avium subsp. paratuberculosis
cgcgcaggugaugcggcccgac

SEQ ID NO: 2936071 - RNA, 23 nt, Mycobacterium avium subsp. paratuberculosis
cgcgcaggugaugcggcccgacc

SEQ ID NO: 2936072 - RNA, 23 nt, Mycobacterium avium subsp. paratuberculosis
cgcgcaguagcgcauaggccgcg

SEQ ID NO: 2936073 - RNA, 15 nt, Mycobacterium avium subsp. paratuberculosis
cgcgcagucggcguc

SEQ ID NO: 2936074 - RNA, 17 nt, Mycobacterium avium subsp. paratuberculosis
cgcgcagucggcgucgc

SEQ ID NO: 2936075 - RNA, 19 nt, Mycobacterium avium subsp. paratuberculosis
cgcgcagucggcgucgcgg

SEQ ID NO: 2936076 - RNA, 15 nt, Mycobacterium avium subsp. paratuberculosis
cgcgcaguugcgcgg

SEQ ID NO: 2936077 - RNA, 18 nt, Mycobacterium avium subsp. paratuberculosis
cgcgcaguugcgcggcgg

SEQ ID NO: 2936078 - RNA, 14 nt, Mycobacterium avium subsp. paratuberculosis
cgcgcaucacccgg

SEQ ID NO: 2936079 - RNA, 17 nt, Mycobacterium avium subsp. paratuberculosis
cgcgcaucacccggcgc

SEQ ID NO: 2936080 - RNA, 20 nt, Mycobacterium avium subsp. paratuberculosis
cgcgcaucacccggcgcgcg

SEQ ID NO: 2936081 - RNA, 22 nt, Mycobacterium avium subsp. paratuberculosis
cgcgcaucacccggcgcgcgga

SEQ ID NO: 2936082 - RNA, 15 nt, Mycobacterium avium subsp. paratuberculosis
cgcgcaucagcaccu

SEQ ID NO: 2936083 - RNA, 23 nt, Mycobacterium avium subsp. paratuberculosis
cgcgcaucagcaccuccggcagc

SEQ ID NO: 2936084 - RNA, 14 nt, Mycobacterium avium subsp. paratuberculosis
cgcgcaucagcgga

SEQ ID NO: 2936085 - RNA, 14 nt, Mycobacterium avium subsp. paratuberculosis
cgcgcaucaggggc

SEQ ID NO: 2936086 - RNA, 14 nt, Mycobacterium avium subsp. paratuberculosis
cgcgcaucaucgcc

SEQ ID NO: 2936087 - RNA, 16 nt, Mycobacterium avium subsp. paratuberculosis
cgcgcaucaucgccca

SEQ ID NO: 2936088 - RNA, 21 nt, Mycobacterium avium subsp. paratuberculosis
cgcgcaucaucgcccagcgca

SEQ ID NO: 2936089 - RNA, 21 nt, Mycobacterium avium subsp. paratuberculosis
cgcgcaucccgucgaccagga

SEQ ID NO: 2936090 - RNA, 14 nt, Mycobacterium avium subsp. paratuberculosis
cgcgcauccgcacc

SEQ ID NO: 2936091 - RNA, 18 nt, Mycobacterium avium subsp. paratuberculosis
cgcgcauccgcaccgaga

SEQ ID NO: 2936092 - RNA, 13 nt, Mycobacterium avium subsp. paratuberculosis
cgcgcaucgccgu

SEQ ID NO: 2936093 - RNA, 15 nt, Mycobacterium avium subsp. paratuberculosis
cgcgcaucgccgucc

SEQ ID NO: 2936094 - RNA, 16 nt, Mycobacterium avium subsp. paratuberculosis
cgcgcaucgccucggc

SEQ ID NO: 2936095 - RNA, 19 nt, Mycobacterium avium subsp. paratuberculosis
cgcgcaucgccucggcggc

SEQ ID NO: 2936096 - RNA, 21 nt, Mycobacterium avium subsp. paratuberculosis
cgcgcaucgccucggcggccg

SEQ ID NO: 2936097 - RNA, 23 nt, Mycobacterium avium subsp. paratuberculosis
cgcgcaucgccucggcggccgcc

SEQ ID NO: 2936098 - RNA, 14 nt, Mycobacterium avium subsp. paratuberculosis
cgcgcaucgcgggc

SEQ ID NO: 2936099 - RNA, 19 nt, Mycobacterium avium subsp. paratuberculosis
cgcgcaucgcgggccaccg

SEQ ID NO: 2936100 - RNA, 24 nt, Mycobacterium avium subsp. paratuberculosis
cgcgcaucgcgggccaccggcgcc

SEQ ID NO: 2936101 - RNA, 20 nt, Mycobacterium avium subsp. paratuberculosis
cgcgcaucggucagcaacag

SEQ ID NO: 2936102 - RNA, 17 nt, Mycobacterium avium subsp. paratuberculosis
cgcgcaucgucgcggcg

SEQ ID NO: 2936103 - RNA, 19 nt, Mycobacterium avium subsp. paratuberculosis
cgcgcaucgucgcggcgcu

SEQ ID NO: 2936104 - RNA, 22 nt, Mycobacterium avium subsp. paratuberculosis
cgcgcaucucgaaugcggcugc

SEQ ID NO: 2936105 - RNA, 12 nt, Mycobacterium avium subsp. paratuberculosis
cgcgcaucugcu

SEQ ID NO: 2936106 - RNA, 17 nt, Mycobacterium avium subsp. paratuberculosis
cgcgcaucugcucggcg

SEQ ID NO: 2936107 - RNA, 16 nt, Mycobacterium avium subsp. paratuberculosis
cgcgcaugcccuggac

SEQ ID NO: 2936108 - RNA, 23 nt, Mycobacterium avium subsp. paratuberculosis
cgcgcauguuggugaucagcccc

SEQ ID NO: 2936109 - RNA, 20 nt, Mycobacterium avium subsp. paratuberculosis
cgcgcauuguugaggauguc

SEQ ID NO: 2936110 - RNA, 16 nt, Mycobacterium avium subsp. paratuberculosis
cgcgccacagcgucuc

SEQ ID NO: 2936111 - RNA, 20 nt, Mycobacterium avium subsp. paratuberculosis
cgcgccacagcgucucgacc

SEQ ID NO: 2936112 - RNA, 19 nt, Mycobacterium avium subsp. paratuberculosis
cgcgccaccccgagcucgg

SEQ ID NO: 2936113 - RNA, 21 nt, Mycobacterium avium subsp. paratuberculosis
cgcgccaccgaggccagcaga

SEQ ID NO: 2936114 - RNA, 19 nt, Mycobacterium avium subsp. paratuberculosis
cgcgccacgacauccccgc

SEQ ID NO: 2936115 - RNA, 22 nt, Mycobacterium avium subsp. paratuberculosis
cgcgccacgccccggcgccguc

SEQ ID NO: 2936116 - RNA, 23 nt, Mycobacterium avium subsp. paratuberculosis
cgcgccacgccccggcgccgucg

SEQ ID NO: 2936117 - RNA, 16 nt, Mycobacterium avium subsp. paratuberculosis
cgcgccacgccgcccc

SEQ ID NO: 2936118 - RNA, 15 nt, Mycobacterium avium subsp. paratuberculosis
cgcgccacgcgcagg

SEQ ID NO: 2936119 - RNA, 19 nt, Mycobacterium avium subsp. paratuberculosis
cgcgccacgcgcagggcga

SEQ ID NO: 2936120 - RNA, 18 nt, Mycobacterium avium subsp. paratuberculosis
cgcgccacguaucgcgcc

SEQ ID NO: 2936121 - RNA, 12 nt, Mycobacterium avium subsp. paratuberculosis
cgcgccagacgu

SEQ ID NO: 2936122 - RNA, 19 nt, Mycobacterium avium subsp. paratuberculosis
cgcgccagacguccagcgc

SEQ ID NO: 2936123 - RNA, 20 nt, Mycobacterium avium subsp. paratuberculosis
cgcgccagacguccagcgcc

SEQ ID NO: 2936124 - RNA, 23 nt, Mycobacterium avium subsp. paratuberculosis
cgcgccagacguccagcgccgcc

SEQ ID NO: 2936125 - RNA, 13 nt, Mycobacterium avium subsp. paratuberculosis
cgcgccagcaccu

SEQ ID NO: 2936126 - RNA, 22 nt, Mycobacterium avium subsp. paratuberculosis
cgcgccagcaccucggcgacca

SEQ ID NO: 2936127 - RNA, 13 nt, Mycobacterium avium subsp. paratuberculosis
cgcgccagcagcg

SEQ ID NO: 2936128 - RNA, 14 nt, Mycobacterium avium subsp. paratuberculosis
cgcgccagcagcgc

SEQ ID NO: 2936129 - RNA, 14 nt, Mycobacterium avium subsp. paratuberculosis
cgcgccagccgccg

SEQ ID NO: 2936130 - RNA, 23 nt, Mycobacterium avium subsp. paratuberculosis
cgcgcccucgauaauggcggccg

SEQ ID NO: 2936131 - RNA, 13 nt, Mycobacterium avium subsp. paratuberculosis
cgcgcccugcugg

SEQ ID NO: 2936132 - RNA, 17 nt, Mycobacterium avium subsp. paratuberculosis
cgcgcccugcugggagc

SEQ ID NO: 2936133 - RNA, 20 nt, Mycobacterium avium subsp. paratuberculosis
cgcgcccuggugcaacaccg

SEQ ID NO: 2936134 - RNA, 21 nt, Mycobacterium avium subsp. paratuberculosis
cgcgcccuucuucgcgggugc

SEQ ID NO: 2936135 - RNA, 15 nt, Mycobacterium avium subsp. paratuberculosis
cgcgccgaacaacgg

SEQ ID NO: 2936136 - RNA, 21 nt, Mycobacterium avium subsp. paratuberculosis
cgcgccgaacaacggcggacc

SEQ ID NO: 2936137 - RNA, 22 nt, Mycobacterium avium subsp. paratuberculosis
cgcgccgaacaacggcggaccg

SEQ ID NO: 2936138 - RNA, 18 nt, Mycobacterium avium subsp. paratuberculosis
cgcgccgaacaccacgcc

SEQ ID NO: 2936139 - RNA, 20 nt, Mycobacterium avium subsp. paratuberculosis
cgcgccgaacaccugcggcg

SEQ ID NO: 2936140 - RNA, 22 nt, Mycobacterium avium subsp. paratuberculosis
cgcgccgaacaccugcggcggc

SEQ ID NO: 2936141 - RNA, 24 nt, Mycobacterium avium subsp. paratuberculosis
cgcgccgaacaccugcggcggcag

SEQ ID NO: 2936142 - RNA, 13 nt, Mycobacterium avium subsp. paratuberculosis
cgcgccgaacgca

SEQ ID NO: 2936143 - RNA, 19 nt, Mycobacterium avium subsp. paratuberculosis
cgcgccgaacgcaccaccg

SEQ ID NO: 2936144 - RNA, 20 nt, Mycobacterium avium subsp. paratuberculosis
cgcgccgaagauggccagcg

SEQ ID NO: 2936145 - RNA, 12 nt, Mycobacterium avium subsp. paratuberculosis
cgcgccgacaga

SEQ ID NO: 2936146 - RNA, 14 nt, Mycobacterium avium subsp. paratuberculosis
cgcgccgacagaug

SEQ ID NO: 2936147 - RNA, 11 nt, Mycobacterium avium subsp. paratuberculosis
cgcgccgacca

SEQ ID NO: 2936148 - RNA, 19 nt, Mycobacterium avium subsp. paratuberculosis
cgcgccgaccacggcccca

SEQ ID NO: 2936149 - RNA, 21 nt, Mycobacterium avium subsp. paratuberculosis
cgcgccgaccacggccccagc

SEQ ID NO: 2936150 - RNA, 13 nt, Mycobacterium avium subsp. paratuberculosis
cgcgccgaccagc

SEQ ID NO: 2936151 - RNA, 13 nt, Mycobacterium avium subsp. paratuberculosis
cgcgccgacccgc

SEQ ID NO: 2936152 - RNA, 15 nt, Mycobacterium avium subsp. paratuberculosis
cgcgccgacccgccc

SEQ ID NO: 2936153 - RNA, 20 nt, Mycobacterium avium subsp. paratuberculosis
cgcgccgacccgcccgccgg

SEQ ID NO: 2936154 - RNA, 22 nt, Mycobacterium avium subsp. paratuberculosis
cgcgccgacccgcccgccgggc

SEQ ID NO: 2936155 - RNA, 20 nt, Mycobacterium avium subsp. paratuberculosis
cgcgccgaccgcgagcacga

SEQ ID NO: 2936156 - RNA, 19 nt, Mycobacterium avium subsp. paratuberculosis
cgcgccgaccucgucggcg

SEQ ID NO: 2936157 - RNA, 23 nt, Mycobacterium avium subsp. paratuberculosis
cgcgccgaccucgucggcggugc

SEQ ID NO: 2936158 - RNA, 20 nt, Mycobacterium avium subsp. paratuberculosis
cgcgccgaccuggucgccga

SEQ ID NO: 2936159 - RNA, 13 nt, Mycobacterium avium subsp. paratuberculosis
cgcgccgacgacc

SEQ ID NO: 2936160 - RNA, 14 nt, Mycobacterium avium subsp. paratuberculosis
cgcgccgacgccca

SEQ ID NO: 2936161 - RNA, 19 nt, Mycobacterium avium subsp. paratuberculosis
cgcgccgacgcccacagcg

SEQ ID NO: 2936162 - RNA, 21 nt, Mycobacterium avium subsp. paratuberculosis
cgcgccgacgcccacagcgcc

SEQ ID NO: 2936163 - RNA, 22 nt, Mycobacterium avium subsp. paratuberculosis
cgcgccgacgcccacagcgcca

SEQ ID NO: 2936164 - RNA, 16 nt, Mycobacterium avium subsp. paratuberculosis
cgcgccgacggccgcg

SEQ ID NO: 2936165 - RNA, 17 nt, Mycobacterium avium subsp. paratuberculosis
cgcgccgacggccgcgc

SEQ ID NO: 2936166 - RNA, 19 nt, Mycobacterium avium subsp. paratuberculosis
cgcgccgagagcgcgucga

SEQ ID NO: 2936167 - RNA, 20 nt, Mycobacterium avium subsp. paratuberculosis
cgcgccgagauuggacgaca

SEQ ID NO: 2936168 - RNA, 13 nt, Mycobacterium avium subsp. paratuberculosis
cgcgccgagcagc

SEQ ID NO: 2936169 - RNA, 16 nt, Mycobacterium avium subsp. paratuberculosis
cgcgccgagcagcugg

SEQ ID NO: 2936170 - RNA, 13 nt, Mycobacterium avium subsp. paratuberculosis
cgcgccgaggaac

SEQ ID NO: 2936171 - RNA, 16 nt, Mycobacterium avium subsp. paratuberculosis
cgcgccgaggaacugc

SEQ ID NO: 2936172 - RNA, 22 nt, Mycobacterium avium subsp. paratuberculosis
cgcgccgaggcgcucggcccgc

SEQ ID NO: 2936173 - RNA, 20 nt, Mycobacterium avium subsp. paratuberculosis
cgcgccgagguggcccgcca

SEQ ID NO: 2936174 - RNA, 21 nt, Mycobacterium avium subsp. paratuberculosis
cgcgccgagguggcccgccac

SEQ ID NO: 2936175 - RNA, 20 nt, Mycobacterium avium subsp. paratuberculosis
cgcgccgagguggccgccag

SEQ ID NO: 2936176 - RNA, 21 nt, Mycobacterium avium subsp. paratuberculosis
cgcgccgagguggccgccagc

SEQ ID NO: 2936177 - RNA, 12 nt, Mycobacterium avium subsp. paratuberculosis
cgcgccgaucac

SEQ ID NO: 2936178 - RNA, 14 nt, Mycobacterium avium subsp. paratuberculosis
cgcgccgaucacga

SEQ ID NO: 2936179 - RNA, 20 nt, Mycobacterium avium subsp. paratuberculosis
cgcgccgauccggcuccaca

SEQ ID NO: 2936180 - RNA, 16 nt, Mycobacterium avium subsp. paratuberculosis
cgcgccgaucgagacg

SEQ ID NO: 2936181 - RNA, 20 nt, Mycobacterium avium subsp. paratuberculosis
cgcgccgaucgagacgaugc

SEQ ID NO: 2936182 - RNA, 15 nt, Mycobacterium avium subsp. paratuberculosis
cgcgccgaucgccca

SEQ ID NO: 2936183 - RNA, 18 nt, Mycobacterium avium subsp. paratuberculosis
cgcgccgaucugaccgag

SEQ ID NO: 2936184 - RNA, 21 nt, Mycobacterium avium subsp. paratuberculosis
cgcgccgaucugaccgagcag

SEQ ID NO: 2936185 - RNA, 21 nt, Mycobacterium avium subsp. paratuberculosis
cgcgccgaugcauuggugcac

SEQ ID NO: 2936186 - RNA, 23 nt, Mycobacterium avium subsp. paratuberculosis
cgcgccgaugcauuggugcacgc

SEQ ID NO: 2936187 - RNA, 13 nt, Mycobacterium avium subsp. paratuberculosis
cgcgccgaugccg

SEQ ID NO: 2936188 - RNA, 20 nt, Mycobacterium avium subsp. paratuberculosis
cgcgccgaugccgaacguca

SEQ ID NO: 2936189 - RNA, 17 nt, Mycobacterium avium subsp. paratuberculosis
cgcgccgaugccgcgcu

SEQ ID NO: 2936190 - RNA, 19 nt, Mycobacterium avium subsp. paratuberculosis
cgcgccgaugccgcgcugc

SEQ ID NO: 2936191 - RNA, 19 nt, Mycobacterium avium subsp. paratuberculosis
cgcgccgauguggccggcg

SEQ ID NO: 2936192 - RNA, 20 nt, Mycobacterium avium subsp. paratuberculosis
cgcgccgauguggccggcga

SEQ ID NO: 2936193 - RNA, 22 nt, Mycobacterium avium subsp. paratuberculosis
cgcgccgauguggccggcgaug

SEQ ID NO: 2936194 - RNA, 19 nt, Mycobacterium avium subsp. paratuberculosis
cgcgccgcaaccgucaguu

SEQ ID NO: 2936195 - RNA, 13 nt, Mycobacterium avium subsp. paratuberculosis
cgcgccgcacagc

SEQ ID NO: 2936196 - RNA, 22 nt, Mycobacterium avium subsp. paratuberculosis
cgcgccgcacagccggcggcgg

SEQ ID NO: 2936197 - RNA, 23 nt, Mycobacterium avium subsp. paratuberculosis
cgcgccgcacagccggcggcggc

SEQ ID NO: 2936198 - RNA, 14 nt, Mycobacterium avium subsp. paratuberculosis
cgcgccgcacugca

SEQ ID NO: 2936199 - RNA, 22 nt, Mycobacterium avium subsp. paratuberculosis
cgcgccgcaggagaucggcgcg

SEQ ID NO: 2936200 - RNA, 12 nt, Mycobacterium avium subsp. paratuberculosis
cgcgccgcauga

SEQ ID NO: 2936201 - RNA, 13 nt, Mycobacterium avium subsp. paratuberculosis
cgcgccgcaugau

SEQ ID NO: 2936202 - RNA, 22 nt, Mycobacterium avium subsp. paratuberculosis
cgcgccgcaugaugcggccaug

SEQ ID NO: 2936203 - RNA, 21 nt, Mycobacterium avium subsp. paratuberculosis
cgcgccgcauuggcaccgucg

SEQ ID NO: 2936204 - RNA, 20 nt, Mycobacterium avium subsp. paratuberculosis
cgcgccgccacaccucggcg

SEQ ID NO: 2936205 - RNA, 13 nt, Mycobacterium avium subsp. paratuberculosis
cgcgccgccacgc

SEQ ID NO: 2936206 - RNA, 17 nt, Mycobacterium avium subsp. paratuberculosis
cgcgccgccacgcggcg

SEQ ID NO: 2936207 - RNA, 18 nt, Mycobacterium avium subsp. paratuberculosis
cgcgccgccacgcggcgc

SEQ ID NO: 2936208 - RNA, 12 nt, Mycobacterium avium subsp. paratuberculosis
cgcgccgccagc

SEQ ID NO: 2936209 - RNA, 13 nt, Mycobacterium avium subsp. paratuberculosis
cgcgccgcccagc

SEQ ID NO: 2936210 - RNA, 16 nt, Mycobacterium avium subsp. paratuberculosis
cgcgccgcccagcggc

SEQ ID NO: 2936211 - RNA, 17 nt, Mycobacterium avium subsp. paratuberculosis
cgcgccgcccagcggcc

SEQ ID NO: 2936212 - RNA, 14 nt, Mycobacterium avium subsp. paratuberculosis
cgcgccgcccccgc

SEQ ID NO: 2936213 - RNA, 14 nt, Mycobacterium avium subsp. paratuberculosis
cgcgccgcccggag

SEQ ID NO: 2936214 - RNA, 23 nt, Mycobacterium avium subsp. paratuberculosis
cgcgccgggcaacagcgcgccgg

SEQ ID NO: 2936215 - RNA, 12 nt, Mycobacterium avium subsp. paratuberculosis
cgcgccgggcac

SEQ ID NO: 2936216 - RNA, 15 nt, Mycobacterium avium subsp. paratuberculosis
cgcgccgggcaccac

SEQ ID NO: 2936217 - RNA, 16 nt, Mycobacterium avium subsp. paratuberculosis
cgcgccgggcaccacc

SEQ ID NO: 2936218 - RNA, 17 nt, Mycobacterium avium subsp. paratuberculosis
cgcgccgggcaccacca

SEQ ID NO: 2936219 - RNA, 19 nt, Mycobacterium avium subsp. paratuberculosis
cgcgccgggcaccaccacc

SEQ ID NO: 2936220 - RNA, 23 nt, Mycobacterium avium subsp. paratuberculosis
cgcgccgggcaccaccaccgaca

SEQ ID NO: 2936221 - RNA, 13 nt, Mycobacterium avium subsp. paratuberculosis
cgcgccgggcagc

SEQ ID NO: 2936222 - RNA, 15 nt, Mycobacterium avium subsp. paratuberculosis
cgcgccgggcagccc

SEQ ID NO: 2936223 - RNA, 19 nt, Mycobacterium avium subsp. paratuberculosis
cgcgccgggcagcccgccg

SEQ ID NO: 2936224 - RNA, 21 nt, Mycobacterium avium subsp. paratuberculosis
cgcgccgggcagcccgccgcg

SEQ ID NO: 2936225 - RNA, 22 nt, Mycobacterium avium subsp. paratuberculosis
cgcgccgggcagcccgccgcgg

SEQ ID NO: 2936226 - RNA, 21 nt, Mycobacterium avium subsp. paratuberculosis
cgcgccgggcgaagucgccgg

SEQ ID NO: 2936227 - RNA, 24 nt, Mycobacterium avium subsp. paratuberculosis
cgcgccgggcgaagucgccggcca

SEQ ID NO: 2936228 - RNA, 21 nt, Mycobacterium avium subsp. paratuberculosis
cgcgccgggcgcccgagccgc

SEQ ID NO: 2936229 - RNA, 13 nt, Mycobacterium avium subsp. paratuberculosis
cgcgccgggcgga

SEQ ID NO: 2936230 - RNA, 21 nt, Mycobacterium avium subsp. paratuberculosis
cgcgccgggcggccucggcgu

SEQ ID NO: 2936231 - RNA, 22 nt, Mycobacterium avium subsp. paratuberculosis
cgcgccgggcguugcccgccgc

SEQ ID NO: 2936232 - RNA, 13 nt, Mycobacterium avium subsp. paratuberculosis
cgcgccggggucc

SEQ ID NO: 2936233 - RNA, 17 nt, Mycobacterium avium subsp. paratuberculosis
cgcgccgggguccucuc

SEQ ID NO: 2936234 - RNA, 22 nt, Mycobacterium avium subsp. paratuberculosis
cgcgccgggguccucucggcgc

SEQ ID NO: 2936235 - RNA, 12 nt, Mycobacterium avium subsp. paratuberculosis
cgcgccggggug

SEQ ID NO: 2936236 - RNA, 23 nt, Mycobacterium avium subsp. paratuberculosis
cgcgccggggugggccaucggca

SEQ ID NO: 2936237 - RNA, 16 nt, Mycobacterium avium subsp. paratuberculosis
cgcgccggggugucca

SEQ ID NO: 2936238 - RNA, 22 nt, Mycobacterium avium subsp. paratuberculosis
cgcgccgguaaugggcgaucga

SEQ ID NO: 2936239 - RNA, 23 nt, Mycobacterium avium subsp. paratuberculosis
cgcgccgguaaugggcgaucgau

SEQ ID NO: 2936240 - RNA, 18 nt, Mycobacterium avium subsp. paratuberculosis
cgcgccgguaggcggcca

SEQ ID NO: 2936241 - RNA, 23 nt, Mycobacterium avium subsp. paratuberculosis
cgcgccgguaggcggccagcgcc

SEQ ID NO: 2936242 - RNA, 15 nt, Mycobacterium avium subsp. paratuberculosis
cgcgccggucccgcg

SEQ ID NO: 2936243 - RNA, 16 nt, Mycobacterium avium subsp. paratuberculosis
cgcgccggucccgcgg

SEQ ID NO: 2936244 - RNA, 19 nt, Mycobacterium avium subsp. paratuberculosis
cgcgccggucccgcggcgg

SEQ ID NO: 2936245 - RNA, 24 nt, Mycobacterium avium subsp. paratuberculosis
cgcgccggucccgcggcggcgcca

SEQ ID NO: 2936246 - RNA, 15 nt, Mycobacterium avium subsp. paratuberculosis
cgcgccgguccggcc

SEQ ID NO: 2936247 - RNA, 16 nt, Mycobacterium avium subsp. paratuberculosis
cgcgccgguccggccc

SEQ ID NO: 2936248 - RNA, 16 nt, Mycobacterium avium subsp. paratuberculosis
cgcgccggugaccccg

SEQ ID NO: 2936249 - RNA, 15 nt, Mycobacterium avium subsp. paratuberculosis
cgcgccguagcggcc

SEQ ID NO: 2936250 - RNA, 16 nt, Mycobacterium avium subsp. paratuberculosis
cgcgccguagcggccc

SEQ ID NO: 2936251 - RNA, 17 nt, Mycobacterium avium subsp. paratuberculosis
cgcgccguagcggccca

SEQ ID NO: 2936252 - RNA, 18 nt, Mycobacterium avium subsp. paratuberculosis
cgcgccguagcggcccag

SEQ ID NO: 2936253 - RNA, 20 nt, Mycobacterium avium subsp. paratuberculosis
cgcgccguagcggcccaggu

SEQ ID NO: 2936254 - RNA, 14 nt, Mycobacterium avium subsp. paratuberculosis
cgcgccguagcggu

SEQ ID NO: 2936255 - RNA, 21 nt, Mycobacterium avium subsp. paratuberculosis
cgcgccgucggacuccuccug

SEQ ID NO: 2936256 - RNA, 15 nt, Mycobacterium avium subsp. paratuberculosis
cgcgccgucggccca

SEQ ID NO: 2936257 - RNA, 16 nt, Mycobacterium avium subsp. paratuberculosis
cgcgccgucggcgaug

SEQ ID NO: 2936258 - RNA, 14 nt, Mycobacterium avium subsp. paratuberculosis
cgcgccgucggcgu

SEQ ID NO: 2936259 - RNA, 22 nt, Mycobacterium avium subsp. paratuberculosis
cgcgccgucggcguucagcggc

SEQ ID NO: 2936260 - RNA, 15 nt, Mycobacterium avium subsp. paratuberculosis
cgcgccgucgucgag

SEQ ID NO: 2936261 - RNA, 19 nt, Mycobacterium avium subsp. paratuberculosis
cgcgccgucgucgagcacc

SEQ ID NO: 2936262 - RNA, 21 nt, Mycobacterium avium subsp. paratuberculosis
cgcgccgucgucgagcaccac

SEQ ID NO: 2936263 - RNA, 14 nt, Mycobacterium avium subsp. paratuberculosis
cgcgccgucgucgg

SEQ ID NO: 2936264 - RNA, 16 nt, Mycobacterium avium subsp. paratuberculosis
cgcgccgucgucggac

SEQ ID NO: 2936265 - RNA, 14 nt, Mycobacterium avium subsp. paratuberculosis
cgcgccgucgucgu

SEQ ID NO: 2936266 - RNA, 21 nt, Mycobacterium avium subsp. paratuberculosis
cgcgccgucgucgucgcucca

SEQ ID NO: 2936267 - RNA, 15 nt, Mycobacterium avium subsp. paratuberculosis
cgcgccgucuccggc

SEQ ID NO: 2936268 - RNA, 18 nt, Mycobacterium avium subsp. paratuberculosis
cgcgccgucuccggcgua

SEQ ID NO: 2936269 - RNA, 17 nt, Mycobacterium avium subsp. paratuberculosis
cgcgccgucuuccgggc

SEQ ID NO: 2936270 - RNA, 19 nt, Mycobacterium avium subsp. paratuberculosis
cgcgccgucuuccgggcca

SEQ ID NO: 2936271 - RNA, 22 nt, Mycobacterium avium subsp. paratuberculosis
cgcgccgugaacugugcggugc

SEQ ID NO: 2936272 - RNA, 15 nt, Mycobacterium avium subsp. paratuberculosis
cgcgccgugacgccg

SEQ ID NO: 2936273 - RNA, 16 nt, Mycobacterium avium subsp. paratuberculosis
cgcgccgugacgccga

SEQ ID NO: 2936274 - RNA, 16 nt, Mycobacterium avium subsp. paratuberculosis
cgcgccgugcgccagc

SEQ ID NO: 2936275 - RNA, 18 nt, Mycobacterium avium subsp. paratuberculosis
cgcgccgugcgccagcga

SEQ ID NO: 2936276 - RNA, 14 nt, Mycobacterium avium subsp. paratuberculosis
cgcgccguggccca

SEQ ID NO: 2936277 - RNA, 12 nt, Mycobacterium avium subsp. paratuberculosis
cgcgccgugggc

SEQ ID NO: 2936278 - RNA, 14 nt, Mycobacterium avium subsp. paratuberculosis
cgcgccguugaccg

SEQ ID NO: 2936279 - RNA, 20 nt, Mycobacterium avium subsp. paratuberculosis
cgcgccguugaccgcggcga

SEQ ID NO: 2936280 - RNA, 21 nt, Mycobacterium avium subsp. paratuberculosis
cgcgccguugaccgcggcgau

SEQ ID NO: 2936281 - RNA, 21 nt, Mycobacterium avium subsp. paratuberculosis
cgcgccguugguggucugcca

SEQ ID NO: 2936282 - RNA, 12 nt, Mycobacterium avium subsp. paratuberculosis
cgcgccuccgac

SEQ ID NO: 2936283 - RNA, 13 nt, Mycobacterium avium subsp. paratuberculosis
cgcgccuccgacg

SEQ ID NO: 2936284 - RNA, 14 nt, Mycobacterium avium subsp. paratuberculosis
cgcgccuccgacga

SEQ ID NO: 2936285 - RNA, 12 nt, Mycobacterium avium subsp. paratuberculosis
cgcgccucgcgu

SEQ ID NO: 2936286 - RNA, 19 nt, Mycobacterium avium subsp. paratuberculosis
cgcgccucgcguacccggg

SEQ ID NO: 2936287 - RNA, 19 nt, Mycobacterium avium subsp. paratuberculosis
cgcgccucgguucugcagc

SEQ ID NO: 2936288 - RNA, 22 nt, Mycobacterium avium subsp. paratuberculosis
cgcgccucgguucugcagcgag

SEQ ID NO: 2936289 - RNA, 23 nt, Mycobacterium avium subsp. paratuberculosis
cgcgccucgguucugcagcgaga

SEQ ID NO: 2936290 - RNA, 16 nt, Mycobacterium avium subsp. paratuberculosis
cgcgccugcaccggcg

SEQ ID NO: 2936291 - RNA, 19 nt, Mycobacterium avium subsp. paratuberculosis
cgcgccugcaccggcgacg

SEQ ID NO: 2936292 - RNA, 12 nt, Mycobacterium avium subsp. paratuberculosis
cgcgccugccug

SEQ ID NO: 2936293 - RNA, 16 nt, Mycobacterium avium subsp. paratuberculosis
cgcgccugcgcggcgg

SEQ ID NO: 2936294 - RNA, 19 nt, Mycobacterium avium subsp. paratuberculosis
cgcgccugcgcggcggcgu

SEQ ID NO: 2936295 - RNA, 16 nt, Mycobacterium avium subsp. paratuberculosis
cgcgccuucgacccgg

SEQ ID NO: 2936296 - RNA, 22 nt, Mycobacterium avium subsp. paratuberculosis
cgcgccuucgacccgguggccc

SEQ ID NO: 2936297 - RNA, 17 nt, Mycobacterium avium subsp. paratuberculosis
cgcgccuucuugcugcc

SEQ ID NO: 2936298 - RNA, 14 nt, Mycobacterium avium subsp. paratuberculosis
cgcgcgcggcgacg

SEQ ID NO: 2936299 - RNA, 14 nt, Mycobacterium avium subsp. paratuberculosis
cgcgcgcggcgcgg

SEQ ID NO: 2936300 - RNA, 13 nt, Mycobacterium avium subsp. paratuberculosis
cgcgcgcggcggc

SEQ ID NO: 2936301 - RNA, 14 nt, Mycobacterium avium subsp. paratuberculosis
cgcgcgcggcggcc

SEQ ID NO: 2936302 - RNA, 15 nt, Mycobacterium avium subsp. paratuberculosis
cgcgcgcggcggcca

SEQ ID NO: 2936303 - RNA, 13 nt, Mycobacterium avium subsp. paratuberculosis
cgcgcgcggcguc

SEQ ID NO: 2936304 - RNA, 15 nt, Mycobacterium avium subsp. paratuberculosis
cgcgcgcggcgucag

SEQ ID NO: 2936305 - RNA, 13 nt, Mycobacterium avium subsp. paratuberculosis
cgcgcgcggcgug

SEQ ID NO: 2936306 - RNA, 14 nt, Mycobacterium avium subsp. paratuberculosis
cgcgcgcggcgugg

SEQ ID NO: 2936307 - RNA, 12 nt, Mycobacterium avium subsp. paratuberculosis
cgcgcgcgggcc

SEQ ID NO: 2936308 - RNA, 12 nt, Mycobacterium avium subsp. paratuberculosis
cgcgcgcgucga

SEQ ID NO: 2936309 - RNA, 13 nt, Mycobacterium avium subsp. paratuberculosis
cgcgcgcgucgac

SEQ ID NO: 2936310 - RNA, 14 nt, Mycobacterium avium subsp. paratuberculosis
cgcgcgcgucgacg

SEQ ID NO: 2936311 - RNA, 12 nt, Mycobacterium avium subsp. paratuberculosis
cgcgcgcucggc

SEQ ID NO: 2936312 - RNA, 14 nt, Mycobacterium avium subsp. paratuberculosis
cgcgcgcucggcgu

SEQ ID NO: 2936313 - RNA, 12 nt, Mycobacterium avium subsp. paratuberculosis
cgcgcgcucggu

SEQ ID NO: 2936314 - RNA, 20 nt, Mycobacterium avium subsp. paratuberculosis
cgcgcgcugcagcauccagg

SEQ ID NO: 2936315 - RNA, 15 nt, Mycobacterium avium subsp. paratuberculosis
cgcgcgcugccgcgc

SEQ ID NO: 2936316 - RNA, 17 nt, Mycobacterium avium subsp. paratuberculosis
cgcgcgcugccgcgccc

SEQ ID NO: 2936317 - RNA, 13 nt, Mycobacterium avium subsp. paratuberculosis
cgcgcgcuggugc

SEQ ID NO: 2936318 - RNA, 19 nt, Mycobacterium avium subsp. paratuberculosis
cgcgcgcuggugcgggcca

SEQ ID NO: 2936319 - RNA, 20 nt, Mycobacterium avium subsp. paratuberculosis
cgcgcgcuggugcgggccag

SEQ ID NO: 2936320 - RNA, 21 nt, Mycobacterium avium subsp. paratuberculosis
cgcgcgcuugcgcucggucgc

SEQ ID NO: 2936321 - RNA, 14 nt, Mycobacterium avium subsp. paratuberculosis
cgcgcggacgcggc

SEQ ID NO: 2936322 - RNA, 22 nt, Mycobacterium avium subsp. paratuberculosis
cgcgcggauuucucagcggcgc

SEQ ID NO: 2936323 - RNA, 13 nt, Mycobacterium avium subsp. paratuberculosis
cgcgcggcaccac

SEQ ID NO: 2936324 - RNA, 15 nt, Mycobacterium avium subsp. paratuberculosis
cgcgcggcaccacca

SEQ ID NO: 2936325 - RNA, 12 nt, Mycobacterium avium subsp. paratuberculosis
cgcgcggcaggu

SEQ ID NO: 2936326 - RNA, 12 nt, Mycobacterium avium subsp. paratuberculosis
cgcgcggcaucg

SEQ ID NO: 2936327 - RNA, 13 nt, Mycobacterium avium subsp. paratuberculosis
cgcgcggcaucgu

SEQ ID NO: 2936328 - RNA, 14 nt, Mycobacterium avium subsp. paratuberculosis
cgcgcggcaucguc

SEQ ID NO: 2936329 - RNA, 15 nt, Mycobacterium avium subsp. paratuberculosis
cgcgcggccaccagc

SEQ ID NO: 2936330 - RNA, 17 nt, Mycobacterium avium subsp. paratuberculosis
cgcgcggccaccagcgc

SEQ ID NO: 2936331 - RNA, 22 nt, Mycobacterium avium subsp. paratuberculosis
cgcgcggccaccagcgcggcca

SEQ ID NO: 2936332 - RNA, 24 nt, Mycobacterium avium subsp. paratuberculosis
cgcgcggccaccagcgcggccacc

SEQ ID NO: 2936333 - RNA, 15 nt, Mycobacterium avium subsp. paratuberculosis
cgcgcggccaccgcg

SEQ ID NO: 2936334 - RNA, 16 nt, Mycobacterium avium subsp. paratuberculosis
cgcgcggccaccgcgc

SEQ ID NO: 2936335 - RNA, 19 nt, Mycobacterium avium subsp. paratuberculosis
cgcgcggccaccgcgcgcu

SEQ ID NO: 2936336 - RNA, 15 nt, Mycobacterium avium subsp. paratuberculosis
cgcgcggccagcccc

SEQ ID NO: 2936337 - RNA, 14 nt, Mycobacterium avium subsp. paratuberculosis
cgcgcggcccgcga

SEQ ID NO: 2936338 - RNA, 18 nt, Mycobacterium avium subsp. paratuberculosis
cgcgcggcccgcgacguc

SEQ ID NO: 2936339 - RNA, 13 nt, Mycobacterium avium subsp. paratuberculosis
cgcgcggccgcca

SEQ ID NO: 2936340 - RNA, 15 nt, Mycobacterium avium subsp. paratuberculosis
cgcgcggccgccucc

SEQ ID NO: 2936341 - RNA, 13 nt, Mycobacterium avium subsp. paratuberculosis
cgcgcggccggcc

SEQ ID NO: 2936342 - RNA, 20 nt, Mycobacterium avium subsp. paratuberculosis
cgcgcggccggccacgcucg

SEQ ID NO: 2936343 - RNA, 13 nt, Mycobacterium avium subsp. paratuberculosis
cgcgcggccgggc

SEQ ID NO: 2936344 - RNA, 15 nt, Mycobacterium avium subsp. paratuberculosis
cgcgcggccgggcuc

SEQ ID NO: 2936345 - RNA, 18 nt, Mycobacterium avium subsp. paratuberculosis
cgcgcggccuccagccgc

SEQ ID NO: 2936346 - RNA, 13 nt, Mycobacterium avium subsp. paratuberculosis
cgcgcggcgacga

SEQ ID NO: 2936347 - RNA, 16 nt, Mycobacterium avium subsp. paratuberculosis
cgcgcggcgacggugg

SEQ ID NO: 2936348 - RNA, 19 nt, Mycobacterium avium subsp. paratuberculosis
cgcgcggcgacgguggcgg

SEQ ID NO: 2936349 - RNA, 20 nt, Mycobacterium avium subsp. paratuberculosis
cgcgcggcgacgguggcggg

SEQ ID NO: 2936350 - RNA, 22 nt, Mycobacterium avium subsp. paratuberculosis
cgcgcggcgaguucugguaggc

SEQ ID NO: 2936351 - RNA, 13 nt, Mycobacterium avium subsp. paratuberculosis
cgcgcggcgaugg

SEQ ID NO: 2936352 - RNA, 12 nt, Mycobacterium avium subsp. paratuberculosis
cgcgcggcgcag

SEQ ID NO: 2936353 - RNA, 15 nt, Mycobacterium avium subsp. paratuberculosis
cgcgcggcgcagggc

SEQ ID NO: 2936354 - RNA, 17 nt, Mycobacterium avium subsp. paratuberculosis
cgcgcggcgcagguccg

SEQ ID NO: 2936355 - RNA, 21 nt, Mycobacterium avium subsp. paratuberculosis
cgcgcggcgcagguccggcag

SEQ ID NO: 2936356 - RNA, 12 nt, Mycobacterium avium subsp. paratuberculosis
cgcgcggcgcca

SEQ ID NO: 2936357 - RNA, 17 nt, Mycobacterium avium subsp. paratuberculosis
cgcgcggcgccagcggc

SEQ ID NO: 2936358 - RNA, 13 nt, Mycobacterium avium subsp. paratuberculosis
cgcgcggcgccca

SEQ ID NO: 2936359 - RNA, 13 nt, Mycobacterium avium subsp. paratuberculosis
cgcgcggcgcccc

SEQ ID NO: 2936360 - RNA, 14 nt, Mycobacterium avium subsp. paratuberculosis
cgcgcggcgccgcg

SEQ ID NO: 2936361 - RNA, 15 nt, Mycobacterium avium subsp. paratuberculosis
cgcgcggcgccgcgu

SEQ ID NO: 2936362 - RNA, 11 nt, Mycobacterium avium subsp. paratuberculosis
cgcgcggcgcg

SEQ ID NO: 2936363 - RNA, 15 nt, Mycobacterium avium subsp. paratuberculosis
cgcgcggcgcggagc

SEQ ID NO: 2936364 - RNA, 12 nt, Mycobacterium avium subsp. paratuberculosis
cgcgcggcggcc

SEQ ID NO: 2936365 - RNA, 13 nt, Mycobacterium avium subsp. paratuberculosis
cgcgcggcggcca

SEQ ID NO: 2936366 - RNA, 14 nt, Mycobacterium avium subsp. paratuberculosis
cgcgcggcggccac

SEQ ID NO: 2936367 - RNA, 15 nt, Mycobacterium avium subsp. paratuberculosis
cgcgcggcggccacc

SEQ ID NO: 2936368 - RNA, 18 nt, Mycobacterium avium subsp. paratuberculosis
cgcgcggcggccaccgcg

SEQ ID NO: 2936369 - RNA, 22 nt, Mycobacterium avium subsp. paratuberculosis
cgcgcggcggccaccgcgccgu

SEQ ID NO: 2936370 - RNA, 22 nt, Mycobacterium avium subsp. paratuberculosis
cgcgcggcgggcccgcagcucg

SEQ ID NO: 2936371 - RNA, 12 nt, Mycobacterium avium subsp. paratuberculosis
cgcgcggcgguc

SEQ ID NO: 2936372 - RNA, 14 nt, Mycobacterium avium subsp. paratuberculosis
cgcgcggcggucca

SEQ ID NO: 2936373 - RNA, 15 nt, Mycobacterium avium subsp. paratuberculosis
cgcgcggcgguccag

SEQ ID NO: 2936374 - RNA, 19 nt, Mycobacterium avium subsp. paratuberculosis
cgcgcggcgguccagcgag

SEQ ID NO: 2936375 - RNA, 21 nt, Mycobacterium avium subsp. paratuberculosis
cgcgcggcggugaccggaucg

SEQ ID NO: 2936376 - RNA, 19 nt, Mycobacterium avium subsp. paratuberculosis
cgcgcggcggugucggugc

SEQ ID NO: 2936377 - RNA, 15 nt, Mycobacterium avium subsp. paratuberculosis
cgcgcggcuacagca

SEQ ID NO: 2936378 - RNA, 12 nt, Mycobacterium avium subsp. paratuberculosis
cgcgcggcucgc

SEQ ID NO: 2936379 - RNA, 19 nt, Mycobacterium avium subsp. paratuberculosis
cgcgcggcucgcgggcgau

SEQ ID NO: 2936380 - RNA, 13 nt, Mycobacterium avium subsp. paratuberculosis
cgcgcggcugcuc

SEQ ID NO: 2936381 - RNA, 14 nt, Mycobacterium avium subsp. paratuberculosis
cgcgcgggagcgcu

SEQ ID NO: 2936382 - RNA, 13 nt, Mycobacterium avium subsp. paratuberculosis
cgcgcgggccagc

SEQ ID NO: 2936383 - RNA, 17 nt, Mycobacterium avium subsp. paratuberculosis
cgcgcgggccagcgccu

SEQ ID NO: 2936384 - RNA, 13 nt, Mycobacterium avium subsp. paratuberculosis
cgcgcucagcccc

SEQ ID NO: 2936385 - RNA, 16 nt, Mycobacterium avium subsp. paratuberculosis
cgcgcucagccccagc

SEQ ID NO: 2936386 - RNA, 17 nt, Mycobacterium avium subsp. paratuberculosis
cgcgcucagccccagcg

SEQ ID NO: 2936387 - RNA, 19 nt, Mycobacterium avium subsp. paratuberculosis
cgcgcucagccccagcgga

SEQ ID NO: 2936388 - RNA, 15 nt, Mycobacterium avium subsp. paratuberculosis
cgcgcucagcgcggc

SEQ ID NO: 2936389 - RNA, 18 nt, Mycobacterium avium subsp. paratuberculosis
cgcgcucagcgcggccac

SEQ ID NO: 2936390 - RNA, 18 nt, Mycobacterium avium subsp. paratuberculosis
cgcgcucagugcacgcuc

SEQ ID NO: 2936391 - RNA, 19 nt, Mycobacterium avium subsp. paratuberculosis
cgcgcucagugcacgcucg

SEQ ID NO: 2936392 - RNA, 12 nt, Mycobacterium avium subsp. paratuberculosis
cgcgcucccggc

SEQ ID NO: 2936393 - RNA, 15 nt, Mycobacterium avium subsp. paratuberculosis
cgcgcucccggcgcc

SEQ ID NO: 2936394 - RNA, 16 nt, Mycobacterium avium subsp. paratuberculosis
cgcgcucccggcgccg

SEQ ID NO: 2936395 - RNA, 17 nt, Mycobacterium avium subsp. paratuberculosis
cgcgcucccggcgccgc

SEQ ID NO: 2936396 - RNA, 18 nt, Mycobacterium avium subsp. paratuberculosis
cgcgcucccggcgccgcc

SEQ ID NO: 2936397 - RNA, 19 nt, Mycobacterium avium subsp. paratuberculosis
cgcgcucccggcgccgccg

SEQ ID NO: 2936398 - RNA, 20 nt, Mycobacterium avium subsp. paratuberculosis
cgcgcucccggcgccgccgu

SEQ ID NO: 2936399 - RNA, 17 nt, Mycobacterium avium subsp. paratuberculosis
cgcgcuccugccagcgg

SEQ ID NO: 2936400 - RNA, 18 nt, Mycobacterium avium subsp. paratuberculosis
cgcgcuccugccagcggc

SEQ ID NO: 2936401 - RNA, 21 nt, Mycobacterium avium subsp. paratuberculosis
cgcgcuccugccagcggcgca

SEQ ID NO: 2936402 - RNA, 14 nt, Mycobacterium avium subsp. paratuberculosis
cgcgcucgacgaug

SEQ ID NO: 2936403 - RNA, 20 nt, Mycobacterium avium subsp. paratuberculosis
cgcgcucgacgaugucgacg

SEQ ID NO: 2936404 - RNA, 13 nt, Mycobacterium avium subsp. paratuberculosis
cgcgcucgcacca

SEQ ID NO: 2936405 - RNA, 15 nt, Mycobacterium avium subsp. paratuberculosis
cgcgcucgcaccagc

SEQ ID NO: 2936406 - RNA, 16 nt, Mycobacterium avium subsp. paratuberculosis
cgcgcucgcaccagcg

SEQ ID NO: 2936407 - RNA, 18 nt, Mycobacterium avium subsp. paratuberculosis
cgcgcucgcaccagcgcu

SEQ ID NO: 2936408 - RNA, 12 nt, Mycobacterium avium subsp. paratuberculosis
cgcgcucggcga

SEQ ID NO: 2936409 - RNA, 13 nt, Mycobacterium avium subsp. paratuberculosis
cgcgcucggcgac

SEQ ID NO: 2936410 - RNA, 20 nt, Mycobacterium avium subsp. paratuberculosis
cgcgcucggcgaccgccggu

SEQ ID NO: 2936411 - RNA, 14 nt, Mycobacterium avium subsp. paratuberculosis
cgcgcucggcgacg

SEQ ID NO: 2936412 - RNA, 14 nt, Mycobacterium avium subsp. paratuberculosis
cgcgcucgggggug

SEQ ID NO: 2936413 - RNA, 14 nt, Mycobacterium avium subsp. paratuberculosis
cgcgcucgugcugc

SEQ ID NO: 2936414 - RNA, 16 nt, Mycobacterium avium subsp. paratuberculosis
cgcgcucuaacuccgc

SEQ ID NO: 2936415 - RNA, 18 nt, Mycobacterium avium subsp. paratuberculosis
cgcgcucuugggcggccg

SEQ ID NO: 2936416 - RNA, 19 nt, Mycobacterium avium subsp. paratuberculosis
cgcgcucuugggcggccgg

SEQ ID NO: 2936417 - RNA, 17 nt, Mycobacterium avium subsp. paratuberculosis
cgcgcugaacgcggugg

SEQ ID NO: 2936418 - RNA, 22 nt, Mycobacterium avium subsp. paratuberculosis
cgcgcugaacgcggugggcacc

SEQ ID NO: 2936419 - RNA, 23 nt, Mycobacterium avium subsp. paratuberculosis
cgcgcugaacgcggugggcacca

SEQ ID NO: 2936420 - RNA, 15 nt, Mycobacterium avium subsp. paratuberculosis
cgcgcugaagcgcga

SEQ ID NO: 2936421 - RNA, 18 nt, Mycobacterium avium subsp. paratuberculosis
cgcgcugaagcgcgaccc

SEQ ID NO: 2936422 - RNA, 13 nt, Mycobacterium avium subsp. paratuberculosis
cgcgcugaccagc

SEQ ID NO: 2936423 - RNA, 16 nt, Mycobacterium avium subsp. paratuberculosis
cgcgcugaccaggccg

SEQ ID NO: 2936424 - RNA, 18 nt, Mycobacterium avium subsp. paratuberculosis
cgcgcugaccaggccguc

SEQ ID NO: 2936425 - RNA, 22 nt, Mycobacterium avium subsp. paratuberculosis
cgcgcugaccaggccguccacc

SEQ ID NO: 2936426 - RNA, 19 nt, Mycobacterium avium subsp. paratuberculosis
cgcgcugaucgccgcuugc

SEQ ID NO: 2936427 - RNA, 13 nt, Mycobacterium avium subsp. paratuberculosis
cgcgcugcaggcc

SEQ ID NO: 2936428 - RNA, 14 nt, Mycobacterium avium subsp. paratuberculosis
cgcgcugcaggccc

SEQ ID NO: 2936429 - RNA, 15 nt, Mycobacterium avium subsp. paratuberculosis
cgcgcugcaggcccg

SEQ ID NO: 2936430 - RNA, 16 nt, Mycobacterium avium subsp. paratuberculosis
cgcgcugcaggcccgg

SEQ ID NO: 2936431 - RNA, 15 nt, Mycobacterium avium subsp. paratuberculosis
cgcgcugccagggcc

SEQ ID NO: 2936432 - RNA, 19 nt, Mycobacterium avium subsp. paratuberculosis
cgcgcugccagggccgggc

SEQ ID NO: 2936433 - RNA, 15 nt, Mycobacterium avium subsp. paratuberculosis
cgcgcugcccagcgc

SEQ ID NO: 2936434 - RNA, 18 nt, Mycobacterium avium subsp. paratuberculosis
cgcgcugcccagcgcggu

SEQ ID NO: 2936435 - RNA, 20 nt, Mycobacterium avium subsp. paratuberculosis
cgcgcugcccagcgcggucg

SEQ ID NO: 2936436 - RNA, 13 nt, Mycobacterium avium subsp. paratuberculosis
cgcgcugccgacg

SEQ ID NO: 2936437 - RNA, 14 nt, Mycobacterium avium subsp. paratuberculosis
cgcgcugccgacga

SEQ ID NO: 2936438 - RNA, 15 nt, Mycobacterium avium subsp. paratuberculosis
cgcgcugccgacgau

SEQ ID NO: 2936439 - RNA, 13 nt, Mycobacterium avium subsp. paratuberculosis
cgcgcugccgcgc

SEQ ID NO: 2936440 - RNA, 14 nt, Mycobacterium avium subsp. paratuberculosis
cgcgcugccgcgcc

SEQ ID NO: 2936441 - RNA, 17 nt, Mycobacterium avium subsp. paratuberculosis
cgcgcugccgcgccccg

SEQ ID NO: 2936442 - RNA, 19 nt, Mycobacterium avium subsp. paratuberculosis
cgcgcugccgcgcgccgac

SEQ ID NO: 2936443 - RNA, 20 nt, Mycobacterium avium subsp. paratuberculosis
cgcgcugccgcgcgccgaca

SEQ ID NO: 2936444 - RNA, 21 nt, Mycobacterium avium subsp. paratuberculosis
cgcgcugccgcgcgccgacag

SEQ ID NO: 2936445 - RNA, 13 nt, Mycobacterium avium subsp. paratuberculosis
cgcgcugccggcc

SEQ ID NO: 2936446 - RNA, 13 nt, Mycobacterium avium subsp. paratuberculosis
cgcgcugcgccgg

SEQ ID NO: 2936447 - RNA, 14 nt, Mycobacterium avium subsp. paratuberculosis
cgcgcugcgccggg

SEQ ID NO: 2936448 - RNA, 15 nt, Mycobacterium avium subsp. paratuberculosis
cgcgcugcgccgggu

SEQ ID NO: 2936449 - RNA, 15 nt, Mycobacterium avium subsp. paratuberculosis
cgcgcugcgcgccgc

SEQ ID NO: 2936450 - RNA, 16 nt, Mycobacterium avium subsp. paratuberculosis
cgcgcugcgcgccgcc

SEQ ID NO: 2936451 - RNA, 23 nt, Mycobacterium avium subsp. paratuberculosis
cgcgcugcgcgcguuguccagca

SEQ ID NO: 2936452 - RNA, 12 nt, Mycobacterium avium subsp. paratuberculosis
cgcgcugcggcg

SEQ ID NO: 2936453 - RNA, 21 nt, Mycobacterium avium subsp. paratuberculosis
cgcgcuggagauguugaucac

SEQ ID NO: 2936454 - RNA, 22 nt, Mycobacterium avium subsp. paratuberculosis
cgcgcuggagauguugaucacg

SEQ ID NO: 2936455 - RNA, 15 nt, Mycobacterium avium subsp. paratuberculosis
cgcgcuggccagcgu

SEQ ID NO: 2936456 - RNA, 17 nt, Mycobacterium avium subsp. paratuberculosis
cgcgcuggccagcguca

SEQ ID NO: 2936457 - RNA, 12 nt, Mycobacterium avium subsp. paratuberculosis
cgcgcuggccga

SEQ ID NO: 2936458 - RNA, 14 nt, Mycobacterium avium subsp. paratuberculosis
cgcgcuggccgauc

SEQ ID NO: 2936459 - RNA, 21 nt, Mycobacterium avium subsp. paratuberculosis
cgcgcuggccgaucccggcca

SEQ ID NO: 2936460 - RNA, 14 nt, Mycobacterium avium subsp. paratuberculosis
cgcgcuggccgggu

SEQ ID NO: 2936461 - RNA, 13 nt, Mycobacterium avium subsp. paratuberculosis
cgcgcuggcgcag

SEQ ID NO: 2936462 - RNA, 17 nt, Mycobacterium avium subsp. paratuberculosis
cgcgcuggcggccaucg

SEQ ID NO: 2936463 - RNA, 20 nt, Mycobacterium avium subsp. paratuberculosis
cgcgcuggcggccaucgccg

SEQ ID NO: 2936464 - RNA, 14 nt, Mycobacterium avium subsp. paratuberculosis
cgcgcuggggugcu

SEQ ID NO: 2936465 - RNA, 12 nt, Mycobacterium avium subsp. paratuberculosis
cgcgcuggugcg

SEQ ID NO: 2936466 - RNA, 17 nt, Mycobacterium avium subsp. paratuberculosis
cgcgcuggugcgggcca

SEQ ID NO: 2936467 - RNA, 18 nt, Mycobacterium avium subsp. paratuberculosis
cgcgcuggugcugccgaa

SEQ ID NO: 2936468 - RNA, 19 nt, Mycobacterium avium subsp. paratuberculosis
cgcgcuggugcugccgaac

SEQ ID NO: 2936469 - RNA, 23 nt, Mycobacterium avium subsp. paratuberculosis
cgcggagaugcuggugacgccgc

SEQ ID NO: 2936470 - RNA, 13 nt, Mycobacterium avium subsp. paratuberculosis
cgcggagccggcc

SEQ ID NO: 2936471 - RNA, 14 nt, Mycobacterium avium subsp. paratuberculosis
cgcggagccggccg

SEQ ID NO: 2936472 - RNA, 15 nt, Mycobacterium avium subsp. paratuberculosis
cgcggagccggccgc

SEQ ID NO: 2936473 - RNA, 19 nt, Mycobacterium avium subsp. paratuberculosis
cgcggagccggccgccgaa

SEQ ID NO: 2936474 - RNA, 19 nt, Mycobacterium avium subsp. paratuberculosis
cgcggagcgggucagcgug

SEQ ID NO: 2936475 - RNA, 13 nt, Mycobacterium avium subsp. paratuberculosis
cgcggagcgucgc

SEQ ID NO: 2936476 - RNA, 19 nt, Mycobacterium avium subsp. paratuberculosis
cgcggaggaauucgccgac

SEQ ID NO: 2936477 - RNA, 18 nt, Mycobacterium avium subsp. paratuberculosis
cgcggaggaugccggcca

SEQ ID NO: 2936478 - RNA, 19 nt, Mycobacterium avium subsp. paratuberculosis
cgcggaggaugccggccag

SEQ ID NO: 2936479 - RNA, 14 nt, Mycobacterium avium subsp. paratuberculosis
cgcggaguaggcgc

SEQ ID NO: 2936480 - RNA, 17 nt, Mycobacterium avium subsp. paratuberculosis
cgcggaguaggcgccgc

SEQ ID NO: 2936481 - RNA, 19 nt, Mycobacterium avium subsp. paratuberculosis
cgcggauacgcccggccac

SEQ ID NO: 2936482 - RNA, 20 nt, Mycobacterium avium subsp. paratuberculosis
cgcggauacgcccggccacc

SEQ ID NO: 2936483 - RNA, 23 nt, Mycobacterium avium subsp. paratuberculosis
cgcggaucaugauccggaagccg

SEQ ID NO: 2936484 - RNA, 15 nt, Mycobacterium avium subsp. paratuberculosis
cgcggauccgggccg

SEQ ID NO: 2936485 - RNA, 18 nt, Mycobacterium avium subsp. paratuberculosis
cgcggauccgggccgccu

SEQ ID NO: 2936486 - RNA, 16 nt, Mycobacterium avium subsp. paratuberculosis
cgcggauccgggccgg

SEQ ID NO: 2936487 - RNA, 21 nt, Mycobacterium avium subsp. paratuberculosis
cgcggauccgggccggcgucg

SEQ ID NO: 2936488 - RNA, 19 nt, Mycobacterium avium subsp. paratuberculosis
cgcggaucgaacagggcgg

SEQ ID NO: 2936489 - RNA, 21 nt, Mycobacterium avium subsp. paratuberculosis
cgcggaucgaacagggcggcg

SEQ ID NO: 2936490 - RNA, 18 nt, Mycobacterium avium subsp. paratuberculosis
cgcggaucgcgcugacca

SEQ ID NO: 2936491 - RNA, 15 nt, Mycobacterium avium subsp. paratuberculosis
cgcggaucgcguagu

SEQ ID NO: 2936492 - RNA, 19 nt, Mycobacterium avium subsp. paratuberculosis
cgcggaucgguggacgcgg

SEQ ID NO: 2936493 - RNA, 13 nt, Mycobacterium avium subsp. paratuberculosis
cgcggaucgucac

SEQ ID NO: 2936494 - RNA, 14 nt, Mycobacterium avium subsp. paratuberculosis
cgcggaucgucacc

SEQ ID NO: 2936495 - RNA, 16 nt, Mycobacterium avium subsp. paratuberculosis
cgcggaucgucaccga

SEQ ID NO: 2936496 - RNA, 22 nt, Mycobacterium avium subsp. paratuberculosis
cgcggaucgucaccgaccccuc

SEQ ID NO: 2936497 - RNA, 16 nt, Mycobacterium avium subsp. paratuberculosis
cgcggaucucgcgcag

SEQ ID NO: 2936498 - RNA, 17 nt, Mycobacterium avium subsp. paratuberculosis
cgcggaucucgcgcagg

SEQ ID NO: 2936499 - RNA, 16 nt, Mycobacterium avium subsp. paratuberculosis
cgcggaucucggugag

SEQ ID NO: 2936500 - RNA, 17 nt, Mycobacterium avium subsp. paratuberculosis
cgcggaucucggugagc

SEQ ID NO: 2936501 - RNA, 15 nt, Mycobacterium avium subsp. paratuberculosis
cgcggaucucgucgg

SEQ ID NO: 2936502 - RNA, 19 nt, Mycobacterium avium subsp. paratuberculosis
cgcggaucucgucgggcca

SEQ ID NO: 2936503 - RNA, 20 nt, Mycobacterium avium subsp. paratuberculosis
cgcggaucucgucgggccac

SEQ ID NO: 2936504 - RNA, 17 nt, Mycobacterium avium subsp. paratuberculosis
cgcggaucuucuccgcc

SEQ ID NO: 2936505 - RNA, 21 nt, Mycobacterium avium subsp. paratuberculosis
cgcggaucuucuccgccacau

SEQ ID NO: 2936506 - RNA, 16 nt, Mycobacterium avium subsp. paratuberculosis
cgcggaugacgggugc

SEQ ID NO: 2936507 - RNA, 21 nt, Mycobacterium avium subsp. paratuberculosis
cgcggaugacgggugcucagg

SEQ ID NO: 2936508 - RNA, 20 nt, Mycobacterium avium subsp. paratuberculosis
cgcggaugcccaggccggcg

SEQ ID NO: 2936509 - RNA, 22 nt, Mycobacterium avium subsp. paratuberculosis
cgcggaugcccaggccggcgag

SEQ ID NO: 2936510 - RNA, 16 nt, Mycobacterium avium subsp. paratuberculosis
cgcggaugcgggcgcu

SEQ ID NO: 2936511 - RNA, 20 nt, Mycobacterium avium subsp. paratuberculosis
cgcggaugcgggcgcugccg

SEQ ID NO: 2936512 - RNA, 15 nt, Mycobacterium avium subsp. paratuberculosis
cgcggauggccucgg

SEQ ID NO: 2936513 - RNA, 16 nt, Mycobacterium avium subsp. paratuberculosis
cgcggauggccucggc

SEQ ID NO: 2936514 - RNA, 19 nt, Mycobacterium avium subsp. paratuberculosis
cgcggauggguggcgauca

SEQ ID NO: 2936515 - RNA, 17 nt, Mycobacterium avium subsp. paratuberculosis
cgcggauggugacggcc

SEQ ID NO: 2936516 - RNA, 16 nt, Mycobacterium avium subsp. paratuberculosis
cgcggauguccgaccg

SEQ ID NO: 2936517 - RNA, 17 nt, Mycobacterium avium subsp. paratuberculosis
cgcggauguccgaccgg

SEQ ID NO: 2936518 - RNA, 19 nt, Mycobacterium avium subsp. paratuberculosis
cgcggauguccgaccgguu

SEQ ID NO: 2936519 - RNA, 20 nt, Mycobacterium avium subsp. paratuberculosis
cgcggauguggaggcgagca

SEQ ID NO: 2936520 - RNA, 21 nt, Mycobacterium avium subsp. paratuberculosis
cgcggauguggaggcgagcaa

SEQ ID NO: 2936521 - RNA, 17 nt, Mycobacterium avium subsp. paratuberculosis
cgcggauuccagcgcgu

SEQ ID NO: 2936522 - RNA, 18 nt, Mycobacterium avium subsp. paratuberculosis
cgcggauuccggcaucgg

SEQ ID NO: 2936523 - RNA, 21 nt, Mycobacterium avium subsp. paratuberculosis
cgcggauuucucagcggcgcu

SEQ ID NO: 2936524 - RNA, 14 nt, Mycobacterium avium subsp. paratuberculosis
cgcggcaacgccag

SEQ ID NO: 2936525 - RNA, 15 nt, Mycobacterium avium subsp. paratuberculosis
cgcggcaacgccagc

SEQ ID NO: 2936526 - RNA, 15 nt, Mycobacterium avium subsp. paratuberculosis
cgcggcaaggcgcag

SEQ ID NO: 2936527 - RNA, 22 nt, Mycobacterium avium subsp. paratuberculosis
cgcggcaaggcguuccaucugc

SEQ ID NO: 2936528 - RNA, 22 nt, Mycobacterium avium subsp. paratuberculosis
cgcggcaccuucaccgaccagc

SEQ ID NO: 2936529 - RNA, 23 nt, Mycobacterium avium subsp. paratuberculosis
cgcggcaccuucaccgaccagcu

SEQ ID NO: 2936530 - RNA, 16 nt, Mycobacterium avium subsp. paratuberculosis
cgcggcacgccgcucg

SEQ ID NO: 2936531 - RNA, 19 nt, Mycobacterium avium subsp. paratuberculosis
cgcggcacgccgcucgucg

SEQ ID NO: 2936532 - RNA, 21 nt, Mycobacterium avium subsp. paratuberculosis
cgcggcacgcugcgccagccg

SEQ ID NO: 2936533 - RNA, 22 nt, Mycobacterium avium subsp. paratuberculosis
cgcggcacgcugcgccagccgu

SEQ ID NO: 2936534 - RNA, 23 nt, Mycobacterium avium subsp. paratuberculosis
cgcggcacgcugcgccagccguc

SEQ ID NO: 2936535 - RNA, 14 nt, Mycobacterium avium subsp. paratuberculosis
cgcggcacgggccg

SEQ ID NO: 2936536 - RNA, 15 nt, Mycobacterium avium subsp. paratuberculosis
cgcggcacgggccgu

SEQ ID NO: 2936537 - RNA, 17 nt, Mycobacterium avium subsp. paratuberculosis
cgcggcacgggccguuc

SEQ ID NO: 2936538 - RNA, 18 nt, Mycobacterium avium subsp. paratuberculosis
cgcggcacgggccguucg

SEQ ID NO: 2936539 - RNA, 13 nt, Mycobacterium avium subsp. paratuberculosis
cgcggcacggugg

SEQ ID NO: 2936540 - RNA, 17 nt, Mycobacterium avium subsp. paratuberculosis
cgcggcagccagccugg

SEQ ID NO: 2936541 - RNA, 14 nt, Mycobacterium avium subsp. paratuberculosis
cgcggcagccgggc

SEQ ID NO: 2936542 - RNA, 16 nt, Mycobacterium avium subsp. paratuberculosis
cgcggcagccgggcga

SEQ ID NO: 2936543 - RNA, 18 nt, Mycobacterium avium subsp. paratuberculosis
cgcggcagccgggcgauc

SEQ ID NO: 2936544 - RNA, 20 nt, Mycobacterium avium subsp. paratuberculosis
cgcggcagccgggcgaucau

SEQ ID NO: 2936545 - RNA, 23 nt, Mycobacterium avium subsp. paratuberculosis
cgcggcagccgggcgaucaucca

SEQ ID NO: 2936546 - RNA, 13 nt, Mycobacterium avium subsp. paratuberculosis
cgcggcaggaauu

SEQ ID NO: 2936547 - RNA, 19 nt, Mycobacterium avium subsp. paratuberculosis
cgcggcaggaauuccagcg

SEQ ID NO: 2936548 - RNA, 22 nt, Mycobacterium avium subsp. paratuberculosis
cgcggcaggaauuccagcgaca

SEQ ID NO: 2936549 - RNA, 14 nt, Mycobacterium avium subsp. paratuberculosis
cgcggcaggcgacc

SEQ ID NO: 2936550 - RNA, 17 nt, Mycobacterium avium subsp. paratuberculosis
cgcggcaggcgacccgc

SEQ ID NO: 2936551 - RNA, 16 nt, Mycobacterium avium subsp. paratuberculosis
cgcggcaggcgcccca

SEQ ID NO: 2936552 - RNA, 18 nt, Mycobacterium avium subsp. paratuberculosis
cgcggcaggcgccccagc

SEQ ID NO: 2936553 - RNA, 15 nt, Mycobacterium avium subsp. paratuberculosis
cgcggccagcugccc

SEQ ID NO: 2936554 - RNA, 20 nt, Mycobacterium avium subsp. paratuberculosis
cgcggccagcugcccgccga

SEQ ID NO: 2936555 - RNA, 21 nt, Mycobacterium avium subsp. paratuberculosis
cgcggccagcugcccgccgac

SEQ ID NO: 2936556 - RNA, 20 nt, Mycobacterium avium subsp. paratuberculosis
cgcggccagcugcgacagca

SEQ ID NO: 2936557 - RNA, 15 nt, Mycobacterium avium subsp. paratuberculosis
cgcggccaggguaga

SEQ ID NO: 2936558 - RNA, 23 nt, Mycobacterium avium subsp. paratuberculosis
cgcggccaggguagaggcggcga

SEQ ID NO: 2936559 - RNA, 15 nt, Mycobacterium avium subsp. paratuberculosis
cgcggccaggucgag

SEQ ID NO: 2936560 - RNA, 20 nt, Mycobacterium avium subsp. paratuberculosis
cgcggcccacccgcagggcg

SEQ ID NO: 2936561 - RNA, 23 nt, Mycobacterium avium subsp. paratuberculosis
cgcggcccacccgcagggcgccg

SEQ ID NO: 2936562 - RNA, 17 nt, Mycobacterium avium subsp. paratuberculosis
cgcggcccaccgcgucg

SEQ ID NO: 2936563 - RNA, 18 nt, Mycobacterium avium subsp. paratuberculosis
cgcggcccaccgcgucgc

SEQ ID NO: 2936564 - RNA, 19 nt, Mycobacterium avium subsp. paratuberculosis
cgcggcccaccgcgucgca

SEQ ID NO: 2936565 - RNA, 15 nt, Mycobacterium avium subsp. paratuberculosis
cgcggcccagcacca

SEQ ID NO: 2936566 - RNA, 19 nt, Mycobacterium avium subsp. paratuberculosis
cgcggcccaguucgcaccc

SEQ ID NO: 2936567 - RNA, 16 nt, Mycobacterium avium subsp. paratuberculosis
cgcggcccccacgcag

SEQ ID NO: 2936568 - RNA, 17 nt, Mycobacterium avium subsp. paratuberculosis
cgcggcccccacgcagc

SEQ ID NO: 2936569 - RNA, 20 nt, Mycobacterium avium subsp. paratuberculosis
cgcggcccccacgcagcggu

SEQ ID NO: 2936570 - RNA, 22 nt, Mycobacterium avium subsp. paratuberculosis
cgcggcccccacgcagcggugc

SEQ ID NO: 2936571 - RNA, 20 nt, Mycobacterium avium subsp. paratuberculosis
cgcggcccccugaucggccg

SEQ ID NO: 2936572 - RNA, 15 nt, Mycobacterium avium subsp. paratuberculosis
cgcggcccgccgaac

SEQ ID NO: 2936573 - RNA, 18 nt, Mycobacterium avium subsp. paratuberculosis
cgcggcccgccgaacgcc

SEQ ID NO: 2936574 - RNA, 15 nt, Mycobacterium avium subsp. paratuberculosis
cgcggcccgcgacgu

SEQ ID NO: 2936575 - RNA, 18 nt, Mycobacterium avium subsp. paratuberculosis
cgcggcccgcgacgucgg

SEQ ID NO: 2936576 - RNA, 13 nt, Mycobacterium avium subsp. paratuberculosis
cgcggcccgcggg

SEQ ID NO: 2936577 - RNA, 22 nt, Mycobacterium avium subsp. paratuberculosis
cgcggcccgcggggcguacgcg

SEQ ID NO: 2936578 - RNA, 14 nt, Mycobacterium avium subsp. paratuberculosis
cgcggcccgcuucc

SEQ ID NO: 2936579 - RNA, 17 nt, Mycobacterium avium subsp. paratuberculosis
cgcggcccggccaccag

SEQ ID NO: 2936580 - RNA, 13 nt, Mycobacterium avium subsp. paratuberculosis
cgcggcccggccc

SEQ ID NO: 2936581 - RNA, 14 nt, Mycobacterium avium subsp. paratuberculosis
cgcggcccggcccg

SEQ ID NO: 2936582 - RNA, 15 nt, Mycobacterium avium subsp. paratuberculosis
cgcggcccggcccgc

SEQ ID NO: 2936583 - RNA, 18 nt, Mycobacterium avium subsp. paratuberculosis
cgcggcccggcccgcugg

SEQ ID NO: 2936584 - RNA, 20 nt, Mycobacterium avium subsp. paratuberculosis
cgcggcccguugagcaccgc

SEQ ID NO: 2936585 - RNA, 20 nt, Mycobacterium avium subsp. paratuberculosis
cgcggccgaaaucaacgcgc

SEQ ID NO: 2936586 - RNA, 22 nt, Mycobacterium avium subsp. paratuberculosis
cgcggccgaaaucaacgcgccg

SEQ ID NO: 2936587 - RNA, 13 nt, Mycobacterium avium subsp. paratuberculosis
cgcggccgagccg

SEQ ID NO: 2936588 - RNA, 16 nt, Mycobacterium avium subsp. paratuberculosis
cgcggccgauucggcg

SEQ ID NO: 2936589 - RNA, 13 nt, Mycobacterium avium subsp. paratuberculosis
cgcggccgccagg

SEQ ID NO: 2936590 - RNA, 16 nt, Mycobacterium avium subsp. paratuberculosis
cgcggccgccaucgau

SEQ ID NO: 2936591 - RNA, 19 nt, Mycobacterium avium subsp. paratuberculosis
cgcggccgccaucgaucgg

SEQ ID NO: 2936592 - RNA, 16 nt, Mycobacterium avium subsp. paratuberculosis
cgcggccgcccagccc

SEQ ID NO: 2936593 - RNA, 18 nt, Mycobacterium avium subsp. paratuberculosis
cgcggccgcccagcccgc

SEQ ID NO: 2936594 - RNA, 13 nt, Mycobacterium avium subsp. paratuberculosis
cgcggccgcccgg

SEQ ID NO: 2936595 - RNA, 16 nt, Mycobacterium avium subsp. paratuberculosis
cgcggccgcccggucc

SEQ ID NO: 2936596 - RNA, 18 nt, Mycobacterium avium subsp. paratuberculosis
cgcggccgcccgguccgg

SEQ ID NO: 2936597 - RNA, 19 nt, Mycobacterium avium subsp. paratuberculosis
cgcggccgcccgguccggg

SEQ ID NO: 2936598 - RNA, 23 nt, Mycobacterium avium subsp. paratuberculosis
cgcggccgcccgguccgggucgc

SEQ ID NO: 2936599 - RNA, 13 nt, Mycobacterium avium subsp. paratuberculosis
cgcggccgcccgu

SEQ ID NO: 2936600 - RNA, 11 nt, Mycobacterium avium subsp. paratuberculosis
cgcggccgccg

SEQ ID NO: 2936601 - RNA, 13 nt, Mycobacterium avium subsp. paratuberculosis
cgcggccgccgcc

SEQ ID NO: 2936602 - RNA, 15 nt, Mycobacterium avium subsp. paratuberculosis
cgcggccgccgccgc

SEQ ID NO: 2936603 - RNA, 14 nt, Mycobacterium avium subsp. paratuberculosis
cgcggccgccgcga

SEQ ID NO: 2936604 - RNA, 17 nt, Mycobacterium avium subsp. paratuberculosis
cgcggccgccgcgacgg

SEQ ID NO: 2936605 - RNA, 20 nt, Mycobacterium avium subsp. paratuberculosis
cgcggccgccgcgacggccg

SEQ ID NO: 2936606 - RNA, 12 nt, Mycobacterium avium subsp. paratuberculosis
cgcggccgccgg

SEQ ID NO: 2936607 - RNA, 15 nt, Mycobacterium avium subsp. paratuberculosis
cgcggccgccggggc

SEQ ID NO: 2936608 - RNA, 16 nt, Mycobacterium avium subsp. paratuberculosis
cgcggccgccggggcc

SEQ ID NO: 2936609 - RNA, 18 nt, Mycobacterium avium subsp. paratuberculosis
cgcggccgccucccgcag

SEQ ID NO: 2936610 - RNA, 14 nt, Mycobacterium avium subsp. paratuberculosis
cgcggccgccuccg

SEQ ID NO: 2936611 - RNA, 14 nt, Mycobacterium avium subsp. paratuberculosis
cgcggccgcgacgg

SEQ ID NO: 2936612 - RNA, 15 nt, Mycobacterium avium subsp. paratuberculosis
cgcggccgcgacugc

SEQ ID NO: 2936613 - RNA, 17 nt, Mycobacterium avium subsp. paratuberculosis
cgcggccgcgacugcag

SEQ ID NO: 2936614 - RNA, 21 nt, Mycobacterium avium subsp. paratuberculosis
cgcggccgcgacugcagguga

SEQ ID NO: 2936615 - RNA, 13 nt, Mycobacterium avium subsp. paratuberculosis
cgcggccgcgccg

SEQ ID NO: 2936616 - RNA, 14 nt, Mycobacterium avium subsp. paratuberculosis
cgcggccgcgccgg

SEQ ID NO: 2936617 - RNA, 13 nt, Mycobacterium avium subsp. paratuberculosis
cgcggccgcgcgc

SEQ ID NO: 2936618 - RNA, 12 nt, Mycobacterium avium subsp. paratuberculosis
cgcggccgcggc

SEQ ID NO: 2936619 - RNA, 16 nt, Mycobacterium avium subsp. paratuberculosis
cgcggccgcggcgcgc

SEQ ID NO: 2936620 - RNA, 15 nt, Mycobacterium avium subsp. paratuberculosis
cgcggccgcggcggg

SEQ ID NO: 2936621 - RNA, 17 nt, Mycobacterium avium subsp. paratuberculosis
cgcggccgcggcgggcg

SEQ ID NO: 2936622 - RNA, 15 nt, Mycobacterium avium subsp. paratuberculosis
cgcggccgcgucggc

SEQ ID NO: 2936623 - RNA, 16 nt, Mycobacterium avium subsp. paratuberculosis
cgcggccgcgucggcg

SEQ ID NO: 2936624 - RNA, 19 nt, Mycobacterium avium subsp. paratuberculosis
cgcggccgcgucggcggcg

SEQ ID NO: 2936625 - RNA, 19 nt, Mycobacterium avium subsp. paratuberculosis
cgcggccgcguugucgacc

SEQ ID NO: 2936626 - RNA, 17 nt, Mycobacterium avium subsp. paratuberculosis
cgcggccgcugcgccca

SEQ ID NO: 2936627 - RNA, 19 nt, Mycobacterium avium subsp. paratuberculosis
cgcggccgcugcgcccagc

SEQ ID NO: 2936628 - RNA, 12 nt, Mycobacterium avium subsp. paratuberculosis
cgcggccgcugg

SEQ ID NO: 2936629 - RNA, 15 nt, Mycobacterium avium subsp. paratuberculosis
cgcggccgcuggcgu

SEQ ID NO: 2936630 - RNA, 22 nt, Mycobacterium avium subsp. paratuberculosis
cgcggccggaagaccguugacg

SEQ ID NO: 2936631 - RNA, 22 nt, Mycobacterium avium subsp. paratuberculosis
cgcggccggaucgaauccggcg

SEQ ID NO: 2936632 - RNA, 14 nt, Mycobacterium avium subsp. paratuberculosis
cgcggccggcacua

SEQ ID NO: 2936633 - RNA, 20 nt, Mycobacterium avium subsp. paratuberculosis
cgcggccggcacuaccgccu

SEQ ID NO: 2936634 - RNA, 12 nt, Mycobacterium avium subsp. paratuberculosis
cgcggccggcca

SEQ ID NO: 2936635 - RNA, 18 nt, Mycobacterium avium subsp. paratuberculosis
cgcggccggccacgcucg

SEQ ID NO: 2936636 - RNA, 21 nt, Mycobacterium avium subsp. paratuberculosis
cgcggccggccacgcucggcg

SEQ ID NO: 2936637 - RNA, 16 nt, Mycobacterium avium subsp. paratuberculosis
cgcggccggccgacac

SEQ ID NO: 2936638 - RNA, 19 nt, Mycobacterium avium subsp. paratuberculosis
cgcggcgagcagcgcgaug

SEQ ID NO: 2936639 - RNA, 21 nt, Mycobacterium avium subsp. paratuberculosis
cgcggcgagcagcgcgaugcc

SEQ ID NO: 2936640 - RNA, 12 nt, Mycobacterium avium subsp. paratuberculosis
cgcggcgagccg

SEQ ID NO: 2936641 - RNA, 13 nt, Mycobacterium avium subsp. paratuberculosis
cgcggcgagccgg

SEQ ID NO: 2936642 - RNA, 12 nt, Mycobacterium avium subsp. paratuberculosis
cgcggcgagcgc

SEQ ID NO: 2936643 - RNA, 14 nt, Mycobacterium avium subsp. paratuberculosis
cgcggcgagcgcgu

SEQ ID NO: 2936644 - RNA, 16 nt, Mycobacterium avium subsp. paratuberculosis
cgcggcgagcgcguuc

SEQ ID NO: 2936645 - RNA, 19 nt, Mycobacterium avium subsp. paratuberculosis
cgcggcgagcgcguucucc

SEQ ID NO: 2936646 - RNA, 13 nt, Mycobacterium avium subsp. paratuberculosis
cgcggcgagcgcu

SEQ ID NO: 2936647 - RNA, 13 nt, Mycobacterium avium subsp. paratuberculosis
cgcggcgagcggc

SEQ ID NO: 2936648 - RNA, 12 nt, Mycobacterium avium subsp. paratuberculosis
cgcggcgaucag

SEQ ID NO: 2936649 - RNA, 13 nt, Mycobacterium avium subsp. paratuberculosis
cgcggcgaucagc

SEQ ID NO: 2936650 - RNA, 16 nt, Mycobacterium avium subsp. paratuberculosis
cgcggcgaucagcagc

SEQ ID NO: 2936651 - RNA, 18 nt, Mycobacterium avium subsp. paratuberculosis
cgcggcgaucagcagcac

SEQ ID NO: 2936652 - RNA, 21 nt, Mycobacterium avium subsp. paratuberculosis
cgcggcgaucagcagcacccg

SEQ ID NO: 2936653 - RNA, 23 nt, Mycobacterium avium subsp. paratuberculosis
cgcggcgaucagcagcacccggg

SEQ ID NO: 2936654 - RNA, 15 nt, Mycobacterium avium subsp. paratuberculosis
cgcggcgaucagccc

SEQ ID NO: 2936655 - RNA, 16 nt, Mycobacterium avium subsp. paratuberculosis
cgcggcgaucagcccg

SEQ ID NO: 2936656 - RNA, 20 nt, Mycobacterium avium subsp. paratuberculosis
cgcggcgaucagcccggccc

SEQ ID NO: 2936657 - RNA, 23 nt, Mycobacterium avium subsp. paratuberculosis
cgcggcgaucagcccggcccgca

SEQ ID NO: 2936658 - RNA, 18 nt, Mycobacterium avium subsp. paratuberculosis
cgcggcgaucagcugcuc

SEQ ID NO: 2936659 - RNA, 14 nt, Mycobacterium avium subsp. paratuberculosis
cgcggcgaucgccg

SEQ ID NO: 2936660 - RNA, 17 nt, Mycobacterium avium subsp. paratuberculosis
cgcggcgaucgccgugg

SEQ ID NO: 2936661 - RNA, 18 nt, Mycobacterium avium subsp. paratuberculosis
cgcggcgaucgccguggu

SEQ ID NO: 2936662 - RNA, 19 nt, Mycobacterium avium subsp. paratuberculosis
cgcggcgaucgcgagcagg

SEQ ID NO: 2936663 - RNA, 22 nt, Mycobacterium avium subsp. paratuberculosis
cgcggcgaucggcgguccgccg

SEQ ID NO: 2936664 - RNA, 16 nt, Mycobacterium avium subsp. paratuberculosis
cgcggcgaucggguca

SEQ ID NO: 2936665 - RNA, 20 nt, Mycobacterium avium subsp. paratuberculosis
cgcggcgaucgggucaccgg

SEQ ID NO: 2936666 - RNA, 14 nt, Mycobacterium avium subsp. paratuberculosis
cgcggcgaucucgg

SEQ ID NO: 2936667 - RNA, 19 nt, Mycobacterium avium subsp. paratuberculosis
cgcggcgaucucggcggcc

SEQ ID NO: 2936668 - RNA, 23 nt, Mycobacterium avium subsp. paratuberculosis
cgcggcgaucuugucccgcaugg

SEQ ID NO: 2936669 - RNA, 21 nt, Mycobacterium avium subsp. paratuberculosis
cgcggcgaucuuugcggccgu

SEQ ID NO: 2936670 - RNA, 22 nt, Mycobacterium avium subsp. paratuberculosis
cgcggcgaucuuugcggccgug

SEQ ID NO: 2936671 - RNA, 17 nt, Mycobacterium avium subsp. paratuberculosis
cgcggcgaugaccgccu

SEQ ID NO: 2936672 - RNA, 17 nt, Mycobacterium avium subsp. paratuberculosis
cgcggcgaugaccggac

SEQ ID NO: 2936673 - RNA, 16 nt, Mycobacterium avium subsp. paratuberculosis
cgcggcgaugauccgc

SEQ ID NO: 2936674 - RNA, 17 nt, Mycobacterium avium subsp. paratuberculosis
cgcggcgaugauccgcg

SEQ ID NO: 2936675 - RNA, 18 nt, Mycobacterium avium subsp. paratuberculosis
cgcggcgaugauccgcgg

SEQ ID NO: 2936676 - RNA, 18 nt, Mycobacterium avium subsp. paratuberculosis
cgcggcgauggacgucca

SEQ ID NO: 2936677 - RNA, 13 nt, Mycobacterium avium subsp. paratuberculosis
cgcggcgauggug

SEQ ID NO: 2936678 - RNA, 21 nt, Mycobacterium avium subsp. paratuberculosis
cgcggcgauggugggcagccg

SEQ ID NO: 2936679 - RNA, 22 nt, Mycobacterium avium subsp. paratuberculosis
cgcggcgauggugggcagccgg

SEQ ID NO: 2936680 - RNA, 18 nt, Mycobacterium avium subsp. paratuberculosis
cgcggcgcacccgggcag

SEQ ID NO: 2936681 - RNA, 19 nt, Mycobacterium avium subsp. paratuberculosis
cgcggcgcacccgggcagc

SEQ ID NO: 2936682 - RNA, 20 nt, Mycobacterium avium subsp. paratuberculosis
cgcggcgcacccgggcagcu

SEQ ID NO: 2936683 - RNA, 14 nt, Mycobacterium avium subsp. paratuberculosis
cgcggcgcaccgag

SEQ ID NO: 2936684 - RNA, 21 nt, Mycobacterium avium subsp. paratuberculosis
cgcggcgcaccgcccgcggug

SEQ ID NO: 2936685 - RNA, 13 nt, Mycobacterium avium subsp. paratuberculosis
cgcggcgcacggu

SEQ ID NO: 2936686 - RNA, 15 nt, Mycobacterium avium subsp. paratuberculosis
cgcggcgcacggugc

SEQ ID NO: 2936687 - RNA, 20 nt, Mycobacterium avium subsp. paratuberculosis
cgcggcgcacguggcugacc

SEQ ID NO: 2936688 - RNA, 14 nt, Mycobacterium avium subsp. paratuberculosis
cgcggcgcagcgcg

SEQ ID NO: 2936689 - RNA, 15 nt, Mycobacterium avium subsp. paratuberculosis
cgcggcgcagcgcga

SEQ ID NO: 2936690 - RNA, 20 nt, Mycobacterium avium subsp. paratuberculosis
cgcggcgcagggcggccggc

SEQ ID NO: 2936691 - RNA, 21 nt, Mycobacterium avium subsp. paratuberculosis
cgcggcgcagggcggccggcc

SEQ ID NO: 2936692 - RNA, 22 nt, Mycobacterium avium subsp. paratuberculosis
cgcggcgcagggcggccggcca

SEQ ID NO: 2936693 - RNA, 23 nt, Mycobacterium avium subsp. paratuberculosis
cgcggcgcagggcggccggccag

SEQ ID NO: 2936694 - RNA, 14 nt, Mycobacterium avium subsp. paratuberculosis
cgcggcgcaggucc

SEQ ID NO: 2936695 - RNA, 15 nt, Mycobacterium avium subsp. paratuberculosis
cgcggcgcagguccg

SEQ ID NO: 2936696 - RNA, 19 nt, Mycobacterium avium subsp. paratuberculosis
cgcggcgcagguccggcag

SEQ ID NO: 2936697 - RNA, 22 nt, Mycobacterium avium subsp. paratuberculosis
cgcggcgcagguccggcagcgc

SEQ ID NO: 2936698 - RNA, 15 nt, Mycobacterium avium subsp. paratuberculosis
cgcggcgccagcggc

SEQ ID NO: 2936699 - RNA, 16 nt, Mycobacterium avium subsp. paratuberculosis
cgcggcgccagcggcc

SEQ ID NO: 2936700 - RNA, 17 nt, Mycobacterium avium subsp. paratuberculosis
cgcggcgccagcggccg

SEQ ID NO: 2936701 - RNA, 18 nt, Mycobacterium avium subsp. paratuberculosis
cgcggcgccagcggccga

SEQ ID NO: 2936702 - RNA, 20 nt, Mycobacterium avium subsp. paratuberculosis
cgcggcgccagcggccgauc

SEQ ID NO: 2936703 - RNA, 19 nt, Mycobacterium avium subsp. paratuberculosis
cgcggcgcccccgcgacgu

SEQ ID NO: 2936704 - RNA, 22 nt, Mycobacterium avium subsp. paratuberculosis
cgcggcgcccccgcgacgucca

SEQ ID NO: 2936705 - RNA, 13 nt, Mycobacterium avium subsp. paratuberculosis
cgcggcgcccgga

SEQ ID NO: 2936706 - RNA, 13 nt, Mycobacterium avium subsp. paratuberculosis
cgcggcgcccggc

SEQ ID NO: 2936707 - RNA, 14 nt, Mycobacterium avium subsp. paratuberculosis
cgcggcgcccggcg

SEQ ID NO: 2936708 - RNA, 23 nt, Mycobacterium avium subsp. paratuberculosis
cgcggcgcccggcgcccggcgcg

SEQ ID NO: 2936709 - RNA, 18 nt, Mycobacterium avium subsp. paratuberculosis
cgcggcgcccucgccggc

SEQ ID NO: 2936710 - RNA, 22 nt, Mycobacterium avium subsp. paratuberculosis
cgcggcgcccucgccggcggcg

SEQ ID NO: 2936711 - RNA, 13 nt, Mycobacterium avium subsp. paratuberculosis
cgcggcgccgacg

SEQ ID NO: 2936712 - RNA, 15 nt, Mycobacterium avium subsp. paratuberculosis
cgcggcgccgauggc

SEQ ID NO: 2936713 - RNA, 14 nt, Mycobacterium avium subsp. paratuberculosis
cgcggcgccgcggc

SEQ ID NO: 2936714 - RNA, 16 nt, Mycobacterium avium subsp. paratuberculosis
cgcggcgccgcggcgg

SEQ ID NO: 2936715 - RNA, 19 nt, Mycobacterium avium subsp. paratuberculosis
cgcggcgccgcggcggcac

SEQ ID NO: 2936716 - RNA, 19 nt, Mycobacterium avium subsp. paratuberculosis
cgcggcgccgcguaccagc

SEQ ID NO: 2936717 - RNA, 22 nt, Mycobacterium avium subsp. paratuberculosis
cgcggcgccgcguaccagcgcc

SEQ ID NO: 2936718 - RNA, 20 nt, Mycobacterium avium subsp. paratuberculosis
cgcggcgccggaugggcgca

SEQ ID NO: 2936719 - RNA, 12 nt, Mycobacterium avium subsp. paratuberculosis
cgcggcgccggg

SEQ ID NO: 2936720 - RNA, 13 nt, Mycobacterium avium subsp. paratuberculosis
cgcggcgccgggc

SEQ ID NO: 2936721 - RNA, 12 nt, Mycobacterium avium subsp. paratuberculosis
cgcggcgccggu

SEQ ID NO: 2936722 - RNA, 14 nt, Mycobacterium avium subsp. paratuberculosis
cgcggcgccggugc

SEQ ID NO: 2936723 - RNA, 16 nt, Mycobacterium avium subsp. paratuberculosis
cgcggcggcgccgcgg

SEQ ID NO: 2936724 - RNA, 14 nt, Mycobacterium avium subsp. paratuberculosis
cgcggcggcgccgu

SEQ ID NO: 2936725 - RNA, 12 nt, Mycobacterium avium subsp. paratuberculosis
cgcggcggcgcu

SEQ ID NO: 2936726 - RNA, 20 nt, Mycobacterium avium subsp. paratuberculosis
cgcggcggcgcuggucggcg

SEQ ID NO: 2936727 - RNA, 13 nt, Mycobacterium avium subsp. paratuberculosis
cgcggcggcggcg

SEQ ID NO: 2936728 - RNA, 22 nt, Mycobacterium avium subsp. paratuberculosis
cgcggcggcggcgcgggcgccc

SEQ ID NO: 2936729 - RNA, 13 nt, Mycobacterium avium subsp. paratuberculosis
cgcggcggcggug

SEQ ID NO: 2936730 - RNA, 14 nt, Mycobacterium avium subsp. paratuberculosis
cgcggcggcggugc

SEQ ID NO: 2936731 - RNA, 15 nt, Mycobacterium avium subsp. paratuberculosis
cgcggcggcggugcu

SEQ ID NO: 2936732 - RNA, 20 nt, Mycobacterium avium subsp. paratuberculosis
cgcggcggcguccgcggccg

SEQ ID NO: 2936733 - RNA, 13 nt, Mycobacterium avium subsp. paratuberculosis
cgcggcggcgucg

SEQ ID NO: 2936734 - RNA, 15 nt, Mycobacterium avium subsp. paratuberculosis
cgcggcggcgucgac

SEQ ID NO: 2936735 - RNA, 20 nt, Mycobacterium avium subsp. paratuberculosis
cgcggcggcgucgaccgccc

SEQ ID NO: 2936736 - RNA, 21 nt, Mycobacterium avium subsp. paratuberculosis
cgcggcggcgucgaccgcccc

SEQ ID NO: 2936737 - RNA, 14 nt, Mycobacterium avium subsp. paratuberculosis
cgcggcggcgucgg

SEQ ID NO: 2936738 - RNA, 13 nt, Mycobacterium avium subsp. paratuberculosis
cgcggcggcgugc

SEQ ID NO: 2936739 - RNA, 15 nt, Mycobacterium avium subsp. paratuberculosis
cgcggcggcgugccg

SEQ ID NO: 2936740 - RNA, 19 nt, Mycobacterium avium subsp. paratuberculosis
cgcggcggcgugccgcccg

SEQ ID NO: 2936741 - RNA, 20 nt, Mycobacterium avium subsp. paratuberculosis
cgcggcggcgugccgcccgg

SEQ ID NO: 2936742 - RNA, 12 nt, Mycobacterium avium subsp. paratuberculosis
cgcggcggcucg

SEQ ID NO: 2936743 - RNA, 14 nt, Mycobacterium avium subsp. paratuberculosis
cgcggcggcucggc

SEQ ID NO: 2936744 - RNA, 23 nt, Mycobacterium avium subsp. paratuberculosis
cgcggcggcucggcggcgucgua

SEQ ID NO: 2936745 - RNA, 20 nt, Mycobacterium avium subsp. paratuberculosis
cgcggcgggaaaccaccugc

SEQ ID NO: 2936746 - RNA, 13 nt, Mycobacterium avium subsp. paratuberculosis
cgcggcgggcagg

SEQ ID NO: 2936747 - RNA, 16 nt, Mycobacterium avium subsp. paratuberculosis
cgcggcgggcauaccg

SEQ ID NO: 2936748 - RNA, 18 nt, Mycobacterium avium subsp. paratuberculosis
cgcggcgggcauaccguc

SEQ ID NO: 2936749 - RNA, 23 nt, Mycobacterium avium subsp. paratuberculosis
cgcggcgggccagucgccgcgca

SEQ ID NO: 2936750 - RNA, 12 nt, Mycobacterium avium subsp. paratuberculosis
cgcggcgggccc

SEQ ID NO: 2936751 - RNA, 14 nt, Mycobacterium avium subsp. paratuberculosis
cgcggcgggcccgc

SEQ ID NO: 2936752 - RNA, 23 nt, Mycobacterium avium subsp. paratuberculosis
cgcggcgggccuugagcaccgcg

SEQ ID NO: 2936753 - RNA, 20 nt, Mycobacterium avium subsp. paratuberculosis
cgcggcgggcgagccgaagc

SEQ ID NO: 2936754 - RNA, 12 nt, Mycobacterium avium subsp. paratuberculosis
cgcggcgggcgc

SEQ ID NO: 2936755 - RNA, 13 nt, Mycobacterium avium subsp. paratuberculosis
cgcggcgggcgcg

SEQ ID NO: 2936756 - RNA, 15 nt, Mycobacterium avium subsp. paratuberculosis
cgcggcgggcgcguc

SEQ ID NO: 2936757 - RNA, 12 nt, Mycobacterium avium subsp. paratuberculosis
cgcggcgggcgu

SEQ ID NO: 2936758 - RNA, 15 nt, Mycobacterium avium subsp. paratuberculosis
cgcggcgggggucgg

SEQ ID NO: 2936759 - RNA, 19 nt, Mycobacterium avium subsp. paratuberculosis
cgcggcgggguccacgcag

SEQ ID NO: 2936760 - RNA, 19 nt, Mycobacterium avium subsp. paratuberculosis
cgcggcggucacgcccggg

SEQ ID NO: 2936761 - RNA, 20 nt, Mycobacterium avium subsp. paratuberculosis
cgcggcggucacgcccgggu

SEQ ID NO: 2936762 - RNA, 23 nt, Mycobacterium avium subsp. paratuberculosis
cgcggcggucagguucgccacga

SEQ ID NO: 2936763 - RNA, 13 nt, Mycobacterium avium subsp. paratuberculosis
cgcggcgguccag

SEQ ID NO: 2936764 - RNA, 19 nt, Mycobacterium avium subsp. paratuberculosis
cgcggcgguccagcgagcc

SEQ ID NO: 2936765 - RNA, 14 nt, Mycobacterium avium subsp. paratuberculosis
cgcggcggucgcgc

SEQ ID NO: 2936766 - RNA, 15 nt, Mycobacterium avium subsp. paratuberculosis
cgcggcggucgcgcg

SEQ ID NO: 2936767 - RNA, 17 nt, Mycobacterium avium subsp. paratuberculosis
cgcggcggucgcgcgcc

SEQ ID NO: 2936768 - RNA, 18 nt, Mycobacterium avium subsp. paratuberculosis
cgcggcggucgcgcgccg

SEQ ID NO: 2936769 - RNA, 20 nt, Mycobacterium avium subsp. paratuberculosis
cgcggcggucgcgcgccggc

SEQ ID NO: 2936770 - RNA, 24 nt, Mycobacterium avium subsp. paratuberculosis
cgcggcggucgcgcgccggcgcag

SEQ ID NO: 2936771 - RNA, 21 nt, Mycobacterium avium subsp. paratuberculosis
cgcggcggugacgaacccgcc

SEQ ID NO: 2936772 - RNA, 17 nt, Mycobacterium avium subsp. paratuberculosis
cgcggcggugagccgcc

SEQ ID NO: 2936773 - RNA, 18 nt, Mycobacterium avium subsp. paratuberculosis
cgcggcggugagccgcca

SEQ ID NO: 2936774 - RNA, 23 nt, Mycobacterium avium subsp. paratuberculosis
cgcggcggugagccgccacagcg

SEQ ID NO: 2936775 - RNA, 14 nt, Mycobacterium avium subsp. paratuberculosis
cgcggcggugccgg

SEQ ID NO: 2936776 - RNA, 15 nt, Mycobacterium avium subsp. paratuberculosis
cgcggcggugccggu

SEQ ID NO: 2936777 - RNA, 20 nt, Mycobacterium avium subsp. paratuberculosis
cgcggcggugcgcagccgcu

SEQ ID NO: 2936778 - RNA, 16 nt, Mycobacterium avium subsp. paratuberculosis
cgcggcggugcucgcg

SEQ ID NO: 2936779 - RNA, 20 nt, Mycobacterium avium subsp. paratuberculosis
cgcggcggugcucgcgccgg

SEQ ID NO: 2936780 - RNA, 23 nt, Mycobacterium avium subsp. paratuberculosis
cgcggcgguggccugcccggcgg

SEQ ID NO: 2936781 - RNA, 16 nt, Mycobacterium avium subsp. paratuberculosis
cgcggcggugucggcg

SEQ ID NO: 2936782 - RNA, 13 nt, Mycobacterium avium subsp. paratuberculosis
cgcggcguagccg

SEQ ID NO: 2936783 - RNA, 18 nt, Mycobacterium avium subsp. paratuberculosis
cgcggcguagccgccggu

SEQ ID NO: 2936784 - RNA, 21 nt, Mycobacterium avium subsp. paratuberculosis
cgcggcguagcgccagucgcg

SEQ ID NO: 2936785 - RNA, 24 nt, Mycobacterium avium subsp. paratuberculosis
cgcggcguagcgccagucgcggcg

SEQ ID NO: 2936786 - RNA, 15 nt, Mycobacterium avium subsp. paratuberculosis
cgcggcguaggcggc

SEQ ID NO: 2936787 - RNA, 17 nt, Mycobacterium avium subsp. paratuberculosis
cgcggcguaggcggcca

SEQ ID NO: 2936788 - RNA, 19 nt, Mycobacterium avium subsp. paratuberculosis
cgcggcguaggugggcagc

SEQ ID NO: 2936789 - RNA, 22 nt, Mycobacterium avium subsp. paratuberculosis
cgcggcguaggugggcagcgcg

SEQ ID NO: 2936790 - RNA, 23 nt, Mycobacterium avium subsp. paratuberculosis
cgcggcguaggugggcagcgcgg

SEQ ID NO: 2936791 - RNA, 13 nt, Mycobacterium avium subsp. paratuberculosis
cgcggcguccacc

SEQ ID NO: 2936792 - RNA, 20 nt, Mycobacterium avium subsp. paratuberculosis
cgcggcguccaccagcacgc

SEQ ID NO: 2936793 - RNA, 20 nt, Mycobacterium avium subsp. paratuberculosis
cgcggcgucccggguaccuc

SEQ ID NO: 2936794 - RNA, 23 nt, Mycobacterium avium subsp. paratuberculosis
cgcggcguccucgaugacgccgg

SEQ ID NO: 2936795 - RNA, 14 nt, Mycobacterium avium subsp. paratuberculosis
cgcggcgucgcggu

SEQ ID NO: 2936796 - RNA, 15 nt, Mycobacterium avium subsp. paratuberculosis
cgcggcgucggccgg

SEQ ID NO: 2936797 - RNA, 19 nt, Mycobacterium avium subsp. paratuberculosis
cgcggcgucggccgggcug

SEQ ID NO: 2936798 - RNA, 22 nt, Mycobacterium avium subsp. paratuberculosis
cgcggcgucggccgggcugccc

SEQ ID NO: 2936799 - RNA, 14 nt, Mycobacterium avium subsp. paratuberculosis
cgcggcgucggccu

SEQ ID NO: 2936800 - RNA, 12 nt, Mycobacterium avium subsp. paratuberculosis
cgcggcgucggg

SEQ ID NO: 2936801 - RNA, 13 nt, Mycobacterium avium subsp. paratuberculosis
cgcggcgucggga

SEQ ID NO: 2936802 - RNA, 14 nt, Mycobacterium avium subsp. paratuberculosis
cgcggcgucgggau

SEQ ID NO: 2936803 - RNA, 14 nt, Mycobacterium avium subsp. paratuberculosis
cgcggcgucgggcg

SEQ ID NO: 2936804 - RNA, 13 nt, Mycobacterium avium subsp. paratuberculosis
cgcggcgucgggu

SEQ ID NO: 2936805 - RNA, 23 nt, Mycobacterium avium subsp. paratuberculosis
cgcggcgucggguagggcgccgu

SEQ ID NO: 2936806 - RNA, 16 nt, Mycobacterium avium subsp. paratuberculosis
cgcggcguggacgucg

SEQ ID NO: 2936807 - RNA, 15 nt, Mycobacterium avium subsp. paratuberculosis
cgcggcgugguagcc

SEQ ID NO: 2936808 - RNA, 18 nt, Mycobacterium avium subsp. paratuberculosis
cgcgggaguccacgccgu

SEQ ID NO: 2936809 - RNA, 16 nt, Mycobacterium avium subsp. paratuberculosis
cgcgggaguggccggc

SEQ ID NO: 2936810 - RNA, 13 nt, Mycobacterium avium subsp. paratuberculosis
cgcgggaucagcg

SEQ ID NO: 2936811 - RNA, 13 nt, Mycobacterium avium subsp. paratuberculosis
cgcgggaucggcc

SEQ ID NO: 2936812 - RNA, 16 nt, Mycobacterium avium subsp. paratuberculosis
cgcgggaucggccggc

SEQ ID NO: 2936813 - RNA, 19 nt, Mycobacterium avium subsp. paratuberculosis
cgcgggaucggccggcgag

SEQ ID NO: 2936814 - RNA, 18 nt, Mycobacterium avium subsp. paratuberculosis
cgcgggaucggugccgac

SEQ ID NO: 2936815 - RNA, 20 nt, Mycobacterium avium subsp. paratuberculosis
cgcgggaucggugccgacgg

SEQ ID NO: 2936816 - RNA, 23 nt, Mycobacterium avium subsp. paratuberculosis
cgcgggaucggugccgacggugc

SEQ ID NO: 2936817 - RNA, 18 nt, Mycobacterium avium subsp. paratuberculosis
cgcgggauugccgagcac

SEQ ID NO: 2936818 - RNA, 13 nt, Mycobacterium avium subsp. paratuberculosis
cgcgggcaagggc

SEQ ID NO: 2936819 - RNA, 20 nt, Mycobacterium avium subsp. paratuberculosis
cgcgggcaaucgcugcgccc

SEQ ID NO: 2936820 - RNA, 16 nt, Mycobacterium avium subsp. paratuberculosis
cgcgggcaccgucguc

SEQ ID NO: 2936821 - RNA, 18 nt, Mycobacterium avium subsp. paratuberculosis
cgcgggcaccgucgucgc

SEQ ID NO: 2936822 - RNA, 20 nt, Mycobacterium avium subsp. paratuberculosis
cgcgggcaccgucgucgcac

SEQ ID NO: 2936823 - RNA, 23 nt, Mycobacterium avium subsp. paratuberculosis
cgcgggcaccgucgucgcaccgg

SEQ ID NO: 2936824 - RNA, 12 nt, Mycobacterium avium subsp. paratuberculosis
cgcgggcagcag

SEQ ID NO: 2936825 - RNA, 13 nt, Mycobacterium avium subsp. paratuberculosis
cgcgggcagccgg

SEQ ID NO: 2936826 - RNA, 15 nt, Mycobacterium avium subsp. paratuberculosis
cgcgggcagccggcg

SEQ ID NO: 2936827 - RNA, 22 nt, Mycobacterium avium subsp. paratuberculosis
cgcgggcagccggcgcccgcag

SEQ ID NO: 2936828 - RNA, 14 nt, Mycobacterium avium subsp. paratuberculosis
cgcgggcagcgagc

SEQ ID NO: 2936829 - RNA, 19 nt, Mycobacterium avium subsp. paratuberculosis
cgcgggcagcgagcacagc

SEQ ID NO: 2936830 - RNA, 23 nt, Mycobacterium avium subsp. paratuberculosis
cgcgggcagggggacgaaccagu

SEQ ID NO: 2936831 - RNA, 14 nt, Mycobacterium avium subsp. paratuberculosis
cgcgggcaucgccg

SEQ ID NO: 2936832 - RNA, 16 nt, Mycobacterium avium subsp. paratuberculosis
cgcgggcaucgccguc

SEQ ID NO: 2936833 - RNA, 22 nt, Mycobacterium avium subsp. paratuberculosis
cgcgggcaucgccgucauggug

SEQ ID NO: 2936834 - RNA, 21 nt, Mycobacterium avium subsp. paratuberculosis
cgcgggcaugaaccaggccgc

SEQ ID NO: 2936835 - RNA, 23 nt, Mycobacterium avium subsp. paratuberculosis
cgcgggcaugaaccaggccgcgc

SEQ ID NO: 2936836 - RNA, 13 nt, Mycobacterium avium subsp. paratuberculosis
cgcgggccacagc

SEQ ID NO: 2936837 - RNA, 20 nt, Mycobacterium avium subsp. paratuberculosis
cgcgggccacagcggcgaca

SEQ ID NO: 2936838 - RNA, 14 nt, Mycobacterium avium subsp. paratuberculosis
cgcgggccaccggc

SEQ ID NO: 2936839 - RNA, 12 nt, Mycobacterium avium subsp. paratuberculosis
cgcgggccagac

SEQ ID NO: 2936840 - RNA, 13 nt, Mycobacterium avium subsp. paratuberculosis
cgcgggccagcca

SEQ ID NO: 2936841 - RNA, 16 nt, Mycobacterium avium subsp. paratuberculosis
cgcgggccagccaggu

SEQ ID NO: 2936842 - RNA, 16 nt, Mycobacterium avium subsp. paratuberculosis
cgcgggcccaccgcca

SEQ ID NO: 2936843 - RNA, 19 nt, Mycobacterium avium subsp. paratuberculosis
cgcgggcccaccgccacca

SEQ ID NO: 2936844 - RNA, 22 nt, Mycobacterium avium subsp. paratuberculosis
cgcgggcccgccguagcgccgg

SEQ ID NO: 2936845 - RNA, 14 nt, Mycobacterium avium subsp. paratuberculosis
cgcgggcccgcgcg

SEQ ID NO: 2936846 - RNA, 16 nt, Mycobacterium avium subsp. paratuberculosis
cgcgggcccgcgcggc

SEQ ID NO: 2936847 - RNA, 20 nt, Mycobacterium avium subsp. paratuberculosis
cgcgggcccgcgcggcggug

SEQ ID NO: 2936848 - RNA, 17 nt, Mycobacterium avium subsp. paratuberculosis
cgcgggcccgcguaacc

SEQ ID NO: 2936849 - RNA, 15 nt, Mycobacterium avium subsp. paratuberculosis
cgcgggcccgggcca

SEQ ID NO: 2936850 - RNA, 16 nt, Mycobacterium avium subsp. paratuberculosis
cgcgggcccgggccac

SEQ ID NO: 2936851 - RNA, 14 nt, Mycobacterium avium subsp. paratuberculosis
cgcgggccgcagcg

SEQ ID NO: 2936852 - RNA, 16 nt, Mycobacterium avium subsp. paratuberculosis
cgcgggccgcagcgcg

SEQ ID NO: 2936853 - RNA, 18 nt, Mycobacterium avium subsp. paratuberculosis
cgcgggccgcagcgcgcg

SEQ ID NO: 2936854 - RNA, 15 nt, Mycobacterium avium subsp. paratuberculosis
cgcgggccggcaccc

SEQ ID NO: 2936855 - RNA, 17 nt, Mycobacterium avium subsp. paratuberculosis
cgcgggccggcacccgg

SEQ ID NO: 2936856 - RNA, 17 nt, Mycobacterium avium subsp. paratuberculosis
cgcgggccugcucgucg

SEQ ID NO: 2936857 - RNA, 23 nt, Mycobacterium avium subsp. paratuberculosis
cgcgggccugcucgucggggcag

SEQ ID NO: 2936858 - RNA, 22 nt, Mycobacterium avium subsp. paratuberculosis
cgcgggccugggcaauggccgc

SEQ ID NO: 2936859 - RNA, 15 nt, Mycobacterium avium subsp. paratuberculosis
cgcgggcgaaaucuc

SEQ ID NO: 2936860 - RNA, 14 nt, Mycobacterium avium subsp. paratuberculosis
cgcgggcgacccgc

SEQ ID NO: 2936861 - RNA, 19 nt, Mycobacterium avium subsp. paratuberculosis
cgcgggcgacccgcuggaa

SEQ ID NO: 2936862 - RNA, 18 nt, Mycobacterium avium subsp. paratuberculosis
cgcgggcgaccugcgggc

SEQ ID NO: 2936863 - RNA, 21 nt, Mycobacterium avium subsp. paratuberculosis
cgcgggcgaccugcgggccca

SEQ ID NO: 2936864 - RNA, 15 nt, Mycobacterium avium subsp. paratuberculosis
cgcgggcgaccuggu

SEQ ID NO: 2936865 - RNA, 18 nt, Mycobacterium avium subsp. paratuberculosis
cgcgggcgaccuggugcu

SEQ ID NO: 2936866 - RNA, 14 nt, Mycobacterium avium subsp. paratuberculosis
cgcgggcgagcagc

SEQ ID NO: 2936867 - RNA, 12 nt, Mycobacterium avium subsp. paratuberculosis
cgcgggcgaucu

SEQ ID NO: 2936868 - RNA, 21 nt, Mycobacterium avium subsp. paratuberculosis
cgcgggcgaucuccagcggcc

SEQ ID NO: 2936869 - RNA, 22 nt, Mycobacterium avium subsp. paratuberculosis
cgcgggcgaucuccagcggccg

SEQ ID NO: 2936870 - RNA, 13 nt, Mycobacterium avium subsp. paratuberculosis
cgcgggcgaugcg

SEQ ID NO: 2936871 - RNA, 22 nt, Mycobacterium avium subsp. paratuberculosis
cgcgggcgaugcggcccggcca

SEQ ID NO: 2936872 - RNA, 19 nt, Mycobacterium avium subsp. paratuberculosis
cgcgggcgauuucgucggc

SEQ ID NO: 2936873 - RNA, 20 nt, Mycobacterium avium subsp. paratuberculosis
cgcgggcgauuucgucggcg

SEQ ID NO: 2936874 - RNA, 22 nt, Mycobacterium avium subsp. paratuberculosis
cgcgggcgauuucgucggcggu

SEQ ID NO: 2936875 - RNA, 23 nt, Mycobacterium avium subsp. paratuberculosis
cgcgggcgauuucgucggcggug

SEQ ID NO: 2936876 - RNA, 19 nt, Mycobacterium avium subsp. paratuberculosis
cgcgggcgcauaccagcgc

SEQ ID NO: 2936877 - RNA, 12 nt, Mycobacterium avium subsp. paratuberculosis
cgcgggcgccca

SEQ ID NO: 2936878 - RNA, 14 nt, Mycobacterium avium subsp. paratuberculosis
cgcgggcgcccagc

SEQ ID NO: 2936879 - RNA, 12 nt, Mycobacterium avium subsp. paratuberculosis
cgcgggcgcccg

SEQ ID NO: 2936880 - RNA, 13 nt, Mycobacterium avium subsp. paratuberculosis
cgcgggcgcccgu

SEQ ID NO: 2936881 - RNA, 15 nt, Mycobacterium avium subsp. paratuberculosis
cgcgggcgcccucca

SEQ ID NO: 2936882 - RNA, 12 nt, Mycobacterium avium subsp. paratuberculosis
cgcgggcgccga

SEQ ID NO: 2936883 - RNA, 12 nt, Mycobacterium avium subsp. paratuberculosis
cgcgggcgccgu

SEQ ID NO: 2936884 - RNA, 21 nt, Mycobacterium avium subsp. paratuberculosis
cgcgggcgccguaggccgcgc

SEQ ID NO: 2936885 - RNA, 13 nt, Mycobacterium avium subsp. paratuberculosis
cgcgggcgccguc

SEQ ID NO: 2936886 - RNA, 14 nt, Mycobacterium avium subsp. paratuberculosis
cgcgggcgccgucg

SEQ ID NO: 2936887 - RNA, 15 nt, Mycobacterium avium subsp. paratuberculosis
cgcgggcgccgucgg

SEQ ID NO: 2936888 - RNA, 19 nt, Mycobacterium avium subsp. paratuberculosis
cgcgggcgccgucggggcu

SEQ ID NO: 2936889 - RNA, 12 nt, Mycobacterium avium subsp. paratuberculosis
cgcgggcgcgcc

SEQ ID NO: 2936890 - RNA, 14 nt, Mycobacterium avium subsp. paratuberculosis
cgcgggcgcgccgu

SEQ ID NO: 2936891 - RNA, 16 nt, Mycobacterium avium subsp. paratuberculosis
cgcgggcgcgccgucc

SEQ ID NO: 2936892 - RNA, 17 nt, Mycobacterium avium subsp. paratuberculosis
cgcgggcgcgccguccc

SEQ ID NO: 2936893 - RNA, 15 nt, Mycobacterium avium subsp. paratuberculosis
cgcgggucggcgccg

SEQ ID NO: 2936894 - RNA, 17 nt, Mycobacterium avium subsp. paratuberculosis
cgcgggucggcgccggc

SEQ ID NO: 2936895 - RNA, 20 nt, Mycobacterium avium subsp. paratuberculosis
cgcgggucggcgccggccag

SEQ ID NO: 2936896 - RNA, 21 nt, Mycobacterium avium subsp. paratuberculosis
cgcgggucggcgccggccagc

SEQ ID NO: 2936897 - RNA, 24 nt, Mycobacterium avium subsp. paratuberculosis
cgcgggucggcgccggccagcggc

SEQ ID NO: 2936898 - RNA, 14 nt, Mycobacterium avium subsp. paratuberculosis
cgcgggucgucggc

SEQ ID NO: 2936899 - RNA, 16 nt, Mycobacterium avium subsp. paratuberculosis
cgcgggucgucgggcg

SEQ ID NO: 2936900 - RNA, 18 nt, Mycobacterium avium subsp. paratuberculosis
cgcgggucgucgggcggc

SEQ ID NO: 2936901 - RNA, 19 nt, Mycobacterium avium subsp. paratuberculosis
cgcgggucgucgggcggca

SEQ ID NO: 2936902 - RNA, 22 nt, Mycobacterium avium subsp. paratuberculosis
cgcgggucuggcucggcaccag

SEQ ID NO: 2936903 - RNA, 15 nt, Mycobacterium avium subsp. paratuberculosis
cgcgggugaccggcg

SEQ ID NO: 2936904 - RNA, 19 nt, Mycobacterium avium subsp. paratuberculosis
cgcgggugaccggcgccgg

SEQ ID NO: 2936905 - RNA, 19 nt, Mycobacterium avium subsp. paratuberculosis
cgcgggugacgaucaccgc

SEQ ID NO: 2936906 - RNA, 19 nt, Mycobacterium avium subsp. paratuberculosis
cgcgggugacgaucuggcg

SEQ ID NO: 2936907 - RNA, 16 nt, Mycobacterium avium subsp. paratuberculosis
cgcgggugaggggcgc

SEQ ID NO: 2936908 - RNA, 19 nt, Mycobacterium avium subsp. paratuberculosis
cgcgggugaggggcgcgcg

SEQ ID NO: 2936909 - RNA, 20 nt, Mycobacterium avium subsp. paratuberculosis
cgcgggugaggggcgcgcgc

SEQ ID NO: 2936910 - RNA, 21 nt, Mycobacterium avium subsp. paratuberculosis
cgcgggugaggggcgcgcgcc

SEQ ID NO: 2936911 - RNA, 22 nt, Mycobacterium avium subsp. paratuberculosis
cgcgggugaggggcgcgcgccg

SEQ ID NO: 2936912 - RNA, 22 nt, Mycobacterium avium subsp. paratuberculosis
cgcgggugauccggugccacgc

SEQ ID NO: 2936913 - RNA, 15 nt, Mycobacterium avium subsp. paratuberculosis
cgcgggugaucugcg

SEQ ID NO: 2936914 - RNA, 15 nt, Mycobacterium avium subsp. paratuberculosis
cgcgggugcagccgg

SEQ ID NO: 2936915 - RNA, 17 nt, Mycobacterium avium subsp. paratuberculosis
cgcgggugcgcucgacg

SEQ ID NO: 2936916 - RNA, 17 nt, Mycobacterium avium subsp. paratuberculosis
cgcgggugcggcacggc

SEQ ID NO: 2936917 - RNA, 14 nt, Mycobacterium avium subsp. paratuberculosis
cgcgggugcggccc

SEQ ID NO: 2936918 - RNA, 16 nt, Mycobacterium avium subsp. paratuberculosis
cgcgggugcggcgcug

SEQ ID NO: 2936919 - RNA, 19 nt, Mycobacterium avium subsp. paratuberculosis
cgcgggugcggcgcugccg

SEQ ID NO: 2936920 - RNA, 13 nt, Mycobacterium avium subsp. paratuberculosis
cgcgggugcgggc

SEQ ID NO: 2936921 - RNA, 15 nt, Mycobacterium avium subsp. paratuberculosis
cgcgggugcugggcg

SEQ ID NO: 2936922 - RNA, 12 nt, Mycobacterium avium subsp. paratuberculosis
cgcggguggcca

SEQ ID NO: 2936923 - RNA, 22 nt, Mycobacterium avium subsp. paratuberculosis
cgcggguggccuucaucaccgc

SEQ ID NO: 2936924 - RNA, 23 nt, Mycobacterium avium subsp. paratuberculosis
cgcggguggccuucaucaccgcc

SEQ ID NO: 2936925 - RNA, 18 nt, Mycobacterium avium subsp. paratuberculosis
cgcggguggcgccacagc

SEQ ID NO: 2936926 - RNA, 20 nt, Mycobacterium avium subsp. paratuberculosis
cgcggguggcgccacagccg

SEQ ID NO: 2936927 - RNA, 20 nt, Mycobacterium avium subsp. paratuberculosis
cgcgggugucgagccaccac

SEQ ID NO: 2936928 - RNA, 19 nt, Mycobacterium avium subsp. paratuberculosis
cgcggguguuucggucggc

SEQ ID NO: 2936929 - RNA, 20 nt, Mycobacterium avium subsp. paratuberculosis
cgcggguguuucggucggcg

SEQ ID NO: 2936930 - RNA, 21 nt, Mycobacterium avium subsp. paratuberculosis
cgcggguguuucggucggcgu

SEQ ID NO: 2936931 - RNA, 22 nt, Mycobacterium avium subsp. paratuberculosis
cgcggguucacccuggcgaacc

SEQ ID NO: 2936932 - RNA, 17 nt, Mycobacterium avium subsp. paratuberculosis
cgcgguaaagucuucgg

SEQ ID NO: 2936933 - RNA, 21 nt, Mycobacterium avium subsp. paratuberculosis
cgcgguaccgaugaccaccgc

SEQ ID NO: 2936934 - RNA, 21 nt, Mycobacterium avium subsp. paratuberculosis
cgcgguagaaccaacgcggcg

SEQ ID NO: 2936935 - RNA, 17 nt, Mycobacterium avium subsp. paratuberculosis
cgcgguagacaccgccg

SEQ ID NO: 2936936 - RNA, 21 nt, Mycobacterium avium subsp. paratuberculosis
cgcgguagacaccgccguugu

SEQ ID NO: 2936937 - RNA, 21 nt, Mycobacterium avium subsp. paratuberculosis
cgcgguagaucgacagggcgu

SEQ ID NO: 2936938 - RNA, 21 nt, Mycobacterium avium subsp. paratuberculosis
cgcgguagaugucggguccgc

SEQ ID NO: 2936939 - RNA, 19 nt, Mycobacterium avium subsp. paratuberculosis
cgcgguagcgcucggucag

SEQ ID NO: 2936940 - RNA, 16 nt, Mycobacterium avium subsp. paratuberculosis
cgcgguagcgcucguc

SEQ ID NO: 2936941 - RNA, 22 nt, Mycobacterium avium subsp. paratuberculosis
cgcgguagucgggauagggcgc

SEQ ID NO: 2936942 - RNA, 20 nt, Mycobacterium avium subsp. paratuberculosis
cgcggucaaacccauugucg

SEQ ID NO: 2936943 - RNA, 17 nt, Mycobacterium avium subsp. paratuberculosis
cgcggucaacaccggga

SEQ ID NO: 2936944 - RNA, 22 nt, Mycobacterium avium subsp. paratuberculosis
cgcggucaacaccgggauccgg

SEQ ID NO: 2936945 - RNA, 15 nt, Mycobacterium avium subsp. paratuberculosis
cgcggucaccggcuc

SEQ ID NO: 2936946 - RNA, 16 nt, Mycobacterium avium subsp. paratuberculosis
cgcggucaccggcucg

SEQ ID NO: 2936947 - RNA, 16 nt, Mycobacterium avium subsp. paratuberculosis
cgcggucaccggucgg

SEQ ID NO: 2936948 - RNA, 19 nt, Mycobacterium avium subsp. paratuberculosis
cgcggucaccggucggugc

SEQ ID NO: 2936949 - RNA, 14 nt, Mycobacterium avium subsp. paratuberculosis
cgcggucagcccgc

SEQ ID NO: 2936950 - RNA, 15 nt, Mycobacterium avium subsp. paratuberculosis
cgcggucagccggcu

SEQ ID NO: 2936951 - RNA, 18 nt, Mycobacterium avium subsp. paratuberculosis
cgcggucagccggcucgg

SEQ ID NO: 2936952 - RNA, 15 nt, Mycobacterium avium subsp. paratuberculosis
cgcggucagcgucug

SEQ ID NO: 2936953 - RNA, 18 nt, Mycobacterium avium subsp. paratuberculosis
cgcggucagcgucuggcg

SEQ ID NO: 2936954 - RNA, 21 nt, Mycobacterium avium subsp. paratuberculosis
cgcggucagcgucuggcgggu

SEQ ID NO: 2936955 - RNA, 13 nt, Mycobacterium avium subsp. paratuberculosis
cgcggucagcucg

SEQ ID NO: 2936956 - RNA, 16 nt, Mycobacterium avium subsp. paratuberculosis
cgcggucagcucgauc

SEQ ID NO: 2936957 - RNA, 20 nt, Mycobacterium avium subsp. paratuberculosis
cgcggucagcucgaucgccg

SEQ ID NO: 2936958 - RNA, 16 nt, Mycobacterium avium subsp. paratuberculosis
cgcggucaucgagccg

SEQ ID NO: 2936959 - RNA, 20 nt, Mycobacterium avium subsp. paratuberculosis
cgcggucaucgagccgguac

SEQ ID NO: 2936960 - RNA, 14 nt, Mycobacterium avium subsp. paratuberculosis
cgcggucaucguca

SEQ ID NO: 2936961 - RNA, 22 nt, Mycobacterium avium subsp. paratuberculosis
cgcggucaucgucauccccugg

SEQ ID NO: 2936962 - RNA, 17 nt, Mycobacterium avium subsp. paratuberculosis
cgcggucaugcgcgggc

SEQ ID NO: 2936963 - RNA, 14 nt, Mycobacterium avium subsp. paratuberculosis
cgcgguccaccaga

SEQ ID NO: 2936964 - RNA, 12 nt, Mycobacterium avium subsp. paratuberculosis
cgcgguccacgc

SEQ ID NO: 2936965 - RNA, 14 nt, Mycobacterium avium subsp. paratuberculosis
cgcgguccacgccg

SEQ ID NO: 2936966 - RNA, 17 nt, Mycobacterium avium subsp. paratuberculosis
cgcgguccacgccggcg

SEQ ID NO: 2936967 - RNA, 20 nt, Mycobacterium avium subsp. paratuberculosis
cgcgguccacgccggcgauc

SEQ ID NO: 2936968 - RNA, 23 nt, Mycobacterium avium subsp. paratuberculosis
cgcgguccacggucagcgcgucg

SEQ ID NO: 2936969 - RNA, 20 nt, Mycobacterium avium subsp. paratuberculosis
cgcgguccacuuccgcgcag

SEQ ID NO: 2936970 - RNA, 21 nt, Mycobacterium avium subsp. paratuberculosis
cgcgguccacuuccgcgcagg

SEQ ID NO: 2936971 - RNA, 14 nt, Mycobacterium avium subsp. paratuberculosis
cgcgguccagcuug

SEQ ID NO: 2936972 - RNA, 14 nt, Mycobacterium avium subsp. paratuberculosis
cgcggucccaggug

SEQ ID NO: 2936973 - RNA, 13 nt, Mycobacterium avium subsp. paratuberculosis
cgcgguccuccug

SEQ ID NO: 2936974 - RNA, 15 nt, Mycobacterium avium subsp. paratuberculosis
cgcggucgaacaacg

SEQ ID NO: 2936975 - RNA, 20 nt, Mycobacterium avium subsp. paratuberculosis
cgcggucgaacaacgcggug

SEQ ID NO: 2936976 - RNA, 17 nt, Mycobacterium avium subsp. paratuberculosis
cgcggucgaagggugcg

SEQ ID NO: 2936977 - RNA, 14 nt, Mycobacterium avium subsp. paratuberculosis
cgcggugccgaccu

SEQ ID NO: 2936978 - RNA, 19 nt, Mycobacterium avium subsp. paratuberculosis
cgcggugccgaccugggcg

SEQ ID NO: 2936979 - RNA, 17 nt, Mycobacterium avium subsp. paratuberculosis
cgcggugccgcagcucg

SEQ ID NO: 2936980 - RNA, 13 nt, Mycobacterium avium subsp. paratuberculosis
cgcggugccggug

SEQ ID NO: 2936981 - RNA, 14 nt, Mycobacterium avium subsp. paratuberculosis
cgcggugcgccgac

SEQ ID NO: 2936982 - RNA, 14 nt, Mycobacterium avium subsp. paratuberculosis
cgcggugcgcgcgc

SEQ ID NO: 2936983 - RNA, 21 nt, Mycobacterium avium subsp. paratuberculosis
cgcggugcgcgcgcgcucggc

SEQ ID NO: 2936984 - RNA, 22 nt, Mycobacterium avium subsp. paratuberculosis
cgcggugcgcgcgcgcucggcg

SEQ ID NO: 2936985 - RNA, 12 nt, Mycobacterium avium subsp. paratuberculosis
cgcggugcggcc

SEQ ID NO: 2936986 - RNA, 13 nt, Mycobacterium avium subsp. paratuberculosis
cgcggugcggccc

SEQ ID NO: 2936987 - RNA, 15 nt, Mycobacterium avium subsp. paratuberculosis
cgcggugcggggccg

SEQ ID NO: 2936988 - RNA, 19 nt, Mycobacterium avium subsp. paratuberculosis
cgcggugcggggccgcggc

SEQ ID NO: 2936989 - RNA, 21 nt, Mycobacterium avium subsp. paratuberculosis
cgcggugcggggccgcggccg

SEQ ID NO: 2936990 - RNA, 22 nt, Mycobacterium avium subsp. paratuberculosis
cgcggugcggggccgcggccgg

SEQ ID NO: 2936991 - RNA, 13 nt, Mycobacterium avium subsp. paratuberculosis
cgcggugcucgcc

SEQ ID NO: 2936992 - RNA, 13 nt, Mycobacterium avium subsp. paratuberculosis
cgcggugcucggc

SEQ ID NO: 2936993 - RNA, 17 nt, Mycobacterium avium subsp. paratuberculosis
cgcggugcucggcgcgc

SEQ ID NO: 2936994 - RNA, 14 nt, Mycobacterium avium subsp. paratuberculosis
cgcggugcugcagc

SEQ ID NO: 2936995 - RNA, 18 nt, Mycobacterium avium subsp. paratuberculosis
cgcgguggaacccagcac

SEQ ID NO: 2936996 - RNA, 13 nt, Mycobacterium avium subsp. paratuberculosis
cgcgguggagcac

SEQ ID NO: 2936997 - RNA, 21 nt, Mycobacterium avium subsp. paratuberculosis
cgcgguggagcacagcacggc

SEQ ID NO: 2936998 - RNA, 23 nt, Mycobacterium avium subsp. paratuberculosis
cgcgguggagcacagcacggcau

SEQ ID NO: 2936999 - RNA, 14 nt, Mycobacterium avium subsp. paratuberculosis
cgcgguggccagca

SEQ ID NO: 2937000 - RNA, 14 nt, Mycobacterium avium subsp. paratuberculosis
cgcgguggccggga

SEQ ID NO: 2937001 - RNA, 15 nt, Mycobacterium avium subsp. paratuberculosis
cgcgguggccgggau

SEQ ID NO: 2937002 - RNA, 16 nt, Mycobacterium avium subsp. paratuberculosis
cgcgguggccguaacc

SEQ ID NO: 2937003 - RNA, 14 nt, Mycobacterium avium subsp. paratuberculosis
cgcgguggcgaacu

SEQ ID NO: 2937004 - RNA, 20 nt, Mycobacterium avium subsp. paratuberculosis
cgcgguggcgaacugcacca

SEQ ID NO: 2937005 - RNA, 22 nt, Mycobacterium avium subsp. paratuberculosis
cgcgguggcgaacugcaccagc

SEQ ID NO: 2937006 - RNA, 23 nt, Mycobacterium avium subsp. paratuberculosis
cgcgguggcgaacugcaccagca

SEQ ID NO: 2937007 - RNA, 14 nt, Mycobacterium avium subsp. paratuberculosis
cgcgguggcgcccg

SEQ ID NO: 2937008 - RNA, 16 nt, Mycobacterium avium subsp. paratuberculosis
cgcgguggcgcccgcg

SEQ ID NO: 2937009 - RNA, 18 nt, Mycobacterium avium subsp. paratuberculosis
cgcgguggcgcccgcggu

SEQ ID NO: 2937010 - RNA, 15 nt, Mycobacterium avium subsp. paratuberculosis
cgcgguggcgccgcg

SEQ ID NO: 2937011 - RNA, 20 nt, Mycobacterium avium subsp. paratuberculosis
cgcgguggcgccgcgggcgg

SEQ ID NO: 2937012 - RNA, 12 nt, Mycobacterium avium subsp. paratuberculosis
cgcgguggcggu

SEQ ID NO: 2937013 - RNA, 14 nt, Mycobacterium avium subsp. paratuberculosis
cgcgguggcggugc

SEQ ID NO: 2937014 - RNA, 16 nt, Mycobacterium avium subsp. paratuberculosis
cgcgguggcgugcagc

SEQ ID NO: 2937015 - RNA, 19 nt, Mycobacterium avium subsp. paratuberculosis
cgcgguggcgugcagcgcg

SEQ ID NO: 2937016 - RNA, 22 nt, Mycobacterium avium subsp. paratuberculosis
cgcgguggcgugcagcgcggcg

SEQ ID NO: 2937017 - RNA, 23 nt, Mycobacterium avium subsp. paratuberculosis
cgcgguggcgugcagcgcggcga

SEQ ID NO: 2937018 - RNA, 19 nt, Mycobacterium avium subsp. paratuberculosis
cgcgguggcuuccagcccg

SEQ ID NO: 2937019 - RNA, 23 nt, Mycobacterium avium subsp. paratuberculosis
cgcggugggcaccagcagcgcga

SEQ ID NO: 2937020 - RNA, 18 nt, Mycobacterium avium subsp. paratuberculosis
cgcggugggcgcgggccg

SEQ ID NO: 2937021 - RNA, 19 nt, Mycobacterium avium subsp. paratuberculosis
cgcggugggcgcgggccgc

SEQ ID NO: 2937022 - RNA, 21 nt, Mycobacterium avium subsp. paratuberculosis
cgcggugggcgcgggccgcgu

SEQ ID NO: 2937023 - RNA, 17 nt, Mycobacterium avium subsp. paratuberculosis
cgcggugggcggcggga

SEQ ID NO: 2937024 - RNA, 14 nt, Mycobacterium avium subsp. paratuberculosis
cgcggugggcucgg

SEQ ID NO: 2937025 - RNA, 15 nt, Mycobacterium avium subsp. paratuberculosis
cgcggugggcucggc

SEQ ID NO: 2937026 - RNA, 17 nt, Mycobacterium avium subsp. paratuberculosis
cgcggugggcucggcgc

SEQ ID NO: 2937027 - RNA, 20 nt, Mycobacterium avium subsp. paratuberculosis
cgcggugggcucggcgccga

SEQ ID NO: 2937028 - RNA, 21 nt, Mycobacterium avium subsp. paratuberculosis
cgcggugggcucggcgccgac

SEQ ID NO: 2937029 - RNA, 22 nt, Mycobacterium avium subsp. paratuberculosis
cgcggugggcucggcgccgacc

SEQ ID NO: 2937030 - RNA, 19 nt, Mycobacterium avium subsp. paratuberculosis
cgcggugggcucgucgaac

SEQ ID NO: 2937031 - RNA, 20 nt, Mycobacterium avium subsp. paratuberculosis
cgcgguggguccgccgggcg

SEQ ID NO: 2937032 - RNA, 22 nt, Mycobacterium avium subsp. paratuberculosis
cgcgguggguccgccgggcgcg

SEQ ID NO: 2937033 - RNA, 23 nt, Mycobacterium avium subsp. paratuberculosis
cgcgguggucagcaccggcgugg

SEQ ID NO: 2937034 - RNA, 15 nt, Mycobacterium avium subsp. paratuberculosis
cgcgguggucagcgg

SEQ ID NO: 2937035 - RNA, 21 nt, Mycobacterium avium subsp. paratuberculosis
cgcgguggucagcggcgccac

SEQ ID NO: 2937036 - RNA, 13 nt, Mycobacterium avium subsp. paratuberculosis
cgcgguggugaua

SEQ ID NO: 2937037 - RNA, 18 nt, Mycobacterium avium subsp. paratuberculosis
cgcgguggugcucgcccc

SEQ ID NO: 2937038 - RNA, 12 nt, Mycobacterium avium subsp. paratuberculosis
cgcggugguggg

SEQ ID NO: 2937039 - RNA, 20 nt, Mycobacterium avium subsp. paratuberculosis
cgcgguggugggcgcggugg

SEQ ID NO: 2937040 - RNA, 18 nt, Mycobacterium avium subsp. paratuberculosis
cgcgguguacagcgcgcc

SEQ ID NO: 2937041 - RNA, 19 nt, Mycobacterium avium subsp. paratuberculosis
cgcgguguacagcgcgccg

SEQ ID NO: 2937042 - RNA, 19 nt, Mycobacterium avium subsp. paratuberculosis
cgcgguguagucgcugacc

SEQ ID NO: 2937043 - RNA, 20 nt, Mycobacterium avium subsp. paratuberculosis
cgcggugucgacgucggugg

SEQ ID NO: 2937044 - RNA, 13 nt, Mycobacterium avium subsp. paratuberculosis
cgcggugucggcg

SEQ ID NO: 2937045 - RNA, 14 nt, Mycobacterium avium subsp. paratuberculosis
cgcggugucggcgu

SEQ ID NO: 2937046 - RNA, 16 nt, Mycobacterium avium subsp. paratuberculosis
cgcggugucggcgucg

SEQ ID NO: 2937047 - RNA, 18 nt, Mycobacterium avium subsp. paratuberculosis
cgcggugucggcgucgau

SEQ ID NO: 2937048 - RNA, 16 nt, Mycobacterium avium subsp. paratuberculosis
cgcggugugcccggcg

SEQ ID NO: 2937049 - RNA, 19 nt, Mycobacterium avium subsp. paratuberculosis
cgcggugugcggcagcucg

SEQ ID NO: 2937050 - RNA, 22 nt, Mycobacterium avium subsp. paratuberculosis
cgcggugugcggcagcucggcg

SEQ ID NO: 2937051 - RNA, 14 nt, Mycobacterium avium subsp. paratuberculosis
cgcggugugcggcg

SEQ ID NO: 2937052 - RNA, 15 nt, Mycobacterium avium subsp. paratuberculosis
cgcggugugcggcgg

SEQ ID NO: 2937053 - RNA, 19 nt, Mycobacterium avium subsp. paratuberculosis
cgcggugugcggcggcucg

SEQ ID NO: 2937054 - RNA, 16 nt, Mycobacterium avium subsp. paratuberculosis
cgcggugugcuggcca

SEQ ID NO: 2937055 - RNA, 18 nt, Mycobacterium avium subsp. paratuberculosis
cgcggugugcuggccagc

SEQ ID NO: 2937056 - RNA, 19 nt, Mycobacterium avium subsp. paratuberculosis
cgcggugugcuggccagca

SEQ ID NO: 2937057 - RNA, 21 nt, Mycobacterium avium subsp. paratuberculosis
cgcggugugcuggccagcacc

SEQ ID NO: 2937058 - RNA, 17 nt, Mycobacterium avium subsp. paratuberculosis
cgcggugugggcgaugg

SEQ ID NO: 2937059 - RNA, 19 nt, Mycobacterium avium subsp. paratuberculosis
cgcggugugggcgauggcg

SEQ ID NO: 2937060 - RNA, 20 nt, Mycobacterium avium subsp. paratuberculosis
cgcggugugggcgauggcgg

SEQ ID NO: 2937061 - RNA, 21 nt, Mycobacterium avium subsp. paratuberculosis
cgcggugugggcgauggcggc

SEQ ID NO: 2937062 - RNA, 21 nt, Mycobacterium avium subsp. paratuberculosis
cgcguagucggcgucggccac

SEQ ID NO: 2937063 - RNA, 23 nt, Mycobacterium avium subsp. paratuberculosis
cgcguagucggcgucggccaccg

SEQ ID NO: 2937064 - RNA, 19 nt, Mycobacterium avium subsp. paratuberculosis
cgcguagucguugucggcg

SEQ ID NO: 2937065 - RNA, 13 nt, Mycobacterium avium subsp. paratuberculosis
cgcguaguggugc

SEQ ID NO: 2937066 - RNA, 18 nt, Mycobacterium avium subsp. paratuberculosis
cgcguauuccagcgccag

SEQ ID NO: 2937067 - RNA, 19 nt, Mycobacterium avium subsp. paratuberculosis
cgcguauugcacggcggcg

SEQ ID NO: 2937068 - RNA, 21 nt, Mycobacterium avium subsp. paratuberculosis
cgcguauugcacggcggcgaa

SEQ ID NO: 2937069 - RNA, 20 nt, Mycobacterium avium subsp. paratuberculosis
cgcgucaaccaccggcaucg

SEQ ID NO: 2937070 - RNA, 21 nt, Mycobacterium avium subsp. paratuberculosis
cgcgucaaccaccggcaucgg

SEQ ID NO: 2937071 - RNA, 18 nt, Mycobacterium avium subsp. paratuberculosis
cgcgucacauccgucacg

SEQ ID NO: 2937072 - RNA, 23 nt, Mycobacterium avium subsp. paratuberculosis
cgcgucacauccgucacgcccgu

SEQ ID NO: 2937073 - RNA, 12 nt, Mycobacterium avium subsp. paratuberculosis
cgcgucaccgga

SEQ ID NO: 2937074 - RNA, 12 nt, Mycobacterium avium subsp. paratuberculosis
cgcgucacgucg

SEQ ID NO: 2937075 - RNA, 16 nt, Mycobacterium avium subsp. paratuberculosis
cgcgucacgucggccu

SEQ ID NO: 2937076 - RNA, 14 nt, Mycobacterium avium subsp. paratuberculosis
cgcgucagcagcgc

SEQ ID NO: 2937077 - RNA, 14 nt, Mycobacterium avium subsp. paratuberculosis
cgcgucagccgucg

SEQ ID NO: 2937078 - RNA, 18 nt, Mycobacterium avium subsp. paratuberculosis
cgcgucagccgucgucgu

SEQ ID NO: 2937079 - RNA, 17 nt, Mycobacterium avium subsp. paratuberculosis
cgcgucagcggcgggca

SEQ ID NO: 2937080 - RNA, 14 nt, Mycobacterium avium subsp. paratuberculosis
cgcgucaucgggcc

SEQ ID NO: 2937081 - RNA, 15 nt, Mycobacterium avium subsp. paratuberculosis
cgcgucaucgggccc

SEQ ID NO: 2937082 - RNA, 15 nt, Mycobacterium avium subsp. paratuberculosis
cgcgucauggccguc

SEQ ID NO: 2937083 - RNA, 21 nt, Mycobacterium avium subsp. paratuberculosis
cgcgucauggccgucgggucg

SEQ ID NO: 2937084 - RNA, 17 nt, Mycobacterium avium subsp. paratuberculosis
cgcguccaaccgcggac

SEQ ID NO: 2937085 - RNA, 14 nt, Mycobacterium avium subsp. paratuberculosis
cgcguccacgaccc

SEQ ID NO: 2937086 - RNA, 17 nt, Mycobacterium avium subsp. paratuberculosis
cgcguccacgaccccgg

SEQ ID NO: 2937087 - RNA, 21 nt, Mycobacterium avium subsp. paratuberculosis
cgcguccacgaccccggcggc

SEQ ID NO: 2937088 - RNA, 22 nt, Mycobacterium avium subsp. paratuberculosis
cgcguccacgaccccggcggca

SEQ ID NO: 2937089 - RNA, 14 nt, Mycobacterium avium subsp. paratuberculosis
cgcguccagcagca

SEQ ID NO: 2937090 - RNA, 13 nt, Mycobacterium avium subsp. paratuberculosis
cgcguccagcaug

SEQ ID NO: 2937091 - RNA, 20 nt, Mycobacterium avium subsp. paratuberculosis
cgcguccagcaugcccacgc

SEQ ID NO: 2937092 - RNA, 21 nt, Mycobacterium avium subsp. paratuberculosis
cgcguccagcaugcccacgcc

SEQ ID NO: 2937093 - RNA, 22 nt, Mycobacterium avium subsp. paratuberculosis
cgcguccaggugcgccgccgcg

SEQ ID NO: 2937094 - RNA, 13 nt, Mycobacterium avium subsp. paratuberculosis
cgcguccccgcgc

SEQ ID NO: 2937095 - RNA, 17 nt, Mycobacterium avium subsp. paratuberculosis
cgcgucccgggccuugg

SEQ ID NO: 2937096 - RNA, 16 nt, Mycobacterium avium subsp. paratuberculosis
cgcgucccuggcgaug

SEQ ID NO: 2937097 - RNA, 18 nt, Mycobacterium avium subsp. paratuberculosis
cgcgucccuggcgaugau

SEQ ID NO: 2937098 - RNA, 13 nt, Mycobacterium avium subsp. paratuberculosis
cgcguccgacggc

SEQ ID NO: 2937099 - RNA, 16 nt, Mycobacterium avium subsp. paratuberculosis
cgcguccgacggcugg

SEQ ID NO: 2937100 - RNA, 17 nt, Mycobacterium avium subsp. paratuberculosis
cgcguccgagcagcagc

SEQ ID NO: 2937101 - RNA, 15 nt, Mycobacterium avium subsp. paratuberculosis
cgcguccgcgaucgu

SEQ ID NO: 2937102 - RNA, 13 nt, Mycobacterium avium subsp. paratuberculosis
cgcguccgcgggc

SEQ ID NO: 2937103 - RNA, 14 nt, Mycobacterium avium subsp. paratuberculosis
cgcguccgcgggcg

SEQ ID NO: 2937104 - RNA, 20 nt, Mycobacterium avium subsp. paratuberculosis
cgcguccgcgggcggggccu

SEQ ID NO: 2937105 - RNA, 18 nt, Mycobacterium avium subsp. paratuberculosis
cgcguccgcgucgucgag

SEQ ID NO: 2937106 - RNA, 23 nt, Mycobacterium avium subsp. paratuberculosis
cgcguccggaggugccggccggu

SEQ ID NO: 2937107 - RNA, 20 nt, Mycobacterium avium subsp. paratuberculosis
cgcguccguagugcucggcg

SEQ ID NO: 2937108 - RNA, 23 nt, Mycobacterium avium subsp. paratuberculosis
cgcguccguagugcucggcgucc

SEQ ID NO: 2937109 - RNA, 19 nt, Mycobacterium avium subsp. paratuberculosis
cgcguccucgccguacgcg

SEQ ID NO: 2937110 - RNA, 22 nt, Mycobacterium avium subsp. paratuberculosis
cgcguccucgccguacgcgccg

SEQ ID NO: 2937111 - RNA, 15 nt, Mycobacterium avium subsp. paratuberculosis
cgcguccucgucgau

SEQ ID NO: 2937112 - RNA, 16 nt, Mycobacterium avium subsp. paratuberculosis
cgcguccucgucgaug

SEQ ID NO: 2937113 - RNA, 18 nt, Mycobacterium avium subsp. paratuberculosis
cgcguccucgucgaugcc

SEQ ID NO: 2937114 - RNA, 16 nt, Mycobacterium avium subsp. paratuberculosis
cgcguccugcagcgcc

SEQ ID NO: 2937115 - RNA, 20 nt, Mycobacterium avium subsp. paratuberculosis
cgcguccugcagcgccgucc

SEQ ID NO: 2937116 - RNA, 15 nt, Mycobacterium avium subsp. paratuberculosis
cgcguccugcaggca

SEQ ID NO: 2937117 - RNA, 19 nt, Mycobacterium avium subsp. paratuberculosis
cgcguccuucuccgccggg

SEQ ID NO: 2937118 - RNA, 15 nt, Mycobacterium avium subsp. paratuberculosis
cgcgucgaacagccg

SEQ ID NO: 2937119 - RNA, 16 nt, Mycobacterium avium subsp. paratuberculosis
cgcgucgaacagccgg

SEQ ID NO: 2937120 - RNA, 17 nt, Mycobacterium avium subsp. paratuberculosis
cgcgucgaacagccggg

SEQ ID NO: 2937121 - RNA, 19 nt, Mycobacterium avium subsp. paratuberculosis
cgcgucgaacagccgggcc

SEQ ID NO: 2937122 - RNA, 20 nt, Mycobacterium avium subsp. paratuberculosis
cgcgucgaacagccgggccg

SEQ ID NO: 2937123 - RNA, 21 nt, Mycobacterium avium subsp. paratuberculosis
cgcgucgaacagccgggccgc

SEQ ID NO: 2937124 - RNA, 15 nt, Mycobacterium avium subsp. paratuberculosis
cgcgucgaaugcgcu

SEQ ID NO: 2937125 - RNA, 16 nt, Mycobacterium avium subsp. paratuberculosis
cgcgucgacaccccgc

SEQ ID NO: 2937126 - RNA, 19 nt, Mycobacterium avium subsp. paratuberculosis
cgcgucgacaccccgcucg

SEQ ID NO: 2937127 - RNA, 20 nt, Mycobacterium avium subsp. paratuberculosis
cgcgucgacaccccgcucgg

SEQ ID NO: 2937128 - RNA, 22 nt, Mycobacterium avium subsp. paratuberculosis
cgcgucgacaccccgcucggcc

SEQ ID NO: 2937129 - RNA, 14 nt, Mycobacterium avium subsp. paratuberculosis
cgcgucgaccaccg

SEQ ID NO: 2937130 - RNA, 14 nt, Mycobacterium avium subsp. paratuberculosis
cgcgucgaccagcc

SEQ ID NO: 2937131 - RNA, 18 nt, Mycobacterium avium subsp. paratuberculosis
cgcgucgaccagccgcau

SEQ ID NO: 2937132 - RNA, 16 nt, Mycobacterium avium subsp. paratuberculosis
cgcgucgaccagccgg

SEQ ID NO: 2937133 - RNA, 16 nt, Mycobacterium avium subsp. paratuberculosis
cgcgucgaccgccgcg

SEQ ID NO: 2937134 - RNA, 13 nt, Mycobacterium avium subsp. paratuberculosis
cgcgucgacgaug

SEQ ID NO: 2937135 - RNA, 23 nt, Mycobacterium avium subsp. paratuberculosis
cgcgucgacgauggcguccaccg

SEQ ID NO: 2937136 - RNA, 12 nt, Mycobacterium avium subsp. paratuberculosis
cgcgucgacgcc

SEQ ID NO: 2937137 - RNA, 14 nt, Mycobacterium avium subsp. paratuberculosis
cgcgucgacgccgc

SEQ ID NO: 2937138 - RNA, 13 nt, Mycobacterium avium subsp. paratuberculosis
cgcgucgacgcgg

SEQ ID NO: 2937139 - RNA, 18 nt, Mycobacterium avium subsp. paratuberculosis
cgcgucgacggcaagcag

SEQ ID NO: 2937140 - RNA, 16 nt, Mycobacterium avium subsp. paratuberculosis
cgcgucgacggcgccg

SEQ ID NO: 2937141 - RNA, 16 nt, Mycobacterium avium subsp. paratuberculosis
cgcgucgacggcgugg

SEQ ID NO: 2937142 - RNA, 17 nt, Mycobacterium avium subsp. paratuberculosis
cgcgucgacgucgggca

SEQ ID NO: 2937143 - RNA, 14 nt, Mycobacterium avium subsp. paratuberculosis
cgcgucgagcaccu

SEQ ID NO: 2937144 - RNA, 17 nt, Mycobacterium avium subsp. paratuberculosis
cgcgucgagcaccugga

SEQ ID NO: 2937145 - RNA, 16 nt, Mycobacterium avium subsp. paratuberculosis
cgcgucgagcagcacc

SEQ ID NO: 2937146 - RNA, 18 nt, Mycobacterium avium subsp. paratuberculosis
cgcgucgagcagcaccac

SEQ ID NO: 2937147 - RNA, 19 nt, Mycobacterium avium subsp. paratuberculosis
cgcgucgugccgagcguga

SEQ ID NO: 2937148 - RNA, 15 nt, Mycobacterium avium subsp. paratuberculosis
cgcgucgugcggccg

SEQ ID NO: 2937149 - RNA, 17 nt, Mycobacterium avium subsp. paratuberculosis
cgcgucgugcggccggc

SEQ ID NO: 2937150 - RNA, 18 nt, Mycobacterium avium subsp. paratuberculosis
cgcgucgugcggccggcg

SEQ ID NO: 2937151 - RNA, 20 nt, Mycobacterium avium subsp. paratuberculosis
cgcgucgugcggccggcgcc

SEQ ID NO: 2937152 - RNA, 16 nt, Mycobacterium avium subsp. paratuberculosis
cgcgucguggcccugc

SEQ ID NO: 2937153 - RNA, 15 nt, Mycobacterium avium subsp. paratuberculosis
cgcgucguguccggg

SEQ ID NO: 2937154 - RNA, 17 nt, Mycobacterium avium subsp. paratuberculosis
cgcgucguguccgggcc

SEQ ID NO: 2937155 - RNA, 19 nt, Mycobacterium avium subsp. paratuberculosis
cgcgucguugucgucgccg

SEQ ID NO: 2937156 - RNA, 20 nt, Mycobacterium avium subsp. paratuberculosis
cgcgucguugucgucgccgg

SEQ ID NO: 2937157 - RNA, 21 nt, Mycobacterium avium subsp. paratuberculosis
cgcgucguugucgucgccggc

SEQ ID NO: 2937158 - RNA, 18 nt, Mycobacterium avium subsp. paratuberculosis
cgcgucucccccgaucag

SEQ ID NO: 2937159 - RNA, 23 nt, Mycobacterium avium subsp. paratuberculosis
cgcgucucccccgaucagcguca

SEQ ID NO: 2937160 - RNA, 13 nt, Mycobacterium avium subsp. paratuberculosis
cgcgucugcucgc

SEQ ID NO: 2937161 - RNA, 20 nt, Mycobacterium avium subsp. paratuberculosis
cgcgucugcucgccggcuac

SEQ ID NO: 2937162 - RNA, 14 nt, Mycobacterium avium subsp. paratuberculosis
cgcgucugcucgcg

SEQ ID NO: 2937163 - RNA, 16 nt, Mycobacterium avium subsp. paratuberculosis
cgcgucuugcgccgaa

SEQ ID NO: 2937164 - RNA, 17 nt, Mycobacterium avium subsp. paratuberculosis
cgcgucuuggacgcccg

SEQ ID NO: 2937165 - RNA, 19 nt, Mycobacterium avium subsp. paratuberculosis
cgcgucuuggacgcccgcg

SEQ ID NO: 2937166 - RNA, 20 nt, Mycobacterium avium subsp. paratuberculosis
cgcgucuuggacgcccgcga

SEQ ID NO: 2937167 - RNA, 15 nt, Mycobacterium avium subsp. paratuberculosis
cgcgugacaagccgg

SEQ ID NO: 2937168 - RNA, 18 nt, Mycobacterium avium subsp. paratuberculosis
cgcgugacaagccggcgu

SEQ ID NO: 2937169 - RNA, 21 nt, Mycobacterium avium subsp. paratuberculosis
cgcgugacaagccggcgucga

SEQ ID NO: 2937170 - RNA, 23 nt, Mycobacterium avium subsp. paratuberculosis
cgcgugacaagccggcgucgaug

SEQ ID NO: 2937171 - RNA, 19 nt, Mycobacterium avium subsp. paratuberculosis
cgcgugacaggggcagcag

SEQ ID NO: 2937172 - RNA, 21 nt, Mycobacterium avium subsp. paratuberculosis
cgcgugacaggggcagcagca

SEQ ID NO: 2937173 - RNA, 19 nt, Mycobacterium avium subsp. paratuberculosis
cgcgugaccccggcgacca

SEQ ID NO: 2937174 - RNA, 23 nt, Mycobacterium avium subsp. paratuberculosis
cgcgugaccccggcgaccagcag

SEQ ID NO: 2937175 - RNA, 13 nt, Mycobacterium avium subsp. paratuberculosis
cgcgugaccggcg

SEQ ID NO: 2937176 - RNA, 16 nt, Mycobacterium avium subsp. paratuberculosis
cgcgugaccggcggug

SEQ ID NO: 2937177 - RNA, 17 nt, Mycobacterium avium subsp. paratuberculosis
cgcgugaccggcggugc

SEQ ID NO: 2937178 - RNA, 19 nt, Mycobacterium avium subsp. paratuberculosis
cgcgugaccggcggugcgg

SEQ ID NO: 2937179 - RNA, 14 nt, Mycobacterium avium subsp. paratuberculosis
cgcgugacgcgcgu

SEQ ID NO: 2937180 - RNA, 14 nt, Mycobacterium avium subsp. paratuberculosis
cgcgugacggccgc

SEQ ID NO: 2937181 - RNA, 16 nt, Mycobacterium avium subsp. paratuberculosis
cgcgugacggccgcgg

SEQ ID NO: 2937182 - RNA, 20 nt, Mycobacterium avium subsp. paratuberculosis
cgcgugacggccgcggcgcg

SEQ ID NO: 2937183 - RNA, 13 nt, Mycobacterium avium subsp. paratuberculosis
cgcgugacggcgg

SEQ ID NO: 2937184 - RNA, 14 nt, Mycobacterium avium subsp. paratuberculosis
cgcgugacggcggg

SEQ ID NO: 2937185 - RNA, 16 nt, Mycobacterium avium subsp. paratuberculosis
cgcgugacggcggggc

SEQ ID NO: 2937186 - RNA, 15 nt, Mycobacterium avium subsp. paratuberculosis
cgcgugaugcagcag

SEQ ID NO: 2937187 - RNA, 19 nt, Mycobacterium avium subsp. paratuberculosis
cgcgugaugggugggcagc

SEQ ID NO: 2937188 - RNA, 17 nt, Mycobacterium avium subsp. paratuberculosis
cgcgugcaacacauggu

SEQ ID NO: 2937189 - RNA, 13 nt, Mycobacterium avium subsp. paratuberculosis
cgcgugcacaccg

SEQ ID NO: 2937190 - RNA, 17 nt, Mycobacterium avium subsp. paratuberculosis
cgcgugcacaccggccu

SEQ ID NO: 2937191 - RNA, 20 nt, Mycobacterium avium subsp. paratuberculosis
cgcgugcacgaacgcggcca

SEQ ID NO: 2937192 - RNA, 23 nt, Mycobacterium avium subsp. paratuberculosis
cgcgugcacgaacgcggccagcg

SEQ ID NO: 2937193 - RNA, 17 nt, Mycobacterium avium subsp. paratuberculosis
cgcgugcgagccgagca

SEQ ID NO: 2937194 - RNA, 12 nt, Mycobacterium avium subsp. paratuberculosis
cgcgugcgccgc

SEQ ID NO: 2937195 - RNA, 14 nt, Mycobacterium avium subsp. paratuberculosis
cgcgugcgccgcgg

SEQ ID NO: 2937196 - RNA, 15 nt, Mycobacterium avium subsp. paratuberculosis
cgcgugcgucacgcu

SEQ ID NO: 2937197 - RNA, 15 nt, Mycobacterium avium subsp. paratuberculosis
cgcgugcgucaucgc

SEQ ID NO: 2937198 - RNA, 19 nt, Mycobacterium avium subsp. paratuberculosis
cgcgugcgucaucgcgcug

SEQ ID NO: 2937199 - RNA, 20 nt, Mycobacterium avium subsp. paratuberculosis
cgcgugcgucaucgcgcugg

SEQ ID NO: 2937200 - RNA, 22 nt, Mycobacterium avium subsp. paratuberculosis
cgcgugcuggggguggcgucga

SEQ ID NO: 2937201 - RNA, 23 nt, Mycobacterium avium subsp. paratuberculosis
cgcgugcuggggguggcgucgac

SEQ ID NO: 2937202 - RNA, 13 nt, Mycobacterium avium subsp. paratuberculosis
cgcgugcuguugc

SEQ ID NO: 2937203 - RNA, 14 nt, Mycobacterium avium subsp. paratuberculosis
cgcguggccucccg

SEQ ID NO: 2937204 - RNA, 15 nt, Mycobacterium avium subsp. paratuberculosis
cgcguggccucccgg

SEQ ID NO: 2937205 - RNA, 14 nt, Mycobacterium avium subsp. paratuberculosis
cgcguggccugggc

SEQ ID NO: 2937206 - RNA, 19 nt, Mycobacterium avium subsp. paratuberculosis
cgcguggccugggcgacca

SEQ ID NO: 2937207 - RNA, 13 nt, Mycobacterium avium subsp. paratuberculosis
cgcguggcgcaca

SEQ ID NO: 2937208 - RNA, 16 nt, Mycobacterium avium subsp. paratuberculosis
cgcguggcgcacagcg

SEQ ID NO: 2937209 - RNA, 15 nt, Mycobacterium avium subsp. paratuberculosis
cgcgugggagagcgg

SEQ ID NO: 2937210 - RNA, 15 nt, Mycobacterium avium subsp. paratuberculosis
cgcgugggcaccccg

SEQ ID NO: 2937211 - RNA, 16 nt, Mycobacterium avium subsp. paratuberculosis
cgcgugggcaccccga

SEQ ID NO: 2937212 - RNA, 22 nt, Mycobacterium avium subsp. paratuberculosis
cgcgugggcaccccgaucaggu

SEQ ID NO: 2937213 - RNA, 16 nt, Mycobacterium avium subsp. paratuberculosis
cgcguggggcgucgcc

SEQ ID NO: 2937214 - RNA, 17 nt, Mycobacterium avium subsp. paratuberculosis
cgcguggggcgucgccg

SEQ ID NO: 2937215 - RNA, 20 nt, Mycobacterium avium subsp. paratuberculosis
cgcguggggcgucgccgccc

SEQ ID NO: 2937216 - RNA, 16 nt, Mycobacterium avium subsp. paratuberculosis
cgcguggucccacacc

SEQ ID NO: 2937217 - RNA, 20 nt, Mycobacterium avium subsp. paratuberculosis
cgcguggucccacaccacca

SEQ ID NO: 2937218 - RNA, 22 nt, Mycobacterium avium subsp. paratuberculosis
cgcgugugcccagcacgacgcc

SEQ ID NO: 2937219 - RNA, 16 nt, Mycobacterium avium subsp. paratuberculosis
cgcgugugcccgccuc

SEQ ID NO: 2937220 - RNA, 16 nt, Mycobacterium avium subsp. paratuberculosis
cgcguucaagccgccg

SEQ ID NO: 2937221 - RNA, 12 nt, Mycobacterium avium subsp. paratuberculosis
cgcguucacccg

SEQ ID NO: 2937222 - RNA, 15 nt, Mycobacterium avium subsp. paratuberculosis
cgcguucacccgcgc

SEQ ID NO: 2937223 - RNA, 19 nt, Mycobacterium avium subsp. paratuberculosis
cgcguucagggugcaggcc

SEQ ID NO: 2937224 - RNA, 20 nt, Mycobacterium avium subsp. paratuberculosis
cgcguucagggugcaggccc

SEQ ID NO: 2937225 - RNA, 22 nt, Mycobacterium avium subsp. paratuberculosis
cgcguucagggugcaggcccgg

SEQ ID NO: 2937226 - RNA, 19 nt, Mycobacterium avium subsp. paratuberculosis
cgcguuccagcacgcccag

SEQ ID NO: 2937227 - RNA, 15 nt, Mycobacterium avium subsp. paratuberculosis
cgcguuccaucagcg

SEQ ID NO: 2937228 - RNA, 17 nt, Mycobacterium avium subsp. paratuberculosis
cgcguuccaucagcgcc

SEQ ID NO: 2937229 - RNA, 19 nt, Mycobacterium avium subsp. paratuberculosis
cgcguuccaucagcgcccg

SEQ ID NO: 2937230 - RNA, 21 nt, Mycobacterium avium subsp. paratuberculosis
cgcguuccaucagcgcccgcg

SEQ ID NO: 2937231 - RNA, 23 nt, Mycobacterium avium subsp. paratuberculosis
cgcguucccgggcccgcugcagc

SEQ ID NO: 2937232 - RNA, 14 nt, Mycobacterium avium subsp. paratuberculosis
cgcucaaccgccca

SEQ ID NO: 2937233 - RNA, 18 nt, Mycobacterium avium subsp. paratuberculosis
cgcucaaccgcccagcgg

SEQ ID NO: 2937234 - RNA, 21 nt, Mycobacterium avium subsp. paratuberculosis
cgcucaacgugauacgccgac

SEQ ID NO: 2937235 - RNA, 22 nt, Mycobacterium avium subsp. paratuberculosis
cgcucaacgugauacgccgacg

SEQ ID NO: 2937236 - RNA, 24 nt, Mycobacterium avium subsp. paratuberculosis
cgcucaacuugaucagcucgcgga

SEQ ID NO: 2937237 - RNA, 21 nt, Mycobacterium avium subsp. paratuberculosis
cgcucacacagccgcuuggcg

SEQ ID NO: 2937238 - RNA, 14 nt, Mycobacterium avium subsp. paratuberculosis
cgcucacccggccc

SEQ ID NO: 2937239 - RNA, 20 nt, Mycobacterium avium subsp. paratuberculosis
cgcucacccggcccaccggc

SEQ ID NO: 2937240 - RNA, 14 nt, Mycobacterium avium subsp. paratuberculosis
cgcucaccgcaucg

SEQ ID NO: 2937241 - RNA, 17 nt, Mycobacterium avium subsp. paratuberculosis
cgcucaccgcaucgaac

SEQ ID NO: 2937242 - RNA, 23 nt, Mycobacterium avium subsp. paratuberculosis
cgcucaccgcaucgaaccgccgc

SEQ ID NO: 2937243 - RNA, 13 nt, Mycobacterium avium subsp. paratuberculosis
cgcucaccgccga

SEQ ID NO: 2937244 - RNA, 21 nt, Mycobacterium avium subsp. paratuberculosis
cgcucaccgcggggugcccgg

SEQ ID NO: 2937245 - RNA, 23 nt, Mycobacterium avium subsp. paratuberculosis
cgcucaccgcggggugcccggcg

SEQ ID NO: 2937246 - RNA, 13 nt, Mycobacterium avium subsp. paratuberculosis
cgcucaccggcgu

SEQ ID NO: 2937247 - RNA, 14 nt, Mycobacterium avium subsp. paratuberculosis
cgcucaccggcgug

SEQ ID NO: 2937248 - RNA, 15 nt, Mycobacterium avium subsp. paratuberculosis
cgcucaccggcgugg

SEQ ID NO: 2937249 - RNA, 18 nt, Mycobacterium avium subsp. paratuberculosis
cgcucaccggcguggugg

SEQ ID NO: 2937250 - RNA, 20 nt, Mycobacterium avium subsp. paratuberculosis
cgcucaccggcguggugggc

SEQ ID NO: 2937251 - RNA, 15 nt, Mycobacterium avium subsp. paratuberculosis
cgcucaccgucgcgg

SEQ ID NO: 2937252 - RNA, 16 nt, Mycobacterium avium subsp. paratuberculosis
cgcucaccgucgcggu

SEQ ID NO: 2937253 - RNA, 17 nt, Mycobacterium avium subsp. paratuberculosis
cgcucaccugcggcccg

SEQ ID NO: 2937254 - RNA, 20 nt, Mycobacterium avium subsp. paratuberculosis
cgcucaccugcggcccgucg

SEQ ID NO: 2937255 - RNA, 19 nt, Mycobacterium avium subsp. paratuberculosis
cgcucacucgucuugcagc

SEQ ID NO: 2937256 - RNA, 19 nt, Mycobacterium avium subsp. paratuberculosis
cgcucagagcugcaccggg

SEQ ID NO: 2937257 - RNA, 15 nt, Mycobacterium avium subsp. paratuberculosis
cgcucagcacgcgga

SEQ ID NO: 2937258 - RNA, 14 nt, Mycobacterium avium subsp. paratuberculosis
cgcucagccccagc

SEQ ID NO: 2937259 - RNA, 20 nt, Mycobacterium avium subsp. paratuberculosis
cgcucagccccagcggagcg

SEQ ID NO: 2937260 - RNA, 12 nt, Mycobacterium avium subsp. paratuberculosis
cgcucagcccgg

SEQ ID NO: 2937261 - RNA, 13 nt, Mycobacterium avium subsp. paratuberculosis
cgcucagcccgga

SEQ ID NO: 2937262 - RNA, 18 nt, Mycobacterium avium subsp. paratuberculosis
cgcucagccguucgcugc

SEQ ID NO: 2937263 - RNA, 20 nt, Mycobacterium avium subsp. paratuberculosis
cgcucagcgauugcggccgc

SEQ ID NO: 2937264 - RNA, 21 nt, Mycobacterium avium subsp. paratuberculosis
cgcucagcgauugcggccgcc

SEQ ID NO: 2937265 - RNA, 22 nt, Mycobacterium avium subsp. paratuberculosis
cgcucagcgauugcggccgccg

SEQ ID NO: 2937266 - RNA, 20 nt, Mycobacterium avium subsp. paratuberculosis
cgcucagcgcggccacaccg

SEQ ID NO: 2937267 - RNA, 14 nt, Mycobacterium avium subsp. paratuberculosis
cgcucagcggcagc

SEQ ID NO: 2937268 - RNA, 15 nt, Mycobacterium avium subsp. paratuberculosis
cgcucagcggcagcg

SEQ ID NO: 2937269 - RNA, 23 nt, Mycobacterium avium subsp. paratuberculosis
cgcucagcggcagcgucgccagc

SEQ ID NO: 2937270 - RNA, 21 nt, Mycobacterium avium subsp. paratuberculosis
cgcucagcgggcggccagccg

SEQ ID NO: 2937271 - RNA, 16 nt, Mycobacterium avium subsp. paratuberculosis
cgcucaggucggccgc

SEQ ID NO: 2937272 - RNA, 18 nt, Mycobacterium avium subsp. paratuberculosis
cgcucaggucggccgcgg

SEQ ID NO: 2937273 - RNA, 19 nt, Mycobacterium avium subsp. paratuberculosis
cgcucaggucggccgcggc

SEQ ID NO: 2937274 - RNA, 20 nt, Mycobacterium avium subsp. paratuberculosis
cgcucaggucggccgcggcc

SEQ ID NO: 2937275 - RNA, 16 nt, Mycobacterium avium subsp. paratuberculosis
cgcucaguccagcucc

SEQ ID NO: 2937276 - RNA, 19 nt, Mycobacterium avium subsp. paratuberculosis
cgcucaucaggcggccggc

SEQ ID NO: 2937277 - RNA, 20 nt, Mycobacterium avium subsp. paratuberculosis
cgcucaucccgaugucggcg

SEQ ID NO: 2937278 - RNA, 14 nt, Mycobacterium avium subsp. paratuberculosis
cgcucaugcccgcc

SEQ ID NO: 2937279 - RNA, 15 nt, Mycobacterium avium subsp. paratuberculosis
cgcucaugcccgcca

SEQ ID NO: 2937280 - RNA, 19 nt, Mycobacterium avium subsp. paratuberculosis
cgcucaugcccgccacggc

SEQ ID NO: 2937281 - RNA, 16 nt, Mycobacterium avium subsp. paratuberculosis
cgcuccacaucugccg

SEQ ID NO: 2937282 - RNA, 17 nt, Mycobacterium avium subsp. paratuberculosis
cgcuccacaucugccgg

SEQ ID NO: 2937283 - RNA, 13 nt, Mycobacterium avium subsp. paratuberculosis
cgcuccaccaccg

SEQ ID NO: 2937284 - RNA, 19 nt, Mycobacterium avium subsp. paratuberculosis
cgcuccaccagcgcgguga

SEQ ID NO: 2937285 - RNA, 22 nt, Mycobacterium avium subsp. paratuberculosis
cgcuccaccagguucgcgcagc

SEQ ID NO: 2937286 - RNA, 22 nt, Mycobacterium avium subsp. paratuberculosis
cgcuccaccgaaaagcccgccg

SEQ ID NO: 2937287 - RNA, 16 nt, Mycobacterium avium subsp. paratuberculosis
cgcuccagaugcggug

SEQ ID NO: 2937288 - RNA, 18 nt, Mycobacterium avium subsp. paratuberculosis
cgcuccagaugcgguggu

SEQ ID NO: 2937289 - RNA, 18 nt, Mycobacterium avium subsp. paratuberculosis
cgcuccagcaggcuggcg

SEQ ID NO: 2937290 - RNA, 13 nt, Mycobacterium avium subsp. paratuberculosis
cgcuccagccacu

SEQ ID NO: 2937291 - RNA, 14 nt, Mycobacterium avium subsp. paratuberculosis
cgcuccagcggcca

SEQ ID NO: 2937292 - RNA, 17 nt, Mycobacterium avium subsp. paratuberculosis
cgcuccagcggccacac

SEQ ID NO: 2937293 - RNA, 18 nt, Mycobacterium avium subsp. paratuberculosis
cgcuccagcggccacacc

SEQ ID NO: 2937294 - RNA, 20 nt, Mycobacterium avium subsp. paratuberculosis
cgcuccagcgggcggcggug

SEQ ID NO: 2937295 - RNA, 19 nt, Mycobacterium avium subsp. paratuberculosis
cgcuccauggcggcgacca

SEQ ID NO: 2937296 - RNA, 14 nt, Mycobacterium avium subsp. paratuberculosis
cgcuccauguucgg

SEQ ID NO: 2937297 - RNA, 21 nt, Mycobacterium avium subsp. paratuberculosis
cgcuccauuuugaacgccucg

SEQ ID NO: 2937298 - RNA, 14 nt, Mycobacterium avium subsp. paratuberculosis
cgcuccccgauccg

SEQ ID NO: 2937299 - RNA, 18 nt, Mycobacterium avium subsp. paratuberculosis
cgcucccgauggcucgcg

SEQ ID NO: 2937300 - RNA, 14 nt, Mycobacterium avium subsp. paratuberculosis
cgcucccgcagcgg

SEQ ID NO: 2937301 - RNA, 14 nt, Mycobacterium avium subsp. paratuberculosis
cgcucccggcgcag

SEQ ID NO: 2937302 - RNA, 15 nt, Mycobacterium avium subsp. paratuberculosis
cgcucccggcgccgc

SEQ ID NO: 2937303 - RNA, 19 nt, Mycobacterium avium subsp. paratuberculosis
cgcucccgguagagcggca

SEQ ID NO: 2937304 - RNA, 15 nt, Mycobacterium avium subsp. paratuberculosis
cgcuccgacgcggug

SEQ ID NO: 2937305 - RNA, 19 nt, Mycobacterium avium subsp. paratuberculosis
cgcuccgcggcgggcgugc

SEQ ID NO: 2937306 - RNA, 20 nt, Mycobacterium avium subsp. paratuberculosis
cgcuccgcgggcagcgagca

SEQ ID NO: 2937307 - RNA, 22 nt, Mycobacterium avium subsp. paratuberculosis
cgcuccgcgggcagcgagcaca

SEQ ID NO: 2937308 - RNA, 12 nt, Mycobacterium avium subsp. paratuberculosis
cgcuccgcggug

SEQ ID NO: 2937309 - RNA, 13 nt, Mycobacterium avium subsp. paratuberculosis
cgcuccgcggugc

SEQ ID NO: 2937310 - RNA, 13 nt, Mycobacterium avium subsp. paratuberculosis
cgcuccggcccga

SEQ ID NO: 2937311 - RNA, 16 nt, Mycobacterium avium subsp. paratuberculosis
cgcuccggcccgagca

SEQ ID NO: 2937312 - RNA, 23 nt, Mycobacterium avium subsp. paratuberculosis
cgcuccggcccgagcaccaccag

SEQ ID NO: 2937313 - RNA, 17 nt, Mycobacterium avium subsp. paratuberculosis
cgcuccggcggacccag

SEQ ID NO: 2937314 - RNA, 21 nt, Mycobacterium avium subsp. paratuberculosis
cgcuccggcggacccagcucc

SEQ ID NO: 2937315 - RNA, 16 nt, Mycobacterium avium subsp. paratuberculosis
cgcuccggucgcgucg

SEQ ID NO: 2937316 - RNA, 13 nt, Mycobacterium avium subsp. paratuberculosis
cgcuccuccucgc

SEQ ID NO: 2937317 - RNA, 22 nt, Mycobacterium avium subsp. paratuberculosis
cgcucggccggguuguccuggc

SEQ ID NO: 2937318 - RNA, 17 nt, Mycobacterium avium subsp. paratuberculosis
cgcucggccguggccgu

SEQ ID NO: 2937319 - RNA, 19 nt, Mycobacterium avium subsp. paratuberculosis
cgcucggccguggccguca

SEQ ID NO: 2937320 - RNA, 20 nt, Mycobacterium avium subsp. paratuberculosis
cgcucggccguggccgucac

SEQ ID NO: 2937321 - RNA, 21 nt, Mycobacterium avium subsp. paratuberculosis
cgcucggccguggccgucacg

SEQ ID NO: 2937322 - RNA, 12 nt, Mycobacterium avium subsp. paratuberculosis
cgcucggccuca

SEQ ID NO: 2937323 - RNA, 19 nt, Mycobacterium avium subsp. paratuberculosis
cgcucggccucaggcgucg

SEQ ID NO: 2937324 - RNA, 20 nt, Mycobacterium avium subsp. paratuberculosis
cgcucggccucaggcgucgg

SEQ ID NO: 2937325 - RNA, 22 nt, Mycobacterium avium subsp. paratuberculosis
cgcucggccucaggcgucgguc

SEQ ID NO: 2937326 - RNA, 23 nt, Mycobacterium avium subsp. paratuberculosis
cgcucggccucaggcgucgguca

SEQ ID NO: 2937327 - RNA, 16 nt, Mycobacterium avium subsp. paratuberculosis
cgcucggcgaccgccg

SEQ ID NO: 2937328 - RNA, 18 nt, Mycobacterium avium subsp. paratuberculosis
cgcucggcgaccgccggu

SEQ ID NO: 2937329 - RNA, 19 nt, Mycobacterium avium subsp. paratuberculosis
cgcucggcgaccgccggug

SEQ ID NO: 2937330 - RNA, 20 nt, Mycobacterium avium subsp. paratuberculosis
cgcucggcgaccgccggugg

SEQ ID NO: 2937331 - RNA, 22 nt, Mycobacterium avium subsp. paratuberculosis
cgcucggcgaccgccggugggg

SEQ ID NO: 2937332 - RNA, 18 nt, Mycobacterium avium subsp. paratuberculosis
cgcucggcgaccugcggc

SEQ ID NO: 2937333 - RNA, 11 nt, Mycobacterium avium subsp. paratuberculosis
cgcucggcgag

SEQ ID NO: 2937334 - RNA, 14 nt, Mycobacterium avium subsp. paratuberculosis
cgcucggcgagcaa

SEQ ID NO: 2937335 - RNA, 20 nt, Mycobacterium avium subsp. paratuberculosis
cgcucggcgagcaaggcgag

SEQ ID NO: 2937336 - RNA, 21 nt, Mycobacterium avium subsp. paratuberculosis
cgcucggcgagcugcgggugc

SEQ ID NO: 2937337 - RNA, 12 nt, Mycobacterium avium subsp. paratuberculosis
cgcucggcgaug

SEQ ID NO: 2937338 - RNA, 16 nt, Mycobacterium avium subsp. paratuberculosis
cgcucggcgccgagcg

SEQ ID NO: 2937339 - RNA, 15 nt, Mycobacterium avium subsp. paratuberculosis
cgcucggcgccggcc

SEQ ID NO: 2937340 - RNA, 17 nt, Mycobacterium avium subsp. paratuberculosis
cgcucggcgccggccgu

SEQ ID NO: 2937341 - RNA, 20 nt, Mycobacterium avium subsp. paratuberculosis
cgcucggcgccggccgucac

SEQ ID NO: 2937342 - RNA, 23 nt, Mycobacterium avium subsp. paratuberculosis
cgcucggcgccggccgucacgcu

SEQ ID NO: 2937343 - RNA, 15 nt, Mycobacterium avium subsp. paratuberculosis
cgcucggcgcgacgu

SEQ ID NO: 2937344 - RNA, 20 nt, Mycobacterium avium subsp. paratuberculosis
cgcucggcgcgcggggccgg

SEQ ID NO: 2937345 - RNA, 22 nt, Mycobacterium avium subsp. paratuberculosis
cgcucggcgcgcggggccggcg

SEQ ID NO: 2937346 - RNA, 13 nt, Mycobacterium avium subsp. paratuberculosis
cgcucggcgcguc

SEQ ID NO: 2937347 - RNA, 15 nt, Mycobacterium avium subsp. paratuberculosis
cgcucggcgcgucgu

SEQ ID NO: 2937348 - RNA, 16 nt, Mycobacterium avium subsp. paratuberculosis
cgcucggcgcgucguc

SEQ ID NO: 2937349 - RNA, 12 nt, Mycobacterium avium subsp. paratuberculosis
cgcucggcgcuc

SEQ ID NO: 2937350 - RNA, 17 nt, Mycobacterium avium subsp. paratuberculosis
cgcucggcgcuccagcg

SEQ ID NO: 2937351 - RNA, 22 nt, Mycobacterium avium subsp. paratuberculosis
cgcucggcgcuccagcgggcgg

SEQ ID NO: 2937352 - RNA, 14 nt, Mycobacterium avium subsp. paratuberculosis
cgcucggcggccga

SEQ ID NO: 2937353 - RNA, 12 nt, Mycobacterium avium subsp. paratuberculosis
cgcucggcggcg

SEQ ID NO: 2937354 - RNA, 13 nt, Mycobacterium avium subsp. paratuberculosis
cgcucggcggcga

SEQ ID NO: 2937355 - RNA, 15 nt, Mycobacterium avium subsp. paratuberculosis
cgcucggcggcgacg

SEQ ID NO: 2937356 - RNA, 18 nt, Mycobacterium avium subsp. paratuberculosis
cgcucggcggcgacggug

SEQ ID NO: 2937357 - RNA, 14 nt, Mycobacterium avium subsp. paratuberculosis
cgcucggcggcgcc

SEQ ID NO: 2937358 - RNA, 15 nt, Mycobacterium avium subsp. paratuberculosis
cgcucggcggcgccg

SEQ ID NO: 2937359 - RNA, 17 nt, Mycobacterium avium subsp. paratuberculosis
cgcucggcggcgccguc

SEQ ID NO: 2937360 - RNA, 18 nt, Mycobacterium avium subsp. paratuberculosis
cgcucggcggcgccgucg

SEQ ID NO: 2937361 - RNA, 20 nt, Mycobacterium avium subsp. paratuberculosis
cgcucggcggcgccgucguc

SEQ ID NO: 2937362 - RNA, 15 nt, Mycobacterium avium subsp. paratuberculosis
cgcucggcggcgcgc

SEQ ID NO: 2937363 - RNA, 20 nt, Mycobacterium avium subsp. paratuberculosis
cgcucggcggcgcgcaggcg

SEQ ID NO: 2937364 - RNA, 13 nt, Mycobacterium avium subsp. paratuberculosis
cgcucggcggguc

SEQ ID NO: 2937365 - RNA, 16 nt, Mycobacterium avium subsp. paratuberculosis
cgcucggcguggcgcu

SEQ ID NO: 2937366 - RNA, 20 nt, Mycobacterium avium subsp. paratuberculosis
cgcucggcguggcgcucagc

SEQ ID NO: 2937367 - RNA, 20 nt, Mycobacterium avium subsp. paratuberculosis
cgcucggcguuggcguaguc

SEQ ID NO: 2937368 - RNA, 19 nt, Mycobacterium avium subsp. paratuberculosis
cgcucgggcccgcgcaccg

SEQ ID NO: 2937369 - RNA, 20 nt, Mycobacterium avium subsp. paratuberculosis
cgcucgggcccgcgcaccgu

SEQ ID NO: 2937370 - RNA, 14 nt, Mycobacterium avium subsp. paratuberculosis
cgcucgggccggcg

SEQ ID NO: 2937371 - RNA, 15 nt, Mycobacterium avium subsp. paratuberculosis
cgcucgggccggcgc

SEQ ID NO: 2937372 - RNA, 16 nt, Mycobacterium avium subsp. paratuberculosis
cgcucgggccggcgcc

SEQ ID NO: 2937373 - RNA, 18 nt, Mycobacterium avium subsp. paratuberculosis
cgcucgggccggcgccga

SEQ ID NO: 2937374 - RNA, 14 nt, Mycobacterium avium subsp. paratuberculosis
cgcucgggcgugcg

SEQ ID NO: 2937375 - RNA, 22 nt, Mycobacterium avium subsp. paratuberculosis
cgcucgggcgugcgcguggggc

SEQ ID NO: 2937376 - RNA, 17 nt, Mycobacterium avium subsp. paratuberculosis
cgcucgggcuucggcgu

SEQ ID NO: 2937377 - RNA, 18 nt, Mycobacterium avium subsp. paratuberculosis
cgcucgggcuucggcguc

SEQ ID NO: 2937378 - RNA, 19 nt, Mycobacterium avium subsp. paratuberculosis
cgcucgggggugcccggcc

SEQ ID NO: 2937379 - RNA, 19 nt, Mycobacterium avium subsp. paratuberculosis
cgcucgggugucgccgagc

SEQ ID NO: 2937380 - RNA, 20 nt, Mycobacterium avium subsp. paratuberculosis
cgcucgggugucgccgagcc

SEQ ID NO: 2937381 - RNA, 14 nt, Mycobacterium avium subsp. paratuberculosis
cgcucggucagcac

SEQ ID NO: 2937382 - RNA, 15 nt, Mycobacterium avium subsp. paratuberculosis
cgcucggucagcacc

SEQ ID NO: 2937383 - RNA, 18 nt, Mycobacterium avium subsp. paratuberculosis
cgcucggucagcaccggg

SEQ ID NO: 2937384 - RNA, 20 nt, Mycobacterium avium subsp. paratuberculosis
cgcucggucagcaccggggc

SEQ ID NO: 2937385 - RNA, 15 nt, Mycobacterium avium subsp. paratuberculosis
cgcucggucgccacg

SEQ ID NO: 2937386 - RNA, 22 nt, Mycobacterium avium subsp. paratuberculosis
cgcucggucuugaucaggucgc

SEQ ID NO: 2937387 - RNA, 20 nt, Mycobacterium avium subsp. paratuberculosis
cgcucguaacgccacggcgg

SEQ ID NO: 2937388 - RNA, 23 nt, Mycobacterium avium subsp. paratuberculosis
cgcucguaacgccacggcggccg

SEQ ID NO: 2937389 - RNA, 18 nt, Mycobacterium avium subsp. paratuberculosis
cgcucguaguuggggccg

SEQ ID NO: 2937390 - RNA, 20 nt, Mycobacterium avium subsp. paratuberculosis
cgcucguaguuggggccggc

SEQ ID NO: 2937391 - RNA, 14 nt, Mycobacterium avium subsp. paratuberculosis
cgcucgucgagucc

SEQ ID NO: 2937392 - RNA, 13 nt, Mycobacterium avium subsp. paratuberculosis
cgcucgucggcca

SEQ ID NO: 2937393 - RNA, 14 nt, Mycobacterium avium subsp. paratuberculosis
cgcucgucggccag

SEQ ID NO: 2937394 - RNA, 13 nt, Mycobacterium avium subsp. paratuberculosis
cgcucgucggcgc

SEQ ID NO: 2937395 - RNA, 15 nt, Mycobacterium avium subsp. paratuberculosis
cgcucgucggcgcgg

SEQ ID NO: 2937396 - RNA, 20 nt, Mycobacterium avium subsp. paratuberculosis
cgcucgucggcgcgggccag

SEQ ID NO: 2937397 - RNA, 22 nt, Mycobacterium avium subsp. paratuberculosis
cgcucgucggcgcgggccagca

SEQ ID NO: 2937398 - RNA, 14 nt, Mycobacterium avium subsp. paratuberculosis
cgcucgucgggcac

SEQ ID NO: 2937399 - RNA, 15 nt, Mycobacterium avium subsp. paratuberculosis
cgcucgucgggcaca

SEQ ID NO: 2937400 - RNA, 18 nt, Mycobacterium avium subsp. paratuberculosis
cgcucgucgggcucgucg

SEQ ID NO: 2937401 - RNA, 21 nt, Mycobacterium avium subsp. paratuberculosis
cgcucgucguagucgaggccg

SEQ ID NO: 2937402 - RNA, 17 nt, Mycobacterium avium subsp. paratuberculosis
cgcugaucgcgauccgg

SEQ ID NO: 2937403 - RNA, 21 nt, Mycobacterium avium subsp. paratuberculosis
cgcugaucgcgauccgggcgc

SEQ ID NO: 2937404 - RNA, 16 nt, Mycobacterium avium subsp. paratuberculosis
cgcugaucuacgucgg

SEQ ID NO: 2937405 - RNA, 22 nt, Mycobacterium avium subsp. paratuberculosis
cgcugaucuacgucggcuggcg

SEQ ID NO: 2937406 - RNA, 16 nt, Mycobacterium avium subsp. paratuberculosis
cgcugaucucgacggu

SEQ ID NO: 2937407 - RNA, 17 nt, Mycobacterium avium subsp. paratuberculosis
cgcugaucucgacggug

SEQ ID NO: 2937408 - RNA, 18 nt, Mycobacterium avium subsp. paratuberculosis
cgcugaucugcggcacca

SEQ ID NO: 2937409 - RNA, 15 nt, Mycobacterium avium subsp. paratuberculosis
cgcugaugccgccga

SEQ ID NO: 2937410 - RNA, 22 nt, Mycobacterium avium subsp. paratuberculosis
cgcugaugccgccgaagcggcg

SEQ ID NO: 2937411 - RNA, 18 nt, Mycobacterium avium subsp. paratuberculosis
cgcugaugcgcaacagca

SEQ ID NO: 2937412 - RNA, 14 nt, Mycobacterium avium subsp. paratuberculosis
cgcugaugcggccg

SEQ ID NO: 2937413 - RNA, 15 nt, Mycobacterium avium subsp. paratuberculosis
cgcugaugcggccgg

SEQ ID NO: 2937414 - RNA, 12 nt, Mycobacterium avium subsp. paratuberculosis
cgcugauggcga

SEQ ID NO: 2937415 - RNA, 15 nt, Mycobacterium avium subsp. paratuberculosis
cgcugauggcgagga

SEQ ID NO: 2937416 - RNA, 19 nt, Mycobacterium avium subsp. paratuberculosis
cgcugcaaccgguccgccg

SEQ ID NO: 2937417 - RNA, 22 nt, Mycobacterium avium subsp. paratuberculosis
cgcugcaaccgguccgccgucg

SEQ ID NO: 2937418 - RNA, 14 nt, Mycobacterium avium subsp. paratuberculosis
cgcugcaccagccc

SEQ ID NO: 2937419 - RNA, 20 nt, Mycobacterium avium subsp. paratuberculosis
cgcugcaccagcccgucggc

SEQ ID NO: 2937420 - RNA, 13 nt, Mycobacterium avium subsp. paratuberculosis
cgcugcagcagcc

SEQ ID NO: 2937421 - RNA, 23 nt, Mycobacterium avium subsp. paratuberculosis
cgcugcagcagcccgaucacccc

SEQ ID NO: 2937422 - RNA, 13 nt, Mycobacterium avium subsp. paratuberculosis
cgcugcagcaugg

SEQ ID NO: 2937423 - RNA, 19 nt, Mycobacterium avium subsp. paratuberculosis
cgcugcagcauggacccga

SEQ ID NO: 2937424 - RNA, 19 nt, Mycobacterium avium subsp. paratuberculosis
cgcugcagccgguccggcg

SEQ ID NO: 2937425 - RNA, 20 nt, Mycobacterium avium subsp. paratuberculosis
cgcugcagccgguccggcgg

SEQ ID NO: 2937426 - RNA, 21 nt, Mycobacterium avium subsp. paratuberculosis
cgcugcagccgguccggcggc

SEQ ID NO: 2937427 - RNA, 15 nt, Mycobacterium avium subsp. paratuberculosis
cgcugcagcgccgag

SEQ ID NO: 2937428 - RNA, 16 nt, Mycobacterium avium subsp. paratuberculosis
cgcugcagcgccgccc

SEQ ID NO: 2937429 - RNA, 19 nt, Mycobacterium avium subsp. paratuberculosis
cgcugcagcgccgcccgca

SEQ ID NO: 2937430 - RNA, 13 nt, Mycobacterium avium subsp. paratuberculosis
cgcugcagcugcu

SEQ ID NO: 2937431 - RNA, 14 nt, Mycobacterium avium subsp. paratuberculosis
cgcugcagcugcuc

SEQ ID NO: 2937432 - RNA, 17 nt, Mycobacterium avium subsp. paratuberculosis
cgcugcagcugcucguc

SEQ ID NO: 2937433 - RNA, 23 nt, Mycobacterium avium subsp. paratuberculosis
cgcugcagcuucgugucaccgcc

SEQ ID NO: 2937434 - RNA, 20 nt, Mycobacterium avium subsp. paratuberculosis
cgcugcaggcccggguagcg

SEQ ID NO: 2937435 - RNA, 19 nt, Mycobacterium avium subsp. paratuberculosis
cgcugcagguggcccacac

SEQ ID NO: 2937436 - RNA, 16 nt, Mycobacterium avium subsp. paratuberculosis
cgcugcaguagccggc

SEQ ID NO: 2937437 - RNA, 17 nt, Mycobacterium avium subsp. paratuberculosis
cgcugcaguagccggcc

SEQ ID NO: 2937438 - RNA, 19 nt, Mycobacterium avium subsp. paratuberculosis
cgcugcaguagccggccag

SEQ ID NO: 2937439 - RNA, 20 nt, Mycobacterium avium subsp. paratuberculosis
cgcugcaguagccggccagc

SEQ ID NO: 2937440 - RNA, 17 nt, Mycobacterium avium subsp. paratuberculosis
cgcugcauagucggccc

SEQ ID NO: 2937441 - RNA, 18 nt, Mycobacterium avium subsp. paratuberculosis
cgcugcauagucggcccg

SEQ ID NO: 2937442 - RNA, 19 nt, Mycobacterium avium subsp. paratuberculosis
cgcugcauagucggcccga

SEQ ID NO: 2937443 - RNA, 14 nt, Mycobacterium avium subsp. paratuberculosis
cgcugcauccgcag

SEQ ID NO: 2937444 - RNA, 15 nt, Mycobacterium avium subsp. paratuberculosis
cgcugcauccgcagc

SEQ ID NO: 2937445 - RNA, 16 nt, Mycobacterium avium subsp. paratuberculosis
cgcugcauccgcagca

SEQ ID NO: 2937446 - RNA, 19 nt, Mycobacterium avium subsp. paratuberculosis
cgcugcauccgcagcacca

SEQ ID NO: 2937447 - RNA, 18 nt, Mycobacterium avium subsp. paratuberculosis
cgcugcaugccggugucg

SEQ ID NO: 2937448 - RNA, 18 nt, Mycobacterium avium subsp. paratuberculosis
cgcugcaugccgucgauc

SEQ ID NO: 2937449 - RNA, 22 nt, Mycobacterium avium subsp. paratuberculosis
cgcugccaaaguuggcaucccg

SEQ ID NO: 2937450 - RNA, 23 nt, Mycobacterium avium subsp. paratuberculosis
cgcugccaaaguuggcaucccgc

SEQ ID NO: 2937451 - RNA, 20 nt, Mycobacterium avium subsp. paratuberculosis
cgcugccacguacaccggga

SEQ ID NO: 2937452 - RNA, 15 nt, Mycobacterium avium subsp. paratuberculosis
cgcugccaggcggug

SEQ ID NO: 2937453 - RNA, 17 nt, Mycobacterium avium subsp. paratuberculosis
cgcugcccaacgucgac

SEQ ID NO: 2937454 - RNA, 14 nt, Mycobacterium avium subsp. paratuberculosis
cgcugcccagcgcg

SEQ ID NO: 2937455 - RNA, 15 nt, Mycobacterium avium subsp. paratuberculosis
cgcugcccagcgcgg

SEQ ID NO: 2937456 - RNA, 16 nt, Mycobacterium avium subsp. paratuberculosis
cgcugcccagcgcggu

SEQ ID NO: 2937457 - RNA, 15 nt, Mycobacterium avium subsp. paratuberculosis
cgcugccccagccac

SEQ ID NO: 2937458 - RNA, 18 nt, Mycobacterium avium subsp. paratuberculosis
cgcugccccagccacagc

SEQ ID NO: 2937459 - RNA, 14 nt, Mycobacterium avium subsp. paratuberculosis
cgcugccccggcga

SEQ ID NO: 2937460 - RNA, 15 nt, Mycobacterium avium subsp. paratuberculosis
cgcugccccggcgag

SEQ ID NO: 2937461 - RNA, 18 nt, Mycobacterium avium subsp. paratuberculosis
cgcugccccggcgaggcc

SEQ ID NO: 2937462 - RNA, 19 nt, Mycobacterium avium subsp. paratuberculosis
cgcugccccggcgaggcca

SEQ ID NO: 2937463 - RNA, 21 nt, Mycobacterium avium subsp. paratuberculosis
cgcugccccggcgaggccagg

SEQ ID NO: 2937464 - RNA, 23 nt, Mycobacterium avium subsp. paratuberculosis
cgcugccccggcgaggccaggcg

SEQ ID NO: 2937465 - RNA, 13 nt, Mycobacterium avium subsp. paratuberculosis
cgcugcccgaugg

SEQ ID NO: 2937466 - RNA, 14 nt, Mycobacterium avium subsp. paratuberculosis
cgcugcccgauggu

SEQ ID NO: 2937467 - RNA, 14 nt, Mycobacterium avium subsp. paratuberculosis
cgcugcccgccgcg

SEQ ID NO: 2937468 - RNA, 18 nt, Mycobacterium avium subsp. paratuberculosis
cgcugcccgccgcggugc

SEQ ID NO: 2937469 - RNA, 13 nt, Mycobacterium avium subsp. paratuberculosis
cgcugcccggcgc

SEQ ID NO: 2937470 - RNA, 14 nt, Mycobacterium avium subsp. paratuberculosis
cgcugcccggcgug

SEQ ID NO: 2937471 - RNA, 14 nt, Mycobacterium avium subsp. paratuberculosis
cgcugcccgggcau

SEQ ID NO: 2937472 - RNA, 16 nt, Mycobacterium avium subsp. paratuberculosis
cgcugcccgggcaucc

SEQ ID NO: 2937473 - RNA, 21 nt, Mycobacterium avium subsp. paratuberculosis
cgcugcccgggcaucccgccg

SEQ ID NO: 2937474 - RNA, 22 nt, Mycobacterium avium subsp. paratuberculosis
cgcugcccgggcaucccgccga

SEQ ID NO: 2937475 - RNA, 15 nt, Mycobacterium avium subsp. paratuberculosis
cgcugcccgucgacc

SEQ ID NO: 2937476 - RNA, 22 nt, Mycobacterium avium subsp. paratuberculosis
cgcugcccgucgaccuccucga

SEQ ID NO: 2937477 - RNA, 13 nt, Mycobacterium avium subsp. paratuberculosis
cgcugcccgugcc

SEQ ID NO: 2937478 - RNA, 14 nt, Mycobacterium avium subsp. paratuberculosis
cgcugcccgugccg

SEQ ID NO: 2937479 - RNA, 16 nt, Mycobacterium avium subsp. paratuberculosis
cgcugcccgugccgca

SEQ ID NO: 2937480 - RNA, 17 nt, Mycobacterium avium subsp. paratuberculosis
cgcugcccgugccgcac

SEQ ID NO: 2937481 - RNA, 16 nt, Mycobacterium avium subsp. paratuberculosis
cgcugcccucggucgc

SEQ ID NO: 2937482 - RNA, 18 nt, Mycobacterium avium subsp. paratuberculosis
cgcugcccucggucgccg

SEQ ID NO: 2937483 - RNA, 19 nt, Mycobacterium avium subsp. paratuberculosis
cgcugcccucggucgccga

SEQ ID NO: 2937484 - RNA, 22 nt, Mycobacterium avium subsp. paratuberculosis
cgcugcccucggucgccgaauc

SEQ ID NO: 2937485 - RNA, 14 nt, Mycobacterium avium subsp. paratuberculosis
cgcugccgacgaug

SEQ ID NO: 2937486 - RNA, 23 nt, Mycobacterium avium subsp. paratuberculosis
cgcugccgacgaugucggcuucg

SEQ ID NO: 2937487 - RNA, 21 nt, Mycobacterium avium subsp. paratuberculosis
cgcugcgcgggucggcgccgg

SEQ ID NO: 2937488 - RNA, 12 nt, Mycobacterium avium subsp. paratuberculosis
cgcugcgcucgc

SEQ ID NO: 2937489 - RNA, 18 nt, Mycobacterium avium subsp. paratuberculosis
cgcugcgcuucgagcaga

SEQ ID NO: 2937490 - RNA, 19 nt, Mycobacterium avium subsp. paratuberculosis
cgcugcggauaaccgucca

SEQ ID NO: 2937491 - RNA, 12 nt, Mycobacterium avium subsp. paratuberculosis
cgcugcggaucc

SEQ ID NO: 2937492 - RNA, 12 nt, Mycobacterium avium subsp. paratuberculosis
cgcugcggcaca

SEQ ID NO: 2937493 - RNA, 16 nt, Mycobacterium avium subsp. paratuberculosis
cgcugcggcacaccag

SEQ ID NO: 2937494 - RNA, 18 nt, Mycobacterium avium subsp. paratuberculosis
cgcugcggcacaccagcg

SEQ ID NO: 2937495 - RNA, 13 nt, Mycobacterium avium subsp. paratuberculosis
cgcugcggcgcag

SEQ ID NO: 2937496 - RNA, 13 nt, Mycobacterium avium subsp. paratuberculosis
cgcugcggcgccg

SEQ ID NO: 2937497 - RNA, 14 nt, Mycobacterium avium subsp. paratuberculosis
cgcugcggcgccgg

SEQ ID NO: 2937498 - RNA, 16 nt, Mycobacterium avium subsp. paratuberculosis
cgcugcggcgccgggc

SEQ ID NO: 2937499 - RNA, 17 nt, Mycobacterium avium subsp. paratuberculosis
cgcugcggcgccgggca

SEQ ID NO: 2937500 - RNA, 14 nt, Mycobacterium avium subsp. paratuberculosis
cgcugcggcgucgu

SEQ ID NO: 2937501 - RNA, 15 nt, Mycobacterium avium subsp. paratuberculosis
cgcugcggcgucguc

SEQ ID NO: 2937502 - RNA, 14 nt, Mycobacterium avium subsp. paratuberculosis
cgcugcggcuggga

SEQ ID NO: 2937503 - RNA, 18 nt, Mycobacterium avium subsp. paratuberculosis
cgcugcgggaagccgagu

SEQ ID NO: 2937504 - RNA, 24 nt, Mycobacterium avium subsp. paratuberculosis
cgcugcgggccaucgacuccagca

SEQ ID NO: 2937505 - RNA, 12 nt, Mycobacterium avium subsp. paratuberculosis
cgcugcgggcgg

SEQ ID NO: 2937506 - RNA, 16 nt, Mycobacterium avium subsp. paratuberculosis
cgcugcgggcgggccg

SEQ ID NO: 2937507 - RNA, 18 nt, Mycobacterium avium subsp. paratuberculosis
cgcugcgggcgggccgcc

SEQ ID NO: 2937508 - RNA, 21 nt, Mycobacterium avium subsp. paratuberculosis
cgcugcgggcgggccgccagg

SEQ ID NO: 2937509 - RNA, 18 nt, Mycobacterium avium subsp. paratuberculosis
cgcugcuccggguccgcg

SEQ ID NO: 2937510 - RNA, 21 nt, Mycobacterium avium subsp. paratuberculosis
cgcugcucgaccucggcgacc

SEQ ID NO: 2937511 - RNA, 15 nt, Mycobacterium avium subsp. paratuberculosis
cgcugcucugcgcgc

SEQ ID NO: 2937512 - RNA, 17 nt, Mycobacterium avium subsp. paratuberculosis
cgcugcucugcgcgcgg

SEQ ID NO: 2937513 - RNA, 19 nt, Mycobacterium avium subsp. paratuberculosis
cgcugcucugcgcgcggug

SEQ ID NO: 2937514 - RNA, 15 nt, Mycobacterium avium subsp. paratuberculosis
cgcugcugcucggcc

SEQ ID NO: 2937515 - RNA, 18 nt, Mycobacterium avium subsp. paratuberculosis
cgcugcugcucggccgca

SEQ ID NO: 2937516 - RNA, 20 nt, Mycobacterium avium subsp. paratuberculosis
cgcugcugcucggccgcauc

SEQ ID NO: 2937517 - RNA, 21 nt, Mycobacterium avium subsp. paratuberculosis
cgcugcugcucggccgcaucg

SEQ ID NO: 2937518 - RNA, 13 nt, Mycobacterium avium subsp. paratuberculosis
cgcugcugcugcc

SEQ ID NO: 2937519 - RNA, 17 nt, Mycobacterium avium subsp. paratuberculosis
cgcugcugcugcccgcc

SEQ ID NO: 2937520 - RNA, 18 nt, Mycobacterium avium subsp. paratuberculosis
cgcugcugcugcccgccc

SEQ ID NO: 2937521 - RNA, 13 nt, Mycobacterium avium subsp. paratuberculosis
cgcugcugggugc

SEQ ID NO: 2937522 - RNA, 17 nt, Mycobacterium avium subsp. paratuberculosis
cgcugcuguugcucggg

SEQ ID NO: 2937523 - RNA, 19 nt, Mycobacterium avium subsp. paratuberculosis
cgcugcuguugcucggggc

SEQ ID NO: 2937524 - RNA, 20 nt, Mycobacterium avium subsp. paratuberculosis
cgcugcuuagccccucccac

SEQ ID NO: 2937525 - RNA, 17 nt, Mycobacterium avium subsp. paratuberculosis
cgcugcuugacccgcuc

SEQ ID NO: 2937526 - RNA, 22 nt, Mycobacterium avium subsp. paratuberculosis
cgcugcuuugucucacgccucg

SEQ ID NO: 2937527 - RNA, 23 nt, Mycobacterium avium subsp. paratuberculosis
cgcuggaaaccucuugcggcgca

SEQ ID NO: 2937528 - RNA, 23 nt, Mycobacterium avium subsp. paratuberculosis
cgcuggaacagcgggccggcguc

SEQ ID NO: 2937529 - RNA, 15 nt, Mycobacterium avium subsp. paratuberculosis
cgcuggaacgccgag

SEQ ID NO: 2937530 - RNA, 21 nt, Mycobacterium avium subsp. paratuberculosis
cgcuggacagccacagcucgg

SEQ ID NO: 2937531 - RNA, 22 nt, Mycobacterium avium subsp. paratuberculosis
cgcuggacagccacagcucggg

SEQ ID NO: 2937532 - RNA, 15 nt, Mycobacterium avium subsp. paratuberculosis
cgcuggauguccagg

SEQ ID NO: 2937533 - RNA, 19 nt, Mycobacterium avium subsp. paratuberculosis
cgcuggauuccaccguggu

SEQ ID NO: 2937534 - RNA, 22 nt, Mycobacterium avium subsp. paratuberculosis
cgcuggauuccaccguggucgg

SEQ ID NO: 2937535 - RNA, 22 nt, Mycobacterium avium subsp. paratuberculosis
cgcuggcaggacgggcaccagu

SEQ ID NO: 2937536 - RNA, 20 nt, Mycobacterium avium subsp. paratuberculosis
cgcuggccacgauccggggc

SEQ ID NO: 2937537 - RNA, 21 nt, Mycobacterium avium subsp. paratuberculosis
cgcuggccacgauccggggca

SEQ ID NO: 2937538 - RNA, 12 nt, Mycobacterium avium subsp. paratuberculosis
cgcuggccagcg

SEQ ID NO: 2937539 - RNA, 16 nt, Mycobacterium avium subsp. paratuberculosis
cgcuggccagcgcgac

SEQ ID NO: 2937540 - RNA, 17 nt, Mycobacterium avium subsp. paratuberculosis
cgcuggccagcgcgacg

SEQ ID NO: 2937541 - RNA, 18 nt, Mycobacterium avium subsp. paratuberculosis
cgcuggccagcgcgacgg

SEQ ID NO: 2937542 - RNA, 19 nt, Mycobacterium avium subsp. paratuberculosis
cgcuggccagcgcgacggc

SEQ ID NO: 2937543 - RNA, 23 nt, Mycobacterium avium subsp. paratuberculosis
cgcuggccagcgucagggcgacu

SEQ ID NO: 2937544 - RNA, 12 nt, Mycobacterium avium subsp. paratuberculosis
cgcuggcccggc

SEQ ID NO: 2937545 - RNA, 13 nt, Mycobacterium avium subsp. paratuberculosis
cgcuggccgaccc

SEQ ID NO: 2937546 - RNA, 22 nt, Mycobacterium avium subsp. paratuberculosis
cgcuggccgaucccggccacgu

SEQ ID NO: 2937547 - RNA, 15 nt, Mycobacterium avium subsp. paratuberculosis
cgcuggccgcgacgu

SEQ ID NO: 2937548 - RNA, 15 nt, Mycobacterium avium subsp. paratuberculosis
cgcuggccgcgccac

SEQ ID NO: 2937549 - RNA, 21 nt, Mycobacterium avium subsp. paratuberculosis
cgcuggccgcggccagcugcc

SEQ ID NO: 2937550 - RNA, 14 nt, Mycobacterium avium subsp. paratuberculosis
cgcuggccggccac

SEQ ID NO: 2937551 - RNA, 21 nt, Mycobacterium avium subsp. paratuberculosis
cgcuggccggccaccagcggc

SEQ ID NO: 2937552 - RNA, 22 nt, Mycobacterium avium subsp. paratuberculosis
cgcuggccggccaccagcggcc

SEQ ID NO: 2937553 - RNA, 12 nt, Mycobacterium avium subsp. paratuberculosis
cgcuggccucca

SEQ ID NO: 2937554 - RNA, 20 nt, Mycobacterium avium subsp. paratuberculosis
cgcuggccuccagcuuugcc

SEQ ID NO: 2937555 - RNA, 21 nt, Mycobacterium avium subsp. paratuberculosis
cgcuggcgaauuccccguagu

SEQ ID NO: 2937556 - RNA, 17 nt, Mycobacterium avium subsp. paratuberculosis
cgcuggcgaccaucagc

SEQ ID NO: 2937557 - RNA, 20 nt, Mycobacterium avium subsp. paratuberculosis
cgcuggcgaccaucagccug

SEQ ID NO: 2937558 - RNA, 17 nt, Mycobacterium avium subsp. paratuberculosis
cgcuggcgaucaccuug

SEQ ID NO: 2937559 - RNA, 18 nt, Mycobacterium avium subsp. paratuberculosis
cgcuggcgaucaccuugc

SEQ ID NO: 2937560 - RNA, 19 nt, Mycobacterium avium subsp. paratuberculosis
cgcuggcgaucaccuugcg

SEQ ID NO: 2937561 - RNA, 22 nt, Mycobacterium avium subsp. paratuberculosis
cgcuggcgaucaccuugcggcc

SEQ ID NO: 2937562 - RNA, 14 nt, Mycobacterium avium subsp. paratuberculosis
cgcuggcgcaggcg

SEQ ID NO: 2937563 - RNA, 12 nt, Mycobacterium avium subsp. paratuberculosis
cgcuggcgccgg

SEQ ID NO: 2937564 - RNA, 14 nt, Mycobacterium avium subsp. paratuberculosis
cgcuggcgccggcg

SEQ ID NO: 2937565 - RNA, 15 nt, Mycobacterium avium subsp. paratuberculosis
cgcuggcgccggcgu

SEQ ID NO: 2937566 - RNA, 16 nt, Mycobacterium avium subsp. paratuberculosis
cgcuggcgccggcguc

SEQ ID NO: 2937567 - RNA, 18 nt, Mycobacterium avium subsp. paratuberculosis
cgcuggcgccggcgucca

SEQ ID NO: 2937568 - RNA, 13 nt, Mycobacterium avium subsp. paratuberculosis
cgcuggcgcgccg

SEQ ID NO: 2937569 - RNA, 15 nt, Mycobacterium avium subsp. paratuberculosis
cgcuggcggccagcg

SEQ ID NO: 2937570 - RNA, 18 nt, Mycobacterium avium subsp. paratuberculosis
cgcuggcggccaucgccg

SEQ ID NO: 2937571 - RNA, 21 nt, Mycobacterium avium subsp. paratuberculosis
cgcuggcggccaucgccgcgg

SEQ ID NO: 2937572 - RNA, 13 nt, Mycobacterium avium subsp. paratuberculosis
cgcuggugcgggc

SEQ ID NO: 2937573 - RNA, 16 nt, Mycobacterium avium subsp. paratuberculosis
cgcuggugcgggccag

SEQ ID NO: 2937574 - RNA, 17 nt, Mycobacterium avium subsp. paratuberculosis
cgcuggugcgggccagc

SEQ ID NO: 2937575 - RNA, 18 nt, Mycobacterium avium subsp. paratuberculosis
cgcuggugcgggccagca

SEQ ID NO: 2937576 - RNA, 13 nt, Mycobacterium avium subsp. paratuberculosis
cgcugguggccga

SEQ ID NO: 2937577 - RNA, 16 nt, Mycobacterium avium subsp. paratuberculosis
cgcugguggccgacgu

SEQ ID NO: 2937578 - RNA, 21 nt, Mycobacterium avium subsp. paratuberculosis
cgcugguggccgacgugccgg

SEQ ID NO: 2937579 - RNA, 13 nt, Mycobacterium avium subsp. paratuberculosis
cgcugguggccug

SEQ ID NO: 2937580 - RNA, 23 nt, Mycobacterium avium subsp. paratuberculosis
cgcugguggugaucacccagccg

SEQ ID NO: 2937581 - RNA, 16 nt, Mycobacterium avium subsp. paratuberculosis
cgcuggugugacgcuc

SEQ ID NO: 2937582 - RNA, 17 nt, Mycobacterium avium subsp. paratuberculosis
cgcuggugugacgcucg

SEQ ID NO: 2937583 - RNA, 15 nt, Mycobacterium avium subsp. paratuberculosis
cgcugguugucgacg

SEQ ID NO: 2937584 - RNA, 17 nt, Mycobacterium avium subsp. paratuberculosis
cgcugguugucgacgcu

SEQ ID NO: 2937585 - RNA, 18 nt, Mycobacterium avium subsp. paratuberculosis
cgcugguugucgacgcug

SEQ ID NO: 2937586 - RNA, 21 nt, Mycobacterium avium subsp. paratuberculosis
cgcugguugucgacgcugcag

SEQ ID NO: 2937587 - RNA, 14 nt, Mycobacterium avium subsp. paratuberculosis
cgcuguagagcagu

SEQ ID NO: 2937588 - RNA, 16 nt, Mycobacterium avium subsp. paratuberculosis
cgcuguaggccagccc

SEQ ID NO: 2937589 - RNA, 19 nt, Mycobacterium avium subsp. paratuberculosis
cgcuguaggccagcccggc

SEQ ID NO: 2937590 - RNA, 15 nt, Mycobacterium avium subsp. paratuberculosis
cgcuguaggcggcgu

SEQ ID NO: 2937591 - RNA, 17 nt, Mycobacterium avium subsp. paratuberculosis
cgcuguagggccaccac

SEQ ID NO: 2937592 - RNA, 14 nt, Mycobacterium avium subsp. paratuberculosis
cgcuguaggucgcg

SEQ ID NO: 2937593 - RNA, 17 nt, Mycobacterium avium subsp. paratuberculosis
cgcuguaguagccgggg

SEQ ID NO: 2937594 - RNA, 18 nt, Mycobacterium avium subsp. paratuberculosis
cgcugucaauccccgcgg

SEQ ID NO: 2937595 - RNA, 16 nt, Mycobacterium avium subsp. paratuberculosis
cgcuguccacguccug

SEQ ID NO: 2937596 - RNA, 19 nt, Mycobacterium avium subsp. paratuberculosis
cgcuguccucgagcgcguc

SEQ ID NO: 2937597 - RNA, 20 nt, Mycobacterium avium subsp. paratuberculosis
cgcuguccugccgggcgucg

SEQ ID NO: 2937598 - RNA, 22 nt, Mycobacterium avium subsp. paratuberculosis
cgcuguccugccgggcgucgac

SEQ ID NO: 2937599 - RNA, 23 nt, Mycobacterium avium subsp. paratuberculosis
cgcuguccugccgggcgucgacg

SEQ ID NO: 2937600 - RNA, 15 nt, Mycobacterium avium subsp. paratuberculosis
cgcuguccuggucgc

SEQ ID NO: 2937601 - RNA, 17 nt, Mycobacterium avium subsp. paratuberculosis
cgcugucgacgcguugu

SEQ ID NO: 2937602 - RNA, 19 nt, Mycobacterium avium subsp. paratuberculosis
cgcugucgauggacaaggu

SEQ ID NO: 2937603 - RNA, 15 nt, Mycobacterium avium subsp. paratuberculosis
cgcugucgcgggccc

SEQ ID NO: 2937604 - RNA, 18 nt, Mycobacterium avium subsp. paratuberculosis
cgcugucgcgggcccgcg

SEQ ID NO: 2937605 - RNA, 14 nt, Mycobacterium avium subsp. paratuberculosis
cgcugucggcgaaa

SEQ ID NO: 2937606 - RNA, 13 nt, Mycobacterium avium subsp. paratuberculosis
cgcugucggugug

SEQ ID NO: 2937607 - RNA, 15 nt, Mycobacterium avium subsp. paratuberculosis
cgcugugauagcggc

SEQ ID NO: 2937608 - RNA, 22 nt, Mycobacterium avium subsp. paratuberculosis
cgcugugaugggugagcgggaa

SEQ ID NO: 2937609 - RNA, 24 nt, Mycobacterium avium subsp. paratuberculosis
cgcugugcgccauguccggcaggc

SEQ ID NO: 2937610 - RNA, 14 nt, Mycobacterium avium subsp. paratuberculosis
cgcugugcggcccg

SEQ ID NO: 2937611 - RNA, 15 nt, Mycobacterium avium subsp. paratuberculosis
cgcugugcggcccgg

SEQ ID NO: 2937612 - RNA, 16 nt, Mycobacterium avium subsp. paratuberculosis
cgcugugcggcccggc

SEQ ID NO: 2937613 - RNA, 22 nt, Mycobacterium avium subsp. paratuberculosis
cgcugugcgggugaggccaggc

SEQ ID NO: 2937614 - RNA, 23 nt, Mycobacterium avium subsp. paratuberculosis
cgcugugcgggugaggccaggcg

SEQ ID NO: 2937615 - RNA, 13 nt, Mycobacterium avium subsp. paratuberculosis
cgcugugcucgac

SEQ ID NO: 2937616 - RNA, 14 nt, Mycobacterium avium subsp. paratuberculosis
cgcugugcucgacg

SEQ ID NO: 2937617 - RNA, 19 nt, Mycobacterium avium subsp. paratuberculosis
cgcuguggacaggucgaug

SEQ ID NO: 2937618 - RNA, 17 nt, Mycobacterium avium subsp. paratuberculosis
cgcuguggccguugauc

SEQ ID NO: 2937619 - RNA, 20 nt, Mycobacterium avium subsp. paratuberculosis
cgcugugguccucgucaccg

SEQ ID NO: 2937620 - RNA, 21 nt, Mycobacterium avium subsp. paratuberculosis
cgcugugguccucgucaccgu

SEQ ID NO: 2937621 - RNA, 18 nt, Mycobacterium avium subsp. paratuberculosis
cgcuguggugacggcccc

SEQ ID NO: 2937622 - RNA, 18 nt, Mycobacterium avium subsp. paratuberculosis
cgcuguuagccucgccag

SEQ ID NO: 2937623 - RNA, 22 nt, Mycobacterium avium subsp. paratuberculosis
cgcuguugcccaauucgacugc

SEQ ID NO: 2937624 - RNA, 17 nt, Mycobacterium avium subsp. paratuberculosis
cgcuguuggaaccggcc

SEQ ID NO: 2937625 - RNA, 17 nt, Mycobacterium avium subsp. paratuberculosis
cgcuguuggcgacggug

SEQ ID NO: 2937626 - RNA, 16 nt, Mycobacterium avium subsp. paratuberculosis
cgcuuacugcgaggcg

SEQ ID NO: 2937627 - RNA, 15 nt, Mycobacterium avium subsp. paratuberculosis
cgcuucaggcagcgc

SEQ ID NO: 2937628 - RNA, 14 nt, Mycobacterium avium subsp. paratuberculosis
cgcuuccagcacca

SEQ ID NO: 2937629 - RNA, 14 nt, Mycobacterium avium subsp. paratuberculosis
cgcuuccagcgcgg

SEQ ID NO: 2937630 - RNA, 19 nt, Mycobacterium avium subsp. paratuberculosis
cgcuuccagcgcggcgauc

SEQ ID NO: 2937631 - RNA, 19 nt, Mycobacterium avium subsp. paratuberculosis
cgcuucccacagucgcugg

SEQ ID NO: 2937632 - RNA, 21 nt, Mycobacterium avium subsp. paratuberculosis
cgcuucgcccggcugcgccgc

SEQ ID NO: 2937633 - RNA, 11 nt, Mycobacterium avium subsp. paratuberculosis
cgcuucggcca

SEQ ID NO: 2937634 - RNA, 12 nt, Mycobacterium avium subsp. paratuberculosis
cgcuucggccag

SEQ ID NO: 2937635 - RNA, 13 nt, Mycobacterium avium subsp. paratuberculosis
cgcuucggccagc

SEQ ID NO: 2937636 - RNA, 14 nt, Mycobacterium avium subsp. paratuberculosis
cgcuucggccagcg

SEQ ID NO: 2937637 - RNA, 15 nt, Mycobacterium avium subsp. paratuberculosis
cgcuucggccagcgc

SEQ ID NO: 2937638 - RNA, 16 nt, Mycobacterium avium subsp. paratuberculosis
cgcuucggccagcgcg

SEQ ID NO: 2937639 - RNA, 18 nt, Mycobacterium avium subsp. paratuberculosis
cgcuucggccagcgcguc

SEQ ID NO: 2937640 - RNA, 18 nt, Mycobacterium avium subsp. paratuberculosis
cgcuucggcucggggucg

SEQ ID NO: 2937641 - RNA, 23 nt, Mycobacterium avium subsp. paratuberculosis
cgcuucgggugcgggugcggccg

SEQ ID NO: 2937642 - RNA, 14 nt, Mycobacterium avium subsp. paratuberculosis
cgcuucgucgccgg

SEQ ID NO: 2937643 - RNA, 18 nt, Mycobacterium avium subsp. paratuberculosis
cgcuucgucgccggccgc

SEQ ID NO: 2937644 - RNA, 21 nt, Mycobacterium avium subsp. paratuberculosis
cgcuucguggacgaacgcggc

SEQ ID NO: 2937645 - RNA, 14 nt, Mycobacterium avium subsp. paratuberculosis
cgcuucugcgccgg

SEQ ID NO: 2937646 - RNA, 20 nt, Mycobacterium avium subsp. paratuberculosis
cgcuucuggcgggcgaagcg

SEQ ID NO: 2937647 - RNA, 13 nt, Mycobacterium avium subsp. paratuberculosis
cgcuugaccucgc

SEQ ID NO: 2937648 - RNA, 22 nt, Mycobacterium avium subsp. paratuberculosis
cgcuugaccucgccgagcagcc

SEQ ID NO: 2937649 - RNA, 18 nt, Mycobacterium avium subsp. paratuberculosis
cgcuugacgaacgccacc

SEQ ID NO: 2937650 - RNA, 23 nt, Mycobacterium avium subsp. paratuberculosis
cgcuugacgaacgccaccacggc

SEQ ID NO: 2937651 - RNA, 13 nt, Mycobacterium avium subsp. paratuberculosis
cgcuugacggccg

SEQ ID NO: 2937652 - RNA, 14 nt, Mycobacterium avium subsp. paratuberculosis
cgcuugacggccgg

SEQ ID NO: 2937653 - RNA, 18 nt, Mycobacterium avium subsp. paratuberculosis
cgcuugacggccgggccc

SEQ ID NO: 2937654 - RNA, 15 nt, Mycobacterium avium subsp. paratuberculosis
cgcuugauggcggcg

SEQ ID NO: 2937655 - RNA, 19 nt, Mycobacterium avium subsp. paratuberculosis
cgcuugcagcuuggcggug

SEQ ID NO: 2937656 - RNA, 14 nt, Mycobacterium avium subsp. paratuberculosis
cgcuugccagccgg

SEQ ID NO: 2937657 - RNA, 18 nt, Mycobacterium avium subsp. paratuberculosis
cggaagcccuugcagcac

SEQ ID NO: 2937658 - RNA, 22 nt, Mycobacterium avium subsp. paratuberculosis
cggaagcccuugcagcacaccg

SEQ ID NO: 2937659 - RNA, 21 nt, Mycobacterium avium subsp. paratuberculosis
cggaaggccaaggccagcaac

SEQ ID NO: 2937660 - RNA, 13 nt, Mycobacterium avium subsp. paratuberculosis
cggaaggccagcu

SEQ ID NO: 2937661 - RNA, 12 nt, Mycobacterium avium subsp. paratuberculosis
cggaaggccagg

SEQ ID NO: 2937662 - RNA, 18 nt, Mycobacterium avium subsp. paratuberculosis
cggaaggcccccggcucg

SEQ ID NO: 2937663 - RNA, 14 nt, Mycobacterium avium subsp. paratuberculosis
cggaaggccgcgcg

SEQ ID NO: 2937664 - RNA, 16 nt, Mycobacterium avium subsp. paratuberculosis
cggaaggccgcgcggg

SEQ ID NO: 2937665 - RNA, 17 nt, Mycobacterium avium subsp. paratuberculosis
cggaaggucuuucgucg

SEQ ID NO: 2937666 - RNA, 15 nt, Mycobacterium avium subsp. paratuberculosis
cggaaguagcccgga

SEQ ID NO: 2937667 - RNA, 17 nt, Mycobacterium avium subsp. paratuberculosis
cggaaguucucgccgug

SEQ ID NO: 2937668 - RNA, 13 nt, Mycobacterium avium subsp. paratuberculosis
cggaauacagcag

SEQ ID NO: 2937669 - RNA, 14 nt, Mycobacterium avium subsp. paratuberculosis
cggaauacagcagc

SEQ ID NO: 2937670 - RNA, 20 nt, Mycobacterium avium subsp. paratuberculosis
cggaaucacuuccgcggcaa

SEQ ID NO: 2937671 - RNA, 23 nt, Mycobacterium avium subsp. paratuberculosis
cggaaucacuuccgcggcaaggc

SEQ ID NO: 2937672 - RNA, 19 nt, Mycobacterium avium subsp. paratuberculosis
cggaaucgauuggugcgca

SEQ ID NO: 2937673 - RNA, 19 nt, Mycobacterium avium subsp. paratuberculosis
cggaaucgcccgggccagg

SEQ ID NO: 2937674 - RNA, 20 nt, Mycobacterium avium subsp. paratuberculosis
cggaaucgcgggaucggccg

SEQ ID NO: 2937675 - RNA, 15 nt, Mycobacterium avium subsp. paratuberculosis
cggaaucgcgguagc

SEQ ID NO: 2937676 - RNA, 14 nt, Mycobacterium avium subsp. paratuberculosis
cggaaucgucggcc

SEQ ID NO: 2937677 - RNA, 16 nt, Mycobacterium avium subsp. paratuberculosis
cggaaucgucggccac

SEQ ID NO: 2937678 - RNA, 20 nt, Mycobacterium avium subsp. paratuberculosis
cggaaucgucggccacgcuc

SEQ ID NO: 2937679 - RNA, 13 nt, Mycobacterium avium subsp. paratuberculosis
cggaaugaacgcg

SEQ ID NO: 2937680 - RNA, 18 nt, Mycobacterium avium subsp. paratuberculosis
cggaaugaacgcggccag

SEQ ID NO: 2937681 - RNA, 20 nt, Mycobacterium avium subsp. paratuberculosis
cggaaugaacgcggccaggg

SEQ ID NO: 2937682 - RNA, 18 nt, Mycobacterium avium subsp. paratuberculosis
cggaaugaacugccgcgg

SEQ ID NO: 2937683 - RNA, 19 nt, Mycobacterium avium subsp. paratuberculosis
cggaauggcaaggccagca

SEQ ID NO: 2937684 - RNA, 20 nt, Mycobacterium avium subsp. paratuberculosis
cggaauggcaaggccagcaa

SEQ ID NO: 2937685 - RNA, 21 nt, Mycobacterium avium subsp. paratuberculosis
cggaauggcaaggccagcaac

SEQ ID NO: 2937686 - RNA, 14 nt, Mycobacterium avium subsp. paratuberculosis
cggaauggcagcag

SEQ ID NO: 2937687 - RNA, 17 nt, Mycobacterium avium subsp. paratuberculosis
cggaauggcagcagccg

SEQ ID NO: 2937688 - RNA, 14 nt, Mycobacterium avium subsp. paratuberculosis
cggaauucgcgggu

SEQ ID NO: 2937689 - RNA, 14 nt, Mycobacterium avium subsp. paratuberculosis
cggaauucgggugc

SEQ ID NO: 2937690 - RNA, 17 nt, Mycobacterium avium subsp. paratuberculosis
cggaauugaagcccugc

SEQ ID NO: 2937691 - RNA, 23 nt, Mycobacterium avium subsp. paratuberculosis
cggaauugaagcccugcucggug

SEQ ID NO: 2937692 - RNA, 22 nt, Mycobacterium avium subsp. paratuberculosis
cggaauugcuuuuugaccaccg

SEQ ID NO: 2937693 - RNA, 17 nt, Mycobacterium avium subsp. paratuberculosis
cggaauuuucgccguca

SEQ ID NO: 2937694 - RNA, 18 nt, Mycobacterium avium subsp. paratuberculosis
cggaauuuucgccgucac

SEQ ID NO: 2937695 - RNA, 14 nt, Mycobacterium avium subsp. paratuberculosis
cggacaccaccgcg

SEQ ID NO: 2937696 - RNA, 21 nt, Mycobacterium avium subsp. paratuberculosis
cggacaccaccgcggugggcc

SEQ ID NO: 2937697 - RNA, 13 nt, Mycobacterium avium subsp. paratuberculosis
cggacaccccggc

SEQ ID NO: 2937698 - RNA, 15 nt, Mycobacterium avium subsp. paratuberculosis
cggacaccccggcca

SEQ ID NO: 2937699 - RNA, 17 nt, Mycobacterium avium subsp. paratuberculosis
cggacaccccggccagu

SEQ ID NO: 2937700 - RNA, 19 nt, Mycobacterium avium subsp. paratuberculosis
cggacaccccggccagucc

SEQ ID NO: 2937701 - RNA, 20 nt, Mycobacterium avium subsp. paratuberculosis
cggacaccccggccaguccg

SEQ ID NO: 2937702 - RNA, 13 nt, Mycobacterium avium subsp. paratuberculosis
cggacacccgcgc

SEQ ID NO: 2937703 - RNA, 14 nt, Mycobacterium avium subsp. paratuberculosis
cggacacccgcgcg

SEQ ID NO: 2937704 - RNA, 16 nt, Mycobacterium avium subsp. paratuberculosis
cggacacccgcgcggu

SEQ ID NO: 2937705 - RNA, 18 nt, Mycobacterium avium subsp. paratuberculosis
cggacacccgcgcggugc

SEQ ID NO: 2937706 - RNA, 20 nt, Mycobacterium avium subsp. paratuberculosis
cggacacccgcgcggugccc

SEQ ID NO: 2937707 - RNA, 13 nt, Mycobacterium avium subsp. paratuberculosis
cggacaccgaacc

SEQ ID NO: 2937708 - RNA, 16 nt, Mycobacterium avium subsp. paratuberculosis
cggacaccggcacguc

SEQ ID NO: 2937709 - RNA, 17 nt, Mycobacterium avium subsp. paratuberculosis
cggacaccucggccagc

SEQ ID NO: 2937710 - RNA, 16 nt, Mycobacterium avium subsp. paratuberculosis
cggacacgaacgacgc

SEQ ID NO: 2937711 - RNA, 22 nt, Mycobacterium avium subsp. paratuberculosis
cggacacgaacgacgcggcacg

SEQ ID NO: 2937712 - RNA, 14 nt, Mycobacterium avium subsp. paratuberculosis
cggacacggccagc

SEQ ID NO: 2937713 - RNA, 21 nt, Mycobacterium avium subsp. paratuberculosis
cggacacggccagcgccguca

SEQ ID NO: 2937714 - RNA, 13 nt, Mycobacterium avium subsp. paratuberculosis
cggacacggccgg

SEQ ID NO: 2937715 - RNA, 17 nt, Mycobacterium avium subsp. paratuberculosis
cggacacggccgggauu

SEQ ID NO: 2937716 - RNA, 18 nt, Mycobacterium avium subsp. paratuberculosis
cggacacggcgccgugcg

SEQ ID NO: 2937717 - RNA, 24 nt, Mycobacterium avium subsp. paratuberculosis
cggacacggcgccgugcgccucga

SEQ ID NO: 2937718 - RNA, 22 nt, Mycobacterium avium subsp. paratuberculosis
cggacagaucgcccaucaccgc

SEQ ID NO: 2937719 - RNA, 14 nt, Mycobacterium avium subsp. paratuberculosis
cggacagcacguug

SEQ ID NO: 2937720 - RNA, 16 nt, Mycobacterium avium subsp. paratuberculosis
cggacagcagcaccgg

SEQ ID NO: 2937721 - RNA, 18 nt, Mycobacterium avium subsp. paratuberculosis
cggacagcagcaccggca

SEQ ID NO: 2937722 - RNA, 21 nt, Mycobacterium avium subsp. paratuberculosis
cggacagcagcaccggcaccg

SEQ ID NO: 2937723 - RNA, 13 nt, Mycobacterium avium subsp. paratuberculosis
cggacagccccga

SEQ ID NO: 2937724 - RNA, 13 nt, Mycobacterium avium subsp. paratuberculosis
cggacagcgcgac

SEQ ID NO: 2937725 - RNA, 12 nt, Mycobacterium avium subsp. paratuberculosis
cggacagcgcgg

SEQ ID NO: 2937726 - RNA, 15 nt, Mycobacterium avium subsp. paratuberculosis
cggacagcgcgguga

SEQ ID NO: 2937727 - RNA, 12 nt, Mycobacterium avium subsp. paratuberculosis
cggacagcgggc

SEQ ID NO: 2937728 - RNA, 14 nt, Mycobacterium avium subsp. paratuberculosis
cggacagcgggccg

SEQ ID NO: 2937729 - RNA, 16 nt, Mycobacterium avium subsp. paratuberculosis
cggacagcgggccgac

SEQ ID NO: 2937730 - RNA, 21 nt, Mycobacterium avium subsp. paratuberculosis
cggacagcgggccgacccggc

SEQ ID NO: 2937731 - RNA, 17 nt, Mycobacterium avium subsp. paratuberculosis
cggacagcucaccgggc

SEQ ID NO: 2937732 - RNA, 22 nt, Mycobacterium avium subsp. paratuberculosis
cggacagcucgccggccgcggg

SEQ ID NO: 2937733 - RNA, 15 nt, Mycobacterium avium subsp. paratuberculosis
cggacagcugggcgu

SEQ ID NO: 2937734 - RNA, 15 nt, Mycobacterium avium subsp. paratuberculosis
cggacagggcggcga

SEQ ID NO: 2937735 - RNA, 16 nt, Mycobacterium avium subsp. paratuberculosis
cggacagggcggcgac

SEQ ID NO: 2937736 - RNA, 17 nt, Mycobacterium avium subsp. paratuberculosis
cggacagggcggcgacc

SEQ ID NO: 2937737 - RNA, 14 nt, Mycobacterium avium subsp. paratuberculosis
cggacaggucgagg

SEQ ID NO: 2937738 - RNA, 13 nt, Mycobacterium avium subsp. paratuberculosis
cggacagguggcc

SEQ ID NO: 2937739 - RNA, 20 nt, Mycobacterium avium subsp. paratuberculosis
cggacagguggccgaucagc

SEQ ID NO: 2937740 - RNA, 17 nt, Mycobacterium avium subsp. paratuberculosis
cggacauaggcgucgcg

SEQ ID NO: 2937741 - RNA, 18 nt, Mycobacterium avium subsp. paratuberculosis
cggacauaggcgucgcgg

SEQ ID NO: 2937742 - RNA, 13 nt, Mycobacterium avium subsp. paratuberculosis
cggaccugggugc

SEQ ID NO: 2937743 - RNA, 17 nt, Mycobacterium avium subsp. paratuberculosis
cggaccugggugcgcca

SEQ ID NO: 2937744 - RNA, 19 nt, Mycobacterium avium subsp. paratuberculosis
cggaccugggugcgccacu

SEQ ID NO: 2937745 - RNA, 19 nt, Mycobacterium avium subsp. paratuberculosis
cggaccuuggugucggcga

SEQ ID NO: 2937746 - RNA, 22 nt, Mycobacterium avium subsp. paratuberculosis
cggaccuuggugucggcgagcu

SEQ ID NO: 2937747 - RNA, 20 nt, Mycobacterium avium subsp. paratuberculosis
cggacgaacaucgagcccac

SEQ ID NO: 2937748 - RNA, 23 nt, Mycobacterium avium subsp. paratuberculosis
cggacgaacaucgagcccaccgc

SEQ ID NO: 2937749 - RNA, 18 nt, Mycobacterium avium subsp. paratuberculosis
cggacgaccugggcgccg

SEQ ID NO: 2937750 - RNA, 22 nt, Mycobacterium avium subsp. paratuberculosis
cggacgacucguucgacgccgg

SEQ ID NO: 2937751 - RNA, 14 nt, Mycobacterium avium subsp. paratuberculosis
cggacgagccgucg

SEQ ID NO: 2937752 - RNA, 17 nt, Mycobacterium avium subsp. paratuberculosis
cggacgagccgucgcgg

SEQ ID NO: 2937753 - RNA, 16 nt, Mycobacterium avium subsp. paratuberculosis
cggacgaugacccagc

SEQ ID NO: 2937754 - RNA, 16 nt, Mycobacterium avium subsp. paratuberculosis
cggacgaugccgcggc

SEQ ID NO: 2937755 - RNA, 18 nt, Mycobacterium avium subsp. paratuberculosis
cggacgaugccgcggcgu

SEQ ID NO: 2937756 - RNA, 15 nt, Mycobacterium avium subsp. paratuberculosis
cggacgaugcgcacc

SEQ ID NO: 2937757 - RNA, 19 nt, Mycobacterium avium subsp. paratuberculosis
cggacgaugcgcacccccg

SEQ ID NO: 2937758 - RNA, 20 nt, Mycobacterium avium subsp. paratuberculosis
cggacgaugcgcacccccgg

SEQ ID NO: 2937759 - RNA, 23 nt, Mycobacterium avium subsp. paratuberculosis
cggacgaugcgcacccccggggc

SEQ ID NO: 2937760 - RNA, 17 nt, Mycobacterium avium subsp. paratuberculosis
cggacgauguccgccgg

SEQ ID NO: 2937761 - RNA, 21 nt, Mycobacterium avium subsp. paratuberculosis
cggacgauguccgccggccgg

SEQ ID NO: 2937762 - RNA, 18 nt, Mycobacterium avium subsp. paratuberculosis
cggacgauucgcgaucaa

SEQ ID NO: 2937763 - RNA, 17 nt, Mycobacterium avium subsp. paratuberculosis
cggacgcagcgaucggc

SEQ ID NO: 2937764 - RNA, 19 nt, Mycobacterium avium subsp. paratuberculosis
cggacgcauccacggccgg

SEQ ID NO: 2937765 - RNA, 20 nt, Mycobacterium avium subsp. paratuberculosis
cggacgcauccacggccggu

SEQ ID NO: 2937766 - RNA, 13 nt, Mycobacterium avium subsp. paratuberculosis
cggacgcccgucg

SEQ ID NO: 2937767 - RNA, 13 nt, Mycobacterium avium subsp. paratuberculosis
cggacgccggcag

SEQ ID NO: 2937768 - RNA, 14 nt, Mycobacterium avium subsp. paratuberculosis
cggacgccggcagc

SEQ ID NO: 2937769 - RNA, 14 nt, Mycobacterium avium subsp. paratuberculosis
cggacgcggccagc

SEQ ID NO: 2937770 - RNA, 16 nt, Mycobacterium avium subsp. paratuberculosis
cggacgcggccagcgc

SEQ ID NO: 2937771 - RNA, 17 nt, Mycobacterium avium subsp. paratuberculosis
cggacgcggccagcgcc

SEQ ID NO: 2937772 - RNA, 18 nt, Mycobacterium avium subsp. paratuberculosis
cggacgcggccagcgccc

SEQ ID NO: 2937773 - RNA, 19 nt, Mycobacterium avium subsp. paratuberculosis
cggacgcggccagcgcccg

SEQ ID NO: 2937774 - RNA, 22 nt, Mycobacterium avium subsp. paratuberculosis
cggacgcggccagcgcccgcgc

SEQ ID NO: 2937775 - RNA, 15 nt, Mycobacterium avium subsp. paratuberculosis
cggacgcggccgagc

SEQ ID NO: 2937776 - RNA, 18 nt, Mycobacterium avium subsp. paratuberculosis
cggacgcggccgagccga

SEQ ID NO: 2937777 - RNA, 22 nt, Mycobacterium avium subsp. paratuberculosis
cggacgcuaagcgcugaaccgg

SEQ ID NO: 2937778 - RNA, 14 nt, Mycobacterium avium subsp. paratuberculosis
cggacggagccgug

SEQ ID NO: 2937779 - RNA, 19 nt, Mycobacterium avium subsp. paratuberculosis
cggacggagccgugcccga

SEQ ID NO: 2937780 - RNA, 17 nt, Mycobacterium avium subsp. paratuberculosis
cggacggaucgaguccc

SEQ ID NO: 2937781 - RNA, 21 nt, Mycobacterium avium subsp. paratuberculosis
cggacggaucgagucccgcgc

SEQ ID NO: 2937782 - RNA, 13 nt, Mycobacterium avium subsp. paratuberculosis
cggacggcaccga

SEQ ID NO: 2937783 - RNA, 21 nt, Mycobacterium avium subsp. paratuberculosis
cggacggcaccgacggagccg

SEQ ID NO: 2937784 - RNA, 21 nt, Mycobacterium avium subsp. paratuberculosis
cggacggccaccuugucggcg

SEQ ID NO: 2937785 - RNA, 22 nt, Mycobacterium avium subsp. paratuberculosis
cggacggccaccuugucggcgc

SEQ ID NO: 2937786 - RNA, 12 nt, Mycobacterium avium subsp. paratuberculosis
cggacggccagc

SEQ ID NO: 2937787 - RNA, 15 nt, Mycobacterium avium subsp. paratuberculosis
cggacggccagcccg

SEQ ID NO: 2937788 - RNA, 14 nt, Mycobacterium avium subsp. paratuberculosis
cggacggccgaaac

SEQ ID NO: 2937789 - RNA, 12 nt, Mycobacterium avium subsp. paratuberculosis
cggacggcgacg

SEQ ID NO: 2937790 - RNA, 14 nt, Mycobacterium avium subsp. paratuberculosis
cggacggcgacggc

SEQ ID NO: 2937791 - RNA, 17 nt, Mycobacterium avium subsp. paratuberculosis
cggacggcgacggcagc

SEQ ID NO: 2937792 - RNA, 19 nt, Mycobacterium avium subsp. paratuberculosis
cggacggcgacggcagcgc

SEQ ID NO: 2937793 - RNA, 16 nt, Mycobacterium avium subsp. paratuberculosis
cggacgggaccacccg

SEQ ID NO: 2937794 - RNA, 17 nt, Mycobacterium avium subsp. paratuberculosis
cggacgggaccacccgc

SEQ ID NO: 2937795 - RNA, 18 nt, Mycobacterium avium subsp. paratuberculosis
cggacgggaccacccgca

SEQ ID NO: 2937796 - RNA, 21 nt, Mycobacterium avium subsp. paratuberculosis
cggacgggaccacccgcagcg

SEQ ID NO: 2937797 - RNA, 17 nt, Mycobacterium avium subsp. paratuberculosis
cggacgggagacgcugu

SEQ ID NO: 2937798 - RNA, 15 nt, Mycobacterium avium subsp. paratuberculosis
cggacgggaucggcg

SEQ ID NO: 2937799 - RNA, 23 nt, Mycobacterium avium subsp. paratuberculosis
cggacgggaucggcgcgucggcg

SEQ ID NO: 2937800 - RNA, 14 nt, Mycobacterium avium subsp. paratuberculosis
cggacgggccgcau

SEQ ID NO: 2937801 - RNA, 15 nt, Mycobacterium avium subsp. paratuberculosis
cggacgggccgcauc

SEQ ID NO: 2937802 - RNA, 19 nt, Mycobacterium avium subsp. paratuberculosis
cggacggguugggcgccag

SEQ ID NO: 2937803 - RNA, 20 nt, Mycobacterium avium subsp. paratuberculosis
cggacggguugggcgccagc

SEQ ID NO: 2937804 - RNA, 22 nt, Mycobacterium avium subsp. paratuberculosis
cggacggguugggcgccagcag

SEQ ID NO: 2937805 - RNA, 23 nt, Mycobacterium avium subsp. paratuberculosis
cggacggguugggcgccagcagc

SEQ ID NO: 2937806 - RNA, 16 nt, Mycobacterium avium subsp. paratuberculosis
cggacggucccgacgc

SEQ ID NO: 2937807 - RNA, 22 nt, Mycobacterium avium subsp. paratuberculosis
cggacggucccgacgcugacga

SEQ ID NO: 2937808 - RNA, 15 nt, Mycobacterium avium subsp. paratuberculosis
cggacggucgccgac

SEQ ID NO: 2937809 - RNA, 16 nt, Mycobacterium avium subsp. paratuberculosis
cggacggugacgccgg

SEQ ID NO: 2937810 - RNA, 19 nt, Mycobacterium avium subsp. paratuberculosis
cggacgugaucgcgguggc

SEQ ID NO: 2937811 - RNA, 20 nt, Mycobacterium avium subsp. paratuberculosis
cggacgugaucgcgguggcc

SEQ ID NO: 2937812 - RNA, 19 nt, Mycobacterium avium subsp. paratuberculosis
cggacuauacacgccugga

SEQ ID NO: 2937813 - RNA, 19 nt, Mycobacterium avium subsp. paratuberculosis
cggacucaggagugguagg

SEQ ID NO: 2937814 - RNA, 23 nt, Mycobacterium avium subsp. paratuberculosis
cggacuccuccugcgacggcagc

SEQ ID NO: 2937815 - RNA, 17 nt, Mycobacterium avium subsp. paratuberculosis
cggacuccucgguggcc

SEQ ID NO: 2937816 - RNA, 22 nt, Mycobacterium avium subsp. paratuberculosis
cggacucgaagaucgccugcag

SEQ ID NO: 2937817 - RNA, 14 nt, Mycobacterium avium subsp. paratuberculosis
cggacucgcgccgg

SEQ ID NO: 2937818 - RNA, 20 nt, Mycobacterium avium subsp. paratuberculosis
cggacucguuggggccacca

SEQ ID NO: 2937819 - RNA, 14 nt, Mycobacterium avium subsp. paratuberculosis
cggacugcccgacc

SEQ ID NO: 2937820 - RNA, 16 nt, Mycobacterium avium subsp. paratuberculosis
cggacuggccaccgcg

SEQ ID NO: 2937821 - RNA, 17 nt, Mycobacterium avium subsp. paratuberculosis
cggacuggccaccgcga

SEQ ID NO: 2937822 - RNA, 20 nt, Mycobacterium avium subsp. paratuberculosis
cggacuggccaccgcgaucu

SEQ ID NO: 2937823 - RNA, 15 nt, Mycobacterium avium subsp. paratuberculosis
cggacuggcugagca

SEQ ID NO: 2937824 - RNA, 18 nt, Mycobacterium avium subsp. paratuberculosis
cggacuggcugagcagca

SEQ ID NO: 2937825 - RNA, 21 nt, Mycobacterium avium subsp. paratuberculosis
cggacuggcugagcagcaccc

SEQ ID NO: 2937826 - RNA, 17 nt, Mycobacterium avium subsp. paratuberculosis
cggaggccaccgcgccg

SEQ ID NO: 2937827 - RNA, 12 nt, Mycobacterium avium subsp. paratuberculosis
cggaggccgcgg

SEQ ID NO: 2937828 - RNA, 13 nt, Mycobacterium avium subsp. paratuberculosis
cggaggccugcgc

SEQ ID NO: 2937829 - RNA, 18 nt, Mycobacterium avium subsp. paratuberculosis
cggaggccugcgcggccg

SEQ ID NO: 2937830 - RNA, 22 nt, Mycobacterium avium subsp. paratuberculosis
cggaggccugcgcggccgcguc

SEQ ID NO: 2937831 - RNA, 18 nt, Mycobacterium avium subsp. paratuberculosis
cggaggccuuggugaugg

SEQ ID NO: 2937832 - RNA, 12 nt, Mycobacterium avium subsp. paratuberculosis
cggaggcgagca

SEQ ID NO: 2937833 - RNA, 17 nt, Mycobacterium avium subsp. paratuberculosis
cggaggcgagcagccgg

SEQ ID NO: 2937834 - RNA, 17 nt, Mycobacterium avium subsp. paratuberculosis
cggaggcgaucaggugg

SEQ ID NO: 2937835 - RNA, 13 nt, Mycobacterium avium subsp. paratuberculosis
cggaggcgaugcg

SEQ ID NO: 2937836 - RNA, 18 nt, Mycobacterium avium subsp. paratuberculosis
cggaggcgaugcggguca

SEQ ID NO: 2937837 - RNA, 22 nt, Mycobacterium avium subsp. paratuberculosis
cggaggcgaugcgggucacggu

SEQ ID NO: 2937838 - RNA, 22 nt, Mycobacterium avium subsp. paratuberculosis
cggaggcggcgggggcgggccc

SEQ ID NO: 2937839 - RNA, 22 nt, Mycobacterium avium subsp. paratuberculosis
cggaggcggcguagucgccggu

SEQ ID NO: 2937840 - RNA, 23 nt, Mycobacterium avium subsp. paratuberculosis
cggaggcggcguagucggcgcag

SEQ ID NO: 2937841 - RNA, 16 nt, Mycobacterium avium subsp. paratuberculosis
cggaggcgucgacgcg

SEQ ID NO: 2937842 - RNA, 17 nt, Mycobacterium avium subsp. paratuberculosis
cggaggcgucgacgcgc

SEQ ID NO: 2937843 - RNA, 19 nt, Mycobacterium avium subsp. paratuberculosis
cggaggcgucgacgcgcug

SEQ ID NO: 2937844 - RNA, 19 nt, Mycobacterium avium subsp. paratuberculosis
cggaggcuucgcucauccc

SEQ ID NO: 2937845 - RNA, 17 nt, Mycobacterium avium subsp. paratuberculosis
cggaggggcgacgggcc

SEQ ID NO: 2937846 - RNA, 17 nt, Mycobacterium avium subsp. paratuberculosis
cggagggguacucggcu

SEQ ID NO: 2937847 - RNA, 19 nt, Mycobacterium avium subsp. paratuberculosis
cggaggguauucgugugcu

SEQ ID NO: 2937848 - RNA, 14 nt, Mycobacterium avium subsp. paratuberculosis
cggaggucagcagg

SEQ ID NO: 2937849 - RNA, 18 nt, Mycobacterium avium subsp. paratuberculosis
cggaggucagcaggguga

SEQ ID NO: 2937850 - RNA, 15 nt, Mycobacterium avium subsp. paratuberculosis
cggaggucagcggcc

SEQ ID NO: 2937851 - RNA, 17 nt, Mycobacterium avium subsp. paratuberculosis
cggaggucagcggcccg

SEQ ID NO: 2937852 - RNA, 23 nt, Mycobacterium avium subsp. paratuberculosis
cggaggucagcggcccgaucacc

SEQ ID NO: 2937853 - RNA, 12 nt, Mycobacterium avium subsp. paratuberculosis
cggaggucaugg

SEQ ID NO: 2937854 - RNA, 17 nt, Mycobacterium avium subsp. paratuberculosis
cggaggugccgcgcggc

SEQ ID NO: 2937855 - RNA, 18 nt, Mycobacterium avium subsp. paratuberculosis
cggaggugccgcgcggca

SEQ ID NO: 2937856 - RNA, 16 nt, Mycobacterium avium subsp. paratuberculosis
cggaggugccggccgg

SEQ ID NO: 2937857 - RNA, 14 nt, Mycobacterium avium subsp. paratuberculosis
cggagguucgccgg

SEQ ID NO: 2937858 - RNA, 14 nt, Mycobacterium avium subsp. paratuberculosis
cggaguaguccagc

SEQ ID NO: 2937859 - RNA, 18 nt, Mycobacterium avium subsp. paratuberculosis
cggaguaguccagcaccg

SEQ ID NO: 2937860 - RNA, 20 nt, Mycobacterium avium subsp. paratuberculosis
cggaguaguccagcaccgcc

SEQ ID NO: 2937861 - RNA, 21 nt, Mycobacterium avium subsp. paratuberculosis
cggaguaguccagcaccgcca

SEQ ID NO: 2937862 - RNA, 18 nt, Mycobacterium avium subsp. paratuberculosis
cggaguaguuccggcggu

SEQ ID NO: 2937863 - RNA, 21 nt, Mycobacterium avium subsp. paratuberculosis
cggaguaguuccggcgguccu

SEQ ID NO: 2937864 - RNA, 14 nt, Mycobacterium avium subsp. paratuberculosis
cggaguccaccggc

SEQ ID NO: 2937865 - RNA, 17 nt, Mycobacterium avium subsp. paratuberculosis
cggaguccaccggcgga

SEQ ID NO: 2937866 - RNA, 14 nt, Mycobacterium avium subsp. paratuberculosis
cggaguccggcucg

SEQ ID NO: 2937867 - RNA, 15 nt, Mycobacterium avium subsp. paratuberculosis
cggaguccggcucgg

SEQ ID NO: 2937868 - RNA, 20 nt, Mycobacterium avium subsp. paratuberculosis
cggagucgcuguuggcgacg

SEQ ID NO: 2937869 - RNA, 18 nt, Mycobacterium avium subsp. paratuberculosis
cggagucgguuucgaccu

SEQ ID NO: 2937870 - RNA, 23 nt, Mycobacterium avium subsp. paratuberculosis
cggagucgguuucgaccugcggg

SEQ ID NO: 2937871 - RNA, 19 nt, Mycobacterium avium subsp. paratuberculosis
cggagucguagucgaugcc

SEQ ID NO: 2937872 - RNA, 17 nt, Mycobacterium avium subsp. paratuberculosis
cggagucgucggcgcgg

SEQ ID NO: 2937873 - RNA, 20 nt, Mycobacterium avium subsp. paratuberculosis
cggagucgucggcgcgguug

SEQ ID NO: 2937874 - RNA, 17 nt, Mycobacterium avium subsp. paratuberculosis
cggagugaaguccauga

SEQ ID NO: 2937875 - RNA, 20 nt, Mycobacterium avium subsp. paratuberculosis
cggagugaccgccagcaccg

SEQ ID NO: 2937876 - RNA, 17 nt, Mycobacterium avium subsp. paratuberculosis
cggagugacgucgcgcg

SEQ ID NO: 2937877 - RNA, 20 nt, Mycobacterium avium subsp. paratuberculosis
cggaguucgcccgcagcacg

SEQ ID NO: 2937878 - RNA, 17 nt, Mycobacterium avium subsp. paratuberculosis
cggaguugcgcagccgg

SEQ ID NO: 2937879 - RNA, 20 nt, Mycobacterium avium subsp. paratuberculosis
cggaguuggaucgccgcaac

SEQ ID NO: 2937880 - RNA, 22 nt, Mycobacterium avium subsp. paratuberculosis
cggauaacucuacugcugcggg

SEQ ID NO: 2937881 - RNA, 19 nt, Mycobacterium avium subsp. paratuberculosis
cggauacccgcggccuccg

SEQ ID NO: 2937882 - RNA, 17 nt, Mycobacterium avium subsp. paratuberculosis
cggauacgcccggccac

SEQ ID NO: 2937883 - RNA, 16 nt, Mycobacterium avium subsp. paratuberculosis
cggauagccgucggcg

SEQ ID NO: 2937884 - RNA, 16 nt, Mycobacterium avium subsp. paratuberculosis
cggauagcguccgccc

SEQ ID NO: 2937885 - RNA, 21 nt, Mycobacterium avium subsp. paratuberculosis
cggauauagccgacgggaucc

SEQ ID NO: 2937886 - RNA, 18 nt, Mycobacterium avium subsp. paratuberculosis
cggaucaaccacaccagc

SEQ ID NO: 2937887 - RNA, 19 nt, Mycobacterium avium subsp. paratuberculosis
cggaucaaccacaccagca

SEQ ID NO: 2937888 - RNA, 11 nt, Mycobacterium avium subsp. paratuberculosis
cggaucaccug

SEQ ID NO: 2937889 - RNA, 13 nt, Mycobacterium avium subsp. paratuberculosis
cggaucagcaccg

SEQ ID NO: 2937890 - RNA, 15 nt, Mycobacterium avium subsp. paratuberculosis
cggaucagcaccgac

SEQ ID NO: 2937891 - RNA, 17 nt, Mycobacterium avium subsp. paratuberculosis
cggaucagcaccgacgc

SEQ ID NO: 2937892 - RNA, 20 nt, Mycobacterium avium subsp. paratuberculosis
cggaucagcaccgacgcggc

SEQ ID NO: 2937893 - RNA, 21 nt, Mycobacterium avium subsp. paratuberculosis
cggaucagcaccgacgcggcg

SEQ ID NO: 2937894 - RNA, 22 nt, Mycobacterium avium subsp. paratuberculosis
cggaucagcaccgacgcggcga

SEQ ID NO: 2937895 - RNA, 22 nt, Mycobacterium avium subsp. paratuberculosis
cggaucagcaggaccgggaucg

SEQ ID NO: 2937896 - RNA, 19 nt, Mycobacterium avium subsp. paratuberculosis
cggaucagcguuccggcgg

SEQ ID NO: 2937897 - RNA, 20 nt, Mycobacterium avium subsp. paratuberculosis
cggaucagcguuccggcggc

SEQ ID NO: 2937898 - RNA, 21 nt, Mycobacterium avium subsp. paratuberculosis
cggaucagcguuccggcggcc

SEQ ID NO: 2937899 - RNA, 22 nt, Mycobacterium avium subsp. paratuberculosis
cggaucagcguuccggcggccg

SEQ ID NO: 2937900 - RNA, 12 nt, Mycobacterium avium subsp. paratuberculosis
cggaucagcuga

SEQ ID NO: 2937901 - RNA, 19 nt, Mycobacterium avium subsp. paratuberculosis
cggaucagcugaccggcga

SEQ ID NO: 2937902 - RNA, 22 nt, Mycobacterium avium subsp. paratuberculosis
cggaucagcugaccggcgaucg

SEQ ID NO: 2937903 - RNA, 13 nt, Mycobacterium avium subsp. paratuberculosis
cggaucaggucgg

SEQ ID NO: 2937904 - RNA, 15 nt, Mycobacterium avium subsp. paratuberculosis
cggaucaggucgguc

SEQ ID NO: 2937905 - RNA, 19 nt, Mycobacterium avium subsp. paratuberculosis
cggaucaggucggucaccg

SEQ ID NO: 2937906 - RNA, 19 nt, Mycobacterium avium subsp. paratuberculosis
cggaucaugcgcgucaugg

SEQ ID NO: 2937907 - RNA, 20 nt, Mycobacterium avium subsp. paratuberculosis
cggauccaccaauucgcgcu

SEQ ID NO: 2937908 - RNA, 22 nt, Mycobacterium avium subsp. paratuberculosis
cggauccaccaauucgcgcugc

SEQ ID NO: 2937909 - RNA, 15 nt, Mycobacterium avium subsp. paratuberculosis
cggauccagcaccgc

SEQ ID NO: 2937910 - RNA, 13 nt, Mycobacterium avium subsp. paratuberculosis
cggaugcaccggc

SEQ ID NO: 2937911 - RNA, 17 nt, Mycobacterium avium subsp. paratuberculosis
cggaugcaccggcagcc

SEQ ID NO: 2937912 - RNA, 21 nt, Mycobacterium avium subsp. paratuberculosis
cggaugcacgugcaccgcggc

SEQ ID NO: 2937913 - RNA, 13 nt, Mycobacterium avium subsp. paratuberculosis
cggaugcccaggc

SEQ ID NO: 2937914 - RNA, 15 nt, Mycobacterium avium subsp. paratuberculosis
cggaugcccaggccg

SEQ ID NO: 2937915 - RNA, 18 nt, Mycobacterium avium subsp. paratuberculosis
cggaugcccaggccggcg

SEQ ID NO: 2937916 - RNA, 20 nt, Mycobacterium avium subsp. paratuberculosis
cggaugcccaggccggcgag

SEQ ID NO: 2937917 - RNA, 21 nt, Mycobacterium avium subsp. paratuberculosis
cggaugcccaggccggcgagc

SEQ ID NO: 2937918 - RNA, 16 nt, Mycobacterium avium subsp. paratuberculosis
cggaugccccuugacg

SEQ ID NO: 2937919 - RNA, 18 nt, Mycobacterium avium subsp. paratuberculosis
cggaugccccuugacggu

SEQ ID NO: 2937920 - RNA, 13 nt, Mycobacterium avium subsp. paratuberculosis
cggaugcccgccg

SEQ ID NO: 2937921 - RNA, 16 nt, Mycobacterium avium subsp. paratuberculosis
cggaugcccgccggcg

SEQ ID NO: 2937922 - RNA, 18 nt, Mycobacterium avium subsp. paratuberculosis
cggaugccgcgcggcgcc

SEQ ID NO: 2937923 - RNA, 19 nt, Mycobacterium avium subsp. paratuberculosis
cggaugccggaggcgccgu

SEQ ID NO: 2937924 - RNA, 22 nt, Mycobacterium avium subsp. paratuberculosis
cggaugccggcgcccagcggcg

SEQ ID NO: 2937925 - RNA, 19 nt, Mycobacterium avium subsp. paratuberculosis
cggaugccggcuugggcga

SEQ ID NO: 2937926 - RNA, 17 nt, Mycobacterium avium subsp. paratuberculosis
cggaugccggggcagca

SEQ ID NO: 2937927 - RNA, 15 nt, Mycobacterium avium subsp. paratuberculosis
cggaugccguagcgc

SEQ ID NO: 2937928 - RNA, 14 nt, Mycobacterium avium subsp. paratuberculosis
cggaugcgcuggug

SEQ ID NO: 2937929 - RNA, 13 nt, Mycobacterium avium subsp. paratuberculosis
cggaugcggccga

SEQ ID NO: 2937930 - RNA, 16 nt, Mycobacterium avium subsp. paratuberculosis
cggaugcggcgcccac

SEQ ID NO: 2937931 - RNA, 16 nt, Mycobacterium avium subsp. paratuberculosis
cggaugcggcucccac

SEQ ID NO: 2937932 - RNA, 20 nt, Mycobacterium avium subsp. paratuberculosis
cggaugcggcucccaccgug

SEQ ID NO: 2937933 - RNA, 19 nt, Mycobacterium avium subsp. paratuberculosis
cggaugcgggccacacacu

SEQ ID NO: 2937934 - RNA, 14 nt, Mycobacterium avium subsp. paratuberculosis
cggaugcgggcgcu

SEQ ID NO: 2937935 - RNA, 18 nt, Mycobacterium avium subsp. paratuberculosis
cggaugcgggcgcugccg

SEQ ID NO: 2937936 - RNA, 16 nt, Mycobacterium avium subsp. paratuberculosis
cggaugcggucgauga

SEQ ID NO: 2937937 - RNA, 19 nt, Mycobacterium avium subsp. paratuberculosis
cggaugcucaccggucagc

SEQ ID NO: 2937938 - RNA, 21 nt, Mycobacterium avium subsp. paratuberculosis
cggaugcugaccaaggccgac

SEQ ID NO: 2937939 - RNA, 16 nt, Mycobacterium avium subsp. paratuberculosis
cggaugcugcggguca

SEQ ID NO: 2937940 - RNA, 13 nt, Mycobacterium avium subsp. paratuberculosis
cggauggagcgcg

SEQ ID NO: 2937941 - RNA, 14 nt, Mycobacterium avium subsp. paratuberculosis
cggauggagcgcga

SEQ ID NO: 2937942 - RNA, 16 nt, Mycobacterium avium subsp. paratuberculosis
cggauggagcgcgacg

SEQ ID NO: 2937943 - RNA, 17 nt, Mycobacterium avium subsp. paratuberculosis
cggauggagcgcgacgg

SEQ ID NO: 2937944 - RNA, 22 nt, Mycobacterium avium subsp. paratuberculosis
cggauggagcgcgacgggcugc

SEQ ID NO: 2937945 - RNA, 14 nt, Mycobacterium avium subsp. paratuberculosis
cggauggccagcag

SEQ ID NO: 2937946 - RNA, 15 nt, Mycobacterium avium subsp. paratuberculosis
cggauggccagcagg

SEQ ID NO: 2937947 - RNA, 18 nt, Mycobacterium avium subsp. paratuberculosis
cggauggccagcagguag

SEQ ID NO: 2937948 - RNA, 13 nt, Mycobacterium avium subsp. paratuberculosis
cggauggccgggc

SEQ ID NO: 2937949 - RNA, 16 nt, Mycobacterium avium subsp. paratuberculosis
cggauggccgggcagg

SEQ ID NO: 2937950 - RNA, 13 nt, Mycobacterium avium subsp. paratuberculosis
cggauggccucgg

SEQ ID NO: 2937951 - RNA, 17 nt, Mycobacterium avium subsp. paratuberculosis
cggauggccucggcgau

SEQ ID NO: 2937952 - RNA, 20 nt, Mycobacterium avium subsp. paratuberculosis
cggauggccucggcgaugcc

SEQ ID NO: 2937953 - RNA, 21 nt, Mycobacterium avium subsp. paratuberculosis
cggauggccucggcgaugccg

SEQ ID NO: 2937954 - RNA, 22 nt, Mycobacterium avium subsp. paratuberculosis
cggauggccucggcgaugccga

SEQ ID NO: 2937955 - RNA, 20 nt, Mycobacterium avium subsp. paratuberculosis
cggauggcgacggcgacgac

SEQ ID NO: 2937956 - RNA, 18 nt, Mycobacterium avium subsp. paratuberculosis
cggauggcgcccggcagc

SEQ ID NO: 2937957 - RNA, 20 nt, Mycobacterium avium subsp. paratuberculosis
cggauggcgcccggcagccg

SEQ ID NO: 2937958 - RNA, 13 nt, Mycobacterium avium subsp. paratuberculosis
cggauggcgcccu

SEQ ID NO: 2937959 - RNA, 12 nt, Mycobacterium avium subsp. paratuberculosis
cggauggcgccg

SEQ ID NO: 2937960 - RNA, 16 nt, Mycobacterium avium subsp. paratuberculosis
cggauggcgccgucga

SEQ ID NO: 2937961 - RNA, 15 nt, Mycobacterium avium subsp. paratuberculosis
cggauggcggucgcg

SEQ ID NO: 2937962 - RNA, 22 nt, Mycobacterium avium subsp. paratuberculosis
cggauggcuguggaugacgcag

SEQ ID NO: 2937963 - RNA, 13 nt, Mycobacterium avium subsp. paratuberculosis
cggaugggcgagg

SEQ ID NO: 2937964 - RNA, 12 nt, Mycobacterium avium subsp. paratuberculosis
cggauggugacg

SEQ ID NO: 2937965 - RNA, 14 nt, Mycobacterium avium subsp. paratuberculosis
cggauguccgaccg

SEQ ID NO: 2937966 - RNA, 16 nt, Mycobacterium avium subsp. paratuberculosis
cggauguccgaccggu

SEQ ID NO: 2937967 - RNA, 17 nt, Mycobacterium avium subsp. paratuberculosis
cggauguccuacggcgg

SEQ ID NO: 2937968 - RNA, 21 nt, Mycobacterium avium subsp. paratuberculosis
cggauguccuacggcgggugc

SEQ ID NO: 2937969 - RNA, 14 nt, Mycobacterium avium subsp. paratuberculosis
cggaugucgggcga

SEQ ID NO: 2937970 - RNA, 15 nt, Mycobacterium avium subsp. paratuberculosis
cggaugucgggcgag

SEQ ID NO: 2937971 - RNA, 20 nt, Mycobacterium avium subsp. paratuberculosis
cggaugucggugugcagcag

SEQ ID NO: 2937972 - RNA, 21 nt, Mycobacterium avium subsp. paratuberculosis
cggaugucgugcggucgcacc

SEQ ID NO: 2937973 - RNA, 17 nt, Mycobacterium avium subsp. paratuberculosis
cggauguggaggcgagc

SEQ ID NO: 2937974 - RNA, 14 nt, Mycobacterium avium subsp. paratuberculosis
cggauguggucggc

SEQ ID NO: 2937975 - RNA, 16 nt, Mycobacterium avium subsp. paratuberculosis
cggauguggucggcca

SEQ ID NO: 2937976 - RNA, 20 nt, Mycobacterium avium subsp. paratuberculosis
cggauguggucggccacgac

SEQ ID NO: 2937977 - RNA, 20 nt, Mycobacterium avium subsp. paratuberculosis
cggauguuguccggaacacc

SEQ ID NO: 2937978 - RNA, 22 nt, Mycobacterium avium subsp. paratuberculosis
cggauuaccgugacggcaucgg

SEQ ID NO: 2937979 - RNA, 16 nt, Mycobacterium avium subsp. paratuberculosis
cggauuacucgccggc

SEQ ID NO: 2937980 - RNA, 17 nt, Mycobacterium avium subsp. paratuberculosis
cggauuacucgccggcg

SEQ ID NO: 2937981 - RNA, 17 nt, Mycobacterium avium subsp. paratuberculosis
cggauucagcgucgcca

SEQ ID NO: 2937982 - RNA, 16 nt, Mycobacterium avium subsp. paratuberculosis
cggauuccagcgcgac

SEQ ID NO: 2937983 - RNA, 21 nt, Mycobacterium avium subsp. paratuberculosis
cggauuccagcgcgaccgccc

SEQ ID NO: 2937984 - RNA, 15 nt, Mycobacterium avium subsp. paratuberculosis
cggauuccagcgcgu

SEQ ID NO: 2937985 - RNA, 23 nt, Mycobacterium avium subsp. paratuberculosis
cggauuccagcgcguagucggcg

SEQ ID NO: 2937986 - RNA, 13 nt, Mycobacterium avium subsp. paratuberculosis
cggauuccgcgga

SEQ ID NO: 2937987 - RNA, 14 nt, Mycobacterium avium subsp. paratuberculosis
cggauuccggcauc

SEQ ID NO: 2937988 - RNA, 16 nt, Mycobacterium avium subsp. paratuberculosis
cggauucgcggcggcg

SEQ ID NO: 2937989 - RNA, 17 nt, Mycobacterium avium subsp. paratuberculosis
cggauucgcggcggcgc

SEQ ID NO: 2937990 - RNA, 19 nt, Mycobacterium avium subsp. paratuberculosis
cggauucgcggcggcgccg

SEQ ID NO: 2937991 - RNA, 16 nt, Mycobacterium avium subsp. paratuberculosis
cggauucggcgcggcu

SEQ ID NO: 2937992 - RNA, 23 nt, Mycobacterium avium subsp. paratuberculosis
cggauucgucaaugauggucagc

SEQ ID NO: 2937993 - RNA, 15 nt, Mycobacterium avium subsp. paratuberculosis
cggauucucgcccgg

SEQ ID NO: 2937994 - RNA, 14 nt, Mycobacterium avium subsp. paratuberculosis
cggauugaccagca

SEQ ID NO: 2937995 - RNA, 16 nt, Mycobacterium avium subsp. paratuberculosis
cggcaccagcaggccc

SEQ ID NO: 2937996 - RNA, 20 nt, Mycobacterium avium subsp. paratuberculosis
cggcaccagcccgccgucgg

SEQ ID NO: 2937997 - RNA, 21 nt, Mycobacterium avium subsp. paratuberculosis
cggcaccagcccgccgucggc

SEQ ID NO: 2937998 - RNA, 14 nt, Mycobacterium avium subsp. paratuberculosis
cggcaccagcggau

SEQ ID NO: 2937999 - RNA, 16 nt, Mycobacterium avium subsp. paratuberculosis
cggcaccagcggaucg

SEQ ID NO: 2938000 - RNA, 13 nt, Mycobacterium avium subsp. paratuberculosis
cggcaccagcggc

SEQ ID NO: 2938001 - RNA, 16 nt, Mycobacterium avium subsp. paratuberculosis
cggcaccagcggcauc

SEQ ID NO: 2938002 - RNA, 22 nt, Mycobacterium avium subsp. paratuberculosis
cggcaccagcggcaucgccgcc

SEQ ID NO: 2938003 - RNA, 23 nt, Mycobacterium avium subsp. paratuberculosis
cggcaccagcggcaucgccgcca

SEQ ID NO: 2938004 - RNA, 12 nt, Mycobacterium avium subsp. paratuberculosis
cggcaccaggua

SEQ ID NO: 2938005 - RNA, 19 nt, Mycobacterium avium subsp. paratuberculosis
cggcaccagguaccggcgg

SEQ ID NO: 2938006 - RNA, 23 nt, Mycobacterium avium subsp. paratuberculosis
cggcaccagguaccggcgggcga

SEQ ID NO: 2938007 - RNA, 17 nt, Mycobacterium avium subsp. paratuberculosis
cggcaccagguucacgu

SEQ ID NO: 2938008 - RNA, 15 nt, Mycobacterium avium subsp. paratuberculosis
cggcaccagucgcgc

SEQ ID NO: 2938009 - RNA, 18 nt, Mycobacterium avium subsp. paratuberculosis
cggcaccagucgcgcagc

SEQ ID NO: 2938010 - RNA, 21 nt, Mycobacterium avium subsp. paratuberculosis
cggcaccagucgcgcagcguc

SEQ ID NO: 2938011 - RNA, 22 nt, Mycobacterium avium subsp. paratuberculosis
cggcaccagucgcgcagcguca

SEQ ID NO: 2938012 - RNA, 18 nt, Mycobacterium avium subsp. paratuberculosis
cggcacccaggucaccga

SEQ ID NO: 2938013 - RNA, 20 nt, Mycobacterium avium subsp. paratuberculosis
cggcacccaggucaccgagg

SEQ ID NO: 2938014 - RNA, 20 nt, Mycobacterium avium subsp. paratuberculosis
cggcacccccaauugccggg

SEQ ID NO: 2938015 - RNA, 13 nt, Mycobacterium avium subsp. paratuberculosis
cggcaccccgcgg

SEQ ID NO: 2938016 - RNA, 14 nt, Mycobacterium avium subsp. paratuberculosis
cggcaccccgcggu

SEQ ID NO: 2938017 - RNA, 16 nt, Mycobacterium avium subsp. paratuberculosis
cggcaccccgcggucg

SEQ ID NO: 2938018 - RNA, 19 nt, Mycobacterium avium subsp. paratuberculosis
cggcaccccgcggucggcg

SEQ ID NO: 2938019 - RNA, 22 nt, Mycobacterium avium subsp. paratuberculosis
cggcaccccgcggucggcggcg

SEQ ID NO: 2938020 - RNA, 23 nt, Mycobacterium avium subsp. paratuberculosis
cggcaccccgcggucggcggcgu

SEQ ID NO: 2938021 - RNA, 21 nt, Mycobacterium avium subsp. paratuberculosis
cggcacccgcaacaccacguc

SEQ ID NO: 2938022 - RNA, 18 nt, Mycobacterium avium subsp. paratuberculosis
cggcacccgcagcuccag

SEQ ID NO: 2938023 - RNA, 12 nt, Mycobacterium avium subsp. paratuberculosis
cggcacccggcc

SEQ ID NO: 2938024 - RNA, 16 nt, Mycobacterium avium subsp. paratuberculosis
cggcacccgguccggc

SEQ ID NO: 2938025 - RNA, 17 nt, Mycobacterium avium subsp. paratuberculosis
cggcacccgguccggcc

SEQ ID NO: 2938026 - RNA, 18 nt, Mycobacterium avium subsp. paratuberculosis
cggcacccgguccggccc

SEQ ID NO: 2938027 - RNA, 23 nt, Mycobacterium avium subsp. paratuberculosis
cggcacccgguccggcccgggga

SEQ ID NO: 2938028 - RNA, 13 nt, Mycobacterium avium subsp. paratuberculosis
cggcaccgacagg

SEQ ID NO: 2938029 - RNA, 20 nt, Mycobacterium avium subsp. paratuberculosis
cggcaccgacagggccagcg

SEQ ID NO: 2938030 - RNA, 20 nt, Mycobacterium avium subsp. paratuberculosis
cggcaccgaccgggcgcucc

SEQ ID NO: 2938031 - RNA, 17 nt, Mycobacterium avium subsp. paratuberculosis
cggcaccgacggagccg

SEQ ID NO: 2938032 - RNA, 19 nt, Mycobacterium avium subsp. paratuberculosis
cggcaccgacggagccgag

SEQ ID NO: 2938033 - RNA, 13 nt, Mycobacterium avium subsp. paratuberculosis
cggcaccgccagc

SEQ ID NO: 2938034 - RNA, 18 nt, Mycobacterium avium subsp. paratuberculosis
cggcaccgccagccacca

SEQ ID NO: 2938035 - RNA, 15 nt, Mycobacterium avium subsp. paratuberculosis
cggcaccgccaucgg

SEQ ID NO: 2938036 - RNA, 19 nt, Mycobacterium avium subsp. paratuberculosis
cggcaccgccaucggcauc

SEQ ID NO: 2938037 - RNA, 20 nt, Mycobacterium avium subsp. paratuberculosis
cggcaccgcccccgcggcgg

SEQ ID NO: 2938038 - RNA, 22 nt, Mycobacterium avium subsp. paratuberculosis
cggcaccgcccccgcggcggcc

SEQ ID NO: 2938039 - RNA, 23 nt, Mycobacterium avium subsp. paratuberculosis
cggcaccgcccccgcggcggcca

SEQ ID NO: 2938040 - RNA, 12 nt, Mycobacterium avium subsp. paratuberculosis
cggcaccgcccg

SEQ ID NO: 2938041 - RNA, 12 nt, Mycobacterium avium subsp. paratuberculosis
cggcaccgccgc

SEQ ID NO: 2938042 - RNA, 14 nt, Mycobacterium avium subsp. paratuberculosis
cggcaccgccgcgg

SEQ ID NO: 2938043 - RNA, 17 nt, Mycobacterium avium subsp. paratuberculosis
cggcaccgccgcggugg

SEQ ID NO: 2938044 - RNA, 15 nt, Mycobacterium avium subsp. paratuberculosis
cggcaccgccggcgg

SEQ ID NO: 2938045 - RNA, 16 nt, Mycobacterium avium subsp. paratuberculosis
cggcaccgccggcggc

SEQ ID NO: 2938046 - RNA, 21 nt, Mycobacterium avium subsp. paratuberculosis
cggcaccgccggcggccuccg

SEQ ID NO: 2938047 - RNA, 15 nt, Mycobacterium avium subsp. paratuberculosis
cggcaccgcgagcac

SEQ ID NO: 2938048 - RNA, 13 nt, Mycobacterium avium subsp. paratuberculosis
cggcaccgcggcg

SEQ ID NO: 2938049 - RNA, 14 nt, Mycobacterium avium subsp. paratuberculosis
cggcaccgcggcgg

SEQ ID NO: 2938050 - RNA, 20 nt, Mycobacterium avium subsp. paratuberculosis
cggcaccgcggcggugucgg

SEQ ID NO: 2938051 - RNA, 17 nt, Mycobacterium avium subsp. paratuberculosis
cggcaccgcggcucggu

SEQ ID NO: 2938052 - RNA, 15 nt, Mycobacterium avium subsp. paratuberculosis
cggcaccgcggucug

SEQ ID NO: 2938053 - RNA, 13 nt, Mycobacterium avium subsp. paratuberculosis
cggcaccgggacc

SEQ ID NO: 2938054 - RNA, 19 nt, Mycobacterium avium subsp. paratuberculosis
cggcaccgggaccuggguc

SEQ ID NO: 2938055 - RNA, 18 nt, Mycobacterium avium subsp. paratuberculosis
cggcaccggugcggcggu

SEQ ID NO: 2938056 - RNA, 19 nt, Mycobacterium avium subsp. paratuberculosis
cggcaccgucaccgacggc

SEQ ID NO: 2938057 - RNA, 21 nt, Mycobacterium avium subsp. paratuberculosis
cggcaccgucaccgacggcug

SEQ ID NO: 2938058 - RNA, 22 nt, Mycobacterium avium subsp. paratuberculosis
cggcaccgucaccgacggcugg

SEQ ID NO: 2938059 - RNA, 15 nt, Mycobacterium avium subsp. paratuberculosis
cggcaccguccggcg

SEQ ID NO: 2938060 - RNA, 16 nt, Mycobacterium avium subsp. paratuberculosis
cggcaccgugccgcgc

SEQ ID NO: 2938061 - RNA, 17 nt, Mycobacterium avium subsp. paratuberculosis
cggcaccgugccgcgcg

SEQ ID NO: 2938062 - RNA, 20 nt, Mycobacterium avium subsp. paratuberculosis
cggcaccgugccgcgcggcg

SEQ ID NO: 2938063 - RNA, 22 nt, Mycobacterium avium subsp. paratuberculosis
cggcaccgugccgcgcggcggu

SEQ ID NO: 2938064 - RNA, 13 nt, Mycobacterium avium subsp. paratuberculosis
cggcaccuccagc

SEQ ID NO: 2938065 - RNA, 14 nt, Mycobacterium avium subsp. paratuberculosis
cggcaccuccagcc

SEQ ID NO: 2938066 - RNA, 18 nt, Mycobacterium avium subsp. paratuberculosis
cggcaccuccagcccggc

SEQ ID NO: 2938067 - RNA, 18 nt, Mycobacterium avium subsp. paratuberculosis
cggcaccuccugcacccg

SEQ ID NO: 2938068 - RNA, 20 nt, Mycobacterium avium subsp. paratuberculosis
cggcaccucgaagggcgcca

SEQ ID NO: 2938069 - RNA, 22 nt, Mycobacterium avium subsp. paratuberculosis
cggcaccucgaagggcgccagc

SEQ ID NO: 2938070 - RNA, 13 nt, Mycobacterium avium subsp. paratuberculosis
cggcaccucucgg

SEQ ID NO: 2938071 - RNA, 15 nt, Mycobacterium avium subsp. paratuberculosis
cggcaccucucggga

SEQ ID NO: 2938072 - RNA, 22 nt, Mycobacterium avium subsp. paratuberculosis
cggcaccuucaccgaccagcug

SEQ ID NO: 2938073 - RNA, 20 nt, Mycobacterium avium subsp. paratuberculosis
cggcaccuuggugagcaccg

SEQ ID NO: 2938074 - RNA, 22 nt, Mycobacterium avium subsp. paratuberculosis
cggcaccuuggugagcaccgcg

SEQ ID NO: 2938075 - RNA, 18 nt, Mycobacterium avium subsp. paratuberculosis
cggcacgaacgcgacgau

SEQ ID NO: 2938076 - RNA, 21 nt, Mycobacterium avium subsp. paratuberculosis
cggcacgaaguugguguccac

SEQ ID NO: 2938077 - RNA, 15 nt, Mycobacterium avium subsp. paratuberculosis
cggcacgaucggcag

SEQ ID NO: 2938078 - RNA, 17 nt, Mycobacterium avium subsp. paratuberculosis
cggcacgaucggcagcg

SEQ ID NO: 2938079 - RNA, 23 nt, Mycobacterium avium subsp. paratuberculosis
cggcagaucguugggcaugucgc

SEQ ID NO: 2938080 - RNA, 16 nt, Mycobacterium avium subsp. paratuberculosis
cggcagauggucucga

SEQ ID NO: 2938081 - RNA, 21 nt, Mycobacterium avium subsp. paratuberculosis
cggcagauggucucgaucucc

SEQ ID NO: 2938082 - RNA, 16 nt, Mycobacterium avium subsp. paratuberculosis
cggcagcaaccggcgg

SEQ ID NO: 2938083 - RNA, 17 nt, Mycobacterium avium subsp. paratuberculosis
cggcagcaaccggcggc

SEQ ID NO: 2938084 - RNA, 21 nt, Mycobacterium avium subsp. paratuberculosis
cggcagcaaccggcggcuggg

SEQ ID NO: 2938085 - RNA, 13 nt, Mycobacterium avium subsp. paratuberculosis
cggcagcacaccu

SEQ ID NO: 2938086 - RNA, 21 nt, Mycobacterium avium subsp. paratuberculosis
cggcagcacaccuuccaccac

SEQ ID NO: 2938087 - RNA, 16 nt, Mycobacterium avium subsp. paratuberculosis
cggcagcacccgcauc

SEQ ID NO: 2938088 - RNA, 15 nt, Mycobacterium avium subsp. paratuberculosis
cggcagcaccgccga

SEQ ID NO: 2938089 - RNA, 20 nt, Mycobacterium avium subsp. paratuberculosis
cggcagcaccgccgacaucg

SEQ ID NO: 2938090 - RNA, 17 nt, Mycobacterium avium subsp. paratuberculosis
cggcagcaccgccgagc

SEQ ID NO: 2938091 - RNA, 23 nt, Mycobacterium avium subsp. paratuberculosis
cggcagcaccgccgagccgucgu

SEQ ID NO: 2938092 - RNA, 15 nt, Mycobacterium avium subsp. paratuberculosis
cggcagcaccggcag

SEQ ID NO: 2938093 - RNA, 16 nt, Mycobacterium avium subsp. paratuberculosis
cggcagcaccggccgg

SEQ ID NO: 2938094 - RNA, 22 nt, Mycobacterium avium subsp. paratuberculosis
cggcagcaccucgcgcagcacc

SEQ ID NO: 2938095 - RNA, 21 nt, Mycobacterium avium subsp. paratuberculosis
cggcagcacgucguaggccau

SEQ ID NO: 2938096 - RNA, 12 nt, Mycobacterium avium subsp. paratuberculosis
cggcagcagcac

SEQ ID NO: 2938097 - RNA, 14 nt, Mycobacterium avium subsp. paratuberculosis
cggcagcagcacca

SEQ ID NO: 2938098 - RNA, 15 nt, Mycobacterium avium subsp. paratuberculosis
cggcagcagcaccag

SEQ ID NO: 2938099 - RNA, 13 nt, Mycobacterium avium subsp. paratuberculosis
cggcagcagcccg

SEQ ID NO: 2938100 - RNA, 14 nt, Mycobacterium avium subsp. paratuberculosis
cggcagcagcgagu

SEQ ID NO: 2938101 - RNA, 17 nt, Mycobacterium avium subsp. paratuberculosis
cggcagcagcgagucga

SEQ ID NO: 2938102 - RNA, 14 nt, Mycobacterium avium subsp. paratuberculosis
cggcagcagcgcgu

SEQ ID NO: 2938103 - RNA, 18 nt, Mycobacterium avium subsp. paratuberculosis
cggcagcagcugcgucgg

SEQ ID NO: 2938104 - RNA, 19 nt, Mycobacterium avium subsp. paratuberculosis
cggcagcagcugcgucggc

SEQ ID NO: 2938105 - RNA, 20 nt, Mycobacterium avium subsp. paratuberculosis
cggcagcagcugcgucggca

SEQ ID NO: 2938106 - RNA, 14 nt, Mycobacterium avium subsp. paratuberculosis
cggcagcagggugc

SEQ ID NO: 2938107 - RNA, 19 nt, Mycobacterium avium subsp. paratuberculosis
cggcagcaggugcaccacc

SEQ ID NO: 2938108 - RNA, 21 nt, Mycobacterium avium subsp. paratuberculosis
cggcagcaucgggacgccugc

SEQ ID NO: 2938109 - RNA, 23 nt, Mycobacterium avium subsp. paratuberculosis
cggcagcaucgggacgccugccg

SEQ ID NO: 2938110 - RNA, 17 nt, Mycobacterium avium subsp. paratuberculosis
cggcagccagaugucgc

SEQ ID NO: 2938111 - RNA, 21 nt, Mycobacterium avium subsp. paratuberculosis
cggcagccagccuggcggcga

SEQ ID NO: 2938112 - RNA, 17 nt, Mycobacterium avium subsp. paratuberculosis
cggcagccaggcguugg

SEQ ID NO: 2938113 - RNA, 12 nt, Mycobacterium avium subsp. paratuberculosis
cggcagccccgu

SEQ ID NO: 2938114 - RNA, 22 nt, Mycobacterium avium subsp. paratuberculosis
cggcagccccgucggucccgac

SEQ ID NO: 2938115 - RNA, 13 nt, Mycobacterium avium subsp. paratuberculosis
cggcagcccgacg

SEQ ID NO: 2938116 - RNA, 16 nt, Mycobacterium avium subsp. paratuberculosis
cggcagcccggaggcg

SEQ ID NO: 2938117 - RNA, 21 nt, Mycobacterium avium subsp. paratuberculosis
cggcagcccggaguagccggu

SEQ ID NO: 2938118 - RNA, 14 nt, Mycobacterium avium subsp. paratuberculosis
cggcagccgcgccc

SEQ ID NO: 2938119 - RNA, 15 nt, Mycobacterium avium subsp. paratuberculosis
cggcagccgcgccca

SEQ ID NO: 2938120 - RNA, 17 nt, Mycobacterium avium subsp. paratuberculosis
cggcagccgcgcccacc

SEQ ID NO: 2938121 - RNA, 19 nt, Mycobacterium avium subsp. paratuberculosis
cggcagccgcuccggcccg

SEQ ID NO: 2938122 - RNA, 20 nt, Mycobacterium avium subsp. paratuberculosis
cggcagccgcuccggcccga

SEQ ID NO: 2938123 - RNA, 15 nt, Mycobacterium avium subsp. paratuberculosis
cggcagccggccacc

SEQ ID NO: 2938124 - RNA, 16 nt, Mycobacterium avium subsp. paratuberculosis
cggcagccggccaccu

SEQ ID NO: 2938125 - RNA, 17 nt, Mycobacterium avium subsp. paratuberculosis
cggcagccggccaccuc

SEQ ID NO: 2938126 - RNA, 14 nt, Mycobacterium avium subsp. paratuberculosis
cggcagccgggcga

SEQ ID NO: 2938127 - RNA, 15 nt, Mycobacterium avium subsp. paratuberculosis
cggcagccggggugc

SEQ ID NO: 2938128 - RNA, 17 nt, Mycobacterium avium subsp. paratuberculosis
cggcagcgaaaccuccg

SEQ ID NO: 2938129 - RNA, 18 nt, Mycobacterium avium subsp. paratuberculosis
cggcagcgaacugccggc

SEQ ID NO: 2938130 - RNA, 19 nt, Mycobacterium avium subsp. paratuberculosis
cggcagcgaacugccggca

SEQ ID NO: 2938131 - RNA, 14 nt, Mycobacterium avium subsp. paratuberculosis
cggcagcgacagcg

SEQ ID NO: 2938132 - RNA, 16 nt, Mycobacterium avium subsp. paratuberculosis
cggcagcgacgcggug

SEQ ID NO: 2938133 - RNA, 17 nt, Mycobacterium avium subsp. paratuberculosis
cggcagcgacgcgguga

SEQ ID NO: 2938134 - RNA, 14 nt, Mycobacterium avium subsp. paratuberculosis
cggcagcgaggcgc

SEQ ID NO: 2938135 - RNA, 14 nt, Mycobacterium avium subsp. paratuberculosis
cggcagcgaguagc

SEQ ID NO: 2938136 - RNA, 14 nt, Mycobacterium avium subsp. paratuberculosis
cggcagcgccaaca

SEQ ID NO: 2938137 - RNA, 13 nt, Mycobacterium avium subsp. paratuberculosis
cggcagcgccacc

SEQ ID NO: 2938138 - RNA, 14 nt, Mycobacterium avium subsp. paratuberculosis
cggcagcgccacca

SEQ ID NO: 2938139 - RNA, 15 nt, Mycobacterium avium subsp. paratuberculosis
cggcagcgccaccag

SEQ ID NO: 2938140 - RNA, 22 nt, Mycobacterium avium subsp. paratuberculosis
cggcagcgccaccagcuccucg

SEQ ID NO: 2938141 - RNA, 14 nt, Mycobacterium avium subsp. paratuberculosis
cggcagcgccagcg

SEQ ID NO: 2938142 - RNA, 17 nt, Mycobacterium avium subsp. paratuberculosis
cggcagcgccagcggga

SEQ ID NO: 2938143 - RNA, 12 nt, Mycobacterium avium subsp. paratuberculosis
cggcagcgcgcc

SEQ ID NO: 2938144 - RNA, 13 nt, Mycobacterium avium subsp. paratuberculosis
cggcagcgcgccc

SEQ ID NO: 2938145 - RNA, 15 nt, Mycobacterium avium subsp. paratuberculosis
cggcagcgcgcccag

SEQ ID NO: 2938146 - RNA, 20 nt, Mycobacterium avium subsp. paratuberculosis
cggcagcgcgcccugaggcc

SEQ ID NO: 2938147 - RNA, 15 nt, Mycobacterium avium subsp. paratuberculosis
cggcagcgcggcguu

SEQ ID NO: 2938148 - RNA, 12 nt, Mycobacterium avium subsp. paratuberculosis
cggcagcgcguu

SEQ ID NO: 2938149 - RNA, 20 nt, Mycobacterium avium subsp. paratuberculosis
cggcagcgcuaaccgcgggc

SEQ ID NO: 2938150 - RNA, 21 nt, Mycobacterium avium subsp. paratuberculosis
cggcagcgcuaaccgcgggca

SEQ ID NO: 2938151 - RNA, 14 nt, Mycobacterium avium subsp. paratuberculosis
cggcagcgcucguc

SEQ ID NO: 2938152 - RNA, 15 nt, Mycobacterium avium subsp. paratuberculosis
cggcagcgcucgucg

SEQ ID NO: 2938153 - RNA, 18 nt, Mycobacterium avium subsp. paratuberculosis
cggcagcgcucgucgucg

SEQ ID NO: 2938154 - RNA, 19 nt, Mycobacterium avium subsp. paratuberculosis
cggcagcgcucgucgucgg

SEQ ID NO: 2938155 - RNA, 20 nt, Mycobacterium avium subsp. paratuberculosis
cggcagcgcucgucgucgga

SEQ ID NO: 2938156 - RNA, 13 nt, Mycobacterium avium subsp. paratuberculosis
cggcagcggcacc

SEQ ID NO: 2938157 - RNA, 24 nt, Mycobacterium avium subsp. paratuberculosis
cggcagcggcaccaacccgaucgg

SEQ ID NO: 2938158 - RNA, 14 nt, Mycobacterium avium subsp. paratuberculosis
cggcagcggcgucg

SEQ ID NO: 2938159 - RNA, 15 nt, Mycobacterium avium subsp. paratuberculosis
cggcagcggcgucgu

SEQ ID NO: 2938160 - RNA, 13 nt, Mycobacterium avium subsp. paratuberculosis
cggcagcggcugc

SEQ ID NO: 2938161 - RNA, 14 nt, Mycobacterium avium subsp. paratuberculosis
cggcagcggcugcu

SEQ ID NO: 2938162 - RNA, 23 nt, Mycobacterium avium subsp. paratuberculosis
cggcagcggcugcugcagcgccc

SEQ ID NO: 2938163 - RNA, 23 nt, Mycobacterium avium subsp. paratuberculosis
cggcagcggggcgaacccggcgc

SEQ ID NO: 2938164 - RNA, 20 nt, Mycobacterium avium subsp. paratuberculosis
cggcagugagggaacgccga

SEQ ID NO: 2938165 - RNA, 20 nt, Mycobacterium avium subsp. paratuberculosis
cggcagugaucggcggaacc

SEQ ID NO: 2938166 - RNA, 21 nt, Mycobacterium avium subsp. paratuberculosis
cggcagugugauucgggucag

SEQ ID NO: 2938167 - RNA, 22 nt, Mycobacterium avium subsp. paratuberculosis
cggcaguugcacuuucgcgugg

SEQ ID NO: 2938168 - RNA, 14 nt, Mycobacterium avium subsp. paratuberculosis
cggcaguugcggcc

SEQ ID NO: 2938169 - RNA, 15 nt, Mycobacterium avium subsp. paratuberculosis
cggcaguugcggccg

SEQ ID NO: 2938170 - RNA, 17 nt, Mycobacterium avium subsp. paratuberculosis
cggcauagauaccggcc

SEQ ID NO: 2938171 - RNA, 20 nt, Mycobacterium avium subsp. paratuberculosis
cggcauagauaccggccagc

SEQ ID NO: 2938172 - RNA, 18 nt, Mycobacterium avium subsp. paratuberculosis
cggcauagcgccgcucgg

SEQ ID NO: 2938173 - RNA, 19 nt, Mycobacterium avium subsp. paratuberculosis
cggcauagcgccgcucggc

SEQ ID NO: 2938174 - RNA, 21 nt, Mycobacterium avium subsp. paratuberculosis
cggcauagcgccgcucggccg

SEQ ID NO: 2938175 - RNA, 15 nt, Mycobacterium avium subsp. paratuberculosis
cggcauaggccagca

SEQ ID NO: 2938176 - RNA, 16 nt, Mycobacterium avium subsp. paratuberculosis
cggcauaggccagcac

SEQ ID NO: 2938177 - RNA, 17 nt, Mycobacterium avium subsp. paratuberculosis
cggcauaggccagcacc

SEQ ID NO: 2938178 - RNA, 18 nt, Mycobacterium avium subsp. paratuberculosis
cggcauaggccagcacca

SEQ ID NO: 2938179 - RNA, 20 nt, Mycobacterium avium subsp. paratuberculosis
cggcauaggccagcaccagc

SEQ ID NO: 2938180 - RNA, 22 nt, Mycobacterium avium subsp. paratuberculosis
cggcauaggccagcaccagcgu

SEQ ID NO: 2938181 - RNA, 17 nt, Mycobacterium avium subsp. paratuberculosis
cggcauaguccagcucg

SEQ ID NO: 2938182 - RNA, 18 nt, Mycobacterium avium subsp. paratuberculosis
cggcauaguccagcucgc

SEQ ID NO: 2938183 - RNA, 14 nt, Mycobacterium avium subsp. paratuberculosis
cggcaucagcgaga

SEQ ID NO: 2938184 - RNA, 23 nt, Mycobacterium avium subsp. paratuberculosis
cggcaucagcgagacgaccagga

SEQ ID NO: 2938185 - RNA, 21 nt, Mycobacterium avium subsp. paratuberculosis
cggcauccagcacggccgcca

SEQ ID NO: 2938186 - RNA, 21 nt, Mycobacterium avium subsp. paratuberculosis
cggcauccccagcugggccgc

SEQ ID NO: 2938187 - RNA, 22 nt, Mycobacterium avium subsp. paratuberculosis
cggcauccccagcugggccgcc

SEQ ID NO: 2938188 - RNA, 21 nt, Mycobacterium avium subsp. paratuberculosis
cggcaucccuggugaccgacg

SEQ ID NO: 2938189 - RNA, 23 nt, Mycobacterium avium subsp. paratuberculosis
cggcaucccuuccugggacagcc

SEQ ID NO: 2938190 - RNA, 14 nt, Mycobacterium avium subsp. paratuberculosis
cggcauccucggcg

SEQ ID NO: 2938191 - RNA, 20 nt, Mycobacterium avium subsp. paratuberculosis
cggcauccucggcgcgucgg

SEQ ID NO: 2938192 - RNA, 19 nt, Mycobacterium avium subsp. paratuberculosis
cggcaucgacaugcccggc

SEQ ID NO: 2938193 - RNA, 20 nt, Mycobacterium avium subsp. paratuberculosis
cggcaucgacaugcccggcg

SEQ ID NO: 2938194 - RNA, 21 nt, Mycobacterium avium subsp. paratuberculosis
cggcaucgacaugcccggcga

SEQ ID NO: 2938195 - RNA, 22 nt, Mycobacterium avium subsp. paratuberculosis
cggcaucgacaugcccggcgac

SEQ ID NO: 2938196 - RNA, 23 nt, Mycobacterium avium subsp. paratuberculosis
cggcaucgacaugcccggcgacg

SEQ ID NO: 2938197 - RNA, 14 nt, Mycobacterium avium subsp. paratuberculosis
cggcaucgaccgcc

SEQ ID NO: 2938198 - RNA, 15 nt, Mycobacterium avium subsp. paratuberculosis
cggcaucgaccgccc

SEQ ID NO: 2938199 - RNA, 19 nt, Mycobacterium avium subsp. paratuberculosis
cggcaucgaccgcccgcug

SEQ ID NO: 2938200 - RNA, 17 nt, Mycobacterium avium subsp. paratuberculosis
cggcaucgaggaccggc

SEQ ID NO: 2938201 - RNA, 18 nt, Mycobacterium avium subsp. paratuberculosis
cggcaucgaggaccggcg

SEQ ID NO: 2938202 - RNA, 20 nt, Mycobacterium avium subsp. paratuberculosis
cggcaucgaggaccggcgcc

SEQ ID NO: 2938203 - RNA, 22 nt, Mycobacterium avium subsp. paratuberculosis
cggcaucgaggaccggcgccgg

SEQ ID NO: 2938204 - RNA, 23 nt, Mycobacterium avium subsp. paratuberculosis
cggcaucgauggcgggcgcgccg

SEQ ID NO: 2938205 - RNA, 24 nt, Mycobacterium avium subsp. paratuberculosis
cggcaucgauggcgggcgcgccgg

SEQ ID NO: 2938206 - RNA, 12 nt, Mycobacterium avium subsp. paratuberculosis
cggcaucgccgc

SEQ ID NO: 2938207 - RNA, 14 nt, Mycobacterium avium subsp. paratuberculosis
cggcaucgccgcca

SEQ ID NO: 2938208 - RNA, 14 nt, Mycobacterium avium subsp. paratuberculosis
cggcaucgcgccgc

SEQ ID NO: 2938209 - RNA, 15 nt, Mycobacterium avium subsp. paratuberculosis
cggcaucgcgccgca

SEQ ID NO: 2938210 - RNA, 16 nt, Mycobacterium avium subsp. paratuberculosis
cggcaucgcgcgcggc

SEQ ID NO: 2938211 - RNA, 21 nt, Mycobacterium avium subsp. paratuberculosis
cggcaucgcgcgcggcgacgg

SEQ ID NO: 2938212 - RNA, 18 nt, Mycobacterium avium subsp. paratuberculosis
cggcaucgcgcgcggcgg

SEQ ID NO: 2938213 - RNA, 20 nt, Mycobacterium avium subsp. paratuberculosis
cggcaucgcgcgcggcggcc

SEQ ID NO: 2938214 - RNA, 22 nt, Mycobacterium avium subsp. paratuberculosis
cggcaucgcgcgcggcggccac

SEQ ID NO: 2938215 - RNA, 16 nt, Mycobacterium avium subsp. paratuberculosis
cggcaucggcgacggc

SEQ ID NO: 2938216 - RNA, 17 nt, Mycobacterium avium subsp. paratuberculosis
cggcaucggcgacggcg

SEQ ID NO: 2938217 - RNA, 14 nt, Mycobacterium avium subsp. paratuberculosis
cggcaucggcgccc

SEQ ID NO: 2938218 - RNA, 15 nt, Mycobacterium avium subsp. paratuberculosis
cggcaucggcgcccu

SEQ ID NO: 2938219 - RNA, 22 nt, Mycobacterium avium subsp. paratuberculosis
cggcaucgguggcaccccgcgc

SEQ ID NO: 2938220 - RNA, 18 nt, Mycobacterium avium subsp. paratuberculosis
cggcaucgucaccucgag

SEQ ID NO: 2938221 - RNA, 13 nt, Mycobacterium avium subsp. paratuberculosis
cggcaucgucggg

SEQ ID NO: 2938222 - RNA, 14 nt, Mycobacterium avium subsp. paratuberculosis
cggcaucucggccg

SEQ ID NO: 2938223 - RNA, 15 nt, Mycobacterium avium subsp. paratuberculosis
cggcaucucggccgg

SEQ ID NO: 2938224 - RNA, 13 nt, Mycobacterium avium subsp. paratuberculosis
cggcaugaccggc

SEQ ID NO: 2938225 - RNA, 14 nt, Mycobacterium avium subsp. paratuberculosis
cggcaugaccggcc

SEQ ID NO: 2938226 - RNA, 18 nt, Mycobacterium avium subsp. paratuberculosis
cggcaugaccggccagca

SEQ ID NO: 2938227 - RNA, 15 nt, Mycobacterium avium subsp. paratuberculosis
cggcaugacgcccag

SEQ ID NO: 2938228 - RNA, 18 nt, Mycobacterium avium subsp. paratuberculosis
cggcaugacgcccagcug

SEQ ID NO: 2938229 - RNA, 13 nt, Mycobacterium avium subsp. paratuberculosis
cggcaugcccccg

SEQ ID NO: 2938230 - RNA, 12 nt, Mycobacterium avium subsp. paratuberculosis
cggcaugccgcc

SEQ ID NO: 2938231 - RNA, 14 nt, Mycobacterium avium subsp. paratuberculosis
cggcaugccgcccg

SEQ ID NO: 2938232 - RNA, 15 nt, Mycobacterium avium subsp. paratuberculosis
cggcaugccgcccgg

SEQ ID NO: 2938233 - RNA, 17 nt, Mycobacterium avium subsp. paratuberculosis
cggcaugccgcccgggc

SEQ ID NO: 2938234 - RNA, 19 nt, Mycobacterium avium subsp. paratuberculosis
cggcaugccgcccgggccg

SEQ ID NO: 2938235 - RNA, 14 nt, Mycobacterium avium subsp. paratuberculosis
cggcaugccgggcc

SEQ ID NO: 2938236 - RNA, 16 nt, Mycobacterium avium subsp. paratuberculosis
cggcaugccgggccag

SEQ ID NO: 2938237 - RNA, 19 nt, Mycobacterium avium subsp. paratuberculosis
cggcaugccgggccagccg

SEQ ID NO: 2938238 - RNA, 21 nt, Mycobacterium avium subsp. paratuberculosis
cggcauggcgaacacgucggc

SEQ ID NO: 2938239 - RNA, 22 nt, Mycobacterium avium subsp. paratuberculosis
cggcauggcgaacacgucggcc

SEQ ID NO: 2938240 - RNA, 20 nt, Mycobacterium avium subsp. paratuberculosis
cggcauggcgaugaccagcg

SEQ ID NO: 2938241 - RNA, 22 nt, Mycobacterium avium subsp. paratuberculosis
cggcauggcgaugaccagcgcg

SEQ ID NO: 2938242 - RNA, 22 nt, Mycobacterium avium subsp. paratuberculosis
cggcauggcuggcggcaacggc

SEQ ID NO: 2938243 - RNA, 22 nt, Mycobacterium avium subsp. paratuberculosis
cggcaugucgguggacagcgcg

SEQ ID NO: 2938244 - RNA, 23 nt, Mycobacterium avium subsp. paratuberculosis
cggcaugucgguggacagcgcga

SEQ ID NO: 2938245 - RNA, 15 nt, Mycobacterium avium subsp. paratuberculosis
cggcauugcagcgga

SEQ ID NO: 2938246 - RNA, 20 nt, Mycobacterium avium subsp. paratuberculosis
cggccaacagcagcgccgcg

SEQ ID NO: 2938247 - RNA, 22 nt, Mycobacterium avium subsp. paratuberculosis
cggccaacagcagcgccgcggc

SEQ ID NO: 2938248 - RNA, 18 nt, Mycobacterium avium subsp. paratuberculosis
cggccaccaugggcggga

SEQ ID NO: 2938249 - RNA, 21 nt, Mycobacterium avium subsp. paratuberculosis
cggccaccaugggcgggacga

SEQ ID NO: 2938250 - RNA, 18 nt, Mycobacterium avium subsp. paratuberculosis
cggccaccaugucggcgu

SEQ ID NO: 2938251 - RNA, 20 nt, Mycobacterium avium subsp. paratuberculosis
cggccaccaugucggcgucg

SEQ ID NO: 2938252 - RNA, 12 nt, Mycobacterium avium subsp. paratuberculosis
cggccaccccgc

SEQ ID NO: 2938253 - RNA, 17 nt, Mycobacterium avium subsp. paratuberculosis
cggccaccccgcagaac

SEQ ID NO: 2938254 - RNA, 15 nt, Mycobacterium avium subsp. paratuberculosis
cggccaccccggagc

SEQ ID NO: 2938255 - RNA, 17 nt, Mycobacterium avium subsp. paratuberculosis
cggccaccccggugacc

SEQ ID NO: 2938256 - RNA, 17 nt, Mycobacterium avium subsp. paratuberculosis
cggccaccgacugcgac

SEQ ID NO: 2938257 - RNA, 14 nt, Mycobacterium avium subsp. paratuberculosis
cggccaccgcccca

SEQ ID NO: 2938258 - RNA, 16 nt, Mycobacterium avium subsp. paratuberculosis
cggccaccgccccagc

SEQ ID NO: 2938259 - RNA, 21 nt, Mycobacterium avium subsp. paratuberculosis
cggccaccgccccagccgacc

SEQ ID NO: 2938260 - RNA, 15 nt, Mycobacterium avium subsp. paratuberculosis
cggccaccgccgcca

SEQ ID NO: 2938261 - RNA, 19 nt, Mycobacterium avium subsp. paratuberculosis
cggccaccgccgccagcag

SEQ ID NO: 2938262 - RNA, 14 nt, Mycobacterium avium subsp. paratuberculosis
cggccaccgcgacg

SEQ ID NO: 2938263 - RNA, 17 nt, Mycobacterium avium subsp. paratuberculosis
cggccaccgcgacgcug

SEQ ID NO: 2938264 - RNA, 20 nt, Mycobacterium avium subsp. paratuberculosis
cggccaccgcgacgcugccg

SEQ ID NO: 2938265 - RNA, 21 nt, Mycobacterium avium subsp. paratuberculosis
cggccaccgcgacgcugccgg

SEQ ID NO: 2938266 - RNA, 22 nt, Mycobacterium avium subsp. paratuberculosis
cggccaccgcgacgcugccggg

SEQ ID NO: 2938267 - RNA, 21 nt, Mycobacterium avium subsp. paratuberculosis
cggccaccgcgaucucgaugg

SEQ ID NO: 2938268 - RNA, 14 nt, Mycobacterium avium subsp. paratuberculosis
cggccaccgcgccc

SEQ ID NO: 2938269 - RNA, 18 nt, Mycobacterium avium subsp. paratuberculosis
cggccaccgcgccccggc

SEQ ID NO: 2938270 - RNA, 21 nt, Mycobacterium avium subsp. paratuberculosis
cggccaccgcgccccggcgca

SEQ ID NO: 2938271 - RNA, 14 nt, Mycobacterium avium subsp. paratuberculosis
cggccaccgcgccg

SEQ ID NO: 2938272 - RNA, 18 nt, Mycobacterium avium subsp. paratuberculosis
cggccaccgcgccguggg

SEQ ID NO: 2938273 - RNA, 20 nt, Mycobacterium avium subsp. paratuberculosis
cggccaccgcgccgugggcg

SEQ ID NO: 2938274 - RNA, 13 nt, Mycobacterium avium subsp. paratuberculosis
cggccaccgcgcg

SEQ ID NO: 2938275 - RNA, 14 nt, Mycobacterium avium subsp. paratuberculosis
cggccaccgcgcgc

SEQ ID NO: 2938276 - RNA, 18 nt, Mycobacterium avium subsp. paratuberculosis
cggccaccgcgcgcugcc

SEQ ID NO: 2938277 - RNA, 15 nt, Mycobacterium avium subsp. paratuberculosis
cggccaccgcgcggc

SEQ ID NO: 2938278 - RNA, 17 nt, Mycobacterium avium subsp. paratuberculosis
cggccaccgcgcggcgg

SEQ ID NO: 2938279 - RNA, 18 nt, Mycobacterium avium subsp. paratuberculosis
cggccaccgcgcggcggu

SEQ ID NO: 2938280 - RNA, 21 nt, Mycobacterium avium subsp. paratuberculosis
cggccaccgcgcggcggucca

SEQ ID NO: 2938281 - RNA, 15 nt, Mycobacterium avium subsp. paratuberculosis
cggccaccgcgcggu

SEQ ID NO: 2938282 - RNA, 16 nt, Mycobacterium avium subsp. paratuberculosis
cggccaccgcgcggug

SEQ ID NO: 2938283 - RNA, 17 nt, Mycobacterium avium subsp. paratuberculosis
cggccaccgcgcggugc

SEQ ID NO: 2938284 - RNA, 12 nt, Mycobacterium avium subsp. paratuberculosis
cggccaccgcgg

SEQ ID NO: 2938285 - RNA, 15 nt, Mycobacterium avium subsp. paratuberculosis
cggccaccgcggcca

SEQ ID NO: 2938286 - RNA, 17 nt, Mycobacterium avium subsp. paratuberculosis
cggccaccgcggccagc

SEQ ID NO: 2938287 - RNA, 19 nt, Mycobacterium avium subsp. paratuberculosis
cggccaccgcggccagcug

SEQ ID NO: 2938288 - RNA, 22 nt, Mycobacterium avium subsp. paratuberculosis
cggccaccgcggccagcugcga

SEQ ID NO: 2938289 - RNA, 19 nt, Mycobacterium avium subsp. paratuberculosis
cggccaccgcggucgacgg

SEQ ID NO: 2938290 - RNA, 17 nt, Mycobacterium avium subsp. paratuberculosis
cggccaccgcguccgcg

SEQ ID NO: 2938291 - RNA, 14 nt, Mycobacterium avium subsp. paratuberculosis
cggccaccggcgcg

SEQ ID NO: 2938292 - RNA, 18 nt, Mycobacterium avium subsp. paratuberculosis
cggccaccggcgcgacgg

SEQ ID NO: 2938293 - RNA, 20 nt, Mycobacterium avium subsp. paratuberculosis
cggccaccggcgcgacggcg

SEQ ID NO: 2938294 - RNA, 22 nt, Mycobacterium avium subsp. paratuberculosis
cggccaccggcgcgacggcggc

SEQ ID NO: 2938295 - RNA, 15 nt, Mycobacterium avium subsp. paratuberculosis
cggccaccgggaccg

SEQ ID NO: 2938296 - RNA, 14 nt, Mycobacterium avium subsp. paratuberculosis
cggccaccgucagc

SEQ ID NO: 2938297 - RNA, 15 nt, Mycobacterium avium subsp. paratuberculosis
cggccaccgucagcg

SEQ ID NO: 2938298 - RNA, 17 nt, Mycobacterium avium subsp. paratuberculosis
cggccaccgucagcguc

SEQ ID NO: 2938299 - RNA, 18 nt, Mycobacterium avium subsp. paratuberculosis
cggccaccgucagcguca

SEQ ID NO: 2938300 - RNA, 14 nt, Mycobacterium avium subsp. paratuberculosis
cggccaccuccagc

SEQ ID NO: 2938301 - RNA, 15 nt, Mycobacterium avium subsp. paratuberculosis
cggccaccucgccgc

SEQ ID NO: 2938302 - RNA, 16 nt, Mycobacterium avium subsp. paratuberculosis
cggccaccucgccgca

SEQ ID NO: 2938303 - RNA, 18 nt, Mycobacterium avium subsp. paratuberculosis
cggccaccucgucccagc

SEQ ID NO: 2938304 - RNA, 22 nt, Mycobacterium avium subsp. paratuberculosis
cggccaccucgucccagcgcaa

SEQ ID NO: 2938305 - RNA, 17 nt, Mycobacterium avium subsp. paratuberculosis
cggccaccucgucggcg

SEQ ID NO: 2938306 - RNA, 18 nt, Mycobacterium avium subsp. paratuberculosis
cggccaccucgucggcgg

SEQ ID NO: 2938307 - RNA, 21 nt, Mycobacterium avium subsp. paratuberculosis
cggccaccucgucggcgguca

SEQ ID NO: 2938308 - RNA, 16 nt, Mycobacterium avium subsp. paratuberculosis
cggccaccuggccggu

SEQ ID NO: 2938309 - RNA, 14 nt, Mycobacterium avium subsp. paratuberculosis
cggccaccugggcg

SEQ ID NO: 2938310 - RNA, 18 nt, Mycobacterium avium subsp. paratuberculosis
cggccaccugggcggggc

SEQ ID NO: 2938311 - RNA, 16 nt, Mycobacterium avium subsp. paratuberculosis
cggccaccuugcgcgg

SEQ ID NO: 2938312 - RNA, 18 nt, Mycobacterium avium subsp. paratuberculosis
cggccaccuugcgcgggu

SEQ ID NO: 2938313 - RNA, 19 nt, Mycobacterium avium subsp. paratuberculosis
cggccaccuugcgcggguc

SEQ ID NO: 2938314 - RNA, 21 nt, Mycobacterium avium subsp. paratuberculosis
cggccaccuugcgcgggucgc

SEQ ID NO: 2938315 - RNA, 19 nt, Mycobacterium avium subsp. paratuberculosis
cggccaccuugucggcgcc

SEQ ID NO: 2938316 - RNA, 21 nt, Mycobacterium avium subsp. paratuberculosis
cggccaccuugucggcgccca

SEQ ID NO: 2938317 - RNA, 23 nt, Mycobacterium avium subsp. paratuberculosis
cggccaccuugucggcgcccagg

SEQ ID NO: 2938318 - RNA, 13 nt, Mycobacterium avium subsp. paratuberculosis
cggccacgacgcg

SEQ ID NO: 2938319 - RNA, 16 nt, Mycobacterium avium subsp. paratuberculosis
cggccacgacgcgcca

SEQ ID NO: 2938320 - RNA, 17 nt, Mycobacterium avium subsp. paratuberculosis
cggccacgacgcggcgc

SEQ ID NO: 2938321 - RNA, 19 nt, Mycobacterium avium subsp. paratuberculosis
cggccacgacgcggcgcgc

SEQ ID NO: 2938322 - RNA, 21 nt, Mycobacterium avium subsp. paratuberculosis
cggccacgacgcggcgcgcga

SEQ ID NO: 2938323 - RNA, 13 nt, Mycobacterium avium subsp. paratuberculosis
cggccacgacggc

SEQ ID NO: 2938324 - RNA, 15 nt, Mycobacterium avium subsp. paratuberculosis
cggccacgacggcgc

SEQ ID NO: 2938325 - RNA, 17 nt, Mycobacterium avium subsp. paratuberculosis
cggccacgacggcgcug

SEQ ID NO: 2938326 - RNA, 13 nt, Mycobacterium avium subsp. paratuberculosis
cggccacgaucgc

SEQ ID NO: 2938327 - RNA, 22 nt, Mycobacterium avium subsp. paratuberculosis
cggccacgaucgcgaucgccga

SEQ ID NO: 2938328 - RNA, 17 nt, Mycobacterium avium subsp. paratuberculosis
cggccacgaucgcggcc

SEQ ID NO: 2938329 - RNA, 18 nt, Mycobacterium avium subsp. paratuberculosis
cggccacgaucgcggcca

SEQ ID NO: 2938330 - RNA, 20 nt, Mycobacterium avium subsp. paratuberculosis
cggccacgaucgcggccagc

SEQ ID NO: 2938331 - RNA, 21 nt, Mycobacterium avium subsp. paratuberculosis
cggccacgaucgcggccagcg

SEQ ID NO: 2938332 - RNA, 21 nt, Mycobacterium avium subsp. paratuberculosis
cggccacgauggggacgucga

SEQ ID NO: 2938333 - RNA, 17 nt, Mycobacterium avium subsp. paratuberculosis
cggccagccagccgccc

SEQ ID NO: 2938334 - RNA, 19 nt, Mycobacterium avium subsp. paratuberculosis
cggccagccagccgcccag

SEQ ID NO: 2938335 - RNA, 21 nt, Mycobacterium avium subsp. paratuberculosis
cggccagccagccgcccagca

SEQ ID NO: 2938336 - RNA, 14 nt, Mycobacterium avium subsp. paratuberculosis
cggccagccaggcc

SEQ ID NO: 2938337 - RNA, 15 nt, Mycobacterium avium subsp. paratuberculosis
cggccagccaggccg

SEQ ID NO: 2938338 - RNA, 23 nt, Mycobacterium avium subsp. paratuberculosis
cggccagccaggccgucggcgcg

SEQ ID NO: 2938339 - RNA, 23 nt, Mycobacterium avium subsp. paratuberculosis
cggccagcccaucccgauccgcg

SEQ ID NO: 2938340 - RNA, 11 nt, Mycobacterium avium subsp. paratuberculosis
cggccagcccc

SEQ ID NO: 2938341 - RNA, 13 nt, Mycobacterium avium subsp. paratuberculosis
cggccagccccac

SEQ ID NO: 2938342 - RNA, 17 nt, Mycobacterium avium subsp. paratuberculosis
cggccagccccaccacc

SEQ ID NO: 2938343 - RNA, 19 nt, Mycobacterium avium subsp. paratuberculosis
cggccagccccaccaccgc

SEQ ID NO: 2938344 - RNA, 13 nt, Mycobacterium avium subsp. paratuberculosis
cggccagccccgg

SEQ ID NO: 2938345 - RNA, 14 nt, Mycobacterium avium subsp. paratuberculosis
cggccagccccggg

SEQ ID NO: 2938346 - RNA, 17 nt, Mycobacterium avium subsp. paratuberculosis
cggccagccccgggaac

SEQ ID NO: 2938347 - RNA, 19 nt, Mycobacterium avium subsp. paratuberculosis
cggccagccccgggaacca

SEQ ID NO: 2938348 - RNA, 16 nt, Mycobacterium avium subsp. paratuberculosis
cggccagcccgcggca

SEQ ID NO: 2938349 - RNA, 17 nt, Mycobacterium avium subsp. paratuberculosis
cggccagcccgcggcag

SEQ ID NO: 2938350 - RNA, 16 nt, Mycobacterium avium subsp. paratuberculosis
cggccagcccgucggg

SEQ ID NO: 2938351 - RNA, 19 nt, Mycobacterium avium subsp. paratuberculosis
cggccagccgcgcgacgcc

SEQ ID NO: 2938352 - RNA, 20 nt, Mycobacterium avium subsp. paratuberculosis
cggccagccgcgcgacgccg

SEQ ID NO: 2938353 - RNA, 15 nt, Mycobacterium avium subsp. paratuberculosis
cggccagccgcgcgg

SEQ ID NO: 2938354 - RNA, 16 nt, Mycobacterium avium subsp. paratuberculosis
cggccagccgcgcggc

SEQ ID NO: 2938355 - RNA, 17 nt, Mycobacterium avium subsp. paratuberculosis
cggccagccgcgcggcg

SEQ ID NO: 2938356 - RNA, 18 nt, Mycobacterium avium subsp. paratuberculosis
cggccagccgcgcggcgu

SEQ ID NO: 2938357 - RNA, 19 nt, Mycobacterium avium subsp. paratuberculosis
cggccagccgcgcggcguc

SEQ ID NO: 2938358 - RNA, 13 nt, Mycobacterium avium subsp. paratuberculosis
cggccagccgcuc

SEQ ID NO: 2938359 - RNA, 16 nt, Mycobacterium avium subsp. paratuberculosis
cggccagccgcucccg

SEQ ID NO: 2938360 - RNA, 20 nt, Mycobacterium avium subsp. paratuberculosis
cggccagccgcucccggcgc

SEQ ID NO: 2938361 - RNA, 21 nt, Mycobacterium avium subsp. paratuberculosis
cggccagccgcucccggcgca

SEQ ID NO: 2938362 - RNA, 11 nt, Mycobacterium avium subsp. paratuberculosis
cggccagccgg

SEQ ID NO: 2938363 - RNA, 14 nt, Mycobacterium avium subsp. paratuberculosis
cggccagccggccg

SEQ ID NO: 2938364 - RNA, 15 nt, Mycobacterium avium subsp. paratuberculosis
cggccagccggccgc

SEQ ID NO: 2938365 - RNA, 19 nt, Mycobacterium avium subsp. paratuberculosis
cggccagccggccgcugac

SEQ ID NO: 2938366 - RNA, 13 nt, Mycobacterium avium subsp. paratuberculosis
cggccagccggcu

SEQ ID NO: 2938367 - RNA, 22 nt, Mycobacterium avium subsp. paratuberculosis
cggccagccggcucuuggcgac

SEQ ID NO: 2938368 - RNA, 15 nt, Mycobacterium avium subsp. paratuberculosis
cggccagccgggcgg

SEQ ID NO: 2938369 - RNA, 17 nt, Mycobacterium avium subsp. paratuberculosis
cggccagccgggcggcc

SEQ ID NO: 2938370 - RNA, 14 nt, Mycobacterium avium subsp. paratuberculosis
cggccagccggggu

SEQ ID NO: 2938371 - RNA, 16 nt, Mycobacterium avium subsp. paratuberculosis
cggccagccgggguag

SEQ ID NO: 2938372 - RNA, 19 nt, Mycobacterium avium subsp. paratuberculosis
cggccagccggucgucggg

SEQ ID NO: 2938373 - RNA, 12 nt, Mycobacterium avium subsp. paratuberculosis
cggccagcgagg

SEQ ID NO: 2938374 - RNA, 16 nt, Mycobacterium avium subsp. paratuberculosis
cggccagcgaggaccc

SEQ ID NO: 2938375 - RNA, 20 nt, Mycobacterium avium subsp. paratuberculosis
cggccagcgaguccagccag

SEQ ID NO: 2938376 - RNA, 15 nt, Mycobacterium avium subsp. paratuberculosis
cggccagcgagucga

SEQ ID NO: 2938377 - RNA, 17 nt, Mycobacterium avium subsp. paratuberculosis
cggccagcgagucgaug

SEQ ID NO: 2938378 - RNA, 17 nt, Mycobacterium avium subsp. paratuberculosis
cggccagcgcagcgacc

SEQ ID NO: 2938379 - RNA, 22 nt, Mycobacterium avium subsp. paratuberculosis
cggccagcgcagguacgcggcg

SEQ ID NO: 2938380 - RNA, 16 nt, Mycobacterium avium subsp. paratuberculosis
cggccagcgccccgcc

SEQ ID NO: 2938381 - RNA, 19 nt, Mycobacterium avium subsp. paratuberculosis
cggccagcgccccgccggg

SEQ ID NO: 2938382 - RNA, 14 nt, Mycobacterium avium subsp. paratuberculosis
cggccagcgcccgc

SEQ ID NO: 2938383 - RNA, 15 nt, Mycobacterium avium subsp. paratuberculosis
cggccagcgcccgcg

SEQ ID NO: 2938384 - RNA, 16 nt, Mycobacterium avium subsp. paratuberculosis
cggccagcgcccgcgc

SEQ ID NO: 2938385 - RNA, 14 nt, Mycobacterium avium subsp. paratuberculosis
cggccagcgccgcc

SEQ ID NO: 2938386 - RNA, 17 nt, Mycobacterium avium subsp. paratuberculosis
cggccagcgccgccagc

SEQ ID NO: 2938387 - RNA, 19 nt, Mycobacterium avium subsp. paratuberculosis
cggccagcgccgccagccg

SEQ ID NO: 2938388 - RNA, 16 nt, Mycobacterium avium subsp. paratuberculosis
cggccagcgccgcccg

SEQ ID NO: 2938389 - RNA, 15 nt, Mycobacterium avium subsp. paratuberculosis
cggccagcgccgcgc

SEQ ID NO: 2938390 - RNA, 18 nt, Mycobacterium avium subsp. paratuberculosis
cggccagcgccgcgcgcg

SEQ ID NO: 2938391 - RNA, 19 nt, Mycobacterium avium subsp. paratuberculosis
cggccagcgccgcgcgcgc

SEQ ID NO: 2938392 - RNA, 17 nt, Mycobacterium avium subsp. paratuberculosis
cggccagcgccgucauc

SEQ ID NO: 2938393 - RNA, 13 nt, Mycobacterium avium subsp. paratuberculosis
cggccagcgccuu

SEQ ID NO: 2938394 - RNA, 11 nt, Mycobacterium avium subsp. paratuberculosis
cggccagcgcg

SEQ ID NO: 2938395 - RNA, 13 nt, Mycobacterium avium subsp. paratuberculosis
cggccagcgcgaa

SEQ ID NO: 2938396 - RNA, 16 nt, Mycobacterium avium subsp. paratuberculosis
cggccagcgcgaaagc

SEQ ID NO: 2938397 - RNA, 22 nt, Mycobacterium avium subsp. paratuberculosis
cggccagcgcgaaagcagcaac

SEQ ID NO: 2938398 - RNA, 13 nt, Mycobacterium avium subsp. paratuberculosis
cggccagcgcgcc

SEQ ID NO: 2938399 - RNA, 14 nt, Mycobacterium avium subsp. paratuberculosis
cggccagcgcgccg

SEQ ID NO: 2938400 - RNA, 15 nt, Mycobacterium avium subsp. paratuberculosis
cggccagcgcgccgc

SEQ ID NO: 2938401 - RNA, 17 nt, Mycobacterium avium subsp. paratuberculosis
cggccagcgcgccgcac

SEQ ID NO: 2938402 - RNA, 16 nt, Mycobacterium avium subsp. paratuberculosis
cggccagcgcgccgcc

SEQ ID NO: 2938403 - RNA, 17 nt, Mycobacterium avium subsp. paratuberculosis
cggccagcgcgccgccg

SEQ ID NO: 2938404 - RNA, 18 nt, Mycobacterium avium subsp. paratuberculosis
cggccagcgcgccgccga

SEQ ID NO: 2938405 - RNA, 15 nt, Mycobacterium avium subsp. paratuberculosis
cggccagcgcgcgca

SEQ ID NO: 2938406 - RNA, 17 nt, Mycobacterium avium subsp. paratuberculosis
cggccagcgcgcgcagc

SEQ ID NO: 2938407 - RNA, 14 nt, Mycobacterium avium subsp. paratuberculosis
cggccagcgcgcgg

SEQ ID NO: 2938408 - RNA, 20 nt, Mycobacterium avium subsp. paratuberculosis
cggccagcgcgcgggcgucc

SEQ ID NO: 2938409 - RNA, 12 nt, Mycobacterium avium subsp. paratuberculosis
cggccagcgcgg

SEQ ID NO: 2938410 - RNA, 13 nt, Mycobacterium avium subsp. paratuberculosis
cggccagcgcggc

SEQ ID NO: 2938411 - RNA, 15 nt, Mycobacterium avium subsp. paratuberculosis
cggccagcgcggccg

SEQ ID NO: 2938412 - RNA, 18 nt, Mycobacterium avium subsp. paratuberculosis
cggccagcgcggccgggc

SEQ ID NO: 2938413 - RNA, 19 nt, Mycobacterium avium subsp. paratuberculosis
cggccagcgcggccgggcg

SEQ ID NO: 2938414 - RNA, 21 nt, Mycobacterium avium subsp. paratuberculosis
cggccagcgcggccgggcgcc

SEQ ID NO: 2938415 - RNA, 22 nt, Mycobacterium avium subsp. paratuberculosis
cggccagcgcggccgggcgccc

SEQ ID NO: 2938416 - RNA, 19 nt, Mycobacterium avium subsp. paratuberculosis
cggccagcgcggcggccag

SEQ ID NO: 2938417 - RNA, 22 nt, Mycobacterium avium subsp. paratuberculosis
cggccagcgcggcggucgcgcg

SEQ ID NO: 2938418 - RNA, 19 nt, Mycobacterium avium subsp. paratuberculosis
cggccagggccgccgcaua

SEQ ID NO: 2938419 - RNA, 14 nt, Mycobacterium avium subsp. paratuberculosis
cggccagggcggcg

SEQ ID NO: 2938420 - RNA, 18 nt, Mycobacterium avium subsp. paratuberculosis
cggccagggcggcgccgg

SEQ ID NO: 2938421 - RNA, 19 nt, Mycobacterium avium subsp. paratuberculosis
cggccagggcggcgccggc

SEQ ID NO: 2938422 - RNA, 21 nt, Mycobacterium avium subsp. paratuberculosis
cggccagggcggcgccggcac

SEQ ID NO: 2938423 - RNA, 23 nt, Mycobacterium avium subsp. paratuberculosis
cggccagggcucgugcagccggc

SEQ ID NO: 2938424 - RNA, 24 nt, Mycobacterium avium subsp. paratuberculosis
cggccagggcucgugcagccggcg

SEQ ID NO: 2938425 - RNA, 23 nt, Mycobacterium avium subsp. paratuberculosis
cggccaggguagaggcggcgacc

SEQ ID NO: 2938426 - RNA, 14 nt, Mycobacterium avium subsp. paratuberculosis
cggccagggugacg

SEQ ID NO: 2938427 - RNA, 20 nt, Mycobacterium avium subsp. paratuberculosis
cggccagggugccgacgacc

SEQ ID NO: 2938428 - RNA, 21 nt, Mycobacterium avium subsp. paratuberculosis
cggccagggugccgacgaccu

SEQ ID NO: 2938429 - RNA, 23 nt, Mycobacterium avium subsp. paratuberculosis
cggccaggguggggaucacgucg

SEQ ID NO: 2938430 - RNA, 18 nt, Mycobacterium avium subsp. paratuberculosis
cggccagggugucccagc

SEQ ID NO: 2938431 - RNA, 22 nt, Mycobacterium avium subsp. paratuberculosis
cggccagggugucccagcgcca

SEQ ID NO: 2938432 - RNA, 22 nt, Mycobacterium avium subsp. paratuberculosis
cggccagguacugaucaccgcg

SEQ ID NO: 2938433 - RNA, 19 nt, Mycobacterium avium subsp. paratuberculosis
cggccagguccacaccgug

SEQ ID NO: 2938434 - RNA, 18 nt, Mycobacterium avium subsp. paratuberculosis
cggccaggucgacggggu

SEQ ID NO: 2938435 - RNA, 23 nt, Mycobacterium avium subsp. paratuberculosis
cggccaggucgacggggucggac

SEQ ID NO: 2938436 - RNA, 15 nt, Mycobacterium avium subsp. paratuberculosis
cggccaggucgccgc

SEQ ID NO: 2938437 - RNA, 19 nt, Mycobacterium avium subsp. paratuberculosis
cggccaggucgccgcgcag

SEQ ID NO: 2938438 - RNA, 20 nt, Mycobacterium avium subsp. paratuberculosis
cggccaggucgccgcgcagc

SEQ ID NO: 2938439 - RNA, 23 nt, Mycobacterium avium subsp. paratuberculosis
cggccaggucgccgcgcagcacc

SEQ ID NO: 2938440 - RNA, 18 nt, Mycobacterium avium subsp. paratuberculosis
cggccagguuccaccggg

SEQ ID NO: 2938441 - RNA, 22 nt, Mycobacterium avium subsp. paratuberculosis
cggccagguuccaccgggcguc

SEQ ID NO: 2938442 - RNA, 17 nt, Mycobacterium avium subsp. paratuberculosis
cggccagguugaccacc

SEQ ID NO: 2938443 - RNA, 18 nt, Mycobacterium avium subsp. paratuberculosis
cggccagguugaccacca

SEQ ID NO: 2938444 - RNA, 19 nt, Mycobacterium avium subsp. paratuberculosis
cggccagguugaccaccag

SEQ ID NO: 2938445 - RNA, 20 nt, Mycobacterium avium subsp. paratuberculosis
cggccagguugaccaccagc

SEQ ID NO: 2938446 - RNA, 21 nt, Mycobacterium avium subsp. paratuberculosis
cggccagguugaccaccagcg

SEQ ID NO: 2938447 - RNA, 20 nt, Mycobacterium avium subsp. paratuberculosis
cggccagguuuugcagcgga

SEQ ID NO: 2938448 - RNA, 16 nt, Mycobacterium avium subsp. paratuberculosis
cggccaguccagcgaa

SEQ ID NO: 2938449 - RNA, 20 nt, Mycobacterium avium subsp. paratuberculosis
cggccaguccagcgaaucga

SEQ ID NO: 2938450 - RNA, 17 nt, Mycobacterium avium subsp. paratuberculosis
cggccaguccaggccgc

SEQ ID NO: 2938451 - RNA, 18 nt, Mycobacterium avium subsp. paratuberculosis
cggccaguccaggccgcc

SEQ ID NO: 2938452 - RNA, 19 nt, Mycobacterium avium subsp. paratuberculosis
cggccaguccaggccgccg

SEQ ID NO: 2938453 - RNA, 20 nt, Mycobacterium avium subsp. paratuberculosis
cggccaguccaggccgccgu

SEQ ID NO: 2938454 - RNA, 23 nt, Mycobacterium avium subsp. paratuberculosis
cggccaguccaggccgccgugga

SEQ ID NO: 2938455 - RNA, 16 nt, Mycobacterium avium subsp. paratuberculosis
cggccaguccgcguga

SEQ ID NO: 2938456 - RNA, 15 nt, Mycobacterium avium subsp. paratuberculosis
cggccaguccggcag

SEQ ID NO: 2938457 - RNA, 16 nt, Mycobacterium avium subsp. paratuberculosis
cggccaguccggcagc

SEQ ID NO: 2938458 - RNA, 19 nt, Mycobacterium avium subsp. paratuberculosis
cggccaguccggcagcagc

SEQ ID NO: 2938459 - RNA, 20 nt, Mycobacterium avium subsp. paratuberculosis
cggccaguccggcagcagcg

SEQ ID NO: 2938460 - RNA, 22 nt, Mycobacterium avium subsp. paratuberculosis
cggccaguccggcagcagcgag

SEQ ID NO: 2938461 - RNA, 16 nt, Mycobacterium avium subsp. paratuberculosis
cggccaguccugggcc

SEQ ID NO: 2938462 - RNA, 16 nt, Mycobacterium avium subsp. paratuberculosis
cggccagugccgggcc

SEQ ID NO: 2938463 - RNA, 16 nt, Mycobacterium avium subsp. paratuberculosis
cggccaguucaccgcg

SEQ ID NO: 2938464 - RNA, 18 nt, Mycobacterium avium subsp. paratuberculosis
cggccaguucaccgcgcu

SEQ ID NO: 2938465 - RNA, 18 nt, Mycobacterium avium subsp. paratuberculosis
cggccaguucccgggcga

SEQ ID NO: 2938466 - RNA, 16 nt, Mycobacterium avium subsp. paratuberculosis
cggccaguucgagcgc

SEQ ID NO: 2938467 - RNA, 20 nt, Mycobacterium avium subsp. paratuberculosis
cggccaguucgagcgccgcg

SEQ ID NO: 2938468 - RNA, 21 nt, Mycobacterium avium subsp. paratuberculosis
cggccaguucgagcgccgcgg

SEQ ID NO: 2938469 - RNA, 22 nt, Mycobacterium avium subsp. paratuberculosis
cggccaguucgagcgccgcggc

SEQ ID NO: 2938470 - RNA, 15 nt, Mycobacterium avium subsp. paratuberculosis
cggccaguucgccgg

SEQ ID NO: 2938471 - RNA, 19 nt, Mycobacterium avium subsp. paratuberculosis
cggccaguucgccggugac

SEQ ID NO: 2938472 - RNA, 12 nt, Mycobacterium avium subsp. paratuberculosis
cggccaguucgg

SEQ ID NO: 2938473 - RNA, 17 nt, Mycobacterium avium subsp. paratuberculosis
cggccaguucggguccg

SEQ ID NO: 2938474 - RNA, 21 nt, Mycobacterium avium subsp. paratuberculosis
cggccaguugaaguccggcgg

SEQ ID NO: 2938475 - RNA, 20 nt, Mycobacterium avium subsp. paratuberculosis
cggccaguugacguugaucg

SEQ ID NO: 2938476 - RNA, 23 nt, Mycobacterium avium subsp. paratuberculosis
cggccaguugacguugaucgcgc

SEQ ID NO: 2938477 - RNA, 17 nt, Mycobacterium avium subsp. paratuberculosis
cggccaucacggugccg

SEQ ID NO: 2938478 - RNA, 18 nt, Mycobacterium avium subsp. paratuberculosis
cggccaucacggugccga

SEQ ID NO: 2938479 - RNA, 14 nt, Mycobacterium avium subsp. paratuberculosis
cggccaucagcacc

SEQ ID NO: 2938480 - RNA, 15 nt, Mycobacterium avium subsp. paratuberculosis
cggccaucagcaccg

SEQ ID NO: 2938481 - RNA, 16 nt, Mycobacterium avium subsp. paratuberculosis
cggccaucagcaccga

SEQ ID NO: 2938482 - RNA, 18 nt, Mycobacterium avium subsp. paratuberculosis
cggccaucagcaccgaau

SEQ ID NO: 2938483 - RNA, 21 nt, Mycobacterium avium subsp. paratuberculosis
cggccaucagcaccgaaucgc

SEQ ID NO: 2938484 - RNA, 22 nt, Mycobacterium avium subsp. paratuberculosis
cggccaucagcaccgaaucgcc

SEQ ID NO: 2938485 - RNA, 13 nt, Mycobacterium avium subsp. paratuberculosis
cggccaucagccg

SEQ ID NO: 2938486 - RNA, 15 nt, Mycobacterium avium subsp. paratuberculosis
cggccaucagccgcc

SEQ ID NO: 2938487 - RNA, 16 nt, Mycobacterium avium subsp. paratuberculosis
cggccaucagccgccg

SEQ ID NO: 2938488 - RNA, 21 nt, Mycobacterium avium subsp. paratuberculosis
cggccaucagccgccgucgcg

SEQ ID NO: 2938489 - RNA, 18 nt, Mycobacterium avium subsp. paratuberculosis
cggccaucaugcccacca

SEQ ID NO: 2938490 - RNA, 23 nt, Mycobacterium avium subsp. paratuberculosis
cggccaucaugcccaccaucccg

SEQ ID NO: 2938491 - RNA, 22 nt, Mycobacterium avium subsp. paratuberculosis
cggccauccccgcguuggccag

SEQ ID NO: 2938492 - RNA, 17 nt, Mycobacterium avium subsp. paratuberculosis
cggccaucccggugccg

SEQ ID NO: 2938493 - RNA, 15 nt, Mycobacterium avium subsp. paratuberculosis
cggccauccgcugcg

SEQ ID NO: 2938494 - RNA, 20 nt, Mycobacterium avium subsp. paratuberculosis
cggccauccgggcggcaucg

SEQ ID NO: 2938495 - RNA, 17 nt, Mycobacterium avium subsp. paratuberculosis
cggccaucgccgccauc

SEQ ID NO: 2938496 - RNA, 14 nt, Mycobacterium avium subsp. paratuberculosis
cggccaucgccgcg

SEQ ID NO: 2938497 - RNA, 15 nt, Mycobacterium avium subsp. paratuberculosis
cggccaucgccgcgg

SEQ ID NO: 2938498 - RNA, 18 nt, Mycobacterium avium subsp. paratuberculosis
cggccaucgccgcggugg

SEQ ID NO: 2938499 - RNA, 19 nt, Mycobacterium avium subsp. paratuberculosis
cggccaucgccgcgguggc

SEQ ID NO: 2938500 - RNA, 12 nt, Mycobacterium avium subsp. paratuberculosis
cggccaucgccu

SEQ ID NO: 2938501 - RNA, 22 nt, Mycobacterium avium subsp. paratuberculosis
cggccaucuccugcacgcgcgg

SEQ ID NO: 2938502 - RNA, 16 nt, Mycobacterium avium subsp. paratuberculosis
cggcccaguucgcacc

SEQ ID NO: 2938503 - RNA, 16 nt, Mycobacterium avium subsp. paratuberculosis
cggcccaucaccagcg

SEQ ID NO: 2938504 - RNA, 17 nt, Mycobacterium avium subsp. paratuberculosis
cggcccaucaccagcgg

SEQ ID NO: 2938505 - RNA, 20 nt, Mycobacterium avium subsp. paratuberculosis
cggcccaucaccagcggcug

SEQ ID NO: 2938506 - RNA, 21 nt, Mycobacterium avium subsp. paratuberculosis
cggcccaucaccagcggcugc

SEQ ID NO: 2938507 - RNA, 18 nt, Mycobacterium avium subsp. paratuberculosis
cggcccaucaccggaccg

SEQ ID NO: 2938508 - RNA, 20 nt, Mycobacterium avium subsp. paratuberculosis
cggcccaucaccggaccggc

SEQ ID NO: 2938509 - RNA, 21 nt, Mycobacterium avium subsp. paratuberculosis
cggcccaucaccggaccggcc

SEQ ID NO: 2938510 - RNA, 17 nt, Mycobacterium avium subsp. paratuberculosis
cggcccaucacgucggg

SEQ ID NO: 2938511 - RNA, 15 nt, Mycobacterium avium subsp. paratuberculosis
cggcccauggcgaac

SEQ ID NO: 2938512 - RNA, 13 nt, Mycobacterium avium subsp. paratuberculosis
cggccccaacggc

SEQ ID NO: 2938513 - RNA, 16 nt, Mycobacterium avium subsp. paratuberculosis
cggccccaacggcgug

SEQ ID NO: 2938514 - RNA, 17 nt, Mycobacterium avium subsp. paratuberculosis
cggccccaacggcgugc

SEQ ID NO: 2938515 - RNA, 18 nt, Mycobacterium avium subsp. paratuberculosis
cggccccaacggcgugca

SEQ ID NO: 2938516 - RNA, 20 nt, Mycobacterium avium subsp. paratuberculosis
cggccccaacggcgugcagc

SEQ ID NO: 2938517 - RNA, 14 nt, Mycobacterium avium subsp. paratuberculosis
cggccccaccgccg

SEQ ID NO: 2938518 - RNA, 15 nt, Mycobacterium avium subsp. paratuberculosis
cggccccaccgccgc

SEQ ID NO: 2938519 - RNA, 19 nt, Mycobacterium avium subsp. paratuberculosis
cggccccaccgccgcugcg

SEQ ID NO: 2938520 - RNA, 22 nt, Mycobacterium avium subsp. paratuberculosis
cggccccacguugaucaugucg

SEQ ID NO: 2938521 - RNA, 14 nt, Mycobacterium avium subsp. paratuberculosis
cggccccagacgaa

SEQ ID NO: 2938522 - RNA, 12 nt, Mycobacterium avium subsp. paratuberculosis
cggccccagccg

SEQ ID NO: 2938523 - RNA, 15 nt, Mycobacterium avium subsp. paratuberculosis
cggccccagccgccg

SEQ ID NO: 2938524 - RNA, 16 nt, Mycobacterium avium subsp. paratuberculosis
cggccccagccgccgc

SEQ ID NO: 2938525 - RNA, 15 nt, Mycobacterium avium subsp. paratuberculosis
cggcccccacgcagc

SEQ ID NO: 2938526 - RNA, 18 nt, Mycobacterium avium subsp. paratuberculosis
cggcccccacgcagcggu

SEQ ID NO: 2938527 - RNA, 16 nt, Mycobacterium avium subsp. paratuberculosis
cggccccccgggcacc

SEQ ID NO: 2938528 - RNA, 18 nt, Mycobacterium avium subsp. paratuberculosis
cggccccccgggcaccag

SEQ ID NO: 2938529 - RNA, 22 nt, Mycobacterium avium subsp. paratuberculosis
cggccccccgggcaccagcgcg

SEQ ID NO: 2938530 - RNA, 19 nt, Mycobacterium avium subsp. paratuberculosis
cggcccccgggcccgaagc

SEQ ID NO: 2938531 - RNA, 20 nt, Mycobacterium avium subsp. paratuberculosis
cggcccccugcucagcggcc

SEQ ID NO: 2938532 - RNA, 14 nt, Mycobacterium avium subsp. paratuberculosis
cggccccgagccga

SEQ ID NO: 2938533 - RNA, 16 nt, Mycobacterium avium subsp. paratuberculosis
cggccccgagccgacg

SEQ ID NO: 2938534 - RNA, 17 nt, Mycobacterium avium subsp. paratuberculosis
cggccccgagcgucacg

SEQ ID NO: 2938535 - RNA, 22 nt, Mycobacterium avium subsp. paratuberculosis
cggccccgagcgucacgccagc

SEQ ID NO: 2938536 - RNA, 11 nt, Mycobacterium avium subsp. paratuberculosis
cggccccgcca

SEQ ID NO: 2938537 - RNA, 13 nt, Mycobacterium avium subsp. paratuberculosis
cggccccgcccgg

SEQ ID NO: 2938538 - RNA, 14 nt, Mycobacterium avium subsp. paratuberculosis
cggccccgcccggc

SEQ ID NO: 2938539 - RNA, 16 nt, Mycobacterium avium subsp. paratuberculosis
cggccccgcccggcgc

SEQ ID NO: 2938540 - RNA, 17 nt, Mycobacterium avium subsp. paratuberculosis
cggccccgcccggcgcg

SEQ ID NO: 2938541 - RNA, 21 nt, Mycobacterium avium subsp. paratuberculosis
cggccccgcccggcgcgcagc

SEQ ID NO: 2938542 - RNA, 18 nt, Mycobacterium avium subsp. paratuberculosis
cggccccgcccggggcgg

SEQ ID NO: 2938543 - RNA, 20 nt, Mycobacterium avium subsp. paratuberculosis
cggccccgcccggggcggcg

SEQ ID NO: 2938544 - RNA, 13 nt, Mycobacterium avium subsp. paratuberculosis
cggccccgcgcau

SEQ ID NO: 2938545 - RNA, 14 nt, Mycobacterium avium subsp. paratuberculosis
cggccccgcgcauc

SEQ ID NO: 2938546 - RNA, 21 nt, Mycobacterium avium subsp. paratuberculosis
cggccccgcgcaucggucagc

SEQ ID NO: 2938547 - RNA, 20 nt, Mycobacterium avium subsp. paratuberculosis
cggccccgcugccguccggc

SEQ ID NO: 2938548 - RNA, 21 nt, Mycobacterium avium subsp. paratuberculosis
cggccccgcugccguccggcg

SEQ ID NO: 2938549 - RNA, 13 nt, Mycobacterium avium subsp. paratuberculosis
cggccccggccga

SEQ ID NO: 2938550 - RNA, 19 nt, Mycobacterium avium subsp. paratuberculosis
cggccccggccgagccggc

SEQ ID NO: 2938551 - RNA, 13 nt, Mycobacterium avium subsp. paratuberculosis
cggccccggccgg

SEQ ID NO: 2938552 - RNA, 14 nt, Mycobacterium avium subsp. paratuberculosis
cggccccggccggc

SEQ ID NO: 2938553 - RNA, 16 nt, Mycobacterium avium subsp. paratuberculosis
cggccccggccggcgg

SEQ ID NO: 2938554 - RNA, 17 nt, Mycobacterium avium subsp. paratuberculosis
cggccccggccggcggg

SEQ ID NO: 2938555 - RNA, 16 nt, Mycobacterium avium subsp. paratuberculosis
cggccccggccgggcg

SEQ ID NO: 2938556 - RNA, 17 nt, Mycobacterium avium subsp. paratuberculosis
cggccccggccgggcga

SEQ ID NO: 2938557 - RNA, 18 nt, Mycobacterium avium subsp. paratuberculosis
cggccccggcgacggcgg

SEQ ID NO: 2938558 - RNA, 15 nt, Mycobacterium avium subsp. paratuberculosis
cggccccggcucggg

SEQ ID NO: 2938559 - RNA, 14 nt, Mycobacterium avium subsp. paratuberculosis
cggccccgggcgcu

SEQ ID NO: 2938560 - RNA, 16 nt, Mycobacterium avium subsp. paratuberculosis
cggccccgggcgcugg

SEQ ID NO: 2938561 - RNA, 19 nt, Mycobacterium avium subsp. paratuberculosis
cggccccgggcgcuggcga

SEQ ID NO: 2938562 - RNA, 20 nt, Mycobacterium avium subsp. paratuberculosis
cggccccgggcgcuggcgau

SEQ ID NO: 2938563 - RNA, 19 nt, Mycobacterium avium subsp. paratuberculosis
cggccccgggggaccagcg

SEQ ID NO: 2938564 - RNA, 21 nt, Mycobacterium avium subsp. paratuberculosis
cggccccgggggaccagcgca

SEQ ID NO: 2938565 - RNA, 20 nt, Mycobacterium avium subsp. paratuberculosis
cggccccgguagccagcacc

SEQ ID NO: 2938566 - RNA, 21 nt, Mycobacterium avium subsp. paratuberculosis
cggccccgguagccagcaccg

SEQ ID NO: 2938567 - RNA, 22 nt, Mycobacterium avium subsp. paratuberculosis
cggccccgguagccagcaccgc

SEQ ID NO: 2938568 - RNA, 23 nt, Mycobacterium avium subsp. paratuberculosis
cggccccgguagccagcaccgcc

SEQ ID NO: 2938569 - RNA, 18 nt, Mycobacterium avium subsp. paratuberculosis
cggccccuaccgccgagc

SEQ ID NO: 2938570 - RNA, 14 nt, Mycobacterium avium subsp. paratuberculosis
cggccccuuggcgu

SEQ ID NO: 2938571 - RNA, 19 nt, Mycobacterium avium subsp. paratuberculosis
cggcccgaaaacgcccggg

SEQ ID NO: 2938572 - RNA, 22 nt, Mycobacterium avium subsp. paratuberculosis
cggcccgaaaacgcccggguga

SEQ ID NO: 2938573 - RNA, 11 nt, Mycobacterium avium subsp. paratuberculosis
cggcccgacca

SEQ ID NO: 2938574 - RNA, 14 nt, Mycobacterium avium subsp. paratuberculosis
cggcccgaccagcg

SEQ ID NO: 2938575 - RNA, 19 nt, Mycobacterium avium subsp. paratuberculosis
cggcccgaccagcgggccg

SEQ ID NO: 2938576 - RNA, 20 nt, Mycobacterium avium subsp. paratuberculosis
cggcccgaccagcgggccga

SEQ ID NO: 2938577 - RNA, 16 nt, Mycobacterium avium subsp. paratuberculosis
cggcccgacccgguca

SEQ ID NO: 2938578 - RNA, 17 nt, Mycobacterium avium subsp. paratuberculosis
cggcccgacccggucag

SEQ ID NO: 2938579 - RNA, 21 nt, Mycobacterium avium subsp. paratuberculosis
cggcccgacccggucagcucg

SEQ ID NO: 2938580 - RNA, 15 nt, Mycobacterium avium subsp. paratuberculosis
cggcccgaccggagc

SEQ ID NO: 2938581 - RNA, 20 nt, Mycobacterium avium subsp. paratuberculosis
cggcccgaccggagccgucu

SEQ ID NO: 2938582 - RNA, 12 nt, Mycobacterium avium subsp. paratuberculosis
cggcccgacgac

SEQ ID NO: 2938583 - RNA, 14 nt, Mycobacterium avium subsp. paratuberculosis
cggcccgacgacgc

SEQ ID NO: 2938584 - RNA, 18 nt, Mycobacterium avium subsp. paratuberculosis
cggcccgagcaccaccag

SEQ ID NO: 2938585 - RNA, 20 nt, Mycobacterium avium subsp. paratuberculosis
cggcccgagcccugcgccag

SEQ ID NO: 2938586 - RNA, 23 nt, Mycobacterium avium subsp. paratuberculosis
cggcccgagcccugcgccagcag

SEQ ID NO: 2938587 - RNA, 14 nt, Mycobacterium avium subsp. paratuberculosis
cggcccgcuggccg

SEQ ID NO: 2938588 - RNA, 18 nt, Mycobacterium avium subsp. paratuberculosis
cggcccgcuggccgccgc

SEQ ID NO: 2938589 - RNA, 18 nt, Mycobacterium avium subsp. paratuberculosis
cggcccgcuucaggcagc

SEQ ID NO: 2938590 - RNA, 22 nt, Mycobacterium avium subsp. paratuberculosis
cggcccgcuucaggcagcgcac

SEQ ID NO: 2938591 - RNA, 24 nt, Mycobacterium avium subsp. paratuberculosis
cggcccgcuucaggcagcgcacga

SEQ ID NO: 2938592 - RNA, 20 nt, Mycobacterium avium subsp. paratuberculosis
cggcccggaacgcgucgccc

SEQ ID NO: 2938593 - RNA, 21 nt, Mycobacterium avium subsp. paratuberculosis
cggcccggaacgcgucgccca

SEQ ID NO: 2938594 - RNA, 23 nt, Mycobacterium avium subsp. paratuberculosis
cggcccggaacgcgucgcccacg

SEQ ID NO: 2938595 - RNA, 22 nt, Mycobacterium avium subsp. paratuberculosis
cggcccggacggagccgugccc

SEQ ID NO: 2938596 - RNA, 17 nt, Mycobacterium avium subsp. paratuberculosis
cggcccggcacuggcga

SEQ ID NO: 2938597 - RNA, 18 nt, Mycobacterium avium subsp. paratuberculosis
cggcccggcacuggcgaa

SEQ ID NO: 2938598 - RNA, 16 nt, Mycobacterium avium subsp. paratuberculosis
cggcccggccaacggg

SEQ ID NO: 2938599 - RNA, 14 nt, Mycobacterium avium subsp. paratuberculosis
cggcccggccacca

SEQ ID NO: 2938600 - RNA, 15 nt, Mycobacterium avium subsp. paratuberculosis
cggcccggccaccag

SEQ ID NO: 2938601 - RNA, 15 nt, Mycobacterium avium subsp. paratuberculosis
cggcccggccacucg

SEQ ID NO: 2938602 - RNA, 21 nt, Mycobacterium avium subsp. paratuberculosis
cggcccggccacucgccgcga

SEQ ID NO: 2938603 - RNA, 17 nt, Mycobacterium avium subsp. paratuberculosis
cggcccggcccgacgga

SEQ ID NO: 2938604 - RNA, 14 nt, Mycobacterium avium subsp. paratuberculosis
cggcccggcccgcu

SEQ ID NO: 2938605 - RNA, 15 nt, Mycobacterium avium subsp. paratuberculosis
cggcccggcccgcug

SEQ ID NO: 2938606 - RNA, 17 nt, Mycobacterium avium subsp. paratuberculosis
cggcccggcccgcuggc

SEQ ID NO: 2938607 - RNA, 15 nt, Mycobacterium avium subsp. paratuberculosis
cggcccggccggcgc

SEQ ID NO: 2938608 - RNA, 21 nt, Mycobacterium avium subsp. paratuberculosis
cggcccggcgaaucagcagcu

SEQ ID NO: 2938609 - RNA, 14 nt, Mycobacterium avium subsp. paratuberculosis
cggcccggcgaugc

SEQ ID NO: 2938610 - RNA, 16 nt, Mycobacterium avium subsp. paratuberculosis
cggcccggcgaugccg

SEQ ID NO: 2938611 - RNA, 15 nt, Mycobacterium avium subsp. paratuberculosis
cggcccggcgcggcc

SEQ ID NO: 2938612 - RNA, 16 nt, Mycobacterium avium subsp. paratuberculosis
cggcccggcgcggccg

SEQ ID NO: 2938613 - RNA, 17 nt, Mycobacterium avium subsp. paratuberculosis
cggcccggcgcggccgg

SEQ ID NO: 2938614 - RNA, 13 nt, Mycobacterium avium subsp. paratuberculosis
cggcccggcggcc

SEQ ID NO: 2938615 - RNA, 14 nt, Mycobacterium avium subsp. paratuberculosis
cggcccggcggccg

SEQ ID NO: 2938616 - RNA, 15 nt, Mycobacterium avium subsp. paratuberculosis
cggcccggcggccgg

SEQ ID NO: 2938617 - RNA, 18 nt, Mycobacterium avium subsp. paratuberculosis
cggcccggcggccggccg

SEQ ID NO: 2938618 - RNA, 19 nt, Mycobacterium avium subsp. paratuberculosis
cggcccggcggccggccgc

SEQ ID NO: 2938619 - RNA, 13 nt, Mycobacterium avium subsp. paratuberculosis
cggcccggcgggc

SEQ ID NO: 2938620 - RNA, 14 nt, Mycobacterium avium subsp. paratuberculosis
cggcccggcguccg

SEQ ID NO: 2938621 - RNA, 16 nt, Mycobacterium avium subsp. paratuberculosis
cggcccggcguccgcg

SEQ ID NO: 2938622 - RNA, 19 nt, Mycobacterium avium subsp. paratuberculosis
cggcccggcguccgcgaac

SEQ ID NO: 2938623 - RNA, 13 nt, Mycobacterium avium subsp. paratuberculosis
cggcccggcgucg

SEQ ID NO: 2938624 - RNA, 13 nt, Mycobacterium avium subsp. paratuberculosis
cggcccggcucgg

SEQ ID NO: 2938625 - RNA, 20 nt, Mycobacterium avium subsp. paratuberculosis
cggcccgggcgauucgucgu

SEQ ID NO: 2938626 - RNA, 22 nt, Mycobacterium avium subsp. paratuberculosis
cggcccgggcgauucgucgucg

SEQ ID NO: 2938627 - RNA, 15 nt, Mycobacterium avium subsp. paratuberculosis
cggcccggggacacc

SEQ ID NO: 2938628 - RNA, 20 nt, Mycobacterium avium subsp. paratuberculosis
cggcccggggacacccucgg

SEQ ID NO: 2938629 - RNA, 21 nt, Mycobacterium avium subsp. paratuberculosis
cggcccggggugugcccgaac

SEQ ID NO: 2938630 - RNA, 16 nt, Mycobacterium avium subsp. paratuberculosis
cggcccgguacaucga

SEQ ID NO: 2938631 - RNA, 18 nt, Mycobacterium avium subsp. paratuberculosis
cggcccgguacaucgacg

SEQ ID NO: 2938632 - RNA, 14 nt, Mycobacterium avium subsp. paratuberculosis
cggcccggucgacu

SEQ ID NO: 2938633 - RNA, 18 nt, Mycobacterium avium subsp. paratuberculosis
cggcccggucuugccggc

SEQ ID NO: 2938634 - RNA, 16 nt, Mycobacterium avium subsp. paratuberculosis
cggcccguccgccccg

SEQ ID NO: 2938635 - RNA, 17 nt, Mycobacterium avium subsp. paratuberculosis
cggcccguccgccccgc

SEQ ID NO: 2938636 - RNA, 18 nt, Mycobacterium avium subsp. paratuberculosis
cggcccguccgccccgcu

SEQ ID NO: 2938637 - RNA, 23 nt, Mycobacterium avium subsp. paratuberculosis
cggcccguccgccccgcugccgg

SEQ ID NO: 2938638 - RNA, 12 nt, Mycobacterium avium subsp. paratuberculosis
cggcccgucgag

SEQ ID NO: 2938639 - RNA, 13 nt, Mycobacterium avium subsp. paratuberculosis
cggcccgucgagc

SEQ ID NO: 2938640 - RNA, 16 nt, Mycobacterium avium subsp. paratuberculosis
cggcccgucgagcggc

SEQ ID NO: 2938641 - RNA, 15 nt, Mycobacterium avium subsp. paratuberculosis
cggcccgucgccacc

SEQ ID NO: 2938642 - RNA, 18 nt, Mycobacterium avium subsp. paratuberculosis
cggcccgucgccaccacg

SEQ ID NO: 2938643 - RNA, 21 nt, Mycobacterium avium subsp. paratuberculosis
cggcccgucgccaccacggcg

SEQ ID NO: 2938644 - RNA, 22 nt, Mycobacterium avium subsp. paratuberculosis
cggcccgucgccaccacggcgc

SEQ ID NO: 2938645 - RNA, 13 nt, Mycobacterium avium subsp. paratuberculosis
cggcccgucgccg

SEQ ID NO: 2938646 - RNA, 14 nt, Mycobacterium avium subsp. paratuberculosis
cggcccgucgccga

SEQ ID NO: 2938647 - RNA, 16 nt, Mycobacterium avium subsp. paratuberculosis
cggcccgucgccgugc

SEQ ID NO: 2938648 - RNA, 17 nt, Mycobacterium avium subsp. paratuberculosis
cggcccgucgccgugcg

SEQ ID NO: 2938649 - RNA, 13 nt, Mycobacterium avium subsp. paratuberculosis
cggcccgugcaug

SEQ ID NO: 2938650 - RNA, 18 nt, Mycobacterium avium subsp. paratuberculosis
cggcccuauggcaucgcc

SEQ ID NO: 2938651 - RNA, 21 nt, Mycobacterium avium subsp. paratuberculosis
cggcccuauggcaucgccaag

SEQ ID NO: 2938652 - RNA, 23 nt, Mycobacterium avium subsp. paratuberculosis
cggcccucagguggacagaugcc

SEQ ID NO: 2938653 - RNA, 15 nt, Mycobacterium avium subsp. paratuberculosis
cggcccuccagcacc

SEQ ID NO: 2938654 - RNA, 13 nt, Mycobacterium avium subsp. paratuberculosis
cggcccugcagcg

SEQ ID NO: 2938655 - RNA, 16 nt, Mycobacterium avium subsp. paratuberculosis
cggcccugcagcgccu

SEQ ID NO: 2938656 - RNA, 21 nt, Mycobacterium avium subsp. paratuberculosis
cggcccugcaggucgcggugg

SEQ ID NO: 2938657 - RNA, 21 nt, Mycobacterium avium subsp. paratuberculosis
cggcccugcgcggccugcagc

SEQ ID NO: 2938658 - RNA, 22 nt, Mycobacterium avium subsp. paratuberculosis
cggcccugcgcggccugcagca

SEQ ID NO: 2938659 - RNA, 14 nt, Mycobacterium avium subsp. paratuberculosis
cggcccugcggcca

SEQ ID NO: 2938660 - RNA, 19 nt, Mycobacterium avium subsp. paratuberculosis
cggcccugcggccagugcc

SEQ ID NO: 2938661 - RNA, 22 nt, Mycobacterium avium subsp. paratuberculosis
cggcccugcggccagugccggg

SEQ ID NO: 2938662 - RNA, 16 nt, Mycobacterium avium subsp. paratuberculosis
cggcccuggaugucac

SEQ ID NO: 2938663 - RNA, 17 nt, Mycobacterium avium subsp. paratuberculosis
cggcccuggaugucacg

SEQ ID NO: 2938664 - RNA, 19 nt, Mycobacterium avium subsp. paratuberculosis
cggcccuggaugucacggu

SEQ ID NO: 2938665 - RNA, 17 nt, Mycobacterium avium subsp. paratuberculosis
cggcccuggcgggcggc

SEQ ID NO: 2938666 - RNA, 21 nt, Mycobacterium avium subsp. paratuberculosis
cggcccuggcgggcggcccgc

SEQ ID NO: 2938667 - RNA, 17 nt, Mycobacterium avium subsp. paratuberculosis
cggcccuggucggccag

SEQ ID NO: 2938668 - RNA, 13 nt, Mycobacterium avium subsp. paratuberculosis
cggcccugguuga

SEQ ID NO: 2938669 - RNA, 20 nt, Mycobacterium avium subsp. paratuberculosis
cggcccugguugagcaccgc

SEQ ID NO: 2938670 - RNA, 22 nt, Mycobacterium avium subsp. paratuberculosis
cggcccugguugagcaccgcga

SEQ ID NO: 2938671 - RNA, 17 nt, Mycobacterium avium subsp. paratuberculosis
cggcccuguucgccguc

SEQ ID NO: 2938672 - RNA, 15 nt, Mycobacterium avium subsp. paratuberculosis
cggccgcaccccacc

SEQ ID NO: 2938673 - RNA, 19 nt, Mycobacterium avium subsp. paratuberculosis
cggccgcaccccacccgcg

SEQ ID NO: 2938674 - RNA, 20 nt, Mycobacterium avium subsp. paratuberculosis
cggccgcaccccacccgcgc

SEQ ID NO: 2938675 - RNA, 15 nt, Mycobacterium avium subsp. paratuberculosis
cggccgcacgcgaac

SEQ ID NO: 2938676 - RNA, 18 nt, Mycobacterium avium subsp. paratuberculosis
cggccgcacgcgaacacc

SEQ ID NO: 2938677 - RNA, 22 nt, Mycobacterium avium subsp. paratuberculosis
cggccgcacguauccgcggucg

SEQ ID NO: 2938678 - RNA, 23 nt, Mycobacterium avium subsp. paratuberculosis
cggccgcacguauccgcggucga

SEQ ID NO: 2938679 - RNA, 13 nt, Mycobacterium avium subsp. paratuberculosis
cggccgcacgucc

SEQ ID NO: 2938680 - RNA, 15 nt, Mycobacterium avium subsp. paratuberculosis
cggccgcacgucccg

SEQ ID NO: 2938681 - RNA, 17 nt, Mycobacterium avium subsp. paratuberculosis
cggccgcacgucccgcc

SEQ ID NO: 2938682 - RNA, 21 nt, Mycobacterium avium subsp. paratuberculosis
cggccgcacgucccgcccggc

SEQ ID NO: 2938683 - RNA, 22 nt, Mycobacterium avium subsp. paratuberculosis
cggccgcacgucccgcccggcg

SEQ ID NO: 2938684 - RNA, 14 nt, Mycobacterium avium subsp. paratuberculosis
cggccgcagcgacu

SEQ ID NO: 2938685 - RNA, 13 nt, Mycobacterium avium subsp. paratuberculosis
cggccgcagcgca

SEQ ID NO: 2938686 - RNA, 21 nt, Mycobacterium avium subsp. paratuberculosis
cggccgcagcgcaucgccggc

SEQ ID NO: 2938687 - RNA, 13 nt, Mycobacterium avium subsp. paratuberculosis
cggccgcagcgcc

SEQ ID NO: 2938688 - RNA, 19 nt, Mycobacterium avium subsp. paratuberculosis
cggccgcagcgcccggcag

SEQ ID NO: 2938689 - RNA, 21 nt, Mycobacterium avium subsp. paratuberculosis
cggccgcagcgcccggcagcg

SEQ ID NO: 2938690 - RNA, 14 nt, Mycobacterium avium subsp. paratuberculosis
cggccgcagcgcga

SEQ ID NO: 2938691 - RNA, 16 nt, Mycobacterium avium subsp. paratuberculosis
cggccgcagcgcgacg

SEQ ID NO: 2938692 - RNA, 14 nt, Mycobacterium avium subsp. paratuberculosis
cggccgcagcggca

SEQ ID NO: 2938693 - RNA, 20 nt, Mycobacterium avium subsp. paratuberculosis
cggccgcagcgugggcaccg

SEQ ID NO: 2938694 - RNA, 14 nt, Mycobacterium avium subsp. paratuberculosis
cggccgcaucguug

SEQ ID NO: 2938695 - RNA, 19 nt, Mycobacterium avium subsp. paratuberculosis
cggccgcaugucgaccucg

SEQ ID NO: 2938696 - RNA, 21 nt, Mycobacterium avium subsp. paratuberculosis
cggccgcaugucgaccucggc

SEQ ID NO: 2938697 - RNA, 16 nt, Mycobacterium avium subsp. paratuberculosis
cggccgcauuuggcgu

SEQ ID NO: 2938698 - RNA, 19 nt, Mycobacterium avium subsp. paratuberculosis
cggccgccaaaucgaucac

SEQ ID NO: 2938699 - RNA, 14 nt, Mycobacterium avium subsp. paratuberculosis
cggccgccaccgag

SEQ ID NO: 2938700 - RNA, 13 nt, Mycobacterium avium subsp. paratuberculosis
cggccgccaccgc

SEQ ID NO: 2938701 - RNA, 14 nt, Mycobacterium avium subsp. paratuberculosis
cggccgccaccgcc

SEQ ID NO: 2938702 - RNA, 20 nt, Mycobacterium avium subsp. paratuberculosis
cggccgccaccgccaucucg

SEQ ID NO: 2938703 - RNA, 15 nt, Mycobacterium avium subsp. paratuberculosis
cggccgccacgcugg

SEQ ID NO: 2938704 - RNA, 13 nt, Mycobacterium avium subsp. paratuberculosis
cggccgccagcag

SEQ ID NO: 2938705 - RNA, 12 nt, Mycobacterium avium subsp. paratuberculosis
cggccgccagcg

SEQ ID NO: 2938706 - RNA, 13 nt, Mycobacterium avium subsp. paratuberculosis
cggccgccagcgc

SEQ ID NO: 2938707 - RNA, 14 nt, Mycobacterium avium subsp. paratuberculosis
cggccgccagcgca

SEQ ID NO: 2938708 - RNA, 16 nt, Mycobacterium avium subsp. paratuberculosis
cggccgccagcgcacc

SEQ ID NO: 2938709 - RNA, 19 nt, Mycobacterium avium subsp. paratuberculosis
cggccgccagcgcaccgag

SEQ ID NO: 2938710 - RNA, 20 nt, Mycobacterium avium subsp. paratuberculosis
cggccgccagcgcaccgagc

SEQ ID NO: 2938711 - RNA, 14 nt, Mycobacterium avium subsp. paratuberculosis
cggccgccagcgcc

SEQ ID NO: 2938712 - RNA, 15 nt, Mycobacterium avium subsp. paratuberculosis
cggccgccagcgccc

SEQ ID NO: 2938713 - RNA, 17 nt, Mycobacterium avium subsp. paratuberculosis
cggccgccagcgcccgc

SEQ ID NO: 2938714 - RNA, 21 nt, Mycobacterium avium subsp. paratuberculosis
cggccgccagcgcccgcgcgu

SEQ ID NO: 2938715 - RNA, 22 nt, Mycobacterium avium subsp. paratuberculosis
cggccgccagcgcccgcgcgug

SEQ ID NO: 2938716 - RNA, 14 nt, Mycobacterium avium subsp. paratuberculosis
cggccgccagcguc

SEQ ID NO: 2938717 - RNA, 20 nt, Mycobacterium avium subsp. paratuberculosis
cggccgccaggucggggccc

SEQ ID NO: 2938718 - RNA, 14 nt, Mycobacterium avium subsp. paratuberculosis
cggccgcccagccc

SEQ ID NO: 2938719 - RNA, 15 nt, Mycobacterium avium subsp. paratuberculosis
cggccgcccagcccg

SEQ ID NO: 2938720 - RNA, 16 nt, Mycobacterium avium subsp. paratuberculosis
cggccgcccagcccgc

SEQ ID NO: 2938721 - RNA, 18 nt, Mycobacterium avium subsp. paratuberculosis
cggccgcccagcccgcgc

SEQ ID NO: 2938722 - RNA, 21 nt, Mycobacterium avium subsp. paratuberculosis
cggccgcccagcccgcgccga

SEQ ID NO: 2938723 - RNA, 22 nt, Mycobacterium avium subsp. paratuberculosis
cggccgcccagcccgcgccgag

SEQ ID NO: 2938724 - RNA, 23 nt, Mycobacterium avium subsp. paratuberculosis
cggccgcccagcccgcgccgagc

SEQ ID NO: 2938725 - RNA, 16 nt, Mycobacterium avium subsp. paratuberculosis
cggccgcccagucgcc

SEQ ID NO: 2938726 - RNA, 18 nt, Mycobacterium avium subsp. paratuberculosis
cggccgcccagucgccgc

SEQ ID NO: 2938727 - RNA, 20 nt, Mycobacterium avium subsp. paratuberculosis
cggccgcccagucgccgccg

SEQ ID NO: 2938728 - RNA, 19 nt, Mycobacterium avium subsp. paratuberculosis
cggccgcccgcaccagcag

SEQ ID NO: 2938729 - RNA, 20 nt, Mycobacterium avium subsp. paratuberculosis
cggccgcccgcaccagcagg

SEQ ID NO: 2938730 - RNA, 12 nt, Mycobacterium avium subsp. paratuberculosis
cggccgcccggc

SEQ ID NO: 2938731 - RNA, 15 nt, Mycobacterium avium subsp. paratuberculosis
cggccgcccggcgag

SEQ ID NO: 2938732 - RNA, 14 nt, Mycobacterium avium subsp. paratuberculosis
cggccgcccgggcg

SEQ ID NO: 2938733 - RNA, 15 nt, Mycobacterium avium subsp. paratuberculosis
cggccgcccgggcgg

SEQ ID NO: 2938734 - RNA, 23 nt, Mycobacterium avium subsp. paratuberculosis
cggccgcccgggcggcccgcauc

SEQ ID NO: 2938735 - RNA, 21 nt, Mycobacterium avium subsp. paratuberculosis
cggccgcccgguccgggucgc

SEQ ID NO: 2938736 - RNA, 16 nt, Mycobacterium avium subsp. paratuberculosis
cggccgcccguccggg

SEQ ID NO: 2938737 - RNA, 17 nt, Mycobacterium avium subsp. paratuberculosis
cggccgcccguccgggc

SEQ ID NO: 2938738 - RNA, 19 nt, Mycobacterium avium subsp. paratuberculosis
cggccgcccguccgggccg

SEQ ID NO: 2938739 - RNA, 22 nt, Mycobacterium avium subsp. paratuberculosis
cggccgcccgucggggcccggc

SEQ ID NO: 2938740 - RNA, 16 nt, Mycobacterium avium subsp. paratuberculosis
cggccgccgaagccgg

SEQ ID NO: 2938741 - RNA, 19 nt, Mycobacterium avium subsp. paratuberculosis
cggccgccgaagccggcuc

SEQ ID NO: 2938742 - RNA, 20 nt, Mycobacterium avium subsp. paratuberculosis
cggccgccgaagccggcucg

SEQ ID NO: 2938743 - RNA, 21 nt, Mycobacterium avium subsp. paratuberculosis
cggccgccgacaccaccacga

SEQ ID NO: 2938744 - RNA, 12 nt, Mycobacterium avium subsp. paratuberculosis
cggccgccgacu

SEQ ID NO: 2938745 - RNA, 15 nt, Mycobacterium avium subsp. paratuberculosis
cggccgccgaggcga

SEQ ID NO: 2938746 - RNA, 17 nt, Mycobacterium avium subsp. paratuberculosis
cggccgccgaggcgaug

SEQ ID NO: 2938747 - RNA, 20 nt, Mycobacterium avium subsp. paratuberculosis
cggccgccgaggcgaugccg

SEQ ID NO: 2938748 - RNA, 14 nt, Mycobacterium avium subsp. paratuberculosis
cggccgccgaucaa

SEQ ID NO: 2938749 - RNA, 22 nt, Mycobacterium avium subsp. paratuberculosis
cggccgccgaucaacaggccca

SEQ ID NO: 2938750 - RNA, 23 nt, Mycobacterium avium subsp. paratuberculosis
cggccgccgauucaaccccgcgc

SEQ ID NO: 2938751 - RNA, 19 nt, Mycobacterium avium subsp. paratuberculosis
cggccgccgauuccggccg

SEQ ID NO: 2938752 - RNA, 20 nt, Mycobacterium avium subsp. paratuberculosis
cggccgccgauuccggccgg

SEQ ID NO: 2938753 - RNA, 14 nt, Mycobacterium avium subsp. paratuberculosis
cggccgccgcccgc

SEQ ID NO: 2938754 - RNA, 18 nt, Mycobacterium avium subsp. paratuberculosis
cggccgccgcccgcgcgg

SEQ ID NO: 2938755 - RNA, 13 nt, Mycobacterium avium subsp. paratuberculosis
cggccgccgccgc

SEQ ID NO: 2938756 - RNA, 21 nt, Mycobacterium avium subsp. paratuberculosis
cggccgccgccgcggccgcgg

SEQ ID NO: 2938757 - RNA, 18 nt, Mycobacterium avium subsp. paratuberculosis
cggccgcggacccgacgg

SEQ ID NO: 2938758 - RNA, 15 nt, Mycobacterium avium subsp. paratuberculosis
cggccgcggaugacc

SEQ ID NO: 2938759 - RNA, 15 nt, Mycobacterium avium subsp. paratuberculosis
cggccgcggauggug

SEQ ID NO: 2938760 - RNA, 22 nt, Mycobacterium avium subsp. paratuberculosis
cggccgcggauggugacggccg

SEQ ID NO: 2938761 - RNA, 20 nt, Mycobacterium avium subsp. paratuberculosis
cggccgcggauuccggcauc

SEQ ID NO: 2938762 - RNA, 14 nt, Mycobacterium avium subsp. paratuberculosis
cggccgcggccagc

SEQ ID NO: 2938763 - RNA, 21 nt, Mycobacterium avium subsp. paratuberculosis
cggccgcggccagcgaggugg

SEQ ID NO: 2938764 - RNA, 15 nt, Mycobacterium avium subsp. paratuberculosis
cggccgcggcccggc

SEQ ID NO: 2938765 - RNA, 19 nt, Mycobacterium avium subsp. paratuberculosis
cggccgcggcccggccacc

SEQ ID NO: 2938766 - RNA, 20 nt, Mycobacterium avium subsp. paratuberculosis
cggccgcggcccggccacca

SEQ ID NO: 2938767 - RNA, 12 nt, Mycobacterium avium subsp. paratuberculosis
cggccgcggccg

SEQ ID NO: 2938768 - RNA, 15 nt, Mycobacterium avium subsp. paratuberculosis
cggccgcggccggcg

SEQ ID NO: 2938769 - RNA, 17 nt, Mycobacterium avium subsp. paratuberculosis
cggccgcggccggcggc

SEQ ID NO: 2938770 - RNA, 12 nt, Mycobacterium avium subsp. paratuberculosis
cggccgcggcgc

SEQ ID NO: 2938771 - RNA, 13 nt, Mycobacterium avium subsp. paratuberculosis
cggccgcggcgcg

SEQ ID NO: 2938772 - RNA, 14 nt, Mycobacterium avium subsp. paratuberculosis
cggccgcggcgcgc

SEQ ID NO: 2938773 - RNA, 17 nt, Mycobacterium avium subsp. paratuberculosis
cggccgcggcgcgcauc

SEQ ID NO: 2938774 - RNA, 15 nt, Mycobacterium avium subsp. paratuberculosis
cggccgcggcgcggc

SEQ ID NO: 2938775 - RNA, 16 nt, Mycobacterium avium subsp. paratuberculosis
cggccgcggcgcggcc

SEQ ID NO: 2938776 - RNA, 17 nt, Mycobacterium avium subsp. paratuberculosis
cggccgcggcgcggccc

SEQ ID NO: 2938777 - RNA, 18 nt, Mycobacterium avium subsp. paratuberculosis
cggccgcggcgcggcccg

SEQ ID NO: 2938778 - RNA, 23 nt, Mycobacterium avium subsp. paratuberculosis
cggccgcggcgcggcccggcccg

SEQ ID NO: 2938779 - RNA, 13 nt, Mycobacterium avium subsp. paratuberculosis
cggccgcggcggg

SEQ ID NO: 2938780 - RNA, 16 nt, Mycobacterium avium subsp. paratuberculosis
cggccgcggcgggcgc

SEQ ID NO: 2938781 - RNA, 22 nt, Mycobacterium avium subsp. paratuberculosis
cggccgcggcgggcgcgucgag

SEQ ID NO: 2938782 - RNA, 20 nt, Mycobacterium avium subsp. paratuberculosis
cggccgcggcggugccggug

SEQ ID NO: 2938783 - RNA, 12 nt, Mycobacterium avium subsp. paratuberculosis
cggccgcggcgu

SEQ ID NO: 2938784 - RNA, 15 nt, Mycobacterium avium subsp. paratuberculosis
cggccgcggcgugca

SEQ ID NO: 2938785 - RNA, 23 nt, Mycobacterium avium subsp. paratuberculosis
cggccgcggcgugcaacugcgug

SEQ ID NO: 2938786 - RNA, 14 nt, Mycobacterium avium subsp. paratuberculosis
cggccgcggggccg

SEQ ID NO: 2938787 - RNA, 19 nt, Mycobacterium avium subsp. paratuberculosis
cggccgcggggccggcgcu

SEQ ID NO: 2938788 - RNA, 23 nt, Mycobacterium avium subsp. paratuberculosis
cggccgcggggccggcgcuggcg

SEQ ID NO: 2938789 - RNA, 20 nt, Mycobacterium avium subsp. paratuberculosis
cggccgcggucucgaccgac

SEQ ID NO: 2938790 - RNA, 22 nt, Mycobacterium avium subsp. paratuberculosis
cggccgcggugaccgcgccgcg

SEQ ID NO: 2938791 - RNA, 19 nt, Mycobacterium avium subsp. paratuberculosis
cggccgcggugugcccggc

SEQ ID NO: 2938792 - RNA, 20 nt, Mycobacterium avium subsp. paratuberculosis
cggccgcggugugcccggcg

SEQ ID NO: 2938793 - RNA, 22 nt, Mycobacterium avium subsp. paratuberculosis
cggccgcggugugcccggcguu

SEQ ID NO: 2938794 - RNA, 19 nt, Mycobacterium avium subsp. paratuberculosis
cggccgcguacuucgcgcc

SEQ ID NO: 2938795 - RNA, 21 nt, Mycobacterium avium subsp. paratuberculosis
cggccgcguccucgccguacg

SEQ ID NO: 2938796 - RNA, 12 nt, Mycobacterium avium subsp. paratuberculosis
cggccgcgucgc

SEQ ID NO: 2938797 - RNA, 15 nt, Mycobacterium avium subsp. paratuberculosis
cggccgcgucgccga

SEQ ID NO: 2938798 - RNA, 17 nt, Mycobacterium avium subsp. paratuberculosis
cggccgcgucgccgauc

SEQ ID NO: 2938799 - RNA, 18 nt, Mycobacterium avium subsp. paratuberculosis
cggccgcgucgccgaucg

SEQ ID NO: 2938800 - RNA, 14 nt, Mycobacterium avium subsp. paratuberculosis
cggccgcgucggcg

SEQ ID NO: 2938801 - RNA, 15 nt, Mycobacterium avium subsp. paratuberculosis
cggccgcgucggcgg

SEQ ID NO: 2938802 - RNA, 19 nt, Mycobacterium avium subsp. paratuberculosis
cggccgcgucggcggcggc

SEQ ID NO: 2938803 - RNA, 19 nt, Mycobacterium avium subsp. paratuberculosis
cggccgcgucggcggucgc

SEQ ID NO: 2938804 - RNA, 22 nt, Mycobacterium avium subsp. paratuberculosis
cggccgcgucggcggucgccag

SEQ ID NO: 2938805 - RNA, 23 nt, Mycobacterium avium subsp. paratuberculosis
cggccgcgucggcggucgccagc

SEQ ID NO: 2938806 - RNA, 13 nt, Mycobacterium avium subsp. paratuberculosis
cggccgcgucggg

SEQ ID NO: 2938807 - RNA, 14 nt, Mycobacterium avium subsp. paratuberculosis
cggccgcgucgggc

SEQ ID NO: 2938808 - RNA, 16 nt, Mycobacterium avium subsp. paratuberculosis
cggccgcgugcaccug

SEQ ID NO: 2938809 - RNA, 18 nt, Mycobacterium avium subsp. paratuberculosis
cggccgcguugucgacca

SEQ ID NO: 2938810 - RNA, 22 nt, Mycobacterium avium subsp. paratuberculosis
cggccgcguugucgaccaccag

SEQ ID NO: 2938811 - RNA, 17 nt, Mycobacterium avium subsp. paratuberculosis
cggccgcuacccggcga

SEQ ID NO: 2938812 - RNA, 18 nt, Mycobacterium avium subsp. paratuberculosis
cggccgcucagcgggcgg

SEQ ID NO: 2938813 - RNA, 20 nt, Mycobacterium avium subsp. paratuberculosis
cggccgcucagcgggcggcc

SEQ ID NO: 2938814 - RNA, 21 nt, Mycobacterium avium subsp. paratuberculosis
cggccgcucagcgggcggcca

SEQ ID NO: 2938815 - RNA, 20 nt, Mycobacterium avium subsp. paratuberculosis
cggccgcucgggugucgccg

SEQ ID NO: 2938816 - RNA, 16 nt, Mycobacterium avium subsp. paratuberculosis
cggccgcugaggaugg

SEQ ID NO: 2938817 - RNA, 14 nt, Mycobacterium avium subsp. paratuberculosis
cggccgcugcccgg

SEQ ID NO: 2938818 - RNA, 15 nt, Mycobacterium avium subsp. paratuberculosis
cggccgcugcccggg

SEQ ID NO: 2938819 - RNA, 15 nt, Mycobacterium avium subsp. paratuberculosis
cggccgcugcgccca

SEQ ID NO: 2938820 - RNA, 17 nt, Mycobacterium avium subsp. paratuberculosis
cggccgcugcgcccagc

SEQ ID NO: 2938821 - RNA, 21 nt, Mycobacterium avium subsp. paratuberculosis
cggccgcugcgcccagcgcgc

SEQ ID NO: 2938822 - RNA, 20 nt, Mycobacterium avium subsp. paratuberculosis
cggccgcugcgggcgggccg

SEQ ID NO: 2938823 - RNA, 14 nt, Mycobacterium avium subsp. paratuberculosis
cggccgcuggcguu

SEQ ID NO: 2938824 - RNA, 17 nt, Mycobacterium avium subsp. paratuberculosis
cggccgcuucccacccg

SEQ ID NO: 2938825 - RNA, 18 nt, Mycobacterium avium subsp. paratuberculosis
cggccgcuucccacccgg

SEQ ID NO: 2938826 - RNA, 23 nt, Mycobacterium avium subsp. paratuberculosis
cggccgcuugccaugucgaaggu

SEQ ID NO: 2938827 - RNA, 14 nt, Mycobacterium avium subsp. paratuberculosis
cggccggaagguca

SEQ ID NO: 2938828 - RNA, 19 nt, Mycobacterium avium subsp. paratuberculosis
cggccggacaccgaaccgc

SEQ ID NO: 2938829 - RNA, 16 nt, Mycobacterium avium subsp. paratuberculosis
cggccggagaccgccg

SEQ ID NO: 2938830 - RNA, 15 nt, Mycobacterium avium subsp. paratuberculosis
cggccggagccgacc

SEQ ID NO: 2938831 - RNA, 19 nt, Mycobacterium avium subsp. paratuberculosis
cggccggagccgaccucgg

SEQ ID NO: 2938832 - RNA, 13 nt, Mycobacterium avium subsp. paratuberculosis
cggccggagcgga

SEQ ID NO: 2938833 - RNA, 16 nt, Mycobacterium avium subsp. paratuberculosis
cggccggagcggaugg

SEQ ID NO: 2938834 - RNA, 23 nt, Mycobacterium avium subsp. paratuberculosis
cggccggagcggauggcgccguc

SEQ ID NO: 2938835 - RNA, 16 nt, Mycobacterium avium subsp. paratuberculosis
cggccggaucgaaaag

SEQ ID NO: 2938836 - RNA, 23 nt, Mycobacterium avium subsp. paratuberculosis
cggccggaucgaauccggcggcg

SEQ ID NO: 2938837 - RNA, 19 nt, Mycobacterium avium subsp. paratuberculosis
cggccggauggccagcagg

SEQ ID NO: 2938838 - RNA, 21 nt, Mycobacterium avium subsp. paratuberculosis
cggccggauggccagcaggua

SEQ ID NO: 2938839 - RNA, 21 nt, Mycobacterium avium subsp. paratuberculosis
cggccggauguuguccggaac

SEQ ID NO: 2938840 - RNA, 20 nt, Mycobacterium avium subsp. paratuberculosis
cggccggauucucgcccggc

SEQ ID NO: 2938841 - RNA, 11 nt, Mycobacterium avium subsp. paratuberculosis
cggccggcgga

SEQ ID NO: 2938842 - RNA, 19 nt, Mycobacterium avium subsp. paratuberculosis
cggccggcggacgcggcca

SEQ ID NO: 2938843 - RNA, 11 nt, Mycobacterium avium subsp. paratuberculosis
cggccggcggc

SEQ ID NO: 2938844 - RNA, 23 nt, Mycobacterium avium subsp. paratuberculosis
cggccggcggcagugcgccgucc

SEQ ID NO: 2938845 - RNA, 13 nt, Mycobacterium avium subsp. paratuberculosis
cggccggcggcgu

SEQ ID NO: 2938846 - RNA, 15 nt, Mycobacterium avium subsp. paratuberculosis
cggccggcggcgucg

SEQ ID NO: 2938847 - RNA, 18 nt, Mycobacterium avium subsp. paratuberculosis
cggccggcggcgucguga

SEQ ID NO: 2938848 - RNA, 15 nt, Mycobacterium avium subsp. paratuberculosis
cggccggcgggcagc

SEQ ID NO: 2938849 - RNA, 22 nt, Mycobacterium avium subsp. paratuberculosis
cggccggcggggcgggggcguu

SEQ ID NO: 2938850 - RNA, 23 nt, Mycobacterium avium subsp. paratuberculosis
cggccggcggggcgggggcguug

SEQ ID NO: 2938851 - RNA, 16 nt, Mycobacterium avium subsp. paratuberculosis
cggccggcggguucug

SEQ ID NO: 2938852 - RNA, 12 nt, Mycobacterium avium subsp. paratuberculosis
cggccggcgguc

SEQ ID NO: 2938853 - RNA, 13 nt, Mycobacterium avium subsp. paratuberculosis
cggccggcgguca

SEQ ID NO: 2938854 - RNA, 13 nt, Mycobacterium avium subsp. paratuberculosis
cggccggcggugu

SEQ ID NO: 2938855 - RNA, 14 nt, Mycobacterium avium subsp. paratuberculosis
cggccggcgguguc

SEQ ID NO: 2938856 - RNA, 16 nt, Mycobacterium avium subsp. paratuberculosis
cggccggcggugucgu

SEQ ID NO: 2938857 - RNA, 15 nt, Mycobacterium avium subsp. paratuberculosis
cggccggcgucacuc

SEQ ID NO: 2938858 - RNA, 13 nt, Mycobacterium avium subsp. paratuberculosis
cggccggcguugu

SEQ ID NO: 2938859 - RNA, 19 nt, Mycobacterium avium subsp. paratuberculosis
cggccggcugcagccgggc

SEQ ID NO: 2938860 - RNA, 20 nt, Mycobacterium avium subsp. paratuberculosis
cggccggcugcagccgggcg

SEQ ID NO: 2938861 - RNA, 18 nt, Mycobacterium avium subsp. paratuberculosis
cggccgggaaacccucga

SEQ ID NO: 2938862 - RNA, 17 nt, Mycobacterium avium subsp. paratuberculosis
cggccgggacgcggucc

SEQ ID NO: 2938863 - RNA, 14 nt, Mycobacterium avium subsp. paratuberculosis
cggccgggacgggu

SEQ ID NO: 2938864 - RNA, 23 nt, Mycobacterium avium subsp. paratuberculosis
cggccgggaucuggccggugagc

SEQ ID NO: 2938865 - RNA, 16 nt, Mycobacterium avium subsp. paratuberculosis
cggccgggaugccgcc

SEQ ID NO: 2938866 - RNA, 18 nt, Mycobacterium avium subsp. paratuberculosis
cggccgggaugccgccgg

SEQ ID NO: 2938867 - RNA, 19 nt, Mycobacterium avium subsp. paratuberculosis
cggccgggaugccgccggu

SEQ ID NO: 2938868 - RNA, 21 nt, Mycobacterium avium subsp. paratuberculosis
cggccgggaugccgccgguca

SEQ ID NO: 2938869 - RNA, 19 nt, Mycobacterium avium subsp. paratuberculosis
cggccgggauuucccgggc

SEQ ID NO: 2938870 - RNA, 23 nt, Mycobacterium avium subsp. paratuberculosis
cggccgggauuucccgggcgauc

SEQ ID NO: 2938871 - RNA, 14 nt, Mycobacterium avium subsp. paratuberculosis
cggccgggccgcgg

SEQ ID NO: 2938872 - RNA, 15 nt, Mycobacterium avium subsp. paratuberculosis
cggccgggccgcggc

SEQ ID NO: 2938873 - RNA, 17 nt, Mycobacterium avium subsp. paratuberculosis
cggccgggccgcggcgg

SEQ ID NO: 2938874 - RNA, 19 nt, Mycobacterium avium subsp. paratuberculosis
cggccgggccgcggcggua

SEQ ID NO: 2938875 - RNA, 20 nt, Mycobacterium avium subsp. paratuberculosis
cggccgggccggaacgcccg

SEQ ID NO: 2938876 - RNA, 23 nt, Mycobacterium avium subsp. paratuberculosis
cggccgggccggaacgcccgauc

SEQ ID NO: 2938877 - RNA, 13 nt, Mycobacterium avium subsp. paratuberculosis
cggccgggccggc

SEQ ID NO: 2938878 - RNA, 14 nt, Mycobacterium avium subsp. paratuberculosis
cggccgggccggcg

SEQ ID NO: 2938879 - RNA, 15 nt, Mycobacterium avium subsp. paratuberculosis
cggccgggcgacugc

SEQ ID NO: 2938880 - RNA, 19 nt, Mycobacterium avium subsp. paratuberculosis
cggccgggcgacugcgugc

SEQ ID NO: 2938881 - RNA, 21 nt, Mycobacterium avium subsp. paratuberculosis
cggccgggcgacugcgugcug

SEQ ID NO: 2938882 - RNA, 12 nt, Mycobacterium avium subsp. paratuberculosis
cggccgggcgau

SEQ ID NO: 2938883 - RNA, 13 nt, Mycobacterium avium subsp. paratuberculosis
cggccgggcgccc

SEQ ID NO: 2938884 - RNA, 15 nt, Mycobacterium avium subsp. paratuberculosis
cggccgggcgccccg

SEQ ID NO: 2938885 - RNA, 17 nt, Mycobacterium avium subsp. paratuberculosis
cggccgggcgccccgac

SEQ ID NO: 2938886 - RNA, 20 nt, Mycobacterium avium subsp. paratuberculosis
cggccgggcggacggcaccg

SEQ ID NO: 2938887 - RNA, 15 nt, Mycobacterium avium subsp. paratuberculosis
cggccgggcggccgg

SEQ ID NO: 2938888 - RNA, 18 nt, Mycobacterium avium subsp. paratuberculosis
cggccgggcggccggagc

SEQ ID NO: 2938889 - RNA, 17 nt, Mycobacterium avium subsp. paratuberculosis
cggccgggcgggggcug

SEQ ID NO: 2938890 - RNA, 21 nt, Mycobacterium avium subsp. paratuberculosis
cggccgggcgggggcugucca

SEQ ID NO: 2938891 - RNA, 19 nt, Mycobacterium avium subsp. paratuberculosis
cggccgggcugcccaccac

SEQ ID NO: 2938892 - RNA, 17 nt, Mycobacterium avium subsp. paratuberculosis
cggccgggcugcgcagc

SEQ ID NO: 2938893 - RNA, 19 nt, Mycobacterium avium subsp. paratuberculosis
cggccgggcugcgcagcac

SEQ ID NO: 2938894 - RNA, 21 nt, Mycobacterium avium subsp. paratuberculosis
cggccggggaguucgcgguug

SEQ ID NO: 2938895 - RNA, 14 nt, Mycobacterium avium subsp. paratuberculosis
cggccggggccagc

SEQ ID NO: 2938896 - RNA, 17 nt, Mycobacterium avium subsp. paratuberculosis
cggccggggccagcacc

SEQ ID NO: 2938897 - RNA, 18 nt, Mycobacterium avium subsp. paratuberculosis
cggccggggccagcaccc

SEQ ID NO: 2938898 - RNA, 19 nt, Mycobacterium avium subsp. paratuberculosis
cggccggggccagcaccca

SEQ ID NO: 2938899 - RNA, 20 nt, Mycobacterium avium subsp. paratuberculosis
cggccggggccagcacccag

SEQ ID NO: 2938900 - RNA, 15 nt, Mycobacterium avium subsp. paratuberculosis
cggccggggcgacca

SEQ ID NO: 2938901 - RNA, 14 nt, Mycobacterium avium subsp. paratuberculosis
cggccggggcggcg

SEQ ID NO: 2938902 - RNA, 20 nt, Mycobacterium avium subsp. paratuberculosis
cggccggggcggcgguaccg

SEQ ID NO: 2938903 - RNA, 14 nt, Mycobacterium avium subsp. paratuberculosis
cggccggggcgggc

SEQ ID NO: 2938904 - RNA, 15 nt, Mycobacterium avium subsp. paratuberculosis
cggccggggcgggca

SEQ ID NO: 2938905 - RNA, 20 nt, Mycobacterium avium subsp. paratuberculosis
cggccggggcgggcacgucg

SEQ ID NO: 2938906 - RNA, 23 nt, Mycobacterium avium subsp. paratuberculosis
cggccggggcgggcacgucgcgc

SEQ ID NO: 2938907 - RNA, 16 nt, Mycobacterium avium subsp. paratuberculosis
cggccgggggcgcggg

SEQ ID NO: 2938908 - RNA, 12 nt, Mycobacterium avium subsp. paratuberculosis
cggccgggguga

SEQ ID NO: 2938909 - RNA, 15 nt, Mycobacterium avium subsp. paratuberculosis
cggccgggucacgug

SEQ ID NO: 2938910 - RNA, 16 nt, Mycobacterium avium subsp. paratuberculosis
cggccgggucccuuug

SEQ ID NO: 2938911 - RNA, 16 nt, Mycobacterium avium subsp. paratuberculosis
cggccgggucgaccgc

SEQ ID NO: 2938912 - RNA, 17 nt, Mycobacterium avium subsp. paratuberculosis
cggccgggucgaccgcg

SEQ ID NO: 2938913 - RNA, 18 nt, Mycobacterium avium subsp. paratuberculosis
cggccgggucgaccgcga

SEQ ID NO: 2938914 - RNA, 16 nt, Mycobacterium avium subsp. paratuberculosis
cggccgggucgagcgc

SEQ ID NO: 2938915 - RNA, 18 nt, Mycobacterium avium subsp. paratuberculosis
cggccgggucgcaggcag

SEQ ID NO: 2938916 - RNA, 21 nt, Mycobacterium avium subsp. paratuberculosis
cggccgggucgcaggcagcag

SEQ ID NO: 2938917 - RNA, 22 nt, Mycobacterium avium subsp. paratuberculosis
cggccgggucguaggccggauc

SEQ ID NO: 2938918 - RNA, 17 nt, Mycobacterium avium subsp. paratuberculosis
cggccgguccgaucguc

SEQ ID NO: 2938919 - RNA, 16 nt, Mycobacterium avium subsp. paratuberculosis
cggccgguccgcccag

SEQ ID NO: 2938920 - RNA, 21 nt, Mycobacterium avium subsp. paratuberculosis
cggccgguccgugcacggcca

SEQ ID NO: 2938921 - RNA, 18 nt, Mycobacterium avium subsp. paratuberculosis
cggccgguccucugcgac

SEQ ID NO: 2938922 - RNA, 19 nt, Mycobacterium avium subsp. paratuberculosis
cggccggucgaaggccccg

SEQ ID NO: 2938923 - RNA, 15 nt, Mycobacterium avium subsp. paratuberculosis
cggccggucgccugc

SEQ ID NO: 2938924 - RNA, 21 nt, Mycobacterium avium subsp. paratuberculosis
cggccggugacuccuccucgg

SEQ ID NO: 2938925 - RNA, 18 nt, Mycobacterium avium subsp. paratuberculosis
cggccggugccacgguca

SEQ ID NO: 2938926 - RNA, 16 nt, Mycobacterium avium subsp. paratuberculosis
cggccuccagccgcuc

SEQ ID NO: 2938927 - RNA, 17 nt, Mycobacterium avium subsp. paratuberculosis
cggccuccagccggcgg

SEQ ID NO: 2938928 - RNA, 18 nt, Mycobacterium avium subsp. paratuberculosis
cggccuccagccggcgga

SEQ ID NO: 2938929 - RNA, 18 nt, Mycobacterium avium subsp. paratuberculosis
cggccucccacucgucga

SEQ ID NO: 2938930 - RNA, 21 nt, Mycobacterium avium subsp. paratuberculosis
cggccucccgguaggcggcga

SEQ ID NO: 2938931 - RNA, 18 nt, Mycobacterium avium subsp. paratuberculosis
cggccuccgagcggcgca

SEQ ID NO: 2938932 - RNA, 19 nt, Mycobacterium avium subsp. paratuberculosis
cggccuccgagcggcgcag

SEQ ID NO: 2938933 - RNA, 21 nt, Mycobacterium avium subsp. paratuberculosis
cggccuccgccaccuccuccg

SEQ ID NO: 2938934 - RNA, 14 nt, Mycobacterium avium subsp. paratuberculosis
cggccuccgcgcgc

SEQ ID NO: 2938935 - RNA, 19 nt, Mycobacterium avium subsp. paratuberculosis
cggccuccgcgcgcggccc

SEQ ID NO: 2938936 - RNA, 15 nt, Mycobacterium avium subsp. paratuberculosis
cggccuccuccucgc

SEQ ID NO: 2938937 - RNA, 17 nt, Mycobacterium avium subsp. paratuberculosis
cggccuccuccucgcug

SEQ ID NO: 2938938 - RNA, 23 nt, Mycobacterium avium subsp. paratuberculosis
cggccucgaagcuggaauaccuu

SEQ ID NO: 2938939 - RNA, 21 nt, Mycobacterium avium subsp. paratuberculosis
cggccucgaucaucaccaccg

SEQ ID NO: 2938940 - RNA, 22 nt, Mycobacterium avium subsp. paratuberculosis
cggccucgaucaucaccaccgc

SEQ ID NO: 2938941 - RNA, 21 nt, Mycobacterium avium subsp. paratuberculosis
cggccucgaugucgucgauga

SEQ ID NO: 2938942 - RNA, 13 nt, Mycobacterium avium subsp. paratuberculosis
cggccucgcccag

SEQ ID NO: 2938943 - RNA, 17 nt, Mycobacterium avium subsp. paratuberculosis
cggccucgcccagcgcc

SEQ ID NO: 2938944 - RNA, 19 nt, Mycobacterium avium subsp. paratuberculosis
cggccucgcccagcgccgc

SEQ ID NO: 2938945 - RNA, 20 nt, Mycobacterium avium subsp. paratuberculosis
cggccucgcccagcgccgcg

SEQ ID NO: 2938946 - RNA, 21 nt, Mycobacterium avium subsp. paratuberculosis
cggccucgcccagcgccgcgg

SEQ ID NO: 2938947 - RNA, 14 nt, Mycobacterium avium subsp. paratuberculosis
cggccucgccggcg

SEQ ID NO: 2938948 - RNA, 17 nt, Mycobacterium avium subsp. paratuberculosis
cggccucgccggcgccg

SEQ ID NO: 2938949 - RNA, 14 nt, Mycobacterium avium subsp. paratuberculosis
cggccucgccgucg

SEQ ID NO: 2938950 - RNA, 15 nt, Mycobacterium avium subsp. paratuberculosis
cggccucgccgucga

SEQ ID NO: 2938951 - RNA, 17 nt, Mycobacterium avium subsp. paratuberculosis
cggccucgccgucgaag

SEQ ID NO: 2938952 - RNA, 21 nt, Mycobacterium avium subsp. paratuberculosis
cggccucgccgucgaaggccg

SEQ ID NO: 2938953 - RNA, 14 nt, Mycobacterium avium subsp. paratuberculosis
cggccucggcaccg

SEQ ID NO: 2938954 - RNA, 16 nt, Mycobacterium avium subsp. paratuberculosis
cggccucggcaccgug

SEQ ID NO: 2938955 - RNA, 15 nt, Mycobacterium avium subsp. paratuberculosis
cggccucggcggccg

SEQ ID NO: 2938956 - RNA, 14 nt, Mycobacterium avium subsp. paratuberculosis
cggccucggcggug

SEQ ID NO: 2938957 - RNA, 18 nt, Mycobacterium avium subsp. paratuberculosis
cggccucggcgguggccu

SEQ ID NO: 2938958 - RNA, 17 nt, Mycobacterium avium subsp. paratuberculosis
cggccucggcguccgcg

SEQ ID NO: 2938959 - RNA, 18 nt, Mycobacterium avium subsp. paratuberculosis
cggccucggcguccgcgg

SEQ ID NO: 2938960 - RNA, 19 nt, Mycobacterium avium subsp. paratuberculosis
cggccucggcguccgcggc

SEQ ID NO: 2938961 - RNA, 14 nt, Mycobacterium avium subsp. paratuberculosis
cggccucggcgucg

SEQ ID NO: 2938962 - RNA, 14 nt, Mycobacterium avium subsp. paratuberculosis
cggccucgucgacg

SEQ ID NO: 2938963 - RNA, 17 nt, Mycobacterium avium subsp. paratuberculosis
cggccucgucgacgucg

SEQ ID NO: 2938964 - RNA, 18 nt, Mycobacterium avium subsp. paratuberculosis
cggccucgucgacgucgg

SEQ ID NO: 2938965 - RNA, 13 nt, Mycobacterium avium subsp. paratuberculosis
cggccucgucgag

SEQ ID NO: 2938966 - RNA, 14 nt, Mycobacterium avium subsp. paratuberculosis
cggccucgucgagg

SEQ ID NO: 2938967 - RNA, 15 nt, Mycobacterium avium subsp. paratuberculosis
cggccucgucggcga

SEQ ID NO: 2938968 - RNA, 18 nt, Mycobacterium avium subsp. paratuberculosis
cggccucgugcaaggccu

SEQ ID NO: 2938969 - RNA, 20 nt, Mycobacterium avium subsp. paratuberculosis
cggccucgugcaaggccugc

SEQ ID NO: 2938970 - RNA, 22 nt, Mycobacterium avium subsp. paratuberculosis
cggccucgugcaaggccugcgc

SEQ ID NO: 2938971 - RNA, 23 nt, Mycobacterium avium subsp. paratuberculosis
cggccucgugcaaggccugcgcc

SEQ ID NO: 2938972 - RNA, 23 nt, Mycobacterium avium subsp. paratuberculosis
cggccucguggaaaucgagcgcg

SEQ ID NO: 2938973 - RNA, 19 nt, Mycobacterium avium subsp. paratuberculosis
cggccucucgucgacgaug

SEQ ID NO: 2938974 - RNA, 22 nt, Mycobacterium avium subsp. paratuberculosis
cggccugacugagucaagccgg

SEQ ID NO: 2938975 - RNA, 17 nt, Mycobacterium avium subsp. paratuberculosis
cggccugagacgacgcc

SEQ ID NO: 2938976 - RNA, 18 nt, Mycobacterium avium subsp. paratuberculosis
cggccugagacgacgcca

SEQ ID NO: 2938977 - RNA, 16 nt, Mycobacterium avium subsp. paratuberculosis
cggccugagccgccgg

SEQ ID NO: 2938978 - RNA, 17 nt, Mycobacterium avium subsp. paratuberculosis
cggccugagccgccggg

SEQ ID NO: 2938979 - RNA, 21 nt, Mycobacterium avium subsp. paratuberculosis
cggccugagccgccggggcgc

SEQ ID NO: 2938980 - RNA, 16 nt, Mycobacterium avium subsp. paratuberculosis
cggccugcacaggggc

SEQ ID NO: 2938981 - RNA, 22 nt, Mycobacterium avium subsp. paratuberculosis
cggccugcaccaccacacccag

SEQ ID NO: 2938982 - RNA, 14 nt, Mycobacterium avium subsp. paratuberculosis
cggccugcacccag

SEQ ID NO: 2938983 - RNA, 18 nt, Mycobacterium avium subsp. paratuberculosis
cggccugcacccagguca

SEQ ID NO: 2938984 - RNA, 13 nt, Mycobacterium avium subsp. paratuberculosis
cggccugcaccuc

SEQ ID NO: 2938985 - RNA, 19 nt, Mycobacterium avium subsp. paratuberculosis
cggccugcaccucgggaug

SEQ ID NO: 2938986 - RNA, 14 nt, Mycobacterium avium subsp. paratuberculosis
cggccugcacgucc

SEQ ID NO: 2938987 - RNA, 19 nt, Mycobacterium avium subsp. paratuberculosis
cggccugcacgucggcgcg

SEQ ID NO: 2938988 - RNA, 22 nt, Mycobacterium avium subsp. paratuberculosis
cggccugcacgucggcgcgcag

SEQ ID NO: 2938989 - RNA, 11 nt, Mycobacterium avium subsp. paratuberculosis
cggccugcagc

SEQ ID NO: 2938990 - RNA, 15 nt, Mycobacterium avium subsp. paratuberculosis
cggccugcagcgcgg

SEQ ID NO: 2938991 - RNA, 18 nt, Mycobacterium avium subsp. paratuberculosis
cggccugcagcgcgguca

SEQ ID NO: 2938992 - RNA, 16 nt, Mycobacterium avium subsp. paratuberculosis
cggccugccaccgcga

SEQ ID NO: 2938993 - RNA, 15 nt, Mycobacterium avium subsp. paratuberculosis
cggccugcccgccgc

SEQ ID NO: 2938994 - RNA, 16 nt, Mycobacterium avium subsp. paratuberculosis
cggccugcccgccgcg

SEQ ID NO: 2938995 - RNA, 18 nt, Mycobacterium avium subsp. paratuberculosis
cggccugcccgccgcggc

SEQ ID NO: 2938996 - RNA, 19 nt, Mycobacterium avium subsp. paratuberculosis
cggccugcccgccgcggcc

SEQ ID NO: 2938997 - RNA, 20 nt, Mycobacterium avium subsp. paratuberculosis
cggccugcccgccgcggccg

SEQ ID NO: 2938998 - RNA, 13 nt, Mycobacterium avium subsp. paratuberculosis
cggccugcccgcg

SEQ ID NO: 2938999 - RNA, 14 nt, Mycobacterium avium subsp. paratuberculosis
cggccugcccgcgg

SEQ ID NO: 2939000 - RNA, 15 nt, Mycobacterium avium subsp. paratuberculosis
cggccugcccgcggg

SEQ ID NO: 2939001 - RNA, 16 nt, Mycobacterium avium subsp. paratuberculosis
cggccugcccgcgggu

SEQ ID NO: 2939002 - RNA, 16 nt, Mycobacterium avium subsp. paratuberculosis
cggccugccggaugcc

SEQ ID NO: 2939003 - RNA, 22 nt, Mycobacterium avium subsp. paratuberculosis
cggccugccggaugccgcgcgg

SEQ ID NO: 2939004 - RNA, 15 nt, Mycobacterium avium subsp. paratuberculosis
cggccugccggccgc

SEQ ID NO: 2939005 - RNA, 18 nt, Mycobacterium avium subsp. paratuberculosis
cggccugccggccgccgc

SEQ ID NO: 2939006 - RNA, 19 nt, Mycobacterium avium subsp. paratuberculosis
cggccugccggccgccgcg

SEQ ID NO: 2939007 - RNA, 15 nt, Mycobacterium avium subsp. paratuberculosis
cggccugcgcccggc

SEQ ID NO: 2939008 - RNA, 16 nt, Mycobacterium avium subsp. paratuberculosis
cggccugcgcgucguc

SEQ ID NO: 2939009 - RNA, 17 nt, Mycobacterium avium subsp. paratuberculosis
cggccugcgcgucgucg

SEQ ID NO: 2939010 - RNA, 15 nt, Mycobacterium avium subsp. paratuberculosis
cggccugcggcggca

SEQ ID NO: 2939011 - RNA, 22 nt, Mycobacterium avium subsp. paratuberculosis
cggcgaacagugcacugccgac

SEQ ID NO: 2939012 - RNA, 23 nt, Mycobacterium avium subsp. paratuberculosis
cggcgaacagugcacugccgacc

SEQ ID NO: 2939013 - RNA, 14 nt, Mycobacterium avium subsp. paratuberculosis
cggcgaaccagcau

SEQ ID NO: 2939014 - RNA, 23 nt, Mycobacterium avium subsp. paratuberculosis
cggcgaaccagggcagccagccc

SEQ ID NO: 2939015 - RNA, 22 nt, Mycobacterium avium subsp. paratuberculosis
cggcgaacccgagcaccccggc

SEQ ID NO: 2939016 - RNA, 14 nt, Mycobacterium avium subsp. paratuberculosis
cggcgaaccgccgc

SEQ ID NO: 2939017 - RNA, 21 nt, Mycobacterium avium subsp. paratuberculosis
cggcgaaccgccgcacccagc

SEQ ID NO: 2939018 - RNA, 12 nt, Mycobacterium avium subsp. paratuberculosis
cggcgaaccggg

SEQ ID NO: 2939019 - RNA, 20 nt, Mycobacterium avium subsp. paratuberculosis
cggcgaaccgggacagccgc

SEQ ID NO: 2939020 - RNA, 15 nt, Mycobacterium avium subsp. paratuberculosis
cggcgaaccgggccc

SEQ ID NO: 2939021 - RNA, 20 nt, Mycobacterium avium subsp. paratuberculosis
cggcgaaccgggcccguagg

SEQ ID NO: 2939022 - RNA, 19 nt, Mycobacterium avium subsp. paratuberculosis
cggcgaaccguucgucguc

SEQ ID NO: 2939023 - RNA, 18 nt, Mycobacterium avium subsp. paratuberculosis
cggcgaacgacgucgagg

SEQ ID NO: 2939024 - RNA, 17 nt, Mycobacterium avium subsp. paratuberculosis
cggcgaacgcccggucg

SEQ ID NO: 2939025 - RNA, 20 nt, Mycobacterium avium subsp. paratuberculosis
cggcgaacgcccggucgaug

SEQ ID NO: 2939026 - RNA, 14 nt, Mycobacterium avium subsp. paratuberculosis
cggcgaacgccgcc

SEQ ID NO: 2939027 - RNA, 15 nt, Mycobacterium avium subsp. paratuberculosis
cggcgaacgccgccg

SEQ ID NO: 2939028 - RNA, 16 nt, Mycobacterium avium subsp. paratuberculosis
cggcgaacgccucggu

SEQ ID NO: 2939029 - RNA, 19 nt, Mycobacterium avium subsp. paratuberculosis
cggcgaacgccucgguggu

SEQ ID NO: 2939030 - RNA, 14 nt, Mycobacterium avium subsp. paratuberculosis
cggcgaacgcgcgg

SEQ ID NO: 2939031 - RNA, 15 nt, Mycobacterium avium subsp. paratuberculosis
cggcgaacgcgcggu

SEQ ID NO: 2939032 - RNA, 18 nt, Mycobacterium avium subsp. paratuberculosis
cggcgaacgcgcggucgu

SEQ ID NO: 2939033 - RNA, 19 nt, Mycobacterium avium subsp. paratuberculosis
cggcgaacgcgcggucguc

SEQ ID NO: 2939034 - RNA, 20 nt, Mycobacterium avium subsp. paratuberculosis
cggcgaacgcgcggucgucg

SEQ ID NO: 2939035 - RNA, 21 nt, Mycobacterium avium subsp. paratuberculosis
cggcgaacgcgcggucgucgc

SEQ ID NO: 2939036 - RNA, 21 nt, Mycobacterium avium subsp. paratuberculosis
cggcgaacgcgucccgggccu

SEQ ID NO: 2939037 - RNA, 15 nt, Mycobacterium avium subsp. paratuberculosis
cggcgaacggccagu

SEQ ID NO: 2939038 - RNA, 18 nt, Mycobacterium avium subsp. paratuberculosis
cggcgaacggccagucca

SEQ ID NO: 2939039 - RNA, 14 nt, Mycobacterium avium subsp. paratuberculosis
cggcgaacggccgc

SEQ ID NO: 2939040 - RNA, 15 nt, Mycobacterium avium subsp. paratuberculosis
cggcgaacggccgcg

SEQ ID NO: 2939041 - RNA, 16 nt, Mycobacterium avium subsp. paratuberculosis
cggcgaacggccgcga

SEQ ID NO: 2939042 - RNA, 20 nt, Mycobacterium avium subsp. paratuberculosis
cggcgaacggccgcgauguc

SEQ ID NO: 2939043 - RNA, 23 nt, Mycobacterium avium subsp. paratuberculosis
cggcgaacgguucgggaaccugg

SEQ ID NO: 2939044 - RNA, 13 nt, Mycobacterium avium subsp. paratuberculosis
cggcgaacgucga

SEQ ID NO: 2939045 - RNA, 17 nt, Mycobacterium avium subsp. paratuberculosis
cggcgaacgucgauguc

SEQ ID NO: 2939046 - RNA, 17 nt, Mycobacterium avium subsp. paratuberculosis
cggcgaacuccacccug

SEQ ID NO: 2939047 - RNA, 22 nt, Mycobacterium avium subsp. paratuberculosis
cggcgaacuccacccugccgac

SEQ ID NO: 2939048 - RNA, 16 nt, Mycobacterium avium subsp. paratuberculosis
cggcgaacuccagauc

SEQ ID NO: 2939049 - RNA, 18 nt, Mycobacterium avium subsp. paratuberculosis
cggcgaacuccagaucgc

SEQ ID NO: 2939050 - RNA, 23 nt, Mycobacterium avium subsp. paratuberculosis
cggcgaacuccagaucgccgccc

SEQ ID NO: 2939051 - RNA, 18 nt, Mycobacterium avium subsp. paratuberculosis
cggcgaacucgcggcggg

SEQ ID NO: 2939052 - RNA, 21 nt, Mycobacterium avium subsp. paratuberculosis
cggcgaacugcuugaucaggu

SEQ ID NO: 2939053 - RNA, 15 nt, Mycobacterium avium subsp. paratuberculosis
cggcgaacuuggccg

SEQ ID NO: 2939054 - RNA, 20 nt, Mycobacterium avium subsp. paratuberculosis
cggcgaacuuggccgacacg

SEQ ID NO: 2939055 - RNA, 13 nt, Mycobacterium avium subsp. paratuberculosis
cggcgaagacguc

SEQ ID NO: 2939056 - RNA, 16 nt, Mycobacterium avium subsp. paratuberculosis
cggcgaagacgucggc

SEQ ID NO: 2939057 - RNA, 21 nt, Mycobacterium avium subsp. paratuberculosis
cggcgaagacgucggcgcggu

SEQ ID NO: 2939058 - RNA, 14 nt, Mycobacterium avium subsp. paratuberculosis
cggcgaagcaggcc

SEQ ID NO: 2939059 - RNA, 15 nt, Mycobacterium avium subsp. paratuberculosis
cggcgaagccggccc

SEQ ID NO: 2939060 - RNA, 17 nt, Mycobacterium avium subsp. paratuberculosis
cggcgaagccggccccg

SEQ ID NO: 2939061 - RNA, 21 nt, Mycobacterium avium subsp. paratuberculosis
cggcgaagccggccccgcccg

SEQ ID NO: 2939062 - RNA, 14 nt, Mycobacterium avium subsp. paratuberculosis
cggcgaagccggcg

SEQ ID NO: 2939063 - RNA, 15 nt, Mycobacterium avium subsp. paratuberculosis
cggcgaagccggcgu

SEQ ID NO: 2939064 - RNA, 18 nt, Mycobacterium avium subsp. paratuberculosis
cggcgaagccggcgucaa

SEQ ID NO: 2939065 - RNA, 22 nt, Mycobacterium avium subsp. paratuberculosis
cggcgaagcuaaaccccacggc

SEQ ID NO: 2939066 - RNA, 15 nt, Mycobacterium avium subsp. paratuberculosis
cggcgaaggacagcc

SEQ ID NO: 2939067 - RNA, 16 nt, Mycobacterium avium subsp. paratuberculosis
cggcgaaggacagccg

SEQ ID NO: 2939068 - RNA, 17 nt, Mycobacterium avium subsp. paratuberculosis
cggcgaaggacagccgg

SEQ ID NO: 2939069 - RNA, 22 nt, Mycobacterium avium subsp. paratuberculosis
cggcgaaggccagcgauacccg

SEQ ID NO: 2939070 - RNA, 14 nt, Mycobacterium avium subsp. paratuberculosis
cggcgaaggcgcgc

SEQ ID NO: 2939071 - RNA, 17 nt, Mycobacterium avium subsp. paratuberculosis
cggcgaaggcgcgcagg

SEQ ID NO: 2939072 - RNA, 23 nt, Mycobacterium avium subsp. paratuberculosis
cggcgaaggucugaaaugccggg

SEQ ID NO: 2939073 - RNA, 20 nt, Mycobacterium avium subsp. paratuberculosis
cggcgaaggugccccgcugg

SEQ ID NO: 2939074 - RNA, 23 nt, Mycobacterium avium subsp. paratuberculosis
cggcgaaggugccccgcuggauc

SEQ ID NO: 2939075 - RNA, 18 nt, Mycobacterium avium subsp. paratuberculosis
cggcgaaguagcgggcgu

SEQ ID NO: 2939076 - RNA, 16 nt, Mycobacterium avium subsp. paratuberculosis
cggcgaagucaucacc

SEQ ID NO: 2939077 - RNA, 17 nt, Mycobacterium avium subsp. paratuberculosis
cggcgaagucaucaccg

SEQ ID NO: 2939078 - RNA, 18 nt, Mycobacterium avium subsp. paratuberculosis
cggcgaagucaucaccgg

SEQ ID NO: 2939079 - RNA, 22 nt, Mycobacterium avium subsp. paratuberculosis
cggcgaagucaucaccggggau

SEQ ID NO: 2939080 - RNA, 23 nt, Mycobacterium avium subsp. paratuberculosis
cggcgaagucaucaccggggauc

SEQ ID NO: 2939081 - RNA, 18 nt, Mycobacterium avium subsp. paratuberculosis
cggcgaauaccagggcga

SEQ ID NO: 2939082 - RNA, 17 nt, Mycobacterium avium subsp. paratuberculosis
cggcgaauauuucgccg

SEQ ID NO: 2939083 - RNA, 20 nt, Mycobacterium avium subsp. paratuberculosis
cggcgaauauuucgccgauc

SEQ ID NO: 2939084 - RNA, 15 nt, Mycobacterium avium subsp. paratuberculosis
cggcgaaucagcagc

SEQ ID NO: 2939085 - RNA, 16 nt, Mycobacterium avium subsp. paratuberculosis
cggcgaaucagcagcu

SEQ ID NO: 2939086 - RNA, 22 nt, Mycobacterium avium subsp. paratuberculosis
cggcgaauccacacaggaccag

SEQ ID NO: 2939087 - RNA, 15 nt, Mycobacterium avium subsp. paratuberculosis
cggcgaauccgaccg

SEQ ID NO: 2939088 - RNA, 21 nt, Mycobacterium avium subsp. paratuberculosis
cggcgaauccgagcaucgggu

SEQ ID NO: 2939089 - RNA, 18 nt, Mycobacterium avium subsp. paratuberculosis
cggcgacaacagcgccga

SEQ ID NO: 2939090 - RNA, 19 nt, Mycobacterium avium subsp. paratuberculosis
cggcgacaacagcgccgag

SEQ ID NO: 2939091 - RNA, 14 nt, Mycobacterium avium subsp. paratuberculosis
cggcgacacccagc

SEQ ID NO: 2939092 - RNA, 16 nt, Mycobacterium avium subsp. paratuberculosis
cggcgacacccagcgg

SEQ ID NO: 2939093 - RNA, 19 nt, Mycobacterium avium subsp. paratuberculosis
cggcgacacccagcggcgc

SEQ ID NO: 2939094 - RNA, 23 nt, Mycobacterium avium subsp. paratuberculosis
cggcgacacccagcggcgcggcc

SEQ ID NO: 2939095 - RNA, 21 nt, Mycobacterium avium subsp. paratuberculosis
cggcgacgauaucggccgcgg

SEQ ID NO: 2939096 - RNA, 22 nt, Mycobacterium avium subsp. paratuberculosis
cggcgacgauaucggccgcggg

SEQ ID NO: 2939097 - RNA, 13 nt, Mycobacterium avium subsp. paratuberculosis
cggcgacgaucac

SEQ ID NO: 2939098 - RNA, 14 nt, Mycobacterium avium subsp. paratuberculosis
cggcgacgaucacc

SEQ ID NO: 2939099 - RNA, 15 nt, Mycobacterium avium subsp. paratuberculosis
cggcgacgaucggcu

SEQ ID NO: 2939100 - RNA, 17 nt, Mycobacterium avium subsp. paratuberculosis
cggcgacgaucggcucg

SEQ ID NO: 2939101 - RNA, 20 nt, Mycobacterium avium subsp. paratuberculosis
cggcgacgaucggcucgagc

SEQ ID NO: 2939102 - RNA, 15 nt, Mycobacterium avium subsp. paratuberculosis
cggcgacgaugcggc

SEQ ID NO: 2939103 - RNA, 18 nt, Mycobacterium avium subsp. paratuberculosis
cggcgacgauggccaggc

SEQ ID NO: 2939104 - RNA, 13 nt, Mycobacterium avium subsp. paratuberculosis
cggcgacgccgcc

SEQ ID NO: 2939105 - RNA, 14 nt, Mycobacterium avium subsp. paratuberculosis
cggcgacgccgccg

SEQ ID NO: 2939106 - RNA, 15 nt, Mycobacterium avium subsp. paratuberculosis
cggcgacgccgccgu

SEQ ID NO: 2939107 - RNA, 16 nt, Mycobacterium avium subsp. paratuberculosis
cggcgacgccgcgcug

SEQ ID NO: 2939108 - RNA, 17 nt, Mycobacterium avium subsp. paratuberculosis
cggcgacgccgcgcugg

SEQ ID NO: 2939109 - RNA, 12 nt, Mycobacterium avium subsp. paratuberculosis
cggcgacgccgg

SEQ ID NO: 2939110 - RNA, 16 nt, Mycobacterium avium subsp. paratuberculosis
cggcgacgccggcgag

SEQ ID NO: 2939111 - RNA, 17 nt, Mycobacterium avium subsp. paratuberculosis
cggcgacgccggcgagg

SEQ ID NO: 2939112 - RNA, 13 nt, Mycobacterium avium subsp. paratuberculosis
cggcgacgccguc

SEQ ID NO: 2939113 - RNA, 15 nt, Mycobacterium avium subsp. paratuberculosis
cggcgacgccgucgg

SEQ ID NO: 2939114 - RNA, 12 nt, Mycobacterium avium subsp. paratuberculosis
cggcgacgcggc

SEQ ID NO: 2939115 - RNA, 15 nt, Mycobacterium avium subsp. paratuberculosis
cggcgacgcggcggg

SEQ ID NO: 2939116 - RNA, 16 nt, Mycobacterium avium subsp. paratuberculosis
cggcgacgcggcggga

SEQ ID NO: 2939117 - RNA, 21 nt, Mycobacterium avium subsp. paratuberculosis
cggcgacgcucaggcguccag

SEQ ID NO: 2939118 - RNA, 14 nt, Mycobacterium avium subsp. paratuberculosis
cggcgacgcuggug

SEQ ID NO: 2939119 - RNA, 16 nt, Mycobacterium avium subsp. paratuberculosis
cggcgacgcugguggc

SEQ ID NO: 2939120 - RNA, 17 nt, Mycobacterium avium subsp. paratuberculosis
cggcgacggcaccgccg

SEQ ID NO: 2939121 - RNA, 18 nt, Mycobacterium avium subsp. paratuberculosis
cggcgacggcaccgccgg

SEQ ID NO: 2939122 - RNA, 12 nt, Mycobacterium avium subsp. paratuberculosis
cggcgacggcag

SEQ ID NO: 2939123 - RNA, 13 nt, Mycobacterium avium subsp. paratuberculosis
cggcgacggcagc

SEQ ID NO: 2939124 - RNA, 14 nt, Mycobacterium avium subsp. paratuberculosis
cggcgacggcagcg

SEQ ID NO: 2939125 - RNA, 15 nt, Mycobacterium avium subsp. paratuberculosis
cggcgacggcagcgc

SEQ ID NO: 2939126 - RNA, 21 nt, Mycobacterium avium subsp. paratuberculosis
cggcgacggcagcgcgauccg

SEQ ID NO: 2939127 - RNA, 17 nt, Mycobacterium avium subsp. paratuberculosis
cggcgacggccagaccg

SEQ ID NO: 2939128 - RNA, 17 nt, Mycobacterium avium subsp. paratuberculosis
cggcgacggccagcgcg

SEQ ID NO: 2939129 - RNA, 19 nt, Mycobacterium avium subsp. paratuberculosis
cggcgacggccagcgcggc

SEQ ID NO: 2939130 - RNA, 22 nt, Mycobacterium avium subsp. paratuberculosis
cggcgacggccagcgcggcggu

SEQ ID NO: 2939131 - RNA, 15 nt, Mycobacterium avium subsp. paratuberculosis
cggcgacggccgucc

SEQ ID NO: 2939132 - RNA, 22 nt, Mycobacterium avium subsp. paratuberculosis
cggcgacggccguccggucgcu

SEQ ID NO: 2939133 - RNA, 12 nt, Mycobacterium avium subsp. paratuberculosis
cggcgacggcga

SEQ ID NO: 2939134 - RNA, 13 nt, Mycobacterium avium subsp. paratuberculosis
cggcgacggcgaa

SEQ ID NO: 2939135 - RNA, 16 nt, Mycobacterium avium subsp. paratuberculosis
cggcgacggcgaacgg

SEQ ID NO: 2939136 - RNA, 13 nt, Mycobacterium avium subsp. paratuberculosis
cggcgacggcgac

SEQ ID NO: 2939137 - RNA, 17 nt, Mycobacterium avium subsp. paratuberculosis
cggcgacggcgaccaca

SEQ ID NO: 2939138 - RNA, 14 nt, Mycobacterium avium subsp. paratuberculosis
cggcgacggcgacg

SEQ ID NO: 2939139 - RNA, 16 nt, Mycobacterium avium subsp. paratuberculosis
cggcgacggcgacggc

SEQ ID NO: 2939140 - RNA, 16 nt, Mycobacterium avium subsp. paratuberculosis
cggcgacggcgccuga

SEQ ID NO: 2939141 - RNA, 19 nt, Mycobacterium avium subsp. paratuberculosis
cggcgacggcgcucaccgg

SEQ ID NO: 2939142 - RNA, 20 nt, Mycobacterium avium subsp. paratuberculosis
cggcgacggcgcucaccggc

SEQ ID NO: 2939143 - RNA, 21 nt, Mycobacterium avium subsp. paratuberculosis
cggcgacggcgcucaccggcg

SEQ ID NO: 2939144 - RNA, 22 nt, Mycobacterium avium subsp. paratuberculosis
cggcgacggcgcucaccggcgu

SEQ ID NO: 2939145 - RNA, 14 nt, Mycobacterium avium subsp. paratuberculosis
cggcgacggcggcc

SEQ ID NO: 2939146 - RNA, 13 nt, Mycobacterium avium subsp. paratuberculosis
cggcgacggcggg

SEQ ID NO: 2939147 - RNA, 17 nt, Mycobacterium avium subsp. paratuberculosis
cggcgacggcggggugc

SEQ ID NO: 2939148 - RNA, 18 nt, Mycobacterium avium subsp. paratuberculosis
cggcgacggcggggugcg

SEQ ID NO: 2939149 - RNA, 17 nt, Mycobacterium avium subsp. paratuberculosis
cggcgacggcggugggc

SEQ ID NO: 2939150 - RNA, 14 nt, Mycobacterium avium subsp. paratuberculosis
cggcgacggcgguu

SEQ ID NO: 2939151 - RNA, 16 nt, Mycobacterium avium subsp. paratuberculosis
cggcgacggcgguucg

SEQ ID NO: 2939152 - RNA, 12 nt, Mycobacterium avium subsp. paratuberculosis
cggcgacggcgu

SEQ ID NO: 2939153 - RNA, 13 nt, Mycobacterium avium subsp. paratuberculosis
cggcgacggcguc

SEQ ID NO: 2939154 - RNA, 16 nt, Mycobacterium avium subsp. paratuberculosis
cggcgacggcguccag

SEQ ID NO: 2939155 - RNA, 21 nt, Mycobacterium avium subsp. paratuberculosis
cggcgacggcguccagcugcg

SEQ ID NO: 2939156 - RNA, 21 nt, Mycobacterium avium subsp. paratuberculosis
cggcgacggcguccgggcgcu

SEQ ID NO: 2939157 - RNA, 14 nt, Mycobacterium avium subsp. paratuberculosis
cggcgacggcgucg

SEQ ID NO: 2939158 - RNA, 17 nt, Mycobacterium avium subsp. paratuberculosis
cggcgacggcgucggcg

SEQ ID NO: 2939159 - RNA, 18 nt, Mycobacterium avium subsp. paratuberculosis
cggcgacggcgucggcgg

SEQ ID NO: 2939160 - RNA, 19 nt, Mycobacterium avium subsp. paratuberculosis
cggcgacggcgucggcggc

SEQ ID NO: 2939161 - RNA, 22 nt, Mycobacterium avium subsp. paratuberculosis
cggcgacggcgucggcggccug

SEQ ID NO: 2939162 - RNA, 14 nt, Mycobacterium avium subsp. paratuberculosis
cggcgacgguggcg

SEQ ID NO: 2939163 - RNA, 17 nt, Mycobacterium avium subsp. paratuberculosis
cggcgacgguggcgccc

SEQ ID NO: 2939164 - RNA, 19 nt, Mycobacterium avium subsp. paratuberculosis
cggcgacgguggcgcccag

SEQ ID NO: 2939165 - RNA, 20 nt, Mycobacterium avium subsp. paratuberculosis
cggcgacgguggcgcccagc

SEQ ID NO: 2939166 - RNA, 21 nt, Mycobacterium avium subsp. paratuberculosis
cggcgacgguggcgcccagcg

SEQ ID NO: 2939167 - RNA, 15 nt, Mycobacterium avium subsp. paratuberculosis
cggcgacgguggcgg

SEQ ID NO: 2939168 - RNA, 19 nt, Mycobacterium avium subsp. paratuberculosis
cggcgacgguggcgggccg

SEQ ID NO: 2939169 - RNA, 16 nt, Mycobacterium avium subsp. paratuberculosis
cggcgacgguguccgc

SEQ ID NO: 2939170 - RNA, 20 nt, Mycobacterium avium subsp. paratuberculosis
cggcgacgguguccgcggcg

SEQ ID NO: 2939171 - RNA, 22 nt, Mycobacterium avium subsp. paratuberculosis
cggcgacgguguccgcggcguc

SEQ ID NO: 2939172 - RNA, 18 nt, Mycobacterium avium subsp. paratuberculosis
cggcgacguacagcgagc

SEQ ID NO: 2939173 - RNA, 20 nt, Mycobacterium avium subsp. paratuberculosis
cggcgacguacagcgagccg

SEQ ID NO: 2939174 - RNA, 22 nt, Mycobacterium avium subsp. paratuberculosis
cggcgacguacagcgagccguc

SEQ ID NO: 2939175 - RNA, 21 nt, Mycobacterium avium subsp. paratuberculosis
cggcgacguccuugaucagca

SEQ ID NO: 2939176 - RNA, 18 nt, Mycobacterium avium subsp. paratuberculosis
cggcgacgucgacggcag

SEQ ID NO: 2939177 - RNA, 17 nt, Mycobacterium avium subsp. paratuberculosis
cggcgacgucgccggcc

SEQ ID NO: 2939178 - RNA, 23 nt, Mycobacterium avium subsp. paratuberculosis
cggcgacgucgccggccugcccg

SEQ ID NO: 2939179 - RNA, 14 nt, Mycobacterium avium subsp. paratuberculosis
cggcgacgucgucg

SEQ ID NO: 2939180 - RNA, 20 nt, Mycobacterium avium subsp. paratuberculosis
cggcgagugcgaaucaucgu

SEQ ID NO: 2939181 - RNA, 22 nt, Mycobacterium avium subsp. paratuberculosis
cggcgaguggaagucagcgcgu

SEQ ID NO: 2939182 - RNA, 17 nt, Mycobacterium avium subsp. paratuberculosis
cggcgaguucgaccucc

SEQ ID NO: 2939183 - RNA, 21 nt, Mycobacterium avium subsp. paratuberculosis
cggcgaguucgaccuccaccc

SEQ ID NO: 2939184 - RNA, 17 nt, Mycobacterium avium subsp. paratuberculosis
cggcgaguucgaugacg

SEQ ID NO: 2939185 - RNA, 21 nt, Mycobacterium avium subsp. paratuberculosis
cggcgaguucgaugacgucgc

SEQ ID NO: 2939186 - RNA, 15 nt, Mycobacterium avium subsp. paratuberculosis
cggcgaguucggcgg

SEQ ID NO: 2939187 - RNA, 18 nt, Mycobacterium avium subsp. paratuberculosis
cggcgaguucggcggccc

SEQ ID NO: 2939188 - RNA, 19 nt, Mycobacterium avium subsp. paratuberculosis
cggcgaguucggcggcccg

SEQ ID NO: 2939189 - RNA, 21 nt, Mycobacterium avium subsp. paratuberculosis
cggcgaguucggcggcccgcu

SEQ ID NO: 2939190 - RNA, 20 nt, Mycobacterium avium subsp. paratuberculosis
cggcgaguucugguaggcgg

SEQ ID NO: 2939191 - RNA, 23 nt, Mycobacterium avium subsp. paratuberculosis
cggcgaguucugguaggcggccg

SEQ ID NO: 2939192 - RNA, 17 nt, Mycobacterium avium subsp. paratuberculosis
cggcgauacccgggagc

SEQ ID NO: 2939193 - RNA, 20 nt, Mycobacterium avium subsp. paratuberculosis
cggcgauaggcggccagcuc

SEQ ID NO: 2939194 - RNA, 22 nt, Mycobacterium avium subsp. paratuberculosis
cggcgauaggcggccagcuccc

SEQ ID NO: 2939195 - RNA, 15 nt, Mycobacterium avium subsp. paratuberculosis
cggcgaucaccgccg

SEQ ID NO: 2939196 - RNA, 16 nt, Mycobacterium avium subsp. paratuberculosis
cggcgaucaccgccgc

SEQ ID NO: 2939197 - RNA, 18 nt, Mycobacterium avium subsp. paratuberculosis
cggcgaucaccgccgcgg

SEQ ID NO: 2939198 - RNA, 19 nt, Mycobacterium avium subsp. paratuberculosis
cggcgaucaccgccgcggc

SEQ ID NO: 2939199 - RNA, 22 nt, Mycobacterium avium subsp. paratuberculosis
cggcgaucaccgccgcggcgac

SEQ ID NO: 2939200 - RNA, 18 nt, Mycobacterium avium subsp. paratuberculosis
cggcgaucaccgcguucu

SEQ ID NO: 2939201 - RNA, 15 nt, Mycobacterium avium subsp. paratuberculosis
cggcgaucaccggga

SEQ ID NO: 2939202 - RNA, 17 nt, Mycobacterium avium subsp. paratuberculosis
cggcgaucaccgggaca

SEQ ID NO: 2939203 - RNA, 20 nt, Mycobacterium avium subsp. paratuberculosis
cggcgaucaccgggacaccg

SEQ ID NO: 2939204 - RNA, 14 nt, Mycobacterium avium subsp. paratuberculosis
cggcgaucagcagc

SEQ ID NO: 2939205 - RNA, 16 nt, Mycobacterium avium subsp. paratuberculosis
cggcgaucagcagcac

SEQ ID NO: 2939206 - RNA, 17 nt, Mycobacterium avium subsp. paratuberculosis
cggcgaucagcagcacc

SEQ ID NO: 2939207 - RNA, 23 nt, Mycobacterium avium subsp. paratuberculosis
cggcgaucagcagcacccgggcc

SEQ ID NO: 2939208 - RNA, 13 nt, Mycobacterium avium subsp. paratuberculosis
cggcgaucagccc

SEQ ID NO: 2939209 - RNA, 16 nt, Mycobacterium avium subsp. paratuberculosis
cggcgaucagcccggc

SEQ ID NO: 2939210 - RNA, 17 nt, Mycobacterium avium subsp. paratuberculosis
cggcgaucagcccggcc

SEQ ID NO: 2939211 - RNA, 23 nt, Mycobacterium avium subsp. paratuberculosis
cggcgaucagcccggcccgcauc

SEQ ID NO: 2939212 - RNA, 13 nt, Mycobacterium avium subsp. paratuberculosis
cggcgaucagcuc

SEQ ID NO: 2939213 - RNA, 14 nt, Mycobacterium avium subsp. paratuberculosis
cggcgaucagcucc

SEQ ID NO: 2939214 - RNA, 22 nt, Mycobacterium avium subsp. paratuberculosis
cggcgaucagcuccuccugcgg

SEQ ID NO: 2939215 - RNA, 23 nt, Mycobacterium avium subsp. paratuberculosis
cggcgaucagcuccuccugcggu

SEQ ID NO: 2939216 - RNA, 15 nt, Mycobacterium avium subsp. paratuberculosis
cggcgaucagcugcc

SEQ ID NO: 2939217 - RNA, 20 nt, Mycobacterium avium subsp. paratuberculosis
cggcgaucagcugcccggag

SEQ ID NO: 2939218 - RNA, 16 nt, Mycobacterium avium subsp. paratuberculosis
cggcgaucagcugcuc

SEQ ID NO: 2939219 - RNA, 14 nt, Mycobacterium avium subsp. paratuberculosis
cggcgaucagcugg

SEQ ID NO: 2939220 - RNA, 17 nt, Mycobacterium avium subsp. paratuberculosis
cggcgaucagcuggauc

SEQ ID NO: 2939221 - RNA, 23 nt, Mycobacterium avium subsp. paratuberculosis
cggcgaucagcuggaucaucucg

SEQ ID NO: 2939222 - RNA, 13 nt, Mycobacterium avium subsp. paratuberculosis
cggcgauccacgc

SEQ ID NO: 2939223 - RNA, 17 nt, Mycobacterium avium subsp. paratuberculosis
cggcgauccacgccucc

SEQ ID NO: 2939224 - RNA, 22 nt, Mycobacterium avium subsp. paratuberculosis
cggcgauccacgccuccggcag

SEQ ID NO: 2939225 - RNA, 14 nt, Mycobacterium avium subsp. paratuberculosis
cggcgauccgcgcg

SEQ ID NO: 2939226 - RNA, 15 nt, Mycobacterium avium subsp. paratuberculosis
cggcgauccgcgcgg

SEQ ID NO: 2939227 - RNA, 16 nt, Mycobacterium avium subsp. paratuberculosis
cggcgauccgcgcggc

SEQ ID NO: 2939228 - RNA, 17 nt, Mycobacterium avium subsp. paratuberculosis
cggcgauccgcgcggcg

SEQ ID NO: 2939229 - RNA, 19 nt, Mycobacterium avium subsp. paratuberculosis
cggcgauccgcgcggcgac

SEQ ID NO: 2939230 - RNA, 15 nt, Mycobacterium avium subsp. paratuberculosis
cggcgauccggccgg

SEQ ID NO: 2939231 - RNA, 16 nt, Mycobacterium avium subsp. paratuberculosis
cggcgauccggccggc

SEQ ID NO: 2939232 - RNA, 22 nt, Mycobacterium avium subsp. paratuberculosis
cggcgauccggccggcggcggu

SEQ ID NO: 2939233 - RNA, 15 nt, Mycobacterium avium subsp. paratuberculosis
cggcgauccgggcac

SEQ ID NO: 2939234 - RNA, 16 nt, Mycobacterium avium subsp. paratuberculosis
cggcgauccgggcacg

SEQ ID NO: 2939235 - RNA, 20 nt, Mycobacterium avium subsp. paratuberculosis
cggcgauccgggcacgcagc

SEQ ID NO: 2939236 - RNA, 21 nt, Mycobacterium avium subsp. paratuberculosis
cggcgauccgggcacgcagcg

SEQ ID NO: 2939237 - RNA, 14 nt, Mycobacterium avium subsp. paratuberculosis
cggcgaucgacguc

SEQ ID NO: 2939238 - RNA, 14 nt, Mycobacterium avium subsp. paratuberculosis
cggcgaucgccagc

SEQ ID NO: 2939239 - RNA, 15 nt, Mycobacterium avium subsp. paratuberculosis
cggcgaucgccagca

SEQ ID NO: 2939240 - RNA, 16 nt, Mycobacterium avium subsp. paratuberculosis
cggcgaucgccagcac

SEQ ID NO: 2939241 - RNA, 17 nt, Mycobacterium avium subsp. paratuberculosis
cggcgaucgccagcacg

SEQ ID NO: 2939242 - RNA, 17 nt, Mycobacterium avium subsp. paratuberculosis
cggcgaucgccgcgaac

SEQ ID NO: 2939243 - RNA, 16 nt, Mycobacterium avium subsp. paratuberculosis
cggcgaucgccgggga

SEQ ID NO: 2939244 - RNA, 18 nt, Mycobacterium avium subsp. paratuberculosis
cggcgaucgccggggauc

SEQ ID NO: 2939245 - RNA, 15 nt, Mycobacterium avium subsp. paratuberculosis
cggcgaucgccgugg

SEQ ID NO: 2939246 - RNA, 20 nt, Mycobacterium avium subsp. paratuberculosis
cggcgaucgccguggucaac

SEQ ID NO: 2939247 - RNA, 15 nt, Mycobacterium avium subsp. paratuberculosis
cggcgaucgcgagca

SEQ ID NO: 2939248 - RNA, 16 nt, Mycobacterium avium subsp. paratuberculosis
cggcgaucgcgcgcac

SEQ ID NO: 2939249 - RNA, 14 nt, Mycobacterium avium subsp. paratuberculosis
cggcgaucggccgc

SEQ ID NO: 2939250 - RNA, 20 nt, Mycobacterium avium subsp. paratuberculosis
cggcgaucggccgcugcggg

SEQ ID NO: 2939251 - RNA, 23 nt, Mycobacterium avium subsp. paratuberculosis
cggcgaucggccgcugcgggcgg

SEQ ID NO: 2939252 - RNA, 12 nt, Mycobacterium avium subsp. paratuberculosis
cggcgaucggcg

SEQ ID NO: 2939253 - RNA, 14 nt, Mycobacterium avium subsp. paratuberculosis
cggcgaucggcggu

SEQ ID NO: 2939254 - RNA, 17 nt, Mycobacterium avium subsp. paratuberculosis
cggcgaucggcgguccg

SEQ ID NO: 2939255 - RNA, 20 nt, Mycobacterium avium subsp. paratuberculosis
cggcgaucggcgguccgccg

SEQ ID NO: 2939256 - RNA, 15 nt, Mycobacterium avium subsp. paratuberculosis
cggcgaucggcgugc

SEQ ID NO: 2939257 - RNA, 16 nt, Mycobacterium avium subsp. paratuberculosis
cggcgaucggcgugcc

SEQ ID NO: 2939258 - RNA, 17 nt, Mycobacterium avium subsp. paratuberculosis
cggcgaucggcgugccg

SEQ ID NO: 2939259 - RNA, 18 nt, Mycobacterium avium subsp. paratuberculosis
cggcgaucggcgugccgg

SEQ ID NO: 2939260 - RNA, 17 nt, Mycobacterium avium subsp. paratuberculosis
cggcgaucgggucaccg

SEQ ID NO: 2939261 - RNA, 22 nt, Mycobacterium avium subsp. paratuberculosis
cggcgaucgggucaccggccga

SEQ ID NO: 2939262 - RNA, 14 nt, Mycobacterium avium subsp. paratuberculosis
cggcgaucgucgcc

SEQ ID NO: 2939263 - RNA, 18 nt, Mycobacterium avium subsp. paratuberculosis
cggcgaucgucgccguca

SEQ ID NO: 2939264 - RNA, 19 nt, Mycobacterium avium subsp. paratuberculosis
cggcgauguaggacgccgc

SEQ ID NO: 2939265 - RNA, 20 nt, Mycobacterium avium subsp. paratuberculosis
cggcgauguaggacgccgca

SEQ ID NO: 2939266 - RNA, 22 nt, Mycobacterium avium subsp. paratuberculosis
cggcgauguaggacgccgcacc

SEQ ID NO: 2939267 - RNA, 23 nt, Mycobacterium avium subsp. paratuberculosis
cggcgauguaggacgccgcaccg

SEQ ID NO: 2939268 - RNA, 20 nt, Mycobacterium avium subsp. paratuberculosis
cggcgauguccuugucgcuc

SEQ ID NO: 2939269 - RNA, 15 nt, Mycobacterium avium subsp. paratuberculosis
cggcgaugucgaagc

SEQ ID NO: 2939270 - RNA, 16 nt, Mycobacterium avium subsp. paratuberculosis
cggcgaugucgaagcc

SEQ ID NO: 2939271 - RNA, 23 nt, Mycobacterium avium subsp. paratuberculosis
cggcgaugucgaagcccuucacc

SEQ ID NO: 2939272 - RNA, 14 nt, Mycobacterium avium subsp. paratuberculosis
cggcgaugucgucg

SEQ ID NO: 2939273 - RNA, 15 nt, Mycobacterium avium subsp. paratuberculosis
cggcgaugucgucga

SEQ ID NO: 2939274 - RNA, 18 nt, Mycobacterium avium subsp. paratuberculosis
cggcgaugucgucgacgc

SEQ ID NO: 2939275 - RNA, 16 nt, Mycobacterium avium subsp. paratuberculosis
cggcgauguggcguuc

SEQ ID NO: 2939276 - RNA, 15 nt, Mycobacterium avium subsp. paratuberculosis
cggcgauguugacca

SEQ ID NO: 2939277 - RNA, 20 nt, Mycobacterium avium subsp. paratuberculosis
cggcgauguugaccacccgc

SEQ ID NO: 2939278 - RNA, 23 nt, Mycobacterium avium subsp. paratuberculosis
cggcgauguugaccacccgcagc

SEQ ID NO: 2939279 - RNA, 15 nt, Mycobacterium avium subsp. paratuberculosis
cggcgauuucggccg

SEQ ID NO: 2939280 - RNA, 21 nt, Mycobacterium avium subsp. paratuberculosis
cggcgcaaccaacucgcgaug

SEQ ID NO: 2939281 - RNA, 16 nt, Mycobacterium avium subsp. paratuberculosis
cggcgcaaccucuucg

SEQ ID NO: 2939282 - RNA, 22 nt, Mycobacterium avium subsp. paratuberculosis
cggcgcaacgggauggcucagc

SEQ ID NO: 2939283 - RNA, 22 nt, Mycobacterium avium subsp. paratuberculosis
cggcgcaaucggggccgacccg

SEQ ID NO: 2939284 - RNA, 22 nt, Mycobacterium avium subsp. paratuberculosis
cggcgcacagcuaggucguggc

SEQ ID NO: 2939285 - RNA, 21 nt, Mycobacterium avium subsp. paratuberculosis
cggcgcacaggaacgcgucga

SEQ ID NO: 2939286 - RNA, 23 nt, Mycobacterium avium subsp. paratuberculosis
cggcgcacaggaacgcgucgacc

SEQ ID NO: 2939287 - RNA, 19 nt, Mycobacterium avium subsp. paratuberculosis
cggcgcacaucguggcgac

SEQ ID NO: 2939288 - RNA, 23 nt, Mycobacterium avium subsp. paratuberculosis
cggcgcacaucguggcgacgacg

SEQ ID NO: 2939289 - RNA, 20 nt, Mycobacterium avium subsp. paratuberculosis
cggcgcaccaaccggccccg

SEQ ID NO: 2939290 - RNA, 12 nt, Mycobacterium avium subsp. paratuberculosis
cggcgcaccagg

SEQ ID NO: 2939291 - RNA, 14 nt, Mycobacterium avium subsp. paratuberculosis
cggcgcaccaggcg

SEQ ID NO: 2939292 - RNA, 20 nt, Mycobacterium avium subsp. paratuberculosis
cggcgcaccaggcgccacag

SEQ ID NO: 2939293 - RNA, 22 nt, Mycobacterium avium subsp. paratuberculosis
cggcgcaccaggcgccacagca

SEQ ID NO: 2939294 - RNA, 23 nt, Mycobacterium avium subsp. paratuberculosis
cggcgcaccagggugucgucgcg

SEQ ID NO: 2939295 - RNA, 13 nt, Mycobacterium avium subsp. paratuberculosis
cggcgcaccccga

SEQ ID NO: 2939296 - RNA, 15 nt, Mycobacterium avium subsp. paratuberculosis
cggcgcaccccgaac

SEQ ID NO: 2939297 - RNA, 16 nt, Mycobacterium avium subsp. paratuberculosis
cggcgcacccgcacga

SEQ ID NO: 2939298 - RNA, 13 nt, Mycobacterium avium subsp. paratuberculosis
cggcgcacccggg

SEQ ID NO: 2939299 - RNA, 14 nt, Mycobacterium avium subsp. paratuberculosis
cggcgcacccgggc

SEQ ID NO: 2939300 - RNA, 16 nt, Mycobacterium avium subsp. paratuberculosis
cggcgcacccgggcag

SEQ ID NO: 2939301 - RNA, 16 nt, Mycobacterium avium subsp. paratuberculosis
cggcgcaccgagucgg

SEQ ID NO: 2939302 - RNA, 13 nt, Mycobacterium avium subsp. paratuberculosis
cggcgcaccgccc

SEQ ID NO: 2939303 - RNA, 15 nt, Mycobacterium avium subsp. paratuberculosis
cggcgcaccgcccgc

SEQ ID NO: 2939304 - RNA, 17 nt, Mycobacterium avium subsp. paratuberculosis
cggcgcaccgcccgcgg

SEQ ID NO: 2939305 - RNA, 18 nt, Mycobacterium avium subsp. paratuberculosis
cggcgcaccgcccgcggu

SEQ ID NO: 2939306 - RNA, 19 nt, Mycobacterium avium subsp. paratuberculosis
cggcgcaccgcccgcggug

SEQ ID NO: 2939307 - RNA, 16 nt, Mycobacterium avium subsp. paratuberculosis
cggcgcaccgcgucga

SEQ ID NO: 2939308 - RNA, 23 nt, Mycobacterium avium subsp. paratuberculosis
cggcgcaccgcgucgaccaccgc

SEQ ID NO: 2939309 - RNA, 13 nt, Mycobacterium avium subsp. paratuberculosis
cggcgcaccgugu

SEQ ID NO: 2939310 - RNA, 15 nt, Mycobacterium avium subsp. paratuberculosis
cggcgcaccgugucg

SEQ ID NO: 2939311 - RNA, 13 nt, Mycobacterium avium subsp. paratuberculosis
cggcgcaccuggc

SEQ ID NO: 2939312 - RNA, 14 nt, Mycobacterium avium subsp. paratuberculosis
cggcgcaccuggcg

SEQ ID NO: 2939313 - RNA, 15 nt, Mycobacterium avium subsp. paratuberculosis
cggcgcaccuggcgc

SEQ ID NO: 2939314 - RNA, 18 nt, Mycobacterium avium subsp. paratuberculosis
cggcgcaccuggcgcagc

SEQ ID NO: 2939315 - RNA, 21 nt, Mycobacterium avium subsp. paratuberculosis
cggcgcaccuggcgcagcacc

SEQ ID NO: 2939316 - RNA, 17 nt, Mycobacterium avium subsp. paratuberculosis
cggcgcacgcagugccg

SEQ ID NO: 2939317 - RNA, 21 nt, Mycobacterium avium subsp. paratuberculosis
cggcgcacgcagugccgcacc

SEQ ID NO: 2939318 - RNA, 22 nt, Mycobacterium avium subsp. paratuberculosis
cggcgcacgcagugccgcacca

SEQ ID NO: 2939319 - RNA, 22 nt, Mycobacterium avium subsp. paratuberculosis
cggcgcacgcuuuuucgcgaac

SEQ ID NO: 2939320 - RNA, 14 nt, Mycobacterium avium subsp. paratuberculosis
cggcgcacggugcc

SEQ ID NO: 2939321 - RNA, 15 nt, Mycobacterium avium subsp. paratuberculosis
cggcgcacggugccc

SEQ ID NO: 2939322 - RNA, 20 nt, Mycobacterium avium subsp. paratuberculosis
cggcgcacggugcccgucgg

SEQ ID NO: 2939323 - RNA, 21 nt, Mycobacterium avium subsp. paratuberculosis
cggcgcacggugcccgucggc

SEQ ID NO: 2939324 - RNA, 22 nt, Mycobacterium avium subsp. paratuberculosis
cggcgcacggugcccgucggca

SEQ ID NO: 2939325 - RNA, 12 nt, Mycobacterium avium subsp. paratuberculosis
cggcgcacgugg

SEQ ID NO: 2939326 - RNA, 19 nt, Mycobacterium avium subsp. paratuberculosis
cggcgcacguggcugaccg

SEQ ID NO: 2939327 - RNA, 23 nt, Mycobacterium avium subsp. paratuberculosis
cggcgcacguggcugaccgacgg

SEQ ID NO: 2939328 - RNA, 15 nt, Mycobacterium avium subsp. paratuberculosis
cggcgcacuccauca

SEQ ID NO: 2939329 - RNA, 17 nt, Mycobacterium avium subsp. paratuberculosis
cggcgcacuccaucacg

SEQ ID NO: 2939330 - RNA, 22 nt, Mycobacterium avium subsp. paratuberculosis
cggcgcacuccaucacgaccuc

SEQ ID NO: 2939331 - RNA, 18 nt, Mycobacterium avium subsp. paratuberculosis
cggcgcagaugaccggcc

SEQ ID NO: 2939332 - RNA, 21 nt, Mycobacterium avium subsp. paratuberculosis
cggcgcagaugaccggccugc

SEQ ID NO: 2939333 - RNA, 23 nt, Mycobacterium avium subsp. paratuberculosis
cggcgcagaugaccggccugcag

SEQ ID NO: 2939334 - RNA, 16 nt, Mycobacterium avium subsp. paratuberculosis
cggcgcagcacggcca

SEQ ID NO: 2939335 - RNA, 18 nt, Mycobacterium avium subsp. paratuberculosis
cggcgcagccagcgccgc

SEQ ID NO: 2939336 - RNA, 15 nt, Mycobacterium avium subsp. paratuberculosis
cggcgcagccagcuc

SEQ ID NO: 2939337 - RNA, 15 nt, Mycobacterium avium subsp. paratuberculosis
cggcgcagccggcca

SEQ ID NO: 2939338 - RNA, 20 nt, Mycobacterium avium subsp. paratuberculosis
cggcgcagcgcacgucgccg

SEQ ID NO: 2939339 - RNA, 21 nt, Mycobacterium avium subsp. paratuberculosis
cggcgcagcgcacgucgccgc

SEQ ID NO: 2939340 - RNA, 14 nt, Mycobacterium avium subsp. paratuberculosis
cggcgcagcgccgc

SEQ ID NO: 2939341 - RNA, 18 nt, Mycobacterium avium subsp. paratuberculosis
cggcgcagcgccgcgccg

SEQ ID NO: 2939342 - RNA, 19 nt, Mycobacterium avium subsp. paratuberculosis
cggcgcagcgccgcgccga

SEQ ID NO: 2939343 - RNA, 20 nt, Mycobacterium avium subsp. paratuberculosis
cggcgcagcgccgcgccgac

SEQ ID NO: 2939344 - RNA, 22 nt, Mycobacterium avium subsp. paratuberculosis
cggcgcagcgccgcgccgaccu

SEQ ID NO: 2939345 - RNA, 13 nt, Mycobacterium avium subsp. paratuberculosis
cggcgcagcgcga

SEQ ID NO: 2939346 - RNA, 14 nt, Mycobacterium avium subsp. paratuberculosis
cggcgcagcgcgau

SEQ ID NO: 2939347 - RNA, 15 nt, Mycobacterium avium subsp. paratuberculosis
cggcgcagcgcgaug

SEQ ID NO: 2939348 - RNA, 17 nt, Mycobacterium avium subsp. paratuberculosis
cggcgcccacagcaggu

SEQ ID NO: 2939349 - RNA, 13 nt, Mycobacterium avium subsp. paratuberculosis
cggcgcccaccgc

SEQ ID NO: 2939350 - RNA, 16 nt, Mycobacterium avium subsp. paratuberculosis
cggcgcccaccgcggc

SEQ ID NO: 2939351 - RNA, 18 nt, Mycobacterium avium subsp. paratuberculosis
cggcgcccaccgcggcgc

SEQ ID NO: 2939352 - RNA, 23 nt, Mycobacterium avium subsp. paratuberculosis
cggcgcccaccgcggcgcgcggc

SEQ ID NO: 2939353 - RNA, 22 nt, Mycobacterium avium subsp. paratuberculosis
cggcgcccacggccaccacggc

SEQ ID NO: 2939354 - RNA, 13 nt, Mycobacterium avium subsp. paratuberculosis
cggcgcccagauc

SEQ ID NO: 2939355 - RNA, 19 nt, Mycobacterium avium subsp. paratuberculosis
cggcgcccagaucggccag

SEQ ID NO: 2939356 - RNA, 13 nt, Mycobacterium avium subsp. paratuberculosis
cggcgcccagcgg

SEQ ID NO: 2939357 - RNA, 16 nt, Mycobacterium avium subsp. paratuberculosis
cggcgcccagcggcga

SEQ ID NO: 2939358 - RNA, 17 nt, Mycobacterium avium subsp. paratuberculosis
cggcgcccagcggcgau

SEQ ID NO: 2939359 - RNA, 20 nt, Mycobacterium avium subsp. paratuberculosis
cggcgcccagcggcgaugcc

SEQ ID NO: 2939360 - RNA, 22 nt, Mycobacterium avium subsp. paratuberculosis
cggcgcccaggauucucagcag

SEQ ID NO: 2939361 - RNA, 22 nt, Mycobacterium avium subsp. paratuberculosis
cggcgcccagguccaccaggug

SEQ ID NO: 2939362 - RNA, 13 nt, Mycobacterium avium subsp. paratuberculosis
cggcgccccacgc

SEQ ID NO: 2939363 - RNA, 14 nt, Mycobacterium avium subsp. paratuberculosis
cggcgccccacgcc

SEQ ID NO: 2939364 - RNA, 16 nt, Mycobacterium avium subsp. paratuberculosis
cggcgccccacgccug

SEQ ID NO: 2939365 - RNA, 18 nt, Mycobacterium avium subsp. paratuberculosis
cggcgccccacgccuggc

SEQ ID NO: 2939366 - RNA, 19 nt, Mycobacterium avium subsp. paratuberculosis
cggcgccccacgccuggcg

SEQ ID NO: 2939367 - RNA, 18 nt, Mycobacterium avium subsp. paratuberculosis
cggcgccccccugcucgc

SEQ ID NO: 2939368 - RNA, 15 nt, Mycobacterium avium subsp. paratuberculosis
cggcgcccccgcgac

SEQ ID NO: 2939369 - RNA, 16 nt, Mycobacterium avium subsp. paratuberculosis
cggcgcccccgcgacg

SEQ ID NO: 2939370 - RNA, 15 nt, Mycobacterium avium subsp. paratuberculosis
cggcgccccgcccgc

SEQ ID NO: 2939371 - RNA, 17 nt, Mycobacterium avium subsp. paratuberculosis
cggcgccccgcccgcga

SEQ ID NO: 2939372 - RNA, 22 nt, Mycobacterium avium subsp. paratuberculosis
cggcgccccgcccgcgacuguc

SEQ ID NO: 2939373 - RNA, 15 nt, Mycobacterium avium subsp. paratuberculosis
cggcgccccggcgcu

SEQ ID NO: 2939374 - RNA, 16 nt, Mycobacterium avium subsp. paratuberculosis
cggcgccccggcgcug

SEQ ID NO: 2939375 - RNA, 17 nt, Mycobacterium avium subsp. paratuberculosis
cggcgccccggcgcuga

SEQ ID NO: 2939376 - RNA, 12 nt, Mycobacterium avium subsp. paratuberculosis
cggcgccccggg

SEQ ID NO: 2939377 - RNA, 13 nt, Mycobacterium avium subsp. paratuberculosis
cggcgccccgggc

SEQ ID NO: 2939378 - RNA, 16 nt, Mycobacterium avium subsp. paratuberculosis
cggcgccccgggcagc

SEQ ID NO: 2939379 - RNA, 13 nt, Mycobacterium avium subsp. paratuberculosis
cggcgcccgaucg

SEQ ID NO: 2939380 - RNA, 14 nt, Mycobacterium avium subsp. paratuberculosis
cggcgcccgaucgg

SEQ ID NO: 2939381 - RNA, 15 nt, Mycobacterium avium subsp. paratuberculosis
cggcgcccgaucggc

SEQ ID NO: 2939382 - RNA, 19 nt, Mycobacterium avium subsp. paratuberculosis
cggcgcccgcaggccgcga

SEQ ID NO: 2939383 - RNA, 14 nt, Mycobacterium avium subsp. paratuberculosis
cggcgcccgccccg

SEQ ID NO: 2939384 - RNA, 16 nt, Mycobacterium avium subsp. paratuberculosis
cggcgcccgccccgac

SEQ ID NO: 2939385 - RNA, 16 nt, Mycobacterium avium subsp. paratuberculosis
cggcgcccgcuccggc

SEQ ID NO: 2939386 - RNA, 18 nt, Mycobacterium avium subsp. paratuberculosis
cggcgcccgcuccggcgg

SEQ ID NO: 2939387 - RNA, 19 nt, Mycobacterium avium subsp. paratuberculosis
cggcgcccgcuccggcgga

SEQ ID NO: 2939388 - RNA, 13 nt, Mycobacterium avium subsp. paratuberculosis
cggcgcccggcac

SEQ ID NO: 2939389 - RNA, 16 nt, Mycobacterium avium subsp. paratuberculosis
cggcgcccggcaccgg

SEQ ID NO: 2939390 - RNA, 18 nt, Mycobacterium avium subsp. paratuberculosis
cggcgcccggcaccggga

SEQ ID NO: 2939391 - RNA, 19 nt, Mycobacterium avium subsp. paratuberculosis
cggcgcccggcccagccgc

SEQ ID NO: 2939392 - RNA, 13 nt, Mycobacterium avium subsp. paratuberculosis
cggcgcccggccg

SEQ ID NO: 2939393 - RNA, 15 nt, Mycobacterium avium subsp. paratuberculosis
cggcgcccggccggc

SEQ ID NO: 2939394 - RNA, 17 nt, Mycobacterium avium subsp. paratuberculosis
cggcgcccggccggugc

SEQ ID NO: 2939395 - RNA, 16 nt, Mycobacterium avium subsp. paratuberculosis
cggcgcccggcgcgcc

SEQ ID NO: 2939396 - RNA, 17 nt, Mycobacterium avium subsp. paratuberculosis
cggcgcccggcgcgcca

SEQ ID NO: 2939397 - RNA, 18 nt, Mycobacterium avium subsp. paratuberculosis
cggcgcccggcgcgccac

SEQ ID NO: 2939398 - RNA, 12 nt, Mycobacterium avium subsp. paratuberculosis
cggcgcccggcu

SEQ ID NO: 2939399 - RNA, 16 nt, Mycobacterium avium subsp. paratuberculosis
cggcgcccgucacgcu

SEQ ID NO: 2939400 - RNA, 17 nt, Mycobacterium avium subsp. paratuberculosis
cggcgcccgucacgcug

SEQ ID NO: 2939401 - RNA, 18 nt, Mycobacterium avium subsp. paratuberculosis
cggcgcccgucacgcugg

SEQ ID NO: 2939402 - RNA, 21 nt, Mycobacterium avium subsp. paratuberculosis
cggcgcccgucacgcuggcgu

SEQ ID NO: 2939403 - RNA, 23 nt, Mycobacterium avium subsp. paratuberculosis
cggcgcccgucacgcuggcguga

SEQ ID NO: 2939404 - RNA, 16 nt, Mycobacterium avium subsp. paratuberculosis
cggcgcccucgaugcg

SEQ ID NO: 2939405 - RNA, 21 nt, Mycobacterium avium subsp. paratuberculosis
cggcgcccucgaugcgcaccg

SEQ ID NO: 2939406 - RNA, 23 nt, Mycobacterium avium subsp. paratuberculosis
cggcgcccucgaugcgcaccgug

SEQ ID NO: 2939407 - RNA, 14 nt, Mycobacterium avium subsp. paratuberculosis
cggcgcccucgccg

SEQ ID NO: 2939408 - RNA, 19 nt, Mycobacterium avium subsp. paratuberculosis
cggcgcccucgccgaccug

SEQ ID NO: 2939409 - RNA, 16 nt, Mycobacterium avium subsp. paratuberculosis
cggcgcccucgccggc

SEQ ID NO: 2939410 - RNA, 18 nt, Mycobacterium avium subsp. paratuberculosis
cggcgcccucgccggcgg

SEQ ID NO: 2939411 - RNA, 21 nt, Mycobacterium avium subsp. paratuberculosis
cggcgcccucgccggcggcgc

SEQ ID NO: 2939412 - RNA, 12 nt, Mycobacterium avium subsp. paratuberculosis
cggcgcccucgg

SEQ ID NO: 2939413 - RNA, 13 nt, Mycobacterium avium subsp. paratuberculosis
cggcgcccucggc

SEQ ID NO: 2939414 - RNA, 18 nt, Mycobacterium avium subsp. paratuberculosis
cggcgcccucggcgaucu

SEQ ID NO: 2939415 - RNA, 19 nt, Mycobacterium avium subsp. paratuberculosis
cggcgcccucggcgaucuc

SEQ ID NO: 2939416 - RNA, 20 nt, Mycobacterium avium subsp. paratuberculosis
cggcgcccugcacccagccg

SEQ ID NO: 2939417 - RNA, 16 nt, Mycobacterium avium subsp. paratuberculosis
cggcgcccuucccggu

SEQ ID NO: 2939418 - RNA, 19 nt, Mycobacterium avium subsp. paratuberculosis
cggcgcccuucccggucgg

SEQ ID NO: 2939419 - RNA, 13 nt, Mycobacterium avium subsp. paratuberculosis
cggcgcccuucgg

SEQ ID NO: 2939420 - RNA, 20 nt, Mycobacterium avium subsp. paratuberculosis
cggcgcccuucggcgcccgc

SEQ ID NO: 2939421 - RNA, 20 nt, Mycobacterium avium subsp. paratuberculosis
cggcgccgaaaaacgcgacg

SEQ ID NO: 2939422 - RNA, 21 nt, Mycobacterium avium subsp. paratuberculosis
cggcgccgaaaaacgcgacgg

SEQ ID NO: 2939423 - RNA, 22 nt, Mycobacterium avium subsp. paratuberculosis
cggcgccgaaaaacgcgacggc

SEQ ID NO: 2939424 - RNA, 23 nt, Mycobacterium avium subsp. paratuberculosis
cggcgccgaaaaacgcgacggcc

SEQ ID NO: 2939425 - RNA, 14 nt, Mycobacterium avium subsp. paratuberculosis
cggcgccgaaccgg

SEQ ID NO: 2939426 - RNA, 23 nt, Mycobacterium avium subsp. paratuberculosis
cggcgccgaaccgggugacgacc

SEQ ID NO: 2939427 - RNA, 15 nt, Mycobacterium avium subsp. paratuberculosis
cggcgccgaacucgg

SEQ ID NO: 2939428 - RNA, 20 nt, Mycobacterium avium subsp. paratuberculosis
cggcgccgaacucggcgccg

SEQ ID NO: 2939429 - RNA, 14 nt, Mycobacterium avium subsp. paratuberculosis
cggcgccgaagccg

SEQ ID NO: 2939430 - RNA, 15 nt, Mycobacterium avium subsp. paratuberculosis
cggcgccgaagccgu

SEQ ID NO: 2939431 - RNA, 19 nt, Mycobacterium avium subsp. paratuberculosis
cggcgccgaagccgucgac

SEQ ID NO: 2939432 - RNA, 20 nt, Mycobacterium avium subsp. paratuberculosis
cggcgccgaagccgucgacc

SEQ ID NO: 2939433 - RNA, 14 nt, Mycobacterium avium subsp. paratuberculosis
cggcgccggcgcgc

SEQ ID NO: 2939434 - RNA, 14 nt, Mycobacterium avium subsp. paratuberculosis
cggcgccggcgguc

SEQ ID NO: 2939435 - RNA, 15 nt, Mycobacterium avium subsp. paratuberculosis
cggcgccggcgguca

SEQ ID NO: 2939436 - RNA, 17 nt, Mycobacterium avium subsp. paratuberculosis
cggcgccggcggucagc

SEQ ID NO: 2939437 - RNA, 21 nt, Mycobacterium avium subsp. paratuberculosis
cggcgccggcggucagcucag

SEQ ID NO: 2939438 - RNA, 19 nt, Mycobacterium avium subsp. paratuberculosis
cggcgccgggaucggcagc

SEQ ID NO: 2939439 - RNA, 21 nt, Mycobacterium avium subsp. paratuberculosis
cggcgccgggaucggcagcgc

SEQ ID NO: 2939440 - RNA, 23 nt, Mycobacterium avium subsp. paratuberculosis
cggcgccgggaucggcagcgcgc

SEQ ID NO: 2939441 - RNA, 18 nt, Mycobacterium avium subsp. paratuberculosis
cggcgccgggcagcccgg

SEQ ID NO: 2939442 - RNA, 20 nt, Mycobacterium avium subsp. paratuberculosis
cggcgccgggcagcccgggu

SEQ ID NO: 2939443 - RNA, 21 nt, Mycobacterium avium subsp. paratuberculosis
cggcgccgggcagcccggguc

SEQ ID NO: 2939444 - RNA, 14 nt, Mycobacterium avium subsp. paratuberculosis
cggcgccgggcggc

SEQ ID NO: 2939445 - RNA, 20 nt, Mycobacterium avium subsp. paratuberculosis
cggcgccgggcggcccgccu

SEQ ID NO: 2939446 - RNA, 21 nt, Mycobacterium avium subsp. paratuberculosis
cggcgccgggcgggcgcaggu

SEQ ID NO: 2939447 - RNA, 13 nt, Mycobacterium avium subsp. paratuberculosis
cggcgccggggcu

SEQ ID NO: 2939448 - RNA, 12 nt, Mycobacterium avium subsp. paratuberculosis
cggcgccggguc

SEQ ID NO: 2939449 - RNA, 23 nt, Mycobacterium avium subsp. paratuberculosis
cggcgccgggucaccggaugcac

SEQ ID NO: 2939450 - RNA, 13 nt, Mycobacterium avium subsp. paratuberculosis
cggcgccgggucg

SEQ ID NO: 2939451 - RNA, 14 nt, Mycobacterium avium subsp. paratuberculosis
cggcgccgggucgc

SEQ ID NO: 2939452 - RNA, 16 nt, Mycobacterium avium subsp. paratuberculosis
cggcgccgggucgcgg

SEQ ID NO: 2939453 - RNA, 17 nt, Mycobacterium avium subsp. paratuberculosis
cggcgccgggucgcggu

SEQ ID NO: 2939454 - RNA, 22 nt, Mycobacterium avium subsp. paratuberculosis
cggcgccgguauauucgcgaug

SEQ ID NO: 2939455 - RNA, 17 nt, Mycobacterium avium subsp. paratuberculosis
cggcgccggucagcggc

SEQ ID NO: 2939456 - RNA, 18 nt, Mycobacterium avium subsp. paratuberculosis
cggcgccggucagcggca

SEQ ID NO: 2939457 - RNA, 19 nt, Mycobacterium avium subsp. paratuberculosis
cggcgccggucagcggcaa

SEQ ID NO: 2939458 - RNA, 20 nt, Mycobacterium avium subsp. paratuberculosis
cggcgccggucagcggcaac

SEQ ID NO: 2939459 - RNA, 15 nt, Mycobacterium avium subsp. paratuberculosis
cggcgccggucguua

SEQ ID NO: 2939460 - RNA, 13 nt, Mycobacterium avium subsp. paratuberculosis
cggcgccggugcc

SEQ ID NO: 2939461 - RNA, 16 nt, Mycobacterium avium subsp. paratuberculosis
cggcgccggugcccac

SEQ ID NO: 2939462 - RNA, 18 nt, Mycobacterium avium subsp. paratuberculosis
cggcgccggugccgcagc

SEQ ID NO: 2939463 - RNA, 20 nt, Mycobacterium avium subsp. paratuberculosis
cggcgccggugccgcagccg

SEQ ID NO: 2939464 - RNA, 13 nt, Mycobacterium avium subsp. paratuberculosis
cggcgccgguggu

SEQ ID NO: 2939465 - RNA, 20 nt, Mycobacterium avium subsp. paratuberculosis
cggcgccgguggugucgacg

SEQ ID NO: 2939466 - RNA, 21 nt, Mycobacterium avium subsp. paratuberculosis
cggcgccgguggugucgacgg

SEQ ID NO: 2939467 - RNA, 19 nt, Mycobacterium avium subsp. paratuberculosis
cggcgccguagguggccau

SEQ ID NO: 2939468 - RNA, 17 nt, Mycobacterium avium subsp. paratuberculosis
cggcgccguccagcucg

SEQ ID NO: 2939469 - RNA, 18 nt, Mycobacterium avium subsp. paratuberculosis
cggcgccguccagcucgc

SEQ ID NO: 2939470 - RNA, 21 nt, Mycobacterium avium subsp. paratuberculosis
cggcgccguccuccucgucgg

SEQ ID NO: 2939471 - RNA, 14 nt, Mycobacterium avium subsp. paratuberculosis
cggcgccgucgaac

SEQ ID NO: 2939472 - RNA, 17 nt, Mycobacterium avium subsp. paratuberculosis
cggcgccgucgaccagc

SEQ ID NO: 2939473 - RNA, 13 nt, Mycobacterium avium subsp. paratuberculosis
cggcgccgucgcc

SEQ ID NO: 2939474 - RNA, 14 nt, Mycobacterium avium subsp. paratuberculosis
cggcgccgucgccg

SEQ ID NO: 2939475 - RNA, 15 nt, Mycobacterium avium subsp. paratuberculosis
cggcgccgucgccga

SEQ ID NO: 2939476 - RNA, 14 nt, Mycobacterium avium subsp. paratuberculosis
cggcgccgucgcgg

SEQ ID NO: 2939477 - RNA, 14 nt, Mycobacterium avium subsp. paratuberculosis
cggcgccgucgucg

SEQ ID NO: 2939478 - RNA, 23 nt, Mycobacterium avium subsp. paratuberculosis
cggcgccgucguucuccauccgg

SEQ ID NO: 2939479 - RNA, 22 nt, Mycobacterium avium subsp. paratuberculosis
cggcgccgugccgcgcggcgau

SEQ ID NO: 2939480 - RNA, 15 nt, Mycobacterium avium subsp. paratuberculosis
cggcgccguugaccg

SEQ ID NO: 2939481 - RNA, 17 nt, Mycobacterium avium subsp. paratuberculosis
cggcgccguugaccggc

SEQ ID NO: 2939482 - RNA, 18 nt, Mycobacterium avium subsp. paratuberculosis
cggcgccguugaccggcc

SEQ ID NO: 2939483 - RNA, 19 nt, Mycobacterium avium subsp. paratuberculosis
cggcgccguugaccggccg

SEQ ID NO: 2939484 - RNA, 22 nt, Mycobacterium avium subsp. paratuberculosis
cggcgccguuucggacgagccg

SEQ ID NO: 2939485 - RNA, 23 nt, Mycobacterium avium subsp. paratuberculosis
cggcgccguuucggacgagccgu

SEQ ID NO: 2939486 - RNA, 15 nt, Mycobacterium avium subsp. paratuberculosis
cggcgccucgaugcg

SEQ ID NO: 2939487 - RNA, 19 nt, Mycobacterium avium subsp. paratuberculosis
cggcgccucggcgccucgg

SEQ ID NO: 2939488 - RNA, 21 nt, Mycobacterium avium subsp. paratuberculosis
cggcgccucggcgccucggcg

SEQ ID NO: 2939489 - RNA, 14 nt, Mycobacterium avium subsp. paratuberculosis
cggcgccucggcgu

SEQ ID NO: 2939490 - RNA, 13 nt, Mycobacterium avium subsp. paratuberculosis
cggcgccugguag

SEQ ID NO: 2939491 - RNA, 20 nt, Mycobacterium avium subsp. paratuberculosis
cggcgccuugaaccggcugg

SEQ ID NO: 2939492 - RNA, 16 nt, Mycobacterium avium subsp. paratuberculosis
cggcgccuugccgguc

SEQ ID NO: 2939493 - RNA, 15 nt, Mycobacterium avium subsp. paratuberculosis
cggcgccuugguccg

SEQ ID NO: 2939494 - RNA, 16 nt, Mycobacterium avium subsp. paratuberculosis
cggcgcgaaccgggcc

SEQ ID NO: 2939495 - RNA, 18 nt, Mycobacterium avium subsp. paratuberculosis
cggcgcgaaccgggccag

SEQ ID NO: 2939496 - RNA, 20 nt, Mycobacterium avium subsp. paratuberculosis
cggcgcgaaccgggccagga

SEQ ID NO: 2939497 - RNA, 22 nt, Mycobacterium avium subsp. paratuberculosis
cggcgcgaaccgggccaggaug

SEQ ID NO: 2939498 - RNA, 17 nt, Mycobacterium avium subsp. paratuberculosis
cggcgcgaagucgagca

SEQ ID NO: 2939499 - RNA, 23 nt, Mycobacterium avium subsp. paratuberculosis
cggcgcgaagucgagcagguucu

SEQ ID NO: 2939500 - RNA, 16 nt, Mycobacterium avium subsp. paratuberculosis
cggcgcgacaccgcgg

SEQ ID NO: 2939501 - RNA, 17 nt, Mycobacterium avium subsp. paratuberculosis
cggcgcgacaccgcggc

SEQ ID NO: 2939502 - RNA, 19 nt, Mycobacterium avium subsp. paratuberculosis
cggcgcgacaccgcggcga

SEQ ID NO: 2939503 - RNA, 14 nt, Mycobacterium avium subsp. paratuberculosis
cggcgcgaccagcg

SEQ ID NO: 2939504 - RNA, 15 nt, Mycobacterium avium subsp. paratuberculosis
cggcgcgaccagcgg

SEQ ID NO: 2939505 - RNA, 17 nt, Mycobacterium avium subsp. paratuberculosis
cggcgcgaccagcggca

SEQ ID NO: 2939506 - RNA, 22 nt, Mycobacterium avium subsp. paratuberculosis
cggcgcgaccagcggcagcagc

SEQ ID NO: 2939507 - RNA, 13 nt, Mycobacterium avium subsp. paratuberculosis
cggcgcgacggca

SEQ ID NO: 2939508 - RNA, 14 nt, Mycobacterium avium subsp. paratuberculosis
cggcgcgacggcgg

SEQ ID NO: 2939509 - RNA, 19 nt, Mycobacterium avium subsp. paratuberculosis
cggcgcgacggcggcgaag

SEQ ID NO: 2939510 - RNA, 13 nt, Mycobacterium avium subsp. paratuberculosis
cggcgcgaggacg

SEQ ID NO: 2939511 - RNA, 13 nt, Mycobacterium avium subsp. paratuberculosis
cggcgcgaggcgc

SEQ ID NO: 2939512 - RNA, 13 nt, Mycobacterium avium subsp. paratuberculosis
cggcgcgaucggc

SEQ ID NO: 2939513 - RNA, 15 nt, Mycobacterium avium subsp. paratuberculosis
cggcgcgaucggccg

SEQ ID NO: 2939514 - RNA, 19 nt, Mycobacterium avium subsp. paratuberculosis
cggcgcgaucggccgcugc

SEQ ID NO: 2939515 - RNA, 13 nt, Mycobacterium avium subsp. paratuberculosis
cggcgcgaucguc

SEQ ID NO: 2939516 - RNA, 14 nt, Mycobacterium avium subsp. paratuberculosis
cggcgcgaucgucg

SEQ ID NO: 2939517 - RNA, 15 nt, Mycobacterium avium subsp. paratuberculosis
cggcgcgaucgucga

SEQ ID NO: 2939518 - RNA, 17 nt, Mycobacterium avium subsp. paratuberculosis
cggcgcggaacagcguc

SEQ ID NO: 2939519 - RNA, 18 nt, Mycobacterium avium subsp. paratuberculosis
cggcgcggaacagcgucg

SEQ ID NO: 2939520 - RNA, 21 nt, Mycobacterium avium subsp. paratuberculosis
cggcgcggaacagcgucgccg

SEQ ID NO: 2939521 - RNA, 23 nt, Mycobacterium avium subsp. paratuberculosis
cggcgcggaacagcgucgccgac

SEQ ID NO: 2939522 - RNA, 24 nt, Mycobacterium avium subsp. paratuberculosis
cggcgcggaacagcgucgccgacg

SEQ ID NO: 2939523 - RNA, 15 nt, Mycobacterium avium subsp. paratuberculosis
cggcgcggacagcgc

SEQ ID NO: 2939524 - RNA, 17 nt, Mycobacterium avium subsp. paratuberculosis
cggcgcggacagcgcgg

SEQ ID NO: 2939525 - RNA, 18 nt, Mycobacterium avium subsp. paratuberculosis
cggcgcggacagcgcggu

SEQ ID NO: 2939526 - RNA, 23 nt, Mycobacterium avium subsp. paratuberculosis
cggcgcggacagcgcggugaugu

SEQ ID NO: 2939527 - RNA, 22 nt, Mycobacterium avium subsp. paratuberculosis
cggcgcggaccccagugcaggc

SEQ ID NO: 2939528 - RNA, 15 nt, Mycobacterium avium subsp. paratuberculosis
cggcgcggagccggc

SEQ ID NO: 2939529 - RNA, 16 nt, Mycobacterium avium subsp. paratuberculosis
cggcgcggagccggcc

SEQ ID NO: 2939530 - RNA, 17 nt, Mycobacterium avium subsp. paratuberculosis
cggcgcggagccggccg

SEQ ID NO: 2939531 - RNA, 21 nt, Mycobacterium avium subsp. paratuberculosis
cggcgcggagccggccgccga

SEQ ID NO: 2939532 - RNA, 12 nt, Mycobacterium avium subsp. paratuberculosis
cggcgcggagcg

SEQ ID NO: 2939533 - RNA, 15 nt, Mycobacterium avium subsp. paratuberculosis
cggcgcggagcgucg

SEQ ID NO: 2939534 - RNA, 20 nt, Mycobacterium avium subsp. paratuberculosis
cggcgcggagcgucgcgaug

SEQ ID NO: 2939535 - RNA, 16 nt, Mycobacterium avium subsp. paratuberculosis
cggcgcggaucgucac

SEQ ID NO: 2939536 - RNA, 18 nt, Mycobacterium avium subsp. paratuberculosis
cggcgcggaucgucaccg

SEQ ID NO: 2939537 - RNA, 16 nt, Mycobacterium avium subsp. paratuberculosis
cggcgcggaucucgcg

SEQ ID NO: 2939538 - RNA, 21 nt, Mycobacterium avium subsp. paratuberculosis
cggcgcggaucucgcgcaggu

SEQ ID NO: 2939539 - RNA, 17 nt, Mycobacterium avium subsp. paratuberculosis
cggcgcggaugacgugc

SEQ ID NO: 2939540 - RNA, 22 nt, Mycobacterium avium subsp. paratuberculosis
cggcgcggaugacgugcaccac

SEQ ID NO: 2939541 - RNA, 22 nt, Mycobacterium avium subsp. paratuberculosis
cggcgcggcaggaauuccagcg

SEQ ID NO: 2939542 - RNA, 16 nt, Mycobacterium avium subsp. paratuberculosis
cggcgcggcagggcca

SEQ ID NO: 2939543 - RNA, 19 nt, Mycobacterium avium subsp. paratuberculosis
cggcgcggcaguccgccgg

SEQ ID NO: 2939544 - RNA, 21 nt, Mycobacterium avium subsp. paratuberculosis
cggcgcggcaguccgccggag

SEQ ID NO: 2939545 - RNA, 19 nt, Mycobacterium avium subsp. paratuberculosis
cggcgcggcaucggcgacg

SEQ ID NO: 2939546 - RNA, 15 nt, Mycobacterium avium subsp. paratuberculosis
cggcgcggccacccc

SEQ ID NO: 2939547 - RNA, 16 nt, Mycobacterium avium subsp. paratuberculosis
cggcgcggccaccccg

SEQ ID NO: 2939548 - RNA, 15 nt, Mycobacterium avium subsp. paratuberculosis
cggcgcggccagcug

SEQ ID NO: 2939549 - RNA, 17 nt, Mycobacterium avium subsp. paratuberculosis
cggcgcggcccggcccg

SEQ ID NO: 2939550 - RNA, 20 nt, Mycobacterium avium subsp. paratuberculosis
cggcgcggcccggcccgcug

SEQ ID NO: 2939551 - RNA, 13 nt, Mycobacterium avium subsp. paratuberculosis
cggcgcggccgau

SEQ ID NO: 2939552 - RNA, 23 nt, Mycobacterium avium subsp. paratuberculosis
cggcgcggccgauucggcgccgc

SEQ ID NO: 2939553 - RNA, 14 nt, Mycobacterium avium subsp. paratuberculosis
cggcgcggccgccc

SEQ ID NO: 2939554 - RNA, 18 nt, Mycobacterium avium subsp. paratuberculosis
cggcgcggccgcccagcc

SEQ ID NO: 2939555 - RNA, 20 nt, Mycobacterium avium subsp. paratuberculosis
cggcgcggccgcccagcccg

SEQ ID NO: 2939556 - RNA, 13 nt, Mycobacterium avium subsp. paratuberculosis
cggcgcggccggu

SEQ ID NO: 2939557 - RNA, 12 nt, Mycobacterium avium subsp. paratuberculosis
cggcgcggcgac

SEQ ID NO: 2939558 - RNA, 17 nt, Mycobacterium avium subsp. paratuberculosis
cggcgcggcgacgugau

SEQ ID NO: 2939559 - RNA, 19 nt, Mycobacterium avium subsp. paratuberculosis
cggcgcggcgacgugaugg

SEQ ID NO: 2939560 - RNA, 14 nt, Mycobacterium avium subsp. paratuberculosis
cggcgcggcgcagc

SEQ ID NO: 2939561 - RNA, 18 nt, Mycobacterium avium subsp. paratuberculosis
cggcgcggcgcagcgcga

SEQ ID NO: 2939562 - RNA, 20 nt, Mycobacterium avium subsp. paratuberculosis
cggcgcggcgcagcgcgaug

SEQ ID NO: 2939563 - RNA, 13 nt, Mycobacterium avium subsp. paratuberculosis
cggcgcggcggcg

SEQ ID NO: 2939564 - RNA, 15 nt, Mycobacterium avium subsp. paratuberculosis
cggcgcggcggcgac

SEQ ID NO: 2939565 - RNA, 20 nt, Mycobacterium avium subsp. paratuberculosis
cggcgcggcggcgacgucga

SEQ ID NO: 2939566 - RNA, 21 nt, Mycobacterium avium subsp. paratuberculosis
cggcgcggcggcgacgucgac

SEQ ID NO: 2939567 - RNA, 17 nt, Mycobacterium avium subsp. paratuberculosis
cggcgcggcggcgccgc

SEQ ID NO: 2939568 - RNA, 13 nt, Mycobacterium avium subsp. paratuberculosis
cggcgcggcggug

SEQ ID NO: 2939569 - RNA, 14 nt, Mycobacterium avium subsp. paratuberculosis
cggcgcggcggugg

SEQ ID NO: 2939570 - RNA, 14 nt, Mycobacterium avium subsp. paratuberculosis
cggcgcggcucacg

SEQ ID NO: 2939571 - RNA, 22 nt, Mycobacterium avium subsp. paratuberculosis
cggcgcggcucacgacuccugg

SEQ ID NO: 2939572 - RNA, 21 nt, Mycobacterium avium subsp. paratuberculosis
cggcgcggcuuuuggcgucgu

SEQ ID NO: 2939573 - RNA, 22 nt, Mycobacterium avium subsp. paratuberculosis
cggcgcggcuuuuggcgucguu

SEQ ID NO: 2939574 - RNA, 16 nt, Mycobacterium avium subsp. paratuberculosis
cggcgcgggccagcag

SEQ ID NO: 2939575 - RNA, 14 nt, Mycobacterium avium subsp. paratuberculosis
cggcgcgggccgca

SEQ ID NO: 2939576 - RNA, 15 nt, Mycobacterium avium subsp. paratuberculosis
cggcgcgggccgcag

SEQ ID NO: 2939577 - RNA, 16 nt, Mycobacterium avium subsp. paratuberculosis
cggcgcgggccgcagc

SEQ ID NO: 2939578 - RNA, 18 nt, Mycobacterium avium subsp. paratuberculosis
cggcgcgggccgcagcgc

SEQ ID NO: 2939579 - RNA, 22 nt, Mycobacterium avium subsp. paratuberculosis
cggcgcgggcgauuucgucggc

SEQ ID NO: 2939580 - RNA, 14 nt, Mycobacterium avium subsp. paratuberculosis
cggcgcgggcgccc

SEQ ID NO: 2939581 - RNA, 15 nt, Mycobacterium avium subsp. paratuberculosis
cggcgcgggcggcgu

SEQ ID NO: 2939582 - RNA, 16 nt, Mycobacterium avium subsp. paratuberculosis
cggcgcgggcggcguc

SEQ ID NO: 2939583 - RNA, 17 nt, Mycobacterium avium subsp. paratuberculosis
cggcgcgggcggcgucg

SEQ ID NO: 2939584 - RNA, 20 nt, Mycobacterium avium subsp. paratuberculosis
cggcgcgggcggcgucggcg

SEQ ID NO: 2939585 - RNA, 13 nt, Mycobacterium avium subsp. paratuberculosis
cggcgcggggcca

SEQ ID NO: 2939586 - RNA, 13 nt, Mycobacterium avium subsp. paratuberculosis
cggcgcgggucgc

SEQ ID NO: 2939587 - RNA, 15 nt, Mycobacterium avium subsp. paratuberculosis
cggcgcgggucgcgg

SEQ ID NO: 2939588 - RNA, 19 nt, Mycobacterium avium subsp. paratuberculosis
cggcgcgggucgcuggccg

SEQ ID NO: 2939589 - RNA, 22 nt, Mycobacterium avium subsp. paratuberculosis
cggcgcgggucgcuggccgcga

SEQ ID NO: 2939590 - RNA, 12 nt, Mycobacterium avium subsp. paratuberculosis
cggcgcggucca

SEQ ID NO: 2939591 - RNA, 14 nt, Mycobacterium avium subsp. paratuberculosis
cggcgcgguccacg

SEQ ID NO: 2939592 - RNA, 20 nt, Mycobacterium avium subsp. paratuberculosis
cggcgcgguccacggucagc

SEQ ID NO: 2939593 - RNA, 21 nt, Mycobacterium avium subsp. paratuberculosis
cggcgcggucgcaggccgccc

SEQ ID NO: 2939594 - RNA, 22 nt, Mycobacterium avium subsp. paratuberculosis
cggcgcggucgcaggccgcccg

SEQ ID NO: 2939595 - RNA, 19 nt, Mycobacterium avium subsp. paratuberculosis
cggcgcggucgcaggcgag

SEQ ID NO: 2939596 - RNA, 16 nt, Mycobacterium avium subsp. paratuberculosis
cggcgcggugcgccga

SEQ ID NO: 2939597 - RNA, 17 nt, Mycobacterium avium subsp. paratuberculosis
cggcgcggugcgccgac

SEQ ID NO: 2939598 - RNA, 18 nt, Mycobacterium avium subsp. paratuberculosis
cggcgcggugcgccgaca

SEQ ID NO: 2939599 - RNA, 19 nt, Mycobacterium avium subsp. paratuberculosis
cggcgcggugcgccgacag

SEQ ID NO: 2939600 - RNA, 15 nt, Mycobacterium avium subsp. paratuberculosis
cggcgcggugcucgg

SEQ ID NO: 2939601 - RNA, 18 nt, Mycobacterium avium subsp. paratuberculosis
cggcgcggugcucggcgc

SEQ ID NO: 2939602 - RNA, 20 nt, Mycobacterium avium subsp. paratuberculosis
cggcgcggugcucggcgcgc

SEQ ID NO: 2939603 - RNA, 15 nt, Mycobacterium avium subsp. paratuberculosis
cggcgcugccggcgc

SEQ ID NO: 2939604 - RNA, 19 nt, Mycobacterium avium subsp. paratuberculosis
cggcgcugccggcgcaccc

SEQ ID NO: 2939605 - RNA, 13 nt, Mycobacterium avium subsp. paratuberculosis
cggcgcugccggu

SEQ ID NO: 2939606 - RNA, 15 nt, Mycobacterium avium subsp. paratuberculosis
cggcgcugcgcccgg

SEQ ID NO: 2939607 - RNA, 18 nt, Mycobacterium avium subsp. paratuberculosis
cggcgcuggccagcgcga

SEQ ID NO: 2939608 - RNA, 20 nt, Mycobacterium avium subsp. paratuberculosis
cggcgcuggccagcgcgacg

SEQ ID NO: 2939609 - RNA, 14 nt, Mycobacterium avium subsp. paratuberculosis
cggcgcuggccgcg

SEQ ID NO: 2939610 - RNA, 16 nt, Mycobacterium avium subsp. paratuberculosis
cggcgcuggccgcggc

SEQ ID NO: 2939611 - RNA, 19 nt, Mycobacterium avium subsp. paratuberculosis
cggcgcuggccgcggccag

SEQ ID NO: 2939612 - RNA, 22 nt, Mycobacterium avium subsp. paratuberculosis
cggcgcuggccgcggccagcug

SEQ ID NO: 2939613 - RNA, 15 nt, Mycobacterium avium subsp. paratuberculosis
cggcgcuggcgacca

SEQ ID NO: 2939614 - RNA, 21 nt, Mycobacterium avium subsp. paratuberculosis
cggcgcuggcgcgccguaccg

SEQ ID NO: 2939615 - RNA, 14 nt, Mycobacterium avium subsp. paratuberculosis
cggcgcuggcgugc

SEQ ID NO: 2939616 - RNA, 15 nt, Mycobacterium avium subsp. paratuberculosis
cggcgcuggcgugcu

SEQ ID NO: 2939617 - RNA, 12 nt, Mycobacterium avium subsp. paratuberculosis
cggcgcugguag

SEQ ID NO: 2939618 - RNA, 18 nt, Mycobacterium avium subsp. paratuberculosis
cggcgcuggucggcgggc

SEQ ID NO: 2939619 - RNA, 20 nt, Mycobacterium avium subsp. paratuberculosis
cggcgcuggucggcgggcag

SEQ ID NO: 2939620 - RNA, 23 nt, Mycobacterium avium subsp. paratuberculosis
cggcgcuggucggcgggcagcga

SEQ ID NO: 2939621 - RNA, 16 nt, Mycobacterium avium subsp. paratuberculosis
cggcgcugucggcggg

SEQ ID NO: 2939622 - RNA, 16 nt, Mycobacterium avium subsp. paratuberculosis
cggcgcuucugcgccg

SEQ ID NO: 2939623 - RNA, 18 nt, Mycobacterium avium subsp. paratuberculosis
cggcgcuucugcgccggu

SEQ ID NO: 2939624 - RNA, 21 nt, Mycobacterium avium subsp. paratuberculosis
cggcgcuucugcgccgguucg

SEQ ID NO: 2939625 - RNA, 18 nt, Mycobacterium avium subsp. paratuberculosis
cggcgcuugaccucgccg

SEQ ID NO: 2939626 - RNA, 20 nt, Mycobacterium avium subsp. paratuberculosis
cggcgcuugaccucgccgag

SEQ ID NO: 2939627 - RNA, 22 nt, Mycobacterium avium subsp. paratuberculosis
cggcgcuugaccucgccgagca

SEQ ID NO: 2939628 - RNA, 24 nt, Mycobacterium avium subsp. paratuberculosis
cggcgcuugaccucgccgagcagc

SEQ ID NO: 2939629 - RNA, 14 nt, Mycobacterium avium subsp. paratuberculosis
cggcgcuugacgaa

SEQ ID NO: 2939630 - RNA, 13 nt, Mycobacterium avium subsp. paratuberculosis
cggcgcuuuccac

SEQ ID NO: 2939631 - RNA, 16 nt, Mycobacterium avium subsp. paratuberculosis
cggcgcuuuccaccuc

SEQ ID NO: 2939632 - RNA, 20 nt, Mycobacterium avium subsp. paratuberculosis
cggcgcuuuccaccucgagc

SEQ ID NO: 2939633 - RNA, 20 nt, Mycobacterium avium subsp. paratuberculosis
cggcggaacccggguggccc

SEQ ID NO: 2939634 - RNA, 23 nt, Mycobacterium avium subsp. paratuberculosis
cggcggaacccggguggcccgca

SEQ ID NO: 2939635 - RNA, 18 nt, Mycobacterium avium subsp. paratuberculosis
cggcggaaccgggccgcu

SEQ ID NO: 2939636 - RNA, 17 nt, Mycobacterium avium subsp. paratuberculosis
cggcggaacggucgggg

SEQ ID NO: 2939637 - RNA, 20 nt, Mycobacterium avium subsp. paratuberculosis
cggcggaacggucggggcgg

SEQ ID NO: 2939638 - RNA, 22 nt, Mycobacterium avium subsp. paratuberculosis
cggcggaacggucggggcggcg

SEQ ID NO: 2939639 - RNA, 19 nt, Mycobacterium avium subsp. paratuberculosis
cggcggaaguagcccggag

SEQ ID NO: 2939640 - RNA, 23 nt, Mycobacterium avium subsp. paratuberculosis
cggcggacagcacguuguucagg

SEQ ID NO: 2939641 - RNA, 13 nt, Mycobacterium avium subsp. paratuberculosis
cggcggacagccc

SEQ ID NO: 2939642 - RNA, 20 nt, Mycobacterium avium subsp. paratuberculosis
cggcggacagccccgagccg

SEQ ID NO: 2939643 - RNA, 13 nt, Mycobacterium avium subsp. paratuberculosis
cggcggacaucgc

SEQ ID NO: 2939644 - RNA, 18 nt, Mycobacterium avium subsp. paratuberculosis
cggcggacaucgccucgg

SEQ ID NO: 2939645 - RNA, 17 nt, Mycobacterium avium subsp. paratuberculosis
cggcggacccagcuccu

SEQ ID NO: 2939646 - RNA, 23 nt, Mycobacterium avium subsp. paratuberculosis
cggcggacccagcuccucggcca

SEQ ID NO: 2939647 - RNA, 18 nt, Mycobacterium avium subsp. paratuberculosis
cggcggacccggaggcgg

SEQ ID NO: 2939648 - RNA, 21 nt, Mycobacterium avium subsp. paratuberculosis
cggcggacccggaggcggcgg

SEQ ID NO: 2939649 - RNA, 22 nt, Mycobacterium avium subsp. paratuberculosis
cggcggacccggaggcggcggg

SEQ ID NO: 2939650 - RNA, 16 nt, Mycobacterium avium subsp. paratuberculosis
cggcggaccggcggcc

SEQ ID NO: 2939651 - RNA, 17 nt, Mycobacterium avium subsp. paratuberculosis
cggcggaccggcggccg

SEQ ID NO: 2939652 - RNA, 18 nt, Mycobacterium avium subsp. paratuberculosis
cggcggaccggcggccgc

SEQ ID NO: 2939653 - RNA, 20 nt, Mycobacterium avium subsp. paratuberculosis
cggcggaccggcggccgcca

SEQ ID NO: 2939654 - RNA, 16 nt, Mycobacterium avium subsp. paratuberculosis
cggcggacgauguccg

SEQ ID NO: 2939655 - RNA, 20 nt, Mycobacterium avium subsp. paratuberculosis
cggcggacgauguccgccgg

SEQ ID NO: 2939656 - RNA, 21 nt, Mycobacterium avium subsp. paratuberculosis
cggcggacgauguccgccggc

SEQ ID NO: 2939657 - RNA, 23 nt, Mycobacterium avium subsp. paratuberculosis
cggcggacgauguccgccggccg

SEQ ID NO: 2939658 - RNA, 13 nt, Mycobacterium avium subsp. paratuberculosis
cggcggacgcggc

SEQ ID NO: 2939659 - RNA, 15 nt, Mycobacterium avium subsp. paratuberculosis
cggcggacgcggcca

SEQ ID NO: 2939660 - RNA, 19 nt, Mycobacterium avium subsp. paratuberculosis
cggcggacgcggccagcgc

SEQ ID NO: 2939661 - RNA, 16 nt, Mycobacterium avium subsp. paratuberculosis
cggcggacucggcgaa

SEQ ID NO: 2939662 - RNA, 18 nt, Mycobacterium avium subsp. paratuberculosis
cggcggacucggcgaagu

SEQ ID NO: 2939663 - RNA, 19 nt, Mycobacterium avium subsp. paratuberculosis
cggcggacucggcgaaguc

SEQ ID NO: 2939664 - RNA, 20 nt, Mycobacterium avium subsp. paratuberculosis
cggcggacuggcugagcagc

SEQ ID NO: 2939665 - RNA, 23 nt, Mycobacterium avium subsp. paratuberculosis
cggcggacuggcugagcagcacc

SEQ ID NO: 2939666 - RNA, 18 nt, Mycobacterium avium subsp. paratuberculosis
cggcggagaugacgugga

SEQ ID NO: 2939667 - RNA, 22 nt, Mycobacterium avium subsp. paratuberculosis
cggcggaggccugcgcggccgc

SEQ ID NO: 2939668 - RNA, 12 nt, Mycobacterium avium subsp. paratuberculosis
cggcggaggcga

SEQ ID NO: 2939669 - RNA, 15 nt, Mycobacterium avium subsp. paratuberculosis
cggcggagggguacu

SEQ ID NO: 2939670 - RNA, 17 nt, Mycobacterium avium subsp. paratuberculosis
cggcggaggucagcggc

SEQ ID NO: 2939671 - RNA, 12 nt, Mycobacterium avium subsp. paratuberculosis
cggcggagucgu

SEQ ID NO: 2939672 - RNA, 17 nt, Mycobacterium avium subsp. paratuberculosis
cggcggauauagccgac

SEQ ID NO: 2939673 - RNA, 19 nt, Mycobacterium avium subsp. paratuberculosis
cggcggauauagccgacgg

SEQ ID NO: 2939674 - RNA, 15 nt, Mycobacterium avium subsp. paratuberculosis
cggcggaucagcacc

SEQ ID NO: 2939675 - RNA, 23 nt, Mycobacterium avium subsp. paratuberculosis
cggcggaucagcaccgacgcggc

SEQ ID NO: 2939676 - RNA, 20 nt, Mycobacterium avium subsp. paratuberculosis
cggcggaucaguaccggcga

SEQ ID NO: 2939677 - RNA, 15 nt, Mycobacterium avium subsp. paratuberculosis
cggcggauccagcac

SEQ ID NO: 2939678 - RNA, 16 nt, Mycobacterium avium subsp. paratuberculosis
cggcggauccagcacc

SEQ ID NO: 2939679 - RNA, 17 nt, Mycobacterium avium subsp. paratuberculosis
cggcggauccagcaccg

SEQ ID NO: 2939680 - RNA, 21 nt, Mycobacterium avium subsp. paratuberculosis
cggcggauccagcaccgccac

SEQ ID NO: 2939681 - RNA, 15 nt, Mycobacterium avium subsp. paratuberculosis
cggcggauccaggug

SEQ ID NO: 2939682 - RNA, 16 nt, Mycobacterium avium subsp. paratuberculosis
cggcggauccaggugg

SEQ ID NO: 2939683 - RNA, 22 nt, Mycobacterium avium subsp. paratuberculosis
cggcggauccucaguccgcccc

SEQ ID NO: 2939684 - RNA, 15 nt, Mycobacterium avium subsp. paratuberculosis
cggcggaucgcgugc

SEQ ID NO: 2939685 - RNA, 18 nt, Mycobacterium avium subsp. paratuberculosis
cggcggaucgcgugcguc

SEQ ID NO: 2939686 - RNA, 14 nt, Mycobacterium avium subsp. paratuberculosis
cggcggaugggugc

SEQ ID NO: 2939687 - RNA, 18 nt, Mycobacterium avium subsp. paratuberculosis
cggcggccauucaucgcg

SEQ ID NO: 2939688 - RNA, 22 nt, Mycobacterium avium subsp. paratuberculosis
cggcggccauucaucgcgcacc

SEQ ID NO: 2939689 - RNA, 12 nt, Mycobacterium avium subsp. paratuberculosis
cggcggccccgg

SEQ ID NO: 2939690 - RNA, 13 nt, Mycobacterium avium subsp. paratuberculosis
cggcggccccggu

SEQ ID NO: 2939691 - RNA, 22 nt, Mycobacterium avium subsp. paratuberculosis
cggcggccccgguagccagcac

SEQ ID NO: 2939692 - RNA, 23 nt, Mycobacterium avium subsp. paratuberculosis
cggcggccccgguagccagcacc

SEQ ID NO: 2939693 - RNA, 20 nt, Mycobacterium avium subsp. paratuberculosis
cggcggccccuucgaugucg

SEQ ID NO: 2939694 - RNA, 18 nt, Mycobacterium avium subsp. paratuberculosis
cggcggcccgcaggaucg

SEQ ID NO: 2939695 - RNA, 21 nt, Mycobacterium avium subsp. paratuberculosis
cggcggcccgcaggaucgagc

SEQ ID NO: 2939696 - RNA, 12 nt, Mycobacterium avium subsp. paratuberculosis
cggcggcccgcc

SEQ ID NO: 2939697 - RNA, 21 nt, Mycobacterium avium subsp. paratuberculosis
cggcggcccgccgcgcccggc

SEQ ID NO: 2939698 - RNA, 22 nt, Mycobacterium avium subsp. paratuberculosis
cggcggcccgccgcgcccggcu

SEQ ID NO: 2939699 - RNA, 14 nt, Mycobacterium avium subsp. paratuberculosis
cggcggcccgccgg

SEQ ID NO: 2939700 - RNA, 13 nt, Mycobacterium avium subsp. paratuberculosis
cggcggcccgcuu

SEQ ID NO: 2939701 - RNA, 12 nt, Mycobacterium avium subsp. paratuberculosis
cggcggcccggc

SEQ ID NO: 2939702 - RNA, 16 nt, Mycobacterium avium subsp. paratuberculosis
cggcggcccggcguca

SEQ ID NO: 2939703 - RNA, 13 nt, Mycobacterium avium subsp. paratuberculosis
cggcggcccgucc

SEQ ID NO: 2939704 - RNA, 17 nt, Mycobacterium avium subsp. paratuberculosis
cggcggcccguccgccc

SEQ ID NO: 2939705 - RNA, 18 nt, Mycobacterium avium subsp. paratuberculosis
cggcggcccguccgcccc

SEQ ID NO: 2939706 - RNA, 22 nt, Mycobacterium avium subsp. paratuberculosis
cggcggcccguccgccccgcug

SEQ ID NO: 2939707 - RNA, 23 nt, Mycobacterium avium subsp. paratuberculosis
cggcggcccguccgccccgcugc

SEQ ID NO: 2939708 - RNA, 14 nt, Mycobacterium avium subsp. paratuberculosis
cggcggcccgucgc

SEQ ID NO: 2939709 - RNA, 15 nt, Mycobacterium avium subsp. paratuberculosis
cggcggcccgucgcc

SEQ ID NO: 2939710 - RNA, 23 nt, Mycobacterium avium subsp. paratuberculosis
cggcggcccgucgccaccacggc

SEQ ID NO: 2939711 - RNA, 19 nt, Mycobacterium avium subsp. paratuberculosis
cggcggccgaauccggccg

SEQ ID NO: 2939712 - RNA, 20 nt, Mycobacterium avium subsp. paratuberculosis
cggcggccgaauccggccgg

SEQ ID NO: 2939713 - RNA, 21 nt, Mycobacterium avium subsp. paratuberculosis
cggcggccgaauccggccgga

SEQ ID NO: 2939714 - RNA, 12 nt, Mycobacterium avium subsp. paratuberculosis
cggcggccgaca

SEQ ID NO: 2939715 - RNA, 13 nt, Mycobacterium avium subsp. paratuberculosis
cggcggccgacag

SEQ ID NO: 2939716 - RNA, 17 nt, Mycobacterium avium subsp. paratuberculosis
cggcggccgacagggug

SEQ ID NO: 2939717 - RNA, 20 nt, Mycobacterium avium subsp. paratuberculosis
cggcggccgacagggugcca

SEQ ID NO: 2939718 - RNA, 15 nt, Mycobacterium avium subsp. paratuberculosis
cggcggccgacccug

SEQ ID NO: 2939719 - RNA, 16 nt, Mycobacterium avium subsp. paratuberculosis
cggcggccgacccugc

SEQ ID NO: 2939720 - RNA, 21 nt, Mycobacterium avium subsp. paratuberculosis
cggcggccgacccugcguccg

SEQ ID NO: 2939721 - RNA, 22 nt, Mycobacterium avium subsp. paratuberculosis
cggcggccgacccugcguccgg

SEQ ID NO: 2939722 - RNA, 15 nt, Mycobacterium avium subsp. paratuberculosis
cggcggccgacgcgc

SEQ ID NO: 2939723 - RNA, 19 nt, Mycobacterium avium subsp. paratuberculosis
cggcggccgacgcgccguc

SEQ ID NO: 2939724 - RNA, 21 nt, Mycobacterium avium subsp. paratuberculosis
cggcggccgacgcgccgucgg

SEQ ID NO: 2939725 - RNA, 14 nt, Mycobacterium avium subsp. paratuberculosis
cggcggccgagcgc

SEQ ID NO: 2939726 - RNA, 14 nt, Mycobacterium avium subsp. paratuberculosis
cggcggccgcagcg

SEQ ID NO: 2939727 - RNA, 12 nt, Mycobacterium avium subsp. paratuberculosis
cggcggccgcca

SEQ ID NO: 2939728 - RNA, 15 nt, Mycobacterium avium subsp. paratuberculosis
cggcggccgccacgc

SEQ ID NO: 2939729 - RNA, 18 nt, Mycobacterium avium subsp. paratuberculosis
cggcggccgccacgcugg

SEQ ID NO: 2939730 - RNA, 19 nt, Mycobacterium avium subsp. paratuberculosis
cggcggccgccaucauccg

SEQ ID NO: 2939731 - RNA, 12 nt, Mycobacterium avium subsp. paratuberculosis
cggcggccgccc

SEQ ID NO: 2939732 - RNA, 14 nt, Mycobacterium avium subsp. paratuberculosis
cggcggccgcccgg

SEQ ID NO: 2939733 - RNA, 15 nt, Mycobacterium avium subsp. paratuberculosis
cggcggccgccgccc

SEQ ID NO: 2939734 - RNA, 19 nt, Mycobacterium avium subsp. paratuberculosis
cggcggccgccgcccgcgc

SEQ ID NO: 2939735 - RNA, 22 nt, Mycobacterium avium subsp. paratuberculosis
cggcggccgccgcccgcgcggc

SEQ ID NO: 2939736 - RNA, 13 nt, Mycobacterium avium subsp. paratuberculosis
cggcggccgccgg

SEQ ID NO: 2939737 - RNA, 14 nt, Mycobacterium avium subsp. paratuberculosis
cggcggccgccggc

SEQ ID NO: 2939738 - RNA, 16 nt, Mycobacterium avium subsp. paratuberculosis
cggcggccgccggcac

SEQ ID NO: 2939739 - RNA, 18 nt, Mycobacterium avium subsp. paratuberculosis
cggcggccgccggcaccg

SEQ ID NO: 2939740 - RNA, 22 nt, Mycobacterium avium subsp. paratuberculosis
cggcggccgccggcaccguccg

SEQ ID NO: 2939741 - RNA, 12 nt, Mycobacterium avium subsp. paratuberculosis
cggcggccgcga

SEQ ID NO: 2939742 - RNA, 14 nt, Mycobacterium avium subsp. paratuberculosis
cggcggccgcgaag

SEQ ID NO: 2939743 - RNA, 16 nt, Mycobacterium avium subsp. paratuberculosis
cggcggccgcgacgga

SEQ ID NO: 2939744 - RNA, 13 nt, Mycobacterium avium subsp. paratuberculosis
cggcggccgcgga

SEQ ID NO: 2939745 - RNA, 14 nt, Mycobacterium avium subsp. paratuberculosis
cggcggccgcggac

SEQ ID NO: 2939746 - RNA, 15 nt, Mycobacterium avium subsp. paratuberculosis
cggcggccgcggacc

SEQ ID NO: 2939747 - RNA, 15 nt, Mycobacterium avium subsp. paratuberculosis
cggcggccgcgucgc

SEQ ID NO: 2939748 - RNA, 17 nt, Mycobacterium avium subsp. paratuberculosis
cggcggccgcgucggcg

SEQ ID NO: 2939749 - RNA, 19 nt, Mycobacterium avium subsp. paratuberculosis
cggcggccgcgucggcggu

SEQ ID NO: 2939750 - RNA, 13 nt, Mycobacterium avium subsp. paratuberculosis
cggcggccggcca

SEQ ID NO: 2939751 - RNA, 15 nt, Mycobacterium avium subsp. paratuberculosis
cggcggccggccagc

SEQ ID NO: 2939752 - RNA, 16 nt, Mycobacterium avium subsp. paratuberculosis
cggcggccggccagca

SEQ ID NO: 2939753 - RNA, 19 nt, Mycobacterium avium subsp. paratuberculosis
cggcggccggccagcgcgc

SEQ ID NO: 2939754 - RNA, 13 nt, Mycobacterium avium subsp. paratuberculosis
cggcggccggccc

SEQ ID NO: 2939755 - RNA, 14 nt, Mycobacterium avium subsp. paratuberculosis
cggcggccggcccc

SEQ ID NO: 2939756 - RNA, 15 nt, Mycobacterium avium subsp. paratuberculosis
cggcggccggccccg

SEQ ID NO: 2939757 - RNA, 20 nt, Mycobacterium avium subsp. paratuberculosis
cggcggccggccccggccgg

SEQ ID NO: 2939758 - RNA, 22 nt, Mycobacterium avium subsp. paratuberculosis
cggcggccggccccggccgggc

SEQ ID NO: 2939759 - RNA, 16 nt, Mycobacterium avium subsp. paratuberculosis
cggcggccggccgcgc

SEQ ID NO: 2939760 - RNA, 21 nt, Mycobacterium avium subsp. paratuberculosis
cggcggccggccgcgcgcggc

SEQ ID NO: 2939761 - RNA, 12 nt, Mycobacterium avium subsp. paratuberculosis
cggcggccggcg

SEQ ID NO: 2939762 - RNA, 14 nt, Mycobacterium avium subsp. paratuberculosis
cggcggccggcgau

SEQ ID NO: 2939763 - RNA, 16 nt, Mycobacterium avium subsp. paratuberculosis
cggcggccggcgauga

SEQ ID NO: 2939764 - RNA, 15 nt, Mycobacterium avium subsp. paratuberculosis
cggcggccggcgccg

SEQ ID NO: 2939765 - RNA, 14 nt, Mycobacterium avium subsp. paratuberculosis
cggcggccggcggc

SEQ ID NO: 2939766 - RNA, 17 nt, Mycobacterium avium subsp. paratuberculosis
cggcggccgggaugccg

SEQ ID NO: 2939767 - RNA, 13 nt, Mycobacterium avium subsp. paratuberculosis
cggcggccggggg

SEQ ID NO: 2939768 - RNA, 13 nt, Mycobacterium avium subsp. paratuberculosis
cggcggccgggug

SEQ ID NO: 2939769 - RNA, 17 nt, Mycobacterium avium subsp. paratuberculosis
cggcggccgucggaucg

SEQ ID NO: 2939770 - RNA, 16 nt, Mycobacterium avium subsp. paratuberculosis
cggcggccucgccguc

SEQ ID NO: 2939771 - RNA, 17 nt, Mycobacterium avium subsp. paratuberculosis
cggcggccucgccgucg

SEQ ID NO: 2939772 - RNA, 14 nt, Mycobacterium avium subsp. paratuberculosis
cggcggcgcugguc

SEQ ID NO: 2939773 - RNA, 15 nt, Mycobacterium avium subsp. paratuberculosis
cggcggcgcuggucg

SEQ ID NO: 2939774 - RNA, 14 nt, Mycobacterium avium subsp. paratuberculosis
cggcggcggaccgu

SEQ ID NO: 2939775 - RNA, 14 nt, Mycobacterium avium subsp. paratuberculosis
cggcggcggcaccg

SEQ ID NO: 2939776 - RNA, 12 nt, Mycobacterium avium subsp. paratuberculosis
cggcggcggcca

SEQ ID NO: 2939777 - RNA, 16 nt, Mycobacterium avium subsp. paratuberculosis
cggcggcggccagcga

SEQ ID NO: 2939778 - RNA, 12 nt, Mycobacterium avium subsp. paratuberculosis
cggcggcggccc

SEQ ID NO: 2939779 - RNA, 13 nt, Mycobacterium avium subsp. paratuberculosis
cggcggcggcccg

SEQ ID NO: 2939780 - RNA, 14 nt, Mycobacterium avium subsp. paratuberculosis
cggcggcggccgcg

SEQ ID NO: 2939781 - RNA, 15 nt, Mycobacterium avium subsp. paratuberculosis
cggcggcggccgcgu

SEQ ID NO: 2939782 - RNA, 13 nt, Mycobacterium avium subsp. paratuberculosis
cggcggcggccug

SEQ ID NO: 2939783 - RNA, 17 nt, Mycobacterium avium subsp. paratuberculosis
cggcggcggccugcacc

SEQ ID NO: 2939784 - RNA, 16 nt, Mycobacterium avium subsp. paratuberculosis
cggcggcggcgcgccg

SEQ ID NO: 2939785 - RNA, 14 nt, Mycobacterium avium subsp. paratuberculosis
cggcggcggcgcgg

SEQ ID NO: 2939786 - RNA, 15 nt, Mycobacterium avium subsp. paratuberculosis
cggcggcggcggccg

SEQ ID NO: 2939787 - RNA, 13 nt, Mycobacterium avium subsp. paratuberculosis
cggcggcggcggu

SEQ ID NO: 2939788 - RNA, 13 nt, Mycobacterium avium subsp. paratuberculosis
cggcggcgggcca

SEQ ID NO: 2939789 - RNA, 14 nt, Mycobacterium avium subsp. paratuberculosis
cggcggcgggccag

SEQ ID NO: 2939790 - RNA, 21 nt, Mycobacterium avium subsp. paratuberculosis
cggcggcgggccagggcgagg

SEQ ID NO: 2939791 - RNA, 16 nt, Mycobacterium avium subsp. paratuberculosis
cggcggcgggcucgga

SEQ ID NO: 2939792 - RNA, 14 nt, Mycobacterium avium subsp. paratuberculosis
cggcggcggggugg

SEQ ID NO: 2939793 - RNA, 19 nt, Mycobacterium avium subsp. paratuberculosis
cggcggcgguccgcccgga

SEQ ID NO: 2939794 - RNA, 20 nt, Mycobacterium avium subsp. paratuberculosis
cggcggcgguccgcccggac

SEQ ID NO: 2939795 - RNA, 18 nt, Mycobacterium avium subsp. paratuberculosis
cggcggcggucggcauag

SEQ ID NO: 2939796 - RNA, 14 nt, Mycobacterium avium subsp. paratuberculosis
cggcggcggugccg

SEQ ID NO: 2939797 - RNA, 21 nt, Mycobacterium avium subsp. paratuberculosis
cggcggcggugccgcaggcga

SEQ ID NO: 2939798 - RNA, 17 nt, Mycobacterium avium subsp. paratuberculosis
cggcggcggugccuggu

SEQ ID NO: 2939799 - RNA, 13 nt, Mycobacterium avium subsp. paratuberculosis
cggcggcggugcg

SEQ ID NO: 2939800 - RNA, 17 nt, Mycobacterium avium subsp. paratuberculosis
cggcggcguacgcgaug

SEQ ID NO: 2939801 - RNA, 21 nt, Mycobacterium avium subsp. paratuberculosis
cggcggcguacgcgauggcgg

SEQ ID NO: 2939802 - RNA, 22 nt, Mycobacterium avium subsp. paratuberculosis
cggcggcguacgcgauggcggc

SEQ ID NO: 2939803 - RNA, 22 nt, Mycobacterium avium subsp. paratuberculosis
cggcggcgucccagugcucgac

SEQ ID NO: 2939804 - RNA, 16 nt, Mycobacterium avium subsp. paratuberculosis
cggcggcguccgcggc

SEQ ID NO: 2939805 - RNA, 18 nt, Mycobacterium avium subsp. paratuberculosis
cggcggcguccgcggccg

SEQ ID NO: 2939806 - RNA, 15 nt, Mycobacterium avium subsp. paratuberculosis
cggcggcgucgaccg

SEQ ID NO: 2939807 - RNA, 13 nt, Mycobacterium avium subsp. paratuberculosis
cggcggcgucggc

SEQ ID NO: 2939808 - RNA, 14 nt, Mycobacterium avium subsp. paratuberculosis
cggcggcgucggcg

SEQ ID NO: 2939809 - RNA, 14 nt, Mycobacterium avium subsp. paratuberculosis
cggcggcgucguga

SEQ ID NO: 2939810 - RNA, 15 nt, Mycobacterium avium subsp. paratuberculosis
cggcggcgugcaccg

SEQ ID NO: 2939811 - RNA, 13 nt, Mycobacterium avium subsp. paratuberculosis
cggcggcgugccg

SEQ ID NO: 2939812 - RNA, 17 nt, Mycobacterium avium subsp. paratuberculosis
cggcggcgugccgcccg

SEQ ID NO: 2939813 - RNA, 19 nt, Mycobacterium avium subsp. paratuberculosis
cggcggcgugccgcccgga

SEQ ID NO: 2939814 - RNA, 20 nt, Mycobacterium avium subsp. paratuberculosis
cggcggcguucagccggagc

SEQ ID NO: 2939815 - RNA, 23 nt, Mycobacterium avium subsp. paratuberculosis
cggcggcguucagccggagccgg

SEQ ID NO: 2939816 - RNA, 18 nt, Mycobacterium avium subsp. paratuberculosis
cggcggcguuggccgccg

SEQ ID NO: 2939817 - RNA, 22 nt, Mycobacterium avium subsp. paratuberculosis
cggcggcucagcaacccgccga

SEQ ID NO: 2939818 - RNA, 14 nt, Mycobacterium avium subsp. paratuberculosis
cggcggcucagggg

SEQ ID NO: 2939819 - RNA, 13 nt, Mycobacterium avium subsp. paratuberculosis
cggcggcucgccg

SEQ ID NO: 2939820 - RNA, 18 nt, Mycobacterium avium subsp. paratuberculosis
cggcggcucgccggcguc

SEQ ID NO: 2939821 - RNA, 12 nt, Mycobacterium avium subsp. paratuberculosis
cggcggcucggc

SEQ ID NO: 2939822 - RNA, 14 nt, Mycobacterium avium subsp. paratuberculosis
cggcggcucgucca

SEQ ID NO: 2939823 - RNA, 19 nt, Mycobacterium avium subsp. paratuberculosis
cggcggcucguccagcccg

SEQ ID NO: 2939824 - RNA, 21 nt, Mycobacterium avium subsp. paratuberculosis
cggcggcucguccagcccggu

SEQ ID NO: 2939825 - RNA, 19 nt, Mycobacterium avium subsp. paratuberculosis
cggcggcugaaccaccgcg

SEQ ID NO: 2939826 - RNA, 15 nt, Mycobacterium avium subsp. paratuberculosis
cggcggcugaagcgc

SEQ ID NO: 2939827 - RNA, 16 nt, Mycobacterium avium subsp. paratuberculosis
cggcggcugaagcgcu

SEQ ID NO: 2939828 - RNA, 19 nt, Mycobacterium avium subsp. paratuberculosis
cggcggcugaagcgcuggg

SEQ ID NO: 2939829 - RNA, 20 nt, Mycobacterium avium subsp. paratuberculosis
cggcggcugaagcgcuggga

SEQ ID NO: 2939830 - RNA, 21 nt, Mycobacterium avium subsp. paratuberculosis
cggcggcugccucgacgaugg

SEQ ID NO: 2939831 - RNA, 12 nt, Mycobacterium avium subsp. paratuberculosis
cggcggcugggc

SEQ ID NO: 2939832 - RNA, 14 nt, Mycobacterium avium subsp. paratuberculosis
cggcggcugggcag

SEQ ID NO: 2939833 - RNA, 21 nt, Mycobacterium avium subsp. paratuberculosis
cggcggcugggcagccgcgcg

SEQ ID NO: 2939834 - RNA, 17 nt, Mycobacterium avium subsp. paratuberculosis
cggcggcugggccgcgg

SEQ ID NO: 2939835 - RNA, 22 nt, Mycobacterium avium subsp. paratuberculosis
cggcggcugggccgcggcgccg

SEQ ID NO: 2939836 - RNA, 20 nt, Mycobacterium avium subsp. paratuberculosis
cggcggcugugaucgcugac

SEQ ID NO: 2939837 - RNA, 22 nt, Mycobacterium avium subsp. paratuberculosis
cggcgggaaaccaccugccgca

SEQ ID NO: 2939838 - RNA, 18 nt, Mycobacterium avium subsp. paratuberculosis
cggcgggaacucgaugcg

SEQ ID NO: 2939839 - RNA, 22 nt, Mycobacterium avium subsp. paratuberculosis
cggcgggaacucgaugcggcag

SEQ ID NO: 2939840 - RNA, 23 nt, Mycobacterium avium subsp. paratuberculosis
cggcgggaacucgaugcggcagc

SEQ ID NO: 2939841 - RNA, 13 nt, Mycobacterium avium subsp. paratuberculosis
cggcgggacccgc

SEQ ID NO: 2939842 - RNA, 15 nt, Mycobacterium avium subsp. paratuberculosis
cggcgggacccgcga

SEQ ID NO: 2939843 - RNA, 16 nt, Mycobacterium avium subsp. paratuberculosis
cggcgggacccgcgac

SEQ ID NO: 2939844 - RNA, 18 nt, Mycobacterium avium subsp. paratuberculosis
cggcgggacccgcgaccc

SEQ ID NO: 2939845 - RNA, 14 nt, Mycobacterium avium subsp. paratuberculosis
cggcgggagccggc

SEQ ID NO: 2939846 - RNA, 19 nt, Mycobacterium avium subsp. paratuberculosis
cggcgggagccggcggcgg

SEQ ID NO: 2939847 - RNA, 23 nt, Mycobacterium avium subsp. paratuberculosis
cggcgggagcuaggcggccgggc

SEQ ID NO: 2939848 - RNA, 17 nt, Mycobacterium avium subsp. paratuberculosis
cggcgggaucggaccgc

SEQ ID NO: 2939849 - RNA, 22 nt, Mycobacterium avium subsp. paratuberculosis
cggcgggaucggaccgcaccac

SEQ ID NO: 2939850 - RNA, 23 nt, Mycobacterium avium subsp. paratuberculosis
cggcgggaucggaccgcaccacc

SEQ ID NO: 2939851 - RNA, 18 nt, Mycobacterium avium subsp. paratuberculosis
cggcgggcaccucggcca

SEQ ID NO: 2939852 - RNA, 13 nt, Mycobacterium avium subsp. paratuberculosis
cggcgggcagcga

SEQ ID NO: 2939853 - RNA, 15 nt, Mycobacterium avium subsp. paratuberculosis
cggcgggcaggccga

SEQ ID NO: 2939854 - RNA, 15 nt, Mycobacterium avium subsp. paratuberculosis
cggcgggcaggcuca

SEQ ID NO: 2939855 - RNA, 15 nt, Mycobacterium avium subsp. paratuberculosis
cggcgggcaucaucg

SEQ ID NO: 2939856 - RNA, 13 nt, Mycobacterium avium subsp. paratuberculosis
cggcgggccagcu

SEQ ID NO: 2939857 - RNA, 22 nt, Mycobacterium avium subsp. paratuberculosis
cggcgggugggggucuggucgg

SEQ ID NO: 2939858 - RNA, 23 nt, Mycobacterium avium subsp. paratuberculosis
cggcgggugggggucuggucggu

SEQ ID NO: 2939859 - RNA, 16 nt, Mycobacterium avium subsp. paratuberculosis
cggcggguucugauac

SEQ ID NO: 2939860 - RNA, 23 nt, Mycobacterium avium subsp. paratuberculosis
cggcggguucugauacaccaccc

SEQ ID NO: 2939861 - RNA, 18 nt, Mycobacterium avium subsp. paratuberculosis
cggcggguugcugagccg

SEQ ID NO: 2939862 - RNA, 19 nt, Mycobacterium avium subsp. paratuberculosis
cggcggguugcugagccgc

SEQ ID NO: 2939863 - RNA, 20 nt, Mycobacterium avium subsp. paratuberculosis
cggcggguugcugagccgcc

SEQ ID NO: 2939864 - RNA, 21 nt, Mycobacterium avium subsp. paratuberculosis
cggcggguugcugagccgccg

SEQ ID NO: 2939865 - RNA, 22 nt, Mycobacterium avium subsp. paratuberculosis
cggcggguugcugagccgccga

SEQ ID NO: 2939866 - RNA, 21 nt, Mycobacterium avium subsp. paratuberculosis
cggcggguuggucccgaucac

SEQ ID NO: 2939867 - RNA, 20 nt, Mycobacterium avium subsp. paratuberculosis
cggcgguaccgaacgacgag

SEQ ID NO: 2939868 - RNA, 18 nt, Mycobacterium avium subsp. paratuberculosis
cggcgguaccgccgaucg

SEQ ID NO: 2939869 - RNA, 15 nt, Mycobacterium avium subsp. paratuberculosis
cggcgguagcgggcg

SEQ ID NO: 2939870 - RNA, 19 nt, Mycobacterium avium subsp. paratuberculosis
cggcgguaugcccgggccg

SEQ ID NO: 2939871 - RNA, 20 nt, Mycobacterium avium subsp. paratuberculosis
cggcgguaugcccgggccgu

SEQ ID NO: 2939872 - RNA, 22 nt, Mycobacterium avium subsp. paratuberculosis
cggcgguaugcccgggccguca

SEQ ID NO: 2939873 - RNA, 23 nt, Mycobacterium avium subsp. paratuberculosis
cggcgguaugcccgggccgucau

SEQ ID NO: 2939874 - RNA, 19 nt, Mycobacterium avium subsp. paratuberculosis
cggcgguauucgucacccc

SEQ ID NO: 2939875 - RNA, 13 nt, Mycobacterium avium subsp. paratuberculosis
cggcggucaacac

SEQ ID NO: 2939876 - RNA, 20 nt, Mycobacterium avium subsp. paratuberculosis
cggcggucaacacgaagccg

SEQ ID NO: 2939877 - RNA, 22 nt, Mycobacterium avium subsp. paratuberculosis
cggcggucaccaaggcgauuuc

SEQ ID NO: 2939878 - RNA, 12 nt, Mycobacterium avium subsp. paratuberculosis
cggcggucacga

SEQ ID NO: 2939879 - RNA, 15 nt, Mycobacterium avium subsp. paratuberculosis
cggcggucacgcccg

SEQ ID NO: 2939880 - RNA, 17 nt, Mycobacterium avium subsp. paratuberculosis
cggcggucacgcccggg

SEQ ID NO: 2939881 - RNA, 18 nt, Mycobacterium avium subsp. paratuberculosis
cggcggucacgcccgggu

SEQ ID NO: 2939882 - RNA, 14 nt, Mycobacterium avium subsp. paratuberculosis
cggcggucagcacc

SEQ ID NO: 2939883 - RNA, 22 nt, Mycobacterium avium subsp. paratuberculosis
cggcggucagcaccgucaccgc

SEQ ID NO: 2939884 - RNA, 14 nt, Mycobacterium avium subsp. paratuberculosis
cggcggucaggccg

SEQ ID NO: 2939885 - RNA, 15 nt, Mycobacterium avium subsp. paratuberculosis
cggcggucaggccgu

SEQ ID NO: 2939886 - RNA, 19 nt, Mycobacterium avium subsp. paratuberculosis
cggcggucaggccgucucg

SEQ ID NO: 2939887 - RNA, 16 nt, Mycobacterium avium subsp. paratuberculosis
cggcggucagguucgc

SEQ ID NO: 2939888 - RNA, 13 nt, Mycobacterium avium subsp. paratuberculosis
cggcgguccagcg

SEQ ID NO: 2939889 - RNA, 19 nt, Mycobacterium avium subsp. paratuberculosis
cggcggucccgugcgccgc

SEQ ID NO: 2939890 - RNA, 20 nt, Mycobacterium avium subsp. paratuberculosis
cggcggucccgugcgccgcc

SEQ ID NO: 2939891 - RNA, 21 nt, Mycobacterium avium subsp. paratuberculosis
cggcggucccgugcgccgccc

SEQ ID NO: 2939892 - RNA, 22 nt, Mycobacterium avium subsp. paratuberculosis
cggcggucccgugcgccgccca

SEQ ID NO: 2939893 - RNA, 15 nt, Mycobacterium avium subsp. paratuberculosis
cggcgguccgcccgg

SEQ ID NO: 2939894 - RNA, 20 nt, Mycobacterium avium subsp. paratuberculosis
cggcgguccgcccggaccag

SEQ ID NO: 2939895 - RNA, 21 nt, Mycobacterium avium subsp. paratuberculosis
cggcgguccgcccggaccagg

SEQ ID NO: 2939896 - RNA, 22 nt, Mycobacterium avium subsp. paratuberculosis
cggcgguccgcccggaccaggg

SEQ ID NO: 2939897 - RNA, 20 nt, Mycobacterium avium subsp. paratuberculosis
cggcgguccguucggcgguu

SEQ ID NO: 2939898 - RNA, 18 nt, Mycobacterium avium subsp. paratuberculosis
cggcgguccugcggcgac

SEQ ID NO: 2939899 - RNA, 20 nt, Mycobacterium avium subsp. paratuberculosis
cggcgguccugcggcgacaa

SEQ ID NO: 2939900 - RNA, 21 nt, Mycobacterium avium subsp. paratuberculosis
cggcgguccugcggcgacaac

SEQ ID NO: 2939901 - RNA, 12 nt, Mycobacterium avium subsp. paratuberculosis
cggcggucgaca

SEQ ID NO: 2939902 - RNA, 20 nt, Mycobacterium avium subsp. paratuberculosis
cggcggucgacacgaucggc

SEQ ID NO: 2939903 - RNA, 21 nt, Mycobacterium avium subsp. paratuberculosis
cggcggucgacacgaucggca

SEQ ID NO: 2939904 - RNA, 18 nt, Mycobacterium avium subsp. paratuberculosis
cggcggucgccacucggg

SEQ ID NO: 2939905 - RNA, 21 nt, Mycobacterium avium subsp. paratuberculosis
cggcggucgccacucgggcgg

SEQ ID NO: 2939906 - RNA, 22 nt, Mycobacterium avium subsp. paratuberculosis
cggcggucgccacucgggcggc

SEQ ID NO: 2939907 - RNA, 15 nt, Mycobacterium avium subsp. paratuberculosis
cggcggucgccagcg

SEQ ID NO: 2939908 - RNA, 17 nt, Mycobacterium avium subsp. paratuberculosis
cggcggucgccagcgcc

SEQ ID NO: 2939909 - RNA, 20 nt, Mycobacterium avium subsp. paratuberculosis
cggcggucgccagcgccacg

SEQ ID NO: 2939910 - RNA, 15 nt, Mycobacterium avium subsp. paratuberculosis
cggcggucgcgcgcc

SEQ ID NO: 2939911 - RNA, 21 nt, Mycobacterium avium subsp. paratuberculosis
cggcggucgcgcgccggcgca

SEQ ID NO: 2939912 - RNA, 22 nt, Mycobacterium avium subsp. paratuberculosis
cggcggucgcgcgccggcgcag

SEQ ID NO: 2939913 - RNA, 20 nt, Mycobacterium avium subsp. paratuberculosis
cggcggucgcggugcccagc

SEQ ID NO: 2939914 - RNA, 23 nt, Mycobacterium avium subsp. paratuberculosis
cggcggucgcugcagcggcggcc

SEQ ID NO: 2939915 - RNA, 12 nt, Mycobacterium avium subsp. paratuberculosis
cggcggucggcg

SEQ ID NO: 2939916 - RNA, 13 nt, Mycobacterium avium subsp. paratuberculosis
cggcggucggcgc

SEQ ID NO: 2939917 - RNA, 15 nt, Mycobacterium avium subsp. paratuberculosis
cggcggucggcgccg

SEQ ID NO: 2939918 - RNA, 15 nt, Mycobacterium avium subsp. paratuberculosis
cggcggucgugcggc

SEQ ID NO: 2939919 - RNA, 16 nt, Mycobacterium avium subsp. paratuberculosis
cggcggucgugcggcu

SEQ ID NO: 2939920 - RNA, 16 nt, Mycobacterium avium subsp. paratuberculosis
cggcggucugucgcgc

SEQ ID NO: 2939921 - RNA, 20 nt, Mycobacterium avium subsp. paratuberculosis
cggcggucugucgcgcgaac

SEQ ID NO: 2939922 - RNA, 22 nt, Mycobacterium avium subsp. paratuberculosis
cggcggucugucgcgcgaacag

SEQ ID NO: 2939923 - RNA, 23 nt, Mycobacterium avium subsp. paratuberculosis
cggcggucugucgcgcgaacagc

SEQ ID NO: 2939924 - RNA, 16 nt, Mycobacterium avium subsp. paratuberculosis
cggcggucuucuuggc

SEQ ID NO: 2939925 - RNA, 20 nt, Mycobacterium avium subsp. paratuberculosis
cggcggucuucuuggccgcg

SEQ ID NO: 2939926 - RNA, 21 nt, Mycobacterium avium subsp. paratuberculosis
cggcggucuucuuggccgcgc

SEQ ID NO: 2939927 - RNA, 22 nt, Mycobacterium avium subsp. paratuberculosis
cggcggucuucuuggcgggcga

SEQ ID NO: 2939928 - RNA, 24 nt, Mycobacterium avium subsp. paratuberculosis
cggcggucuucuuggcgggcgacu

SEQ ID NO: 2939929 - RNA, 18 nt, Mycobacterium avium subsp. paratuberculosis
cggcggucuuggcggcca

SEQ ID NO: 2939930 - RNA, 20 nt, Mycobacterium avium subsp. paratuberculosis
cggcggucuuggcggccagc

SEQ ID NO: 2939931 - RNA, 22 nt, Mycobacterium avium subsp. paratuberculosis
cggcggucuuggcggccagcgc

SEQ ID NO: 2939932 - RNA, 15 nt, Mycobacterium avium subsp. paratuberculosis
cggcggugaccggau

SEQ ID NO: 2939933 - RNA, 20 nt, Mycobacterium avium subsp. paratuberculosis
cggcggugaccggaucggcc

SEQ ID NO: 2939934 - RNA, 23 nt, Mycobacterium avium subsp. paratuberculosis
cggcggugaccggaucggccagc

SEQ ID NO: 2939935 - RNA, 20 nt, Mycobacterium avium subsp. paratuberculosis
cggcggugacgaacccgccg

SEQ ID NO: 2939936 - RNA, 20 nt, Mycobacterium avium subsp. paratuberculosis
cggcggugacgaugucgaug

SEQ ID NO: 2939937 - RNA, 20 nt, Mycobacterium avium subsp. paratuberculosis
cggcggugacguuccagccg

SEQ ID NO: 2939938 - RNA, 21 nt, Mycobacterium avium subsp. paratuberculosis
cggcggugacguuccagccgu

SEQ ID NO: 2939939 - RNA, 13 nt, Mycobacterium avium subsp. paratuberculosis
cggcggugagccg

SEQ ID NO: 2939940 - RNA, 19 nt, Mycobacterium avium subsp. paratuberculosis
cggcguaccgcggcggcgu

SEQ ID NO: 2939941 - RNA, 21 nt, Mycobacterium avium subsp. paratuberculosis
cggcguaccgcggcggcgucg

SEQ ID NO: 2939942 - RNA, 17 nt, Mycobacterium avium subsp. paratuberculosis
cggcguacgacaucucg

SEQ ID NO: 2939943 - RNA, 17 nt, Mycobacterium avium subsp. paratuberculosis
cggcguacucgcacagc

SEQ ID NO: 2939944 - RNA, 23 nt, Mycobacterium avium subsp. paratuberculosis
cggcguacucgcacagccggcgc

SEQ ID NO: 2939945 - RNA, 23 nt, Mycobacterium avium subsp. paratuberculosis
cggcguacugcgcgaccaaacgc

SEQ ID NO: 2939946 - RNA, 17 nt, Mycobacterium avium subsp. paratuberculosis
cggcguacugcgcgagc

SEQ ID NO: 2939947 - RNA, 20 nt, Mycobacterium avium subsp. paratuberculosis
cggcguacugcgcgagcucg

SEQ ID NO: 2939948 - RNA, 15 nt, Mycobacterium avium subsp. paratuberculosis
cggcguagaccagcg

SEQ ID NO: 2939949 - RNA, 20 nt, Mycobacterium avium subsp. paratuberculosis
cggcguagaccagcgacgcc

SEQ ID NO: 2939950 - RNA, 21 nt, Mycobacterium avium subsp. paratuberculosis
cggcguagaccagcgacgcca

SEQ ID NO: 2939951 - RNA, 14 nt, Mycobacterium avium subsp. paratuberculosis
cggcguagcagucg

SEQ ID NO: 2939952 - RNA, 15 nt, Mycobacterium avium subsp. paratuberculosis
cggcguagcagucgg

SEQ ID NO: 2939953 - RNA, 14 nt, Mycobacterium avium subsp. paratuberculosis
cggcguagccgccg

SEQ ID NO: 2939954 - RNA, 15 nt, Mycobacterium avium subsp. paratuberculosis
cggcguaggcggcca

SEQ ID NO: 2939955 - RNA, 20 nt, Mycobacterium avium subsp. paratuberculosis
cggcguaggugggcagcgcg

SEQ ID NO: 2939956 - RNA, 21 nt, Mycobacterium avium subsp. paratuberculosis
cggcguaggugggcagcgcgg

SEQ ID NO: 2939957 - RNA, 23 nt, Mycobacterium avium subsp. paratuberculosis
cggcguaggugggcagcgcggcc

SEQ ID NO: 2939958 - RNA, 24 nt, Mycobacterium avium subsp. paratuberculosis
cggcguaggugggcagcgcggcca

SEQ ID NO: 2939959 - RNA, 16 nt, Mycobacterium avium subsp. paratuberculosis
cggcguagucgccggu

SEQ ID NO: 2939960 - RNA, 16 nt, Mycobacterium avium subsp. paratuberculosis
cggcguagucggcgca

SEQ ID NO: 2939961 - RNA, 17 nt, Mycobacterium avium subsp. paratuberculosis
cggcguagucggcgcag

SEQ ID NO: 2939962 - RNA, 21 nt, Mycobacterium avium subsp. paratuberculosis
cggcguagucggcgcagcgca

SEQ ID NO: 2939963 - RNA, 22 nt, Mycobacterium avium subsp. paratuberculosis
cggcguaucaacugagcgcccg

SEQ ID NO: 2939964 - RNA, 18 nt, Mycobacterium avium subsp. paratuberculosis
cggcguauucgucgucgg

SEQ ID NO: 2939965 - RNA, 20 nt, Mycobacterium avium subsp. paratuberculosis
cggcguauucgucgucggcc

SEQ ID NO: 2939966 - RNA, 21 nt, Mycobacterium avium subsp. paratuberculosis
cggcguauucgucgucggccu

SEQ ID NO: 2939967 - RNA, 23 nt, Mycobacterium avium subsp. paratuberculosis
cggcguauucgucgucggccucg

SEQ ID NO: 2939968 - RNA, 17 nt, Mycobacterium avium subsp. paratuberculosis
cggcgucaccaggcugc

SEQ ID NO: 2939969 - RNA, 22 nt, Mycobacterium avium subsp. paratuberculosis
cggcgucaccccaccgagcagc

SEQ ID NO: 2939970 - RNA, 12 nt, Mycobacterium avium subsp. paratuberculosis
cggcgucaccgc

SEQ ID NO: 2939971 - RNA, 14 nt, Mycobacterium avium subsp. paratuberculosis
cggcgucaccgcgg

SEQ ID NO: 2939972 - RNA, 19 nt, Mycobacterium avium subsp. paratuberculosis
cggcgucacgcuggcguga

SEQ ID NO: 2939973 - RNA, 13 nt, Mycobacterium avium subsp. paratuberculosis
cggcgucacucug

SEQ ID NO: 2939974 - RNA, 19 nt, Mycobacterium avium subsp. paratuberculosis
cggcgucacucuggcguga

SEQ ID NO: 2939975 - RNA, 17 nt, Mycobacterium avium subsp. paratuberculosis
cggcgucacugcccagc

SEQ ID NO: 2939976 - RNA, 19 nt, Mycobacterium avium subsp. paratuberculosis
cggcgucagagguuggcga

SEQ ID NO: 2939977 - RNA, 23 nt, Mycobacterium avium subsp. paratuberculosis
cggcgucaggaccucgaagcagc

SEQ ID NO: 2939978 - RNA, 21 nt, Mycobacterium avium subsp. paratuberculosis
cggcgucaggggugccagccg

SEQ ID NO: 2939979 - RNA, 22 nt, Mycobacterium avium subsp. paratuberculosis
cggcgucaggggugccagccgu

SEQ ID NO: 2939980 - RNA, 15 nt, Mycobacterium avium subsp. paratuberculosis
cggcgucaucccccg

SEQ ID NO: 2939981 - RNA, 14 nt, Mycobacterium avium subsp. paratuberculosis
cggcgucaucuugg

SEQ ID NO: 2939982 - RNA, 13 nt, Mycobacterium avium subsp. paratuberculosis
cggcgucauggug

SEQ ID NO: 2939983 - RNA, 16 nt, Mycobacterium avium subsp. paratuberculosis
cggcguccaccagcac

SEQ ID NO: 2939984 - RNA, 19 nt, Mycobacterium avium subsp. paratuberculosis
cggcguccaccagcacgcc

SEQ ID NO: 2939985 - RNA, 17 nt, Mycobacterium avium subsp. paratuberculosis
cggcguccaccggucga

SEQ ID NO: 2939986 - RNA, 16 nt, Mycobacterium avium subsp. paratuberculosis
cggcguccacgccgug

SEQ ID NO: 2939987 - RNA, 16 nt, Mycobacterium avium subsp. paratuberculosis
cggcguccagcgccgc

SEQ ID NO: 2939988 - RNA, 19 nt, Mycobacterium avium subsp. paratuberculosis
cggcguccagcgccgccac

SEQ ID NO: 2939989 - RNA, 15 nt, Mycobacterium avium subsp. paratuberculosis
cggcguccagcgcgg

SEQ ID NO: 2939990 - RNA, 18 nt, Mycobacterium avium subsp. paratuberculosis
cggcguccagcgcgguga

SEQ ID NO: 2939991 - RNA, 19 nt, Mycobacterium avium subsp. paratuberculosis
cggcguccagcgcggugag

SEQ ID NO: 2939992 - RNA, 13 nt, Mycobacterium avium subsp. paratuberculosis
cggcguccagcug

SEQ ID NO: 2939993 - RNA, 16 nt, Mycobacterium avium subsp. paratuberculosis
cggcguccagcugcgc

SEQ ID NO: 2939994 - RNA, 20 nt, Mycobacterium avium subsp. paratuberculosis
cggcguccagcugcgcgccg

SEQ ID NO: 2939995 - RNA, 22 nt, Mycobacterium avium subsp. paratuberculosis
cggcguccagcugcgcgccggc

SEQ ID NO: 2939996 - RNA, 17 nt, Mycobacterium avium subsp. paratuberculosis
cggcguccaggcgcacc

SEQ ID NO: 2939997 - RNA, 19 nt, Mycobacterium avium subsp. paratuberculosis
cggcguccaggcgcaccgc

SEQ ID NO: 2939998 - RNA, 21 nt, Mycobacterium avium subsp. paratuberculosis
cggcguccaggcgcaccgcca

SEQ ID NO: 2939999 - RNA, 21 nt, Mycobacterium avium subsp. paratuberculosis
cggcguccaguagccgccggg

SEQ ID NO: 2940000 - RNA, 22 nt, Mycobacterium avium subsp. paratuberculosis
cggcguccagugcaugccggcc

SEQ ID NO: 2940001 - RNA, 19 nt, Mycobacterium avium subsp. paratuberculosis
cggcguccaguucggccag

SEQ ID NO: 2940002 - RNA, 17 nt, Mycobacterium avium subsp. paratuberculosis
cggcguccaguugcggc

SEQ ID NO: 2940003 - RNA, 18 nt, Mycobacterium avium subsp. paratuberculosis
cggcguccaguugcggca

SEQ ID NO: 2940004 - RNA, 19 nt, Mycobacterium avium subsp. paratuberculosis
cggcguccaguugcggcac

SEQ ID NO: 2940005 - RNA, 21 nt, Mycobacterium avium subsp. paratuberculosis
cggcgucccagugcucgacca

SEQ ID NO: 2940006 - RNA, 15 nt, Mycobacterium avium subsp. paratuberculosis
cggcguccccggcgg

SEQ ID NO: 2940007 - RNA, 13 nt, Mycobacterium avium subsp. paratuberculosis
cggcgucccgcgc

SEQ ID NO: 2940008 - RNA, 18 nt, Mycobacterium avium subsp. paratuberculosis
cggcgucccgcgccacgu

SEQ ID NO: 2940009 - RNA, 15 nt, Mycobacterium avium subsp. paratuberculosis
cggcgucccggcguc

SEQ ID NO: 2940010 - RNA, 16 nt, Mycobacterium avium subsp. paratuberculosis
cggcgucccggcgucu

SEQ ID NO: 2940011 - RNA, 22 nt, Mycobacterium avium subsp. paratuberculosis
cggcgucccggguaccucugcg

SEQ ID NO: 2940012 - RNA, 16 nt, Mycobacterium avium subsp. paratuberculosis
cggcguccgcgaacgg

SEQ ID NO: 2940013 - RNA, 20 nt, Mycobacterium avium subsp. paratuberculosis
cggcguccgcgaacgggugc

SEQ ID NO: 2940014 - RNA, 23 nt, Mycobacterium avium subsp. paratuberculosis
cggcguccgcgaacgggugcggc

SEQ ID NO: 2940015 - RNA, 15 nt, Mycobacterium avium subsp. paratuberculosis
cggcguccgcggccg

SEQ ID NO: 2940016 - RNA, 18 nt, Mycobacterium avium subsp. paratuberculosis
cggcguccgcggccgcgg

SEQ ID NO: 2940017 - RNA, 21 nt, Mycobacterium avium subsp. paratuberculosis
cggcguccgcggccgcggcgc

SEQ ID NO: 2940018 - RNA, 19 nt, Mycobacterium avium subsp. paratuberculosis
cggcguccgggcgcugcgc

SEQ ID NO: 2940019 - RNA, 21 nt, Mycobacterium avium subsp. paratuberculosis
cggcguccgggcgcugcgcgg

SEQ ID NO: 2940020 - RNA, 22 nt, Mycobacterium avium subsp. paratuberculosis
cggcguccgugccguccggccg

SEQ ID NO: 2940021 - RNA, 15 nt, Mycobacterium avium subsp. paratuberculosis
cggcguccucgacca

SEQ ID NO: 2940022 - RNA, 19 nt, Mycobacterium avium subsp. paratuberculosis
cggcguccucgaccacccg

SEQ ID NO: 2940023 - RNA, 17 nt, Mycobacterium avium subsp. paratuberculosis
cggcguccucgacgccg

SEQ ID NO: 2940024 - RNA, 24 nt, Mycobacterium avium subsp. paratuberculosis
cggcgucguaaugcgucaugccgg

SEQ ID NO: 2940025 - RNA, 18 nt, Mycobacterium avium subsp. paratuberculosis
cggcgucguacagcagcc

SEQ ID NO: 2940026 - RNA, 19 nt, Mycobacterium avium subsp. paratuberculosis
cggcgucguacagcagccc

SEQ ID NO: 2940027 - RNA, 20 nt, Mycobacterium avium subsp. paratuberculosis
cggcgucguacagcagcccc

SEQ ID NO: 2940028 - RNA, 19 nt, Mycobacterium avium subsp. paratuberculosis
cggcgucguagacgcugcc

SEQ ID NO: 2940029 - RNA, 20 nt, Mycobacterium avium subsp. paratuberculosis
cggcgucguagacgcugccg

SEQ ID NO: 2940030 - RNA, 19 nt, Mycobacterium avium subsp. paratuberculosis
cggcgucguaguugcggcc

SEQ ID NO: 2940031 - RNA, 21 nt, Mycobacterium avium subsp. paratuberculosis
cggcgucguaguugcggccgg

SEQ ID NO: 2940032 - RNA, 22 nt, Mycobacterium avium subsp. paratuberculosis
cggcgucguaguugcggccggc

SEQ ID NO: 2940033 - RNA, 23 nt, Mycobacterium avium subsp. paratuberculosis
cggcgucguaguugcggccggcg

SEQ ID NO: 2940034 - RNA, 14 nt, Mycobacterium avium subsp. paratuberculosis
cggcgucgucgagc

SEQ ID NO: 2940035 - RNA, 15 nt, Mycobacterium avium subsp. paratuberculosis
cggcgucgucgagca

SEQ ID NO: 2940036 - RNA, 17 nt, Mycobacterium avium subsp. paratuberculosis
cggcgucgucgagcacc

SEQ ID NO: 2940037 - RNA, 18 nt, Mycobacterium avium subsp. paratuberculosis
cggcgucgucgagcaccg

SEQ ID NO: 2940038 - RNA, 20 nt, Mycobacterium avium subsp. paratuberculosis
cggcgucgucgagcaccggc

SEQ ID NO: 2940039 - RNA, 13 nt, Mycobacterium avium subsp. paratuberculosis
cggcgucgucgcc

SEQ ID NO: 2940040 - RNA, 14 nt, Mycobacterium avium subsp. paratuberculosis
cggcgucgucgccg

SEQ ID NO: 2940041 - RNA, 15 nt, Mycobacterium avium subsp. paratuberculosis
cggcgucgucgccgu

SEQ ID NO: 2940042 - RNA, 16 nt, Mycobacterium avium subsp. paratuberculosis
cggcgucgucgccgug

SEQ ID NO: 2940043 - RNA, 23 nt, Mycobacterium avium subsp. paratuberculosis
cggcgucgucgccguggcggccc

SEQ ID NO: 2940044 - RNA, 16 nt, Mycobacterium avium subsp. paratuberculosis
cggcgucgucgucgag

SEQ ID NO: 2940045 - RNA, 20 nt, Mycobacterium avium subsp. paratuberculosis
cggcgucgucgucgcagugc

SEQ ID NO: 2940046 - RNA, 15 nt, Mycobacterium avium subsp. paratuberculosis
cggcgucgugaccga

SEQ ID NO: 2940047 - RNA, 18 nt, Mycobacterium avium subsp. paratuberculosis
cggcgucgugaccgaccu

SEQ ID NO: 2940048 - RNA, 17 nt, Mycobacterium avium subsp. paratuberculosis
cggcgucguugagcagg

SEQ ID NO: 2940049 - RNA, 20 nt, Mycobacterium avium subsp. paratuberculosis
cggcgucucagucggccacc

SEQ ID NO: 2940050 - RNA, 21 nt, Mycobacterium avium subsp. paratuberculosis
cggcgucucagucggccaccg

SEQ ID NO: 2940051 - RNA, 16 nt, Mycobacterium avium subsp. paratuberculosis
cggcgucucggcccga

SEQ ID NO: 2940052 - RNA, 13 nt, Mycobacterium avium subsp. paratuberculosis
cggcgucucggcg

SEQ ID NO: 2940053 - RNA, 22 nt, Mycobacterium avium subsp. paratuberculosis
cggcgucucggcgucucggcgu

SEQ ID NO: 2940054 - RNA, 15 nt, Mycobacterium avium subsp. paratuberculosis
cggcgucugcauccg

SEQ ID NO: 2940055 - RNA, 15 nt, Mycobacterium avium subsp. paratuberculosis
cggcgucuggccgga

SEQ ID NO: 2940056 - RNA, 17 nt, Mycobacterium avium subsp. paratuberculosis
cggcgucuucggggaug

SEQ ID NO: 2940057 - RNA, 20 nt, Mycobacterium avium subsp. paratuberculosis
cggcgucuugaucucggcgg

SEQ ID NO: 2940058 - RNA, 23 nt, Mycobacterium avium subsp. paratuberculosis
cggcgucuugaucucggcggcga

SEQ ID NO: 2940059 - RNA, 17 nt, Mycobacterium avium subsp. paratuberculosis
cggcgucuugcugcgga

SEQ ID NO: 2940060 - RNA, 22 nt, Mycobacterium avium subsp. paratuberculosis
cggcgugaauccucagcacggc

SEQ ID NO: 2940061 - RNA, 23 nt, Mycobacterium avium subsp. paratuberculosis
cggcgugaauccucagcacggcc

SEQ ID NO: 2940062 - RNA, 14 nt, Mycobacterium avium subsp. paratuberculosis
cggcgugaccggcu

SEQ ID NO: 2940063 - RNA, 16 nt, Mycobacterium avium subsp. paratuberculosis
cggcgugaccggcugc

SEQ ID NO: 2940064 - RNA, 16 nt, Mycobacterium avium subsp. paratuberculosis
cggcgugagcgagccg

SEQ ID NO: 2940065 - RNA, 17 nt, Mycobacterium avium subsp. paratuberculosis
cggcgugagcgagccgg

SEQ ID NO: 2940066 - RNA, 19 nt, Mycobacterium avium subsp. paratuberculosis
cggcgugaugacggcggcg

SEQ ID NO: 2940067 - RNA, 20 nt, Mycobacterium avium subsp. paratuberculosis
cggcgugaugacggcggcgg

SEQ ID NO: 2940068 - RNA, 22 nt, Mycobacterium avium subsp. paratuberculosis
cggcgugaugacggcggcggug

SEQ ID NO: 2940069 - RNA, 14 nt, Mycobacterium avium subsp. paratuberculosis
cggcgugcacaggc

SEQ ID NO: 2940070 - RNA, 16 nt, Mycobacterium avium subsp. paratuberculosis
cggcgugcacaggccg

SEQ ID NO: 2940071 - RNA, 19 nt, Mycobacterium avium subsp. paratuberculosis
cggcgugcacaggccgccg

SEQ ID NO: 2940072 - RNA, 20 nt, Mycobacterium avium subsp. paratuberculosis
cggcgugcacaggccgccgc

SEQ ID NO: 2940073 - RNA, 14 nt, Mycobacterium avium subsp. paratuberculosis
cggcgugcaccgcc

SEQ ID NO: 2940074 - RNA, 16 nt, Mycobacterium avium subsp. paratuberculosis
cggcgugcaccgcccg

SEQ ID NO: 2940075 - RNA, 19 nt, Mycobacterium avium subsp. paratuberculosis
cggcgugcaccgcccgcgc

SEQ ID NO: 2940076 - RNA, 21 nt, Mycobacterium avium subsp. paratuberculosis
cggcgugcagcacgcccucgg

SEQ ID NO: 2940077 - RNA, 20 nt, Mycobacterium avium subsp. paratuberculosis
cggcgugcagcacggggacg

SEQ ID NO: 2940078 - RNA, 14 nt, Mycobacterium avium subsp. paratuberculosis
cggcgugcaguccc

SEQ ID NO: 2940079 - RNA, 12 nt, Mycobacterium avium subsp. paratuberculosis
cggcgugccacc

SEQ ID NO: 2940080 - RNA, 15 nt, Mycobacterium avium subsp. paratuberculosis
cggcgugccagggca

SEQ ID NO: 2940081 - RNA, 19 nt, Mycobacterium avium subsp. paratuberculosis
cggcgugccagggcagcgc

SEQ ID NO: 2940082 - RNA, 21 nt, Mycobacterium avium subsp. paratuberculosis
cggcgugccagggcagcgcga

SEQ ID NO: 2940083 - RNA, 22 nt, Mycobacterium avium subsp. paratuberculosis
cggcgugccagggcagcgcgac

SEQ ID NO: 2940084 - RNA, 23 nt, Mycobacterium avium subsp. paratuberculosis
cggcgugccagggcagcgcgacc

SEQ ID NO: 2940085 - RNA, 14 nt, Mycobacterium avium subsp. paratuberculosis
cggcgugcccgccg

SEQ ID NO: 2940086 - RNA, 15 nt, Mycobacterium avium subsp. paratuberculosis
cggcgugcccgccga

SEQ ID NO: 2940087 - RNA, 20 nt, Mycobacterium avium subsp. paratuberculosis
cggcgugcccgccgaccagg

SEQ ID NO: 2940088 - RNA, 13 nt, Mycobacterium avium subsp. paratuberculosis
cggcgugccgccc

SEQ ID NO: 2940089 - RNA, 14 nt, Mycobacterium avium subsp. paratuberculosis
cggcgugccgcccg

SEQ ID NO: 2940090 - RNA, 15 nt, Mycobacterium avium subsp. paratuberculosis
cggcgugccgcccgg

SEQ ID NO: 2940091 - RNA, 17 nt, Mycobacterium avium subsp. paratuberculosis
cggcgugccgcccggac

SEQ ID NO: 2940092 - RNA, 19 nt, Mycobacterium avium subsp. paratuberculosis
cggcgugccgcccggaccg

SEQ ID NO: 2940093 - RNA, 15 nt, Mycobacterium avium subsp. paratuberculosis
cggcgugccggacuc

SEQ ID NO: 2940094 - RNA, 22 nt, Mycobacterium avium subsp. paratuberculosis
cggcgugcgccaguuugccguc

SEQ ID NO: 2940095 - RNA, 14 nt, Mycobacterium avium subsp. paratuberculosis
cggcgugcggucgc

SEQ ID NO: 2940096 - RNA, 19 nt, Mycobacterium avium subsp. paratuberculosis
cggcgugcggucgcgggac

SEQ ID NO: 2940097 - RNA, 14 nt, Mycobacterium avium subsp. paratuberculosis
cggcgugcuccagc

SEQ ID NO: 2940098 - RNA, 15 nt, Mycobacterium avium subsp. paratuberculosis
cggcgugcuccagca

SEQ ID NO: 2940099 - RNA, 16 nt, Mycobacterium avium subsp. paratuberculosis
cggcgugcuccagcag

SEQ ID NO: 2940100 - RNA, 21 nt, Mycobacterium avium subsp. paratuberculosis
cggcgugcuccagcaggcgcg

SEQ ID NO: 2940101 - RNA, 22 nt, Mycobacterium avium subsp. paratuberculosis
cggcgugcuccagcaggcgcgc

SEQ ID NO: 2940102 - RNA, 15 nt, Mycobacterium avium subsp. paratuberculosis
cggcgugcucggcca

SEQ ID NO: 2940103 - RNA, 16 nt, Mycobacterium avium subsp. paratuberculosis
cggcgugcucggccac

SEQ ID NO: 2940104 - RNA, 17 nt, Mycobacterium avium subsp. paratuberculosis
cggcgugcucggccacg

SEQ ID NO: 2940105 - RNA, 21 nt, Mycobacterium avium subsp. paratuberculosis
cggcgugcucggccacgacgc

SEQ ID NO: 2940106 - RNA, 22 nt, Mycobacterium avium subsp. paratuberculosis
cggcgugcucggccacgacgcg

SEQ ID NO: 2940107 - RNA, 19 nt, Mycobacterium avium subsp. paratuberculosis
cggcgugcucgucgcggag

SEQ ID NO: 2940108 - RNA, 19 nt, Mycobacterium avium subsp. paratuberculosis
cggcguuggacagcucgac

SEQ ID NO: 2940109 - RNA, 21 nt, Mycobacterium avium subsp. paratuberculosis
cggcguuggacagcucgacga

SEQ ID NO: 2940110 - RNA, 13 nt, Mycobacterium avium subsp. paratuberculosis
cggcguuggccgc

SEQ ID NO: 2940111 - RNA, 18 nt, Mycobacterium avium subsp. paratuberculosis
cggcguuggccgccgccu

SEQ ID NO: 2940112 - RNA, 18 nt, Mycobacterium avium subsp. paratuberculosis
cggcguuggcggcgucga

SEQ ID NO: 2940113 - RNA, 13 nt, Mycobacterium avium subsp. paratuberculosis
cggcguuggcgua

SEQ ID NO: 2940114 - RNA, 23 nt, Mycobacterium avium subsp. paratuberculosis
cggcguugguccacacguccugg

SEQ ID NO: 2940115 - RNA, 15 nt, Mycobacterium avium subsp. paratuberculosis
cggcguuguccaggu

SEQ ID NO: 2940116 - RNA, 15 nt, Mycobacterium avium subsp. paratuberculosis
cggcguuguggccac

SEQ ID NO: 2940117 - RNA, 17 nt, Mycobacterium avium subsp. paratuberculosis
cggcguuguggccaccg

SEQ ID NO: 2940118 - RNA, 23 nt, Mycobacterium avium subsp. paratuberculosis
cggcguuguggccaccgaugccc

SEQ ID NO: 2940119 - RNA, 14 nt, Mycobacterium avium subsp. paratuberculosis
cggcuaagccggcg

SEQ ID NO: 2940120 - RNA, 18 nt, Mycobacterium avium subsp. paratuberculosis
cggcuaagccggcgucgg

SEQ ID NO: 2940121 - RNA, 19 nt, Mycobacterium avium subsp. paratuberculosis
cggcuaagccggcgucggg

SEQ ID NO: 2940122 - RNA, 19 nt, Mycobacterium avium subsp. paratuberculosis
cggcuaauucagcugcgga

SEQ ID NO: 2940123 - RNA, 17 nt, Mycobacterium avium subsp. paratuberculosis
cggcuaauucgggccgc

SEQ ID NO: 2940124 - RNA, 18 nt, Mycobacterium avium subsp. paratuberculosis
cggcuaauucgggccgcc

SEQ ID NO: 2940125 - RNA, 19 nt, Mycobacterium avium subsp. paratuberculosis
cggcuacagcaacauccug

SEQ ID NO: 2940126 - RNA, 14 nt, Mycobacterium avium subsp. paratuberculosis
cggcuaccgcgcgg

SEQ ID NO: 2940127 - RNA, 17 nt, Mycobacterium avium subsp. paratuberculosis
cggcuaccggcgcugga

SEQ ID NO: 2940128 - RNA, 17 nt, Mycobacterium avium subsp. paratuberculosis
cggcuaccugaccagcg

SEQ ID NO: 2940129 - RNA, 18 nt, Mycobacterium avium subsp. paratuberculosis
cggcuacucggacgccgg

SEQ ID NO: 2940130 - RNA, 19 nt, Mycobacterium avium subsp. paratuberculosis
cggcuacucggacgccggc

SEQ ID NO: 2940131 - RNA, 21 nt, Mycobacterium avium subsp. paratuberculosis
cggcuacucggacgccggcag

SEQ ID NO: 2940132 - RNA, 22 nt, Mycobacterium avium subsp. paratuberculosis
cggcuacucggacgccggcagc

SEQ ID NO: 2940133 - RNA, 14 nt, Mycobacterium avium subsp. paratuberculosis
cggcuagacgcgca

SEQ ID NO: 2940134 - RNA, 19 nt, Mycobacterium avium subsp. paratuberculosis
cggcuagacgcgcagcacg

SEQ ID NO: 2940135 - RNA, 20 nt, Mycobacterium avium subsp. paratuberculosis
cggcuagcagcuccggucgg

SEQ ID NO: 2940136 - RNA, 22 nt, Mycobacterium avium subsp. paratuberculosis
cggcucaaaccguugaccacca

SEQ ID NO: 2940137 - RNA, 23 nt, Mycobacterium avium subsp. paratuberculosis
cggcucaaaccguugaccaccag

SEQ ID NO: 2940138 - RNA, 12 nt, Mycobacterium avium subsp. paratuberculosis
cggcucaacggc

SEQ ID NO: 2940139 - RNA, 14 nt, Mycobacterium avium subsp. paratuberculosis
cggcucaacggccg

SEQ ID NO: 2940140 - RNA, 16 nt, Mycobacterium avium subsp. paratuberculosis
cggcucaacggccggc

SEQ ID NO: 2940141 - RNA, 18 nt, Mycobacterium avium subsp. paratuberculosis
cggcucaacggccggcgc

SEQ ID NO: 2940142 - RNA, 20 nt, Mycobacterium avium subsp. paratuberculosis
cggcucaacggccggcgccg

SEQ ID NO: 2940143 - RNA, 16 nt, Mycobacterium avium subsp. paratuberculosis
cggcucacagcgcggc

SEQ ID NO: 2940144 - RNA, 17 nt, Mycobacterium avium subsp. paratuberculosis
cggcucacagcgcggcg

SEQ ID NO: 2940145 - RNA, 15 nt, Mycobacterium avium subsp. paratuberculosis
cggcucacaugggcg

SEQ ID NO: 2940146 - RNA, 18 nt, Mycobacterium avium subsp. paratuberculosis
cggcucaccgaacgcgau

SEQ ID NO: 2940147 - RNA, 19 nt, Mycobacterium avium subsp. paratuberculosis
cggcucaccgaacgcgaug

SEQ ID NO: 2940148 - RNA, 18 nt, Mycobacterium avium subsp. paratuberculosis
cggcucagcaacccgccg

SEQ ID NO: 2940149 - RNA, 14 nt, Mycobacterium avium subsp. paratuberculosis
cggcucagcccggc

SEQ ID NO: 2940150 - RNA, 15 nt, Mycobacterium avium subsp. paratuberculosis
cggcucagcccggcg

SEQ ID NO: 2940151 - RNA, 16 nt, Mycobacterium avium subsp. paratuberculosis
cggcucagcgcgacgu

SEQ ID NO: 2940152 - RNA, 14 nt, Mycobacterium avium subsp. paratuberculosis
cggcucagcggcaa

SEQ ID NO: 2940153 - RNA, 13 nt, Mycobacterium avium subsp. paratuberculosis
cggcucagggugc

SEQ ID NO: 2940154 - RNA, 16 nt, Mycobacterium avium subsp. paratuberculosis
cggcucagggugcgcu

SEQ ID NO: 2940155 - RNA, 17 nt, Mycobacterium avium subsp. paratuberculosis
cggcucagggugcgcug

SEQ ID NO: 2940156 - RNA, 22 nt, Mycobacterium avium subsp. paratuberculosis
cggcucagggugcgcuggccga

SEQ ID NO: 2940157 - RNA, 13 nt, Mycobacterium avium subsp. paratuberculosis
cggcuccacagca

SEQ ID NO: 2940158 - RNA, 21 nt, Mycobacterium avium subsp. paratuberculosis
cggcuccacagcaguuccgac

SEQ ID NO: 2940159 - RNA, 13 nt, Mycobacterium avium subsp. paratuberculosis
cggcuccaccgcg

SEQ ID NO: 2940160 - RNA, 14 nt, Mycobacterium avium subsp. paratuberculosis
cggcuccaccgcgc

SEQ ID NO: 2940161 - RNA, 15 nt, Mycobacterium avium subsp. paratuberculosis
cggcuccaccgcgcc

SEQ ID NO: 2940162 - RNA, 16 nt, Mycobacterium avium subsp. paratuberculosis
cggcuccaccgcgccg

SEQ ID NO: 2940163 - RNA, 17 nt, Mycobacterium avium subsp. paratuberculosis
cggcuccaccgcgccgg

SEQ ID NO: 2940164 - RNA, 15 nt, Mycobacterium avium subsp. paratuberculosis
cggcuccacgaugcc

SEQ ID NO: 2940165 - RNA, 13 nt, Mycobacterium avium subsp. paratuberculosis
cggcuccagcagc

SEQ ID NO: 2940166 - RNA, 15 nt, Mycobacterium avium subsp. paratuberculosis
cggcuccagcagcgg

SEQ ID NO: 2940167 - RNA, 20 nt, Mycobacterium avium subsp. paratuberculosis
cggcuccagcagcggcucgg

SEQ ID NO: 2940168 - RNA, 14 nt, Mycobacterium avium subsp. paratuberculosis
cggcuccagcgccc

SEQ ID NO: 2940169 - RNA, 18 nt, Mycobacterium avium subsp. paratuberculosis
cggcuccagcgcccgccg

SEQ ID NO: 2940170 - RNA, 20 nt, Mycobacterium avium subsp. paratuberculosis
cggcuccagcgcccgccgca

SEQ ID NO: 2940171 - RNA, 18 nt, Mycobacterium avium subsp. paratuberculosis
cggcuccauguccggagc

SEQ ID NO: 2940172 - RNA, 19 nt, Mycobacterium avium subsp. paratuberculosis
cggcuccauguccggagcg

SEQ ID NO: 2940173 - RNA, 13 nt, Mycobacterium avium subsp. paratuberculosis
cggcucccaggcc

SEQ ID NO: 2940174 - RNA, 17 nt, Mycobacterium avium subsp. paratuberculosis
cggcucccaggcccauc

SEQ ID NO: 2940175 - RNA, 19 nt, Mycobacterium avium subsp. paratuberculosis
cggcuccgagcggaugccg

SEQ ID NO: 2940176 - RNA, 19 nt, Mycobacterium avium subsp. paratuberculosis
cggcuccgaucuccuggug

SEQ ID NO: 2940177 - RNA, 18 nt, Mycobacterium avium subsp. paratuberculosis
cggcuccgcaugcccggg

SEQ ID NO: 2940178 - RNA, 22 nt, Mycobacterium avium subsp. paratuberculosis
cggcuccgcaugcccgggcgac

SEQ ID NO: 2940179 - RNA, 15 nt, Mycobacterium avium subsp. paratuberculosis
cggcuccggccgcgc

SEQ ID NO: 2940180 - RNA, 16 nt, Mycobacterium avium subsp. paratuberculosis
cggcuccggccgcgcc

SEQ ID NO: 2940181 - RNA, 17 nt, Mycobacterium avium subsp. paratuberculosis
cggcuccggccgcgccg

SEQ ID NO: 2940182 - RNA, 18 nt, Mycobacterium avium subsp. paratuberculosis
cggcuccggccgcgccgg

SEQ ID NO: 2940183 - RNA, 19 nt, Mycobacterium avium subsp. paratuberculosis
cggcuccggccgcgccggc

SEQ ID NO: 2940184 - RNA, 17 nt, Mycobacterium avium subsp. paratuberculosis
cggcuccuaugucggug

SEQ ID NO: 2940185 - RNA, 12 nt, Mycobacterium avium subsp. paratuberculosis
cggcuccugccg

SEQ ID NO: 2940186 - RNA, 22 nt, Mycobacterium avium subsp. paratuberculosis
cggcuccugccguucggccagc

SEQ ID NO: 2940187 - RNA, 23 nt, Mycobacterium avium subsp. paratuberculosis
cggcuccugccguucggccagcg

SEQ ID NO: 2940188 - RNA, 15 nt, Mycobacterium avium subsp. paratuberculosis
cggcuccuugcgccg

SEQ ID NO: 2940189 - RNA, 18 nt, Mycobacterium avium subsp. paratuberculosis
cggcucgaaaugccuugg

SEQ ID NO: 2940190 - RNA, 22 nt, Mycobacterium avium subsp. paratuberculosis
cggcucgaaaugccuuggcggc

SEQ ID NO: 2940191 - RNA, 17 nt, Mycobacterium avium subsp. paratuberculosis
cggcucgaaguggcagc

SEQ ID NO: 2940192 - RNA, 15 nt, Mycobacterium avium subsp. paratuberculosis
cggcucgaccucacc

SEQ ID NO: 2940193 - RNA, 19 nt, Mycobacterium avium subsp. paratuberculosis
cggcucuuggcgaccucgu

SEQ ID NO: 2940194 - RNA, 14 nt, Mycobacterium avium subsp. paratuberculosis
cggcugaaccaccg

SEQ ID NO: 2940195 - RNA, 16 nt, Mycobacterium avium subsp. paratuberculosis
cggcugaaccugcugg

SEQ ID NO: 2940196 - RNA, 22 nt, Mycobacterium avium subsp. paratuberculosis
cggcugaaccugcugggcggca

SEQ ID NO: 2940197 - RNA, 15 nt, Mycobacterium avium subsp. paratuberculosis
cggcugaacgccagc

SEQ ID NO: 2940198 - RNA, 16 nt, Mycobacterium avium subsp. paratuberculosis
cggcugaacgccagca

SEQ ID NO: 2940199 - RNA, 18 nt, Mycobacterium avium subsp. paratuberculosis
cggcugaacgccagcagc

SEQ ID NO: 2940200 - RNA, 20 nt, Mycobacterium avium subsp. paratuberculosis
cggcugaacgccagcagccg

SEQ ID NO: 2940201 - RNA, 21 nt, Mycobacterium avium subsp. paratuberculosis
cggcugaacgccagcagccgc

SEQ ID NO: 2940202 - RNA, 22 nt, Mycobacterium avium subsp. paratuberculosis
cggcugaagcgcugggacagcg

SEQ ID NO: 2940203 - RNA, 15 nt, Mycobacterium avium subsp. paratuberculosis
cggcugacccgcccg

SEQ ID NO: 2940204 - RNA, 16 nt, Mycobacterium avium subsp. paratuberculosis
cggcugacccgcccgg

SEQ ID NO: 2940205 - RNA, 15 nt, Mycobacterium avium subsp. paratuberculosis
cggcugaccgagcgg

SEQ ID NO: 2940206 - RNA, 16 nt, Mycobacterium avium subsp. paratuberculosis
cggcugaccgagcggc

SEQ ID NO: 2940207 - RNA, 19 nt, Mycobacterium avium subsp. paratuberculosis
cggcugaccgagcggcgcu

SEQ ID NO: 2940208 - RNA, 20 nt, Mycobacterium avium subsp. paratuberculosis
cggcugaccgagcggcgcug

SEQ ID NO: 2940209 - RNA, 24 nt, Mycobacterium avium subsp. paratuberculosis
cggcugaccgagcggcgcugcagc

SEQ ID NO: 2940210 - RNA, 13 nt, Mycobacterium avium subsp. paratuberculosis
cggcugaccggcg

SEQ ID NO: 2940211 - RNA, 15 nt, Mycobacterium avium subsp. paratuberculosis
cggcugaccggcggu

SEQ ID NO: 2940212 - RNA, 16 nt, Mycobacterium avium subsp. paratuberculosis
cggcugacugccggcg

SEQ ID NO: 2940213 - RNA, 18 nt, Mycobacterium avium subsp. paratuberculosis
cggcugagcagccagucg

SEQ ID NO: 2940214 - RNA, 14 nt, Mycobacterium avium subsp. paratuberculosis
cggcugagcgucgg

SEQ ID NO: 2940215 - RNA, 19 nt, Mycobacterium avium subsp. paratuberculosis
cggcugcacccucugccac

SEQ ID NO: 2940216 - RNA, 22 nt, Mycobacterium avium subsp. paratuberculosis
cggcugcacccucugccacggc

SEQ ID NO: 2940217 - RNA, 12 nt, Mycobacterium avium subsp. paratuberculosis
cggcugcagcag

SEQ ID NO: 2940218 - RNA, 17 nt, Mycobacterium avium subsp. paratuberculosis
cggcugcagccgggcgg

SEQ ID NO: 2940219 - RNA, 20 nt, Mycobacterium avium subsp. paratuberculosis
cggcugcagccgggcggcgg

SEQ ID NO: 2940220 - RNA, 16 nt, Mycobacterium avium subsp. paratuberculosis
cggcugcaggcagcga

SEQ ID NO: 2940221 - RNA, 16 nt, Mycobacterium avium subsp. paratuberculosis
cggcugcaucaugccg

SEQ ID NO: 2940222 - RNA, 19 nt, Mycobacterium avium subsp. paratuberculosis
cggcugcaucaugccgccc

SEQ ID NO: 2940223 - RNA, 20 nt, Mycobacterium avium subsp. paratuberculosis
cggcugcaucaugccgccca

SEQ ID NO: 2940224 - RNA, 23 nt, Mycobacterium avium subsp. paratuberculosis
cggcugcaucaugccgcccauca

SEQ ID NO: 2940225 - RNA, 13 nt, Mycobacterium avium subsp. paratuberculosis
cggcugcccagga

SEQ ID NO: 2940226 - RNA, 14 nt, Mycobacterium avium subsp. paratuberculosis
cggcugccccaggg

SEQ ID NO: 2940227 - RNA, 22 nt, Mycobacterium avium subsp. paratuberculosis
cggcugccccagggaccagugg

SEQ ID NO: 2940228 - RNA, 20 nt, Mycobacterium avium subsp. paratuberculosis
cggcugcccgacccgcacca

SEQ ID NO: 2940229 - RNA, 21 nt, Mycobacterium avium subsp. paratuberculosis
cggcugcccgacccgcaccac

SEQ ID NO: 2940230 - RNA, 23 nt, Mycobacterium avium subsp. paratuberculosis
cggcugcccgacccgcaccaccg

SEQ ID NO: 2940231 - RNA, 13 nt, Mycobacterium avium subsp. paratuberculosis
cggcugcccgcga

SEQ ID NO: 2940232 - RNA, 14 nt, Mycobacterium avium subsp. paratuberculosis
cggcugcccgcgac

SEQ ID NO: 2940233 - RNA, 15 nt, Mycobacterium avium subsp. paratuberculosis
cggcugcccgcgacu

SEQ ID NO: 2940234 - RNA, 20 nt, Mycobacterium avium subsp. paratuberculosis
cggcugcccgcgacugucgg

SEQ ID NO: 2940235 - RNA, 21 nt, Mycobacterium avium subsp. paratuberculosis
cggcugcccgcgacugucggc

SEQ ID NO: 2940236 - RNA, 21 nt, Mycobacterium avium subsp. paratuberculosis
cggcugcccgcgcggcucaca

SEQ ID NO: 2940237 - RNA, 13 nt, Mycobacterium avium subsp. paratuberculosis
cggcugcccggcc

SEQ ID NO: 2940238 - RNA, 15 nt, Mycobacterium avium subsp. paratuberculosis
cggcugcccggcccg

SEQ ID NO: 2940239 - RNA, 18 nt, Mycobacterium avium subsp. paratuberculosis
cggcugcccggcccgccg

SEQ ID NO: 2940240 - RNA, 15 nt, Mycobacterium avium subsp. paratuberculosis
cggcugccgaccucg

SEQ ID NO: 2940241 - RNA, 19 nt, Mycobacterium avium subsp. paratuberculosis
cggcugccgaccucgaugg

SEQ ID NO: 2940242 - RNA, 21 nt, Mycobacterium avium subsp. paratuberculosis
cggcugccgaccucgauggcg

SEQ ID NO: 2940243 - RNA, 22 nt, Mycobacterium avium subsp. paratuberculosis
cggcugccgaccucgauggcga

SEQ ID NO: 2940244 - RNA, 14 nt, Mycobacterium avium subsp. paratuberculosis
cggcugccggccaa

SEQ ID NO: 2940245 - RNA, 20 nt, Mycobacterium avium subsp. paratuberculosis
cggcugcgcagcgcagcacc

SEQ ID NO: 2940246 - RNA, 18 nt, Mycobacterium avium subsp. paratuberculosis
cggcugcgcguucggcgc

SEQ ID NO: 2940247 - RNA, 22 nt, Mycobacterium avium subsp. paratuberculosis
cggcugcgcguucggcgccacc

SEQ ID NO: 2940248 - RNA, 16 nt, Mycobacterium avium subsp. paratuberculosis
cggcugcgggccagcg

SEQ ID NO: 2940249 - RNA, 21 nt, Mycobacterium avium subsp. paratuberculosis
cggcugcgggccagcgcaucg

SEQ ID NO: 2940250 - RNA, 20 nt, Mycobacterium avium subsp. paratuberculosis
cggcugcgguuggccggccg

SEQ ID NO: 2940251 - RNA, 15 nt, Mycobacterium avium subsp. paratuberculosis
cggcugcucgaaccg

SEQ ID NO: 2940252 - RNA, 18 nt, Mycobacterium avium subsp. paratuberculosis
cggcugcucgaaccgcga

SEQ ID NO: 2940253 - RNA, 23 nt, Mycobacterium avium subsp. paratuberculosis
cggcugcucgcgcugccgcgcgc

SEQ ID NO: 2940254 - RNA, 14 nt, Mycobacterium avium subsp. paratuberculosis
cggcugcugcacga

SEQ ID NO: 2940255 - RNA, 17 nt, Mycobacterium avium subsp. paratuberculosis
cggcugcugcacgacga

SEQ ID NO: 2940256 - RNA, 16 nt, Mycobacterium avium subsp. paratuberculosis
cggcugcugcagcgcc

SEQ ID NO: 2940257 - RNA, 21 nt, Mycobacterium avium subsp. paratuberculosis
cggcugcugcagcgcccgggc

SEQ ID NO: 2940258 - RNA, 22 nt, Mycobacterium avium subsp. paratuberculosis
cggcugcugcagcgcccgggcc

SEQ ID NO: 2940259 - RNA, 14 nt, Mycobacterium avium subsp. paratuberculosis
cggcugcugcgcgg

SEQ ID NO: 2940260 - RNA, 16 nt, Mycobacterium avium subsp. paratuberculosis
cggcugcugcgcggca

SEQ ID NO: 2940261 - RNA, 17 nt, Mycobacterium avium subsp. paratuberculosis
cggcugcugcgcggcac

SEQ ID NO: 2940262 - RNA, 22 nt, Mycobacterium avium subsp. paratuberculosis
cggcugcuguucguccgugcug

SEQ ID NO: 2940263 - RNA, 20 nt, Mycobacterium avium subsp. paratuberculosis
cggcuggaacaucccggagc

SEQ ID NO: 2940264 - RNA, 20 nt, Mycobacterium avium subsp. paratuberculosis
cggcuggaaucccgccucgg

SEQ ID NO: 2940265 - RNA, 21 nt, Mycobacterium avium subsp. paratuberculosis
cggcuggaaucccgccucggc

SEQ ID NO: 2940266 - RNA, 13 nt, Mycobacterium avium subsp. paratuberculosis
cggcuggacaccc

SEQ ID NO: 2940267 - RNA, 17 nt, Mycobacterium avium subsp. paratuberculosis
cggcuggacacccccga

SEQ ID NO: 2940268 - RNA, 13 nt, Mycobacterium avium subsp. paratuberculosis
cggcuggcccggc

SEQ ID NO: 2940269 - RNA, 15 nt, Mycobacterium avium subsp. paratuberculosis
cggcuggcccggcgc

SEQ ID NO: 2940270 - RNA, 16 nt, Mycobacterium avium subsp. paratuberculosis
cggcuggcccggcgcg

SEQ ID NO: 2940271 - RNA, 20 nt, Mycobacterium avium subsp. paratuberculosis
cggcuggcccggcgcggcgg

SEQ ID NO: 2940272 - RNA, 22 nt, Mycobacterium avium subsp. paratuberculosis
cggcuggcccggcgcggcggcg

SEQ ID NO: 2940273 - RNA, 13 nt, Mycobacterium avium subsp. paratuberculosis
cggcuggccgagc

SEQ ID NO: 2940274 - RNA, 14 nt, Mycobacterium avium subsp. paratuberculosis
cggcuggccgagcg

SEQ ID NO: 2940275 - RNA, 21 nt, Mycobacterium avium subsp. paratuberculosis
cggcuggccgagcggcugcug

SEQ ID NO: 2940276 - RNA, 14 nt, Mycobacterium avium subsp. paratuberculosis
cggcuggccgcaca

SEQ ID NO: 2940277 - RNA, 18 nt, Mycobacterium avium subsp. paratuberculosis
cgggaaaucggacccagc

SEQ ID NO: 2940278 - RNA, 15 nt, Mycobacterium avium subsp. paratuberculosis
cgggaaaugcgucgg

SEQ ID NO: 2940279 - RNA, 19 nt, Mycobacterium avium subsp. paratuberculosis
cgggaaaugcgucggcagu

SEQ ID NO: 2940280 - RNA, 23 nt, Mycobacterium avium subsp. paratuberculosis
cgggaaaugcugcacccaccggc

SEQ ID NO: 2940281 - RNA, 15 nt, Mycobacterium avium subsp. paratuberculosis
cgggaacaccacguc

SEQ ID NO: 2940282 - RNA, 19 nt, Mycobacterium avium subsp. paratuberculosis
cgggaacacguagcgaucg

SEQ ID NO: 2940283 - RNA, 16 nt, Mycobacterium avium subsp. paratuberculosis
cgggaacagccaggcg

SEQ ID NO: 2940284 - RNA, 16 nt, Mycobacterium avium subsp. paratuberculosis
cgggaacagcccgccc

SEQ ID NO: 2940285 - RNA, 16 nt, Mycobacterium avium subsp. paratuberculosis
cgggaacagcgacgcc

SEQ ID NO: 2940286 - RNA, 17 nt, Mycobacterium avium subsp. paratuberculosis
cgggaacagcgacgccc

SEQ ID NO: 2940287 - RNA, 18 nt, Mycobacterium avium subsp. paratuberculosis
cgggaacagcgacgccca

SEQ ID NO: 2940288 - RNA, 17 nt, Mycobacterium avium subsp. paratuberculosis
cgggaaccagcccaggu

SEQ ID NO: 2940289 - RNA, 21 nt, Mycobacterium avium subsp. paratuberculosis
cgggaacccauucggucaucg

SEQ ID NO: 2940290 - RNA, 15 nt, Mycobacterium avium subsp. paratuberculosis
cgggaaccuggccgu

SEQ ID NO: 2940291 - RNA, 19 nt, Mycobacterium avium subsp. paratuberculosis
cgggaacgacggugcgccc

SEQ ID NO: 2940292 - RNA, 20 nt, Mycobacterium avium subsp. paratuberculosis
cgggaacgacggugcgcccg

SEQ ID NO: 2940293 - RNA, 14 nt, Mycobacterium avium subsp. paratuberculosis
cgggaacgaucggc

SEQ ID NO: 2940294 - RNA, 17 nt, Mycobacterium avium subsp. paratuberculosis
cgggaacgcggcgaagg

SEQ ID NO: 2940295 - RNA, 20 nt, Mycobacterium avium subsp. paratuberculosis
cgggaacgcgucgaacaccc

SEQ ID NO: 2940296 - RNA, 20 nt, Mycobacterium avium subsp. paratuberculosis
cgggaacggguagugcacgg

SEQ ID NO: 2940297 - RNA, 17 nt, Mycobacterium avium subsp. paratuberculosis
cgggaacggucagccgc

SEQ ID NO: 2940298 - RNA, 23 nt, Mycobacterium avium subsp. paratuberculosis
cgggaacgucauggccagcucgu

SEQ ID NO: 2940299 - RNA, 17 nt, Mycobacterium avium subsp. paratuberculosis
cgggaacucgaugcggc

SEQ ID NO: 2940300 - RNA, 20 nt, Mycobacterium avium subsp. paratuberculosis
cgggaacucgaugcggcagc

SEQ ID NO: 2940301 - RNA, 16 nt, Mycobacterium avium subsp. paratuberculosis
cgggaacucggccagc

SEQ ID NO: 2940302 - RNA, 20 nt, Mycobacterium avium subsp. paratuberculosis
cgggaacucggccagcuggu

SEQ ID NO: 2940303 - RNA, 22 nt, Mycobacterium avium subsp. paratuberculosis
cgggaagaucgcagcggugaca

SEQ ID NO: 2940304 - RNA, 17 nt, Mycobacterium avium subsp. paratuberculosis
cgggaagcccaccgcgg

SEQ ID NO: 2940305 - RNA, 19 nt, Mycobacterium avium subsp. paratuberculosis
cgggaagcccaccgcggug

SEQ ID NO: 2940306 - RNA, 19 nt, Mycobacterium avium subsp. paratuberculosis
cgggaagccgaggucgccg

SEQ ID NO: 2940307 - RNA, 21 nt, Mycobacterium avium subsp. paratuberculosis
cgggaagccgaggucgccgac

SEQ ID NO: 2940308 - RNA, 22 nt, Mycobacterium avium subsp. paratuberculosis
cgggaagccgaggucgccgacg

SEQ ID NO: 2940309 - RNA, 23 nt, Mycobacterium avium subsp. paratuberculosis
cgggaagccgaggucgccgacgc

SEQ ID NO: 2940310 - RNA, 16 nt, Mycobacterium avium subsp. paratuberculosis
cgggaagccgcagcag

SEQ ID NO: 2940311 - RNA, 17 nt, Mycobacterium avium subsp. paratuberculosis
cgggaagccgcagcagg

SEQ ID NO: 2940312 - RNA, 13 nt, Mycobacterium avium subsp. paratuberculosis
cgggaagccgccg

SEQ ID NO: 2940313 - RNA, 16 nt, Mycobacterium avium subsp. paratuberculosis
cgggaagccgccgccc

SEQ ID NO: 2940314 - RNA, 19 nt, Mycobacterium avium subsp. paratuberculosis
cgggaagcgaagcgggacu

SEQ ID NO: 2940315 - RNA, 20 nt, Mycobacterium avium subsp. paratuberculosis
cgggaagcugguggugaucg

SEQ ID NO: 2940316 - RNA, 16 nt, Mycobacterium avium subsp. paratuberculosis
cgggaaggcggccgcg

SEQ ID NO: 2940317 - RNA, 17 nt, Mycobacterium avium subsp. paratuberculosis
cgggaaggcggccgcga

SEQ ID NO: 2940318 - RNA, 16 nt, Mycobacterium avium subsp. paratuberculosis
cgggaaggugucggcc

SEQ ID NO: 2940319 - RNA, 18 nt, Mycobacterium avium subsp. paratuberculosis
cgggaaggugucggccgg

SEQ ID NO: 2940320 - RNA, 19 nt, Mycobacterium avium subsp. paratuberculosis
cgggaaggugucggccggg

SEQ ID NO: 2940321 - RNA, 19 nt, Mycobacterium avium subsp. paratuberculosis
cgggaaguagggcagcccg

SEQ ID NO: 2940322 - RNA, 20 nt, Mycobacterium avium subsp. paratuberculosis
cgggaaguagggcagcccga

SEQ ID NO: 2940323 - RNA, 22 nt, Mycobacterium avium subsp. paratuberculosis
cgggaaguagggcagcccgaac

SEQ ID NO: 2940324 - RNA, 13 nt, Mycobacterium avium subsp. paratuberculosis
cgggaagucgucg

SEQ ID NO: 2940325 - RNA, 23 nt, Mycobacterium avium subsp. paratuberculosis
cgggaaguugcccaacuggcgac

SEQ ID NO: 2940326 - RNA, 14 nt, Mycobacterium avium subsp. paratuberculosis
cgggaaucacgccc

SEQ ID NO: 2940327 - RNA, 15 nt, Mycobacterium avium subsp. paratuberculosis
cgggaaucacgcccc

SEQ ID NO: 2940328 - RNA, 22 nt, Mycobacterium avium subsp. paratuberculosis
cgggaaucacgccccaggcgcc

SEQ ID NO: 2940329 - RNA, 18 nt, Mycobacterium avium subsp. paratuberculosis
cgggaaucccacccgcaa

SEQ ID NO: 2940330 - RNA, 21 nt, Mycobacterium avium subsp. paratuberculosis
cgggaaucgagggcgcgcagc

SEQ ID NO: 2940331 - RNA, 15 nt, Mycobacterium avium subsp. paratuberculosis
cgggaauggccgcgc

SEQ ID NO: 2940332 - RNA, 16 nt, Mycobacterium avium subsp. paratuberculosis
cgggaauggccgcgcc

SEQ ID NO: 2940333 - RNA, 17 nt, Mycobacterium avium subsp. paratuberculosis
cgggaauggccgcgccg

SEQ ID NO: 2940334 - RNA, 17 nt, Mycobacterium avium subsp. paratuberculosis
cgggaaugucgcgcagc

SEQ ID NO: 2940335 - RNA, 18 nt, Mycobacterium avium subsp. paratuberculosis
cgggaaugucgcgcagca

SEQ ID NO: 2940336 - RNA, 17 nt, Mycobacterium avium subsp. paratuberculosis
cgggaauuggcaccgga

SEQ ID NO: 2940337 - RNA, 18 nt, Mycobacterium avium subsp. paratuberculosis
cgggaauuggcaccggac

SEQ ID NO: 2940338 - RNA, 18 nt, Mycobacterium avium subsp. paratuberculosis
cgggacaccgcuggccga

SEQ ID NO: 2940339 - RNA, 21 nt, Mycobacterium avium subsp. paratuberculosis
cgggacaccgcuggccgaggc

SEQ ID NO: 2940340 - RNA, 13 nt, Mycobacterium avium subsp. paratuberculosis
cgggacacggcgg

SEQ ID NO: 2940341 - RNA, 20 nt, Mycobacterium avium subsp. paratuberculosis
cgggacacggcggcgcgggc

SEQ ID NO: 2940342 - RNA, 15 nt, Mycobacterium avium subsp. paratuberculosis
cgggacagcaaucgg

SEQ ID NO: 2940343 - RNA, 17 nt, Mycobacterium avium subsp. paratuberculosis
cgggacagcaccaccag

SEQ ID NO: 2940344 - RNA, 13 nt, Mycobacterium avium subsp. paratuberculosis
cgggacagcccga

SEQ ID NO: 2940345 - RNA, 16 nt, Mycobacterium avium subsp. paratuberculosis
cgggacagccgcgccg

SEQ ID NO: 2940346 - RNA, 18 nt, Mycobacterium avium subsp. paratuberculosis
cgggacagccgcgccgac

SEQ ID NO: 2940347 - RNA, 19 nt, Mycobacterium avium subsp. paratuberculosis
cgggacagccgcgccgaca

SEQ ID NO: 2940348 - RNA, 20 nt, Mycobacterium avium subsp. paratuberculosis
cgggacagccgcgccgacag

SEQ ID NO: 2940349 - RNA, 18 nt, Mycobacterium avium subsp. paratuberculosis
cgggacagguagcgcagc

SEQ ID NO: 2940350 - RNA, 20 nt, Mycobacterium avium subsp. paratuberculosis
cgggacagguagcgcagccc

SEQ ID NO: 2940351 - RNA, 13 nt, Mycobacterium avium subsp. paratuberculosis
cgggaccacccgc

SEQ ID NO: 2940352 - RNA, 14 nt, Mycobacterium avium subsp. paratuberculosis
cgggaccacccgca

SEQ ID NO: 2940353 - RNA, 15 nt, Mycobacterium avium subsp. paratuberculosis
cgggaccacccgcag

SEQ ID NO: 2940354 - RNA, 16 nt, Mycobacterium avium subsp. paratuberculosis
cgggaccacccgcagc

SEQ ID NO: 2940355 - RNA, 22 nt, Mycobacterium avium subsp. paratuberculosis
cgggaccacccgcagcgcggcg

SEQ ID NO: 2940356 - RNA, 13 nt, Mycobacterium avium subsp. paratuberculosis
cgggaccagcgcc

SEQ ID NO: 2940357 - RNA, 15 nt, Mycobacterium avium subsp. paratuberculosis
cgggaccagcgccuc

SEQ ID NO: 2940358 - RNA, 19 nt, Mycobacterium avium subsp. paratuberculosis
cgggaccagcgccucggcc

SEQ ID NO: 2940359 - RNA, 20 nt, Mycobacterium avium subsp. paratuberculosis
cgggaccagcgccucggccu

SEQ ID NO: 2940360 - RNA, 15 nt, Mycobacterium avium subsp. paratuberculosis
cgggaccagcgcggu

SEQ ID NO: 2940361 - RNA, 18 nt, Mycobacterium avium subsp. paratuberculosis
cgggauagccgagcggcg

SEQ ID NO: 2940362 - RNA, 22 nt, Mycobacterium avium subsp. paratuberculosis
cgggauagggcgcgucgaucgc

SEQ ID NO: 2940363 - RNA, 15 nt, Mycobacterium avium subsp. paratuberculosis
cgggauaguccggca

SEQ ID NO: 2940364 - RNA, 17 nt, Mycobacterium avium subsp. paratuberculosis
cgggauaguccggcaug

SEQ ID NO: 2940365 - RNA, 19 nt, Mycobacterium avium subsp. paratuberculosis
cgggauaguucgccgccgc

SEQ ID NO: 2940366 - RNA, 22 nt, Mycobacterium avium subsp. paratuberculosis
cgggauaguucgccgccgccag

SEQ ID NO: 2940367 - RNA, 23 nt, Mycobacterium avium subsp. paratuberculosis
cgggauaugcgccugcacggugc

SEQ ID NO: 2940368 - RNA, 17 nt, Mycobacterium avium subsp. paratuberculosis
cgggauauucgcccagc

SEQ ID NO: 2940369 - RNA, 21 nt, Mycobacterium avium subsp. paratuberculosis
cgggauauucgcccagcggca

SEQ ID NO: 2940370 - RNA, 17 nt, Mycobacterium avium subsp. paratuberculosis
cgggaucaacacgaacu

SEQ ID NO: 2940371 - RNA, 13 nt, Mycobacterium avium subsp. paratuberculosis
cgggaucacacgc

SEQ ID NO: 2940372 - RNA, 18 nt, Mycobacterium avium subsp. paratuberculosis
cgggaucacacgcgcgcc

SEQ ID NO: 2940373 - RNA, 19 nt, Mycobacterium avium subsp. paratuberculosis
cgggaucacacgcgcgccc

SEQ ID NO: 2940374 - RNA, 15 nt, Mycobacterium avium subsp. paratuberculosis
cgggaucacccucgg

SEQ ID NO: 2940375 - RNA, 19 nt, Mycobacterium avium subsp. paratuberculosis
cgggaucacccucggcguc

SEQ ID NO: 2940376 - RNA, 20 nt, Mycobacterium avium subsp. paratuberculosis
cgggaucacccucggcgucc

SEQ ID NO: 2940377 - RNA, 14 nt, Mycobacterium avium subsp. paratuberculosis
cgggaucagcggga

SEQ ID NO: 2940378 - RNA, 16 nt, Mycobacterium avium subsp. paratuberculosis
cgggauccaggaacgg

SEQ ID NO: 2940379 - RNA, 20 nt, Mycobacterium avium subsp. paratuberculosis
cgggauccaggaacggcacc

SEQ ID NO: 2940380 - RNA, 15 nt, Mycobacterium avium subsp. paratuberculosis
cgggauccaggaauu

SEQ ID NO: 2940381 - RNA, 19 nt, Mycobacterium avium subsp. paratuberculosis
cgggauccccaccgugacg

SEQ ID NO: 2940382 - RNA, 13 nt, Mycobacterium avium subsp. paratuberculosis
cgggaucccgcag

SEQ ID NO: 2940383 - RNA, 14 nt, Mycobacterium avium subsp. paratuberculosis
cgggaucccgcagc

SEQ ID NO: 2940384 - RNA, 16 nt, Mycobacterium avium subsp. paratuberculosis
cgggaucccgcagccg

SEQ ID NO: 2940385 - RNA, 23 nt, Mycobacterium avium subsp. paratuberculosis
cgggauccggauugccgggcagc

SEQ ID NO: 2940386 - RNA, 17 nt, Mycobacterium avium subsp. paratuberculosis
cgggauccggcgcgccg

SEQ ID NO: 2940387 - RNA, 19 nt, Mycobacterium avium subsp. paratuberculosis
cgggauccggcgcgccgcg

SEQ ID NO: 2940388 - RNA, 16 nt, Mycobacterium avium subsp. paratuberculosis
cgggauccucgccgcg

SEQ ID NO: 2940389 - RNA, 17 nt, Mycobacterium avium subsp. paratuberculosis
cgggauccucgccgcgg

SEQ ID NO: 2940390 - RNA, 19 nt, Mycobacterium avium subsp. paratuberculosis
cgggauccucgccgcgggc

SEQ ID NO: 2940391 - RNA, 16 nt, Mycobacterium avium subsp. paratuberculosis
cgggaucgaucccguc

SEQ ID NO: 2940392 - RNA, 18 nt, Mycobacterium avium subsp. paratuberculosis
cgggaucgaucccgucgg

SEQ ID NO: 2940393 - RNA, 21 nt, Mycobacterium avium subsp. paratuberculosis
cgggaucgaucccgucggcca

SEQ ID NO: 2940394 - RNA, 18 nt, Mycobacterium avium subsp. paratuberculosis
cgggaucgcggcggucag

SEQ ID NO: 2940395 - RNA, 19 nt, Mycobacterium avium subsp. paratuberculosis
cgggaucggaccgcaccac

SEQ ID NO: 2940396 - RNA, 13 nt, Mycobacterium avium subsp. paratuberculosis
cgggaucggcagc

SEQ ID NO: 2940397 - RNA, 14 nt, Mycobacterium avium subsp. paratuberculosis
cgggaucggcagcg

SEQ ID NO: 2940398 - RNA, 22 nt, Mycobacterium avium subsp. paratuberculosis
cgggaucggcagcgcgcccucg

SEQ ID NO: 2940399 - RNA, 14 nt, Mycobacterium avium subsp. paratuberculosis
cgggaucggccggc

SEQ ID NO: 2940400 - RNA, 15 nt, Mycobacterium avium subsp. paratuberculosis
cgggaucggccggcg

SEQ ID NO: 2940401 - RNA, 19 nt, Mycobacterium avium subsp. paratuberculosis
cgggaucggccggcgaggu

SEQ ID NO: 2940402 - RNA, 20 nt, Mycobacterium avium subsp. paratuberculosis
cgggaucggccggcgaggug

SEQ ID NO: 2940403 - RNA, 13 nt, Mycobacterium avium subsp. paratuberculosis
cgggaucggcgcc

SEQ ID NO: 2940404 - RNA, 14 nt, Mycobacterium avium subsp. paratuberculosis
cgggaucggcgcgu

SEQ ID NO: 2940405 - RNA, 15 nt, Mycobacterium avium subsp. paratuberculosis
cgggaucggcggcgg

SEQ ID NO: 2940406 - RNA, 13 nt, Mycobacterium avium subsp. paratuberculosis
cgggaucggcggg

SEQ ID NO: 2940407 - RNA, 16 nt, Mycobacterium avium subsp. paratuberculosis
cgggaucggcggggcg

SEQ ID NO: 2940408 - RNA, 20 nt, Mycobacterium avium subsp. paratuberculosis
cgggaucggcggggcgcguu

SEQ ID NO: 2940409 - RNA, 21 nt, Mycobacterium avium subsp. paratuberculosis
cgggaucggcuuggugggcgc

SEQ ID NO: 2940410 - RNA, 17 nt, Mycobacterium avium subsp. paratuberculosis
cgggaucggggugccgc

SEQ ID NO: 2940411 - RNA, 19 nt, Mycobacterium avium subsp. paratuberculosis
cgggaucggggugccgccg

SEQ ID NO: 2940412 - RNA, 18 nt, Mycobacterium avium subsp. paratuberculosis
cgggaucggugccgacgg

SEQ ID NO: 2940413 - RNA, 16 nt, Mycobacterium avium subsp. paratuberculosis
cgggaucgucgccggg

SEQ ID NO: 2940414 - RNA, 16 nt, Mycobacterium avium subsp. paratuberculosis
cgggaucguguggccg

SEQ ID NO: 2940415 - RNA, 19 nt, Mycobacterium avium subsp. paratuberculosis
cgggaucguguggccgccc

SEQ ID NO: 2940416 - RNA, 22 nt, Mycobacterium avium subsp. paratuberculosis
cgggaucguguggccgcccucg

SEQ ID NO: 2940417 - RNA, 23 nt, Mycobacterium avium subsp. paratuberculosis
cgggaugaacucgugcggcgccg

SEQ ID NO: 2940418 - RNA, 14 nt, Mycobacterium avium subsp. paratuberculosis
cgggaugaagccgc

SEQ ID NO: 2940419 - RNA, 16 nt, Mycobacterium avium subsp. paratuberculosis
cgggaugaagccgccc

SEQ ID NO: 2940420 - RNA, 16 nt, Mycobacterium avium subsp. paratuberculosis
cgggaugacaccgcgg

SEQ ID NO: 2940421 - RNA, 18 nt, Mycobacterium avium subsp. paratuberculosis
cgggaugacaccgcggac

SEQ ID NO: 2940422 - RNA, 20 nt, Mycobacterium avium subsp. paratuberculosis
cgggaugacaccgcggacca

SEQ ID NO: 2940423 - RNA, 23 nt, Mycobacterium avium subsp. paratuberculosis
cgggaugacaccgcggaccaccg

SEQ ID NO: 2940424 - RNA, 18 nt, Mycobacterium avium subsp. paratuberculosis
cgggaugaucggcgccuu

SEQ ID NO: 2940425 - RNA, 14 nt, Mycobacterium avium subsp. paratuberculosis
cgggaugccagucc

SEQ ID NO: 2940426 - RNA, 16 nt, Mycobacterium avium subsp. paratuberculosis
cgggaugccgagcagc

SEQ ID NO: 2940427 - RNA, 14 nt, Mycobacterium avium subsp. paratuberculosis
cgggaugccgaggu

SEQ ID NO: 2940428 - RNA, 20 nt, Mycobacterium avium subsp. paratuberculosis
cgggaugccgccggucacgg

SEQ ID NO: 2940429 - RNA, 21 nt, Mycobacterium avium subsp. paratuberculosis
cgggaugccgccggucacggc

SEQ ID NO: 2940430 - RNA, 23 nt, Mycobacterium avium subsp. paratuberculosis
cgggaugccgccggucacggcgu

SEQ ID NO: 2940431 - RNA, 21 nt, Mycobacterium avium subsp. paratuberculosis
cgggaugccugcccgcgcagg

SEQ ID NO: 2940432 - RNA, 22 nt, Mycobacterium avium subsp. paratuberculosis
cgggaugccugcccgcgcaggc

SEQ ID NO: 2940433 - RNA, 16 nt, Mycobacterium avium subsp. paratuberculosis
cgggaugcgccaccga

SEQ ID NO: 2940434 - RNA, 14 nt, Mycobacterium avium subsp. paratuberculosis
cgggauggacagga

SEQ ID NO: 2940435 - RNA, 14 nt, Mycobacterium avium subsp. paratuberculosis
cgggauggagccgc

SEQ ID NO: 2940436 - RNA, 20 nt, Mycobacterium avium subsp. paratuberculosis
cgggauggcguucugcaccg

SEQ ID NO: 2940437 - RNA, 13 nt, Mycobacterium avium subsp. paratuberculosis
cgggauggcucag

SEQ ID NO: 2940438 - RNA, 21 nt, Mycobacterium avium subsp. paratuberculosis
cgggauggcucagcgcaccgc

SEQ ID NO: 2940439 - RNA, 23 nt, Mycobacterium avium subsp. paratuberculosis
cgggaugggcauugcccaucgcc

SEQ ID NO: 2940440 - RNA, 19 nt, Mycobacterium avium subsp. paratuberculosis
cgggauggguggucaccgu

SEQ ID NO: 2940441 - RNA, 20 nt, Mycobacterium avium subsp. paratuberculosis
cgggauggguggucaccgug

SEQ ID NO: 2940442 - RNA, 12 nt, Mycobacterium avium subsp. paratuberculosis
cgggauggugac

SEQ ID NO: 2940443 - RNA, 17 nt, Mycobacterium avium subsp. paratuberculosis
cgggauggugaccagcg

SEQ ID NO: 2940444 - RNA, 23 nt, Mycobacterium avium subsp. paratuberculosis
cgggauggugaccagcgcccccg

SEQ ID NO: 2940445 - RNA, 23 nt, Mycobacterium avium subsp. paratuberculosis
cgggcacgacggucagcacgcug

SEQ ID NO: 2940446 - RNA, 16 nt, Mycobacterium avium subsp. paratuberculosis
cgggcacgcagcggcg

SEQ ID NO: 2940447 - RNA, 21 nt, Mycobacterium avium subsp. paratuberculosis
cgggcacgcagcggcgucacg

SEQ ID NO: 2940448 - RNA, 23 nt, Mycobacterium avium subsp. paratuberculosis
cgggcacgcagcggcgucacgcc

SEQ ID NO: 2940449 - RNA, 13 nt, Mycobacterium avium subsp. paratuberculosis
cgggcacgccgcc

SEQ ID NO: 2940450 - RNA, 14 nt, Mycobacterium avium subsp. paratuberculosis
cgggcacgccgccg

SEQ ID NO: 2940451 - RNA, 15 nt, Mycobacterium avium subsp. paratuberculosis
cgggcacgccgccgc

SEQ ID NO: 2940452 - RNA, 16 nt, Mycobacterium avium subsp. paratuberculosis
cgggcacgccgccgcg

SEQ ID NO: 2940453 - RNA, 13 nt, Mycobacterium avium subsp. paratuberculosis
cgggcacgcgaga

SEQ ID NO: 2940454 - RNA, 15 nt, Mycobacterium avium subsp. paratuberculosis
cgggcacgcgagacg

SEQ ID NO: 2940455 - RNA, 13 nt, Mycobacterium avium subsp. paratuberculosis
cgggcacggcgau

SEQ ID NO: 2940456 - RNA, 16 nt, Mycobacterium avium subsp. paratuberculosis
cgggcacggcgaugua

SEQ ID NO: 2940457 - RNA, 15 nt, Mycobacterium avium subsp. paratuberculosis
cgggcacguccagcc

SEQ ID NO: 2940458 - RNA, 16 nt, Mycobacterium avium subsp. paratuberculosis
cgggcacguccagccc

SEQ ID NO: 2940459 - RNA, 17 nt, Mycobacterium avium subsp. paratuberculosis
cgggcacguccagcccg

SEQ ID NO: 2940460 - RNA, 22 nt, Mycobacterium avium subsp. paratuberculosis
cgggcacguccagcccgcgcca

SEQ ID NO: 2940461 - RNA, 24 nt, Mycobacterium avium subsp. paratuberculosis
cgggcacguccagcccgcgccagc

SEQ ID NO: 2940462 - RNA, 15 nt, Mycobacterium avium subsp. paratuberculosis
cgggcacgucgacgc

SEQ ID NO: 2940463 - RNA, 16 nt, Mycobacterium avium subsp. paratuberculosis
cgggcacgucgacgcc

SEQ ID NO: 2940464 - RNA, 13 nt, Mycobacterium avium subsp. paratuberculosis
cgggcacgucgcg

SEQ ID NO: 2940465 - RNA, 19 nt, Mycobacterium avium subsp. paratuberculosis
cgggcacgucgcgcggggu

SEQ ID NO: 2940466 - RNA, 22 nt, Mycobacterium avium subsp. paratuberculosis
cgggcacgucgcgcggggucgg

SEQ ID NO: 2940467 - RNA, 22 nt, Mycobacterium avium subsp. paratuberculosis
cgggcacucccuuguugccgag

SEQ ID NO: 2940468 - RNA, 18 nt, Mycobacterium avium subsp. paratuberculosis
cgggcacucgagcguccg

SEQ ID NO: 2940469 - RNA, 20 nt, Mycobacterium avium subsp. paratuberculosis
cgggcacuuaacaccucgcc

SEQ ID NO: 2940470 - RNA, 23 nt, Mycobacterium avium subsp. paratuberculosis
cgggcacuuaacaccucgccucc

SEQ ID NO: 2940471 - RNA, 21 nt, Mycobacterium avium subsp. paratuberculosis
cgggcacuucguccaucgucc

SEQ ID NO: 2940472 - RNA, 21 nt, Mycobacterium avium subsp. paratuberculosis
cgggcagauggucgccgacgg

SEQ ID NO: 2940473 - RNA, 14 nt, Mycobacterium avium subsp. paratuberculosis
cgggcagcagcacc

SEQ ID NO: 2940474 - RNA, 17 nt, Mycobacterium avium subsp. paratuberculosis
cgggcagcagcaccagc

SEQ ID NO: 2940475 - RNA, 22 nt, Mycobacterium avium subsp. paratuberculosis
cgggcagcagcaccagcgccgc

SEQ ID NO: 2940476 - RNA, 21 nt, Mycobacterium avium subsp. paratuberculosis
cgggcagcagcuccaucgacg

SEQ ID NO: 2940477 - RNA, 14 nt, Mycobacterium avium subsp. paratuberculosis
cgggcagcccaggu

SEQ ID NO: 2940478 - RNA, 15 nt, Mycobacterium avium subsp. paratuberculosis
cgggcagcccaggua

SEQ ID NO: 2940479 - RNA, 20 nt, Mycobacterium avium subsp. paratuberculosis
cgggcagcccagguaaucga

SEQ ID NO: 2940480 - RNA, 15 nt, Mycobacterium avium subsp. paratuberculosis
cgggcagcccgccga

SEQ ID NO: 2940481 - RNA, 17 nt, Mycobacterium avium subsp. paratuberculosis
cgggcagcccgccgacc

SEQ ID NO: 2940482 - RNA, 17 nt, Mycobacterium avium subsp. paratuberculosis
cgggcagcccgccgcgg

SEQ ID NO: 2940483 - RNA, 24 nt, Mycobacterium avium subsp. paratuberculosis
cgggcagccgcacaccgcggcggc

SEQ ID NO: 2940484 - RNA, 18 nt, Mycobacterium avium subsp. paratuberculosis
cgggcagccgcuuggccg

SEQ ID NO: 2940485 - RNA, 19 nt, Mycobacterium avium subsp. paratuberculosis
cgggcagccgcuuggccgg

SEQ ID NO: 2940486 - RNA, 14 nt, Mycobacterium avium subsp. paratuberculosis
cgggcagccggcgc

SEQ ID NO: 2940487 - RNA, 14 nt, Mycobacterium avium subsp. paratuberculosis
cgggcagcgagcac

SEQ ID NO: 2940488 - RNA, 17 nt, Mycobacterium avium subsp. paratuberculosis
cgggcagcgagcacagc

SEQ ID NO: 2940489 - RNA, 18 nt, Mycobacterium avium subsp. paratuberculosis
cgggcagcgagcacagcg

SEQ ID NO: 2940490 - RNA, 23 nt, Mycobacterium avium subsp. paratuberculosis
cgggcagcgagucgaaggcgcgg

SEQ ID NO: 2940491 - RNA, 12 nt, Mycobacterium avium subsp. paratuberculosis
cgggcagcgcga

SEQ ID NO: 2940492 - RNA, 15 nt, Mycobacterium avium subsp. paratuberculosis
cgggcagcgcgacac

SEQ ID NO: 2940493 - RNA, 20 nt, Mycobacterium avium subsp. paratuberculosis
cgggcagcgcgacaccggac

SEQ ID NO: 2940494 - RNA, 12 nt, Mycobacterium avium subsp. paratuberculosis
cgggcagcgcgc

SEQ ID NO: 2940495 - RNA, 14 nt, Mycobacterium avium subsp. paratuberculosis
cgggcagcgcgcga

SEQ ID NO: 2940496 - RNA, 17 nt, Mycobacterium avium subsp. paratuberculosis
cgggcagcgcgcgagac

SEQ ID NO: 2940497 - RNA, 20 nt, Mycobacterium avium subsp. paratuberculosis
cgggcagcgcgcgagacacc

SEQ ID NO: 2940498 - RNA, 12 nt, Mycobacterium avium subsp. paratuberculosis
cgggcagcgcgu

SEQ ID NO: 2940499 - RNA, 14 nt, Mycobacterium avium subsp. paratuberculosis
cgggcagcgcgugc

SEQ ID NO: 2940500 - RNA, 12 nt, Mycobacterium avium subsp. paratuberculosis
cgggcagcgugu

SEQ ID NO: 2940501 - RNA, 17 nt, Mycobacterium avium subsp. paratuberculosis
cgggcagcuuccgccuc

SEQ ID NO: 2940502 - RNA, 20 nt, Mycobacterium avium subsp. paratuberculosis
cgggcagcuuccgccucggc

SEQ ID NO: 2940503 - RNA, 16 nt, Mycobacterium avium subsp. paratuberculosis
cgggcaggccgggaua

SEQ ID NO: 2940504 - RNA, 15 nt, Mycobacterium avium subsp. paratuberculosis
cgggcaggccggugc

SEQ ID NO: 2940505 - RNA, 21 nt, Mycobacterium avium subsp. paratuberculosis
cgggcaggcucagguaggcgc

SEQ ID NO: 2940506 - RNA, 12 nt, Mycobacterium avium subsp. paratuberculosis
cgggcaggguga

SEQ ID NO: 2940507 - RNA, 13 nt, Mycobacterium avium subsp. paratuberculosis
cgggcagggugac

SEQ ID NO: 2940508 - RNA, 14 nt, Mycobacterium avium subsp. paratuberculosis
cgggcagggugacc

SEQ ID NO: 2940509 - RNA, 16 nt, Mycobacterium avium subsp. paratuberculosis
cgggcagggugaccga

SEQ ID NO: 2940510 - RNA, 22 nt, Mycobacterium avium subsp. paratuberculosis
cgggcagguacugcuugccgcc

SEQ ID NO: 2940511 - RNA, 23 nt, Mycobacterium avium subsp. paratuberculosis
cgggcagguacugcuugccgccg

SEQ ID NO: 2940512 - RNA, 18 nt, Mycobacterium avium subsp. paratuberculosis
cgggcagguggucggcga

SEQ ID NO: 2940513 - RNA, 21 nt, Mycobacterium avium subsp. paratuberculosis
cgggcagguggucggcgaacu

SEQ ID NO: 2940514 - RNA, 22 nt, Mycobacterium avium subsp. paratuberculosis
cgggcagguucauccccgcggc

SEQ ID NO: 2940515 - RNA, 19 nt, Mycobacterium avium subsp. paratuberculosis
cgggcagugcacgacgacc

SEQ ID NO: 2940516 - RNA, 23 nt, Mycobacterium avium subsp. paratuberculosis
cgggcagugcgcggcguccucga

SEQ ID NO: 2940517 - RNA, 16 nt, Mycobacterium avium subsp. paratuberculosis
cgggcaguuccuugcg

SEQ ID NO: 2940518 - RNA, 21 nt, Mycobacterium avium subsp. paratuberculosis
cgggcaguuccuugcgcagca

SEQ ID NO: 2940519 - RNA, 22 nt, Mycobacterium avium subsp. paratuberculosis
cgggcaguuccuugcgcagcac

SEQ ID NO: 2940520 - RNA, 17 nt, Mycobacterium avium subsp. paratuberculosis
cgggcaguugccggcca

SEQ ID NO: 2940521 - RNA, 19 nt, Mycobacterium avium subsp. paratuberculosis
cgggcaguugccggccauc

SEQ ID NO: 2940522 - RNA, 17 nt, Mycobacterium avium subsp. paratuberculosis
cgggcauacugcuugcc

SEQ ID NO: 2940523 - RNA, 23 nt, Mycobacterium avium subsp. paratuberculosis
cgggcauacugcuugccgucgac

SEQ ID NO: 2940524 - RNA, 14 nt, Mycobacterium avium subsp. paratuberculosis
cgggcaucaucgcu

SEQ ID NO: 2940525 - RNA, 13 nt, Mycobacterium avium subsp. paratuberculosis
cgggcaucccgcc

SEQ ID NO: 2940526 - RNA, 17 nt, Mycobacterium avium subsp. paratuberculosis
cgggcaucccgccgaac

SEQ ID NO: 2940527 - RNA, 14 nt, Mycobacterium avium subsp. paratuberculosis
cgggcauccgcccg

SEQ ID NO: 2940528 - RNA, 15 nt, Mycobacterium avium subsp. paratuberculosis
cgggcauccgcccgu

SEQ ID NO: 2940529 - RNA, 21 nt, Mycobacterium avium subsp. paratuberculosis
cgggcauccggcucagaaggc

SEQ ID NO: 2940530 - RNA, 23 nt, Mycobacterium avium subsp. paratuberculosis
cgggccaggaugaccgcccagga

SEQ ID NO: 2940531 - RNA, 22 nt, Mycobacterium avium subsp. paratuberculosis
cgggccaggaugucggacucgc

SEQ ID NO: 2940532 - RNA, 22 nt, Mycobacterium avium subsp. paratuberculosis
cgggccaggauguucaccccgg

SEQ ID NO: 2940533 - RNA, 16 nt, Mycobacterium avium subsp. paratuberculosis
cgggccaggcccaccg

SEQ ID NO: 2940534 - RNA, 22 nt, Mycobacterium avium subsp. paratuberculosis
cgggccaggcccaccgucgcca

SEQ ID NO: 2940535 - RNA, 21 nt, Mycobacterium avium subsp. paratuberculosis
cgggccaggcgcgcgcuggug

SEQ ID NO: 2940536 - RNA, 19 nt, Mycobacterium avium subsp. paratuberculosis
cgggccaggcgcgcguagc

SEQ ID NO: 2940537 - RNA, 21 nt, Mycobacterium avium subsp. paratuberculosis
cgggccaggucgaagcgcagc

SEQ ID NO: 2940538 - RNA, 14 nt, Mycobacterium avium subsp. paratuberculosis
cgggccaggugugc

SEQ ID NO: 2940539 - RNA, 16 nt, Mycobacterium avium subsp. paratuberculosis
cgggccagguucgcgc

SEQ ID NO: 2940540 - RNA, 19 nt, Mycobacterium avium subsp. paratuberculosis
cgggccagguucgcgccga

SEQ ID NO: 2940541 - RNA, 22 nt, Mycobacterium avium subsp. paratuberculosis
cgggccagguucgcgccgaugc

SEQ ID NO: 2940542 - RNA, 15 nt, Mycobacterium avium subsp. paratuberculosis
cgggccagucgccgc

SEQ ID NO: 2940543 - RNA, 16 nt, Mycobacterium avium subsp. paratuberculosis
cgggccagucgccgcg

SEQ ID NO: 2940544 - RNA, 19 nt, Mycobacterium avium subsp. paratuberculosis
cgggccaucgacuccagca

SEQ ID NO: 2940545 - RNA, 21 nt, Mycobacterium avium subsp. paratuberculosis
cgggccaucgacuccagcacc

SEQ ID NO: 2940546 - RNA, 19 nt, Mycobacterium avium subsp. paratuberculosis
cgggccauguccccgacca

SEQ ID NO: 2940547 - RNA, 23 nt, Mycobacterium avium subsp. paratuberculosis
cgggccauguccccgaccaucau

SEQ ID NO: 2940548 - RNA, 13 nt, Mycobacterium avium subsp. paratuberculosis
cgggcccaccgcc

SEQ ID NO: 2940549 - RNA, 15 nt, Mycobacterium avium subsp. paratuberculosis
cgggcccaccgcgcg

SEQ ID NO: 2940550 - RNA, 18 nt, Mycobacterium avium subsp. paratuberculosis
cgggcccaccgcgcgcug

SEQ ID NO: 2940551 - RNA, 19 nt, Mycobacterium avium subsp. paratuberculosis
cgggcccaccgcgcgcugc

SEQ ID NO: 2940552 - RNA, 23 nt, Mycobacterium avium subsp. paratuberculosis
cgggcccaccgcgcgcugcagca

SEQ ID NO: 2940553 - RNA, 12 nt, Mycobacterium avium subsp. paratuberculosis
cgggcccagcac

SEQ ID NO: 2940554 - RNA, 13 nt, Mycobacterium avium subsp. paratuberculosis
cgggcccagcacc

SEQ ID NO: 2940555 - RNA, 14 nt, Mycobacterium avium subsp. paratuberculosis
cgggcccagcacca

SEQ ID NO: 2940556 - RNA, 15 nt, Mycobacterium avium subsp. paratuberculosis
cgggcccagcaccac

SEQ ID NO: 2940557 - RNA, 17 nt, Mycobacterium avium subsp. paratuberculosis
cgggcccagcaccacca

SEQ ID NO: 2940558 - RNA, 22 nt, Mycobacterium avium subsp. paratuberculosis
cgggcccagcagauagcccagc

SEQ ID NO: 2940559 - RNA, 13 nt, Mycobacterium avium subsp. paratuberculosis
cgggcccagcagc

SEQ ID NO: 2940560 - RNA, 16 nt, Mycobacterium avium subsp. paratuberculosis
cgggcccagcagccug

SEQ ID NO: 2940561 - RNA, 21 nt, Mycobacterium avium subsp. paratuberculosis
cgggcccagcagccugccccc

SEQ ID NO: 2940562 - RNA, 16 nt, Mycobacterium avium subsp. paratuberculosis
cgggcccagcgcgacg

SEQ ID NO: 2940563 - RNA, 14 nt, Mycobacterium avium subsp. paratuberculosis
cgggcccagcucgg

SEQ ID NO: 2940564 - RNA, 22 nt, Mycobacterium avium subsp. paratuberculosis
cgggcccagguaguagcgccac

SEQ ID NO: 2940565 - RNA, 13 nt, Mycobacterium avium subsp. paratuberculosis
cgggccccacgcc

SEQ ID NO: 2940566 - RNA, 17 nt, Mycobacterium avium subsp. paratuberculosis
cgggccccacgccaguc

SEQ ID NO: 2940567 - RNA, 14 nt, Mycobacterium avium subsp. paratuberculosis
cgggcccgacgacg

SEQ ID NO: 2940568 - RNA, 22 nt, Mycobacterium avium subsp. paratuberculosis
cgggcccgagguccucgcgcaa

SEQ ID NO: 2940569 - RNA, 23 nt, Mycobacterium avium subsp. paratuberculosis
cgggcccgauggcggccugcagg

SEQ ID NO: 2940570 - RNA, 20 nt, Mycobacterium avium subsp. paratuberculosis
cgggcccgcccgcagcggcg

SEQ ID NO: 2940571 - RNA, 22 nt, Mycobacterium avium subsp. paratuberculosis
cgggcccgcccgcagcggcggu

SEQ ID NO: 2940572 - RNA, 13 nt, Mycobacterium avium subsp. paratuberculosis
cgggcccgcgccg

SEQ ID NO: 2940573 - RNA, 14 nt, Mycobacterium avium subsp. paratuberculosis
cgggcccgcgccgc

SEQ ID NO: 2940574 - RNA, 15 nt, Mycobacterium avium subsp. paratuberculosis
cgggcccgcgccgcg

SEQ ID NO: 2940575 - RNA, 17 nt, Mycobacterium avium subsp. paratuberculosis
cgggcccgcgccgcguc

SEQ ID NO: 2940576 - RNA, 21 nt, Mycobacterium avium subsp. paratuberculosis
cgggcccgcgccgcgucgucg

SEQ ID NO: 2940577 - RNA, 16 nt, Mycobacterium avium subsp. paratuberculosis
cgggcccgcgccuucu

SEQ ID NO: 2940578 - RNA, 23 nt, Mycobacterium avium subsp. paratuberculosis
cgggcccgcgccuucuugcugcc

SEQ ID NO: 2940579 - RNA, 15 nt, Mycobacterium avium subsp. paratuberculosis
cgggcccgcgcggcg

SEQ ID NO: 2940580 - RNA, 17 nt, Mycobacterium avium subsp. paratuberculosis
cgggcccgcgcggcggu

SEQ ID NO: 2940581 - RNA, 14 nt, Mycobacterium avium subsp. paratuberculosis
cgggcccgcgggau

SEQ ID NO: 2940582 - RNA, 23 nt, Mycobacterium avium subsp. paratuberculosis
cgggcccgcguaaccggcggcgg

SEQ ID NO: 2940583 - RNA, 23 nt, Mycobacterium avium subsp. paratuberculosis
cgggcccgcucaccugcggcccg

SEQ ID NO: 2940584 - RNA, 15 nt, Mycobacterium avium subsp. paratuberculosis
cgggcccgcugcagc

SEQ ID NO: 2940585 - RNA, 20 nt, Mycobacterium avium subsp. paratuberculosis
cgggcccgcugcagcgccga

SEQ ID NO: 2940586 - RNA, 11 nt, Mycobacterium avium subsp. paratuberculosis
cgggcccggcc

SEQ ID NO: 2940587 - RNA, 17 nt, Mycobacterium avium subsp. paratuberculosis
cgggcccggccgccagc

SEQ ID NO: 2940588 - RNA, 12 nt, Mycobacterium avium subsp. paratuberculosis
cgggcccggcgc

SEQ ID NO: 2940589 - RNA, 13 nt, Mycobacterium avium subsp. paratuberculosis
cgggcccgggcgc

SEQ ID NO: 2940590 - RNA, 13 nt, Mycobacterium avium subsp. paratuberculosis
cgggcccgggcug

SEQ ID NO: 2940591 - RNA, 18 nt, Mycobacterium avium subsp. paratuberculosis
cgggcccgggcugcccgg

SEQ ID NO: 2940592 - RNA, 19 nt, Mycobacterium avium subsp. paratuberculosis
cgggcccgggcugcccggg

SEQ ID NO: 2940593 - RNA, 16 nt, Mycobacterium avium subsp. paratuberculosis
cgggcccggucccgcg

SEQ ID NO: 2940594 - RNA, 19 nt, Mycobacterium avium subsp. paratuberculosis
cgggcccggucccgcguca

SEQ ID NO: 2940595 - RNA, 18 nt, Mycobacterium avium subsp. paratuberculosis
cgggcccggucgucgccg

SEQ ID NO: 2940596 - RNA, 17 nt, Mycobacterium avium subsp. paratuberculosis
cgggcccguagcucgcg

SEQ ID NO: 2940597 - RNA, 19 nt, Mycobacterium avium subsp. paratuberculosis
cgggcccguagcucgcgcc

SEQ ID NO: 2940598 - RNA, 20 nt, Mycobacterium avium subsp. paratuberculosis
cgggcccguagcucgcgccg

SEQ ID NO: 2940599 - RNA, 21 nt, Mycobacterium avium subsp. paratuberculosis
cgggcccguagcucgcgccga

SEQ ID NO: 2940600 - RNA, 23 nt, Mycobacterium avium subsp. paratuberculosis
cgggcccguagcucgcgccgacc

SEQ ID NO: 2940601 - RNA, 14 nt, Mycobacterium avium subsp. paratuberculosis
cgggcccguccgcg

SEQ ID NO: 2940602 - RNA, 16 nt, Mycobacterium avium subsp. paratuberculosis
cgggcccgucgccggc

SEQ ID NO: 2940603 - RNA, 17 nt, Mycobacterium avium subsp. paratuberculosis
cgggcccgucgccggcg

SEQ ID NO: 2940604 - RNA, 20 nt, Mycobacterium avium subsp. paratuberculosis
cgggcccgucgccggcgcgc

SEQ ID NO: 2940605 - RNA, 13 nt, Mycobacterium avium subsp. paratuberculosis
cgggcccucggac

SEQ ID NO: 2940606 - RNA, 13 nt, Mycobacterium avium subsp. paratuberculosis
cgggccgaacugc

SEQ ID NO: 2940607 - RNA, 14 nt, Mycobacterium avium subsp. paratuberculosis
cgggccgaacugcc

SEQ ID NO: 2940608 - RNA, 19 nt, Mycobacterium avium subsp. paratuberculosis
cgggccgaacugccgaugc

SEQ ID NO: 2940609 - RNA, 23 nt, Mycobacterium avium subsp. paratuberculosis
cgggccgaagaccgggccgauga

SEQ ID NO: 2940610 - RNA, 20 nt, Mycobacterium avium subsp. paratuberculosis
cgggccgaaggcggcgccgg

SEQ ID NO: 2940611 - RNA, 21 nt, Mycobacterium avium subsp. paratuberculosis
cgggccgaaggcggcgccggc

SEQ ID NO: 2940612 - RNA, 16 nt, Mycobacterium avium subsp. paratuberculosis
cgggccgacagcacgc

SEQ ID NO: 2940613 - RNA, 18 nt, Mycobacterium avium subsp. paratuberculosis
cgggccgacagcacgccg

SEQ ID NO: 2940614 - RNA, 15 nt, Mycobacterium avium subsp. paratuberculosis
cgggccggcgucgcg

SEQ ID NO: 2940615 - RNA, 16 nt, Mycobacterium avium subsp. paratuberculosis
cgggccggcgucgcgg

SEQ ID NO: 2940616 - RNA, 17 nt, Mycobacterium avium subsp. paratuberculosis
cgggccggcgucgcggu

SEQ ID NO: 2940617 - RNA, 18 nt, Mycobacterium avium subsp. paratuberculosis
cgggccggcgucgcggug

SEQ ID NO: 2940618 - RNA, 13 nt, Mycobacterium avium subsp. paratuberculosis
cgggccgggcacc

SEQ ID NO: 2940619 - RNA, 16 nt, Mycobacterium avium subsp. paratuberculosis
cgggccgggcaccgcg

SEQ ID NO: 2940620 - RNA, 22 nt, Mycobacterium avium subsp. paratuberculosis
cgggccgggcacgucgacgccc

SEQ ID NO: 2940621 - RNA, 14 nt, Mycobacterium avium subsp. paratuberculosis
cgggccgggcgggc

SEQ ID NO: 2940622 - RNA, 20 nt, Mycobacterium avium subsp. paratuberculosis
cgggccgggcgggcacccca

SEQ ID NO: 2940623 - RNA, 21 nt, Mycobacterium avium subsp. paratuberculosis
cgggccgggcgggcaccccau

SEQ ID NO: 2940624 - RNA, 14 nt, Mycobacterium avium subsp. paratuberculosis
cgggccgggggcgg

SEQ ID NO: 2940625 - RNA, 16 nt, Mycobacterium avium subsp. paratuberculosis
cgggccgggggcggcg

SEQ ID NO: 2940626 - RNA, 19 nt, Mycobacterium avium subsp. paratuberculosis
cgggccgggggcggcggcg

SEQ ID NO: 2940627 - RNA, 13 nt, Mycobacterium avium subsp. paratuberculosis
cgggccggucagc

SEQ ID NO: 2940628 - RNA, 15 nt, Mycobacterium avium subsp. paratuberculosis
cgggccggucagcgc

SEQ ID NO: 2940629 - RNA, 17 nt, Mycobacterium avium subsp. paratuberculosis
cgggccggucagcgcga

SEQ ID NO: 2940630 - RNA, 19 nt, Mycobacterium avium subsp. paratuberculosis
cgggccggucagcgcgaca

SEQ ID NO: 2940631 - RNA, 14 nt, Mycobacterium avium subsp. paratuberculosis
cgggccggucgguc

SEQ ID NO: 2940632 - RNA, 17 nt, Mycobacterium avium subsp. paratuberculosis
cgggccggucggucagu

SEQ ID NO: 2940633 - RNA, 16 nt, Mycobacterium avium subsp. paratuberculosis
cgggccguaucggccc

SEQ ID NO: 2940634 - RNA, 20 nt, Mycobacterium avium subsp. paratuberculosis
cgggccguaucggccccggc

SEQ ID NO: 2940635 - RNA, 14 nt, Mycobacterium avium subsp. paratuberculosis
cgggccgucaucgc

SEQ ID NO: 2940636 - RNA, 15 nt, Mycobacterium avium subsp. paratuberculosis
cgggccgucaucgcc

SEQ ID NO: 2940637 - RNA, 16 nt, Mycobacterium avium subsp. paratuberculosis
cgggccgucaucgccg

SEQ ID NO: 2940638 - RNA, 17 nt, Mycobacterium avium subsp. paratuberculosis
cgggccgucaucgccga

SEQ ID NO: 2940639 - RNA, 19 nt, Mycobacterium avium subsp. paratuberculosis
cgggccgucaucgccgacg

SEQ ID NO: 2940640 - RNA, 14 nt, Mycobacterium avium subsp. paratuberculosis
cgggccguccgccg

SEQ ID NO: 2940641 - RNA, 16 nt, Mycobacterium avium subsp. paratuberculosis
cgggccguccgccggc

SEQ ID NO: 2940642 - RNA, 21 nt, Mycobacterium avium subsp. paratuberculosis
cgggccguccgccggcuggcg

SEQ ID NO: 2940643 - RNA, 13 nt, Mycobacterium avium subsp. paratuberculosis
cgggccguccggg

SEQ ID NO: 2940644 - RNA, 15 nt, Mycobacterium avium subsp. paratuberculosis
cgggccgugccgcca

SEQ ID NO: 2940645 - RNA, 16 nt, Mycobacterium avium subsp. paratuberculosis
cgggccguggcaccgg

SEQ ID NO: 2940646 - RNA, 22 nt, Mycobacterium avium subsp. paratuberculosis
cgggccguggcaccgggugggc

SEQ ID NO: 2940647 - RNA, 13 nt, Mycobacterium avium subsp. paratuberculosis
cgggccguucagc

SEQ ID NO: 2940648 - RNA, 15 nt, Mycobacterium avium subsp. paratuberculosis
cgggccguucagcgg

SEQ ID NO: 2940649 - RNA, 20 nt, Mycobacterium avium subsp. paratuberculosis
cgggccguucagcgggcggu

SEQ ID NO: 2940650 - RNA, 18 nt, Mycobacterium avium subsp. paratuberculosis
cgggccuaggaccccggc

SEQ ID NO: 2940651 - RNA, 20 nt, Mycobacterium avium subsp. paratuberculosis
cgggccuaggaccccggcug

SEQ ID NO: 2940652 - RNA, 21 nt, Mycobacterium avium subsp. paratuberculosis
cgggccuaggaccccggcugc

SEQ ID NO: 2940653 - RNA, 22 nt, Mycobacterium avium subsp. paratuberculosis
cgggccuaggaccccggcugcu

SEQ ID NO: 2940654 - RNA, 16 nt, Mycobacterium avium subsp. paratuberculosis
cgggccuaugccgcgu

SEQ ID NO: 2940655 - RNA, 19 nt, Mycobacterium avium subsp. paratuberculosis
cgggccuccuguuggcccu

SEQ ID NO: 2940656 - RNA, 14 nt, Mycobacterium avium subsp. paratuberculosis
cgggccucgccgcu

SEQ ID NO: 2940657 - RNA, 13 nt, Mycobacterium avium subsp. paratuberculosis
cgggccugcagca

SEQ ID NO: 2940658 - RNA, 19 nt, Mycobacterium avium subsp. paratuberculosis
cgggccugcagcaacucgc

SEQ ID NO: 2940659 - RNA, 15 nt, Mycobacterium avium subsp. paratuberculosis
cgggccugcgcgccg

SEQ ID NO: 2940660 - RNA, 14 nt, Mycobacterium avium subsp. paratuberculosis
cgggccugcggcgc

SEQ ID NO: 2940661 - RNA, 16 nt, Mycobacterium avium subsp. paratuberculosis
cgggccugcggcgcgg

SEQ ID NO: 2940662 - RNA, 17 nt, Mycobacterium avium subsp. paratuberculosis
cgggccugcggcgcggc

SEQ ID NO: 2940663 - RNA, 19 nt, Mycobacterium avium subsp. paratuberculosis
cgggccugcggcgcggcca

SEQ ID NO: 2940664 - RNA, 19 nt, Mycobacterium avium subsp. paratuberculosis
cgggccugcggcggccgca

SEQ ID NO: 2940665 - RNA, 21 nt, Mycobacterium avium subsp. paratuberculosis
cgggccugcucgucggggcag

SEQ ID NO: 2940666 - RNA, 13 nt, Mycobacterium avium subsp. paratuberculosis
cgggccugggcaa

SEQ ID NO: 2940667 - RNA, 22 nt, Mycobacterium avium subsp. paratuberculosis
cgggccugggcaauggccgcga

SEQ ID NO: 2940668 - RNA, 14 nt, Mycobacterium avium subsp. paratuberculosis
cgggccuguccagc

SEQ ID NO: 2940669 - RNA, 19 nt, Mycobacterium avium subsp. paratuberculosis
cgggccuguuucugcgccu

SEQ ID NO: 2940670 - RNA, 16 nt, Mycobacterium avium subsp. paratuberculosis
cgggccuucacgcugg

SEQ ID NO: 2940671 - RNA, 16 nt, Mycobacterium avium subsp. paratuberculosis
cgggccuucuucucga

SEQ ID NO: 2940672 - RNA, 18 nt, Mycobacterium avium subsp. paratuberculosis
cgggccuucuucucgacg

SEQ ID NO: 2940673 - RNA, 20 nt, Mycobacterium avium subsp. paratuberculosis
cgggccuucuucucgacgua

SEQ ID NO: 2940674 - RNA, 21 nt, Mycobacterium avium subsp. paratuberculosis
cgggccuugacggccugggcg

SEQ ID NO: 2940675 - RNA, 23 nt, Mycobacterium avium subsp. paratuberculosis
cgggccuugacggccugggcgac

SEQ ID NO: 2940676 - RNA, 15 nt, Mycobacterium avium subsp. paratuberculosis
cgggccuugagcacc

SEQ ID NO: 2940677 - RNA, 16 nt, Mycobacterium avium subsp. paratuberculosis
cgggccuugagcaccg

SEQ ID NO: 2940678 - RNA, 17 nt, Mycobacterium avium subsp. paratuberculosis
cgggccuugagcaccgc

SEQ ID NO: 2940679 - RNA, 21 nt, Mycobacterium avium subsp. paratuberculosis
cgggccuugagcaccgcgucg

SEQ ID NO: 2940680 - RNA, 13 nt, Mycobacterium avium subsp. paratuberculosis
cgggccuuggcga

SEQ ID NO: 2940681 - RNA, 15 nt, Mycobacterium avium subsp. paratuberculosis
cgggcgaaaucucga

SEQ ID NO: 2940682 - RNA, 14 nt, Mycobacterium avium subsp. paratuberculosis
cgggcgaaccacgg

SEQ ID NO: 2940683 - RNA, 17 nt, Mycobacterium avium subsp. paratuberculosis
cgggcgaaccacggguc

SEQ ID NO: 2940684 - RNA, 16 nt, Mycobacterium avium subsp. paratuberculosis
cgggcgaacgucgggu

SEQ ID NO: 2940685 - RNA, 22 nt, Mycobacterium avium subsp. paratuberculosis
cgggcgaacgucgggucgaagu

SEQ ID NO: 2940686 - RNA, 19 nt, Mycobacterium avium subsp. paratuberculosis
cgggcgaaguagccggcga

SEQ ID NO: 2940687 - RNA, 22 nt, Mycobacterium avium subsp. paratuberculosis
cgggcgaaguagccggcgaucg

SEQ ID NO: 2940688 - RNA, 17 nt, Mycobacterium avium subsp. paratuberculosis
cgggcgaagucgccggc

SEQ ID NO: 2940689 - RNA, 21 nt, Mycobacterium avium subsp. paratuberculosis
cgggcgacaccccgcgaguca

SEQ ID NO: 2940690 - RNA, 18 nt, Mycobacterium avium subsp. paratuberculosis
cgggcgacaucucgguga

SEQ ID NO: 2940691 - RNA, 18 nt, Mycobacterium avium subsp. paratuberculosis
cgggcgacaugcccgcgg

SEQ ID NO: 2940692 - RNA, 21 nt, Mycobacterium avium subsp. paratuberculosis
cgggcgacaugcccgcggugc

SEQ ID NO: 2940693 - RNA, 13 nt, Mycobacterium avium subsp. paratuberculosis
cgggcgaccccgg

SEQ ID NO: 2940694 - RNA, 16 nt, Mycobacterium avium subsp. paratuberculosis
cgggcgaccccggcca

SEQ ID NO: 2940695 - RNA, 20 nt, Mycobacterium avium subsp. paratuberculosis
cgggcgaccccggccaggau

SEQ ID NO: 2940696 - RNA, 15 nt, Mycobacterium avium subsp. paratuberculosis
cgggcgacccgcugg

SEQ ID NO: 2940697 - RNA, 21 nt, Mycobacterium avium subsp. paratuberculosis
cgggcgacccgcuggaacagc

SEQ ID NO: 2940698 - RNA, 18 nt, Mycobacterium avium subsp. paratuberculosis
cgggcgaccugcgggccc

SEQ ID NO: 2940699 - RNA, 19 nt, Mycobacterium avium subsp. paratuberculosis
cgggcgcgacggucacgcu

SEQ ID NO: 2940700 - RNA, 20 nt, Mycobacterium avium subsp. paratuberculosis
cgggcgcgacggucacgcug

SEQ ID NO: 2940701 - RNA, 21 nt, Mycobacterium avium subsp. paratuberculosis
cgggcgcgacggucacgcugg

SEQ ID NO: 2940702 - RNA, 18 nt, Mycobacterium avium subsp. paratuberculosis
cgggcgcgcagaucgucg

SEQ ID NO: 2940703 - RNA, 21 nt, Mycobacterium avium subsp. paratuberculosis
cgggcgcgcagaucgucgacc

SEQ ID NO: 2940704 - RNA, 12 nt, Mycobacterium avium subsp. paratuberculosis
cgggcgcgcagc

SEQ ID NO: 2940705 - RNA, 13 nt, Mycobacterium avium subsp. paratuberculosis
cgggcgcgcagcc

SEQ ID NO: 2940706 - RNA, 14 nt, Mycobacterium avium subsp. paratuberculosis
cgggcgcgcagcca

SEQ ID NO: 2940707 - RNA, 11 nt, Mycobacterium avium subsp. paratuberculosis
cgggcgcgccc

SEQ ID NO: 2940708 - RNA, 14 nt, Mycobacterium avium subsp. paratuberculosis
cgggcgcgcccacc

SEQ ID NO: 2940709 - RNA, 23 nt, Mycobacterium avium subsp. paratuberculosis
cgggcgcgcccacccgcgccggc

SEQ ID NO: 2940710 - RNA, 14 nt, Mycobacterium avium subsp. paratuberculosis
cgggcgcgccggcg

SEQ ID NO: 2940711 - RNA, 15 nt, Mycobacterium avium subsp. paratuberculosis
cgggcgcgccggcgc

SEQ ID NO: 2940712 - RNA, 13 nt, Mycobacterium avium subsp. paratuberculosis
cgggcgcgccguc

SEQ ID NO: 2940713 - RNA, 14 nt, Mycobacterium avium subsp. paratuberculosis
cgggcgcgccgucc

SEQ ID NO: 2940714 - RNA, 13 nt, Mycobacterium avium subsp. paratuberculosis
cgggcgcgcgccu

SEQ ID NO: 2940715 - RNA, 15 nt, Mycobacterium avium subsp. paratuberculosis
cgggcgcgcgcgcca

SEQ ID NO: 2940716 - RNA, 13 nt, Mycobacterium avium subsp. paratuberculosis
cgggcgcggacag

SEQ ID NO: 2940717 - RNA, 23 nt, Mycobacterium avium subsp. paratuberculosis
cgggcgcggauggguggcgauca

SEQ ID NO: 2940718 - RNA, 12 nt, Mycobacterium avium subsp. paratuberculosis
cgggcgcggcca

SEQ ID NO: 2940719 - RNA, 13 nt, Mycobacterium avium subsp. paratuberculosis
cgggcgcggccag

SEQ ID NO: 2940720 - RNA, 15 nt, Mycobacterium avium subsp. paratuberculosis
cgggcgcggccagcg

SEQ ID NO: 2940721 - RNA, 16 nt, Mycobacterium avium subsp. paratuberculosis
cgggcgcggccagcgc

SEQ ID NO: 2940722 - RNA, 18 nt, Mycobacterium avium subsp. paratuberculosis
cgggcgcggccagcgcga

SEQ ID NO: 2940723 - RNA, 16 nt, Mycobacterium avium subsp. paratuberculosis
cgggcgcggcggcaac

SEQ ID NO: 2940724 - RNA, 16 nt, Mycobacterium avium subsp. paratuberculosis
cgggcgcgggcgccgu

SEQ ID NO: 2940725 - RNA, 15 nt, Mycobacterium avium subsp. paratuberculosis
cgggcgcgguguggg

SEQ ID NO: 2940726 - RNA, 19 nt, Mycobacterium avium subsp. paratuberculosis
cgggcgcggugugggcgau

SEQ ID NO: 2940727 - RNA, 14 nt, Mycobacterium avium subsp. paratuberculosis
cgggcgcgucgagg

SEQ ID NO: 2940728 - RNA, 15 nt, Mycobacterium avium subsp. paratuberculosis
cgggcgcgucgaggu

SEQ ID NO: 2940729 - RNA, 18 nt, Mycobacterium avium subsp. paratuberculosis
cgggcgcgucgaggucgu

SEQ ID NO: 2940730 - RNA, 14 nt, Mycobacterium avium subsp. paratuberculosis
cgggcgcgugcaca

SEQ ID NO: 2940731 - RNA, 17 nt, Mycobacterium avium subsp. paratuberculosis
cgggcgcgugcacaccg

SEQ ID NO: 2940732 - RNA, 12 nt, Mycobacterium avium subsp. paratuberculosis
cgggcgcucggc

SEQ ID NO: 2940733 - RNA, 19 nt, Mycobacterium avium subsp. paratuberculosis
cgggcgcucggccagcagu

SEQ ID NO: 2940734 - RNA, 14 nt, Mycobacterium avium subsp. paratuberculosis
cgggcgcucuucgg

SEQ ID NO: 2940735 - RNA, 19 nt, Mycobacterium avium subsp. paratuberculosis
cgggcgcugagcacggugg

SEQ ID NO: 2940736 - RNA, 15 nt, Mycobacterium avium subsp. paratuberculosis
cgggcgcugcaaggg

SEQ ID NO: 2940737 - RNA, 17 nt, Mycobacterium avium subsp. paratuberculosis
cgggcgcugcgcggugg

SEQ ID NO: 2940738 - RNA, 23 nt, Mycobacterium avium subsp. paratuberculosis
cgggcgcugcgcgguggcgcggg

SEQ ID NO: 2940739 - RNA, 14 nt, Mycobacterium avium subsp. paratuberculosis
cgggcgcuggccgu

SEQ ID NO: 2940740 - RNA, 16 nt, Mycobacterium avium subsp. paratuberculosis
cgggcgcuggccgugg

SEQ ID NO: 2940741 - RNA, 22 nt, Mycobacterium avium subsp. paratuberculosis
cgggcgcuggccguggccguga

SEQ ID NO: 2940742 - RNA, 12 nt, Mycobacterium avium subsp. paratuberculosis
cgggcgcuggcg

SEQ ID NO: 2940743 - RNA, 17 nt, Mycobacterium avium subsp. paratuberculosis
cgggcggaagucggugc

SEQ ID NO: 2940744 - RNA, 20 nt, Mycobacterium avium subsp. paratuberculosis
cgggcggaugucggugugga

SEQ ID NO: 2940745 - RNA, 24 nt, Mycobacterium avium subsp. paratuberculosis
cgggcggaugucgguguggaccgc

SEQ ID NO: 2940746 - RNA, 12 nt, Mycobacterium avium subsp. paratuberculosis
cgggcggcaccg

SEQ ID NO: 2940747 - RNA, 14 nt, Mycobacterium avium subsp. paratuberculosis
cgggcggcaccgcu

SEQ ID NO: 2940748 - RNA, 20 nt, Mycobacterium avium subsp. paratuberculosis
cgggcggcaccgcugccggc

SEQ ID NO: 2940749 - RNA, 12 nt, Mycobacterium avium subsp. paratuberculosis
cgggcggcagca

SEQ ID NO: 2940750 - RNA, 16 nt, Mycobacterium avium subsp. paratuberculosis
cgggcggcagcacguc

SEQ ID NO: 2940751 - RNA, 13 nt, Mycobacterium avium subsp. paratuberculosis
cgggcggcagcag

SEQ ID NO: 2940752 - RNA, 14 nt, Mycobacterium avium subsp. paratuberculosis
cgggcggcagcagc

SEQ ID NO: 2940753 - RNA, 20 nt, Mycobacterium avium subsp. paratuberculosis
cgggcggcagggccagcacc

SEQ ID NO: 2940754 - RNA, 21 nt, Mycobacterium avium subsp. paratuberculosis
cgggcggcagggccagcacca

SEQ ID NO: 2940755 - RNA, 16 nt, Mycobacterium avium subsp. paratuberculosis
cgggcggcaggucggc

SEQ ID NO: 2940756 - RNA, 18 nt, Mycobacterium avium subsp. paratuberculosis
cgggcggcaggucggcgg

SEQ ID NO: 2940757 - RNA, 14 nt, Mycobacterium avium subsp. paratuberculosis
cgggcggcaggugg

SEQ ID NO: 2940758 - RNA, 14 nt, Mycobacterium avium subsp. paratuberculosis
cgggcggcaucgcg

SEQ ID NO: 2940759 - RNA, 19 nt, Mycobacterium avium subsp. paratuberculosis
cgggcggcaucgcgccgca

SEQ ID NO: 2940760 - RNA, 15 nt, Mycobacterium avium subsp. paratuberculosis
cgggcggccagccgc

SEQ ID NO: 2940761 - RNA, 16 nt, Mycobacterium avium subsp. paratuberculosis
cgggcggccagccgcg

SEQ ID NO: 2940762 - RNA, 17 nt, Mycobacterium avium subsp. paratuberculosis
cgggcggccagccgcgc

SEQ ID NO: 2940763 - RNA, 19 nt, Mycobacterium avium subsp. paratuberculosis
cgggcggccagccgcgcgg

SEQ ID NO: 2940764 - RNA, 20 nt, Mycobacterium avium subsp. paratuberculosis
cgggcggccagccgcgcggc

SEQ ID NO: 2940765 - RNA, 16 nt, Mycobacterium avium subsp. paratuberculosis
cgggcggccagccgcu

SEQ ID NO: 2940766 - RNA, 22 nt, Mycobacterium avium subsp. paratuberculosis
cgggcggccagccgcucccggc

SEQ ID NO: 2940767 - RNA, 14 nt, Mycobacterium avium subsp. paratuberculosis
cgggcggccagggu

SEQ ID NO: 2940768 - RNA, 16 nt, Mycobacterium avium subsp. paratuberculosis
cgggcggccccgggcg

SEQ ID NO: 2940769 - RNA, 21 nt, Mycobacterium avium subsp. paratuberculosis
cgggcggccccgggcgcuggc

SEQ ID NO: 2940770 - RNA, 19 nt, Mycobacterium avium subsp. paratuberculosis
cgggcggcccgccucggcg

SEQ ID NO: 2940771 - RNA, 23 nt, Mycobacterium avium subsp. paratuberculosis
cgggcggcccgccucggcggccg

SEQ ID NO: 2940772 - RNA, 22 nt, Mycobacterium avium subsp. paratuberculosis
cgggcggcccggguggacgccc

SEQ ID NO: 2940773 - RNA, 16 nt, Mycobacterium avium subsp. paratuberculosis
cgggcggccgaucccg

SEQ ID NO: 2940774 - RNA, 17 nt, Mycobacterium avium subsp. paratuberculosis
cgggcggccggagccga

SEQ ID NO: 2940775 - RNA, 15 nt, Mycobacterium avium subsp. paratuberculosis
cgggcggccgugguc

SEQ ID NO: 2940776 - RNA, 13 nt, Mycobacterium avium subsp. paratuberculosis
cgggcggccucgg

SEQ ID NO: 2940777 - RNA, 14 nt, Mycobacterium avium subsp. paratuberculosis
cgggcggccucggc

SEQ ID NO: 2940778 - RNA, 14 nt, Mycobacterium avium subsp. paratuberculosis
cgggcggccugccg

SEQ ID NO: 2940779 - RNA, 15 nt, Mycobacterium avium subsp. paratuberculosis
cgggcggccugccgg

SEQ ID NO: 2940780 - RNA, 18 nt, Mycobacterium avium subsp. paratuberculosis
cgggcggcgaacaccagc

SEQ ID NO: 2940781 - RNA, 20 nt, Mycobacterium avium subsp. paratuberculosis
cgggcggcgaacaccagcac

SEQ ID NO: 2940782 - RNA, 19 nt, Mycobacterium avium subsp. paratuberculosis
cgggcggcgacgucguggc

SEQ ID NO: 2940783 - RNA, 17 nt, Mycobacterium avium subsp. paratuberculosis
cgggcggcgcagucggc

SEQ ID NO: 2940784 - RNA, 19 nt, Mycobacterium avium subsp. paratuberculosis
cgggcguggcggucggugc

SEQ ID NO: 2940785 - RNA, 18 nt, Mycobacterium avium subsp. paratuberculosis
cgggcguggcgucgguga

SEQ ID NO: 2940786 - RNA, 22 nt, Mycobacterium avium subsp. paratuberculosis
cgggcguggcuugaucgcaccc

SEQ ID NO: 2940787 - RNA, 19 nt, Mycobacterium avium subsp. paratuberculosis
cgggcguguagccugcggc

SEQ ID NO: 2940788 - RNA, 22 nt, Mycobacterium avium subsp. paratuberculosis
cgggcguguagccugcggccug

SEQ ID NO: 2940789 - RNA, 23 nt, Mycobacterium avium subsp. paratuberculosis
cgggcguguaguccaggucgauc

SEQ ID NO: 2940790 - RNA, 15 nt, Mycobacterium avium subsp. paratuberculosis
cgggcguucaucacc

SEQ ID NO: 2940791 - RNA, 16 nt, Mycobacterium avium subsp. paratuberculosis
cgggcguucaucaccu

SEQ ID NO: 2940792 - RNA, 13 nt, Mycobacterium avium subsp. paratuberculosis
cgggcguucccgc

SEQ ID NO: 2940793 - RNA, 17 nt, Mycobacterium avium subsp. paratuberculosis
cgggcguucccgcgcgc

SEQ ID NO: 2940794 - RNA, 15 nt, Mycobacterium avium subsp. paratuberculosis
cgggcguugcccgcc

SEQ ID NO: 2940795 - RNA, 19 nt, Mycobacterium avium subsp. paratuberculosis
cgggcguugcccgccgcgg

SEQ ID NO: 2940796 - RNA, 20 nt, Mycobacterium avium subsp. paratuberculosis
cgggcguugcccgccgcggc

SEQ ID NO: 2940797 - RNA, 22 nt, Mycobacterium avium subsp. paratuberculosis
cgggcguugcccgccgcggcga

SEQ ID NO: 2940798 - RNA, 15 nt, Mycobacterium avium subsp. paratuberculosis
cgggcguugcgccgc

SEQ ID NO: 2940799 - RNA, 21 nt, Mycobacterium avium subsp. paratuberculosis
cgggcguugcgccgcgagcgc

SEQ ID NO: 2940800 - RNA, 22 nt, Mycobacterium avium subsp. paratuberculosis
cgggcguugcgccgcgagcgca

SEQ ID NO: 2940801 - RNA, 21 nt, Mycobacterium avium subsp. paratuberculosis
cgggcguugcgcucuguuggc

SEQ ID NO: 2940802 - RNA, 21 nt, Mycobacterium avium subsp. paratuberculosis
cgggcguuggcuuccucgcug

SEQ ID NO: 2940803 - RNA, 15 nt, Mycobacterium avium subsp. paratuberculosis
cgggcuaagucguug

SEQ ID NO: 2940804 - RNA, 14 nt, Mycobacterium avium subsp. paratuberculosis
cgggcuagacgcgc

SEQ ID NO: 2940805 - RNA, 18 nt, Mycobacterium avium subsp. paratuberculosis
cgggcuagacgcgcacca

SEQ ID NO: 2940806 - RNA, 18 nt, Mycobacterium avium subsp. paratuberculosis
cgggcuaggcucggcagc

SEQ ID NO: 2940807 - RNA, 20 nt, Mycobacterium avium subsp. paratuberculosis
cgggcuaggcucggcagccg

SEQ ID NO: 2940808 - RNA, 17 nt, Mycobacterium avium subsp. paratuberculosis
cgggcuaucgcccggcg

SEQ ID NO: 2940809 - RNA, 16 nt, Mycobacterium avium subsp. paratuberculosis
cgggcucccgcucgcc

SEQ ID NO: 2940810 - RNA, 22 nt, Mycobacterium avium subsp. paratuberculosis
cgggcucccucgucgcuaccuc

SEQ ID NO: 2940811 - RNA, 14 nt, Mycobacterium avium subsp. paratuberculosis
cgggcuccgcacga

SEQ ID NO: 2940812 - RNA, 19 nt, Mycobacterium avium subsp. paratuberculosis
cgggcuccgcacgaccuga

SEQ ID NO: 2940813 - RNA, 14 nt, Mycobacterium avium subsp. paratuberculosis
cgggcucgaacaac

SEQ ID NO: 2940814 - RNA, 21 nt, Mycobacterium avium subsp. paratuberculosis
cgggcucgaacaacccggccg

SEQ ID NO: 2940815 - RNA, 15 nt, Mycobacterium avium subsp. paratuberculosis
cgggcucgagcaccg

SEQ ID NO: 2940816 - RNA, 15 nt, Mycobacterium avium subsp. paratuberculosis
cgggcucgagcccca

SEQ ID NO: 2940817 - RNA, 20 nt, Mycobacterium avium subsp. paratuberculosis
cgggcucgagggcggcgacc

SEQ ID NO: 2940818 - RNA, 13 nt, Mycobacterium avium subsp. paratuberculosis
cgggcucgccggc

SEQ ID NO: 2940819 - RNA, 17 nt, Mycobacterium avium subsp. paratuberculosis
cgggcucgccggcccga

SEQ ID NO: 2940820 - RNA, 19 nt, Mycobacterium avium subsp. paratuberculosis
cgggcucgccucggggauc

SEQ ID NO: 2940821 - RNA, 22 nt, Mycobacterium avium subsp. paratuberculosis
cgggcucgccucggggaucgcc

SEQ ID NO: 2940822 - RNA, 17 nt, Mycobacterium avium subsp. paratuberculosis
cgggcucgcgcuggcgg

SEQ ID NO: 2940823 - RNA, 18 nt, Mycobacterium avium subsp. paratuberculosis
cgggcucgcggccugcgg

SEQ ID NO: 2940824 - RNA, 13 nt, Mycobacterium avium subsp. paratuberculosis
cgggcucgcgguc

SEQ ID NO: 2940825 - RNA, 16 nt, Mycobacterium avium subsp. paratuberculosis
cgggcucggacgacuc

SEQ ID NO: 2940826 - RNA, 21 nt, Mycobacterium avium subsp. paratuberculosis
cgggcucggaguugcgcagcc

SEQ ID NO: 2940827 - RNA, 14 nt, Mycobacterium avium subsp. paratuberculosis
cgggcucggccgcc

SEQ ID NO: 2940828 - RNA, 17 nt, Mycobacterium avium subsp. paratuberculosis
cgggcucggccgccgac

SEQ ID NO: 2940829 - RNA, 18 nt, Mycobacterium avium subsp. paratuberculosis
cgggcucggccgccgaca

SEQ ID NO: 2940830 - RNA, 13 nt, Mycobacterium avium subsp. paratuberculosis
cgggcucggcgua

SEQ ID NO: 2940831 - RNA, 20 nt, Mycobacterium avium subsp. paratuberculosis
cgggcucggcguacaggccg

SEQ ID NO: 2940832 - RNA, 18 nt, Mycobacterium avium subsp. paratuberculosis
cgggcucggucaccccgg

SEQ ID NO: 2940833 - RNA, 20 nt, Mycobacterium avium subsp. paratuberculosis
cgggcucggucaccccggag

SEQ ID NO: 2940834 - RNA, 19 nt, Mycobacterium avium subsp. paratuberculosis
cgggcucgucguugcgcag

SEQ ID NO: 2940835 - RNA, 16 nt, Mycobacterium avium subsp. paratuberculosis
cgggcugaacucgacg

SEQ ID NO: 2940836 - RNA, 21 nt, Mycobacterium avium subsp. paratuberculosis
cgggcugaagaucaacagccg

SEQ ID NO: 2940837 - RNA, 15 nt, Mycobacterium avium subsp. paratuberculosis
cgggcugaccucgcg

SEQ ID NO: 2940838 - RNA, 16 nt, Mycobacterium avium subsp. paratuberculosis
cgggcugacgucgaag

SEQ ID NO: 2940839 - RNA, 17 nt, Mycobacterium avium subsp. paratuberculosis
cgggcugacgucgaagg

SEQ ID NO: 2940840 - RNA, 16 nt, Mycobacterium avium subsp. paratuberculosis
cgggcugauccgcgac

SEQ ID NO: 2940841 - RNA, 12 nt, Mycobacterium avium subsp. paratuberculosis
cgggcugcacca

SEQ ID NO: 2940842 - RNA, 13 nt, Mycobacterium avium subsp. paratuberculosis
cgggcugcacgcu

SEQ ID NO: 2940843 - RNA, 14 nt, Mycobacterium avium subsp. paratuberculosis
cgggcugcacgcug

SEQ ID NO: 2940844 - RNA, 15 nt, Mycobacterium avium subsp. paratuberculosis
cgggcugcacgcugc

SEQ ID NO: 2940845 - RNA, 14 nt, Mycobacterium avium subsp. paratuberculosis
cgggcugcagcagc

SEQ ID NO: 2940846 - RNA, 18 nt, Mycobacterium avium subsp. paratuberculosis
cgggcugcagcagcgacu

SEQ ID NO: 2940847 - RNA, 16 nt, Mycobacterium avium subsp. paratuberculosis
cgggcugcagcgacug

SEQ ID NO: 2940848 - RNA, 19 nt, Mycobacterium avium subsp. paratuberculosis
cgggcugcagggccggguc

SEQ ID NO: 2940849 - RNA, 16 nt, Mycobacterium avium subsp. paratuberculosis
cgggcugcccaccacc

SEQ ID NO: 2940850 - RNA, 17 nt, Mycobacterium avium subsp. paratuberculosis
cgggcugcccaccacca

SEQ ID NO: 2940851 - RNA, 17 nt, Mycobacterium avium subsp. paratuberculosis
cgggcugcccggcgccg

SEQ ID NO: 2940852 - RNA, 14 nt, Mycobacterium avium subsp. paratuberculosis
cgggcugcgcagca

SEQ ID NO: 2940853 - RNA, 18 nt, Mycobacterium avium subsp. paratuberculosis
cgggcugcgcagcaccgu

SEQ ID NO: 2940854 - RNA, 14 nt, Mycobacterium avium subsp. paratuberculosis
cgggcugcggcgag

SEQ ID NO: 2940855 - RNA, 15 nt, Mycobacterium avium subsp. paratuberculosis
cgggcugcggcgagu

SEQ ID NO: 2940856 - RNA, 22 nt, Mycobacterium avium subsp. paratuberculosis
cgggcugcggcgagucccggcg

SEQ ID NO: 2940857 - RNA, 17 nt, Mycobacterium avium subsp. paratuberculosis
cgggcugcgggcaucgc

SEQ ID NO: 2940858 - RNA, 21 nt, Mycobacterium avium subsp. paratuberculosis
cgggcugcgggcaucgcuggu

SEQ ID NO: 2940859 - RNA, 13 nt, Mycobacterium avium subsp. paratuberculosis
cgggcugcgguuc

SEQ ID NO: 2940860 - RNA, 17 nt, Mycobacterium avium subsp. paratuberculosis
cgggcugcgguuccggg

SEQ ID NO: 2940861 - RNA, 19 nt, Mycobacterium avium subsp. paratuberculosis
cgggcugcgguuccgggcg

SEQ ID NO: 2940862 - RNA, 19 nt, Mycobacterium avium subsp. paratuberculosis
cgggcugcugcacgucgcc

SEQ ID NO: 2940863 - RNA, 14 nt, Mycobacterium avium subsp. paratuberculosis
cgggcuggccaggc

SEQ ID NO: 2940864 - RNA, 16 nt, Mycobacterium avium subsp. paratuberculosis
cgggcuggccaggcuc

SEQ ID NO: 2940865 - RNA, 15 nt, Mycobacterium avium subsp. paratuberculosis
cgggcuggccgucgg

SEQ ID NO: 2940866 - RNA, 16 nt, Mycobacterium avium subsp. paratuberculosis
cgggcuggccgucggc

SEQ ID NO: 2940867 - RNA, 19 nt, Mycobacterium avium subsp. paratuberculosis
cgggcuggccgucggcgau

SEQ ID NO: 2940868 - RNA, 17 nt, Mycobacterium avium subsp. paratuberculosis
cgggcuggcgcuggauc

SEQ ID NO: 2940869 - RNA, 22 nt, Mycobacterium avium subsp. paratuberculosis
cggggccagcacgcccccgcug

SEQ ID NO: 2940870 - RNA, 15 nt, Mycobacterium avium subsp. paratuberculosis
cggggccaggaugcc

SEQ ID NO: 2940871 - RNA, 19 nt, Mycobacterium avium subsp. paratuberculosis
cggggccagguacuccucg

SEQ ID NO: 2940872 - RNA, 19 nt, Mycobacterium avium subsp. paratuberculosis
cggggccaucucagcguuc

SEQ ID NO: 2940873 - RNA, 13 nt, Mycobacterium avium subsp. paratuberculosis
cggggcccacccc

SEQ ID NO: 2940874 - RNA, 17 nt, Mycobacterium avium subsp. paratuberculosis
cggggcccaccccggac

SEQ ID NO: 2940875 - RNA, 17 nt, Mycobacterium avium subsp. paratuberculosis
cggggccccaacccccc

SEQ ID NO: 2940876 - RNA, 15 nt, Mycobacterium avium subsp. paratuberculosis
cggggcccggcccgg

SEQ ID NO: 2940877 - RNA, 17 nt, Mycobacterium avium subsp. paratuberculosis
cggggcccggcccggcg

SEQ ID NO: 2940878 - RNA, 14 nt, Mycobacterium avium subsp. paratuberculosis
cggggcccgggccg

SEQ ID NO: 2940879 - RNA, 22 nt, Mycobacterium avium subsp. paratuberculosis
cggggcccguccccaccaccga

SEQ ID NO: 2940880 - RNA, 13 nt, Mycobacterium avium subsp. paratuberculosis
cggggcccuccgc

SEQ ID NO: 2940881 - RNA, 16 nt, Mycobacterium avium subsp. paratuberculosis
cggggcccuccgcggc

SEQ ID NO: 2940882 - RNA, 18 nt, Mycobacterium avium subsp. paratuberculosis
cggggcccuccgcggcgc

SEQ ID NO: 2940883 - RNA, 23 nt, Mycobacterium avium subsp. paratuberculosis
cggggcccuccgcggcgccguag

SEQ ID NO: 2940884 - RNA, 15 nt, Mycobacterium avium subsp. paratuberculosis
cggggccgcaccuga

SEQ ID NO: 2940885 - RNA, 12 nt, Mycobacterium avium subsp. paratuberculosis
cggggccgccgu

SEQ ID NO: 2940886 - RNA, 14 nt, Mycobacterium avium subsp. paratuberculosis
cggggccgccgucg

SEQ ID NO: 2940887 - RNA, 15 nt, Mycobacterium avium subsp. paratuberculosis
cggggccgccgucgg

SEQ ID NO: 2940888 - RNA, 12 nt, Mycobacterium avium subsp. paratuberculosis
cggggccgcggc

SEQ ID NO: 2940889 - RNA, 16 nt, Mycobacterium avium subsp. paratuberculosis
cggggccgcggccggc

SEQ ID NO: 2940890 - RNA, 17 nt, Mycobacterium avium subsp. paratuberculosis
cggggccgcggccggca

SEQ ID NO: 2940891 - RNA, 14 nt, Mycobacterium avium subsp. paratuberculosis
cggggccgcggcuc

SEQ ID NO: 2940892 - RNA, 15 nt, Mycobacterium avium subsp. paratuberculosis
cggggccgcggcucg

SEQ ID NO: 2940893 - RNA, 22 nt, Mycobacterium avium subsp. paratuberculosis
cggggccgcggcucgcgacgcg

SEQ ID NO: 2940894 - RNA, 21 nt, Mycobacterium avium subsp. paratuberculosis
cggggccggcgaugcccguga

SEQ ID NO: 2940895 - RNA, 13 nt, Mycobacterium avium subsp. paratuberculosis
cggggccggcgcg

SEQ ID NO: 2940896 - RNA, 15 nt, Mycobacterium avium subsp. paratuberculosis
cggggccggcgcggu

SEQ ID NO: 2940897 - RNA, 16 nt, Mycobacterium avium subsp. paratuberculosis
cggggccggcgcggug

SEQ ID NO: 2940898 - RNA, 17 nt, Mycobacterium avium subsp. paratuberculosis
cggggccggcgcggugc

SEQ ID NO: 2940899 - RNA, 23 nt, Mycobacterium avium subsp. paratuberculosis
cggggccggcgcggugggcggcg

SEQ ID NO: 2940900 - RNA, 12 nt, Mycobacterium avium subsp. paratuberculosis
cggggccggcgg

SEQ ID NO: 2940901 - RNA, 13 nt, Mycobacterium avium subsp. paratuberculosis
cggggccggcggc

SEQ ID NO: 2940902 - RNA, 14 nt, Mycobacterium avium subsp. paratuberculosis
cggggccggcggcg

SEQ ID NO: 2940903 - RNA, 15 nt, Mycobacterium avium subsp. paratuberculosis
cggggccggcggcgg

SEQ ID NO: 2940904 - RNA, 16 nt, Mycobacterium avium subsp. paratuberculosis
cggggccggcggcggc

SEQ ID NO: 2940905 - RNA, 18 nt, Mycobacterium avium subsp. paratuberculosis
cggggccggcggcggcca

SEQ ID NO: 2940906 - RNA, 19 nt, Mycobacterium avium subsp. paratuberculosis
cggggccggcggcggccag

SEQ ID NO: 2940907 - RNA, 20 nt, Mycobacterium avium subsp. paratuberculosis
cggggccggcggcggccagc

SEQ ID NO: 2940908 - RNA, 22 nt, Mycobacterium avium subsp. paratuberculosis
cggggccggcgggggcgcgucc

SEQ ID NO: 2940909 - RNA, 17 nt, Mycobacterium avium subsp. paratuberculosis
cggggccggugauggug

SEQ ID NO: 2940910 - RNA, 20 nt, Mycobacterium avium subsp. paratuberculosis
cggggccggugcguccgccg

SEQ ID NO: 2940911 - RNA, 23 nt, Mycobacterium avium subsp. paratuberculosis
cggggccggugcguccgccggcg

SEQ ID NO: 2940912 - RNA, 22 nt, Mycobacterium avium subsp. paratuberculosis
cggggccgguuggugcgccguc

SEQ ID NO: 2940913 - RNA, 23 nt, Mycobacterium avium subsp. paratuberculosis
cggggccgguuggugcgccguca

SEQ ID NO: 2940914 - RNA, 14 nt, Mycobacterium avium subsp. paratuberculosis
cggggccguccggg

SEQ ID NO: 2940915 - RNA, 14 nt, Mycobacterium avium subsp. paratuberculosis
cggggccuccacca

SEQ ID NO: 2940916 - RNA, 17 nt, Mycobacterium avium subsp. paratuberculosis
cggggccuccaccagcg

SEQ ID NO: 2940917 - RNA, 20 nt, Mycobacterium avium subsp. paratuberculosis
cggggccuccaccagcggcg

SEQ ID NO: 2940918 - RNA, 13 nt, Mycobacterium avium subsp. paratuberculosis
cggggccuccagc

SEQ ID NO: 2940919 - RNA, 15 nt, Mycobacterium avium subsp. paratuberculosis
cggggccuccagcca

SEQ ID NO: 2940920 - RNA, 16 nt, Mycobacterium avium subsp. paratuberculosis
cggggccuccagccag

SEQ ID NO: 2940921 - RNA, 21 nt, Mycobacterium avium subsp. paratuberculosis
cggggccuccagccagcgcgc

SEQ ID NO: 2940922 - RNA, 18 nt, Mycobacterium avium subsp. paratuberculosis
cggggccucgaugcggcc

SEQ ID NO: 2940923 - RNA, 23 nt, Mycobacterium avium subsp. paratuberculosis
cggggccucgaugcggccgucgg

SEQ ID NO: 2940924 - RNA, 18 nt, Mycobacterium avium subsp. paratuberculosis
cggggccucgucgccgcg

SEQ ID NO: 2940925 - RNA, 19 nt, Mycobacterium avium subsp. paratuberculosis
cggggccucgucgccgcgg

SEQ ID NO: 2940926 - RNA, 12 nt, Mycobacterium avium subsp. paratuberculosis
cggggccuucuu

SEQ ID NO: 2940927 - RNA, 23 nt, Mycobacterium avium subsp. paratuberculosis
cggggccuucuuggcggcggccu

SEQ ID NO: 2940928 - RNA, 21 nt, Mycobacterium avium subsp. paratuberculosis
cggggccuugacucccucgcc

SEQ ID NO: 2940929 - RNA, 17 nt, Mycobacterium avium subsp. paratuberculosis
cggggcgaacccggcgc

SEQ ID NO: 2940930 - RNA, 15 nt, Mycobacterium avium subsp. paratuberculosis
cggggcgaccaguag

SEQ ID NO: 2940931 - RNA, 21 nt, Mycobacterium avium subsp. paratuberculosis
cggggcgaccaguaggccagc

SEQ ID NO: 2940932 - RNA, 20 nt, Mycobacterium avium subsp. paratuberculosis
cggggcgaccuggacgccgc

SEQ ID NO: 2940933 - RNA, 21 nt, Mycobacterium avium subsp. paratuberculosis
cggggcgaccuggacgccgca

SEQ ID NO: 2940934 - RNA, 21 nt, Mycobacterium avium subsp. paratuberculosis
cggggcgaccuugcgcagccg

SEQ ID NO: 2940935 - RNA, 22 nt, Mycobacterium avium subsp. paratuberculosis
cggggcgaccuugcgcagccgg

SEQ ID NO: 2940936 - RNA, 23 nt, Mycobacterium avium subsp. paratuberculosis
cggggcgaccuugcgcagccggc

SEQ ID NO: 2940937 - RNA, 16 nt, Mycobacterium avium subsp. paratuberculosis
cggggcgaugccgaca

SEQ ID NO: 2940938 - RNA, 17 nt, Mycobacterium avium subsp. paratuberculosis
cggggcgaugccgacac

SEQ ID NO: 2940939 - RNA, 22 nt, Mycobacterium avium subsp. paratuberculosis
cggggcgaugccgacaccccac

SEQ ID NO: 2940940 - RNA, 13 nt, Mycobacterium avium subsp. paratuberculosis
cggggcgcagccc

SEQ ID NO: 2940941 - RNA, 17 nt, Mycobacterium avium subsp. paratuberculosis
cggggcgcagcccggcg

SEQ ID NO: 2940942 - RNA, 19 nt, Mycobacterium avium subsp. paratuberculosis
cggggcgcagcccggcggu

SEQ ID NO: 2940943 - RNA, 20 nt, Mycobacterium avium subsp. paratuberculosis
cggggcgccccgcugguagc

SEQ ID NO: 2940944 - RNA, 14 nt, Mycobacterium avium subsp. paratuberculosis
cggggcgccgacag

SEQ ID NO: 2940945 - RNA, 14 nt, Mycobacterium avium subsp. paratuberculosis
cggggcgccgccga

SEQ ID NO: 2940946 - RNA, 15 nt, Mycobacterium avium subsp. paratuberculosis
cggggcgccgccgaa

SEQ ID NO: 2940947 - RNA, 21 nt, Mycobacterium avium subsp. paratuberculosis
cggggcgccgccgaacagcag

SEQ ID NO: 2940948 - RNA, 14 nt, Mycobacterium avium subsp. paratuberculosis
cggggcgccgcugc

SEQ ID NO: 2940949 - RNA, 13 nt, Mycobacterium avium subsp. paratuberculosis
cggggcgccuacc

SEQ ID NO: 2940950 - RNA, 22 nt, Mycobacterium avium subsp. paratuberculosis
cggggcgccuaccggguggcca

SEQ ID NO: 2940951 - RNA, 14 nt, Mycobacterium avium subsp. paratuberculosis
cggggcgcgaggcg

SEQ ID NO: 2940952 - RNA, 15 nt, Mycobacterium avium subsp. paratuberculosis
cggggcgcgaggcgc

SEQ ID NO: 2940953 - RNA, 12 nt, Mycobacterium avium subsp. paratuberculosis
cggggcgcgcag

SEQ ID NO: 2940954 - RNA, 20 nt, Mycobacterium avium subsp. paratuberculosis
cgggggugucguagcggcug

SEQ ID NO: 2940955 - RNA, 23 nt, Mycobacterium avium subsp. paratuberculosis
cgggggugucguagcggcugucg

SEQ ID NO: 2940956 - RNA, 19 nt, Mycobacterium avium subsp. paratuberculosis
cggggguucguugcgccgc

SEQ ID NO: 2940957 - RNA, 23 nt, Mycobacterium avium subsp. paratuberculosis
cggggguucguugcgccgccagg

SEQ ID NO: 2940958 - RNA, 18 nt, Mycobacterium avium subsp. paratuberculosis
cgggguacucggcggcgg

SEQ ID NO: 2940959 - RNA, 21 nt, Mycobacterium avium subsp. paratuberculosis
cgggguacucggcggcgggca

SEQ ID NO: 2940960 - RNA, 23 nt, Mycobacterium avium subsp. paratuberculosis
cgggguacucggcggcgggcagg

SEQ ID NO: 2940961 - RNA, 20 nt, Mycobacterium avium subsp. paratuberculosis
cgggguagaggccgcggauc

SEQ ID NO: 2940962 - RNA, 16 nt, Mycobacterium avium subsp. paratuberculosis
cgggguagccggcccg

SEQ ID NO: 2940963 - RNA, 17 nt, Mycobacterium avium subsp. paratuberculosis
cgggguagccggcccgc

SEQ ID NO: 2940964 - RNA, 15 nt, Mycobacterium avium subsp. paratuberculosis
cgggguagggcggcg

SEQ ID NO: 2940965 - RNA, 21 nt, Mycobacterium avium subsp. paratuberculosis
cgggguagggcggcgggguuc

SEQ ID NO: 2940966 - RNA, 19 nt, Mycobacterium avium subsp. paratuberculosis
cggggucaccuuggccgga

SEQ ID NO: 2940967 - RNA, 21 nt, Mycobacterium avium subsp. paratuberculosis
cggggucacggauacccgcgg

SEQ ID NO: 2940968 - RNA, 22 nt, Mycobacterium avium subsp. paratuberculosis
cggggucacggauacccgcggc

SEQ ID NO: 2940969 - RNA, 16 nt, Mycobacterium avium subsp. paratuberculosis
cgggguccaccggccg

SEQ ID NO: 2940970 - RNA, 18 nt, Mycobacterium avium subsp. paratuberculosis
cgggguccaccggccgau

SEQ ID NO: 2940971 - RNA, 22 nt, Mycobacterium avium subsp. paratuberculosis
cgggguccaccggccgauggcc

SEQ ID NO: 2940972 - RNA, 14 nt, Mycobacterium avium subsp. paratuberculosis
cgggguccaggccg

SEQ ID NO: 2940973 - RNA, 17 nt, Mycobacterium avium subsp. paratuberculosis
cgggguccaggccgcgc

SEQ ID NO: 2940974 - RNA, 18 nt, Mycobacterium avium subsp. paratuberculosis
cgggguccaggccgcgcc

SEQ ID NO: 2940975 - RNA, 19 nt, Mycobacterium avium subsp. paratuberculosis
cggggucccaauccucgcc

SEQ ID NO: 2940976 - RNA, 20 nt, Mycobacterium avium subsp. paratuberculosis
cggggucccaauccucgccg

SEQ ID NO: 2940977 - RNA, 16 nt, Mycobacterium avium subsp. paratuberculosis
cgggguccgcaacgcc

SEQ ID NO: 2940978 - RNA, 20 nt, Mycobacterium avium subsp. paratuberculosis
cgggguccgcaacgccggcg

SEQ ID NO: 2940979 - RNA, 21 nt, Mycobacterium avium subsp. paratuberculosis
cgggguccgcaacgccggcgu

SEQ ID NO: 2940980 - RNA, 24 nt, Mycobacterium avium subsp. paratuberculosis
cgggguccgcaacgccggcgugca

SEQ ID NO: 2940981 - RNA, 18 nt, Mycobacterium avium subsp. paratuberculosis
cgggguccucucggcgcc

SEQ ID NO: 2940982 - RNA, 22 nt, Mycobacterium avium subsp. paratuberculosis
cgggguccucucggcgccgucc

SEQ ID NO: 2940983 - RNA, 12 nt, Mycobacterium avium subsp. paratuberculosis
cggggucgaaca

SEQ ID NO: 2940984 - RNA, 13 nt, Mycobacterium avium subsp. paratuberculosis
cggggucgaacau

SEQ ID NO: 2940985 - RNA, 18 nt, Mycobacterium avium subsp. paratuberculosis
cggggucgaaguccugcg

SEQ ID NO: 2940986 - RNA, 22 nt, Mycobacterium avium subsp. paratuberculosis
cggggucgaaguccugcgccgc

SEQ ID NO: 2940987 - RNA, 17 nt, Mycobacterium avium subsp. paratuberculosis
cggggucgacagccuga

SEQ ID NO: 2940988 - RNA, 14 nt, Mycobacterium avium subsp. paratuberculosis
cggggucgaucacc

SEQ ID NO: 2940989 - RNA, 13 nt, Mycobacterium avium subsp. paratuberculosis
cggggucgccguc

SEQ ID NO: 2940990 - RNA, 14 nt, Mycobacterium avium subsp. paratuberculosis
cggggucgccgucg

SEQ ID NO: 2940991 - RNA, 12 nt, Mycobacterium avium subsp. paratuberculosis
cggggucgcgcc

SEQ ID NO: 2940992 - RNA, 13 nt, Mycobacterium avium subsp. paratuberculosis
cggggucgcgcgc

SEQ ID NO: 2940993 - RNA, 15 nt, Mycobacterium avium subsp. paratuberculosis
cggggucggacagag

SEQ ID NO: 2940994 - RNA, 12 nt, Mycobacterium avium subsp. paratuberculosis
cggggucggccg

SEQ ID NO: 2940995 - RNA, 15 nt, Mycobacterium avium subsp. paratuberculosis
cggggucggccgagg

SEQ ID NO: 2940996 - RNA, 17 nt, Mycobacterium avium subsp. paratuberculosis
cggggucggccgagguc

SEQ ID NO: 2940997 - RNA, 13 nt, Mycobacterium avium subsp. paratuberculosis
cggggucggcgcc

SEQ ID NO: 2940998 - RNA, 14 nt, Mycobacterium avium subsp. paratuberculosis
cggggucggcgccc

SEQ ID NO: 2940999 - RNA, 18 nt, Mycobacterium avium subsp. paratuberculosis
cggggucggcgccgcgcg

SEQ ID NO: 2941000 - RNA, 14 nt, Mycobacterium avium subsp. paratuberculosis
cggggucggcgucg

SEQ ID NO: 2941001 - RNA, 20 nt, Mycobacterium avium subsp. paratuberculosis
cggggucgggaucaacacga

SEQ ID NO: 2941002 - RNA, 15 nt, Mycobacterium avium subsp. paratuberculosis
cggggucgggccgga

SEQ ID NO: 2941003 - RNA, 18 nt, Mycobacterium avium subsp. paratuberculosis
cggggucgggccggacag

SEQ ID NO: 2941004 - RNA, 19 nt, Mycobacterium avium subsp. paratuberculosis
cggggucgggccggacagc

SEQ ID NO: 2941005 - RNA, 15 nt, Mycobacterium avium subsp. paratuberculosis
cggggucgucgacgg

SEQ ID NO: 2941006 - RNA, 13 nt, Mycobacterium avium subsp. paratuberculosis
cggggucgucgcg

SEQ ID NO: 2941007 - RNA, 19 nt, Mycobacterium avium subsp. paratuberculosis
cggggucucaaucuucucc

SEQ ID NO: 2941008 - RNA, 23 nt, Mycobacterium avium subsp. paratuberculosis
cggggucucaaucuucuccgcgg

SEQ ID NO: 2941009 - RNA, 13 nt, Mycobacterium avium subsp. paratuberculosis
cggggugacgccc

SEQ ID NO: 2941010 - RNA, 15 nt, Mycobacterium avium subsp. paratuberculosis
cggggugacgcccgu

SEQ ID NO: 2941011 - RNA, 19 nt, Mycobacterium avium subsp. paratuberculosis
cggggugacgcccgucccg

SEQ ID NO: 2941012 - RNA, 22 nt, Mycobacterium avium subsp. paratuberculosis
cggggugacgcccgucccgccg

SEQ ID NO: 2941013 - RNA, 19 nt, Mycobacterium avium subsp. paratuberculosis
cggggugacuucgagccgg

SEQ ID NO: 2941014 - RNA, 16 nt, Mycobacterium avium subsp. paratuberculosis
cggggugagcaccgcg

SEQ ID NO: 2941015 - RNA, 22 nt, Mycobacterium avium subsp. paratuberculosis
cggggugagcaccgcgaccagc

SEQ ID NO: 2941016 - RNA, 23 nt, Mycobacterium avium subsp. paratuberculosis
cggggugagcaccgcgaccagcu

SEQ ID NO: 2941017 - RNA, 13 nt, Mycobacterium avium subsp. paratuberculosis
cggggugaugccg

SEQ ID NO: 2941018 - RNA, 13 nt, Mycobacterium avium subsp. paratuberculosis
cggggugcaccgu

SEQ ID NO: 2941019 - RNA, 12 nt, Mycobacterium avium subsp. paratuberculosis
cggggugcagca

SEQ ID NO: 2941020 - RNA, 14 nt, Mycobacterium avium subsp. paratuberculosis
cggggugcagcacc

SEQ ID NO: 2941021 - RNA, 22 nt, Mycobacterium avium subsp. paratuberculosis
cggggugcagcaccacgaacgc

SEQ ID NO: 2941022 - RNA, 15 nt, Mycobacterium avium subsp. paratuberculosis
cggggugcccaccac

SEQ ID NO: 2941023 - RNA, 15 nt, Mycobacterium avium subsp. paratuberculosis
cggggugcccggcga

SEQ ID NO: 2941024 - RNA, 18 nt, Mycobacterium avium subsp. paratuberculosis
cggggugcccggcgagga

SEQ ID NO: 2941025 - RNA, 18 nt, Mycobacterium avium subsp. paratuberculosis
cggggugcccgggccgca

SEQ ID NO: 2941026 - RNA, 12 nt, Mycobacterium avium subsp. paratuberculosis
cggggugccgcc

SEQ ID NO: 2941027 - RNA, 13 nt, Mycobacterium avium subsp. paratuberculosis
cggggugccgccg

SEQ ID NO: 2941028 - RNA, 16 nt, Mycobacterium avium subsp. paratuberculosis
cggggugccgccgggg

SEQ ID NO: 2941029 - RNA, 22 nt, Mycobacterium avium subsp. paratuberculosis
cggggugccgccggggacccgc

SEQ ID NO: 2941030 - RNA, 15 nt, Mycobacterium avium subsp. paratuberculosis
cggggugcgccaggc

SEQ ID NO: 2941031 - RNA, 17 nt, Mycobacterium avium subsp. paratuberculosis
cggggugcgccaggcag

SEQ ID NO: 2941032 - RNA, 18 nt, Mycobacterium avium subsp. paratuberculosis
cggggugcucgaucggcg

SEQ ID NO: 2941033 - RNA, 20 nt, Mycobacterium avium subsp. paratuberculosis
cggggugcucgaucggcgcg

SEQ ID NO: 2941034 - RNA, 21 nt, Mycobacterium avium subsp. paratuberculosis
cggggugcucgaucggcgcgc

SEQ ID NO: 2941035 - RNA, 19 nt, Mycobacterium avium subsp. paratuberculosis
cgggguggaauaggccgcg

SEQ ID NO: 2941036 - RNA, 20 nt, Mycobacterium avium subsp. paratuberculosis
cgggguggaauaggccgcgu

SEQ ID NO: 2941037 - RNA, 14 nt, Mycobacterium avium subsp. paratuberculosis
cgggguggacgcga

SEQ ID NO: 2941038 - RNA, 19 nt, Mycobacterium avium subsp. paratuberculosis
cgggguggacgcgaccagg

SEQ ID NO: 2941039 - RNA, 18 nt, Mycobacterium avium subsp. paratuberculosis
cggguaggugcccggguc

SEQ ID NO: 2941040 - RNA, 15 nt, Mycobacterium avium subsp. paratuberculosis
cggguaugucggcga

SEQ ID NO: 2941041 - RNA, 18 nt, Mycobacterium avium subsp. paratuberculosis
cgggucaauugccacagc

SEQ ID NO: 2941042 - RNA, 19 nt, Mycobacterium avium subsp. paratuberculosis
cgggucaauugccacagcc

SEQ ID NO: 2941043 - RNA, 20 nt, Mycobacterium avium subsp. paratuberculosis
cgggucaauugccacagccg

SEQ ID NO: 2941044 - RNA, 16 nt, Mycobacterium avium subsp. paratuberculosis
cgggucacacccucgg

SEQ ID NO: 2941045 - RNA, 18 nt, Mycobacterium avium subsp. paratuberculosis
cgggucacacccucggcc

SEQ ID NO: 2941046 - RNA, 20 nt, Mycobacterium avium subsp. paratuberculosis
cgggucacacccucggcccg

SEQ ID NO: 2941047 - RNA, 23 nt, Mycobacterium avium subsp. paratuberculosis
cgggucacacccucggcccgcca

SEQ ID NO: 2941048 - RNA, 12 nt, Mycobacterium avium subsp. paratuberculosis
cgggucaccggc

SEQ ID NO: 2941049 - RNA, 18 nt, Mycobacterium avium subsp. paratuberculosis
cgggucaccggccgagcc

SEQ ID NO: 2941050 - RNA, 19 nt, Mycobacterium avium subsp. paratuberculosis
cgggucaccggccgagccg

SEQ ID NO: 2941051 - RNA, 22 nt, Mycobacterium avium subsp. paratuberculosis
cgggucaccgugcgggucgcgc

SEQ ID NO: 2941052 - RNA, 21 nt, Mycobacterium avium subsp. paratuberculosis
cgggucacgaacuccuugacc

SEQ ID NO: 2941053 - RNA, 21 nt, Mycobacterium avium subsp. paratuberculosis
cgggucacggucaggccggga

SEQ ID NO: 2941054 - RNA, 20 nt, Mycobacterium avium subsp. paratuberculosis
cgggucacgugcacccacgc

SEQ ID NO: 2941055 - RNA, 16 nt, Mycobacterium avium subsp. paratuberculosis
cgggucagaccgcggc

SEQ ID NO: 2941056 - RNA, 17 nt, Mycobacterium avium subsp. paratuberculosis
cgggucagaccgcggcg

SEQ ID NO: 2941057 - RNA, 18 nt, Mycobacterium avium subsp. paratuberculosis
cgggucagaccgcggcgg

SEQ ID NO: 2941058 - RNA, 19 nt, Mycobacterium avium subsp. paratuberculosis
cgggucagaccgcggcggu

SEQ ID NO: 2941059 - RNA, 13 nt, Mycobacterium avium subsp. paratuberculosis
cgggucagcacca

SEQ ID NO: 2941060 - RNA, 14 nt, Mycobacterium avium subsp. paratuberculosis
cgggucagcacccg

SEQ ID NO: 2941061 - RNA, 18 nt, Mycobacterium avium subsp. paratuberculosis
cgggucagcacccgcagc

SEQ ID NO: 2941062 - RNA, 20 nt, Mycobacterium avium subsp. paratuberculosis
cgggucagcacccgcagccg

SEQ ID NO: 2941063 - RNA, 23 nt, Mycobacterium avium subsp. paratuberculosis
cgggucagcacccgcagccgcga

SEQ ID NO: 2941064 - RNA, 18 nt, Mycobacterium avium subsp. paratuberculosis
cgggucagcaccgcggag

SEQ ID NO: 2941065 - RNA, 16 nt, Mycobacterium avium subsp. paratuberculosis
cgggucagcagcgucu

SEQ ID NO: 2941066 - RNA, 22 nt, Mycobacterium avium subsp. paratuberculosis
cgggucagcagcgucugcgcca

SEQ ID NO: 2941067 - RNA, 13 nt, Mycobacterium avium subsp. paratuberculosis
cgggucagcagcu

SEQ ID NO: 2941068 - RNA, 18 nt, Mycobacterium avium subsp. paratuberculosis
cgggucagcuccaccugc

SEQ ID NO: 2941069 - RNA, 21 nt, Mycobacterium avium subsp. paratuberculosis
cgggucaggaacaccgagccg

SEQ ID NO: 2941070 - RNA, 15 nt, Mycobacterium avium subsp. paratuberculosis
cgggucaguucgcgg

SEQ ID NO: 2941071 - RNA, 17 nt, Mycobacterium avium subsp. paratuberculosis
cgggucaguucgcggcg

SEQ ID NO: 2941072 - RNA, 18 nt, Mycobacterium avium subsp. paratuberculosis
cgggucaguucgcggcgc

SEQ ID NO: 2941073 - RNA, 20 nt, Mycobacterium avium subsp. paratuberculosis
cgggucaguucgcggcgcac

SEQ ID NO: 2941074 - RNA, 17 nt, Mycobacterium avium subsp. paratuberculosis
cgggucauccccgugcg

SEQ ID NO: 2941075 - RNA, 21 nt, Mycobacterium avium subsp. paratuberculosis
cgggucauccccgugcggggc

SEQ ID NO: 2941076 - RNA, 16 nt, Mycobacterium avium subsp. paratuberculosis
cggguccagccgccgg

SEQ ID NO: 2941077 - RNA, 17 nt, Mycobacterium avium subsp. paratuberculosis
cggguccagccgccggc

SEQ ID NO: 2941078 - RNA, 18 nt, Mycobacterium avium subsp. paratuberculosis
cggguccagccgccggcg

SEQ ID NO: 2941079 - RNA, 19 nt, Mycobacterium avium subsp. paratuberculosis
cggguccagccgccggcgg

SEQ ID NO: 2941080 - RNA, 16 nt, Mycobacterium avium subsp. paratuberculosis
cggguccagccgcggu

SEQ ID NO: 2941081 - RNA, 17 nt, Mycobacterium avium subsp. paratuberculosis
cggguccagccgcgguu

SEQ ID NO: 2941082 - RNA, 13 nt, Mycobacterium avium subsp. paratuberculosis
cggguccaucgcc

SEQ ID NO: 2941083 - RNA, 17 nt, Mycobacterium avium subsp. paratuberculosis
cggguccaucgccucga

SEQ ID NO: 2941084 - RNA, 14 nt, Mycobacterium avium subsp. paratuberculosis
cgggucccagaugc

SEQ ID NO: 2941085 - RNA, 15 nt, Mycobacterium avium subsp. paratuberculosis
cgggucccagaugcg

SEQ ID NO: 2941086 - RNA, 16 nt, Mycobacterium avium subsp. paratuberculosis
cgggucccagaugcgc

SEQ ID NO: 2941087 - RNA, 20 nt, Mycobacterium avium subsp. paratuberculosis
cgggucccagaugcgcgacg

SEQ ID NO: 2941088 - RNA, 20 nt, Mycobacterium avium subsp. paratuberculosis
cgggucccagugccaguacc

SEQ ID NO: 2941089 - RNA, 13 nt, Mycobacterium avium subsp. paratuberculosis
cgggucccccgcc

SEQ ID NO: 2941090 - RNA, 15 nt, Mycobacterium avium subsp. paratuberculosis
cgggucccccgccga

SEQ ID NO: 2941091 - RNA, 17 nt, Mycobacterium avium subsp. paratuberculosis
cgggucccccgccgacc

SEQ ID NO: 2941092 - RNA, 14 nt, Mycobacterium avium subsp. paratuberculosis
cgggucccggcaac

SEQ ID NO: 2941093 - RNA, 22 nt, Mycobacterium avium subsp. paratuberculosis
cgggucccggcaacaccggcgg

SEQ ID NO: 2941094 - RNA, 23 nt, Mycobacterium avium subsp. paratuberculosis
cgggucccggcaacaccggcggc

SEQ ID NO: 2941095 - RNA, 15 nt, Mycobacterium avium subsp. paratuberculosis
cggguccgaccagca

SEQ ID NO: 2941096 - RNA, 16 nt, Mycobacterium avium subsp. paratuberculosis
cggguccgaccagcac

SEQ ID NO: 2941097 - RNA, 18 nt, Mycobacterium avium subsp. paratuberculosis
cggguccgaccagcaccc

SEQ ID NO: 2941098 - RNA, 21 nt, Mycobacterium avium subsp. paratuberculosis
cggguccgaggugaucgcgaa

SEQ ID NO: 2941099 - RNA, 13 nt, Mycobacterium avium subsp. paratuberculosis
cggguccgcgguc

SEQ ID NO: 2941100 - RNA, 20 nt, Mycobacterium avium subsp. paratuberculosis
cggguccuggaaggcguugg

SEQ ID NO: 2941101 - RNA, 15 nt, Mycobacterium avium subsp. paratuberculosis
cggguccuggaucag

SEQ ID NO: 2941102 - RNA, 19 nt, Mycobacterium avium subsp. paratuberculosis
cggguccuggcccccgccc

SEQ ID NO: 2941103 - RNA, 21 nt, Mycobacterium avium subsp. paratuberculosis
cggguccuggcccccgcccca

SEQ ID NO: 2941104 - RNA, 19 nt, Mycobacterium avium subsp. paratuberculosis
cggguccuugccggcggcg

SEQ ID NO: 2941105 - RNA, 20 nt, Mycobacterium avium subsp. paratuberculosis
cggguccuugcgccccggcg

SEQ ID NO: 2941106 - RNA, 17 nt, Mycobacterium avium subsp. paratuberculosis
cgggucgaagugcucga

SEQ ID NO: 2941107 - RNA, 12 nt, Mycobacterium avium subsp. paratuberculosis
cgggucgaccgc

SEQ ID NO: 2941108 - RNA, 13 nt, Mycobacterium avium subsp. paratuberculosis
cgggucgaccgcc

SEQ ID NO: 2941109 - RNA, 19 nt, Mycobacterium avium subsp. paratuberculosis
cgggucgaccgccgcgucg

SEQ ID NO: 2941110 - RNA, 17 nt, Mycobacterium avium subsp. paratuberculosis
cgggucgaccgccucgg

SEQ ID NO: 2941111 - RNA, 19 nt, Mycobacterium avium subsp. paratuberculosis
cgggucgacgagcaggcug

SEQ ID NO: 2941112 - RNA, 14 nt, Mycobacterium avium subsp. paratuberculosis
cgggucgacgccga

SEQ ID NO: 2941113 - RNA, 15 nt, Mycobacterium avium subsp. paratuberculosis
cgggucgagagccgc

SEQ ID NO: 2941114 - RNA, 16 nt, Mycobacterium avium subsp. paratuberculosis
cgggucgagcgcgccg

SEQ ID NO: 2941115 - RNA, 17 nt, Mycobacterium avium subsp. paratuberculosis
cgggucgagcgcgccga

SEQ ID NO: 2941116 - RNA, 19 nt, Mycobacterium avium subsp. paratuberculosis
cgggucgagcgcgccgaga

SEQ ID NO: 2941117 - RNA, 16 nt, Mycobacterium avium subsp. paratuberculosis
cgggucgagcggcccg

SEQ ID NO: 2941118 - RNA, 17 nt, Mycobacterium avium subsp. paratuberculosis
cgggucgagggucgcca

SEQ ID NO: 2941119 - RNA, 22 nt, Mycobacterium avium subsp. paratuberculosis
cgggucgauaugcugcaacggc

SEQ ID NO: 2941120 - RNA, 17 nt, Mycobacterium avium subsp. paratuberculosis
cgggucgaucucggcgc

SEQ ID NO: 2941121 - RNA, 18 nt, Mycobacterium avium subsp. paratuberculosis
cgggucgaucucggcgca

SEQ ID NO: 2941122 - RNA, 19 nt, Mycobacterium avium subsp. paratuberculosis
cgggucgaucucggcgcag

SEQ ID NO: 2941123 - RNA, 19 nt, Mycobacterium avium subsp. paratuberculosis
cgggucucgaaccgggcgg

SEQ ID NO: 2941124 - RNA, 16 nt, Mycobacterium avium subsp. paratuberculosis
cgggucucgcccaccu

SEQ ID NO: 2941125 - RNA, 21 nt, Mycobacterium avium subsp. paratuberculosis
cgggucugcucacgcaacgag

SEQ ID NO: 2941126 - RNA, 19 nt, Mycobacterium avium subsp. paratuberculosis
cgggucuggcucggcacca

SEQ ID NO: 2941127 - RNA, 20 nt, Mycobacterium avium subsp. paratuberculosis
cgggucuuccacgccgguga

SEQ ID NO: 2941128 - RNA, 19 nt, Mycobacterium avium subsp. paratuberculosis
cgggugaacccgacguugc

SEQ ID NO: 2941129 - RNA, 22 nt, Mycobacterium avium subsp. paratuberculosis
cgggugaacccgacguugccgc

SEQ ID NO: 2941130 - RNA, 17 nt, Mycobacterium avium subsp. paratuberculosis
cgggugaacgaggccgc

SEQ ID NO: 2941131 - RNA, 18 nt, Mycobacterium avium subsp. paratuberculosis
cgggugaacgaggccgcg

SEQ ID NO: 2941132 - RNA, 19 nt, Mycobacterium avium subsp. paratuberculosis
cgggugaacgaggccgcgc

SEQ ID NO: 2941133 - RNA, 15 nt, Mycobacterium avium subsp. paratuberculosis
cgggugaaucgacac

SEQ ID NO: 2941134 - RNA, 20 nt, Mycobacterium avium subsp. paratuberculosis
cgggugaaucgacaccgcac

SEQ ID NO: 2941135 - RNA, 16 nt, Mycobacterium avium subsp. paratuberculosis
cgggugaccgacagca

SEQ ID NO: 2941136 - RNA, 22 nt, Mycobacterium avium subsp. paratuberculosis
cgggugaccgccuuggcgcgcu

SEQ ID NO: 2941137 - RNA, 23 nt, Mycobacterium avium subsp. paratuberculosis
cgggugaccgccuuggcgcgcuc

SEQ ID NO: 2941138 - RNA, 24 nt, Mycobacterium avium subsp. paratuberculosis
cgggugaccgccuuggcgcgcucg

SEQ ID NO: 2941139 - RNA, 16 nt, Mycobacterium avium subsp. paratuberculosis
cgggugaccggcgccg

SEQ ID NO: 2941140 - RNA, 15 nt, Mycobacterium avium subsp. paratuberculosis
cgggugaccggcgcg

SEQ ID NO: 2941141 - RNA, 16 nt, Mycobacterium avium subsp. paratuberculosis
cgggugaccggcgcgc

SEQ ID NO: 2941142 - RNA, 22 nt, Mycobacterium avium subsp. paratuberculosis
cgggugaccggcgcgcagcauc

SEQ ID NO: 2941143 - RNA, 15 nt, Mycobacterium avium subsp. paratuberculosis
cgggugaccggcggc

SEQ ID NO: 2941144 - RNA, 15 nt, Mycobacterium avium subsp. paratuberculosis
cgggugacgaucacc

SEQ ID NO: 2941145 - RNA, 18 nt, Mycobacterium avium subsp. paratuberculosis
cgggugacgaucaccgcu

SEQ ID NO: 2941146 - RNA, 19 nt, Mycobacterium avium subsp. paratuberculosis
cgggugacgccucaggcga

SEQ ID NO: 2941147 - RNA, 22 nt, Mycobacterium avium subsp. paratuberculosis
cgggugacgccucaggcgagca

SEQ ID NO: 2941148 - RNA, 24 nt, Mycobacterium avium subsp. paratuberculosis
cgggugacgccucaggcgagcacc

SEQ ID NO: 2941149 - RNA, 16 nt, Mycobacterium avium subsp. paratuberculosis
cgggugacgcugaccu

SEQ ID NO: 2941150 - RNA, 16 nt, Mycobacterium avium subsp. paratuberculosis
cgggugagacggccag

SEQ ID NO: 2941151 - RNA, 17 nt, Mycobacterium avium subsp. paratuberculosis
cgggugaggacgcccgg

SEQ ID NO: 2941152 - RNA, 20 nt, Mycobacterium avium subsp. paratuberculosis
cgggugaggacgcccggcga

SEQ ID NO: 2941153 - RNA, 13 nt, Mycobacterium avium subsp. paratuberculosis
cgggugaggccag

SEQ ID NO: 2941154 - RNA, 15 nt, Mycobacterium avium subsp. paratuberculosis
cgggugaggccaggc

SEQ ID NO: 2941155 - RNA, 15 nt, Mycobacterium avium subsp. paratuberculosis
cgggugaggggcgcg

SEQ ID NO: 2941156 - RNA, 16 nt, Mycobacterium avium subsp. paratuberculosis
cgggugaggggcgcgc

SEQ ID NO: 2941157 - RNA, 17 nt, Mycobacterium avium subsp. paratuberculosis
cgggugaggggcgcgcg

SEQ ID NO: 2941158 - RNA, 17 nt, Mycobacterium avium subsp. paratuberculosis
cgggugauaccggccca

SEQ ID NO: 2941159 - RNA, 19 nt, Mycobacterium avium subsp. paratuberculosis
cgggugauaccggcccagc

SEQ ID NO: 2941160 - RNA, 23 nt, Mycobacterium avium subsp. paratuberculosis
cgggugaucaacgcggacacggc

SEQ ID NO: 2941161 - RNA, 22 nt, Mycobacterium avium subsp. paratuberculosis
cgggugauccagcccugcucgg

SEQ ID NO: 2941162 - RNA, 11 nt, Mycobacterium avium subsp. paratuberculosis
cgggugaucuu

SEQ ID NO: 2941163 - RNA, 21 nt, Mycobacterium avium subsp. paratuberculosis
cgggugauggccgccgcaggc

SEQ ID NO: 2941164 - RNA, 18 nt, Mycobacterium avium subsp. paratuberculosis
cgggugauggucucccgg

SEQ ID NO: 2941165 - RNA, 21 nt, Mycobacterium avium subsp. paratuberculosis
cgggugauggucucccgggcg

SEQ ID NO: 2941166 - RNA, 22 nt, Mycobacterium avium subsp. paratuberculosis
cgggugauggucucccgggcgg

SEQ ID NO: 2941167 - RNA, 15 nt, Mycobacterium avium subsp. paratuberculosis
cgggugaugucgccg

SEQ ID NO: 2941168 - RNA, 17 nt, Mycobacterium avium subsp. paratuberculosis
cgggugaugucgccgac

SEQ ID NO: 2941169 - RNA, 13 nt, Mycobacterium avium subsp. paratuberculosis
cgggugcagccgg

SEQ ID NO: 2941170 - RNA, 16 nt, Mycobacterium avium subsp. paratuberculosis
cgggugcaggcccagc

SEQ ID NO: 2941171 - RNA, 18 nt, Mycobacterium avium subsp. paratuberculosis
cgggugcccgcguacagc

SEQ ID NO: 2941172 - RNA, 12 nt, Mycobacterium avium subsp. paratuberculosis
cgggugcccggc

SEQ ID NO: 2941173 - RNA, 15 nt, Mycobacterium avium subsp. paratuberculosis
cgggugcccggcugg

SEQ ID NO: 2941174 - RNA, 22 nt, Mycobacterium avium subsp. paratuberculosis
cgggugcccggcugggcgcgca

SEQ ID NO: 2941175 - RNA, 23 nt, Mycobacterium avium subsp. paratuberculosis
cgggugccuucuuggcggcgguc

SEQ ID NO: 2941176 - RNA, 20 nt, Mycobacterium avium subsp. paratuberculosis
cgggugcgaacagccacggu

SEQ ID NO: 2941177 - RNA, 13 nt, Mycobacterium avium subsp. paratuberculosis
cgggugcgacggc

SEQ ID NO: 2941178 - RNA, 18 nt, Mycobacterium avium subsp. paratuberculosis
cgggugcgcgucgcggug

SEQ ID NO: 2941179 - RNA, 19 nt, Mycobacterium avium subsp. paratuberculosis
cgggugcgcgucgcggugg

SEQ ID NO: 2941180 - RNA, 23 nt, Mycobacterium avium subsp. paratuberculosis
cgggugcgcgucgcgguggagca

SEQ ID NO: 2941181 - RNA, 17 nt, Mycobacterium avium subsp. paratuberculosis
cgggugcgcucaccgca

SEQ ID NO: 2941182 - RNA, 22 nt, Mycobacterium avium subsp. paratuberculosis
cgggugcgcucgacggccugca

SEQ ID NO: 2941183 - RNA, 20 nt, Mycobacterium avium subsp. paratuberculosis
cgggugcgcugcagcgagac

SEQ ID NO: 2941184 - RNA, 11 nt, Mycobacterium avium subsp. paratuberculosis
cgggugcggca

SEQ ID NO: 2941185 - RNA, 12 nt, Mycobacterium avium subsp. paratuberculosis
cgggugcggcac

SEQ ID NO: 2941186 - RNA, 13 nt, Mycobacterium avium subsp. paratuberculosis
cgggugcggccag

SEQ ID NO: 2941187 - RNA, 14 nt, Mycobacterium avium subsp. paratuberculosis
cgggugcggccagc

SEQ ID NO: 2941188 - RNA, 16 nt, Mycobacterium avium subsp. paratuberculosis
cgggugcggccagcgc

SEQ ID NO: 2941189 - RNA, 17 nt, Mycobacterium avium subsp. paratuberculosis
cgggugcggccagcgca

SEQ ID NO: 2941190 - RNA, 12 nt, Mycobacterium avium subsp. paratuberculosis
cgggugcggccc

SEQ ID NO: 2941191 - RNA, 14 nt, Mycobacterium avium subsp. paratuberculosis
cgggugcggccggu

SEQ ID NO: 2941192 - RNA, 16 nt, Mycobacterium avium subsp. paratuberculosis
cgggugcggcgcucgg

SEQ ID NO: 2941193 - RNA, 14 nt, Mycobacterium avium subsp. paratuberculosis
cgggugcggcggug

SEQ ID NO: 2941194 - RNA, 15 nt, Mycobacterium avium subsp. paratuberculosis
cgggugcggcggugu

SEQ ID NO: 2941195 - RNA, 17 nt, Mycobacterium avium subsp. paratuberculosis
cgggugcgggccagcag

SEQ ID NO: 2941196 - RNA, 18 nt, Mycobacterium avium subsp. paratuberculosis
cgggugcgggccagcagc

SEQ ID NO: 2941197 - RNA, 12 nt, Mycobacterium avium subsp. paratuberculosis
cgggugcgggcg

SEQ ID NO: 2941198 - RNA, 20 nt, Mycobacterium avium subsp. paratuberculosis
cgggugcgggcugacgucga

SEQ ID NO: 2941199 - RNA, 23 nt, Mycobacterium avium subsp. paratuberculosis
cgggugcgggcugacgucgaagg

SEQ ID NO: 2941200 - RNA, 16 nt, Mycobacterium avium subsp. paratuberculosis
cgggugcgggugcggc

SEQ ID NO: 2941201 - RNA, 18 nt, Mycobacterium avium subsp. paratuberculosis
cgggugcgggugcggccg

SEQ ID NO: 2941202 - RNA, 15 nt, Mycobacterium avium subsp. paratuberculosis
cgggugcucagccua

SEQ ID NO: 2941203 - RNA, 17 nt, Mycobacterium avium subsp. paratuberculosis
cgggugcucagguugcg

SEQ ID NO: 2941204 - RNA, 22 nt, Mycobacterium avium subsp. paratuberculosis
cgggugcucagguugcgcagca

SEQ ID NO: 2941205 - RNA, 23 nt, Mycobacterium avium subsp. paratuberculosis
cgggugcucagguugcgcagcag

SEQ ID NO: 2941206 - RNA, 22 nt, Mycobacterium avium subsp. paratuberculosis
cgggugcugaacgccugccggc

SEQ ID NO: 2941207 - RNA, 22 nt, Mycobacterium avium subsp. paratuberculosis
cggguucgccggugaccgcgcc

SEQ ID NO: 2941208 - RNA, 15 nt, Mycobacterium avium subsp. paratuberculosis
cggguucggucucgg

SEQ ID NO: 2941209 - RNA, 17 nt, Mycobacterium avium subsp. paratuberculosis
cggguucggucucggcg

SEQ ID NO: 2941210 - RNA, 22 nt, Mycobacterium avium subsp. paratuberculosis
cggguucuggccguggucggcg

SEQ ID NO: 2941211 - RNA, 15 nt, Mycobacterium avium subsp. paratuberculosis
cggguugagcagguc

SEQ ID NO: 2941212 - RNA, 22 nt, Mycobacterium avium subsp. paratuberculosis
cggguugagcaggucagccagg

SEQ ID NO: 2941213 - RNA, 21 nt, Mycobacterium avium subsp. paratuberculosis
cggguugcaggccacgcccac

SEQ ID NO: 2941214 - RNA, 15 nt, Mycobacterium avium subsp. paratuberculosis
cggguugccggcggc

SEQ ID NO: 2941215 - RNA, 14 nt, Mycobacterium avium subsp. paratuberculosis
cggguugccgucga

SEQ ID NO: 2941216 - RNA, 18 nt, Mycobacterium avium subsp. paratuberculosis
cggguugccgucgacgaa

SEQ ID NO: 2941217 - RNA, 23 nt, Mycobacterium avium subsp. paratuberculosis
cggguugcgaaagcccaggcccg

SEQ ID NO: 2941218 - RNA, 12 nt, Mycobacterium avium subsp. paratuberculosis
cggguugcgcgg

SEQ ID NO: 2941219 - RNA, 20 nt, Mycobacterium avium subsp. paratuberculosis
cggguugcggaucggugcag

SEQ ID NO: 2941220 - RNA, 22 nt, Mycobacterium avium subsp. paratuberculosis
cggguugcggaucggugcaggc

SEQ ID NO: 2941221 - RNA, 14 nt, Mycobacterium avium subsp. paratuberculosis
cggguugcgggcca

SEQ ID NO: 2941222 - RNA, 15 nt, Mycobacterium avium subsp. paratuberculosis
cggguugcgggccag

SEQ ID NO: 2941223 - RNA, 17 nt, Mycobacterium avium subsp. paratuberculosis
cggguugcgggccaggc

SEQ ID NO: 2941224 - RNA, 14 nt, Mycobacterium avium subsp. paratuberculosis
cggguugcggucca

SEQ ID NO: 2941225 - RNA, 19 nt, Mycobacterium avium subsp. paratuberculosis
cggguugcgguccccggag

SEQ ID NO: 2941226 - RNA, 20 nt, Mycobacterium avium subsp. paratuberculosis
cggguugcgguccccggaga

SEQ ID NO: 2941227 - RNA, 20 nt, Mycobacterium avium subsp. paratuberculosis
cggguugcgugcagccgcaa

SEQ ID NO: 2941228 - RNA, 16 nt, Mycobacterium avium subsp. paratuberculosis
cggguugcugagccgc

SEQ ID NO: 2941229 - RNA, 17 nt, Mycobacterium avium subsp. paratuberculosis
cggguugcugagccgcc

SEQ ID NO: 2941230 - RNA, 18 nt, Mycobacterium avium subsp. paratuberculosis
cggguugcugagccgccg

SEQ ID NO: 2941231 - RNA, 19 nt, Mycobacterium avium subsp. paratuberculosis
cggguugcugagccgccga

SEQ ID NO: 2941232 - RNA, 20 nt, Mycobacterium avium subsp. paratuberculosis
cggguugcugagccgccgag

SEQ ID NO: 2941233 - RNA, 21 nt, Mycobacterium avium subsp. paratuberculosis
cggguugcugagccgccgagc

SEQ ID NO: 2941234 - RNA, 23 nt, Mycobacterium avium subsp. paratuberculosis
cggguugcugagccgccgagccg

SEQ ID NO: 2941235 - RNA, 13 nt, Mycobacterium avium subsp. paratuberculosis
cggguuggccagg

SEQ ID NO: 2941236 - RNA, 14 nt, Mycobacterium avium subsp. paratuberculosis
cggguuggccaggg

SEQ ID NO: 2941237 - RNA, 14 nt, Mycobacterium avium subsp. paratuberculosis
cggguuggcgcgca

SEQ ID NO: 2941238 - RNA, 16 nt, Mycobacterium avium subsp. paratuberculosis
cggguuggcgcgcacc

SEQ ID NO: 2941239 - RNA, 17 nt, Mycobacterium avium subsp. paratuberculosis
cggguugggcgccagca

SEQ ID NO: 2941240 - RNA, 20 nt, Mycobacterium avium subsp. paratuberculosis
cggguugggcgccagcagca

SEQ ID NO: 2941241 - RNA, 22 nt, Mycobacterium avium subsp. paratuberculosis
cggguugggcgccagcagcacc

SEQ ID NO: 2941242 - RNA, 14 nt, Mycobacterium avium subsp. paratuberculosis
cggguugggcggcg

SEQ ID NO: 2941243 - RNA, 18 nt, Mycobacterium avium subsp. paratuberculosis
cggguugggcggcggcca

SEQ ID NO: 2941244 - RNA, 20 nt, Mycobacterium avium subsp. paratuberculosis
cggguugggcggcggccacc

SEQ ID NO: 2941245 - RNA, 15 nt, Mycobacterium avium subsp. paratuberculosis
cggguuggggccgcg

SEQ ID NO: 2941246 - RNA, 16 nt, Mycobacterium avium subsp. paratuberculosis
cggguuggggccgcgg

SEQ ID NO: 2941247 - RNA, 15 nt, Mycobacterium avium subsp. paratuberculosis
cggguuggucggcgc

SEQ ID NO: 2941248 - RNA, 14 nt, Mycobacterium avium subsp. paratuberculosis
cggguuggugucga

SEQ ID NO: 2941249 - RNA, 20 nt, Mycobacterium avium subsp. paratuberculosis
cggguuguagcaggcggugg

SEQ ID NO: 2941250 - RNA, 19 nt, Mycobacterium avium subsp. paratuberculosis
cggguugucgacguggugc

SEQ ID NO: 2941251 - RNA, 20 nt, Mycobacterium avium subsp. paratuberculosis
cggguugucgucgucggcga

SEQ ID NO: 2941252 - RNA, 19 nt, Mycobacterium avium subsp. paratuberculosis
cggguuguucuccagcggc

SEQ ID NO: 2941253 - RNA, 21 nt, Mycobacterium avium subsp. paratuberculosis
cggguuguucuccagcggccg

SEQ ID NO: 2941254 - RNA, 14 nt, Mycobacterium avium subsp. paratuberculosis
cggguuucgaagac

SEQ ID NO: 2941255 - RNA, 16 nt, Mycobacterium avium subsp. paratuberculosis
cggguuucgaagacgc

SEQ ID NO: 2941256 - RNA, 21 nt, Mycobacterium avium subsp. paratuberculosis
cggguuucgaagacgccccag

SEQ ID NO: 2941257 - RNA, 12 nt, Mycobacterium avium subsp. paratuberculosis
cggguuucgcgg

SEQ ID NO: 2941258 - RNA, 15 nt, Mycobacterium avium subsp. paratuberculosis
cggguuucggcccgg

SEQ ID NO: 2941259 - RNA, 16 nt, Mycobacterium avium subsp. paratuberculosis
cggguuucggcccggc

SEQ ID NO: 2941260 - RNA, 21 nt, Mycobacterium avium subsp. paratuberculosis
cggguuucgucucuuccucgg

SEQ ID NO: 2941261 - RNA, 15 nt, Mycobacterium avium subsp. paratuberculosis
cggguuugaggccca

SEQ ID NO: 2941262 - RNA, 18 nt, Mycobacterium avium subsp. paratuberculosis
cggguuugccgacggugu

SEQ ID NO: 2941263 - RNA, 19 nt, Mycobacterium avium subsp. paratuberculosis
cggguuuggccgcgggcgg

SEQ ID NO: 2941264 - RNA, 14 nt, Mycobacterium avium subsp. paratuberculosis
cggguuuguccggc

SEQ ID NO: 2941265 - RNA, 17 nt, Mycobacterium avium subsp. paratuberculosis
cggguuuguccggccag

SEQ ID NO: 2941266 - RNA, 19 nt, Mycobacterium avium subsp. paratuberculosis
cggguuuguccggccaggu

SEQ ID NO: 2941267 - RNA, 15 nt, Mycobacterium avium subsp. paratuberculosis
cggguuuucgggccg

SEQ ID NO: 2941268 - RNA, 16 nt, Mycobacterium avium subsp. paratuberculosis
cggguuuucgggccgg

SEQ ID NO: 2941269 - RNA, 19 nt, Mycobacterium avium subsp. paratuberculosis
cggguuuucgggccgguca

SEQ ID NO: 2941270 - RNA, 17 nt, Mycobacterium avium subsp. paratuberculosis
cgguaaaacuggccagc

SEQ ID NO: 2941271 - RNA, 18 nt, Mycobacterium avium subsp. paratuberculosis
cgguaaaacuggccagca

SEQ ID NO: 2941272 - RNA, 19 nt, Mycobacterium avium subsp. paratuberculosis
cgguaaagucuucggcgau

SEQ ID NO: 2941273 - RNA, 19 nt, Mycobacterium avium subsp. paratuberculosis
cgguaaauugaacgccgcc

SEQ ID NO: 2941274 - RNA, 20 nt, Mycobacterium avium subsp. paratuberculosis
cgguaaauugaacgccgcca

SEQ ID NO: 2941275 - RNA, 22 nt, Mycobacterium avium subsp. paratuberculosis
cgguaaauugaacgccgccaac

SEQ ID NO: 2941276 - RNA, 13 nt, Mycobacterium avium subsp. paratuberculosis
cgguaacagagcg

SEQ ID NO: 2941277 - RNA, 13 nt, Mycobacterium avium subsp. paratuberculosis
cgguaaccacccg

SEQ ID NO: 2941278 - RNA, 18 nt, Mycobacterium avium subsp. paratuberculosis
cgguaacugcguguggcg

SEQ ID NO: 2941279 - RNA, 14 nt, Mycobacterium avium subsp. paratuberculosis
cgguaaggcaggca

SEQ ID NO: 2941280 - RNA, 16 nt, Mycobacterium avium subsp. paratuberculosis
cgguaaucggcggugg

SEQ ID NO: 2941281 - RNA, 17 nt, Mycobacterium avium subsp. paratuberculosis
cgguaaugggcgaucga

SEQ ID NO: 2941282 - RNA, 16 nt, Mycobacterium avium subsp. paratuberculosis
cgguacacguggccga

SEQ ID NO: 2941283 - RNA, 22 nt, Mycobacterium avium subsp. paratuberculosis
cgguacagcgacuccagcgcga

SEQ ID NO: 2941284 - RNA, 12 nt, Mycobacterium avium subsp. paratuberculosis
cgguacagcgcc

SEQ ID NO: 2941285 - RNA, 14 nt, Mycobacterium avium subsp. paratuberculosis
cgguacaggcccca

SEQ ID NO: 2941286 - RNA, 15 nt, Mycobacterium avium subsp. paratuberculosis
cgguacaucccgccg

SEQ ID NO: 2941287 - RNA, 15 nt, Mycobacterium avium subsp. paratuberculosis
cgguacaucgacgcg

SEQ ID NO: 2941288 - RNA, 18 nt, Mycobacterium avium subsp. paratuberculosis
cgguacaucgacgcgacc

SEQ ID NO: 2941289 - RNA, 16 nt, Mycobacterium avium subsp. paratuberculosis
cgguaccacgccgucg

SEQ ID NO: 2941290 - RNA, 19 nt, Mycobacterium avium subsp. paratuberculosis
cgguaccacgccgucgacg

SEQ ID NO: 2941291 - RNA, 21 nt, Mycobacterium avium subsp. paratuberculosis
cgguaccagggcagcgccucg

SEQ ID NO: 2941292 - RNA, 21 nt, Mycobacterium avium subsp. paratuberculosis
cggucaccgagcggccgucca

SEQ ID NO: 2941293 - RNA, 14 nt, Mycobacterium avium subsp. paratuberculosis
cggucaccggcagg

SEQ ID NO: 2941294 - RNA, 12 nt, Mycobacterium avium subsp. paratuberculosis
cggucaccgguc

SEQ ID NO: 2941295 - RNA, 16 nt, Mycobacterium avium subsp. paratuberculosis
cggucaccggucgcgu

SEQ ID NO: 2941296 - RNA, 17 nt, Mycobacterium avium subsp. paratuberculosis
cggucaccggucgcguu

SEQ ID NO: 2941297 - RNA, 22 nt, Mycobacterium avium subsp. paratuberculosis
cggucaccggucggugcccagc

SEQ ID NO: 2941298 - RNA, 20 nt, Mycobacterium avium subsp. paratuberculosis
cggucaccggugucacgcug

SEQ ID NO: 2941299 - RNA, 23 nt, Mycobacterium avium subsp. paratuberculosis
cggucaccggugucacgcuggcg

SEQ ID NO: 2941300 - RNA, 15 nt, Mycobacterium avium subsp. paratuberculosis
cggucaccucgucga

SEQ ID NO: 2941301 - RNA, 18 nt, Mycobacterium avium subsp. paratuberculosis
cggucaccucgucgaucc

SEQ ID NO: 2941302 - RNA, 16 nt, Mycobacterium avium subsp. paratuberculosis
cggucaccuugaccau

SEQ ID NO: 2941303 - RNA, 19 nt, Mycobacterium avium subsp. paratuberculosis
cggucaccuugaccaugag

SEQ ID NO: 2941304 - RNA, 20 nt, Mycobacterium avium subsp. paratuberculosis
cggucacgcugaucgaccgg

SEQ ID NO: 2941305 - RNA, 15 nt, Mycobacterium avium subsp. paratuberculosis
cggucacgcuggcgu

SEQ ID NO: 2941306 - RNA, 14 nt, Mycobacterium avium subsp. paratuberculosis
cggucacggccgcc

SEQ ID NO: 2941307 - RNA, 15 nt, Mycobacterium avium subsp. paratuberculosis
cggucacggccgcca

SEQ ID NO: 2941308 - RNA, 18 nt, Mycobacterium avium subsp. paratuberculosis
cggucacggcgucggcgu

SEQ ID NO: 2941309 - RNA, 15 nt, Mycobacterium avium subsp. paratuberculosis
cggucacggucuggc

SEQ ID NO: 2941310 - RNA, 23 nt, Mycobacterium avium subsp. paratuberculosis
cggucacggucuggcuggugacc

SEQ ID NO: 2941311 - RNA, 17 nt, Mycobacterium avium subsp. paratuberculosis
cggucacguagcucagc

SEQ ID NO: 2941312 - RNA, 14 nt, Mycobacterium avium subsp. paratuberculosis
cggucagacgaugg

SEQ ID NO: 2941313 - RNA, 22 nt, Mycobacterium avium subsp. paratuberculosis
cggucagacgaugggccgcccg

SEQ ID NO: 2941314 - RNA, 12 nt, Mycobacterium avium subsp. paratuberculosis
cggucagcaccg

SEQ ID NO: 2941315 - RNA, 14 nt, Mycobacterium avium subsp. paratuberculosis
cggucagcacgcug

SEQ ID NO: 2941316 - RNA, 16 nt, Mycobacterium avium subsp. paratuberculosis
cggucagcaggcgccg

SEQ ID NO: 2941317 - RNA, 20 nt, Mycobacterium avium subsp. paratuberculosis
cggucagcaggcgccgcagc

SEQ ID NO: 2941318 - RNA, 16 nt, Mycobacterium avium subsp. paratuberculosis
cggucagcaucgggua

SEQ ID NO: 2941319 - RNA, 20 nt, Mycobacterium avium subsp. paratuberculosis
cggucagcauggcgaugacg

SEQ ID NO: 2941320 - RNA, 21 nt, Mycobacterium avium subsp. paratuberculosis
cggucagcauggcgaugacgu

SEQ ID NO: 2941321 - RNA, 20 nt, Mycobacterium avium subsp. paratuberculosis
cggucagcccccaccgcgcc

SEQ ID NO: 2941322 - RNA, 14 nt, Mycobacterium avium subsp. paratuberculosis
cggucagcccgccc

SEQ ID NO: 2941323 - RNA, 22 nt, Mycobacterium avium subsp. paratuberculosis
cggucagcccgcccuuggccgc

SEQ ID NO: 2941324 - RNA, 15 nt, Mycobacterium avium subsp. paratuberculosis
cggucagccgcggcu

SEQ ID NO: 2941325 - RNA, 21 nt, Mycobacterium avium subsp. paratuberculosis
cggucagccgggcggccucgu

SEQ ID NO: 2941326 - RNA, 22 nt, Mycobacterium avium subsp. paratuberculosis
cggucagcgagcgguuggcgac

SEQ ID NO: 2941327 - RNA, 13 nt, Mycobacterium avium subsp. paratuberculosis
cggucagcgcauc

SEQ ID NO: 2941328 - RNA, 13 nt, Mycobacterium avium subsp. paratuberculosis
cggucagcgccag

SEQ ID NO: 2941329 - RNA, 17 nt, Mycobacterium avium subsp. paratuberculosis
cggucagcgccagcaug

SEQ ID NO: 2941330 - RNA, 19 nt, Mycobacterium avium subsp. paratuberculosis
cggucagcgccagcaugcc

SEQ ID NO: 2941331 - RNA, 20 nt, Mycobacterium avium subsp. paratuberculosis
cggucagcgcgacaucgccg

SEQ ID NO: 2941332 - RNA, 13 nt, Mycobacterium avium subsp. paratuberculosis
cggucagcgcgcc

SEQ ID NO: 2941333 - RNA, 16 nt, Mycobacterium avium subsp. paratuberculosis
cggucagcgcgccguc

SEQ ID NO: 2941334 - RNA, 18 nt, Mycobacterium avium subsp. paratuberculosis
cggucagcgcguccaggu

SEQ ID NO: 2941335 - RNA, 15 nt, Mycobacterium avium subsp. paratuberculosis
cggucagcgcgucgg

SEQ ID NO: 2941336 - RNA, 19 nt, Mycobacterium avium subsp. paratuberculosis
cggucagcgcuacugccgc

SEQ ID NO: 2941337 - RNA, 18 nt, Mycobacterium avium subsp. paratuberculosis
cggucagcggcaacacgc

SEQ ID NO: 2941338 - RNA, 14 nt, Mycobacterium avium subsp. paratuberculosis
cggucagcggccag

SEQ ID NO: 2941339 - RNA, 23 nt, Mycobacterium avium subsp. paratuberculosis
cggucagcggcgucaggauggug

SEQ ID NO: 2941340 - RNA, 15 nt, Mycobacterium avium subsp. paratuberculosis
cggucagcggcgugc

SEQ ID NO: 2941341 - RNA, 19 nt, Mycobacterium avium subsp. paratuberculosis
cggucagcguccaguccgg

SEQ ID NO: 2941342 - RNA, 13 nt, Mycobacterium avium subsp. paratuberculosis
cggucagcgucgc

SEQ ID NO: 2941343 - RNA, 15 nt, Mycobacterium avium subsp. paratuberculosis
cggucagcgucgccg

SEQ ID NO: 2941344 - RNA, 16 nt, Mycobacterium avium subsp. paratuberculosis
cggucagcgucgccgc

SEQ ID NO: 2941345 - RNA, 16 nt, Mycobacterium avium subsp. paratuberculosis
cggucagcgucuggcg

SEQ ID NO: 2941346 - RNA, 18 nt, Mycobacterium avium subsp. paratuberculosis
cggucagcgucuggcggg

SEQ ID NO: 2941347 - RNA, 12 nt, Mycobacterium avium subsp. paratuberculosis
cggucagcgugg

SEQ ID NO: 2941348 - RNA, 14 nt, Mycobacterium avium subsp. paratuberculosis
cggucagcguggcg

SEQ ID NO: 2941349 - RNA, 18 nt, Mycobacterium avium subsp. paratuberculosis
cggucagcguggcgucgg

SEQ ID NO: 2941350 - RNA, 20 nt, Mycobacterium avium subsp. paratuberculosis
cggucagcguggcgucggcg

SEQ ID NO: 2941351 - RNA, 22 nt, Mycobacterium avium subsp. paratuberculosis
cggucagcucaggaacggccgg

SEQ ID NO: 2941352 - RNA, 12 nt, Mycobacterium avium subsp. paratuberculosis
cggucagcucga

SEQ ID NO: 2941353 - RNA, 17 nt, Mycobacterium avium subsp. paratuberculosis
cggucagcucgaaggug

SEQ ID NO: 2941354 - RNA, 22 nt, Mycobacterium avium subsp. paratuberculosis
cggucagcucgaaggugaccau

SEQ ID NO: 2941355 - RNA, 18 nt, Mycobacterium avium subsp. paratuberculosis
cggucagcucgaucgccg

SEQ ID NO: 2941356 - RNA, 19 nt, Mycobacterium avium subsp. paratuberculosis
cggucagcucgaucgccgc

SEQ ID NO: 2941357 - RNA, 23 nt, Mycobacterium avium subsp. paratuberculosis
cggucagcucgaucgccgcgccc

SEQ ID NO: 2941358 - RNA, 15 nt, Mycobacterium avium subsp. paratuberculosis
cggucagcucgccgu

SEQ ID NO: 2941359 - RNA, 18 nt, Mycobacterium avium subsp. paratuberculosis
cggucagcucgccguccg

SEQ ID NO: 2941360 - RNA, 15 nt, Mycobacterium avium subsp. paratuberculosis
cggucagcucgcgcc

SEQ ID NO: 2941361 - RNA, 16 nt, Mycobacterium avium subsp. paratuberculosis
cggucagcucgcgccc

SEQ ID NO: 2941362 - RNA, 17 nt, Mycobacterium avium subsp. paratuberculosis
cggucagcucgcgcccg

SEQ ID NO: 2941363 - RNA, 18 nt, Mycobacterium avium subsp. paratuberculosis
cggucagcucgcgcccgg

SEQ ID NO: 2941364 - RNA, 19 nt, Mycobacterium avium subsp. paratuberculosis
cggucagcucgcgcccggc

SEQ ID NO: 2941365 - RNA, 21 nt, Mycobacterium avium subsp. paratuberculosis
cggucagcucgcgcccggcca

SEQ ID NO: 2941366 - RNA, 23 nt, Mycobacterium avium subsp. paratuberculosis
cggucagcucgcgcccggccagg

SEQ ID NO: 2941367 - RNA, 18 nt, Mycobacterium avium subsp. paratuberculosis
cggucagcugguagaugg

SEQ ID NO: 2941368 - RNA, 14 nt, Mycobacterium avium subsp. paratuberculosis
cggucagcuggugc

SEQ ID NO: 2941369 - RNA, 17 nt, Mycobacterium avium subsp. paratuberculosis
cggucagcuggugcaga

SEQ ID NO: 2941370 - RNA, 21 nt, Mycobacterium avium subsp. paratuberculosis
cggucaggaacccggcccgga

SEQ ID NO: 2941371 - RNA, 13 nt, Mycobacterium avium subsp. paratuberculosis
cggucaggaacgc

SEQ ID NO: 2941372 - RNA, 23 nt, Mycobacterium avium subsp. paratuberculosis
cggucaggaucgacuccgggugg

SEQ ID NO: 2941373 - RNA, 22 nt, Mycobacterium avium subsp. paratuberculosis
cggucaggcacucgaucagcac

SEQ ID NO: 2941374 - RNA, 23 nt, Mycobacterium avium subsp. paratuberculosis
cggucaggcauuccaccgcgcgg

SEQ ID NO: 2941375 - RNA, 20 nt, Mycobacterium avium subsp. paratuberculosis
cggucaggcccaggucguga

SEQ ID NO: 2941376 - RNA, 18 nt, Mycobacterium avium subsp. paratuberculosis
cggucccguccaucgccg

SEQ ID NO: 2941377 - RNA, 16 nt, Mycobacterium avium subsp. paratuberculosis
cggucccgugcgccgc

SEQ ID NO: 2941378 - RNA, 19 nt, Mycobacterium avium subsp. paratuberculosis
cggucccgugcgccgccca

SEQ ID NO: 2941379 - RNA, 15 nt, Mycobacterium avium subsp. paratuberculosis
cggucccguugaucu

SEQ ID NO: 2941380 - RNA, 13 nt, Mycobacterium avium subsp. paratuberculosis
cgguccgacaccg

SEQ ID NO: 2941381 - RNA, 13 nt, Mycobacterium avium subsp. paratuberculosis
cgguccgaccagc

SEQ ID NO: 2941382 - RNA, 17 nt, Mycobacterium avium subsp. paratuberculosis
cgguccgaccagcggcc

SEQ ID NO: 2941383 - RNA, 19 nt, Mycobacterium avium subsp. paratuberculosis
cgguccgaccgccaccacc

SEQ ID NO: 2941384 - RNA, 22 nt, Mycobacterium avium subsp. paratuberculosis
cgguccgaccgccaccacccgg

SEQ ID NO: 2941385 - RNA, 14 nt, Mycobacterium avium subsp. paratuberculosis
cgguccgacggcug

SEQ ID NO: 2941386 - RNA, 15 nt, Mycobacterium avium subsp. paratuberculosis
cgguccgaucguccg

SEQ ID NO: 2941387 - RNA, 17 nt, Mycobacterium avium subsp. paratuberculosis
cgguccgaucguccggc

SEQ ID NO: 2941388 - RNA, 20 nt, Mycobacterium avium subsp. paratuberculosis
cgguccgaucguccggcgcc

SEQ ID NO: 2941389 - RNA, 21 nt, Mycobacterium avium subsp. paratuberculosis
cgguccgaucguccggcgcca

SEQ ID NO: 2941390 - RNA, 14 nt, Mycobacterium avium subsp. paratuberculosis
cgguccgcccagac

SEQ ID NO: 2941391 - RNA, 20 nt, Mycobacterium avium subsp. paratuberculosis
cgguccgcccagacgcgggc

SEQ ID NO: 2941392 - RNA, 12 nt, Mycobacterium avium subsp. paratuberculosis
cgguccgcccgg

SEQ ID NO: 2941393 - RNA, 19 nt, Mycobacterium avium subsp. paratuberculosis
cgguccgcccggaccaggg

SEQ ID NO: 2941394 - RNA, 14 nt, Mycobacterium avium subsp. paratuberculosis
cgguccgccgcagc

SEQ ID NO: 2941395 - RNA, 20 nt, Mycobacterium avium subsp. paratuberculosis
cgguccgccgcagcggcgcc

SEQ ID NO: 2941396 - RNA, 23 nt, Mycobacterium avium subsp. paratuberculosis
cgguccgccgcagcggcgccgca

SEQ ID NO: 2941397 - RNA, 14 nt, Mycobacterium avium subsp. paratuberculosis
cgguccgccgccgg

SEQ ID NO: 2941398 - RNA, 15 nt, Mycobacterium avium subsp. paratuberculosis
cgguccgccgccggc

SEQ ID NO: 2941399 - RNA, 17 nt, Mycobacterium avium subsp. paratuberculosis
cgguccgccgccggcgg

SEQ ID NO: 2941400 - RNA, 18 nt, Mycobacterium avium subsp. paratuberculosis
cgguccgccgccggcgga

SEQ ID NO: 2941401 - RNA, 14 nt, Mycobacterium avium subsp. paratuberculosis
cgguccgccgucgg

SEQ ID NO: 2941402 - RNA, 20 nt, Mycobacterium avium subsp. paratuberculosis
cgguccgccgucggggugcg

SEQ ID NO: 2941403 - RNA, 17 nt, Mycobacterium avium subsp. paratuberculosis
cgguccgcucaucgucg

SEQ ID NO: 2941404 - RNA, 23 nt, Mycobacterium avium subsp. paratuberculosis
cgguccgcucaucgucguuggcg

SEQ ID NO: 2941405 - RNA, 15 nt, Mycobacterium avium subsp. paratuberculosis
cgguccgcuccacca

SEQ ID NO: 2941406 - RNA, 18 nt, Mycobacterium avium subsp. paratuberculosis
cgguccgcuccaccagcg

SEQ ID NO: 2941407 - RNA, 21 nt, Mycobacterium avium subsp. paratuberculosis
cgguccgcuccaccagcgcgg

SEQ ID NO: 2941408 - RNA, 22 nt, Mycobacterium avium subsp. paratuberculosis
cgguccgcuccaccagcgcggu

SEQ ID NO: 2941409 - RNA, 18 nt, Mycobacterium avium subsp. paratuberculosis
cgguccgcugugcggccc

SEQ ID NO: 2941410 - RNA, 18 nt, Mycobacterium avium subsp. paratuberculosis
cgguccggcccuggucgg

SEQ ID NO: 2941411 - RNA, 13 nt, Mycobacterium avium subsp. paratuberculosis
cgguccggcggca

SEQ ID NO: 2941412 - RNA, 15 nt, Mycobacterium avium subsp. paratuberculosis
cgguccggcggcacc

SEQ ID NO: 2941413 - RNA, 16 nt, Mycobacterium avium subsp. paratuberculosis
cgguccggcggcacca

SEQ ID NO: 2941414 - RNA, 19 nt, Mycobacterium avium subsp. paratuberculosis
cgguccggcggcaccaccc

SEQ ID NO: 2941415 - RNA, 20 nt, Mycobacterium avium subsp. paratuberculosis
cgguccggcugaacgccagc

SEQ ID NO: 2941416 - RNA, 23 nt, Mycobacterium avium subsp. paratuberculosis
cgguccggcugaacgccagcagc

SEQ ID NO: 2941417 - RNA, 16 nt, Mycobacterium avium subsp. paratuberculosis
cgguccggcuggucgg

SEQ ID NO: 2941418 - RNA, 20 nt, Mycobacterium avium subsp. paratuberculosis
cgguccggucacgcccgggg

SEQ ID NO: 2941419 - RNA, 14 nt, Mycobacterium avium subsp. paratuberculosis
cgguccgugcacgg

SEQ ID NO: 2941420 - RNA, 17 nt, Mycobacterium avium subsp. paratuberculosis
cgguccgugcacggcca

SEQ ID NO: 2941421 - RNA, 18 nt, Mycobacterium avium subsp. paratuberculosis
cgguccgugcacggccaa

SEQ ID NO: 2941422 - RNA, 19 nt, Mycobacterium avium subsp. paratuberculosis
cgguccgugccacggccgc

SEQ ID NO: 2941423 - RNA, 14 nt, Mycobacterium avium subsp. paratuberculosis
cgguccuccccgcu

SEQ ID NO: 2941424 - RNA, 18 nt, Mycobacterium avium subsp. paratuberculosis
cgguccuccccgcuggcg

SEQ ID NO: 2941425 - RNA, 21 nt, Mycobacterium avium subsp. paratuberculosis
cgguccuccccgcuggcgccg

SEQ ID NO: 2941426 - RNA, 22 nt, Mycobacterium avium subsp. paratuberculosis
cgguccuccccgcuggcgccgg

SEQ ID NO: 2941427 - RNA, 14 nt, Mycobacterium avium subsp. paratuberculosis
cgguccucucgaag

SEQ ID NO: 2941428 - RNA, 21 nt, Mycobacterium avium subsp. paratuberculosis
cgguccugggccuccggcggc

SEQ ID NO: 2941429 - RNA, 15 nt, Mycobacterium avium subsp. paratuberculosis
cgguccuucucgcac

SEQ ID NO: 2941430 - RNA, 22 nt, Mycobacterium avium subsp. paratuberculosis
cgguccuucucgcacagcacca

SEQ ID NO: 2941431 - RNA, 22 nt, Mycobacterium avium subsp. paratuberculosis
cgguccuugagguagucgcgca

SEQ ID NO: 2941432 - RNA, 23 nt, Mycobacterium avium subsp. paratuberculosis
cgguccuugagguagucgcgcag

SEQ ID NO: 2941433 - RNA, 14 nt, Mycobacterium avium subsp. paratuberculosis
cgguccuuggccug

SEQ ID NO: 2941434 - RNA, 17 nt, Mycobacterium avium subsp. paratuberculosis
cgguccuuggccugcuu

SEQ ID NO: 2941435 - RNA, 19 nt, Mycobacterium avium subsp. paratuberculosis
cggucgaacaacgcgguga

SEQ ID NO: 2941436 - RNA, 23 nt, Mycobacterium avium subsp. paratuberculosis
cggucgaacaacgcggugaccgc

SEQ ID NO: 2941437 - RNA, 19 nt, Mycobacterium avium subsp. paratuberculosis
cggucgaacgccagcgccg

SEQ ID NO: 2941438 - RNA, 12 nt, Mycobacterium avium subsp. paratuberculosis
cggucgaacgcg

SEQ ID NO: 2941439 - RNA, 15 nt, Mycobacterium avium subsp. paratuberculosis
cggucgaacgcggcg

SEQ ID NO: 2941440 - RNA, 18 nt, Mycobacterium avium subsp. paratuberculosis
cggucgaacgcggcgccg

SEQ ID NO: 2941441 - RNA, 19 nt, Mycobacterium avium subsp. paratuberculosis
cggucgaacgcggcgccga

SEQ ID NO: 2941442 - RNA, 20 nt, Mycobacterium avium subsp. paratuberculosis
cggucgaacgcggcgccgac

SEQ ID NO: 2941443 - RNA, 18 nt, Mycobacterium avium subsp. paratuberculosis
cggucgaaggaggccagc

SEQ ID NO: 2941444 - RNA, 17 nt, Mycobacterium avium subsp. paratuberculosis
cggucgacacgaucggc

SEQ ID NO: 2941445 - RNA, 21 nt, Mycobacterium avium subsp. paratuberculosis
cggucgacacgaucggcauga

SEQ ID NO: 2941446 - RNA, 17 nt, Mycobacterium avium subsp. paratuberculosis
cggucgaccagcuccug

SEQ ID NO: 2941447 - RNA, 19 nt, Mycobacterium avium subsp. paratuberculosis
cggucgaccagcuccugga

SEQ ID NO: 2941448 - RNA, 13 nt, Mycobacterium avium subsp. paratuberculosis
cggucgaccucga

SEQ ID NO: 2941449 - RNA, 16 nt, Mycobacterium avium subsp. paratuberculosis
cggucgaccucgagcg

SEQ ID NO: 2941450 - RNA, 23 nt, Mycobacterium avium subsp. paratuberculosis
cggucgaccucgagcgucacgcu

SEQ ID NO: 2941451 - RNA, 13 nt, Mycobacterium avium subsp. paratuberculosis
cggucgacgaaga

SEQ ID NO: 2941452 - RNA, 14 nt, Mycobacterium avium subsp. paratuberculosis
cggucgacgacgaa

SEQ ID NO: 2941453 - RNA, 15 nt, Mycobacterium avium subsp. paratuberculosis
cggucgacgacgaac

SEQ ID NO: 2941454 - RNA, 22 nt, Mycobacterium avium subsp. paratuberculosis
cggucgacgauggcccgggcca

SEQ ID NO: 2941455 - RNA, 13 nt, Mycobacterium avium subsp. paratuberculosis
cggucgacgcggg

SEQ ID NO: 2941456 - RNA, 14 nt, Mycobacterium avium subsp. paratuberculosis
cggucgacgcgggg

SEQ ID NO: 2941457 - RNA, 17 nt, Mycobacterium avium subsp. paratuberculosis
cggucgacgcggggcgg

SEQ ID NO: 2941458 - RNA, 21 nt, Mycobacterium avium subsp. paratuberculosis
cggucgacgcggggcggcggc

SEQ ID NO: 2941459 - RNA, 16 nt, Mycobacterium avium subsp. paratuberculosis
cggucgacuugggcgg

SEQ ID NO: 2941460 - RNA, 23 nt, Mycobacterium avium subsp. paratuberculosis
cggucgcggugucggcgucgauc

SEQ ID NO: 2941461 - RNA, 12 nt, Mycobacterium avium subsp. paratuberculosis
cggucgcgucgu

SEQ ID NO: 2941462 - RNA, 13 nt, Mycobacterium avium subsp. paratuberculosis
cggucgcgucguc

SEQ ID NO: 2941463 - RNA, 19 nt, Mycobacterium avium subsp. paratuberculosis
cggucgcgucgucggcggg

SEQ ID NO: 2941464 - RNA, 16 nt, Mycobacterium avium subsp. paratuberculosis
cggucgcgucgugcgg

SEQ ID NO: 2941465 - RNA, 19 nt, Mycobacterium avium subsp. paratuberculosis
cggucgcgucgugcggccg

SEQ ID NO: 2941466 - RNA, 21 nt, Mycobacterium avium subsp. paratuberculosis
cggucgcgucgugcggccggc

SEQ ID NO: 2941467 - RNA, 23 nt, Mycobacterium avium subsp. paratuberculosis
cggucgcgucgugcggccggcgc

SEQ ID NO: 2941468 - RNA, 17 nt, Mycobacterium avium subsp. paratuberculosis
cggucgcgugaccggcg

SEQ ID NO: 2941469 - RNA, 18 nt, Mycobacterium avium subsp. paratuberculosis
cggucgcgugaccggcgg

SEQ ID NO: 2941470 - RNA, 22 nt, Mycobacterium avium subsp. paratuberculosis
cggucgcgugaccggcggugcg

SEQ ID NO: 2941471 - RNA, 15 nt, Mycobacterium avium subsp. paratuberculosis
cggucgcugaccccg

SEQ ID NO: 2941472 - RNA, 16 nt, Mycobacterium avium subsp. paratuberculosis
cggucgcugaccccgc

SEQ ID NO: 2941473 - RNA, 20 nt, Mycobacterium avium subsp. paratuberculosis
cggucgcugaccccgcucgg

SEQ ID NO: 2941474 - RNA, 17 nt, Mycobacterium avium subsp. paratuberculosis
cggucgcugacccgccg

SEQ ID NO: 2941475 - RNA, 21 nt, Mycobacterium avium subsp. paratuberculosis
cggucgcugacccgccgcaac

SEQ ID NO: 2941476 - RNA, 14 nt, Mycobacterium avium subsp. paratuberculosis
cggucgcugcagcg

SEQ ID NO: 2941477 - RNA, 21 nt, Mycobacterium avium subsp. paratuberculosis
cggucgcugcagcggcggcca

SEQ ID NO: 2941478 - RNA, 11 nt, Mycobacterium avium subsp. paratuberculosis
cggucgcugcg

SEQ ID NO: 2941479 - RNA, 15 nt, Mycobacterium avium subsp. paratuberculosis
cggucggacgcgggg

SEQ ID NO: 2941480 - RNA, 22 nt, Mycobacterium avium subsp. paratuberculosis
cggucggaggccuuggugaugg

SEQ ID NO: 2941481 - RNA, 19 nt, Mycobacterium avium subsp. paratuberculosis
cggucggaguccagcacgc

SEQ ID NO: 2941482 - RNA, 23 nt, Mycobacterium avium subsp. paratuberculosis
cggucggcaacccgaccucgucg

SEQ ID NO: 2941483 - RNA, 14 nt, Mycobacterium avium subsp. paratuberculosis
cggucggcaggaaa

SEQ ID NO: 2941484 - RNA, 17 nt, Mycobacterium avium subsp. paratuberculosis
cggucggcaggaaagcg

SEQ ID NO: 2941485 - RNA, 15 nt, Mycobacterium avium subsp. paratuberculosis
cggucggcauagcgc

SEQ ID NO: 2941486 - RNA, 18 nt, Mycobacterium avium subsp. paratuberculosis
cggucggccccgcgcauc

SEQ ID NO: 2941487 - RNA, 18 nt, Mycobacterium avium subsp. paratuberculosis
cggucggcccgcugcggc

SEQ ID NO: 2941488 - RNA, 14 nt, Mycobacterium avium subsp. paratuberculosis
cggucggcgacgua

SEQ ID NO: 2941489 - RNA, 15 nt, Mycobacterium avium subsp. paratuberculosis
cggucggcgcccggc

SEQ ID NO: 2941490 - RNA, 17 nt, Mycobacterium avium subsp. paratuberculosis
cggucggcgcccggccc

SEQ ID NO: 2941491 - RNA, 21 nt, Mycobacterium avium subsp. paratuberculosis
cggucggcgcccggcccagcc

SEQ ID NO: 2941492 - RNA, 12 nt, Mycobacterium avium subsp. paratuberculosis
cggucggcgccg

SEQ ID NO: 2941493 - RNA, 13 nt, Mycobacterium avium subsp. paratuberculosis
cggucggcgccga

SEQ ID NO: 2941494 - RNA, 14 nt, Mycobacterium avium subsp. paratuberculosis
cggucggcgccgau

SEQ ID NO: 2941495 - RNA, 16 nt, Mycobacterium avium subsp. paratuberculosis
cggucggcgccgauca

SEQ ID NO: 2941496 - RNA, 18 nt, Mycobacterium avium subsp. paratuberculosis
cggucggcgccgaucacg

SEQ ID NO: 2941497 - RNA, 14 nt, Mycobacterium avium subsp. paratuberculosis
cggucggcgcgggg

SEQ ID NO: 2941498 - RNA, 17 nt, Mycobacterium avium subsp. paratuberculosis
cggucggcgcggggcca

SEQ ID NO: 2941499 - RNA, 19 nt, Mycobacterium avium subsp. paratuberculosis
cggucggcgcucgcgggug

SEQ ID NO: 2941500 - RNA, 16 nt, Mycobacterium avium subsp. paratuberculosis
cggucggcggaggcga

SEQ ID NO: 2941501 - RNA, 12 nt, Mycobacterium avium subsp. paratuberculosis
cggucggcgguu

SEQ ID NO: 2941502 - RNA, 14 nt, Mycobacterium avium subsp. paratuberculosis
cggucggcgguucg

SEQ ID NO: 2941503 - RNA, 12 nt, Mycobacterium avium subsp. paratuberculosis
cggucggcgucc

SEQ ID NO: 2941504 - RNA, 17 nt, Mycobacterium avium subsp. paratuberculosis
cggucggcguccagcgc

SEQ ID NO: 2941505 - RNA, 18 nt, Mycobacterium avium subsp. paratuberculosis
cggucggcguccagcgcg

SEQ ID NO: 2941506 - RNA, 15 nt, Mycobacterium avium subsp. paratuberculosis
cggucggcgucgaag

SEQ ID NO: 2941507 - RNA, 16 nt, Mycobacterium avium subsp. paratuberculosis
cggucggcgucgaagg

SEQ ID NO: 2941508 - RNA, 14 nt, Mycobacterium avium subsp. paratuberculosis
cggucggcgucgcu

SEQ ID NO: 2941509 - RNA, 15 nt, Mycobacterium avium subsp. paratuberculosis
cggucggcgucgcuc

SEQ ID NO: 2941510 - RNA, 13 nt, Mycobacterium avium subsp. paratuberculosis
cggucggcgucgu

SEQ ID NO: 2941511 - RNA, 20 nt, Mycobacterium avium subsp. paratuberculosis
cggucggcgucguacagcag

SEQ ID NO: 2941512 - RNA, 22 nt, Mycobacterium avium subsp. paratuberculosis
cggucggcgucguacagcagcc

SEQ ID NO: 2941513 - RNA, 23 nt, Mycobacterium avium subsp. paratuberculosis
cggucgggaucgaucccgucggc

SEQ ID NO: 2941514 - RNA, 18 nt, Mycobacterium avium subsp. paratuberculosis
cggucgggaucggugaag

SEQ ID NO: 2941515 - RNA, 18 nt, Mycobacterium avium subsp. paratuberculosis
cggucgggcagugcacga

SEQ ID NO: 2941516 - RNA, 12 nt, Mycobacterium avium subsp. paratuberculosis
cggucgggccaa

SEQ ID NO: 2941517 - RNA, 13 nt, Mycobacterium avium subsp. paratuberculosis
cggucgggcgauc

SEQ ID NO: 2941518 - RNA, 15 nt, Mycobacterium avium subsp. paratuberculosis
cggucgggcgauccg

SEQ ID NO: 2941519 - RNA, 18 nt, Mycobacterium avium subsp. paratuberculosis
cggucggggaauuccggc

SEQ ID NO: 2941520 - RNA, 14 nt, Mycobacterium avium subsp. paratuberculosis
cggucggggcggcg

SEQ ID NO: 2941521 - RNA, 15 nt, Mycobacterium avium subsp. paratuberculosis
cggucggggcggcgg

SEQ ID NO: 2941522 - RNA, 20 nt, Mycobacterium avium subsp. paratuberculosis
cggucggggcggcgggcgaa

SEQ ID NO: 2941523 - RNA, 21 nt, Mycobacterium avium subsp. paratuberculosis
cggucgggucccggcaacacc

SEQ ID NO: 2941524 - RNA, 23 nt, Mycobacterium avium subsp. paratuberculosis
cggucgggucccggcaacaccgg

SEQ ID NO: 2941525 - RNA, 14 nt, Mycobacterium avium subsp. paratuberculosis
cggucgggugcgcu

SEQ ID NO: 2941526 - RNA, 16 nt, Mycobacterium avium subsp. paratuberculosis
cggucgggugcgcuca

SEQ ID NO: 2941527 - RNA, 18 nt, Mycobacterium avium subsp. paratuberculosis
cggucgggugcgcucacc

SEQ ID NO: 2941528 - RNA, 19 nt, Mycobacterium avium subsp. paratuberculosis
cggucgggugcgcucaccg

SEQ ID NO: 2941529 - RNA, 16 nt, Mycobacterium avium subsp. paratuberculosis
cggucggucagcuggu

SEQ ID NO: 2941530 - RNA, 20 nt, Mycobacterium avium subsp. paratuberculosis
cggucggucagucgcgccgc

SEQ ID NO: 2941531 - RNA, 14 nt, Mycobacterium avium subsp. paratuberculosis
cggucggucggccg

SEQ ID NO: 2941532 - RNA, 16 nt, Mycobacterium avium subsp. paratuberculosis
cggucggucggccgca

SEQ ID NO: 2941533 - RNA, 19 nt, Mycobacterium avium subsp. paratuberculosis
cggucggugagcuggccgc

SEQ ID NO: 2941534 - RNA, 22 nt, Mycobacterium avium subsp. paratuberculosis
cggucggugcccagcaccgccg

SEQ ID NO: 2941535 - RNA, 13 nt, Mycobacterium avium subsp. paratuberculosis
cggucggugcgca

SEQ ID NO: 2941536 - RNA, 13 nt, Mycobacterium avium subsp. paratuberculosis
cggucgguggcgg

SEQ ID NO: 2941537 - RNA, 16 nt, Mycobacterium avium subsp. paratuberculosis
cggucgguggcggugc

SEQ ID NO: 2941538 - RNA, 21 nt, Mycobacterium avium subsp. paratuberculosis
cggucgguggcggugccgcgg

SEQ ID NO: 2941539 - RNA, 23 nt, Mycobacterium avium subsp. paratuberculosis
cggucgguggcggugccgcggcg

SEQ ID NO: 2941540 - RNA, 19 nt, Mycobacterium avium subsp. paratuberculosis
cggucgguucauccacucg

SEQ ID NO: 2941541 - RNA, 21 nt, Mycobacterium avium subsp. paratuberculosis
cggucgguucauccacucggc

SEQ ID NO: 2941542 - RNA, 13 nt, Mycobacterium avium subsp. paratuberculosis
cggucguacacau

SEQ ID NO: 2941543 - RNA, 21 nt, Mycobacterium avium subsp. paratuberculosis
cggucguacgucuugcgcacc

SEQ ID NO: 2941544 - RNA, 16 nt, Mycobacterium avium subsp. paratuberculosis
cggucguagucggccc

SEQ ID NO: 2941545 - RNA, 19 nt, Mycobacterium avium subsp. paratuberculosis
cggucuuugccaucccggu

SEQ ID NO: 2941546 - RNA, 19 nt, Mycobacterium avium subsp. paratuberculosis
cggucuuugccggccauga

SEQ ID NO: 2941547 - RNA, 14 nt, Mycobacterium avium subsp. paratuberculosis
cggugaaaccggcg

SEQ ID NO: 2941548 - RNA, 17 nt, Mycobacterium avium subsp. paratuberculosis
cggugaaaccggcgccg

SEQ ID NO: 2941549 - RNA, 18 nt, Mycobacterium avium subsp. paratuberculosis
cggugaaauagcgcagca

SEQ ID NO: 2941550 - RNA, 13 nt, Mycobacterium avium subsp. paratuberculosis
cggugaacccgcc

SEQ ID NO: 2941551 - RNA, 17 nt, Mycobacterium avium subsp. paratuberculosis
cggugaacccgccggcg

SEQ ID NO: 2941552 - RNA, 21 nt, Mycobacterium avium subsp. paratuberculosis
cggugaaccgcugaccaggaa

SEQ ID NO: 2941553 - RNA, 16 nt, Mycobacterium avium subsp. paratuberculosis
cggugaacgcgguacc

SEQ ID NO: 2941554 - RNA, 17 nt, Mycobacterium avium subsp. paratuberculosis
cggugaacgcgguaccg

SEQ ID NO: 2941555 - RNA, 17 nt, Mycobacterium avium subsp. paratuberculosis
cggugaacgggccgcac

SEQ ID NO: 2941556 - RNA, 17 nt, Mycobacterium avium subsp. paratuberculosis
cggugaacgucgauccc

SEQ ID NO: 2941557 - RNA, 23 nt, Mycobacterium avium subsp. paratuberculosis
cggugaacgucgauccccgcagc

SEQ ID NO: 2941558 - RNA, 21 nt, Mycobacterium avium subsp. paratuberculosis
cggugaacuccgggcccacca

SEQ ID NO: 2941559 - RNA, 15 nt, Mycobacterium avium subsp. paratuberculosis
cggugaacugcagcc

SEQ ID NO: 2941560 - RNA, 17 nt, Mycobacterium avium subsp. paratuberculosis
cggugaagaucagcgcg

SEQ ID NO: 2941561 - RNA, 14 nt, Mycobacterium avium subsp. paratuberculosis
cggugaagaucgcc

SEQ ID NO: 2941562 - RNA, 16 nt, Mycobacterium avium subsp. paratuberculosis
cggugaagaucgcccg

SEQ ID NO: 2941563 - RNA, 18 nt, Mycobacterium avium subsp. paratuberculosis
cggugaagaucgcccgcc

SEQ ID NO: 2941564 - RNA, 13 nt, Mycobacterium avium subsp. paratuberculosis
cggugaagccgac

SEQ ID NO: 2941565 - RNA, 16 nt, Mycobacterium avium subsp. paratuberculosis
cggugaagccgacgcc

SEQ ID NO: 2941566 - RNA, 18 nt, Mycobacterium avium subsp. paratuberculosis
cggugaagccgacgccgu

SEQ ID NO: 2941567 - RNA, 14 nt, Mycobacterium avium subsp. paratuberculosis
cggugaagccgcgg

SEQ ID NO: 2941568 - RNA, 15 nt, Mycobacterium avium subsp. paratuberculosis
cggugaagcggcgcg

SEQ ID NO: 2941569 - RNA, 18 nt, Mycobacterium avium subsp. paratuberculosis
cggugaagcgggacagca

SEQ ID NO: 2941570 - RNA, 18 nt, Mycobacterium avium subsp. paratuberculosis
cggugaagucggugccca

SEQ ID NO: 2941571 - RNA, 19 nt, Mycobacterium avium subsp. paratuberculosis
cggugaagucggugcccag

SEQ ID NO: 2941572 - RNA, 20 nt, Mycobacterium avium subsp. paratuberculosis
cggugaagucggugcccagc

SEQ ID NO: 2941573 - RNA, 23 nt, Mycobacterium avium subsp. paratuberculosis
cggugaagucggugcccagcgcg

SEQ ID NO: 2941574 - RNA, 17 nt, Mycobacterium avium subsp. paratuberculosis
cggugaagugccggcug

SEQ ID NO: 2941575 - RNA, 15 nt, Mycobacterium avium subsp. paratuberculosis
cggugaaguugccgc

SEQ ID NO: 2941576 - RNA, 17 nt, Mycobacterium avium subsp. paratuberculosis
cggugaaguugccgccg

SEQ ID NO: 2941577 - RNA, 18 nt, Mycobacterium avium subsp. paratuberculosis
cggugaaguugccgccgc

SEQ ID NO: 2941578 - RNA, 21 nt, Mycobacterium avium subsp. paratuberculosis
cggugaaguugccgccgccgg

SEQ ID NO: 2941579 - RNA, 15 nt, Mycobacterium avium subsp. paratuberculosis
cggugaaguuggcgg

SEQ ID NO: 2941580 - RNA, 18 nt, Mycobacterium avium subsp. paratuberculosis
cggugaaguuggcggcgg

SEQ ID NO: 2941581 - RNA, 15 nt, Mycobacterium avium subsp. paratuberculosis
cggugaaugucguga

SEQ ID NO: 2941582 - RNA, 17 nt, Mycobacterium avium subsp. paratuberculosis
cggugaauucaucgucc

SEQ ID NO: 2941583 - RNA, 21 nt, Mycobacterium avium subsp. paratuberculosis
cggugaauucaucguccccuc

SEQ ID NO: 2941584 - RNA, 19 nt, Mycobacterium avium subsp. paratuberculosis
cggugaauugggcgaguac

SEQ ID NO: 2941585 - RNA, 21 nt, Mycobacterium avium subsp. paratuberculosis
cggugacaaagaucacagcgc

SEQ ID NO: 2941586 - RNA, 13 nt, Mycobacterium avium subsp. paratuberculosis
cggugacacccag

SEQ ID NO: 2941587 - RNA, 13 nt, Mycobacterium avium subsp. paratuberculosis
cggugacaucgcc

SEQ ID NO: 2941588 - RNA, 15 nt, Mycobacterium avium subsp. paratuberculosis
cggugacaucgccac

SEQ ID NO: 2941589 - RNA, 17 nt, Mycobacterium avium subsp. paratuberculosis
cggugacaucgccaccu

SEQ ID NO: 2941590 - RNA, 19 nt, Mycobacterium avium subsp. paratuberculosis
cggugacaucgccaccugg

SEQ ID NO: 2941591 - RNA, 22 nt, Mycobacterium avium subsp. paratuberculosis
cggugaccacgccgugcccggc

SEQ ID NO: 2941592 - RNA, 23 nt, Mycobacterium avium subsp. paratuberculosis
cggugaccacgccgugcccggcg

SEQ ID NO: 2941593 - RNA, 15 nt, Mycobacterium avium subsp. paratuberculosis
cggugaccacggucg

SEQ ID NO: 2941594 - RNA, 16 nt, Mycobacterium avium subsp. paratuberculosis
cggugaccacggucgg

SEQ ID NO: 2941595 - RNA, 20 nt, Mycobacterium avium subsp. paratuberculosis
cggugaccacggucggcggg

SEQ ID NO: 2941596 - RNA, 18 nt, Mycobacterium avium subsp. paratuberculosis
cggugaccccgucgaacg

SEQ ID NO: 2941597 - RNA, 14 nt, Mycobacterium avium subsp. paratuberculosis
cggugaccgcccgc

SEQ ID NO: 2941598 - RNA, 14 nt, Mycobacterium avium subsp. paratuberculosis
cggugaccgccgcc

SEQ ID NO: 2941599 - RNA, 15 nt, Mycobacterium avium subsp. paratuberculosis
cggugaccgccgcca

SEQ ID NO: 2941600 - RNA, 14 nt, Mycobacterium avium subsp. paratuberculosis
cggugaccgccucg

SEQ ID NO: 2941601 - RNA, 18 nt, Mycobacterium avium subsp. paratuberculosis
cggugaccgccucgucga

SEQ ID NO: 2941602 - RNA, 14 nt, Mycobacterium avium subsp. paratuberculosis
cggugaccgcgacg

SEQ ID NO: 2941603 - RNA, 17 nt, Mycobacterium avium subsp. paratuberculosis
cggugaccgcgacgcug

SEQ ID NO: 2941604 - RNA, 18 nt, Mycobacterium avium subsp. paratuberculosis
cggugaccgcgacgcugc

SEQ ID NO: 2941605 - RNA, 13 nt, Mycobacterium avium subsp. paratuberculosis
cggugaccgcgcc

SEQ ID NO: 2941606 - RNA, 15 nt, Mycobacterium avium subsp. paratuberculosis
cggugaccgcggccu

SEQ ID NO: 2941607 - RNA, 21 nt, Mycobacterium avium subsp. paratuberculosis
cggugaccgcggccucgucga

SEQ ID NO: 2941608 - RNA, 22 nt, Mycobacterium avium subsp. paratuberculosis
cggugaccgcggccucgucgag

SEQ ID NO: 2941609 - RNA, 19 nt, Mycobacterium avium subsp. paratuberculosis
cggugaccggaucggccag

SEQ ID NO: 2941610 - RNA, 21 nt, Mycobacterium avium subsp. paratuberculosis
cggugaccggaucggccagca

SEQ ID NO: 2941611 - RNA, 22 nt, Mycobacterium avium subsp. paratuberculosis
cggugaccggaucggccagcag

SEQ ID NO: 2941612 - RNA, 23 nt, Mycobacterium avium subsp. paratuberculosis
cggugaccggaucggccagcagg

SEQ ID NO: 2941613 - RNA, 18 nt, Mycobacterium avium subsp. paratuberculosis
cggugaccggcgcgcccg

SEQ ID NO: 2941614 - RNA, 13 nt, Mycobacterium avium subsp. paratuberculosis
cggugaccggcuc

SEQ ID NO: 2941615 - RNA, 14 nt, Mycobacterium avium subsp. paratuberculosis
cggugaccggcucg

SEQ ID NO: 2941616 - RNA, 17 nt, Mycobacterium avium subsp. paratuberculosis
cggugaccggcucgagc

SEQ ID NO: 2941617 - RNA, 16 nt, Mycobacterium avium subsp. paratuberculosis
cggugaccgucgccga

SEQ ID NO: 2941618 - RNA, 18 nt, Mycobacterium avium subsp. paratuberculosis
cggugaccgucgccgacc

SEQ ID NO: 2941619 - RNA, 15 nt, Mycobacterium avium subsp. paratuberculosis
cggugaccucgagca

SEQ ID NO: 2941620 - RNA, 16 nt, Mycobacterium avium subsp. paratuberculosis
cggugaccucgagcac

SEQ ID NO: 2941621 - RNA, 17 nt, Mycobacterium avium subsp. paratuberculosis
cggugaccucgagcacc

SEQ ID NO: 2941622 - RNA, 18 nt, Mycobacterium avium subsp. paratuberculosis
cggugaccucgagcaccg

SEQ ID NO: 2941623 - RNA, 23 nt, Mycobacterium avium subsp. paratuberculosis
cggugaccucgucgggcgccagc

SEQ ID NO: 2941624 - RNA, 18 nt, Mycobacterium avium subsp. paratuberculosis
cggugaccugcagcgccu

SEQ ID NO: 2941625 - RNA, 20 nt, Mycobacterium avium subsp. paratuberculosis
cggugacgaaaugcaacgca

SEQ ID NO: 2941626 - RNA, 18 nt, Mycobacterium avium subsp. paratuberculosis
cggugacgaacccgccgc

SEQ ID NO: 2941627 - RNA, 20 nt, Mycobacterium avium subsp. paratuberculosis
cggugacgaacccgccgcgg

SEQ ID NO: 2941628 - RNA, 12 nt, Mycobacterium avium subsp. paratuberculosis
cggugacgaccg

SEQ ID NO: 2941629 - RNA, 19 nt, Mycobacterium avium subsp. paratuberculosis
cggugacgaccggcagccg

SEQ ID NO: 2941630 - RNA, 18 nt, Mycobacterium avium subsp. paratuberculosis
cggugaugaacgcgccgu

SEQ ID NO: 2941631 - RNA, 12 nt, Mycobacterium avium subsp. paratuberculosis
cggugaugacgu

SEQ ID NO: 2941632 - RNA, 20 nt, Mycobacterium avium subsp. paratuberculosis
cggugaugacguagucgucc

SEQ ID NO: 2941633 - RNA, 19 nt, Mycobacterium avium subsp. paratuberculosis
cggugaugacgucgcccac

SEQ ID NO: 2941634 - RNA, 14 nt, Mycobacterium avium subsp. paratuberculosis
cggugaugaucgcc

SEQ ID NO: 2941635 - RNA, 16 nt, Mycobacterium avium subsp. paratuberculosis
cggugaugaucgccgg

SEQ ID NO: 2941636 - RNA, 20 nt, Mycobacterium avium subsp. paratuberculosis
cggugaugaucgccgggucg

SEQ ID NO: 2941637 - RNA, 24 nt, Mycobacterium avium subsp. paratuberculosis
cggugaugaucgccgggucgcacg

SEQ ID NO: 2941638 - RNA, 14 nt, Mycobacterium avium subsp. paratuberculosis
cggugaugccgagc

SEQ ID NO: 2941639 - RNA, 16 nt, Mycobacterium avium subsp. paratuberculosis
cggugaugccgagcgc

SEQ ID NO: 2941640 - RNA, 21 nt, Mycobacterium avium subsp. paratuberculosis
cggugaugccggcauccucgg

SEQ ID NO: 2941641 - RNA, 21 nt, Mycobacterium avium subsp. paratuberculosis
cggugaugccggccagccgcg

SEQ ID NO: 2941642 - RNA, 22 nt, Mycobacterium avium subsp. paratuberculosis
cggugaugccggccagccgcgc

SEQ ID NO: 2941643 - RNA, 15 nt, Mycobacterium avium subsp. paratuberculosis
cggugaugcgcggcg

SEQ ID NO: 2941644 - RNA, 18 nt, Mycobacterium avium subsp. paratuberculosis
cggugaugcgcggcgacg

SEQ ID NO: 2941645 - RNA, 23 nt, Mycobacterium avium subsp. paratuberculosis
cggugauggugaucucgccgcgg

SEQ ID NO: 2941646 - RNA, 15 nt, Mycobacterium avium subsp. paratuberculosis
cggugaugucgacgu

SEQ ID NO: 2941647 - RNA, 16 nt, Mycobacterium avium subsp. paratuberculosis
cggugaugucgacguc

SEQ ID NO: 2941648 - RNA, 21 nt, Mycobacterium avium subsp. paratuberculosis
cggugaugucgacgucgucga

SEQ ID NO: 2941649 - RNA, 14 nt, Mycobacterium avium subsp. paratuberculosis
cggugaugucgccg

SEQ ID NO: 2941650 - RNA, 17 nt, Mycobacterium avium subsp. paratuberculosis
cggugaugucgccggcg

SEQ ID NO: 2941651 - RNA, 15 nt, Mycobacterium avium subsp. paratuberculosis
cggugaugucgguga

SEQ ID NO: 2941652 - RNA, 18 nt, Mycobacterium avium subsp. paratuberculosis
cggugaugugcaggaccu

SEQ ID NO: 2941653 - RNA, 15 nt, Mycobacterium avium subsp. paratuberculosis
cggugauguugucga

SEQ ID NO: 2941654 - RNA, 16 nt, Mycobacterium avium subsp. paratuberculosis
cggugauuccggcacc

SEQ ID NO: 2941655 - RNA, 17 nt, Mycobacterium avium subsp. paratuberculosis
cggugauuccggcaccc

SEQ ID NO: 2941656 - RNA, 15 nt, Mycobacterium avium subsp. paratuberculosis
cggugcacacgccga

SEQ ID NO: 2941657 - RNA, 14 nt, Mycobacterium avium subsp. paratuberculosis
cggugcaccaccgu

SEQ ID NO: 2941658 - RNA, 20 nt, Mycobacterium avium subsp. paratuberculosis
cggugcaccaggacgcgacc

SEQ ID NO: 2941659 - RNA, 22 nt, Mycobacterium avium subsp. paratuberculosis
cggugcaccaggacgcgaccgg

SEQ ID NO: 2941660 - RNA, 14 nt, Mycobacterium avium subsp. paratuberculosis
cggugcaccgcgcg

SEQ ID NO: 2941661 - RNA, 15 nt, Mycobacterium avium subsp. paratuberculosis
cggugcaccgcgcgc

SEQ ID NO: 2941662 - RNA, 17 nt, Mycobacterium avium subsp. paratuberculosis
cggugcaccgcgcgcac

SEQ ID NO: 2941663 - RNA, 18 nt, Mycobacterium avium subsp. paratuberculosis
cggugcaccgcgcgcacc

SEQ ID NO: 2941664 - RNA, 13 nt, Mycobacterium avium subsp. paratuberculosis
cggugcaccgcgg

SEQ ID NO: 2941665 - RNA, 14 nt, Mycobacterium avium subsp. paratuberculosis
cggugcaccgcggc

SEQ ID NO: 2941666 - RNA, 19 nt, Mycobacterium avium subsp. paratuberculosis
cggugcaccgcggcgcgca

SEQ ID NO: 2941667 - RNA, 20 nt, Mycobacterium avium subsp. paratuberculosis
cggugcaccgcggcgcgcau

SEQ ID NO: 2941668 - RNA, 21 nt, Mycobacterium avium subsp. paratuberculosis
cggugcaccgcggcgcgcauc

SEQ ID NO: 2941669 - RNA, 14 nt, Mycobacterium avium subsp. paratuberculosis
cggugcacgagcgu

SEQ ID NO: 2941670 - RNA, 17 nt, Mycobacterium avium subsp. paratuberculosis
cggugcacgagcgucgu

SEQ ID NO: 2941671 - RNA, 12 nt, Mycobacterium avium subsp. paratuberculosis
cggugcacggcg

SEQ ID NO: 2941672 - RNA, 15 nt, Mycobacterium avium subsp. paratuberculosis
cggugcacggcgcca

SEQ ID NO: 2941673 - RNA, 17 nt, Mycobacterium avium subsp. paratuberculosis
cggugcacggcgccacc

SEQ ID NO: 2941674 - RNA, 20 nt, Mycobacterium avium subsp. paratuberculosis
cggugcacggcgccaccagc

SEQ ID NO: 2941675 - RNA, 20 nt, Mycobacterium avium subsp. paratuberculosis
cggugcacggucagcucgcg

SEQ ID NO: 2941676 - RNA, 24 nt, Mycobacterium avium subsp. paratuberculosis
cggugcacggucagcucgcgcccg

SEQ ID NO: 2941677 - RNA, 17 nt, Mycobacterium avium subsp. paratuberculosis
cggugcagaccccggcg

SEQ ID NO: 2941678 - RNA, 19 nt, Mycobacterium avium subsp. paratuberculosis
cggugcagaccccggcguc

SEQ ID NO: 2941679 - RNA, 21 nt, Mycobacterium avium subsp. paratuberculosis
cggugcagaccccggcgucca

SEQ ID NO: 2941680 - RNA, 12 nt, Mycobacterium avium subsp. paratuberculosis
cggugcagcacg

SEQ ID NO: 2941681 - RNA, 19 nt, Mycobacterium avium subsp. paratuberculosis
cggugcagcacgugcgcgg

SEQ ID NO: 2941682 - RNA, 13 nt, Mycobacterium avium subsp. paratuberculosis
cggugcagcagcg

SEQ ID NO: 2941683 - RNA, 14 nt, Mycobacterium avium subsp. paratuberculosis
cggugcagccgcgg

SEQ ID NO: 2941684 - RNA, 15 nt, Mycobacterium avium subsp. paratuberculosis
cggugcagccggggg

SEQ ID NO: 2941685 - RNA, 19 nt, Mycobacterium avium subsp. paratuberculosis
cggugcagccgggugcggu

SEQ ID NO: 2941686 - RNA, 15 nt, Mycobacterium avium subsp. paratuberculosis
cggugcaggccgcga

SEQ ID NO: 2941687 - RNA, 17 nt, Mycobacterium avium subsp. paratuberculosis
cggugcaggccgcgacg

SEQ ID NO: 2941688 - RNA, 16 nt, Mycobacterium avium subsp. paratuberculosis
cggugcagggucagca

SEQ ID NO: 2941689 - RNA, 17 nt, Mycobacterium avium subsp. paratuberculosis
cggugcagggucagcag

SEQ ID NO: 2941690 - RNA, 20 nt, Mycobacterium avium subsp. paratuberculosis
cggugcaguacgcaucggcg

SEQ ID NO: 2941691 - RNA, 21 nt, Mycobacterium avium subsp. paratuberculosis
cggugcaguacgcaucggcgc

SEQ ID NO: 2941692 - RNA, 24 nt, Mycobacterium avium subsp. paratuberculosis
cggugcaguacgcaucggcgccgg

SEQ ID NO: 2941693 - RNA, 16 nt, Mycobacterium avium subsp. paratuberculosis
cggugcaucgucgcgg

SEQ ID NO: 2941694 - RNA, 19 nt, Mycobacterium avium subsp. paratuberculosis
cggugcaucgucgcggcgg

SEQ ID NO: 2941695 - RNA, 20 nt, Mycobacterium avium subsp. paratuberculosis
cggugcaucgucgcggcggu

SEQ ID NO: 2941696 - RNA, 16 nt, Mycobacterium avium subsp. paratuberculosis
cggugcaugcgcuggc

SEQ ID NO: 2941697 - RNA, 19 nt, Mycobacterium avium subsp. paratuberculosis
cggugcaugcgcuggcgaa

SEQ ID NO: 2941698 - RNA, 15 nt, Mycobacterium avium subsp. paratuberculosis
cggugccacgcggcu

SEQ ID NO: 2941699 - RNA, 17 nt, Mycobacterium avium subsp. paratuberculosis
cggugccaucgugggcg

SEQ ID NO: 2941700 - RNA, 18 nt, Mycobacterium avium subsp. paratuberculosis
cggugccaucgugggcgc

SEQ ID NO: 2941701 - RNA, 20 nt, Mycobacterium avium subsp. paratuberculosis
cggugccaucgugggcgccg

SEQ ID NO: 2941702 - RNA, 22 nt, Mycobacterium avium subsp. paratuberculosis
cggugccaucgugggcgccguc

SEQ ID NO: 2941703 - RNA, 20 nt, Mycobacterium avium subsp. paratuberculosis
cggugcccagcaccgccggc

SEQ ID NO: 2941704 - RNA, 22 nt, Mycobacterium avium subsp. paratuberculosis
cggugcccagcaccgccggcgc

SEQ ID NO: 2941705 - RNA, 21 nt, Mycobacterium avium subsp. paratuberculosis
cggugcccagccaggccgccg

SEQ ID NO: 2941706 - RNA, 13 nt, Mycobacterium avium subsp. paratuberculosis
cggugcccagccg

SEQ ID NO: 2941707 - RNA, 20 nt, Mycobacterium avium subsp. paratuberculosis
cggugcccagccgcaggugc

SEQ ID NO: 2941708 - RNA, 14 nt, Mycobacterium avium subsp. paratuberculosis
cggugcccagcgcg

SEQ ID NO: 2941709 - RNA, 13 nt, Mycobacterium avium subsp. paratuberculosis
cggugcccgccgc

SEQ ID NO: 2941710 - RNA, 17 nt, Mycobacterium avium subsp. paratuberculosis
cggugcccgccgcgacc

SEQ ID NO: 2941711 - RNA, 13 nt, Mycobacterium avium subsp. paratuberculosis
cggugcccgcggg

SEQ ID NO: 2941712 - RNA, 20 nt, Mycobacterium avium subsp. paratuberculosis
cggugcccggaacggcgggc

SEQ ID NO: 2941713 - RNA, 23 nt, Mycobacterium avium subsp. paratuberculosis
cggugcccggaacggcgggcccg

SEQ ID NO: 2941714 - RNA, 16 nt, Mycobacterium avium subsp. paratuberculosis
cggugcccggggucca

SEQ ID NO: 2941715 - RNA, 15 nt, Mycobacterium avium subsp. paratuberculosis
cggugcgccgaccgc

SEQ ID NO: 2941716 - RNA, 16 nt, Mycobacterium avium subsp. paratuberculosis
cggugcgccgaccgcg

SEQ ID NO: 2941717 - RNA, 16 nt, Mycobacterium avium subsp. paratuberculosis
cggugcgccggcagcg

SEQ ID NO: 2941718 - RNA, 19 nt, Mycobacterium avium subsp. paratuberculosis
cggugcgcgaguaggcgaa

SEQ ID NO: 2941719 - RNA, 12 nt, Mycobacterium avium subsp. paratuberculosis
cggugcgcgccg

SEQ ID NO: 2941720 - RNA, 14 nt, Mycobacterium avium subsp. paratuberculosis
cggugcgcgcgcgc

SEQ ID NO: 2941721 - RNA, 17 nt, Mycobacterium avium subsp. paratuberculosis
cggugcgcgcgcgcucg

SEQ ID NO: 2941722 - RNA, 14 nt, Mycobacterium avium subsp. paratuberculosis
cggugcgcggcgaa

SEQ ID NO: 2941723 - RNA, 14 nt, Mycobacterium avium subsp. paratuberculosis
cggugcgcggggug

SEQ ID NO: 2941724 - RNA, 20 nt, Mycobacterium avium subsp. paratuberculosis
cggugcgcgucagccgucgu

SEQ ID NO: 2941725 - RNA, 14 nt, Mycobacterium avium subsp. paratuberculosis
cggugcgcuccucg

SEQ ID NO: 2941726 - RNA, 20 nt, Mycobacterium avium subsp. paratuberculosis
cggugcgcucgugaccggcg

SEQ ID NO: 2941727 - RNA, 18 nt, Mycobacterium avium subsp. paratuberculosis
cggugcggaaggcccccg

SEQ ID NO: 2941728 - RNA, 17 nt, Mycobacterium avium subsp. paratuberculosis
cggugcggacccguugg

SEQ ID NO: 2941729 - RNA, 21 nt, Mycobacterium avium subsp. paratuberculosis
cggugcggaugaagugcgcca

SEQ ID NO: 2941730 - RNA, 23 nt, Mycobacterium avium subsp. paratuberculosis
cggugcggaugaagugcgccagc

SEQ ID NO: 2941731 - RNA, 21 nt, Mycobacterium avium subsp. paratuberculosis
cggugcggcccgcggcaucgu

SEQ ID NO: 2941732 - RNA, 12 nt, Mycobacterium avium subsp. paratuberculosis
cggugcggccgc

SEQ ID NO: 2941733 - RNA, 13 nt, Mycobacterium avium subsp. paratuberculosis
cggugcggccgca

SEQ ID NO: 2941734 - RNA, 13 nt, Mycobacterium avium subsp. paratuberculosis
cggugcggccgcg

SEQ ID NO: 2941735 - RNA, 20 nt, Mycobacterium avium subsp. paratuberculosis
cggugcggccgcgaucgcca

SEQ ID NO: 2941736 - RNA, 17 nt, Mycobacterium avium subsp. paratuberculosis
cggugcggccgcgcagc

SEQ ID NO: 2941737 - RNA, 15 nt, Mycobacterium avium subsp. paratuberculosis
cggugcggccucgac

SEQ ID NO: 2941738 - RNA, 16 nt, Mycobacterium avium subsp. paratuberculosis
cggugcggccucgacg

SEQ ID NO: 2941739 - RNA, 23 nt, Mycobacterium avium subsp. paratuberculosis
cggugcggcgggcucggacgacu

SEQ ID NO: 2941740 - RNA, 15 nt, Mycobacterium avium subsp. paratuberculosis
cggugcggcucgggc

SEQ ID NO: 2941741 - RNA, 18 nt, Mycobacterium avium subsp. paratuberculosis
cggugcggcucgggcggu

SEQ ID NO: 2941742 - RNA, 13 nt, Mycobacterium avium subsp. paratuberculosis
cggugcgggcugg

SEQ ID NO: 2941743 - RNA, 17 nt, Mycobacterium avium subsp. paratuberculosis
cggugcggggccgcggc

SEQ ID NO: 2941744 - RNA, 19 nt, Mycobacterium avium subsp. paratuberculosis
cggugcggggccgcggccg

SEQ ID NO: 2941745 - RNA, 11 nt, Mycobacterium avium subsp. paratuberculosis
cggugcggguc

SEQ ID NO: 2941746 - RNA, 17 nt, Mycobacterium avium subsp. paratuberculosis
cggugcgggucacaccc

SEQ ID NO: 2941747 - RNA, 12 nt, Mycobacterium avium subsp. paratuberculosis
cggugcgggugc

SEQ ID NO: 2941748 - RNA, 15 nt, Mycobacterium avium subsp. paratuberculosis
cggugcgggugccga

SEQ ID NO: 2941749 - RNA, 17 nt, Mycobacterium avium subsp. paratuberculosis
cggugcgggugccgaac

SEQ ID NO: 2941750 - RNA, 23 nt, Mycobacterium avium subsp. paratuberculosis
cggugcgggugguguggcgucgg

SEQ ID NO: 2941751 - RNA, 24 nt, Mycobacterium avium subsp. paratuberculosis
cggugcgggugguguggcgucggc

SEQ ID NO: 2941752 - RNA, 17 nt, Mycobacterium avium subsp. paratuberculosis
cggugcggucgcgcagc

SEQ ID NO: 2941753 - RNA, 19 nt, Mycobacterium avium subsp. paratuberculosis
cggugcggucgcgcagccg

SEQ ID NO: 2941754 - RNA, 20 nt, Mycobacterium avium subsp. paratuberculosis
cggugcggucgcgcagccgg

SEQ ID NO: 2941755 - RNA, 14 nt, Mycobacterium avium subsp. paratuberculosis
cggugcggucggcg

SEQ ID NO: 2941756 - RNA, 16 nt, Mycobacterium avium subsp. paratuberculosis
cggugcggucggcguc

SEQ ID NO: 2941757 - RNA, 15 nt, Mycobacterium avium subsp. paratuberculosis
cggugcggugcgccg

SEQ ID NO: 2941758 - RNA, 16 nt, Mycobacterium avium subsp. paratuberculosis
cggugcggugcgccgc

SEQ ID NO: 2941759 - RNA, 15 nt, Mycobacterium avium subsp. paratuberculosis
cggugcguccgccgg

SEQ ID NO: 2941760 - RNA, 23 nt, Mycobacterium avium subsp. paratuberculosis
cggugcguccgccggcggugcgg

SEQ ID NO: 2941761 - RNA, 14 nt, Mycobacterium avium subsp. paratuberculosis
cggugcgucgggcg

SEQ ID NO: 2941762 - RNA, 15 nt, Mycobacterium avium subsp. paratuberculosis
cggugcgucgggcgc

SEQ ID NO: 2941763 - RNA, 21 nt, Mycobacterium avium subsp. paratuberculosis
cggugcgucgggcgccggcgc

SEQ ID NO: 2941764 - RNA, 15 nt, Mycobacterium avium subsp. paratuberculosis
cggugcgugccagca

SEQ ID NO: 2941765 - RNA, 17 nt, Mycobacterium avium subsp. paratuberculosis
cggugcgugccagcagc

SEQ ID NO: 2941766 - RNA, 18 nt, Mycobacterium avium subsp. paratuberculosis
cggugcgugccagcagcu

SEQ ID NO: 2941767 - RNA, 19 nt, Mycobacterium avium subsp. paratuberculosis
cggugcgugccagcagcuc

SEQ ID NO: 2941768 - RNA, 15 nt, Mycobacterium avium subsp. paratuberculosis
cggugcucaucagcg

SEQ ID NO: 2941769 - RNA, 20 nt, Mycobacterium avium subsp. paratuberculosis
cggugcucaucagcgacacc

SEQ ID NO: 2941770 - RNA, 16 nt, Mycobacterium avium subsp. paratuberculosis
cggugcucccccggac

SEQ ID NO: 2941771 - RNA, 20 nt, Mycobacterium avium subsp. paratuberculosis
cggugcucccccggaccugc

SEQ ID NO: 2941772 - RNA, 23 nt, Mycobacterium avium subsp. paratuberculosis
cggugcucccccggaccugccgg

SEQ ID NO: 2941773 - RNA, 21 nt, Mycobacterium avium subsp. paratuberculosis
cggugcucgauguaccaggcc

SEQ ID NO: 2941774 - RNA, 17 nt, Mycobacterium avium subsp. paratuberculosis
cggugcucgcgccgggc

SEQ ID NO: 2941775 - RNA, 19 nt, Mycobacterium avium subsp. paratuberculosis
cggugcucgcgccgggcgg

SEQ ID NO: 2941776 - RNA, 15 nt, Mycobacterium avium subsp. paratuberculosis
cggugcucggcgcgc

SEQ ID NO: 2941777 - RNA, 16 nt, Mycobacterium avium subsp. paratuberculosis
cggugcucggcgcgcg

SEQ ID NO: 2941778 - RNA, 23 nt, Mycobacterium avium subsp. paratuberculosis
cggugcucggcgcgcggggccgg

SEQ ID NO: 2941779 - RNA, 16 nt, Mycobacterium avium subsp. paratuberculosis
cggugcucgucgagca

SEQ ID NO: 2941780 - RNA, 17 nt, Mycobacterium avium subsp. paratuberculosis
cggugcucuccugcuug

SEQ ID NO: 2941781 - RNA, 15 nt, Mycobacterium avium subsp. paratuberculosis
cggugcucucgucgu

SEQ ID NO: 2941782 - RNA, 21 nt, Mycobacterium avium subsp. paratuberculosis
cggugcucucgucgucggcgg

SEQ ID NO: 2941783 - RNA, 22 nt, Mycobacterium avium subsp. paratuberculosis
cggugcucucgucgucggcggg

SEQ ID NO: 2941784 - RNA, 20 nt, Mycobacterium avium subsp. paratuberculosis
cggugcucuugacggccgcg

SEQ ID NO: 2941785 - RNA, 22 nt, Mycobacterium avium subsp. paratuberculosis
cggugcucuugacggccgcggc

SEQ ID NO: 2941786 - RNA, 15 nt, Mycobacterium avium subsp. paratuberculosis
cggugcugacccggu

SEQ ID NO: 2941787 - RNA, 12 nt, Mycobacterium avium subsp. paratuberculosis
cggugcugcaga

SEQ ID NO: 2941788 - RNA, 18 nt, Mycobacterium avium subsp. paratuberculosis
cggugcugcagauccgcu

SEQ ID NO: 2941789 - RNA, 20 nt, Mycobacterium avium subsp. paratuberculosis
cggugcugcagauccgcucg

SEQ ID NO: 2941790 - RNA, 16 nt, Mycobacterium avium subsp. paratuberculosis
cggugcugcagcgcga

SEQ ID NO: 2941791 - RNA, 20 nt, Mycobacterium avium subsp. paratuberculosis
cggugcugcagcgcgaggcg

SEQ ID NO: 2941792 - RNA, 21 nt, Mycobacterium avium subsp. paratuberculosis
cggugcugcagcgcgaggcgc

SEQ ID NO: 2941793 - RNA, 15 nt, Mycobacterium avium subsp. paratuberculosis
cggugcuggcgaugu

SEQ ID NO: 2941794 - RNA, 22 nt, Mycobacterium avium subsp. paratuberculosis
cggugcuggucaugccgucgac

SEQ ID NO: 2941795 - RNA, 22 nt, Mycobacterium avium subsp. paratuberculosis
cggugcuuaccggccggccgcc

SEQ ID NO: 2941796 - RNA, 23 nt, Mycobacterium avium subsp. paratuberculosis
cggugcuuggcguugaugucggc

SEQ ID NO: 2941797 - RNA, 20 nt, Mycobacterium avium subsp. paratuberculosis
cgguggaacaguucggugcg

SEQ ID NO: 2941798 - RNA, 21 nt, Mycobacterium avium subsp. paratuberculosis
cgguggaacaguucggugcgg

SEQ ID NO: 2941799 - RNA, 12 nt, Mycobacterium avium subsp. paratuberculosis
cgguggcgauga

SEQ ID NO: 2941800 - RNA, 15 nt, Mycobacterium avium subsp. paratuberculosis
cgguggcgauggugc

SEQ ID NO: 2941801 - RNA, 23 nt, Mycobacterium avium subsp. paratuberculosis
cgguggcgcacaacccggacagc

SEQ ID NO: 2941802 - RNA, 12 nt, Mycobacterium avium subsp. paratuberculosis
cgguggcgccca

SEQ ID NO: 2941803 - RNA, 13 nt, Mycobacterium avium subsp. paratuberculosis
cgguggcgcccag

SEQ ID NO: 2941804 - RNA, 14 nt, Mycobacterium avium subsp. paratuberculosis
cgguggcgcccagc

SEQ ID NO: 2941805 - RNA, 21 nt, Mycobacterium avium subsp. paratuberculosis
cgguggcgcccagcgagcugc

SEQ ID NO: 2941806 - RNA, 12 nt, Mycobacterium avium subsp. paratuberculosis
cgguggcgcccg

SEQ ID NO: 2941807 - RNA, 16 nt, Mycobacterium avium subsp. paratuberculosis
cgguggcgcccgcggu

SEQ ID NO: 2941808 - RNA, 17 nt, Mycobacterium avium subsp. paratuberculosis
cgguggcgccgcgcagc

SEQ ID NO: 2941809 - RNA, 19 nt, Mycobacterium avium subsp. paratuberculosis
cgguggcgccgcgcagcca

SEQ ID NO: 2941810 - RNA, 15 nt, Mycobacterium avium subsp. paratuberculosis
cgguggcgccgcggg

SEQ ID NO: 2941811 - RNA, 18 nt, Mycobacterium avium subsp. paratuberculosis
cgguggcgccgcgggcgg

SEQ ID NO: 2941812 - RNA, 13 nt, Mycobacterium avium subsp. paratuberculosis
cgguggcgccggg

SEQ ID NO: 2941813 - RNA, 14 nt, Mycobacterium avium subsp. paratuberculosis
cgguggcgccgggg

SEQ ID NO: 2941814 - RNA, 15 nt, Mycobacterium avium subsp. paratuberculosis
cgguggcgccggggc

SEQ ID NO: 2941815 - RNA, 19 nt, Mycobacterium avium subsp. paratuberculosis
cgguggcgcgaaucccggc

SEQ ID NO: 2941816 - RNA, 22 nt, Mycobacterium avium subsp. paratuberculosis
cgguggcgcgaaucccggccuc

SEQ ID NO: 2941817 - RNA, 13 nt, Mycobacterium avium subsp. paratuberculosis
cgguggcgcgcag

SEQ ID NO: 2941818 - RNA, 14 nt, Mycobacterium avium subsp. paratuberculosis
cgguggcgcgcagu

SEQ ID NO: 2941819 - RNA, 17 nt, Mycobacterium avium subsp. paratuberculosis
cgguggcgcgcagucgc

SEQ ID NO: 2941820 - RNA, 13 nt, Mycobacterium avium subsp. paratuberculosis
cgguggcgcgggu

SEQ ID NO: 2941821 - RNA, 12 nt, Mycobacterium avium subsp. paratuberculosis
cgguggcggcca

SEQ ID NO: 2941822 - RNA, 14 nt, Mycobacterium avium subsp. paratuberculosis
cgguggcggccacg

SEQ ID NO: 2941823 - RNA, 16 nt, Mycobacterium avium subsp. paratuberculosis
cgguggcggccacgau

SEQ ID NO: 2941824 - RNA, 20 nt, Mycobacterium avium subsp. paratuberculosis
cgguggcggccaggccggcg

SEQ ID NO: 2941825 - RNA, 23 nt, Mycobacterium avium subsp. paratuberculosis
cgguggcggccaggccggcgacg

SEQ ID NO: 2941826 - RNA, 15 nt, Mycobacterium avium subsp. paratuberculosis
cgguggcggcgaacg

SEQ ID NO: 2941827 - RNA, 19 nt, Mycobacterium avium subsp. paratuberculosis
cgguggcggcgaacgcgcg

SEQ ID NO: 2941828 - RNA, 20 nt, Mycobacterium avium subsp. paratuberculosis
cgguggcggcgaacgcgcgg

SEQ ID NO: 2941829 - RNA, 14 nt, Mycobacterium avium subsp. paratuberculosis
cgguggcggcgaca

SEQ ID NO: 2941830 - RNA, 14 nt, Mycobacterium avium subsp. paratuberculosis
cgguggcggcgagg

SEQ ID NO: 2941831 - RNA, 21 nt, Mycobacterium avium subsp. paratuberculosis
cgguggcggcgaugucgucga

SEQ ID NO: 2941832 - RNA, 12 nt, Mycobacterium avium subsp. paratuberculosis
cgguggcggcgg

SEQ ID NO: 2941833 - RNA, 17 nt, Mycobacterium avium subsp. paratuberculosis
cgguggcggcggcgacg

SEQ ID NO: 2941834 - RNA, 15 nt, Mycobacterium avium subsp. paratuberculosis
cgguggcgggccgcc

SEQ ID NO: 2941835 - RNA, 16 nt, Mycobacterium avium subsp. paratuberculosis
cgguggcgggccgccg

SEQ ID NO: 2941836 - RNA, 15 nt, Mycobacterium avium subsp. paratuberculosis
cgguggcggugccgc

SEQ ID NO: 2941837 - RNA, 18 nt, Mycobacterium avium subsp. paratuberculosis
cgguggcggugccgcggc

SEQ ID NO: 2941838 - RNA, 19 nt, Mycobacterium avium subsp. paratuberculosis
cgguggcggugccgcggcg

SEQ ID NO: 2941839 - RNA, 20 nt, Mycobacterium avium subsp. paratuberculosis
cgguggcggugcggucgcgc

SEQ ID NO: 2941840 - RNA, 12 nt, Mycobacterium avium subsp. paratuberculosis
cgguggcggugg

SEQ ID NO: 2941841 - RNA, 16 nt, Mycobacterium avium subsp. paratuberculosis
cgguggcgguggccac

SEQ ID NO: 2941842 - RNA, 18 nt, Mycobacterium avium subsp. paratuberculosis
cgguggcgguggggccga

SEQ ID NO: 2941843 - RNA, 22 nt, Mycobacterium avium subsp. paratuberculosis
cgguggcguagcggugaaacgc

SEQ ID NO: 2941844 - RNA, 17 nt, Mycobacterium avium subsp. paratuberculosis
cgguggcguccagcggg

SEQ ID NO: 2941845 - RNA, 19 nt, Mycobacterium avium subsp. paratuberculosis
cgguggcguccucgacggu

SEQ ID NO: 2941846 - RNA, 20 nt, Mycobacterium avium subsp. paratuberculosis
cgguggcguccucgacggug

SEQ ID NO: 2941847 - RNA, 13 nt, Mycobacterium avium subsp. paratuberculosis
cgguggcgucggc

SEQ ID NO: 2941848 - RNA, 18 nt, Mycobacterium avium subsp. paratuberculosis
cgguggcgucggcggccu

SEQ ID NO: 2941849 - RNA, 19 nt, Mycobacterium avium subsp. paratuberculosis
cgguggcgucggcggccug

SEQ ID NO: 2941850 - RNA, 20 nt, Mycobacterium avium subsp. paratuberculosis
cgguggcgugcagcgcggcg

SEQ ID NO: 2941851 - RNA, 24 nt, Mycobacterium avium subsp. paratuberculosis
cgguggcgugcagcgcggcgauga

SEQ ID NO: 2941852 - RNA, 20 nt, Mycobacterium avium subsp. paratuberculosis
cgguggcuaccgccgggcgg

SEQ ID NO: 2941853 - RNA, 18 nt, Mycobacterium avium subsp. paratuberculosis
cggugggaauccacagcg

SEQ ID NO: 2941854 - RNA, 15 nt, Mycobacterium avium subsp. paratuberculosis
cggugggacggcggg

SEQ ID NO: 2941855 - RNA, 16 nt, Mycobacterium avium subsp. paratuberculosis
cggugggacggcgggu

SEQ ID NO: 2941856 - RNA, 18 nt, Mycobacterium avium subsp. paratuberculosis
cggugggacugggcgccg

SEQ ID NO: 2941857 - RNA, 14 nt, Mycobacterium avium subsp. paratuberculosis
cggugggcaccagc

SEQ ID NO: 2941858 - RNA, 18 nt, Mycobacterium avium subsp. paratuberculosis
cggugggcaccagcagcg

SEQ ID NO: 2941859 - RNA, 18 nt, Mycobacterium avium subsp. paratuberculosis
cggugggcagcucgucgg

SEQ ID NO: 2941860 - RNA, 19 nt, Mycobacterium avium subsp. paratuberculosis
cggugggcagcucgucggc

SEQ ID NO: 2941861 - RNA, 20 nt, Mycobacterium avium subsp. paratuberculosis
cggugggcagcucgucggcg

SEQ ID NO: 2941862 - RNA, 16 nt, Mycobacterium avium subsp. paratuberculosis
cggugggcccgccguc

SEQ ID NO: 2941863 - RNA, 18 nt, Mycobacterium avium subsp. paratuberculosis
cggugggcccgccgucga

SEQ ID NO: 2941864 - RNA, 22 nt, Mycobacterium avium subsp. paratuberculosis
cggugggccgcaccuggcagca

SEQ ID NO: 2941865 - RNA, 12 nt, Mycobacterium avium subsp. paratuberculosis
cggugggccgcc

SEQ ID NO: 2941866 - RNA, 13 nt, Mycobacterium avium subsp. paratuberculosis
cggugggccgccg

SEQ ID NO: 2941867 - RNA, 16 nt, Mycobacterium avium subsp. paratuberculosis
cggugggccgccgcgg

SEQ ID NO: 2941868 - RNA, 16 nt, Mycobacterium avium subsp. paratuberculosis
cggugggcgcgggccg

SEQ ID NO: 2941869 - RNA, 20 nt, Mycobacterium avium subsp. paratuberculosis
cggugggcgcugguccucgg

SEQ ID NO: 2941870 - RNA, 12 nt, Mycobacterium avium subsp. paratuberculosis
cggugggcggcg

SEQ ID NO: 2941871 - RNA, 14 nt, Mycobacterium avium subsp. paratuberculosis
cggugggcggcgcc

SEQ ID NO: 2941872 - RNA, 16 nt, Mycobacterium avium subsp. paratuberculosis
cggugggcggcgcccg

SEQ ID NO: 2941873 - RNA, 18 nt, Mycobacterium avium subsp. paratuberculosis
cggugggcggcgcccgac

SEQ ID NO: 2941874 - RNA, 13 nt, Mycobacterium avium subsp. paratuberculosis
cggugggcggcgg

SEQ ID NO: 2941875 - RNA, 14 nt, Mycobacterium avium subsp. paratuberculosis
cggugggcggcggg

SEQ ID NO: 2941876 - RNA, 15 nt, Mycobacterium avium subsp. paratuberculosis
cggugggcggcggga

SEQ ID NO: 2941877 - RNA, 17 nt, Mycobacterium avium subsp. paratuberculosis
cggugggcucggccauc

SEQ ID NO: 2941878 - RNA, 22 nt, Mycobacterium avium subsp. paratuberculosis
cggugggcucggccaucccggu

SEQ ID NO: 2941879 - RNA, 18 nt, Mycobacterium avium subsp. paratuberculosis
cggugggcucggcgccga

SEQ ID NO: 2941880 - RNA, 14 nt, Mycobacterium avium subsp. paratuberculosis
cggugggcucgucg

SEQ ID NO: 2941881 - RNA, 18 nt, Mycobacterium avium subsp. paratuberculosis
cgguggggcuggccgcac

SEQ ID NO: 2941882 - RNA, 20 nt, Mycobacterium avium subsp. paratuberculosis
cgguggggcuggccgcacgg

SEQ ID NO: 2941883 - RNA, 14 nt, Mycobacterium avium subsp. paratuberculosis
cggugggggccagg

SEQ ID NO: 2941884 - RNA, 16 nt, Mycobacterium avium subsp. paratuberculosis
cggugucgccgucgcc

SEQ ID NO: 2941885 - RNA, 18 nt, Mycobacterium avium subsp. paratuberculosis
cggugucgccgucgccgc

SEQ ID NO: 2941886 - RNA, 19 nt, Mycobacterium avium subsp. paratuberculosis
cggugucgccgucgccgca

SEQ ID NO: 2941887 - RNA, 17 nt, Mycobacterium avium subsp. paratuberculosis
cggugucgcucaucccg

SEQ ID NO: 2941888 - RNA, 20 nt, Mycobacterium avium subsp. paratuberculosis
cggugucgcuguaggccagc

SEQ ID NO: 2941889 - RNA, 23 nt, Mycobacterium avium subsp. paratuberculosis
cggugucgcuguaggccagcccg

SEQ ID NO: 2941890 - RNA, 14 nt, Mycobacterium avium subsp. paratuberculosis
cggugucggcgccc

SEQ ID NO: 2941891 - RNA, 18 nt, Mycobacterium avium subsp. paratuberculosis
cggugucggcgccccggc

SEQ ID NO: 2941892 - RNA, 17 nt, Mycobacterium avium subsp. paratuberculosis
cggugucggcgucgauc

SEQ ID NO: 2941893 - RNA, 17 nt, Mycobacterium avium subsp. paratuberculosis
cggugucggggucgucg

SEQ ID NO: 2941894 - RNA, 14 nt, Mycobacterium avium subsp. paratuberculosis
cggugucggugccg

SEQ ID NO: 2941895 - RNA, 19 nt, Mycobacterium avium subsp. paratuberculosis
cggugucggugccgagcac

SEQ ID NO: 2941896 - RNA, 20 nt, Mycobacterium avium subsp. paratuberculosis
cggugucguaguugcgcgcc

SEQ ID NO: 2941897 - RNA, 21 nt, Mycobacterium avium subsp. paratuberculosis
cggugucguaguugcgcgccg

SEQ ID NO: 2941898 - RNA, 23 nt, Mycobacterium avium subsp. paratuberculosis
cggugucguaguugcgcgccgau

SEQ ID NO: 2941899 - RNA, 13 nt, Mycobacterium avium subsp. paratuberculosis
cggugucgucgac

SEQ ID NO: 2941900 - RNA, 14 nt, Mycobacterium avium subsp. paratuberculosis
cggugucgucgacc

SEQ ID NO: 2941901 - RNA, 21 nt, Mycobacterium avium subsp. paratuberculosis
cggugucugaccucgcgccgc

SEQ ID NO: 2941902 - RNA, 23 nt, Mycobacterium avium subsp. paratuberculosis
cggugucugaccucgcgccgcga

SEQ ID NO: 2941903 - RNA, 17 nt, Mycobacterium avium subsp. paratuberculosis
cggugugaucgagcacc

SEQ ID NO: 2941904 - RNA, 19 nt, Mycobacterium avium subsp. paratuberculosis
cggugugaucgagcaccag

SEQ ID NO: 2941905 - RNA, 21 nt, Mycobacterium avium subsp. paratuberculosis
cggugugaucgagcaccagcg

SEQ ID NO: 2941906 - RNA, 15 nt, Mycobacterium avium subsp. paratuberculosis
cggugugcagcagcu

SEQ ID NO: 2941907 - RNA, 18 nt, Mycobacterium avium subsp. paratuberculosis
cggugugcagcagcucgg

SEQ ID NO: 2941908 - RNA, 20 nt, Mycobacterium avium subsp. paratuberculosis
cggugugcagcagcucggcg

SEQ ID NO: 2941909 - RNA, 21 nt, Mycobacterium avium subsp. paratuberculosis
cggugugcagcagcucggcga

SEQ ID NO: 2941910 - RNA, 15 nt, Mycobacterium avium subsp. paratuberculosis
cggugugcagccacc

SEQ ID NO: 2941911 - RNA, 21 nt, Mycobacterium avium subsp. paratuberculosis
cggugugcagccacccgucgg

SEQ ID NO: 2941912 - RNA, 14 nt, Mycobacterium avium subsp. paratuberculosis
cggugugccgaagg

SEQ ID NO: 2941913 - RNA, 20 nt, Mycobacterium avium subsp. paratuberculosis
cggugugccuggcuccccgg

SEQ ID NO: 2941914 - RNA, 12 nt, Mycobacterium avium subsp. paratuberculosis
cggugugcggca

SEQ ID NO: 2941915 - RNA, 18 nt, Mycobacterium avium subsp. paratuberculosis
cggugugcggcagcucgg

SEQ ID NO: 2941916 - RNA, 22 nt, Mycobacterium avium subsp. paratuberculosis
cggugugcggcagcucggcggc

SEQ ID NO: 2941917 - RNA, 12 nt, Mycobacterium avium subsp. paratuberculosis
cggugugcggcg

SEQ ID NO: 2941918 - RNA, 14 nt, Mycobacterium avium subsp. paratuberculosis
cggugugcggcggc

SEQ ID NO: 2941919 - RNA, 15 nt, Mycobacterium avium subsp. paratuberculosis
cggugugcggcggcu

SEQ ID NO: 2941920 - RNA, 17 nt, Mycobacterium avium subsp. paratuberculosis
cggugugcggcggcucg

SEQ ID NO: 2941921 - RNA, 21 nt, Mycobacterium avium subsp. paratuberculosis
cggugugcgguucacgcggcu

SEQ ID NO: 2941922 - RNA, 15 nt, Mycobacterium avium subsp. paratuberculosis
cggugugcugaccca

SEQ ID NO: 2941923 - RNA, 21 nt, Mycobacterium avium subsp. paratuberculosis
cggugugcugacccagcgcgg

SEQ ID NO: 2941924 - RNA, 17 nt, Mycobacterium avium subsp. paratuberculosis
cggugugcuggccagca

SEQ ID NO: 2941925 - RNA, 14 nt, Mycobacterium avium subsp. paratuberculosis
cgguguggaccgcg

SEQ ID NO: 2941926 - RNA, 16 nt, Mycobacterium avium subsp. paratuberculosis
cgguguggaccgcgca

SEQ ID NO: 2941927 - RNA, 18 nt, Mycobacterium avium subsp. paratuberculosis
cgguguggaccgcgcagu

SEQ ID NO: 2941928 - RNA, 21 nt, Mycobacterium avium subsp. paratuberculosis
cgguguggaccgcgcagucgg

SEQ ID NO: 2941929 - RNA, 16 nt, Mycobacterium avium subsp. paratuberculosis
cgguguggccgcggug

SEQ ID NO: 2941930 - RNA, 19 nt, Mycobacterium avium subsp. paratuberculosis
cggugugggcgauggcggc

SEQ ID NO: 2941931 - RNA, 17 nt, Mycobacterium avium subsp. paratuberculosis
cggugugggcggacugc

SEQ ID NO: 2941932 - RNA, 20 nt, Mycobacterium avium subsp. paratuberculosis
cggugugggucagcgaggcg

SEQ ID NO: 2941933 - RNA, 17 nt, Mycobacterium avium subsp. paratuberculosis
cgguguucaagccggcg

SEQ ID NO: 2941934 - RNA, 20 nt, Mycobacterium avium subsp. paratuberculosis
cgguguucaagccggcgugg

SEQ ID NO: 2941935 - RNA, 20 nt, Mycobacterium avium subsp. paratuberculosis
cgguguucgagggcgcggcg

SEQ ID NO: 2941936 - RNA, 15 nt, Mycobacterium avium subsp. paratuberculosis
cgguguucggcgcca

SEQ ID NO: 2941937 - RNA, 15 nt, Mycobacterium avium subsp. paratuberculosis
cgguguucgggucgg

SEQ ID NO: 2941938 - RNA, 20 nt, Mycobacterium avium subsp. paratuberculosis
cgguguucuugaacggcgcg

SEQ ID NO: 2941939 - RNA, 23 nt, Mycobacterium avium subsp. paratuberculosis
cgguguucuugaacggcgcgucg

SEQ ID NO: 2941940 - RNA, 13 nt, Mycobacterium avium subsp. paratuberculosis
cgguguugagcgc

SEQ ID NO: 2941941 - RNA, 15 nt, Mycobacterium avium subsp. paratuberculosis
cgguguugagcgcgu

SEQ ID NO: 2941942 - RNA, 20 nt, Mycobacterium avium subsp. paratuberculosis
cgguguugccgacggcgccg

SEQ ID NO: 2941943 - RNA, 16 nt, Mycobacterium avium subsp. paratuberculosis
cgguguugcgcacccg

SEQ ID NO: 2941944 - RNA, 17 nt, Mycobacterium avium subsp. paratuberculosis
cgguguugcgcacccgc

SEQ ID NO: 2941945 - RNA, 19 nt, Mycobacterium avium subsp. paratuberculosis
cgguguugcgcacccgcgg

SEQ ID NO: 2941946 - RNA, 16 nt, Mycobacterium avium subsp. paratuberculosis
cgguguugcgcagcga

SEQ ID NO: 2941947 - RNA, 20 nt, Mycobacterium avium subsp. paratuberculosis
cgguguugcgcagcgaacgu

SEQ ID NO: 2941948 - RNA, 16 nt, Mycobacterium avium subsp. paratuberculosis
cgguguuggcggcguc

SEQ ID NO: 2941949 - RNA, 15 nt, Mycobacterium avium subsp. paratuberculosis
cgguguuuggccgcg

SEQ ID NO: 2941950 - RNA, 16 nt, Mycobacterium avium subsp. paratuberculosis
cgguguuuggccgcgc

SEQ ID NO: 2941951 - RNA, 17 nt, Mycobacterium avium subsp. paratuberculosis
cgguguuuggccgcgca

SEQ ID NO: 2941952 - RNA, 19 nt, Mycobacterium avium subsp. paratuberculosis
cgguguuuggccgcgcagc

SEQ ID NO: 2941953 - RNA, 19 nt, Mycobacterium avium subsp. paratuberculosis
cgguuaccggugcacgagc

SEQ ID NO: 2941954 - RNA, 14 nt, Mycobacterium avium subsp. paratuberculosis
cgguucacgcggcu

SEQ ID NO: 2941955 - RNA, 15 nt, Mycobacterium avium subsp. paratuberculosis
cgguucacgcggcug

SEQ ID NO: 2941956 - RNA, 19 nt, Mycobacterium avium subsp. paratuberculosis
cgguucacgcggcuggccc

SEQ ID NO: 2941957 - RNA, 20 nt, Mycobacterium avium subsp. paratuberculosis
cgguucacgcggcuggcccg

SEQ ID NO: 2941958 - RNA, 17 nt, Mycobacterium avium subsp. paratuberculosis
cgguucauccacucggc

SEQ ID NO: 2941959 - RNA, 21 nt, Mycobacterium avium subsp. paratuberculosis
cgguucauccacucggccacc

SEQ ID NO: 2941960 - RNA, 11 nt, Mycobacterium avium subsp. paratuberculosis
cgguuccaacc

SEQ ID NO: 2941961 - RNA, 21 nt, Mycobacterium avium subsp. paratuberculosis
cgguuccaaccaccguggccc

SEQ ID NO: 2941962 - RNA, 22 nt, Mycobacterium avium subsp. paratuberculosis
cgguuccaaccaccguggcccc

SEQ ID NO: 2941963 - RNA, 16 nt, Mycobacterium avium subsp. paratuberculosis
cgguuccaccgggccg

SEQ ID NO: 2941964 - RNA, 19 nt, Mycobacterium avium subsp. paratuberculosis
cgguuccaccgggccgcca

SEQ ID NO: 2941965 - RNA, 16 nt, Mycobacterium avium subsp. paratuberculosis
cgguuccagaccggcg

SEQ ID NO: 2941966 - RNA, 17 nt, Mycobacterium avium subsp. paratuberculosis
cgguuccagaccggcgg

SEQ ID NO: 2941967 - RNA, 19 nt, Mycobacterium avium subsp. paratuberculosis
cgguuccagaccggcggcg

SEQ ID NO: 2941968 - RNA, 15 nt, Mycobacterium avium subsp. paratuberculosis
cguaaccgccguugg

SEQ ID NO: 2941969 - RNA, 13 nt, Mycobacterium avium subsp. paratuberculosis
cguaaccggcggc

SEQ ID NO: 2941970 - RNA, 14 nt, Mycobacterium avium subsp. paratuberculosis
cguaaccggcggcg

SEQ ID NO: 2941971 - RNA, 14 nt, Mycobacterium avium subsp. paratuberculosis
cguaaccggugaca

SEQ ID NO: 2941972 - RNA, 15 nt, Mycobacterium avium subsp. paratuberculosis
cguaacgccacggcg

SEQ ID NO: 2941973 - RNA, 19 nt, Mycobacterium avium subsp. paratuberculosis
cguaaugcgucaugccgga

SEQ ID NO: 2941974 - RNA, 16 nt, Mycobacterium avium subsp. paratuberculosis
cguaauugaucguguu

SEQ ID NO: 2941975 - RNA, 15 nt, Mycobacterium avium subsp. paratuberculosis
cguacaaggugaugg

SEQ ID NO: 2941976 - RNA, 21 nt, Mycobacterium avium subsp. paratuberculosis
cguacaaggugauggcccgcu

SEQ ID NO: 2941977 - RNA, 21 nt, Mycobacterium avium subsp. paratuberculosis
cguacaccagggugccgccgg

SEQ ID NO: 2941978 - RNA, 16 nt, Mycobacterium avium subsp. paratuberculosis
cguacaccggcugacc

SEQ ID NO: 2941979 - RNA, 19 nt, Mycobacterium avium subsp. paratuberculosis
cguacaccgggaucggggu

SEQ ID NO: 2941980 - RNA, 20 nt, Mycobacterium avium subsp. paratuberculosis
cguacaccgggaucggggug

SEQ ID NO: 2941981 - RNA, 15 nt, Mycobacterium avium subsp. paratuberculosis
cguacacgaugcccu

SEQ ID NO: 2941982 - RNA, 15 nt, Mycobacterium avium subsp. paratuberculosis
cguacacggcccgcg

SEQ ID NO: 2941983 - RNA, 17 nt, Mycobacterium avium subsp. paratuberculosis
cguacacggcccgcggc

SEQ ID NO: 2941984 - RNA, 20 nt, Mycobacterium avium subsp. paratuberculosis
cguacagcaauccgcugaac

SEQ ID NO: 2941985 - RNA, 12 nt, Mycobacterium avium subsp. paratuberculosis
cguacagcagcc

SEQ ID NO: 2941986 - RNA, 23 nt, Mycobacterium avium subsp. paratuberculosis
cguacagcagccccugcaccacg

SEQ ID NO: 2941987 - RNA, 15 nt, Mycobacterium avium subsp. paratuberculosis
cguacagcccgcgga

SEQ ID NO: 2941988 - RNA, 20 nt, Mycobacterium avium subsp. paratuberculosis
cguacagcgagccgucgacc

SEQ ID NO: 2941989 - RNA, 21 nt, Mycobacterium avium subsp. paratuberculosis
cguacagcgagccgucgaccg

SEQ ID NO: 2941990 - RNA, 12 nt, Mycobacterium avium subsp. paratuberculosis
cguacagcgccc

SEQ ID NO: 2941991 - RNA, 18 nt, Mycobacterium avium subsp. paratuberculosis
cguacagcgggucguugg

SEQ ID NO: 2941992 - RNA, 20 nt, Mycobacterium avium subsp. paratuberculosis
cguacagcgggucguuggcg

SEQ ID NO: 2941993 - RNA, 14 nt, Mycobacterium avium subsp. paratuberculosis
cguacagcuggucc

SEQ ID NO: 2941994 - RNA, 18 nt, Mycobacterium avium subsp. paratuberculosis
cguacagcugguccggcc

SEQ ID NO: 2941995 - RNA, 20 nt, Mycobacterium avium subsp. paratuberculosis
cguacagcugguccggccgg

SEQ ID NO: 2941996 - RNA, 15 nt, Mycobacterium avium subsp. paratuberculosis
cguacaggccgucgg

SEQ ID NO: 2941997 - RNA, 16 nt, Mycobacterium avium subsp. paratuberculosis
cguacaggccgucggg

SEQ ID NO: 2941998 - RNA, 20 nt, Mycobacterium avium subsp. paratuberculosis
cguacaucagcucgucagcg

SEQ ID NO: 2941999 - RNA, 13 nt, Mycobacterium avium subsp. paratuberculosis
cguacauggugac

SEQ ID NO: 2942000 - RNA, 18 nt, Mycobacterium avium subsp. paratuberculosis
cguacauggugaccagcg

SEQ ID NO: 2942001 - RNA, 21 nt, Mycobacterium avium subsp. paratuberculosis
cguacauggugaccagcguga

SEQ ID NO: 2942002 - RNA, 21 nt, Mycobacterium avium subsp. paratuberculosis
cguaccaccaccagucggcgc

SEQ ID NO: 2942003 - RNA, 16 nt, Mycobacterium avium subsp. paratuberculosis
cguaccagcgcucgac

SEQ ID NO: 2942004 - RNA, 17 nt, Mycobacterium avium subsp. paratuberculosis
cguaccagcgcucgacg

SEQ ID NO: 2942005 - RNA, 23 nt, Mycobacterium avium subsp. paratuberculosis
cguaccagcgcucgacgaggcgg

SEQ ID NO: 2942006 - RNA, 22 nt, Mycobacterium avium subsp. paratuberculosis
cguaccagcugcccaccagcag

SEQ ID NO: 2942007 - RNA, 17 nt, Mycobacterium avium subsp. paratuberculosis
cguacccccgcacgcca

SEQ ID NO: 2942008 - RNA, 22 nt, Mycobacterium avium subsp. paratuberculosis
cguacccccgcacgccagcauc

SEQ ID NO: 2942009 - RNA, 12 nt, Mycobacterium avium subsp. paratuberculosis
cguacccgccca

SEQ ID NO: 2942010 - RNA, 21 nt, Mycobacterium avium subsp. paratuberculosis
cguacccgcccaugcacgauc

SEQ ID NO: 2942011 - RNA, 17 nt, Mycobacterium avium subsp. paratuberculosis
cguacccgggcaaugau

SEQ ID NO: 2942012 - RNA, 22 nt, Mycobacterium avium subsp. paratuberculosis
cguaccgaggaugaccgcggcg

SEQ ID NO: 2942013 - RNA, 16 nt, Mycobacterium avium subsp. paratuberculosis
cguaccgauccgcggg

SEQ ID NO: 2942014 - RNA, 14 nt, Mycobacterium avium subsp. paratuberculosis
cguaccgcaacacc

SEQ ID NO: 2942015 - RNA, 12 nt, Mycobacterium avium subsp. paratuberculosis
cguaccgcggcg

SEQ ID NO: 2942016 - RNA, 13 nt, Mycobacterium avium subsp. paratuberculosis
cguaccgcggcgg

SEQ ID NO: 2942017 - RNA, 18 nt, Mycobacterium avium subsp. paratuberculosis
cguaccgcggcggcgucg

SEQ ID NO: 2942018 - RNA, 19 nt, Mycobacterium avium subsp. paratuberculosis
cguaccgcggcggcgucga

SEQ ID NO: 2942019 - RNA, 20 nt, Mycobacterium avium subsp. paratuberculosis
cguaccgcggcggcgucgac

SEQ ID NO: 2942020 - RNA, 21 nt, Mycobacterium avium subsp. paratuberculosis
cguaccgcggcggcgucgacc

SEQ ID NO: 2942021 - RNA, 15 nt, Mycobacterium avium subsp. paratuberculosis
cguaccgcuuggccc

SEQ ID NO: 2942022 - RNA, 12 nt, Mycobacterium avium subsp. paratuberculosis
cguaccggcgua

SEQ ID NO: 2942023 - RNA, 18 nt, Mycobacterium avium subsp. paratuberculosis
cguaccgguacagcgacu

SEQ ID NO: 2942024 - RNA, 20 nt, Mycobacterium avium subsp. paratuberculosis
cguaccuagggcccacgcuc

SEQ ID NO: 2942025 - RNA, 20 nt, Mycobacterium avium subsp. paratuberculosis
cguacgacaucucgacggug

SEQ ID NO: 2942026 - RNA, 20 nt, Mycobacterium avium subsp. paratuberculosis
cguacgccgccuugacgccg

SEQ ID NO: 2942027 - RNA, 12 nt, Mycobacterium avium subsp. paratuberculosis
cguacgcgccgg

SEQ ID NO: 2942028 - RNA, 14 nt, Mycobacterium avium subsp. paratuberculosis
cguacgcgccggcc

SEQ ID NO: 2942029 - RNA, 20 nt, Mycobacterium avium subsp. paratuberculosis
cguacgcgccggccagccgg

SEQ ID NO: 2942030 - RNA, 14 nt, Mycobacterium avium subsp. paratuberculosis
cguacgcgcugccg

SEQ ID NO: 2942031 - RNA, 16 nt, Mycobacterium avium subsp. paratuberculosis
cguacgcgcugccgac

SEQ ID NO: 2942032 - RNA, 22 nt, Mycobacterium avium subsp. paratuberculosis
cguacggcccgggaagccgcag

SEQ ID NO: 2942033 - RNA, 17 nt, Mycobacterium avium subsp. paratuberculosis
cguacgggaugaucagc

SEQ ID NO: 2942034 - RNA, 20 nt, Mycobacterium avium subsp. paratuberculosis
cguacgggaugaucagcagg

SEQ ID NO: 2942035 - RNA, 21 nt, Mycobacterium avium subsp. paratuberculosis
cguacgggaugaucagcaggu

SEQ ID NO: 2942036 - RNA, 12 nt, Mycobacterium avium subsp. paratuberculosis
cguacgggcgca

SEQ ID NO: 2942037 - RNA, 15 nt, Mycobacterium avium subsp. paratuberculosis
cguacgggcgcagcg

SEQ ID NO: 2942038 - RNA, 18 nt, Mycobacterium avium subsp. paratuberculosis
cguacgggcgcagcgccg

SEQ ID NO: 2942039 - RNA, 20 nt, Mycobacterium avium subsp. paratuberculosis
cguacgggcgcagcgccguc

SEQ ID NO: 2942040 - RNA, 14 nt, Mycobacterium avium subsp. paratuberculosis
cguacgggcgggca

SEQ ID NO: 2942041 - RNA, 19 nt, Mycobacterium avium subsp. paratuberculosis
cguacggguugccgucgac

SEQ ID NO: 2942042 - RNA, 21 nt, Mycobacterium avium subsp. paratuberculosis
cguacggguugccgucgacga

SEQ ID NO: 2942043 - RNA, 20 nt, Mycobacterium avium subsp. paratuberculosis
cguacggguugggcggggcg

SEQ ID NO: 2942044 - RNA, 23 nt, Mycobacterium avium subsp. paratuberculosis
cguacggguugggcggggcgucg

SEQ ID NO: 2942045 - RNA, 23 nt, Mycobacterium avium subsp. paratuberculosis
cguacucccaggauuccgucggc

SEQ ID NO: 2942046 - RNA, 24 nt, Mycobacterium avium subsp. paratuberculosis
cguacucccaggauuccgucggcg

SEQ ID NO: 2942047 - RNA, 19 nt, Mycobacterium avium subsp. paratuberculosis
cguacucccaggccgcggc

SEQ ID NO: 2942048 - RNA, 14 nt, Mycobacterium avium subsp. paratuberculosis
cguacuccgacaga

SEQ ID NO: 2942049 - RNA, 18 nt, Mycobacterium avium subsp. paratuberculosis
cguacucgugggccacca

SEQ ID NO: 2942050 - RNA, 14 nt, Mycobacterium avium subsp. paratuberculosis
cguacugcgcgacc

SEQ ID NO: 2942051 - RNA, 14 nt, Mycobacterium avium subsp. paratuberculosis
cguacuggcgccgg

SEQ ID NO: 2942052 - RNA, 19 nt, Mycobacterium avium subsp. paratuberculosis
cguagaaccggcccagcag

SEQ ID NO: 2942053 - RNA, 14 nt, Mycobacterium avium subsp. paratuberculosis
cguaggcggccagc

SEQ ID NO: 2942054 - RNA, 17 nt, Mycobacterium avium subsp. paratuberculosis
cguaggcggccagcagc

SEQ ID NO: 2942055 - RNA, 19 nt, Mycobacterium avium subsp. paratuberculosis
cguaggcggccagcagcac

SEQ ID NO: 2942056 - RNA, 18 nt, Mycobacterium avium subsp. paratuberculosis
cguagggacugcgccggg

SEQ ID NO: 2942057 - RNA, 20 nt, Mycobacterium avium subsp. paratuberculosis
cguagggcagcccgagcaac

SEQ ID NO: 2942058 - RNA, 15 nt, Mycobacterium avium subsp. paratuberculosis
cguagggcucggcgu

SEQ ID NO: 2942059 - RNA, 17 nt, Mycobacterium avium subsp. paratuberculosis
cguaggguucgccgaug

SEQ ID NO: 2942060 - RNA, 16 nt, Mycobacterium avium subsp. paratuberculosis
cguaggugagcaacgc

SEQ ID NO: 2942061 - RNA, 19 nt, Mycobacterium avium subsp. paratuberculosis
cguaggugagcaacgccag

SEQ ID NO: 2942062 - RNA, 22 nt, Mycobacterium avium subsp. paratuberculosis
cguaggugagcaacgccagcgc

SEQ ID NO: 2942063 - RNA, 22 nt, Mycobacterium avium subsp. paratuberculosis
cguaggugcacagcccgugcag

SEQ ID NO: 2942064 - RNA, 17 nt, Mycobacterium avium subsp. paratuberculosis
cguagguggccagcacg

SEQ ID NO: 2942065 - RNA, 16 nt, Mycobacterium avium subsp. paratuberculosis
cguaggugggcagcgc

SEQ ID NO: 2942066 - RNA, 21 nt, Mycobacterium avium subsp. paratuberculosis
cguaggugggcagcgcggcca

SEQ ID NO: 2942067 - RNA, 23 nt, Mycobacterium avium subsp. paratuberculosis
cguaggugggcagcgcggccagc

SEQ ID NO: 2942068 - RNA, 15 nt, Mycobacterium avium subsp. paratuberculosis
cguaguagcggauca

SEQ ID NO: 2942069 - RNA, 15 nt, Mycobacterium avium subsp. paratuberculosis
cguaguaggcgccga

SEQ ID NO: 2942070 - RNA, 16 nt, Mycobacterium avium subsp. paratuberculosis
cguaguaggcgccgaa

SEQ ID NO: 2942071 - RNA, 15 nt, Mycobacterium avium subsp. paratuberculosis
cguaguaggugcgcg

SEQ ID NO: 2942072 - RNA, 19 nt, Mycobacterium avium subsp. paratuberculosis
cguaguaggugcgcgagga

SEQ ID NO: 2942073 - RNA, 20 nt, Mycobacterium avium subsp. paratuberculosis
cguaguaggugcgcgaggag

SEQ ID NO: 2942074 - RNA, 14 nt, Mycobacterium avium subsp. paratuberculosis
cguaguccagcacg

SEQ ID NO: 2942075 - RNA, 19 nt, Mycobacterium avium subsp. paratuberculosis
cguaguccgacgauccggg

SEQ ID NO: 2942076 - RNA, 23 nt, Mycobacterium avium subsp. paratuberculosis
cguaguccgacgauccgggccgg

SEQ ID NO: 2942077 - RNA, 18 nt, Mycobacterium avium subsp. paratuberculosis
cguagucgaccgggaucg

SEQ ID NO: 2942078 - RNA, 19 nt, Mycobacterium avium subsp. paratuberculosis
cguagucgauggccucguc

SEQ ID NO: 2942079 - RNA, 21 nt, Mycobacterium avium subsp. paratuberculosis
cguagucgauggccucgucgc

SEQ ID NO: 2942080 - RNA, 22 nt, Mycobacterium avium subsp. paratuberculosis
cguagucgauggccucgucgcg

SEQ ID NO: 2942081 - RNA, 14 nt, Mycobacterium avium subsp. paratuberculosis
cguagucgccggug

SEQ ID NO: 2942082 - RNA, 19 nt, Mycobacterium avium subsp. paratuberculosis
cguagucgcgcaccauccg

SEQ ID NO: 2942083 - RNA, 14 nt, Mycobacterium avium subsp. paratuberculosis
cguagucgcucggc

SEQ ID NO: 2942084 - RNA, 17 nt, Mycobacterium avium subsp. paratuberculosis
cguagucgcucggcggc

SEQ ID NO: 2942085 - RNA, 19 nt, Mycobacterium avium subsp. paratuberculosis
cguagucgcucggcggcga

SEQ ID NO: 2942086 - RNA, 21 nt, Mycobacterium avium subsp. paratuberculosis
cguagucgcucggcggcgacg

SEQ ID NO: 2942087 - RNA, 15 nt, Mycobacterium avium subsp. paratuberculosis
cguagucgcugagcg

SEQ ID NO: 2942088 - RNA, 16 nt, Mycobacterium avium subsp. paratuberculosis
cguagucggcccgccg

SEQ ID NO: 2942089 - RNA, 19 nt, Mycobacterium avium subsp. paratuberculosis
cguagucggcccgccgggc

SEQ ID NO: 2942090 - RNA, 21 nt, Mycobacterium avium subsp. paratuberculosis
cguagucggcccgccgggccg

SEQ ID NO: 2942091 - RNA, 22 nt, Mycobacterium avium subsp. paratuberculosis
cguagucggcccgccgggccgg

SEQ ID NO: 2942092 - RNA, 16 nt, Mycobacterium avium subsp. paratuberculosis
cguagucggcgcagcg

SEQ ID NO: 2942093 - RNA, 17 nt, Mycobacterium avium subsp. paratuberculosis
cguagucggcgcagcgc

SEQ ID NO: 2942094 - RNA, 12 nt, Mycobacterium avium subsp. paratuberculosis
cguagucggcgg

SEQ ID NO: 2942095 - RNA, 15 nt, Mycobacterium avium subsp. paratuberculosis
cguagucggcggcga

SEQ ID NO: 2942096 - RNA, 18 nt, Mycobacterium avium subsp. paratuberculosis
cguagucggcgucggcca

SEQ ID NO: 2942097 - RNA, 13 nt, Mycobacterium avium subsp. paratuberculosis
cguagucgucgau

SEQ ID NO: 2942098 - RNA, 19 nt, Mycobacterium avium subsp. paratuberculosis
cguagucguugucggcggu

SEQ ID NO: 2942099 - RNA, 14 nt, Mycobacterium avium subsp. paratuberculosis
cguagugcucggcg

SEQ ID NO: 2942100 - RNA, 21 nt, Mycobacterium avium subsp. paratuberculosis
cguagugcucggcgucccgcg

SEQ ID NO: 2942101 - RNA, 16 nt, Mycobacterium avium subsp. paratuberculosis
cguagugggucggcgg

SEQ ID NO: 2942102 - RNA, 17 nt, Mycobacterium avium subsp. paratuberculosis
cguagugggucggcggc

SEQ ID NO: 2942103 - RNA, 18 nt, Mycobacterium avium subsp. paratuberculosis
cguagugggucggcggcu

SEQ ID NO: 2942104 - RNA, 15 nt, Mycobacterium avium subsp. paratuberculosis
cguaguucgucgaac

SEQ ID NO: 2942105 - RNA, 16 nt, Mycobacterium avium subsp. paratuberculosis
cguaguugcgcgccga

SEQ ID NO: 2942106 - RNA, 15 nt, Mycobacterium avium subsp. paratuberculosis
cguaguugcggccgg

SEQ ID NO: 2942107 - RNA, 19 nt, Mycobacterium avium subsp. paratuberculosis
cguaguugcggccggcggu

SEQ ID NO: 2942108 - RNA, 20 nt, Mycobacterium avium subsp. paratuberculosis
cguaguugcggccggcggug

SEQ ID NO: 2942109 - RNA, 16 nt, Mycobacterium avium subsp. paratuberculosis
cguaguuggggccggc

SEQ ID NO: 2942110 - RNA, 19 nt, Mycobacterium avium subsp. paratuberculosis
cguaguuggggccggccgc

SEQ ID NO: 2942111 - RNA, 21 nt, Mycobacterium avium subsp. paratuberculosis
cguaguuggggccggccgccc

SEQ ID NO: 2942112 - RNA, 21 nt, Mycobacterium avium subsp. paratuberculosis
cguauacgccagaugcgccgc

SEQ ID NO: 2942113 - RNA, 20 nt, Mycobacterium avium subsp. paratuberculosis
cguaucaacugagcgcccgg

SEQ ID NO: 2942114 - RNA, 23 nt, Mycobacterium avium subsp. paratuberculosis
cguaucaacugagcgcccggucg

SEQ ID NO: 2942115 - RNA, 17 nt, Mycobacterium avium subsp. paratuberculosis
cguauccgcggucgacc

SEQ ID NO: 2942116 - RNA, 14 nt, Mycobacterium avium subsp. paratuberculosis
cguauccggccagc

SEQ ID NO: 2942117 - RNA, 15 nt, Mycobacterium avium subsp. paratuberculosis
cguaucgcgccugca

SEQ ID NO: 2942118 - RNA, 18 nt, Mycobacterium avium subsp. paratuberculosis
cguaucgcgccugcaccg

SEQ ID NO: 2942119 - RNA, 16 nt, Mycobacterium avium subsp. paratuberculosis
cguaucuccaccgucg

SEQ ID NO: 2942120 - RNA, 19 nt, Mycobacterium avium subsp. paratuberculosis
cguaucuccaccgucgaug

SEQ ID NO: 2942121 - RNA, 13 nt, Mycobacterium avium subsp. paratuberculosis
cguauucgacggc

SEQ ID NO: 2942122 - RNA, 17 nt, Mycobacterium avium subsp. paratuberculosis
cguauucgacggcgacc

SEQ ID NO: 2942123 - RNA, 14 nt, Mycobacterium avium subsp. paratuberculosis
cguauucgccgacg

SEQ ID NO: 2942124 - RNA, 15 nt, Mycobacterium avium subsp. paratuberculosis
cguauucggcgcgca

SEQ ID NO: 2942125 - RNA, 17 nt, Mycobacterium avium subsp. paratuberculosis
cguauucgucgucggcc

SEQ ID NO: 2942126 - RNA, 17 nt, Mycobacterium avium subsp. paratuberculosis
cguauugcacggcggcg

SEQ ID NO: 2942127 - RNA, 17 nt, Mycobacterium avium subsp. paratuberculosis
cguauugccgucggcgu

SEQ ID NO: 2942128 - RNA, 15 nt, Mycobacterium avium subsp. paratuberculosis
cguauuggcaggcga

SEQ ID NO: 2942129 - RNA, 14 nt, Mycobacterium avium subsp. paratuberculosis
cguauuguccuguc

SEQ ID NO: 2942130 - RNA, 17 nt, Mycobacterium avium subsp. paratuberculosis
cgucaacaccguggugg

SEQ ID NO: 2942131 - RNA, 17 nt, Mycobacterium avium subsp. paratuberculosis
cgucaaccaccggcauc

SEQ ID NO: 2942132 - RNA, 22 nt, Mycobacterium avium subsp. paratuberculosis
cgucaacccguuccacaucagg

SEQ ID NO: 2942133 - RNA, 15 nt, Mycobacterium avium subsp. paratuberculosis
cgucaacgacccgga

SEQ ID NO: 2942134 - RNA, 23 nt, Mycobacterium avium subsp. paratuberculosis
cgucaacgccccggucgugucau

SEQ ID NO: 2942135 - RNA, 18 nt, Mycobacterium avium subsp. paratuberculosis
cgucacauccgucacgcc

SEQ ID NO: 2942136 - RNA, 17 nt, Mycobacterium avium subsp. paratuberculosis
cgucaccaaugcgccgg

SEQ ID NO: 2942137 - RNA, 18 nt, Mycobacterium avium subsp. paratuberculosis
cgucacugcccagccauc

SEQ ID NO: 2942138 - RNA, 15 nt, Mycobacterium avium subsp. paratuberculosis
cgucacugucggcgc

SEQ ID NO: 2942139 - RNA, 16 nt, Mycobacterium avium subsp. paratuberculosis
cgucacugucggcgcg

SEQ ID NO: 2942140 - RNA, 17 nt, Mycobacterium avium subsp. paratuberculosis
cgucacugucggcgcgg

SEQ ID NO: 2942141 - RNA, 20 nt, Mycobacterium avium subsp. paratuberculosis
cgucacugucggcgcggacg

SEQ ID NO: 2942142 - RNA, 21 nt, Mycobacterium avium subsp. paratuberculosis
cgucacugucggcgcggacgu

SEQ ID NO: 2942143 - RNA, 16 nt, Mycobacterium avium subsp. paratuberculosis
cgucacuucgccgggc

SEQ ID NO: 2942144 - RNA, 21 nt, Mycobacterium avium subsp. paratuberculosis
cgucacuucgccgggcuggcc

SEQ ID NO: 2942145 - RNA, 19 nt, Mycobacterium avium subsp. paratuberculosis
cgucagaaccggggccagc

SEQ ID NO: 2942146 - RNA, 22 nt, Mycobacterium avium subsp. paratuberculosis
cgucagaaccggggccagcacg

SEQ ID NO: 2942147 - RNA, 13 nt, Mycobacterium avium subsp. paratuberculosis
cgucagcaccgcg

SEQ ID NO: 2942148 - RNA, 15 nt, Mycobacterium avium subsp. paratuberculosis
cgucagcaccgcgac

SEQ ID NO: 2942149 - RNA, 20 nt, Mycobacterium avium subsp. paratuberculosis
cgucagcaccgcgacgguga

SEQ ID NO: 2942150 - RNA, 21 nt, Mycobacterium avium subsp. paratuberculosis
cgucagcaccgcgacggugag

SEQ ID NO: 2942151 - RNA, 18 nt, Mycobacterium avium subsp. paratuberculosis
cgucagcaccgugggccc

SEQ ID NO: 2942152 - RNA, 14 nt, Mycobacterium avium subsp. paratuberculosis
cgucagcagcgcga

SEQ ID NO: 2942153 - RNA, 16 nt, Mycobacterium avium subsp. paratuberculosis
cgucagcagggccucg

SEQ ID NO: 2942154 - RNA, 17 nt, Mycobacterium avium subsp. paratuberculosis
cgucagcagggccucgc

SEQ ID NO: 2942155 - RNA, 19 nt, Mycobacterium avium subsp. paratuberculosis
cgucagccagguguagacc

SEQ ID NO: 2942156 - RNA, 19 nt, Mycobacterium avium subsp. paratuberculosis
cgucagccccuuaccggcc

SEQ ID NO: 2942157 - RNA, 15 nt, Mycobacterium avium subsp. paratuberculosis
cgucagccgggccag

SEQ ID NO: 2942158 - RNA, 22 nt, Mycobacterium avium subsp. paratuberculosis
cgucagccgggccagcccggga

SEQ ID NO: 2942159 - RNA, 12 nt, Mycobacterium avium subsp. paratuberculosis
cgucagcgccgc

SEQ ID NO: 2942160 - RNA, 17 nt, Mycobacterium avium subsp. paratuberculosis
cgucagcgccgcccgca

SEQ ID NO: 2942161 - RNA, 15 nt, Mycobacterium avium subsp. paratuberculosis
cgucagcgcgggcca

SEQ ID NO: 2942162 - RNA, 16 nt, Mycobacterium avium subsp. paratuberculosis
cgucagcgcgggccag

SEQ ID NO: 2942163 - RNA, 19 nt, Mycobacterium avium subsp. paratuberculosis
cgucagcgcgggccagcag

SEQ ID NO: 2942164 - RNA, 17 nt, Mycobacterium avium subsp. paratuberculosis
cgucagcgucagcacgu

SEQ ID NO: 2942165 - RNA, 21 nt, Mycobacterium avium subsp. paratuberculosis
cgucagcuaggaagccagccg

SEQ ID NO: 2942166 - RNA, 19 nt, Mycobacterium avium subsp. paratuberculosis
cgucagcucccccgacacc

SEQ ID NO: 2942167 - RNA, 22 nt, Mycobacterium avium subsp. paratuberculosis
cgucagcucccccgacaccgcc

SEQ ID NO: 2942168 - RNA, 19 nt, Mycobacterium avium subsp. paratuberculosis
cgucaggaacgccggcuug

SEQ ID NO: 2942169 - RNA, 23 nt, Mycobacterium avium subsp. paratuberculosis
cgucaggaaugcgacgacgucgu

SEQ ID NO: 2942170 - RNA, 18 nt, Mycobacterium avium subsp. paratuberculosis
cgucaggagugcucggcg

SEQ ID NO: 2942171 - RNA, 12 nt, Mycobacterium avium subsp. paratuberculosis
cgucaggccggu

SEQ ID NO: 2942172 - RNA, 22 nt, Mycobacterium avium subsp. paratuberculosis
cgucaggccguagcggcucgcc

SEQ ID NO: 2942173 - RNA, 17 nt, Mycobacterium avium subsp. paratuberculosis
cgucagggcgacuccgg

SEQ ID NO: 2942174 - RNA, 18 nt, Mycobacterium avium subsp. paratuberculosis
cgucagggguuggcgcgc

SEQ ID NO: 2942175 - RNA, 21 nt, Mycobacterium avium subsp. paratuberculosis
cgucagggguuggcgcgcaga

SEQ ID NO: 2942176 - RNA, 19 nt, Mycobacterium avium subsp. paratuberculosis
cgucagggugacguggcgg

SEQ ID NO: 2942177 - RNA, 23 nt, Mycobacterium avium subsp. paratuberculosis
cgucaggguggccucgucggcgc

SEQ ID NO: 2942178 - RNA, 19 nt, Mycobacterium avium subsp. paratuberculosis
cgucaggguggugcccccg

SEQ ID NO: 2942179 - RNA, 15 nt, Mycobacterium avium subsp. paratuberculosis
cgucaggucaccgag

SEQ ID NO: 2942180 - RNA, 16 nt, Mycobacterium avium subsp. paratuberculosis
cgucaggucaccgagc

SEQ ID NO: 2942181 - RNA, 16 nt, Mycobacterium avium subsp. paratuberculosis
cgucagguccgcgaac

SEQ ID NO: 2942182 - RNA, 13 nt, Mycobacterium avium subsp. paratuberculosis
cgucaggucgacc

SEQ ID NO: 2942183 - RNA, 19 nt, Mycobacterium avium subsp. paratuberculosis
cgucaggucgaccggcucg

SEQ ID NO: 2942184 - RNA, 22 nt, Mycobacterium avium subsp. paratuberculosis
cgucaggucgcgguagucggga

SEQ ID NO: 2942185 - RNA, 19 nt, Mycobacterium avium subsp. paratuberculosis
cgucaggucuucggucgcg

SEQ ID NO: 2942186 - RNA, 23 nt, Mycobacterium avium subsp. paratuberculosis
cgucaggucuucggucgcgaccc

SEQ ID NO: 2942187 - RNA, 13 nt, Mycobacterium avium subsp. paratuberculosis
cgucagguucgag

SEQ ID NO: 2942188 - RNA, 16 nt, Mycobacterium avium subsp. paratuberculosis
cgucaguucguagauc

SEQ ID NO: 2942189 - RNA, 22 nt, Mycobacterium avium subsp. paratuberculosis
cgucaguucguagaucacggcg

SEQ ID NO: 2942190 - RNA, 13 nt, Mycobacterium avium subsp. paratuberculosis
cgucaucaccgcc

SEQ ID NO: 2942191 - RNA, 14 nt, Mycobacterium avium subsp. paratuberculosis
cgucaucaccgccg

SEQ ID NO: 2942192 - RNA, 16 nt, Mycobacterium avium subsp. paratuberculosis
cgucaucacgugcugg

SEQ ID NO: 2942193 - RNA, 19 nt, Mycobacterium avium subsp. paratuberculosis
cgucaucacgugcuggcgc

SEQ ID NO: 2942194 - RNA, 20 nt, Mycobacterium avium subsp. paratuberculosis
cgucaucaucaccgggaugg

SEQ ID NO: 2942195 - RNA, 19 nt, Mycobacterium avium subsp. paratuberculosis
cgucauccccaucucgagc

SEQ ID NO: 2942196 - RNA, 16 nt, Mycobacterium avium subsp. paratuberculosis
cgucaucccccgcagc

SEQ ID NO: 2942197 - RNA, 16 nt, Mycobacterium avium subsp. paratuberculosis
cgucauccccuggccg

SEQ ID NO: 2942198 - RNA, 13 nt, Mycobacterium avium subsp. paratuberculosis
cgucauccggcug

SEQ ID NO: 2942199 - RNA, 16 nt, Mycobacterium avium subsp. paratuberculosis
cgucauccggcugccc

SEQ ID NO: 2942200 - RNA, 18 nt, Mycobacterium avium subsp. paratuberculosis
cgucaucgacuugccgcc

SEQ ID NO: 2942201 - RNA, 19 nt, Mycobacterium avium subsp. paratuberculosis
cgucaucgacuugccgccg

SEQ ID NO: 2942202 - RNA, 13 nt, Mycobacterium avium subsp. paratuberculosis
cgucaucgccgac

SEQ ID NO: 2942203 - RNA, 17 nt, Mycobacterium avium subsp. paratuberculosis
cgucaucgccgacggug

SEQ ID NO: 2942204 - RNA, 18 nt, Mycobacterium avium subsp. paratuberculosis
cgucaucgccgacgguga

SEQ ID NO: 2942205 - RNA, 14 nt, Mycobacterium avium subsp. paratuberculosis
cgucaucgcggcga

SEQ ID NO: 2942206 - RNA, 16 nt, Mycobacterium avium subsp. paratuberculosis
cgucaucggcucgauc

SEQ ID NO: 2942207 - RNA, 15 nt, Mycobacterium avium subsp. paratuberculosis
cgucaucgggcccga

SEQ ID NO: 2942208 - RNA, 16 nt, Mycobacterium avium subsp. paratuberculosis
cgucaucgggcccgac

SEQ ID NO: 2942209 - RNA, 16 nt, Mycobacterium avium subsp. paratuberculosis
cgucaucgugugggcg

SEQ ID NO: 2942210 - RNA, 13 nt, Mycobacterium avium subsp. paratuberculosis
cgucaucuugucg

SEQ ID NO: 2942211 - RNA, 22 nt, Mycobacterium avium subsp. paratuberculosis
cgucaugccguaaguggcgccg

SEQ ID NO: 2942212 - RNA, 20 nt, Mycobacterium avium subsp. paratuberculosis
cgucaugccuuggccguagg

SEQ ID NO: 2942213 - RNA, 14 nt, Mycobacterium avium subsp. paratuberculosis
cgucauggacagcc

SEQ ID NO: 2942214 - RNA, 19 nt, Mycobacterium avium subsp. paratuberculosis
cgucauggacagccaccgu

SEQ ID NO: 2942215 - RNA, 23 nt, Mycobacterium avium subsp. paratuberculosis
cgucauggacagccaccgugccu

SEQ ID NO: 2942216 - RNA, 17 nt, Mycobacterium avium subsp. paratuberculosis
cgucauggagaucaccg

SEQ ID NO: 2942217 - RNA, 19 nt, Mycobacterium avium subsp. paratuberculosis
cgucauggagaucaccgcg

SEQ ID NO: 2942218 - RNA, 19 nt, Mycobacterium avium subsp. paratuberculosis
cgucauggccgucgggucg

SEQ ID NO: 2942219 - RNA, 23 nt, Mycobacterium avium subsp. paratuberculosis
cgucauggccgucgggucggcga

SEQ ID NO: 2942220 - RNA, 16 nt, Mycobacterium avium subsp. paratuberculosis
cgucauuucggucggc

SEQ ID NO: 2942221 - RNA, 15 nt, Mycobacterium avium subsp. paratuberculosis
cguccagcugggcug

SEQ ID NO: 2942222 - RNA, 18 nt, Mycobacterium avium subsp. paratuberculosis
cguccagcuucucggcgu

SEQ ID NO: 2942223 - RNA, 14 nt, Mycobacterium avium subsp. paratuberculosis
cguccaggaugagc

SEQ ID NO: 2942224 - RNA, 22 nt, Mycobacterium avium subsp. paratuberculosis
cguccaggaugagcugggcggc

SEQ ID NO: 2942225 - RNA, 13 nt, Mycobacterium avium subsp. paratuberculosis
cguccaggccgcu

SEQ ID NO: 2942226 - RNA, 14 nt, Mycobacterium avium subsp. paratuberculosis
cguccaggccgcug

SEQ ID NO: 2942227 - RNA, 18 nt, Mycobacterium avium subsp. paratuberculosis
cguccaggccggcgccgc

SEQ ID NO: 2942228 - RNA, 21 nt, Mycobacterium avium subsp. paratuberculosis
cguccaggcgcaccgccaccg

SEQ ID NO: 2942229 - RNA, 22 nt, Mycobacterium avium subsp. paratuberculosis
cguccaggcgcaccgccaccgc

SEQ ID NO: 2942230 - RNA, 13 nt, Mycobacterium avium subsp. paratuberculosis
cguccagggccac

SEQ ID NO: 2942231 - RNA, 15 nt, Mycobacterium avium subsp. paratuberculosis
cguccagggccaccg

SEQ ID NO: 2942232 - RNA, 16 nt, Mycobacterium avium subsp. paratuberculosis
cguccagggccaccgc

SEQ ID NO: 2942233 - RNA, 17 nt, Mycobacterium avium subsp. paratuberculosis
cguccagggccaccgcg

SEQ ID NO: 2942234 - RNA, 20 nt, Mycobacterium avium subsp. paratuberculosis
cguccaggguggccagcacg

SEQ ID NO: 2942235 - RNA, 15 nt, Mycobacterium avium subsp. paratuberculosis
cguccaggucgcccu

SEQ ID NO: 2942236 - RNA, 16 nt, Mycobacterium avium subsp. paratuberculosis
cguccaggucgcccuc

SEQ ID NO: 2942237 - RNA, 17 nt, Mycobacterium avium subsp. paratuberculosis
cguccaggucgcccucg

SEQ ID NO: 2942238 - RNA, 18 nt, Mycobacterium avium subsp. paratuberculosis
cguccaggucgcccucga

SEQ ID NO: 2942239 - RNA, 21 nt, Mycobacterium avium subsp. paratuberculosis
cguccaggugcacccgcggcg

SEQ ID NO: 2942240 - RNA, 18 nt, Mycobacterium avium subsp. paratuberculosis
cguccaggugcgccgccg

SEQ ID NO: 2942241 - RNA, 20 nt, Mycobacterium avium subsp. paratuberculosis
cguccaggugcgccgccgcg

SEQ ID NO: 2942242 - RNA, 22 nt, Mycobacterium avium subsp. paratuberculosis
cguccaggugcgccgccgcguc

SEQ ID NO: 2942243 - RNA, 14 nt, Mycobacterium avium subsp. paratuberculosis
cguccaguagccgc

SEQ ID NO: 2942244 - RNA, 16 nt, Mycobacterium avium subsp. paratuberculosis
cguccaguagccgccg

SEQ ID NO: 2942245 - RNA, 17 nt, Mycobacterium avium subsp. paratuberculosis
cguccaguagccgccgg

SEQ ID NO: 2942246 - RNA, 23 nt, Mycobacterium avium subsp. paratuberculosis
cguccaguagccgccgggcguag

SEQ ID NO: 2942247 - RNA, 16 nt, Mycobacterium avium subsp. paratuberculosis
cguccaguccggcgug

SEQ ID NO: 2942248 - RNA, 17 nt, Mycobacterium avium subsp. paratuberculosis
cguccaguccggcgugc

SEQ ID NO: 2942249 - RNA, 15 nt, Mycobacterium avium subsp. paratuberculosis
cguccagucgauguc

SEQ ID NO: 2942250 - RNA, 22 nt, Mycobacterium avium subsp. paratuberculosis
cguccagucgaugucgguggcg

SEQ ID NO: 2942251 - RNA, 20 nt, Mycobacterium avium subsp. paratuberculosis
cguccagugacgccugcggc

SEQ ID NO: 2942252 - RNA, 23 nt, Mycobacterium avium subsp. paratuberculosis
cguccagugacgccugcggccca

SEQ ID NO: 2942253 - RNA, 20 nt, Mycobacterium avium subsp. paratuberculosis
cguccaguucggccagcgcg

SEQ ID NO: 2942254 - RNA, 24 nt, Mycobacterium avium subsp. paratuberculosis
cguccaguugcggcacgccgacca

SEQ ID NO: 2942255 - RNA, 24 nt, Mycobacterium avium subsp. paratuberculosis
cguccauaccccccacgcucggcg

SEQ ID NO: 2942256 - RNA, 15 nt, Mycobacterium avium subsp. paratuberculosis
cguccaucauggcgc

SEQ ID NO: 2942257 - RNA, 19 nt, Mycobacterium avium subsp. paratuberculosis
cguccaucauggcgcugcg

SEQ ID NO: 2942258 - RNA, 14 nt, Mycobacterium avium subsp. paratuberculosis
cguccaucgccgcg

SEQ ID NO: 2942259 - RNA, 16 nt, Mycobacterium avium subsp. paratuberculosis
cguccaucgccgcgca

SEQ ID NO: 2942260 - RNA, 15 nt, Mycobacterium avium subsp. paratuberculosis
cguccaucgggaccg

SEQ ID NO: 2942261 - RNA, 17 nt, Mycobacterium avium subsp. paratuberculosis
cguccaucguccucgcg

SEQ ID NO: 2942262 - RNA, 23 nt, Mycobacterium avium subsp. paratuberculosis
cguccaugaaccacugcggcaga

SEQ ID NO: 2942263 - RNA, 15 nt, Mycobacterium avium subsp. paratuberculosis
cguccaugcccgccc

SEQ ID NO: 2942264 - RNA, 17 nt, Mycobacterium avium subsp. paratuberculosis
cguccaugcccgcccac

SEQ ID NO: 2942265 - RNA, 20 nt, Mycobacterium avium subsp. paratuberculosis
cguccaugcucuugcgggcg

SEQ ID NO: 2942266 - RNA, 21 nt, Mycobacterium avium subsp. paratuberculosis
cguccaugcucuugcgggcgg

SEQ ID NO: 2942267 - RNA, 14 nt, Mycobacterium avium subsp. paratuberculosis
cguccaugcuggug

SEQ ID NO: 2942268 - RNA, 20 nt, Mycobacterium avium subsp. paratuberculosis
cguccaugcuggugccgccg

SEQ ID NO: 2942269 - RNA, 15 nt, Mycobacterium avium subsp. paratuberculosis
cguccauggucgagc

SEQ ID NO: 2942270 - RNA, 18 nt, Mycobacterium avium subsp. paratuberculosis
cguccauggucgagccgc

SEQ ID NO: 2942271 - RNA, 20 nt, Mycobacterium avium subsp. paratuberculosis
cguccauggucgagccgcag

SEQ ID NO: 2942272 - RNA, 21 nt, Mycobacterium avium subsp. paratuberculosis
cguccauguaguucagcagcc

SEQ ID NO: 2942273 - RNA, 22 nt, Mycobacterium avium subsp. paratuberculosis
cguccauguaguucagcagccg

SEQ ID NO: 2942274 - RNA, 22 nt, Mycobacterium avium subsp. paratuberculosis
cgucccacacgggugugacauc

SEQ ID NO: 2942275 - RNA, 17 nt, Mycobacterium avium subsp. paratuberculosis
cgucccagcacaacgcc

SEQ ID NO: 2942276 - RNA, 20 nt, Mycobacterium avium subsp. paratuberculosis
cgucccagcgcaacggcguc

SEQ ID NO: 2942277 - RNA, 22 nt, Mycobacterium avium subsp. paratuberculosis
cgucccagcgcaacggcgucga

SEQ ID NO: 2942278 - RNA, 19 nt, Mycobacterium avium subsp. paratuberculosis
cgucccaggguugccgcac

SEQ ID NO: 2942279 - RNA, 14 nt, Mycobacterium avium subsp. paratuberculosis
cguccccaccaccg

SEQ ID NO: 2942280 - RNA, 13 nt, Mycobacterium avium subsp. paratuberculosis
cguccccgcgcgg

SEQ ID NO: 2942281 - RNA, 16 nt, Mycobacterium avium subsp. paratuberculosis
cguccccgggcgugcc

SEQ ID NO: 2942282 - RNA, 17 nt, Mycobacterium avium subsp. paratuberculosis
cguccccgggcgugccg

SEQ ID NO: 2942283 - RNA, 16 nt, Mycobacterium avium subsp. paratuberculosis
cguccccgugcagccg

SEQ ID NO: 2942284 - RNA, 20 nt, Mycobacterium avium subsp. paratuberculosis
cguccccgugcagccgggcc

SEQ ID NO: 2942285 - RNA, 13 nt, Mycobacterium avium subsp. paratuberculosis
cgucccgcccggc

SEQ ID NO: 2942286 - RNA, 15 nt, Mycobacterium avium subsp. paratuberculosis
cgucccgcccggcgc

SEQ ID NO: 2942287 - RNA, 16 nt, Mycobacterium avium subsp. paratuberculosis
cgucccgcccggcgcc

SEQ ID NO: 2942288 - RNA, 17 nt, Mycobacterium avium subsp. paratuberculosis
cgucccgcccggcgccg

SEQ ID NO: 2942289 - RNA, 19 nt, Mycobacterium avium subsp. paratuberculosis
cgucccgcccggcgccggc

SEQ ID NO: 2942290 - RNA, 13 nt, Mycobacterium avium subsp. paratuberculosis
cgucccgcgccac

SEQ ID NO: 2942291 - RNA, 14 nt, Mycobacterium avium subsp. paratuberculosis
cgucccgcgccgga

SEQ ID NO: 2942292 - RNA, 23 nt, Mycobacterium avium subsp. paratuberculosis
cgucccgcgcgggggccgccgcg

SEQ ID NO: 2942293 - RNA, 20 nt, Mycobacterium avium subsp. paratuberculosis
cgucccgcucgaucuggcgg

SEQ ID NO: 2942294 - RNA, 23 nt, Mycobacterium avium subsp. paratuberculosis
cgucccgcucgaucuggcggacc

SEQ ID NO: 2942295 - RNA, 16 nt, Mycobacterium avium subsp. paratuberculosis
cgucccggacgcugcg

SEQ ID NO: 2942296 - RNA, 17 nt, Mycobacterium avium subsp. paratuberculosis
cgucccggacgcugcgg

SEQ ID NO: 2942297 - RNA, 21 nt, Mycobacterium avium subsp. paratuberculosis
cgucccggcccauggcgaaca

SEQ ID NO: 2942298 - RNA, 22 nt, Mycobacterium avium subsp. paratuberculosis
cgucccgggccuuggccaacgc

SEQ ID NO: 2942299 - RNA, 19 nt, Mycobacterium avium subsp. paratuberculosis
cgucccggugucgccgucg

SEQ ID NO: 2942300 - RNA, 19 nt, Mycobacterium avium subsp. paratuberculosis
cgucccgguugaccccggc

SEQ ID NO: 2942301 - RNA, 22 nt, Mycobacterium avium subsp. paratuberculosis
cgucccgguugaccccggcccc

SEQ ID NO: 2942302 - RNA, 23 nt, Mycobacterium avium subsp. paratuberculosis
cgucccgguugaccccggccccg

SEQ ID NO: 2942303 - RNA, 18 nt, Mycobacterium avium subsp. paratuberculosis
cgucccgucacggcugcc

SEQ ID NO: 2942304 - RNA, 21 nt, Mycobacterium avium subsp. paratuberculosis
cgucccgucacggcugccgac

SEQ ID NO: 2942305 - RNA, 14 nt, Mycobacterium avium subsp. paratuberculosis
cguccggguccggc

SEQ ID NO: 2942306 - RNA, 16 nt, Mycobacterium avium subsp. paratuberculosis
cguccggguccggcuu

SEQ ID NO: 2942307 - RNA, 22 nt, Mycobacterium avium subsp. paratuberculosis
cguccgggucgcacagccgcag

SEQ ID NO: 2942308 - RNA, 17 nt, Mycobacterium avium subsp. paratuberculosis
cguccgggugcgggcug

SEQ ID NO: 2942309 - RNA, 21 nt, Mycobacterium avium subsp. paratuberculosis
cguccggguucgacgccucgg

SEQ ID NO: 2942310 - RNA, 20 nt, Mycobacterium avium subsp. paratuberculosis
cguccgguaggugaucgccu

SEQ ID NO: 2942311 - RNA, 14 nt, Mycobacterium avium subsp. paratuberculosis
cguccggucagacc

SEQ ID NO: 2942312 - RNA, 15 nt, Mycobacterium avium subsp. paratuberculosis
cguccggucgcuggg

SEQ ID NO: 2942313 - RNA, 17 nt, Mycobacterium avium subsp. paratuberculosis
cguccgguucggcggca

SEQ ID NO: 2942314 - RNA, 16 nt, Mycobacterium avium subsp. paratuberculosis
cguccguagugcucgg

SEQ ID NO: 2942315 - RNA, 19 nt, Mycobacterium avium subsp. paratuberculosis
cguccguagugcucggcgu

SEQ ID NO: 2942316 - RNA, 15 nt, Mycobacterium avium subsp. paratuberculosis
cguccgugccguccg

SEQ ID NO: 2942317 - RNA, 14 nt, Mycobacterium avium subsp. paratuberculosis
cguccgugcugccg

SEQ ID NO: 2942318 - RNA, 16 nt, Mycobacterium avium subsp. paratuberculosis
cguccgugcugccggc

SEQ ID NO: 2942319 - RNA, 18 nt, Mycobacterium avium subsp. paratuberculosis
cguccgugcugccggccg

SEQ ID NO: 2942320 - RNA, 19 nt, Mycobacterium avium subsp. paratuberculosis
cguccgugcugccggccgg

SEQ ID NO: 2942321 - RNA, 21 nt, Mycobacterium avium subsp. paratuberculosis
cguccgugcugccggccggca

SEQ ID NO: 2942322 - RNA, 11 nt, Mycobacterium avium subsp. paratuberculosis
cguccucccgg

SEQ ID NO: 2942323 - RNA, 20 nt, Mycobacterium avium subsp. paratuberculosis
cguccucccggccgacgaug

SEQ ID NO: 2942324 - RNA, 15 nt, Mycobacterium avium subsp. paratuberculosis
cguccucccgguagc

SEQ ID NO: 2942325 - RNA, 14 nt, Mycobacterium avium subsp. paratuberculosis
cguccuccuccucg

SEQ ID NO: 2942326 - RNA, 18 nt, Mycobacterium avium subsp. paratuberculosis
cguccuccucguccgcgg

SEQ ID NO: 2942327 - RNA, 20 nt, Mycobacterium avium subsp. paratuberculosis
cguccuccucguccgcggcg

SEQ ID NO: 2942328 - RNA, 15 nt, Mycobacterium avium subsp. paratuberculosis
cguccucgaccaccc

SEQ ID NO: 2942329 - RNA, 17 nt, Mycobacterium avium subsp. paratuberculosis
cguccucgaccacccgc

SEQ ID NO: 2942330 - RNA, 19 nt, Mycobacterium avium subsp. paratuberculosis
cguccucgaccacccgcug

SEQ ID NO: 2942331 - RNA, 23 nt, Mycobacterium avium subsp. paratuberculosis
cguccucgaccacccgcugguca

SEQ ID NO: 2942332 - RNA, 16 nt, Mycobacterium avium subsp. paratuberculosis
cguccucgacgccgcg

SEQ ID NO: 2942333 - RNA, 17 nt, Mycobacterium avium subsp. paratuberculosis
cguccucgacgccgcgc

SEQ ID NO: 2942334 - RNA, 15 nt, Mycobacterium avium subsp. paratuberculosis
cguccucgacggugg

SEQ ID NO: 2942335 - RNA, 17 nt, Mycobacterium avium subsp. paratuberculosis
cguccucgacgguggag

SEQ ID NO: 2942336 - RNA, 12 nt, Mycobacterium avium subsp. paratuberculosis
cguccucgaggg

SEQ ID NO: 2942337 - RNA, 19 nt, Mycobacterium avium subsp. paratuberculosis
cguccucgaucaccgacag

SEQ ID NO: 2942338 - RNA, 20 nt, Mycobacterium avium subsp. paratuberculosis
cguccucgaucaccgacagc

SEQ ID NO: 2942339 - RNA, 16 nt, Mycobacterium avium subsp. paratuberculosis
cguccucgaugacgcc

SEQ ID NO: 2942340 - RNA, 17 nt, Mycobacterium avium subsp. paratuberculosis
cguccucgaugacgccg

SEQ ID NO: 2942341 - RNA, 17 nt, Mycobacterium avium subsp. paratuberculosis
cguccucgaugccgacc

SEQ ID NO: 2942342 - RNA, 19 nt, Mycobacterium avium subsp. paratuberculosis
cguccucgaugccgaccga

SEQ ID NO: 2942343 - RNA, 20 nt, Mycobacterium avium subsp. paratuberculosis
cguccucgaugccgaccgac

SEQ ID NO: 2942344 - RNA, 20 nt, Mycobacterium avium subsp. paratuberculosis
cguccucgccguacgcgccg

SEQ ID NO: 2942345 - RNA, 22 nt, Mycobacterium avium subsp. paratuberculosis
cguccucgccguacgcgccggc

SEQ ID NO: 2942346 - RNA, 21 nt, Mycobacterium avium subsp. paratuberculosis
cguccucggccgccaccgcca

SEQ ID NO: 2942347 - RNA, 11 nt, Mycobacterium avium subsp. paratuberculosis
cguccucgguc

SEQ ID NO: 2942348 - RNA, 17 nt, Mycobacterium avium subsp. paratuberculosis
cguccucggucaggccg

SEQ ID NO: 2942349 - RNA, 14 nt, Mycobacterium avium subsp. paratuberculosis
cguccucgucggcg

SEQ ID NO: 2942350 - RNA, 18 nt, Mycobacterium avium subsp. paratuberculosis
cguccucgucggcgaagg

SEQ ID NO: 2942351 - RNA, 17 nt, Mycobacterium avium subsp. paratuberculosis
cguccucgucgguccag

SEQ ID NO: 2942352 - RNA, 22 nt, Mycobacterium avium subsp. paratuberculosis
cguccucguucuggcccgccau

SEQ ID NO: 2942353 - RNA, 23 nt, Mycobacterium avium subsp. paratuberculosis
cguccucguucuggcccgccauc

SEQ ID NO: 2942354 - RNA, 22 nt, Mycobacterium avium subsp. paratuberculosis
cguccugagguauucgucgagg

SEQ ID NO: 2942355 - RNA, 22 nt, Mycobacterium avium subsp. paratuberculosis
cguccugauuuuggggacgcug

SEQ ID NO: 2942356 - RNA, 23 nt, Mycobacterium avium subsp. paratuberculosis
cguccugauuuuggggacgcuga

SEQ ID NO: 2942357 - RNA, 18 nt, Mycobacterium avium subsp. paratuberculosis
cguccugcagcagccgga

SEQ ID NO: 2942358 - RNA, 22 nt, Mycobacterium avium subsp. paratuberculosis
cguccugcaggcaggccggcag

SEQ ID NO: 2942359 - RNA, 23 nt, Mycobacterium avium subsp. paratuberculosis
cguccugcaggcaggccggcagc

SEQ ID NO: 2942360 - RNA, 16 nt, Mycobacterium avium subsp. paratuberculosis
cguccuggacgucguc

SEQ ID NO: 2942361 - RNA, 20 nt, Mycobacterium avium subsp. paratuberculosis
cguccuggacgucgucgcug

SEQ ID NO: 2942362 - RNA, 14 nt, Mycobacterium avium subsp. paratuberculosis
cguccuggaucgcg

SEQ ID NO: 2942363 - RNA, 16 nt, Mycobacterium avium subsp. paratuberculosis
cguccuggaugaacag

SEQ ID NO: 2942364 - RNA, 17 nt, Mycobacterium avium subsp. paratuberculosis
cguccuggcgccaguag

SEQ ID NO: 2942365 - RNA, 14 nt, Mycobacterium avium subsp. paratuberculosis
cguccuggcgcugg

SEQ ID NO: 2942366 - RNA, 12 nt, Mycobacterium avium subsp. paratuberculosis
cguccugggccg

SEQ ID NO: 2942367 - RNA, 18 nt, Mycobacterium avium subsp. paratuberculosis
cguccuucuccgccgggc

SEQ ID NO: 2942368 - RNA, 15 nt, Mycobacterium avium subsp. paratuberculosis
cguccuugaccagcu

SEQ ID NO: 2942369 - RNA, 15 nt, Mycobacterium avium subsp. paratuberculosis
cguccuugacccggc

SEQ ID NO: 2942370 - RNA, 19 nt, Mycobacterium avium subsp. paratuberculosis
cguccuugacccggccgca

SEQ ID NO: 2942371 - RNA, 23 nt, Mycobacterium avium subsp. paratuberculosis
cguccuugacccggccgcacacc

SEQ ID NO: 2942372 - RNA, 13 nt, Mycobacterium avium subsp. paratuberculosis
cguccuugacgaa

SEQ ID NO: 2942373 - RNA, 16 nt, Mycobacterium avium subsp. paratuberculosis
cguccuugacgaacga

SEQ ID NO: 2942374 - RNA, 20 nt, Mycobacterium avium subsp. paratuberculosis
cguccuugagcccccaccug

SEQ ID NO: 2942375 - RNA, 14 nt, Mycobacterium avium subsp. paratuberculosis
cguccuugaucagc

SEQ ID NO: 2942376 - RNA, 23 nt, Mycobacterium avium subsp. paratuberculosis
cguccuugaucagcaugucgccc

SEQ ID NO: 2942377 - RNA, 15 nt, Mycobacterium avium subsp. paratuberculosis
cguccuugccgauca

SEQ ID NO: 2942378 - RNA, 18 nt, Mycobacterium avium subsp. paratuberculosis
cguccuugccgaucagcg

SEQ ID NO: 2942379 - RNA, 13 nt, Mycobacterium avium subsp. paratuberculosis
cguccuuggccgc

SEQ ID NO: 2942380 - RNA, 14 nt, Mycobacterium avium subsp. paratuberculosis
cguccuuggccgcc

SEQ ID NO: 2942381 - RNA, 19 nt, Mycobacterium avium subsp. paratuberculosis
cguccuuggccgccagcac

SEQ ID NO: 2942382 - RNA, 20 nt, Mycobacterium avium subsp. paratuberculosis
cguccuuggugacggccucc

SEQ ID NO: 2942383 - RNA, 20 nt, Mycobacterium avium subsp. paratuberculosis
cguccuugucgcgcaccgcg

SEQ ID NO: 2942384 - RNA, 23 nt, Mycobacterium avium subsp. paratuberculosis
cguccuugucgcgcaccgcggcg

SEQ ID NO: 2942385 - RNA, 22 nt, Mycobacterium avium subsp. paratuberculosis
cgucgaaaaacccggugccggc

SEQ ID NO: 2942386 - RNA, 12 nt, Mycobacterium avium subsp. paratuberculosis
cgucgaaaccgu

SEQ ID NO: 2942387 - RNA, 16 nt, Mycobacterium avium subsp. paratuberculosis
cgucgaaacggcugcu

SEQ ID NO: 2942388 - RNA, 16 nt, Mycobacterium avium subsp. paratuberculosis
cgucgaaauagcggcg

SEQ ID NO: 2942389 - RNA, 18 nt, Mycobacterium avium subsp. paratuberculosis
cgucgaccgcgccggggu

SEQ ID NO: 2942390 - RNA, 15 nt, Mycobacterium avium subsp. paratuberculosis
cgucgaccgcggccu

SEQ ID NO: 2942391 - RNA, 23 nt, Mycobacterium avium subsp. paratuberculosis
cgucgaccgucacgcuggcguga

SEQ ID NO: 2942392 - RNA, 15 nt, Mycobacterium avium subsp. paratuberculosis
cgucgaccugcucgu

SEQ ID NO: 2942393 - RNA, 18 nt, Mycobacterium avium subsp. paratuberculosis
cgucgaccugcucgucgg

SEQ ID NO: 2942394 - RNA, 21 nt, Mycobacterium avium subsp. paratuberculosis
cgucgaccugcucgucgguga

SEQ ID NO: 2942395 - RNA, 22 nt, Mycobacterium avium subsp. paratuberculosis
cgucgaccugcucgucggugac

SEQ ID NO: 2942396 - RNA, 18 nt, Mycobacterium avium subsp. paratuberculosis
cgucgaccuugcagcccg

SEQ ID NO: 2942397 - RNA, 19 nt, Mycobacterium avium subsp. paratuberculosis
cgucgaccuugcagcccgc

SEQ ID NO: 2942398 - RNA, 23 nt, Mycobacterium avium subsp. paratuberculosis
cgucgacgaacuuggacggaucg

SEQ ID NO: 2942399 - RNA, 15 nt, Mycobacterium avium subsp. paratuberculosis
cgucgacgaccacca

SEQ ID NO: 2942400 - RNA, 15 nt, Mycobacterium avium subsp. paratuberculosis
cgucgacgacggcgc

SEQ ID NO: 2942401 - RNA, 14 nt, Mycobacterium avium subsp. paratuberculosis
cgucgacgacgguc

SEQ ID NO: 2942402 - RNA, 19 nt, Mycobacterium avium subsp. paratuberculosis
cgucgacgagcccgccggc

SEQ ID NO: 2942403 - RNA, 18 nt, Mycobacterium avium subsp. paratuberculosis
cgucgacgauggcccgga

SEQ ID NO: 2942404 - RNA, 21 nt, Mycobacterium avium subsp. paratuberculosis
cgucgacgauggcccggaccg

SEQ ID NO: 2942405 - RNA, 23 nt, Mycobacterium avium subsp. paratuberculosis
cgucgacgauggcccggaccgcc

SEQ ID NO: 2942406 - RNA, 17 nt, Mycobacterium avium subsp. paratuberculosis
cgucgacgccgcugccg

SEQ ID NO: 2942407 - RNA, 18 nt, Mycobacterium avium subsp. paratuberculosis
cgucgacgccgcugccgg

SEQ ID NO: 2942408 - RNA, 14 nt, Mycobacterium avium subsp. paratuberculosis
cgucgacgccgguc

SEQ ID NO: 2942409 - RNA, 16 nt, Mycobacterium avium subsp. paratuberculosis
cgucgacgcgggcgac

SEQ ID NO: 2942410 - RNA, 14 nt, Mycobacterium avium subsp. paratuberculosis
cgucgacgcggucg

SEQ ID NO: 2942411 - RNA, 14 nt, Mycobacterium avium subsp. paratuberculosis
cgucgacgcgguga

SEQ ID NO: 2942412 - RNA, 22 nt, Mycobacterium avium subsp. paratuberculosis
cgucgacgcggugacaugcccg

SEQ ID NO: 2942413 - RNA, 16 nt, Mycobacterium avium subsp. paratuberculosis
cgucgacgcgugcguc

SEQ ID NO: 2942414 - RNA, 23 nt, Mycobacterium avium subsp. paratuberculosis
cgucgacgcgugcgucaucgcgc

SEQ ID NO: 2942415 - RNA, 15 nt, Mycobacterium avium subsp. paratuberculosis
cgucgacggcagcgc

SEQ ID NO: 2942416 - RNA, 13 nt, Mycobacterium avium subsp. paratuberculosis
cgucgacggccgc

SEQ ID NO: 2942417 - RNA, 17 nt, Mycobacterium avium subsp. paratuberculosis
cgucgacggccgccgcg

SEQ ID NO: 2942418 - RNA, 15 nt, Mycobacterium avium subsp. paratuberculosis
cgucgacggccgcgc

SEQ ID NO: 2942419 - RNA, 17 nt, Mycobacterium avium subsp. paratuberculosis
cgucgacggccgcgccg

SEQ ID NO: 2942420 - RNA, 19 nt, Mycobacterium avium subsp. paratuberculosis
cgucgacggccgcgccgaa

SEQ ID NO: 2942421 - RNA, 14 nt, Mycobacterium avium subsp. paratuberculosis
cgucgacggcgccg

SEQ ID NO: 2942422 - RNA, 17 nt, Mycobacterium avium subsp. paratuberculosis
cgucgacggcgccggac

SEQ ID NO: 2942423 - RNA, 20 nt, Mycobacterium avium subsp. paratuberculosis
cgucgacggcggcgucccag

SEQ ID NO: 2942424 - RNA, 17 nt, Mycobacterium avium subsp. paratuberculosis
cgucgacgggccaccag

SEQ ID NO: 2942425 - RNA, 19 nt, Mycobacterium avium subsp. paratuberculosis
cgucgacgggccaccagcg

SEQ ID NO: 2942426 - RNA, 21 nt, Mycobacterium avium subsp. paratuberculosis
cgucgacgggccaccagcgca

SEQ ID NO: 2942427 - RNA, 19 nt, Mycobacterium avium subsp. paratuberculosis
cgucgacguccucgcccgg

SEQ ID NO: 2942428 - RNA, 22 nt, Mycobacterium avium subsp. paratuberculosis
cgucgacguccucgcccgggug

SEQ ID NO: 2942429 - RNA, 14 nt, Mycobacterium avium subsp. paratuberculosis
cgucgacgucgagg

SEQ ID NO: 2942430 - RNA, 18 nt, Mycobacterium avium subsp. paratuberculosis
cgucgacgucgagggcgc

SEQ ID NO: 2942431 - RNA, 16 nt, Mycobacterium avium subsp. paratuberculosis
cgucgacgucggacgc

SEQ ID NO: 2942432 - RNA, 20 nt, Mycobacterium avium subsp. paratuberculosis
cgucgacgucggacgcggcc

SEQ ID NO: 2942433 - RNA, 14 nt, Mycobacterium avium subsp. paratuberculosis
cgucgacgucgggc

SEQ ID NO: 2942434 - RNA, 18 nt, Mycobacterium avium subsp. paratuberculosis
cgucgacgugcgcggcgu

SEQ ID NO: 2942435 - RNA, 18 nt, Mycobacterium avium subsp. paratuberculosis
cgucgacgugggcggcca

SEQ ID NO: 2942436 - RNA, 21 nt, Mycobacterium avium subsp. paratuberculosis
cgucgacgugggcggccacca

SEQ ID NO: 2942437 - RNA, 17 nt, Mycobacterium avium subsp. paratuberculosis
cgucgacguucgccgcc

SEQ ID NO: 2942438 - RNA, 18 nt, Mycobacterium avium subsp. paratuberculosis
cgucgacguucgccgcca

SEQ ID NO: 2942439 - RNA, 21 nt, Mycobacterium avium subsp. paratuberculosis
cgucgacguucgccgccagca

SEQ ID NO: 2942440 - RNA, 23 nt, Mycobacterium avium subsp. paratuberculosis
cgucgacguucgccgccagcacg

SEQ ID NO: 2942441 - RNA, 14 nt, Mycobacterium avium subsp. paratuberculosis
cgucgacucggcgg

SEQ ID NO: 2942442 - RNA, 19 nt, Mycobacterium avium subsp. paratuberculosis
cgucgacucggcggugccg

SEQ ID NO: 2942443 - RNA, 23 nt, Mycobacterium avium subsp. paratuberculosis
cgucgacucggcggugccguccu

SEQ ID NO: 2942444 - RNA, 22 nt, Mycobacterium avium subsp. paratuberculosis
cgucgacugaucgacgagccgg

SEQ ID NO: 2942445 - RNA, 23 nt, Mycobacterium avium subsp. paratuberculosis
cgucgacugaucgacgagccggg

SEQ ID NO: 2942446 - RNA, 15 nt, Mycobacterium avium subsp. paratuberculosis
cgucgacugcaccga

SEQ ID NO: 2942447 - RNA, 16 nt, Mycobacterium avium subsp. paratuberculosis
cgucgacugcaccgac

SEQ ID NO: 2942448 - RNA, 17 nt, Mycobacterium avium subsp. paratuberculosis
cgucgagaaaagcggcg

SEQ ID NO: 2942449 - RNA, 19 nt, Mycobacterium avium subsp. paratuberculosis
cgucgagaaaagcggcgaa

SEQ ID NO: 2942450 - RNA, 21 nt, Mycobacterium avium subsp. paratuberculosis
cgucgagaaaagcggcgaaau

SEQ ID NO: 2942451 - RNA, 19 nt, Mycobacterium avium subsp. paratuberculosis
cgucgagaaaggccagcac

SEQ ID NO: 2942452 - RNA, 22 nt, Mycobacterium avium subsp. paratuberculosis
cgucgagaaaggccagcacgca

SEQ ID NO: 2942453 - RNA, 17 nt, Mycobacterium avium subsp. paratuberculosis
cgucgagaagaccuggu

SEQ ID NO: 2942454 - RNA, 16 nt, Mycobacterium avium subsp. paratuberculosis
cgucgagcaccacccg

SEQ ID NO: 2942455 - RNA, 19 nt, Mycobacterium avium subsp. paratuberculosis
cgucgagcaccacccgggu

SEQ ID NO: 2942456 - RNA, 12 nt, Mycobacterium avium subsp. paratuberculosis
cgucgagcaccg

SEQ ID NO: 2942457 - RNA, 17 nt, Mycobacterium avium subsp. paratuberculosis
cgucgagcaccgcgucc

SEQ ID NO: 2942458 - RNA, 18 nt, Mycobacterium avium subsp. paratuberculosis
cgucgagcaccgcguccg

SEQ ID NO: 2942459 - RNA, 15 nt, Mycobacterium avium subsp. paratuberculosis
cgucgagcaccggca

SEQ ID NO: 2942460 - RNA, 19 nt, Mycobacterium avium subsp. paratuberculosis
cgucgagcaccggcuggug

SEQ ID NO: 2942461 - RNA, 13 nt, Mycobacterium avium subsp. paratuberculosis
cgucgagcaccug

SEQ ID NO: 2942462 - RNA, 22 nt, Mycobacterium avium subsp. paratuberculosis
cgucgagcaccuggagcggguc

SEQ ID NO: 2942463 - RNA, 16 nt, Mycobacterium avium subsp. paratuberculosis
cgucgagcagcaccac

SEQ ID NO: 2942464 - RNA, 19 nt, Mycobacterium avium subsp. paratuberculosis
cgucgagcagcaccacccg

SEQ ID NO: 2942465 - RNA, 22 nt, Mycobacterium avium subsp. paratuberculosis
cgucgagcagcaccacccgcac

SEQ ID NO: 2942466 - RNA, 14 nt, Mycobacterium avium subsp. paratuberculosis
cgucgagcagccgc

SEQ ID NO: 2942467 - RNA, 16 nt, Mycobacterium avium subsp. paratuberculosis
cgucgagcagcgcccg

SEQ ID NO: 2942468 - RNA, 17 nt, Mycobacterium avium subsp. paratuberculosis
cgucgagcagcgcccgg

SEQ ID NO: 2942469 - RNA, 21 nt, Mycobacterium avium subsp. paratuberculosis
cgucgagcagcgcccggcgau

SEQ ID NO: 2942470 - RNA, 15 nt, Mycobacterium avium subsp. paratuberculosis
cgucgagcaggguga

SEQ ID NO: 2942471 - RNA, 17 nt, Mycobacterium avium subsp. paratuberculosis
cgucgagcagggugacg

SEQ ID NO: 2942472 - RNA, 18 nt, Mycobacterium avium subsp. paratuberculosis
cgucgagcauccggcgca

SEQ ID NO: 2942473 - RNA, 15 nt, Mycobacterium avium subsp. paratuberculosis
cgucgaucucgguga

SEQ ID NO: 2942474 - RNA, 17 nt, Mycobacterium avium subsp. paratuberculosis
cgucgaucucggugagc

SEQ ID NO: 2942475 - RNA, 18 nt, Mycobacterium avium subsp. paratuberculosis
cgucgaucucggugagcc

SEQ ID NO: 2942476 - RNA, 20 nt, Mycobacterium avium subsp. paratuberculosis
cgucgaucucggugagccgc

SEQ ID NO: 2942477 - RNA, 18 nt, Mycobacterium avium subsp. paratuberculosis
cgucgaucuucgcggcgu

SEQ ID NO: 2942478 - RNA, 19 nt, Mycobacterium avium subsp. paratuberculosis
cgucgaucuucgcggcgua

SEQ ID NO: 2942479 - RNA, 20 nt, Mycobacterium avium subsp. paratuberculosis
cgucgaucuugucguccagu

SEQ ID NO: 2942480 - RNA, 14 nt, Mycobacterium avium subsp. paratuberculosis
cgucgaugaacagc

SEQ ID NO: 2942481 - RNA, 14 nt, Mycobacterium avium subsp. paratuberculosis
cgucgaugaacauc

SEQ ID NO: 2942482 - RNA, 22 nt, Mycobacterium avium subsp. paratuberculosis
cgucgaugacgaugcccggggu

SEQ ID NO: 2942483 - RNA, 17 nt, Mycobacterium avium subsp. paratuberculosis
cgucgaugacguccacc

SEQ ID NO: 2942484 - RNA, 18 nt, Mycobacterium avium subsp. paratuberculosis
cgucgaugacguccacca

SEQ ID NO: 2942485 - RNA, 21 nt, Mycobacterium avium subsp. paratuberculosis
cgucgaugcccuagcgguggc

SEQ ID NO: 2942486 - RNA, 20 nt, Mycobacterium avium subsp. paratuberculosis
cgucgaugccgaaccgcucc

SEQ ID NO: 2942487 - RNA, 16 nt, Mycobacterium avium subsp. paratuberculosis
cgucgaugccgaucgg

SEQ ID NO: 2942488 - RNA, 14 nt, Mycobacterium avium subsp. paratuberculosis
cgucgaugccggcg

SEQ ID NO: 2942489 - RNA, 17 nt, Mycobacterium avium subsp. paratuberculosis
cgucgaugccggcgacg

SEQ ID NO: 2942490 - RNA, 20 nt, Mycobacterium avium subsp. paratuberculosis
cgucgaugccggcgauccgc

SEQ ID NO: 2942491 - RNA, 15 nt, Mycobacterium avium subsp. paratuberculosis
cgucgaugcgcagca

SEQ ID NO: 2942492 - RNA, 17 nt, Mycobacterium avium subsp. paratuberculosis
cgucgaugcgcagcagc

SEQ ID NO: 2942493 - RNA, 19 nt, Mycobacterium avium subsp. paratuberculosis
cgucgaugcgcagcagcgg

SEQ ID NO: 2942494 - RNA, 20 nt, Mycobacterium avium subsp. paratuberculosis
cgucgaugcgcagcagcggc

SEQ ID NO: 2942495 - RNA, 16 nt, Mycobacterium avium subsp. paratuberculosis
cgucgaugcgcgccac

SEQ ID NO: 2942496 - RNA, 18 nt, Mycobacterium avium subsp. paratuberculosis
cgucgaugcgcgccacca

SEQ ID NO: 2942497 - RNA, 23 nt, Mycobacterium avium subsp. paratuberculosis
cgucgaugcggaucucggugccg

SEQ ID NO: 2942498 - RNA, 15 nt, Mycobacterium avium subsp. paratuberculosis
cgucgaugcgggccc

SEQ ID NO: 2942499 - RNA, 17 nt, Mycobacterium avium subsp. paratuberculosis
cgucgauggacagggcg

SEQ ID NO: 2942500 - RNA, 18 nt, Mycobacterium avium subsp. paratuberculosis
cgucgauggacagggcga

SEQ ID NO: 2942501 - RNA, 15 nt, Mycobacterium avium subsp. paratuberculosis
cgucgauggccacca

SEQ ID NO: 2942502 - RNA, 13 nt, Mycobacterium avium subsp. paratuberculosis
cgucgauggcgcg

SEQ ID NO: 2942503 - RNA, 19 nt, Mycobacterium avium subsp. paratuberculosis
cgucgaugggcucgagcaa

SEQ ID NO: 2942504 - RNA, 16 nt, Mycobacterium avium subsp. paratuberculosis
cgucgaugucgcccgg

SEQ ID NO: 2942505 - RNA, 21 nt, Mycobacterium avium subsp. paratuberculosis
cgucgaugucggcggcccggu

SEQ ID NO: 2942506 - RNA, 14 nt, Mycobacterium avium subsp. paratuberculosis
cgucgaugucgucg

SEQ ID NO: 2942507 - RNA, 19 nt, Mycobacterium avium subsp. paratuberculosis
cgucgaugucgucgucgac

SEQ ID NO: 2942508 - RNA, 21 nt, Mycobacterium avium subsp. paratuberculosis
cgucgaugucgucgucgacgc

SEQ ID NO: 2942509 - RNA, 15 nt, Mycobacterium avium subsp. paratuberculosis
cgucgaugugcucgg

SEQ ID NO: 2942510 - RNA, 19 nt, Mycobacterium avium subsp. paratuberculosis
cgucgaugugcucggggca

SEQ ID NO: 2942511 - RNA, 20 nt, Mycobacterium avium subsp. paratuberculosis
cgucgaugugcucggggcag

SEQ ID NO: 2942512 - RNA, 16 nt, Mycobacterium avium subsp. paratuberculosis
cgucgaugugggccgc

SEQ ID NO: 2942513 - RNA, 17 nt, Mycobacterium avium subsp. paratuberculosis
cgucgaugugggccgca

SEQ ID NO: 2942514 - RNA, 21 nt, Mycobacterium avium subsp. paratuberculosis
cgucgaugugggccgcagcag

SEQ ID NO: 2942515 - RNA, 20 nt, Mycobacterium avium subsp. paratuberculosis
cgucgcacaaccgggccaac

SEQ ID NO: 2942516 - RNA, 13 nt, Mycobacterium avium subsp. paratuberculosis
cgucgcacagcgc

SEQ ID NO: 2942517 - RNA, 14 nt, Mycobacterium avium subsp. paratuberculosis
cgucgcacagcgcc

SEQ ID NO: 2942518 - RNA, 17 nt, Mycobacterium avium subsp. paratuberculosis
cgucgcaccggcaguga

SEQ ID NO: 2942519 - RNA, 18 nt, Mycobacterium avium subsp. paratuberculosis
cgucgcacuagguccggc

SEQ ID NO: 2942520 - RNA, 20 nt, Mycobacterium avium subsp. paratuberculosis
cgucgcacuagguccggcgc

SEQ ID NO: 2942521 - RNA, 22 nt, Mycobacterium avium subsp. paratuberculosis
cgucgcacuagguccggcgcga

SEQ ID NO: 2942522 - RNA, 17 nt, Mycobacterium avium subsp. paratuberculosis
cgucgcagaucccgccg

SEQ ID NO: 2942523 - RNA, 18 nt, Mycobacterium avium subsp. paratuberculosis
cgucgcagaucccgccgg

SEQ ID NO: 2942524 - RNA, 12 nt, Mycobacterium avium subsp. paratuberculosis
cgucgcagcccg

SEQ ID NO: 2942525 - RNA, 17 nt, Mycobacterium avium subsp. paratuberculosis
cgucgcagcccgggugc

SEQ ID NO: 2942526 - RNA, 16 nt, Mycobacterium avium subsp. paratuberculosis
cgucgcagugcccgcc

SEQ ID NO: 2942527 - RNA, 17 nt, Mycobacterium avium subsp. paratuberculosis
cgucgcagugcccgccc

SEQ ID NO: 2942528 - RNA, 19 nt, Mycobacterium avium subsp. paratuberculosis
cgucgcaucagcucggcag

SEQ ID NO: 2942529 - RNA, 18 nt, Mycobacterium avium subsp. paratuberculosis
cgucgccaauccggcggg

SEQ ID NO: 2942530 - RNA, 19 nt, Mycobacterium avium subsp. paratuberculosis
cgucgccaauccggcgggc

SEQ ID NO: 2942531 - RNA, 17 nt, Mycobacterium avium subsp. paratuberculosis
cgucgccaccagaccgg

SEQ ID NO: 2942532 - RNA, 20 nt, Mycobacterium avium subsp. paratuberculosis
cgucgccaccagaccggcga

SEQ ID NO: 2942533 - RNA, 12 nt, Mycobacterium avium subsp. paratuberculosis
cgucgccaccga

SEQ ID NO: 2942534 - RNA, 18 nt, Mycobacterium avium subsp. paratuberculosis
cgucgccaccgagucgcg

SEQ ID NO: 2942535 - RNA, 21 nt, Mycobacterium avium subsp. paratuberculosis
cgucgccaccgagucgcgcga

SEQ ID NO: 2942536 - RNA, 22 nt, Mycobacterium avium subsp. paratuberculosis
cgucgccaccgagucgcgcgac

SEQ ID NO: 2942537 - RNA, 15 nt, Mycobacterium avium subsp. paratuberculosis
cgucgccaccgaugc

SEQ ID NO: 2942538 - RNA, 16 nt, Mycobacterium avium subsp. paratuberculosis
cgucgccaccgaugcg

SEQ ID NO: 2942539 - RNA, 21 nt, Mycobacterium avium subsp. paratuberculosis
cgucgccaccgaugcgggcca

SEQ ID NO: 2942540 - RNA, 15 nt, Mycobacterium avium subsp. paratuberculosis
cgucgccacgaucac

SEQ ID NO: 2942541 - RNA, 22 nt, Mycobacterium avium subsp. paratuberculosis
cgucgccacgaucaccaccacc

SEQ ID NO: 2942542 - RNA, 13 nt, Mycobacterium avium subsp. paratuberculosis
cgucgccagccgc

SEQ ID NO: 2942543 - RNA, 14 nt, Mycobacterium avium subsp. paratuberculosis
cgucgccagccgcc

SEQ ID NO: 2942544 - RNA, 15 nt, Mycobacterium avium subsp. paratuberculosis
cgucgccagccgccg

SEQ ID NO: 2942545 - RNA, 17 nt, Mycobacterium avium subsp. paratuberculosis
cgucgccagccgccggc

SEQ ID NO: 2942546 - RNA, 19 nt, Mycobacterium avium subsp. paratuberculosis
cgucgccaguugcacuuuc

SEQ ID NO: 2942547 - RNA, 23 nt, Mycobacterium avium subsp. paratuberculosis
cgucgccaguugcacuuucggca

SEQ ID NO: 2942548 - RNA, 14 nt, Mycobacterium avium subsp. paratuberculosis
cgucgccaucgucu

SEQ ID NO: 2942549 - RNA, 23 nt, Mycobacterium avium subsp. paratuberculosis
cgucgccaugccgucgcgcaccg

SEQ ID NO: 2942550 - RNA, 17 nt, Mycobacterium avium subsp. paratuberculosis
cgucgcccacccgccag

SEQ ID NO: 2942551 - RNA, 18 nt, Mycobacterium avium subsp. paratuberculosis
cgucgcccacccgccagc

SEQ ID NO: 2942552 - RNA, 19 nt, Mycobacterium avium subsp. paratuberculosis
cgucgcccacccggggccg

SEQ ID NO: 2942553 - RNA, 21 nt, Mycobacterium avium subsp. paratuberculosis
cgucgcccacccggggccguc

SEQ ID NO: 2942554 - RNA, 22 nt, Mycobacterium avium subsp. paratuberculosis
cgucgcccacccggggccgucc

SEQ ID NO: 2942555 - RNA, 12 nt, Mycobacterium avium subsp. paratuberculosis
cgucgcccaccg

SEQ ID NO: 2942556 - RNA, 14 nt, Mycobacterium avium subsp. paratuberculosis
cgucgcccaccgac

SEQ ID NO: 2942557 - RNA, 17 nt, Mycobacterium avium subsp. paratuberculosis
cgucgccucgcccucgg

SEQ ID NO: 2942558 - RNA, 16 nt, Mycobacterium avium subsp. paratuberculosis
cgucgcgacgagcggg

SEQ ID NO: 2942559 - RNA, 17 nt, Mycobacterium avium subsp. paratuberculosis
cgucgcgacgagcgggc

SEQ ID NO: 2942560 - RNA, 15 nt, Mycobacterium avium subsp. paratuberculosis
cgucgcgaucacacc

SEQ ID NO: 2942561 - RNA, 13 nt, Mycobacterium avium subsp. paratuberculosis
cgucgcgaucagu

SEQ ID NO: 2942562 - RNA, 17 nt, Mycobacterium avium subsp. paratuberculosis
cgucgcgaucgcggucc

SEQ ID NO: 2942563 - RNA, 18 nt, Mycobacterium avium subsp. paratuberculosis
cgucgcgaucgcggucca

SEQ ID NO: 2942564 - RNA, 20 nt, Mycobacterium avium subsp. paratuberculosis
cgucgcgaucgcgguccagg

SEQ ID NO: 2942565 - RNA, 22 nt, Mycobacterium avium subsp. paratuberculosis
cgucgcgaugcccaagccggcc

SEQ ID NO: 2942566 - RNA, 17 nt, Mycobacterium avium subsp. paratuberculosis
cgucgcgaugugcucga

SEQ ID NO: 2942567 - RNA, 19 nt, Mycobacterium avium subsp. paratuberculosis
cgucgcgaugugcucgauc

SEQ ID NO: 2942568 - RNA, 21 nt, Mycobacterium avium subsp. paratuberculosis
cgucgcgcaaacugacaggcg

SEQ ID NO: 2942569 - RNA, 17 nt, Mycobacterium avium subsp. paratuberculosis
cgucgcgcaccaccucg

SEQ ID NO: 2942570 - RNA, 20 nt, Mycobacterium avium subsp. paratuberculosis
cgucgcgcaccaccucgauc

SEQ ID NO: 2942571 - RNA, 14 nt, Mycobacterium avium subsp. paratuberculosis
cgucgcgcaccagc

SEQ ID NO: 2942572 - RNA, 15 nt, Mycobacterium avium subsp. paratuberculosis
cgucgcgcaccagcu

SEQ ID NO: 2942573 - RNA, 17 nt, Mycobacterium avium subsp. paratuberculosis
cgucgcgcaccagcucg

SEQ ID NO: 2942574 - RNA, 20 nt, Mycobacterium avium subsp. paratuberculosis
cgucgcgcaccagcucgagg

SEQ ID NO: 2942575 - RNA, 17 nt, Mycobacterium avium subsp. paratuberculosis
cgucgcgcacccagccg

SEQ ID NO: 2942576 - RNA, 18 nt, Mycobacterium avium subsp. paratuberculosis
cgucgcgcacccagccgc

SEQ ID NO: 2942577 - RNA, 14 nt, Mycobacterium avium subsp. paratuberculosis
cgucgcgcagcagc

SEQ ID NO: 2942578 - RNA, 18 nt, Mycobacterium avium subsp. paratuberculosis
cgucgcgcagcagcggga

SEQ ID NO: 2942579 - RNA, 17 nt, Mycobacterium avium subsp. paratuberculosis
cgucgcgcagguaggug

SEQ ID NO: 2942580 - RNA, 14 nt, Mycobacterium avium subsp. paratuberculosis
cgucgcgcaggucg

SEQ ID NO: 2942581 - RNA, 17 nt, Mycobacterium avium subsp. paratuberculosis
cgucgcgcaggucgggc

SEQ ID NO: 2942582 - RNA, 15 nt, Mycobacterium avium subsp. paratuberculosis
cgucgcgccagcggu

SEQ ID NO: 2942583 - RNA, 18 nt, Mycobacterium avium subsp. paratuberculosis
cgucgcgccagcggucca

SEQ ID NO: 2942584 - RNA, 12 nt, Mycobacterium avium subsp. paratuberculosis
cgucgcgccgau

SEQ ID NO: 2942585 - RNA, 22 nt, Mycobacterium avium subsp. paratuberculosis
cgucgcgccgauguacugggcc

SEQ ID NO: 2942586 - RNA, 13 nt, Mycobacterium avium subsp. paratuberculosis
cgucgcgccgcca

SEQ ID NO: 2942587 - RNA, 14 nt, Mycobacterium avium subsp. paratuberculosis
cgucgcgccgccac

SEQ ID NO: 2942588 - RNA, 17 nt, Mycobacterium avium subsp. paratuberculosis
cgucgcgccgccacccc

SEQ ID NO: 2942589 - RNA, 21 nt, Mycobacterium avium subsp. paratuberculosis
cgucgcgccgccaccccaggc

SEQ ID NO: 2942590 - RNA, 23 nt, Mycobacterium avium subsp. paratuberculosis
cgucgcgccgccgcgucgugccg

SEQ ID NO: 2942591 - RNA, 17 nt, Mycobacterium avium subsp. paratuberculosis
cgucgcgccgcucggcc

SEQ ID NO: 2942592 - RNA, 23 nt, Mycobacterium avium subsp. paratuberculosis
cgucgcgcgacugggcgcccacc

SEQ ID NO: 2942593 - RNA, 14 nt, Mycobacterium avium subsp. paratuberculosis
cgucgcgcgggguc

SEQ ID NO: 2942594 - RNA, 16 nt, Mycobacterium avium subsp. paratuberculosis
cgucgcgcggggucgg

SEQ ID NO: 2942595 - RNA, 22 nt, Mycobacterium avium subsp. paratuberculosis
cgucgcgcggggugacgcccgu

SEQ ID NO: 2942596 - RNA, 16 nt, Mycobacterium avium subsp. paratuberculosis
cgucgcgcugccggcc

SEQ ID NO: 2942597 - RNA, 17 nt, Mycobacterium avium subsp. paratuberculosis
cgucgcgcugccggccc

SEQ ID NO: 2942598 - RNA, 19 nt, Mycobacterium avium subsp. paratuberculosis
cgucgcgcugccggcccga

SEQ ID NO: 2942599 - RNA, 22 nt, Mycobacterium avium subsp. paratuberculosis
cgucgcggaacagccggcucag

SEQ ID NO: 2942600 - RNA, 19 nt, Mycobacterium avium subsp. paratuberculosis
cgucgcggaaccguugcag

SEQ ID NO: 2942601 - RNA, 21 nt, Mycobacterium avium subsp. paratuberculosis
cgucgcggaaccguugcagca

SEQ ID NO: 2942602 - RNA, 16 nt, Mycobacterium avium subsp. paratuberculosis
cgucgcggaggaugcc

SEQ ID NO: 2942603 - RNA, 17 nt, Mycobacterium avium subsp. paratuberculosis
cgucgcggaggaugccg

SEQ ID NO: 2942604 - RNA, 24 nt, Mycobacterium avium subsp. paratuberculosis
cgucgcggaggaugccggccagcu

SEQ ID NO: 2942605 - RNA, 16 nt, Mycobacterium avium subsp. paratuberculosis
cgucgcggcccuggau

SEQ ID NO: 2942606 - RNA, 12 nt, Mycobacterium avium subsp. paratuberculosis
cgucgcggccgg

SEQ ID NO: 2942607 - RNA, 20 nt, Mycobacterium avium subsp. paratuberculosis
cgucgcggcgaucgcgagca

SEQ ID NO: 2942608 - RNA, 16 nt, Mycobacterium avium subsp. paratuberculosis
cgucgcggcgcacccg

SEQ ID NO: 2942609 - RNA, 13 nt, Mycobacterium avium subsp. paratuberculosis
cgucgcggcgcgg

SEQ ID NO: 2942610 - RNA, 14 nt, Mycobacterium avium subsp. paratuberculosis
cgucgcggcgcgga

SEQ ID NO: 2942611 - RNA, 15 nt, Mycobacterium avium subsp. paratuberculosis
cgucgcggcgcggac

SEQ ID NO: 2942612 - RNA, 13 nt, Mycobacterium avium subsp. paratuberculosis
cgucgcggcgcua

SEQ ID NO: 2942613 - RNA, 16 nt, Mycobacterium avium subsp. paratuberculosis
cgucgcggcgcugccg

SEQ ID NO: 2942614 - RNA, 19 nt, Mycobacterium avium subsp. paratuberculosis
cgucgcggcgcugccggug

SEQ ID NO: 2942615 - RNA, 12 nt, Mycobacterium avium subsp. paratuberculosis
cgucgcggcggc

SEQ ID NO: 2942616 - RNA, 13 nt, Mycobacterium avium subsp. paratuberculosis
cgucgcggcggcc

SEQ ID NO: 2942617 - RNA, 15 nt, Mycobacterium avium subsp. paratuberculosis
cgucgcggcggcccg

SEQ ID NO: 2942618 - RNA, 18 nt, Mycobacterium avium subsp. paratuberculosis
cgucgcggcggcccgucg

SEQ ID NO: 2942619 - RNA, 21 nt, Mycobacterium avium subsp. paratuberculosis
cgucgcggcggcccgucgcca

SEQ ID NO: 2942620 - RNA, 17 nt, Mycobacterium avium subsp. paratuberculosis
cgucgcggcggcgcugg

SEQ ID NO: 2942621 - RNA, 18 nt, Mycobacterium avium subsp. paratuberculosis
cgucgcggcgggggucgg

SEQ ID NO: 2942622 - RNA, 13 nt, Mycobacterium avium subsp. paratuberculosis
cgucgcggcgguc

SEQ ID NO: 2942623 - RNA, 14 nt, Mycobacterium avium subsp. paratuberculosis
cgucgcggcgguca

SEQ ID NO: 2942624 - RNA, 23 nt, Mycobacterium avium subsp. paratuberculosis
cgucgcggcggugcgcagccgcu

SEQ ID NO: 2942625 - RNA, 19 nt, Mycobacterium avium subsp. paratuberculosis
cgucgcgggaaucccaccc

SEQ ID NO: 2942626 - RNA, 20 nt, Mycobacterium avium subsp. paratuberculosis
cgucgcgggagagcgcgggc

SEQ ID NO: 2942627 - RNA, 21 nt, Mycobacterium avium subsp. paratuberculosis
cgucgcgggagagcgcgggca

SEQ ID NO: 2942628 - RNA, 22 nt, Mycobacterium avium subsp. paratuberculosis
cgucgcgggagagcgcgggcac

SEQ ID NO: 2942629 - RNA, 16 nt, Mycobacterium avium subsp. paratuberculosis
cgucgcgggcccgggc

SEQ ID NO: 2942630 - RNA, 18 nt, Mycobacterium avium subsp. paratuberculosis
cgucgcgggcccgggcca

SEQ ID NO: 2942631 - RNA, 12 nt, Mycobacterium avium subsp. paratuberculosis
cgucgcgggcga

SEQ ID NO: 2942632 - RNA, 21 nt, Mycobacterium avium subsp. paratuberculosis
cgucgcgggcgaaggagaaga

SEQ ID NO: 2942633 - RNA, 21 nt, Mycobacterium avium subsp. paratuberculosis
cgucgcgggucagcgucgcca

SEQ ID NO: 2942634 - RNA, 17 nt, Mycobacterium avium subsp. paratuberculosis
cgucgcgggugaccggc

SEQ ID NO: 2942635 - RNA, 18 nt, Mycobacterium avium subsp. paratuberculosis
cgucgcgguccacgccgg

SEQ ID NO: 2942636 - RNA, 14 nt, Mycobacterium avium subsp. paratuberculosis
cgucgcggucggcg

SEQ ID NO: 2942637 - RNA, 15 nt, Mycobacterium avium subsp. paratuberculosis
cgucgcggucggcgu

SEQ ID NO: 2942638 - RNA, 16 nt, Mycobacterium avium subsp. paratuberculosis
cgucgcggucggcguc

SEQ ID NO: 2942639 - RNA, 21 nt, Mycobacterium avium subsp. paratuberculosis
cgucgcggugaaguugccgcc

SEQ ID NO: 2942640 - RNA, 19 nt, Mycobacterium avium subsp. paratuberculosis
cgucgcgguggagcacagc

SEQ ID NO: 2942641 - RNA, 22 nt, Mycobacterium avium subsp. paratuberculosis
cgucgcgguggagcacagcacg

SEQ ID NO: 2942642 - RNA, 16 nt, Mycobacterium avium subsp. paratuberculosis
cgucggccgcacaaca

SEQ ID NO: 2942643 - RNA, 13 nt, Mycobacterium avium subsp. paratuberculosis
cgucggccgccag

SEQ ID NO: 2942644 - RNA, 17 nt, Mycobacterium avium subsp. paratuberculosis
cgucggccgccagggcc

SEQ ID NO: 2942645 - RNA, 15 nt, Mycobacterium avium subsp. paratuberculosis
cgucggccgccgacu

SEQ ID NO: 2942646 - RNA, 21 nt, Mycobacterium avium subsp. paratuberculosis
cgucggccgcgcgugcccgcg

SEQ ID NO: 2942647 - RNA, 11 nt, Mycobacterium avium subsp. paratuberculosis
cgucggccggc

SEQ ID NO: 2942648 - RNA, 16 nt, Mycobacterium avium subsp. paratuberculosis
cgucggccggcaguug

SEQ ID NO: 2942649 - RNA, 22 nt, Mycobacterium avium subsp. paratuberculosis
cgucggccggcaguugcggccg

SEQ ID NO: 2942650 - RNA, 12 nt, Mycobacterium avium subsp. paratuberculosis
cgucggccggcu

SEQ ID NO: 2942651 - RNA, 15 nt, Mycobacterium avium subsp. paratuberculosis
cgucggccggcucga

SEQ ID NO: 2942652 - RNA, 14 nt, Mycobacterium avium subsp. paratuberculosis
cgucggccgggccg

SEQ ID NO: 2942653 - RNA, 15 nt, Mycobacterium avium subsp. paratuberculosis
cgucggccgggccgg

SEQ ID NO: 2942654 - RNA, 16 nt, Mycobacterium avium subsp. paratuberculosis
cgucggccgggccggc

SEQ ID NO: 2942655 - RNA, 12 nt, Mycobacterium avium subsp. paratuberculosis
cgucggccgggg

SEQ ID NO: 2942656 - RNA, 15 nt, Mycobacterium avium subsp. paratuberculosis
cgucggccgggggcg

SEQ ID NO: 2942657 - RNA, 17 nt, Mycobacterium avium subsp. paratuberculosis
cgucggccgggggcgcg

SEQ ID NO: 2942658 - RNA, 14 nt, Mycobacterium avium subsp. paratuberculosis
cgucggccgggucg

SEQ ID NO: 2942659 - RNA, 18 nt, Mycobacterium avium subsp. paratuberculosis
cgucggccgucggcgccg

SEQ ID NO: 2942660 - RNA, 21 nt, Mycobacterium avium subsp. paratuberculosis
cgucggccgucggcgccgccg

SEQ ID NO: 2942661 - RNA, 16 nt, Mycobacterium avium subsp. paratuberculosis
cgucggccuccagccg

SEQ ID NO: 2942662 - RNA, 17 nt, Mycobacterium avium subsp. paratuberculosis
cgucggccuccagccgg

SEQ ID NO: 2942663 - RNA, 13 nt, Mycobacterium avium subsp. paratuberculosis
cgucggccucggc

SEQ ID NO: 2942664 - RNA, 15 nt, Mycobacterium avium subsp. paratuberculosis
cgucggccucggcgg

SEQ ID NO: 2942665 - RNA, 17 nt, Mycobacterium avium subsp. paratuberculosis
cgucggccucggcggcc

SEQ ID NO: 2942666 - RNA, 18 nt, Mycobacterium avium subsp. paratuberculosis
cgucggccucggcggccg

SEQ ID NO: 2942667 - RNA, 20 nt, Mycobacterium avium subsp. paratuberculosis
cgucggccucggcggccggg

SEQ ID NO: 2942668 - RNA, 21 nt, Mycobacterium avium subsp. paratuberculosis
cgucggccucggcggccggga

SEQ ID NO: 2942669 - RNA, 16 nt, Mycobacterium avium subsp. paratuberculosis
cgucggccucggcggu

SEQ ID NO: 2942670 - RNA, 11 nt, Mycobacterium avium subsp. paratuberculosis
cgucggccugc

SEQ ID NO: 2942671 - RNA, 15 nt, Mycobacterium avium subsp. paratuberculosis
cgucggccugcacga

SEQ ID NO: 2942672 - RNA, 20 nt, Mycobacterium avium subsp. paratuberculosis
cgucggccugcacgucggcg

SEQ ID NO: 2942673 - RNA, 24 nt, Mycobacterium avium subsp. paratuberculosis
cgucggccugcacgucggcgcgca

SEQ ID NO: 2942674 - RNA, 16 nt, Mycobacterium avium subsp. paratuberculosis
cgucggccugcccgcg

SEQ ID NO: 2942675 - RNA, 16 nt, Mycobacterium avium subsp. paratuberculosis
cgucggccugcgcugc

SEQ ID NO: 2942676 - RNA, 21 nt, Mycobacterium avium subsp. paratuberculosis
cgucggccugcgcugcggcca

SEQ ID NO: 2942677 - RNA, 16 nt, Mycobacterium avium subsp. paratuberculosis
cgucggccuguccggu

SEQ ID NO: 2942678 - RNA, 21 nt, Mycobacterium avium subsp. paratuberculosis
cgucggcgaacggccagucca

SEQ ID NO: 2942679 - RNA, 23 nt, Mycobacterium avium subsp. paratuberculosis
cgucggcgaacuccagaucgccg

SEQ ID NO: 2942680 - RNA, 14 nt, Mycobacterium avium subsp. paratuberculosis
cgucggcgaaggug

SEQ ID NO: 2942681 - RNA, 19 nt, Mycobacterium avium subsp. paratuberculosis
cgucggcgaccgcgcgcgg

SEQ ID NO: 2942682 - RNA, 21 nt, Mycobacterium avium subsp. paratuberculosis
cgucggcgaccgcgcgcggcg

SEQ ID NO: 2942683 - RNA, 14 nt, Mycobacterium avium subsp. paratuberculosis
cgucggcgacgacc

SEQ ID NO: 2942684 - RNA, 17 nt, Mycobacterium avium subsp. paratuberculosis
cgucggcgacggcgucc

SEQ ID NO: 2942685 - RNA, 13 nt, Mycobacterium avium subsp. paratuberculosis
cgucggcgagcag

SEQ ID NO: 2942686 - RNA, 18 nt, Mycobacterium avium subsp. paratuberculosis
cgucggcgagcagcagcg

SEQ ID NO: 2942687 - RNA, 22 nt, Mycobacterium avium subsp. paratuberculosis
cgucggcgagcagcagcgcggu

SEQ ID NO: 2942688 - RNA, 17 nt, Mycobacterium avium subsp. paratuberculosis
cgucggcgagcagcugc

SEQ ID NO: 2942689 - RNA, 12 nt, Mycobacterium avium subsp. paratuberculosis
cgucggcgagcg

SEQ ID NO: 2942690 - RNA, 23 nt, Mycobacterium avium subsp. paratuberculosis
cgucggcgaguucgaccuccacc

SEQ ID NO: 2942691 - RNA, 13 nt, Mycobacterium avium subsp. paratuberculosis
cgucggcgaucgc

SEQ ID NO: 2942692 - RNA, 16 nt, Mycobacterium avium subsp. paratuberculosis
cgucggcgaucgccag

SEQ ID NO: 2942693 - RNA, 20 nt, Mycobacterium avium subsp. paratuberculosis
cgucggcgaucgccagcacg

SEQ ID NO: 2942694 - RNA, 21 nt, Mycobacterium avium subsp. paratuberculosis
cgucggcgaucgccagcacgg

SEQ ID NO: 2942695 - RNA, 12 nt, Mycobacterium avium subsp. paratuberculosis
cgucggcgaucu

SEQ ID NO: 2942696 - RNA, 14 nt, Mycobacterium avium subsp. paratuberculosis
cgucggcgaucucg

SEQ ID NO: 2942697 - RNA, 11 nt, Mycobacterium avium subsp. paratuberculosis
cgucggcgaug

SEQ ID NO: 2942698 - RNA, 12 nt, Mycobacterium avium subsp. paratuberculosis
cgucggcgaugc

SEQ ID NO: 2942699 - RNA, 21 nt, Mycobacterium avium subsp. paratuberculosis
cgucggcgauggcggcgugca

SEQ ID NO: 2942700 - RNA, 21 nt, Mycobacterium avium subsp. paratuberculosis
cgucggcgccccccugcucgc

SEQ ID NO: 2942701 - RNA, 14 nt, Mycobacterium avium subsp. paratuberculosis
cgucggcgccgccg

SEQ ID NO: 2942702 - RNA, 15 nt, Mycobacterium avium subsp. paratuberculosis
cgucggcgccgccga

SEQ ID NO: 2942703 - RNA, 18 nt, Mycobacterium avium subsp. paratuberculosis
cgucggcgccgccgagcc

SEQ ID NO: 2942704 - RNA, 13 nt, Mycobacterium avium subsp. paratuberculosis
cgucggcgccgcg

SEQ ID NO: 2942705 - RNA, 16 nt, Mycobacterium avium subsp. paratuberculosis
cgucggcgccgcgccg

SEQ ID NO: 2942706 - RNA, 13 nt, Mycobacterium avium subsp. paratuberculosis
cgucggcgccgga

SEQ ID NO: 2942707 - RNA, 16 nt, Mycobacterium avium subsp. paratuberculosis
cgucggcgccggaucg

SEQ ID NO: 2942708 - RNA, 14 nt, Mycobacterium avium subsp. paratuberculosis
cgucggcgccggcc

SEQ ID NO: 2942709 - RNA, 15 nt, Mycobacterium avium subsp. paratuberculosis
cgucggcgccggcca

SEQ ID NO: 2942710 - RNA, 14 nt, Mycobacterium avium subsp. paratuberculosis
cgucggcgccgucg

SEQ ID NO: 2942711 - RNA, 15 nt, Mycobacterium avium subsp. paratuberculosis
cgucggcgccgucgc

SEQ ID NO: 2942712 - RNA, 18 nt, Mycobacterium avium subsp. paratuberculosis
cgucggcgccgucgcggg

SEQ ID NO: 2942713 - RNA, 15 nt, Mycobacterium avium subsp. paratuberculosis
cgucggcgcgcaccg

SEQ ID NO: 2942714 - RNA, 16 nt, Mycobacterium avium subsp. paratuberculosis
cgucggcgcgcaccgc

SEQ ID NO: 2942715 - RNA, 13 nt, Mycobacterium avium subsp. paratuberculosis
cgucggcgcgcag

SEQ ID NO: 2942716 - RNA, 14 nt, Mycobacterium avium subsp. paratuberculosis
cgucggcgcgcagg

SEQ ID NO: 2942717 - RNA, 15 nt, Mycobacterium avium subsp. paratuberculosis
cgucggcgcgccacc

SEQ ID NO: 2942718 - RNA, 13 nt, Mycobacterium avium subsp. paratuberculosis
cgucggcgcggcc

SEQ ID NO: 2942719 - RNA, 18 nt, Mycobacterium avium subsp. paratuberculosis
cgucggcgcgggccagca

SEQ ID NO: 2942720 - RNA, 21 nt, Mycobacterium avium subsp. paratuberculosis
cgucggcgcgggccagcagca

SEQ ID NO: 2942721 - RNA, 13 nt, Mycobacterium avium subsp. paratuberculosis
cgucggcgcgucg

SEQ ID NO: 2942722 - RNA, 22 nt, Mycobacterium avium subsp. paratuberculosis
cgucggcgcgucguacaccucg

SEQ ID NO: 2942723 - RNA, 13 nt, Mycobacterium avium subsp. paratuberculosis
cgucggcgcgugc

SEQ ID NO: 2942724 - RNA, 19 nt, Mycobacterium avium subsp. paratuberculosis
cgucggcgcgugccaacca

SEQ ID NO: 2942725 - RNA, 14 nt, Mycobacterium avium subsp. paratuberculosis
cgucggcgcuggcc

SEQ ID NO: 2942726 - RNA, 23 nt, Mycobacterium avium subsp. paratuberculosis
cgucggcgcuggccagcgcgacg

SEQ ID NO: 2942727 - RNA, 22 nt, Mycobacterium avium subsp. paratuberculosis
cgucggcgcuuuccaccucgag

SEQ ID NO: 2942728 - RNA, 15 nt, Mycobacterium avium subsp. paratuberculosis
cgucgggcucggccg

SEQ ID NO: 2942729 - RNA, 14 nt, Mycobacterium avium subsp. paratuberculosis
cgucgggcucgucg

SEQ ID NO: 2942730 - RNA, 19 nt, Mycobacterium avium subsp. paratuberculosis
cgucgggcugggcgggguu

SEQ ID NO: 2942731 - RNA, 20 nt, Mycobacterium avium subsp. paratuberculosis
cgucggggacgaagaccggg

SEQ ID NO: 2942732 - RNA, 14 nt, Mycobacterium avium subsp. paratuberculosis
cgucggggaucagc

SEQ ID NO: 2942733 - RNA, 15 nt, Mycobacterium avium subsp. paratuberculosis
cgucggggaucagcg

SEQ ID NO: 2942734 - RNA, 18 nt, Mycobacterium avium subsp. paratuberculosis
cgucggggcagccgucga

SEQ ID NO: 2942735 - RNA, 20 nt, Mycobacterium avium subsp. paratuberculosis
cgucggggcagccgucgaug

SEQ ID NO: 2942736 - RNA, 21 nt, Mycobacterium avium subsp. paratuberculosis
cgucggggcagccgucgaugc

SEQ ID NO: 2942737 - RNA, 13 nt, Mycobacterium avium subsp. paratuberculosis
cgucggggcccgg

SEQ ID NO: 2942738 - RNA, 14 nt, Mycobacterium avium subsp. paratuberculosis
cgucggggcccggc

SEQ ID NO: 2942739 - RNA, 17 nt, Mycobacterium avium subsp. paratuberculosis
cgucggggcccggcccg

SEQ ID NO: 2942740 - RNA, 23 nt, Mycobacterium avium subsp. paratuberculosis
cgucggggcccuccgcggcgccg

SEQ ID NO: 2942741 - RNA, 14 nt, Mycobacterium avium subsp. paratuberculosis
cgucggggcgccua

SEQ ID NO: 2942742 - RNA, 15 nt, Mycobacterium avium subsp. paratuberculosis
cgucggggcgccuac

SEQ ID NO: 2942743 - RNA, 14 nt, Mycobacterium avium subsp. paratuberculosis
cgucggggcuggcg

SEQ ID NO: 2942744 - RNA, 19 nt, Mycobacterium avium subsp. paratuberculosis
cgucgggggcguuugaggu

SEQ ID NO: 2942745 - RNA, 14 nt, Mycobacterium avium subsp. paratuberculosis
cgucgggggugccg

SEQ ID NO: 2942746 - RNA, 15 nt, Mycobacterium avium subsp. paratuberculosis
cgucgggggugccgc

SEQ ID NO: 2942747 - RNA, 18 nt, Mycobacterium avium subsp. paratuberculosis
cgucggggucgcgccggu

SEQ ID NO: 2942748 - RNA, 18 nt, Mycobacterium avium subsp. paratuberculosis
cgucggggugcgccaggc

SEQ ID NO: 2942749 - RNA, 15 nt, Mycobacterium avium subsp. paratuberculosis
cgucgggguggccgg

SEQ ID NO: 2942750 - RNA, 16 nt, Mycobacterium avium subsp. paratuberculosis
cgucgggguggccggc

SEQ ID NO: 2942751 - RNA, 17 nt, Mycobacterium avium subsp. paratuberculosis
cgucgggguggccggcc

SEQ ID NO: 2942752 - RNA, 23 nt, Mycobacterium avium subsp. paratuberculosis
cgucgggguggggacgacgccga

SEQ ID NO: 2942753 - RNA, 18 nt, Mycobacterium avium subsp. paratuberculosis
cgucggguagggcgccgu

SEQ ID NO: 2942754 - RNA, 19 nt, Mycobacterium avium subsp. paratuberculosis
cgucggguagggcgccguc

SEQ ID NO: 2942755 - RNA, 20 nt, Mycobacterium avium subsp. paratuberculosis
cgucggguagggcgccgucg

SEQ ID NO: 2942756 - RNA, 13 nt, Mycobacterium avium subsp. paratuberculosis
cgucggguccgac

SEQ ID NO: 2942757 - RNA, 17 nt, Mycobacterium avium subsp. paratuberculosis
cgucggguccgaccagc

SEQ ID NO: 2942758 - RNA, 19 nt, Mycobacterium avium subsp. paratuberculosis
cgucggguccgaccagcac

SEQ ID NO: 2942759 - RNA, 23 nt, Mycobacterium avium subsp. paratuberculosis
cgucggguccgaccagcacccgg

SEQ ID NO: 2942760 - RNA, 16 nt, Mycobacterium avium subsp. paratuberculosis
cgucgggucggcgagc

SEQ ID NO: 2942761 - RNA, 17 nt, Mycobacterium avium subsp. paratuberculosis
cgucgggucggcgagca

SEQ ID NO: 2942762 - RNA, 19 nt, Mycobacterium avium subsp. paratuberculosis
cgucgggucggcgagcagc

SEQ ID NO: 2942763 - RNA, 22 nt, Mycobacterium avium subsp. paratuberculosis
cgucgggucggcgagcagccgc

SEQ ID NO: 2942764 - RNA, 20 nt, Mycobacterium avium subsp. paratuberculosis
cgucgggugucaggucggcg

SEQ ID NO: 2942765 - RNA, 15 nt, Mycobacterium avium subsp. paratuberculosis
cgucggguguggcgc

SEQ ID NO: 2942766 - RNA, 19 nt, Mycobacterium avium subsp. paratuberculosis
cgucggguguggcgccgug

SEQ ID NO: 2942767 - RNA, 16 nt, Mycobacterium avium subsp. paratuberculosis
cgucggguucgccggu

SEQ ID NO: 2942768 - RNA, 19 nt, Mycobacterium avium subsp. paratuberculosis
cgucggguuggccagggcg

SEQ ID NO: 2942769 - RNA, 15 nt, Mycobacterium avium subsp. paratuberculosis
cgucgguaaucggcg

SEQ ID NO: 2942770 - RNA, 20 nt, Mycobacterium avium subsp. paratuberculosis
cgucgguaguugcacucucg

SEQ ID NO: 2942771 - RNA, 15 nt, Mycobacterium avium subsp. paratuberculosis
cgucggucacccggu

SEQ ID NO: 2942772 - RNA, 16 nt, Mycobacterium avium subsp. paratuberculosis
cgucggucacccgguu

SEQ ID NO: 2942773 - RNA, 16 nt, Mycobacterium avium subsp. paratuberculosis
cgucggucacggacag

SEQ ID NO: 2942774 - RNA, 17 nt, Mycobacterium avium subsp. paratuberculosis
cgucggucacggacagc

SEQ ID NO: 2942775 - RNA, 17 nt, Mycobacterium avium subsp. paratuberculosis
cgucggucagcaggcgc

SEQ ID NO: 2942776 - RNA, 19 nt, Mycobacterium avium subsp. paratuberculosis
cgucggucagcaggcgccg

SEQ ID NO: 2942777 - RNA, 20 nt, Mycobacterium avium subsp. paratuberculosis
cgucggucagcaggcgccgc

SEQ ID NO: 2942778 - RNA, 15 nt, Mycobacterium avium subsp. paratuberculosis
cgucggucagcaucg

SEQ ID NO: 2942779 - RNA, 20 nt, Mycobacterium avium subsp. paratuberculosis
cgucggucagcgagcgguug

SEQ ID NO: 2942780 - RNA, 17 nt, Mycobacterium avium subsp. paratuberculosis
cgucggucagcggcguc

SEQ ID NO: 2942781 - RNA, 14 nt, Mycobacterium avium subsp. paratuberculosis
cgucggucagcucg

SEQ ID NO: 2942782 - RNA, 19 nt, Mycobacterium avium subsp. paratuberculosis
cgucggucaggaacgcgga

SEQ ID NO: 2942783 - RNA, 17 nt, Mycobacterium avium subsp. paratuberculosis
cgucggucaggccggcg

SEQ ID NO: 2942784 - RNA, 13 nt, Mycobacterium avium subsp. paratuberculosis
cgucggucccgac

SEQ ID NO: 2942785 - RNA, 20 nt, Mycobacterium avium subsp. paratuberculosis
cgucggucccgacgcggcgc

SEQ ID NO: 2942786 - RNA, 20 nt, Mycobacterium avium subsp. paratuberculosis
cgucggucucgacguuggag

SEQ ID NO: 2942787 - RNA, 20 nt, Mycobacterium avium subsp. paratuberculosis
cgucggucucuucgacccgg

SEQ ID NO: 2942788 - RNA, 15 nt, Mycobacterium avium subsp. paratuberculosis
cgucggucugcaggu

SEQ ID NO: 2942789 - RNA, 19 nt, Mycobacterium avium subsp. paratuberculosis
cgucggugaaauagcgcag

SEQ ID NO: 2942790 - RNA, 22 nt, Mycobacterium avium subsp. paratuberculosis
cgucggugaaauagcgcagcau

SEQ ID NO: 2942791 - RNA, 19 nt, Mycobacterium avium subsp. paratuberculosis
cgucggugaacgccgguga

SEQ ID NO: 2942792 - RNA, 20 nt, Mycobacterium avium subsp. paratuberculosis
cgucggugaacucguccaug

SEQ ID NO: 2942793 - RNA, 21 nt, Mycobacterium avium subsp. paratuberculosis
cgucggugaaguuggcggcgg

SEQ ID NO: 2942794 - RNA, 23 nt, Mycobacterium avium subsp. paratuberculosis
cgucggugaaguuggcggcggug

SEQ ID NO: 2942795 - RNA, 13 nt, Mycobacterium avium subsp. paratuberculosis
cgucggugacgcc

SEQ ID NO: 2942796 - RNA, 14 nt, Mycobacterium avium subsp. paratuberculosis
cgucggugacgccc

SEQ ID NO: 2942797 - RNA, 16 nt, Mycobacterium avium subsp. paratuberculosis
cgucggugacggugug

SEQ ID NO: 2942798 - RNA, 23 nt, Mycobacterium avium subsp. paratuberculosis
cgucggugauggugaccaaccac

SEQ ID NO: 2942799 - RNA, 18 nt, Mycobacterium avium subsp. paratuberculosis
cgucggugaugucgguga

SEQ ID NO: 2942800 - RNA, 18 nt, Mycobacterium avium subsp. paratuberculosis
cgucggugccgcguucgg

SEQ ID NO: 2942801 - RNA, 15 nt, Mycobacterium avium subsp. paratuberculosis
cgucggugcgcgccg

SEQ ID NO: 2942802 - RNA, 17 nt, Mycobacterium avium subsp. paratuberculosis
cgucggugcgcgccgca

SEQ ID NO: 2942803 - RNA, 13 nt, Mycobacterium avium subsp. paratuberculosis
cgucgguggcggc

SEQ ID NO: 2942804 - RNA, 19 nt, Mycobacterium avium subsp. paratuberculosis
cgucgguggcggcggcgac

SEQ ID NO: 2942805 - RNA, 20 nt, Mycobacterium avium subsp. paratuberculosis
cgucgguggcggcggcgacg

SEQ ID NO: 2942806 - RNA, 14 nt, Mycobacterium avium subsp. paratuberculosis
cgucgguggcggug

SEQ ID NO: 2942807 - RNA, 15 nt, Mycobacterium avium subsp. paratuberculosis
cgucgguggcggugg

SEQ ID NO: 2942808 - RNA, 20 nt, Mycobacterium avium subsp. paratuberculosis
cgucgguggcgguggggccg

SEQ ID NO: 2942809 - RNA, 21 nt, Mycobacterium avium subsp. paratuberculosis
cgucgguggcgguggggccga

SEQ ID NO: 2942810 - RNA, 15 nt, Mycobacterium avium subsp. paratuberculosis
cgucggugggccgcc

SEQ ID NO: 2942811 - RNA, 16 nt, Mycobacterium avium subsp. paratuberculosis
cgucggugggccgccg

SEQ ID NO: 2942812 - RNA, 19 nt, Mycobacterium avium subsp. paratuberculosis
cgucggugggccgccgcgg

SEQ ID NO: 2942813 - RNA, 19 nt, Mycobacterium avium subsp. paratuberculosis
cgucgucggccucggcggc

SEQ ID NO: 2942814 - RNA, 21 nt, Mycobacterium avium subsp. paratuberculosis
cgucgucggccucggcggccg

SEQ ID NO: 2942815 - RNA, 16 nt, Mycobacterium avium subsp. paratuberculosis
cgucgucggcgaacgg

SEQ ID NO: 2942816 - RNA, 13 nt, Mycobacterium avium subsp. paratuberculosis
cgucgucggcgac

SEQ ID NO: 2942817 - RNA, 14 nt, Mycobacterium avium subsp. paratuberculosis
cgucgucggcgacg

SEQ ID NO: 2942818 - RNA, 16 nt, Mycobacterium avium subsp. paratuberculosis
cgucgucggcgacgac

SEQ ID NO: 2942819 - RNA, 18 nt, Mycobacterium avium subsp. paratuberculosis
cgucgucggcgccgcgcc

SEQ ID NO: 2942820 - RNA, 23 nt, Mycobacterium avium subsp. paratuberculosis
cgucgucggcgccgcgccggcac

SEQ ID NO: 2942821 - RNA, 14 nt, Mycobacterium avium subsp. paratuberculosis
cgucgucggcggcg

SEQ ID NO: 2942822 - RNA, 16 nt, Mycobacterium avium subsp. paratuberculosis
cgucgucggcggcgac

SEQ ID NO: 2942823 - RNA, 17 nt, Mycobacterium avium subsp. paratuberculosis
cgucgucggcggcgacg

SEQ ID NO: 2942824 - RNA, 14 nt, Mycobacterium avium subsp. paratuberculosis
cgucgucggcgggc

SEQ ID NO: 2942825 - RNA, 14 nt, Mycobacterium avium subsp. paratuberculosis
cgucgucggcgggg

SEQ ID NO: 2942826 - RNA, 15 nt, Mycobacterium avium subsp. paratuberculosis
cgucgucggcgggga

SEQ ID NO: 2942827 - RNA, 15 nt, Mycobacterium avium subsp. paratuberculosis
cgucgucgucgaccg

SEQ ID NO: 2942828 - RNA, 15 nt, Mycobacterium avium subsp. paratuberculosis
cgucgucgucgagca

SEQ ID NO: 2942829 - RNA, 15 nt, Mycobacterium avium subsp. paratuberculosis
cgucgucgucgcucc

SEQ ID NO: 2942830 - RNA, 13 nt, Mycobacterium avium subsp. paratuberculosis
cgucgucgucggc

SEQ ID NO: 2942831 - RNA, 15 nt, Mycobacterium avium subsp. paratuberculosis
cgucgucgucggccg

SEQ ID NO: 2942832 - RNA, 20 nt, Mycobacterium avium subsp. paratuberculosis
cgucgucgugcgcgggcgaa

SEQ ID NO: 2942833 - RNA, 22 nt, Mycobacterium avium subsp. paratuberculosis
cgucgucguuggcccgccgcgg

SEQ ID NO: 2942834 - RNA, 20 nt, Mycobacterium avium subsp. paratuberculosis
cgucgucguuguuggcggcg

SEQ ID NO: 2942835 - RNA, 14 nt, Mycobacterium avium subsp. paratuberculosis
cgucgucuuggccu

SEQ ID NO: 2942836 - RNA, 13 nt, Mycobacterium avium subsp. paratuberculosis
cgucgugaccgac

SEQ ID NO: 2942837 - RNA, 22 nt, Mycobacterium avium subsp. paratuberculosis
cgucgugauggcgaaccagcgc

SEQ ID NO: 2942838 - RNA, 19 nt, Mycobacterium avium subsp. paratuberculosis
cgucgugcaacucccgcgc

SEQ ID NO: 2942839 - RNA, 21 nt, Mycobacterium avium subsp. paratuberculosis
cgucgugcaacucccgcgccg

SEQ ID NO: 2942840 - RNA, 12 nt, Mycobacterium avium subsp. paratuberculosis
cgucgugcacca

SEQ ID NO: 2942841 - RNA, 23 nt, Mycobacterium avium subsp. paratuberculosis
cgucgugcaccacgacgucgagc

SEQ ID NO: 2942842 - RNA, 16 nt, Mycobacterium avium subsp. paratuberculosis
cgucgugcacgccgug

SEQ ID NO: 2942843 - RNA, 17 nt, Mycobacterium avium subsp. paratuberculosis
cgucgugcacgccgugg

SEQ ID NO: 2942844 - RNA, 14 nt, Mycobacterium avium subsp. paratuberculosis
cgucgugccagcgc

SEQ ID NO: 2942845 - RNA, 15 nt, Mycobacterium avium subsp. paratuberculosis
cgucgugccagcgca

SEQ ID NO: 2942846 - RNA, 15 nt, Mycobacterium avium subsp. paratuberculosis
cgucgugccgagcgu

SEQ ID NO: 2942847 - RNA, 17 nt, Mycobacterium avium subsp. paratuberculosis
cgucgugccgagcguga

SEQ ID NO: 2942848 - RNA, 18 nt, Mycobacterium avium subsp. paratuberculosis
cgucgugcgcgggcgaaa

SEQ ID NO: 2942849 - RNA, 14 nt, Mycobacterium avium subsp. paratuberculosis
cgucgugcggccgg

SEQ ID NO: 2942850 - RNA, 15 nt, Mycobacterium avium subsp. paratuberculosis
cgucgugcggccggc

SEQ ID NO: 2942851 - RNA, 19 nt, Mycobacterium avium subsp. paratuberculosis
cgucgugcggccggcgccg

SEQ ID NO: 2942852 - RNA, 19 nt, Mycobacterium avium subsp. paratuberculosis
cgucgugcgggcuccgcac

SEQ ID NO: 2942853 - RNA, 15 nt, Mycobacterium avium subsp. paratuberculosis
cgucgugcucggcga

SEQ ID NO: 2942854 - RNA, 16 nt, Mycobacterium avium subsp. paratuberculosis
cgucgugggcgauccg

SEQ ID NO: 2942855 - RNA, 17 nt, Mycobacterium avium subsp. paratuberculosis
cgucgugggcgauccgc

SEQ ID NO: 2942856 - RNA, 21 nt, Mycobacterium avium subsp. paratuberculosis
cgucguggguauccgccgcca

SEQ ID NO: 2942857 - RNA, 22 nt, Mycobacterium avium subsp. paratuberculosis
cgucguggguauccgccgccag

SEQ ID NO: 2942858 - RNA, 17 nt, Mycobacterium avium subsp. paratuberculosis
cgucgugguagcggucg

SEQ ID NO: 2942859 - RNA, 12 nt, Mycobacterium avium subsp. paratuberculosis
cgucguggucga

SEQ ID NO: 2942860 - RNA, 14 nt, Mycobacterium avium subsp. paratuberculosis
cgucguggucgacg

SEQ ID NO: 2942861 - RNA, 15 nt, Mycobacterium avium subsp. paratuberculosis
cgucguggucgacgc

SEQ ID NO: 2942862 - RNA, 16 nt, Mycobacterium avium subsp. paratuberculosis
cgucgugguggccgcg

SEQ ID NO: 2942863 - RNA, 17 nt, Mycobacterium avium subsp. paratuberculosis
cgucgugguggccgcga

SEQ ID NO: 2942864 - RNA, 21 nt, Mycobacterium avium subsp. paratuberculosis
cgucgugucguguucgccgag

SEQ ID NO: 2942865 - RNA, 13 nt, Mycobacterium avium subsp. paratuberculosis
cgucguucucggg

SEQ ID NO: 2942866 - RNA, 21 nt, Mycobacterium avium subsp. paratuberculosis
cgucguucucgggggcgggca

SEQ ID NO: 2942867 - RNA, 14 nt, Mycobacterium avium subsp. paratuberculosis
cgucguugaacgcg

SEQ ID NO: 2942868 - RNA, 18 nt, Mycobacterium avium subsp. paratuberculosis
cgucguugaacgcgcggg

SEQ ID NO: 2942869 - RNA, 21 nt, Mycobacterium avium subsp. paratuberculosis
cgucguugaacgcgcgggugc

SEQ ID NO: 2942870 - RNA, 14 nt, Mycobacterium avium subsp. paratuberculosis
cgucguugaccgag

SEQ ID NO: 2942871 - RNA, 21 nt, Mycobacterium avium subsp. paratuberculosis
cgucguugaccgaggcgaucg

SEQ ID NO: 2942872 - RNA, 22 nt, Mycobacterium avium subsp. paratuberculosis
cgucguugaccgaggcgaucgc

SEQ ID NO: 2942873 - RNA, 23 nt, Mycobacterium avium subsp. paratuberculosis
cgucguugaccgaggcgaucgcg

SEQ ID NO: 2942874 - RNA, 15 nt, Mycobacterium avium subsp. paratuberculosis
cgucguugaccugcu

SEQ ID NO: 2942875 - RNA, 14 nt, Mycobacterium avium subsp. paratuberculosis
cgucguugacgccc

SEQ ID NO: 2942876 - RNA, 22 nt, Mycobacterium avium subsp. paratuberculosis
cgucguugagcaggcuggagua

SEQ ID NO: 2942877 - RNA, 16 nt, Mycobacterium avium subsp. paratuberculosis
cgucguugagcaucac

SEQ ID NO: 2942878 - RNA, 15 nt, Mycobacterium avium subsp. paratuberculosis
cgucguugcgcagcg

SEQ ID NO: 2942879 - RNA, 13 nt, Mycobacterium avium subsp. paratuberculosis
cgucguugcgggc

SEQ ID NO: 2942880 - RNA, 14 nt, Mycobacterium avium subsp. paratuberculosis
cgucguugcgggcg

SEQ ID NO: 2942881 - RNA, 18 nt, Mycobacterium avium subsp. paratuberculosis
cgucguugcgggcggcgc

SEQ ID NO: 2942882 - RNA, 21 nt, Mycobacterium avium subsp. paratuberculosis
cgucguugcgggcggcgcggc

SEQ ID NO: 2942883 - RNA, 16 nt, Mycobacterium avium subsp. paratuberculosis
cgucguuggcccgccg

SEQ ID NO: 2942884 - RNA, 16 nt, Mycobacterium avium subsp. paratuberculosis
cgucguuggcgccguc

SEQ ID NO: 2942885 - RNA, 16 nt, Mycobacterium avium subsp. paratuberculosis
cgucguugucgucgcc

SEQ ID NO: 2942886 - RNA, 19 nt, Mycobacterium avium subsp. paratuberculosis
cgucguugugggccagcgc

SEQ ID NO: 2942887 - RNA, 20 nt, Mycobacterium avium subsp. paratuberculosis
cgucguugugggccagcgcg

SEQ ID NO: 2942888 - RNA, 21 nt, Mycobacterium avium subsp. paratuberculosis
cgucguugugggccagcgcgg

SEQ ID NO: 2942889 - RNA, 19 nt, Mycobacterium avium subsp. paratuberculosis
cgucguuguugcgcgggaa

SEQ ID NO: 2942890 - RNA, 18 nt, Mycobacterium avium subsp. paratuberculosis
cgucguuguuggcggcgg

SEQ ID NO: 2942891 - RNA, 19 nt, Mycobacterium avium subsp. paratuberculosis
cgucguuguuggcggcggu

SEQ ID NO: 2942892 - RNA, 20 nt, Mycobacterium avium subsp. paratuberculosis
cgucguuguuggcggcggug

SEQ ID NO: 2942893 - RNA, 20 nt, Mycobacterium avium subsp. paratuberculosis
cgucguuuuccagccggcgc

SEQ ID NO: 2942894 - RNA, 21 nt, Mycobacterium avium subsp. paratuberculosis
cgucguuuuccagccggcgca

SEQ ID NO: 2942895 - RNA, 14 nt, Mycobacterium avium subsp. paratuberculosis
cgucuagcggcgug

SEQ ID NO: 2942896 - RNA, 21 nt, Mycobacterium avium subsp. paratuberculosis
cgucucaggaauuugcggccc

SEQ ID NO: 2942897 - RNA, 22 nt, Mycobacterium avium subsp. paratuberculosis
cgucucagucggccaccgcgau

SEQ ID NO: 2942898 - RNA, 22 nt, Mycobacterium avium subsp. paratuberculosis
cgucuuuucccacacgcucggc

SEQ ID NO: 2942899 - RNA, 20 nt, Mycobacterium avium subsp. paratuberculosis
cgugaaacuaacuucacgcu

SEQ ID NO: 2942900 - RNA, 23 nt, Mycobacterium avium subsp. paratuberculosis
cgugaaacuaacuucacgcucgc

SEQ ID NO: 2942901 - RNA, 19 nt, Mycobacterium avium subsp. paratuberculosis
cgugaaacuagcuucacgc

SEQ ID NO: 2942902 - RNA, 19 nt, Mycobacterium avium subsp. paratuberculosis
cgugaaacuagcuucacgu

SEQ ID NO: 2942903 - RNA, 20 nt, Mycobacterium avium subsp. paratuberculosis
cgugaaacuagcuucacguu

SEQ ID NO: 2942904 - RNA, 19 nt, Mycobacterium avium subsp. paratuberculosis
cgugaaacuaguuucacgu

SEQ ID NO: 2942905 - RNA, 20 nt, Mycobacterium avium subsp. paratuberculosis
cgugaaacuaguuucacguu

SEQ ID NO: 2942906 - RNA, 23 nt, Mycobacterium avium subsp. paratuberculosis
cgugaaaucguggcuuucggcgc

SEQ ID NO: 2942907 - RNA, 21 nt, Mycobacterium avium subsp. paratuberculosis
cgugaaccggcguugcauuuc

SEQ ID NO: 2942908 - RNA, 21 nt, Mycobacterium avium subsp. paratuberculosis
cgugaacgacgccguucaggu

SEQ ID NO: 2942909 - RNA, 17 nt, Mycobacterium avium subsp. paratuberculosis
cgugaacugugcggugc

SEQ ID NO: 2942910 - RNA, 22 nt, Mycobacterium avium subsp. paratuberculosis
cgugaacugugcggugcggcuu

SEQ ID NO: 2942911 - RNA, 20 nt, Mycobacterium avium subsp. paratuberculosis
cgugaacuuaacuucacgcu

SEQ ID NO: 2942912 - RNA, 21 nt, Mycobacterium avium subsp. paratuberculosis
cgugaacuuaacuucacgcuc

SEQ ID NO: 2942913 - RNA, 15 nt, Mycobacterium avium subsp. paratuberculosis
cgugaagaucagcga

SEQ ID NO: 2942914 - RNA, 14 nt, Mycobacterium avium subsp. paratuberculosis
cgugaagccggugg

SEQ ID NO: 2942915 - RNA, 20 nt, Mycobacterium avium subsp. paratuberculosis
cgugaagcuagcuucacgcu

SEQ ID NO: 2942916 - RNA, 21 nt, Mycobacterium avium subsp. paratuberculosis
cgugaagcuagcuucacgcuc

SEQ ID NO: 2942917 - RNA, 23 nt, Mycobacterium avium subsp. paratuberculosis
cgugaagcuagcuucacgcucgg

SEQ ID NO: 2942918 - RNA, 19 nt, Mycobacterium avium subsp. paratuberculosis
cgugaagcuaguuucacgc

SEQ ID NO: 2942919 - RNA, 15 nt, Mycobacterium avium subsp. paratuberculosis
cgugaagggcccgcc

SEQ ID NO: 2942920 - RNA, 22 nt, Mycobacterium avium subsp. paratuberculosis
cgugaagggguccggaagcccu

SEQ ID NO: 2942921 - RNA, 19 nt, Mycobacterium avium subsp. paratuberculosis
cgugaaguuaguuucacgc

SEQ ID NO: 2942922 - RNA, 16 nt, Mycobacterium avium subsp. paratuberculosis
cgugaauccucagcac

SEQ ID NO: 2942923 - RNA, 17 nt, Mycobacterium avium subsp. paratuberculosis
cgugaauccucagcacg

SEQ ID NO: 2942924 - RNA, 18 nt, Mycobacterium avium subsp. paratuberculosis
cgugaaucuuggccagca

SEQ ID NO: 2942925 - RNA, 13 nt, Mycobacterium avium subsp. paratuberculosis
cgugaaugcccag

SEQ ID NO: 2942926 - RNA, 14 nt, Mycobacterium avium subsp. paratuberculosis
cgugaauucggccg

SEQ ID NO: 2942927 - RNA, 16 nt, Mycobacterium avium subsp. paratuberculosis
cgugacaagccggcgu

SEQ ID NO: 2942928 - RNA, 18 nt, Mycobacterium avium subsp. paratuberculosis
cgugacaagccggcgucg

SEQ ID NO: 2942929 - RNA, 19 nt, Mycobacterium avium subsp. paratuberculosis
cgugacaagccggcgucga

SEQ ID NO: 2942930 - RNA, 17 nt, Mycobacterium avium subsp. paratuberculosis
cgugacaggggcagcag

SEQ ID NO: 2942931 - RNA, 23 nt, Mycobacterium avium subsp. paratuberculosis
cgugacaggggcagcagcagauc

SEQ ID NO: 2942932 - RNA, 22 nt, Mycobacterium avium subsp. paratuberculosis
cgugacaggguaacccgggacc

SEQ ID NO: 2942933 - RNA, 18 nt, Mycobacterium avium subsp. paratuberculosis
cgugacagucgaccucgc

SEQ ID NO: 2942934 - RNA, 19 nt, Mycobacterium avium subsp. paratuberculosis
cgugacagucgaccucgcg

SEQ ID NO: 2942935 - RNA, 19 nt, Mycobacterium avium subsp. paratuberculosis
cgugaccaaugcggugaac

SEQ ID NO: 2942936 - RNA, 14 nt, Mycobacterium avium subsp. paratuberculosis
cgugaccaccgugc

SEQ ID NO: 2942937 - RNA, 19 nt, Mycobacterium avium subsp. paratuberculosis
cgugaccccggcgaccagc

SEQ ID NO: 2942938 - RNA, 21 nt, Mycobacterium avium subsp. paratuberculosis
cgugaccccggcgaccagcag

SEQ ID NO: 2942939 - RNA, 14 nt, Mycobacterium avium subsp. paratuberculosis
cgugacccgccgug

SEQ ID NO: 2942940 - RNA, 15 nt, Mycobacterium avium subsp. paratuberculosis
cgugacccgccguga

SEQ ID NO: 2942941 - RNA, 17 nt, Mycobacterium avium subsp. paratuberculosis
cgugacccgccgugacc

SEQ ID NO: 2942942 - RNA, 22 nt, Mycobacterium avium subsp. paratuberculosis
cgugacccugccgucaccggcc

SEQ ID NO: 2942943 - RNA, 22 nt, Mycobacterium avium subsp. paratuberculosis
cgugaccgaccuccaaugcgcc

SEQ ID NO: 2942944 - RNA, 18 nt, Mycobacterium avium subsp. paratuberculosis
cgugaccggcggugucgg

SEQ ID NO: 2942945 - RNA, 22 nt, Mycobacterium avium subsp. paratuberculosis
cgugaccggcugcucgcgcugc

SEQ ID NO: 2942946 - RNA, 12 nt, Mycobacterium avium subsp. paratuberculosis
cgugacgaccug

SEQ ID NO: 2942947 - RNA, 14 nt, Mycobacterium avium subsp. paratuberculosis
cgugacgaccuggu

SEQ ID NO: 2942948 - RNA, 17 nt, Mycobacterium avium subsp. paratuberculosis
cgugacgaccuggucgc

SEQ ID NO: 2942949 - RNA, 22 nt, Mycobacterium avium subsp. paratuberculosis
cgugacgaccuggucgccgccg

SEQ ID NO: 2942950 - RNA, 17 nt, Mycobacterium avium subsp. paratuberculosis
cgugacgcccggcgccg

SEQ ID NO: 2942951 - RNA, 16 nt, Mycobacterium avium subsp. paratuberculosis
cgugacgccgauccgc

SEQ ID NO: 2942952 - RNA, 20 nt, Mycobacterium avium subsp. paratuberculosis
cgugacgccgauccgcugcg

SEQ ID NO: 2942953 - RNA, 15 nt, Mycobacterium avium subsp. paratuberculosis
cgugacgccgcugcg

SEQ ID NO: 2942954 - RNA, 12 nt, Mycobacterium avium subsp. paratuberculosis
cgugacgccggg

SEQ ID NO: 2942955 - RNA, 14 nt, Mycobacterium avium subsp. paratuberculosis
cgugacgccgggcc

SEQ ID NO: 2942956 - RNA, 17 nt, Mycobacterium avium subsp. paratuberculosis
cgugacgccgggccgcc

SEQ ID NO: 2942957 - RNA, 18 nt, Mycobacterium avium subsp. paratuberculosis
cgugacgccgggccgccg

SEQ ID NO: 2942958 - RNA, 20 nt, Mycobacterium avium subsp. paratuberculosis
cgugacgccgggccgccgcg

SEQ ID NO: 2942959 - RNA, 22 nt, Mycobacterium avium subsp. paratuberculosis
cgugacgccgggccgccgcggc

SEQ ID NO: 2942960 - RNA, 13 nt, Mycobacterium avium subsp. paratuberculosis
cgugacgccgucc

SEQ ID NO: 2942961 - RNA, 19 nt, Mycobacterium avium subsp. paratuberculosis
cgugacgcgaagucgccgc

SEQ ID NO: 2942962 - RNA, 12 nt, Mycobacterium avium subsp. paratuberculosis
cgugacgcgcgu

SEQ ID NO: 2942963 - RNA, 20 nt, Mycobacterium avium subsp. paratuberculosis
cgugacgcgcgugacggcgg

SEQ ID NO: 2942964 - RNA, 12 nt, Mycobacterium avium subsp. paratuberculosis
cgugacgcggcg

SEQ ID NO: 2942965 - RNA, 14 nt, Mycobacterium avium subsp. paratuberculosis
cgugacgcggcguc

SEQ ID NO: 2942966 - RNA, 21 nt, Mycobacterium avium subsp. paratuberculosis
cgugacgcucgacggccggcg

SEQ ID NO: 2942967 - RNA, 15 nt, Mycobacterium avium subsp. paratuberculosis
cgugacgcucgaggc

SEQ ID NO: 2942968 - RNA, 18 nt, Mycobacterium avium subsp. paratuberculosis
cgugacgcucgccggcgg

SEQ ID NO: 2942969 - RNA, 15 nt, Mycobacterium avium subsp. paratuberculosis
cgugacgcucggccg

SEQ ID NO: 2942970 - RNA, 16 nt, Mycobacterium avium subsp. paratuberculosis
cgugacgcucggccgu

SEQ ID NO: 2942971 - RNA, 17 nt, Mycobacterium avium subsp. paratuberculosis
cgugacgcucggccgug

SEQ ID NO: 2942972 - RNA, 15 nt, Mycobacterium avium subsp. paratuberculosis
cgugacgcucggccu

SEQ ID NO: 2942973 - RNA, 18 nt, Mycobacterium avium subsp. paratuberculosis
cgugacgcucggcgccgc

SEQ ID NO: 2942974 - RNA, 19 nt, Mycobacterium avium subsp. paratuberculosis
cgugacgcucggcgccgcg

SEQ ID NO: 2942975 - RNA, 20 nt, Mycobacterium avium subsp. paratuberculosis
cgugacgcucggcgccgcgg

SEQ ID NO: 2942976 - RNA, 19 nt, Mycobacterium avium subsp. paratuberculosis
cgugacgcucggcgccggc

SEQ ID NO: 2942977 - RNA, 21 nt, Mycobacterium avium subsp. paratuberculosis
cgugacgcucggcgccggccg

SEQ ID NO: 2942978 - RNA, 16 nt, Mycobacterium avium subsp. paratuberculosis
cgugacgcucggcgcg

SEQ ID NO: 2942979 - RNA, 18 nt, Mycobacterium avium subsp. paratuberculosis
cgugacgcucggcgcguc

SEQ ID NO: 2942980 - RNA, 19 nt, Mycobacterium avium subsp. paratuberculosis
cgugacgcucggcgcgucg

SEQ ID NO: 2942981 - RNA, 15 nt, Mycobacterium avium subsp. paratuberculosis
cgugacgcucggcgg

SEQ ID NO: 2942982 - RNA, 17 nt, Mycobacterium avium subsp. paratuberculosis
cgugcaccggcgagucc

SEQ ID NO: 2942983 - RNA, 18 nt, Mycobacterium avium subsp. paratuberculosis
cgugcaccgucgccggcg

SEQ ID NO: 2942984 - RNA, 22 nt, Mycobacterium avium subsp. paratuberculosis
cgugcaccgucgccggcggggc

SEQ ID NO: 2942985 - RNA, 14 nt, Mycobacterium avium subsp. paratuberculosis
cgugcaccugcagc

SEQ ID NO: 2942986 - RNA, 15 nt, Mycobacterium avium subsp. paratuberculosis
cgugcaccugcagcc

SEQ ID NO: 2942987 - RNA, 20 nt, Mycobacterium avium subsp. paratuberculosis
cgugcaccugugaggcaccg

SEQ ID NO: 2942988 - RNA, 24 nt, Mycobacterium avium subsp. paratuberculosis
cgugcaccugugaggcaccgaacg

SEQ ID NO: 2942989 - RNA, 24 nt, Mycobacterium avium subsp. paratuberculosis
cgugcaccuuggucagcucccggc

SEQ ID NO: 2942990 - RNA, 14 nt, Mycobacterium avium subsp. paratuberculosis
cgugcacgaacgcg

SEQ ID NO: 2942991 - RNA, 17 nt, Mycobacterium avium subsp. paratuberculosis
cgugcacgaacgcggcc

SEQ ID NO: 2942992 - RNA, 18 nt, Mycobacterium avium subsp. paratuberculosis
cgugcacgaacgcggcca

SEQ ID NO: 2942993 - RNA, 23 nt, Mycobacterium avium subsp. paratuberculosis
cgugcacgaacgcggccagcggg

SEQ ID NO: 2942994 - RNA, 14 nt, Mycobacterium avium subsp. paratuberculosis
cgugcacgaucgcg

SEQ ID NO: 2942995 - RNA, 14 nt, Mycobacterium avium subsp. paratuberculosis
cgugcacgccgucg

SEQ ID NO: 2942996 - RNA, 17 nt, Mycobacterium avium subsp. paratuberculosis
cgugcacgccgucgugc

SEQ ID NO: 2942997 - RNA, 16 nt, Mycobacterium avium subsp. paratuberculosis
cgugcacgccguggcg

SEQ ID NO: 2942998 - RNA, 21 nt, Mycobacterium avium subsp. paratuberculosis
cgugcacgccguggcggcggg

SEQ ID NO: 2942999 - RNA, 22 nt, Mycobacterium avium subsp. paratuberculosis
cgugcacgccguggcggcgggc

SEQ ID NO: 2943000 - RNA, 14 nt, Mycobacterium avium subsp. paratuberculosis
cgugcacggcgccg

SEQ ID NO: 2943001 - RNA, 19 nt, Mycobacterium avium subsp. paratuberculosis
cgugcacggcgccgugccg

SEQ ID NO: 2943002 - RNA, 16 nt, Mycobacterium avium subsp. paratuberculosis
cgugcacucagggcga

SEQ ID NO: 2943003 - RNA, 13 nt, Mycobacterium avium subsp. paratuberculosis
cgugcagaacagc

SEQ ID NO: 2943004 - RNA, 16 nt, Mycobacterium avium subsp. paratuberculosis
cgugcagaacagcacg

SEQ ID NO: 2943005 - RNA, 20 nt, Mycobacterium avium subsp. paratuberculosis
cgugcagacaaccggugugc

SEQ ID NO: 2943006 - RNA, 11 nt, Mycobacterium avium subsp. paratuberculosis
cgugcagcacc

SEQ ID NO: 2943007 - RNA, 14 nt, Mycobacterium avium subsp. paratuberculosis
cgugcagcaccgcc

SEQ ID NO: 2943008 - RNA, 17 nt, Mycobacterium avium subsp. paratuberculosis
cgugcagcaccgccagc

SEQ ID NO: 2943009 - RNA, 18 nt, Mycobacterium avium subsp. paratuberculosis
cgugcagcaccgccagca

SEQ ID NO: 2943010 - RNA, 15 nt, Mycobacterium avium subsp. paratuberculosis
cgugcagcaccucga

SEQ ID NO: 2943011 - RNA, 23 nt, Mycobacterium avium subsp. paratuberculosis
cgugcagcaccucgaagccgacg

SEQ ID NO: 2943012 - RNA, 15 nt, Mycobacterium avium subsp. paratuberculosis
cgugcagcacgcccu

SEQ ID NO: 2943013 - RNA, 14 nt, Mycobacterium avium subsp. paratuberculosis
cgugcagcacgccg

SEQ ID NO: 2943014 - RNA, 17 nt, Mycobacterium avium subsp. paratuberculosis
cgugcagcacgccgcgg

SEQ ID NO: 2943015 - RNA, 20 nt, Mycobacterium avium subsp. paratuberculosis
cgugcagcacggggacgcug

SEQ ID NO: 2943016 - RNA, 13 nt, Mycobacterium avium subsp. paratuberculosis
cgugcagccggcg

SEQ ID NO: 2943017 - RNA, 18 nt, Mycobacterium avium subsp. paratuberculosis
cgugcagccggcggcgcc

SEQ ID NO: 2943018 - RNA, 19 nt, Mycobacterium avium subsp. paratuberculosis
cgugcagccggcggcgccu

SEQ ID NO: 2943019 - RNA, 12 nt, Mycobacterium avium subsp. paratuberculosis
cgugcagccggg

SEQ ID NO: 2943020 - RNA, 13 nt, Mycobacterium avium subsp. paratuberculosis
cgugcagccgggc

SEQ ID NO: 2943021 - RNA, 14 nt, Mycobacterium avium subsp. paratuberculosis
cgugcagccgggcc

SEQ ID NO: 2943022 - RNA, 15 nt, Mycobacterium avium subsp. paratuberculosis
cgugcagccgggcgg

SEQ ID NO: 2943023 - RNA, 17 nt, Mycobacterium avium subsp. paratuberculosis
cgugcagccgggcggcg

SEQ ID NO: 2943024 - RNA, 19 nt, Mycobacterium avium subsp. paratuberculosis
cgugcagccgggcggcgcc

SEQ ID NO: 2943025 - RNA, 22 nt, Mycobacterium avium subsp. paratuberculosis
cgugcagccgggcggcgccgaa

SEQ ID NO: 2943026 - RNA, 23 nt, Mycobacterium avium subsp. paratuberculosis
cgugcagccgggcggcgccgaac

SEQ ID NO: 2943027 - RNA, 14 nt, Mycobacterium avium subsp. paratuberculosis
cgugcagcgccagc

SEQ ID NO: 2943028 - RNA, 18 nt, Mycobacterium avium subsp. paratuberculosis
cgugcagcgccagcaccg

SEQ ID NO: 2943029 - RNA, 12 nt, Mycobacterium avium subsp. paratuberculosis
cgugcagcgccc

SEQ ID NO: 2943030 - RNA, 18 nt, Mycobacterium avium subsp. paratuberculosis
cgugcagcgcccagccga

SEQ ID NO: 2943031 - RNA, 23 nt, Mycobacterium avium subsp. paratuberculosis
cgugcagcgcccagccgagccgg

SEQ ID NO: 2943032 - RNA, 13 nt, Mycobacterium avium subsp. paratuberculosis
cgugcagcgcggc

SEQ ID NO: 2943033 - RNA, 14 nt, Mycobacterium avium subsp. paratuberculosis
cgugcagcucggug

SEQ ID NO: 2943034 - RNA, 15 nt, Mycobacterium avium subsp. paratuberculosis
cgugcagcucggugc

SEQ ID NO: 2943035 - RNA, 18 nt, Mycobacterium avium subsp. paratuberculosis
cgugcagcucggugcaga

SEQ ID NO: 2943036 - RNA, 17 nt, Mycobacterium avium subsp. paratuberculosis
cgugcaggauccgcucg

SEQ ID NO: 2943037 - RNA, 17 nt, Mycobacterium avium subsp. paratuberculosis
cgugcaggaucggcuug

SEQ ID NO: 2943038 - RNA, 21 nt, Mycobacterium avium subsp. paratuberculosis
cgugcaggaugaccgcgucgg

SEQ ID NO: 2943039 - RNA, 22 nt, Mycobacterium avium subsp. paratuberculosis
cgugcaggaugaccgcgucggc

SEQ ID NO: 2943040 - RNA, 12 nt, Mycobacterium avium subsp. paratuberculosis
cgugcaggccgc

SEQ ID NO: 2943041 - RNA, 14 nt, Mycobacterium avium subsp. paratuberculosis
cgugcaggccgcgg

SEQ ID NO: 2943042 - RNA, 15 nt, Mycobacterium avium subsp. paratuberculosis
cgugcaggccgcggg

SEQ ID NO: 2943043 - RNA, 17 nt, Mycobacterium avium subsp. paratuberculosis
cgugcaggccgcgggug

SEQ ID NO: 2943044 - RNA, 19 nt, Mycobacterium avium subsp. paratuberculosis
cgugcaggccgcggguggc

SEQ ID NO: 2943045 - RNA, 14 nt, Mycobacterium avium subsp. paratuberculosis
cgugcaggugcggc

SEQ ID NO: 2943046 - RNA, 17 nt, Mycobacterium avium subsp. paratuberculosis
cgugcaggugcggcacc

SEQ ID NO: 2943047 - RNA, 16 nt, Mycobacterium avium subsp. paratuberculosis
cgugcagucccagauc

SEQ ID NO: 2943048 - RNA, 15 nt, Mycobacterium avium subsp. paratuberculosis
cgugcauccagccgu

SEQ ID NO: 2943049 - RNA, 14 nt, Mycobacterium avium subsp. paratuberculosis
cgugcaucggcgcc

SEQ ID NO: 2943050 - RNA, 15 nt, Mycobacterium avium subsp. paratuberculosis
cgugcaucggcgccu

SEQ ID NO: 2943051 - RNA, 16 nt, Mycobacterium avium subsp. paratuberculosis
cgugcaucggcgccug

SEQ ID NO: 2943052 - RNA, 17 nt, Mycobacterium avium subsp. paratuberculosis
cgugcaucggcgccugc

SEQ ID NO: 2943053 - RNA, 23 nt, Mycobacterium avium subsp. paratuberculosis
cgugcaucggcgccugcgagcac

SEQ ID NO: 2943054 - RNA, 19 nt, Mycobacterium avium subsp. paratuberculosis
cgugcaucgggcgcucggc

SEQ ID NO: 2943055 - RNA, 17 nt, Mycobacterium avium subsp. paratuberculosis
cgugcauguagguggcg

SEQ ID NO: 2943056 - RNA, 21 nt, Mycobacterium avium subsp. paratuberculosis
cgugcauguagguggcgacca

SEQ ID NO: 2943057 - RNA, 17 nt, Mycobacterium avium subsp. paratuberculosis
cgugcaugugcucggcg

SEQ ID NO: 2943058 - RNA, 18 nt, Mycobacterium avium subsp. paratuberculosis
cgugcaugugcucggcga

SEQ ID NO: 2943059 - RNA, 23 nt, Mycobacterium avium subsp. paratuberculosis
cgugcauucaggucaccgcgcga

SEQ ID NO: 2943060 - RNA, 16 nt, Mycobacterium avium subsp. paratuberculosis
cgugcauucagugcga

SEQ ID NO: 2943061 - RNA, 19 nt, Mycobacterium avium subsp. paratuberculosis
cgugcauucagugcgagaa

SEQ ID NO: 2943062 - RNA, 22 nt, Mycobacterium avium subsp. paratuberculosis
cgugccaaccacuugaagccgg

SEQ ID NO: 2943063 - RNA, 23 nt, Mycobacterium avium subsp. paratuberculosis
cgugccaagcguauccggccagc

SEQ ID NO: 2943064 - RNA, 17 nt, Mycobacterium avium subsp. paratuberculosis
cgugccacaggccgaac

SEQ ID NO: 2943065 - RNA, 20 nt, Mycobacterium avium subsp. paratuberculosis
cgugccacaggccgaacagc

SEQ ID NO: 2943066 - RNA, 21 nt, Mycobacterium avium subsp. paratuberculosis
cgugccacaggccgaacagca

SEQ ID NO: 2943067 - RNA, 15 nt, Mycobacterium avium subsp. paratuberculosis
cgugccggcggcagg

SEQ ID NO: 2943068 - RNA, 13 nt, Mycobacterium avium subsp. paratuberculosis
cgugccggcggcg

SEQ ID NO: 2943069 - RNA, 14 nt, Mycobacterium avium subsp. paratuberculosis
cgugccggcggcgg

SEQ ID NO: 2943070 - RNA, 15 nt, Mycobacterium avium subsp. paratuberculosis
cgugccggcggcgga

SEQ ID NO: 2943071 - RNA, 22 nt, Mycobacterium avium subsp. paratuberculosis
cgugccggcggcggaccgucgg

SEQ ID NO: 2943072 - RNA, 15 nt, Mycobacterium avium subsp. paratuberculosis
cgugccggcucggcg

SEQ ID NO: 2943073 - RNA, 20 nt, Mycobacterium avium subsp. paratuberculosis
cgugccggcucggcggcuca

SEQ ID NO: 2943074 - RNA, 16 nt, Mycobacterium avium subsp. paratuberculosis
cgugccgggcgguacg

SEQ ID NO: 2943075 - RNA, 16 nt, Mycobacterium avium subsp. paratuberculosis
cgugccgguggaacag

SEQ ID NO: 2943076 - RNA, 16 nt, Mycobacterium avium subsp. paratuberculosis
cgugccguccagcucc

SEQ ID NO: 2943077 - RNA, 17 nt, Mycobacterium avium subsp. paratuberculosis
cgugccgucggcgucga

SEQ ID NO: 2943078 - RNA, 17 nt, Mycobacterium avium subsp. paratuberculosis
cgugccuuacgccgggg

SEQ ID NO: 2943079 - RNA, 15 nt, Mycobacterium avium subsp. paratuberculosis
cgugccuugcaccca

SEQ ID NO: 2943080 - RNA, 16 nt, Mycobacterium avium subsp. paratuberculosis
cgugcgaaugacgcgc

SEQ ID NO: 2943081 - RNA, 17 nt, Mycobacterium avium subsp. paratuberculosis
cgugcgaaugacgcgca

SEQ ID NO: 2943082 - RNA, 15 nt, Mycobacterium avium subsp. paratuberculosis
cgugcgacaccggcg

SEQ ID NO: 2943083 - RNA, 16 nt, Mycobacterium avium subsp. paratuberculosis
cgugcgacggcucuuc

SEQ ID NO: 2943084 - RNA, 14 nt, Mycobacterium avium subsp. paratuberculosis
cgugcgagccgagc

SEQ ID NO: 2943085 - RNA, 23 nt, Mycobacterium avium subsp. paratuberculosis
cgugcgagccgagcacgcagccg

SEQ ID NO: 2943086 - RNA, 21 nt, Mycobacterium avium subsp. paratuberculosis
cgugcgcccauccggcgccgc

SEQ ID NO: 2943087 - RNA, 24 nt, Mycobacterium avium subsp. paratuberculosis
cgugcgcccauccggcgccgcgca

SEQ ID NO: 2943088 - RNA, 21 nt, Mycobacterium avium subsp. paratuberculosis
cgugcgccccgcccugcuuga

SEQ ID NO: 2943089 - RNA, 14 nt, Mycobacterium avium subsp. paratuberculosis
cgugcgcccgacgc

SEQ ID NO: 2943090 - RNA, 17 nt, Mycobacterium avium subsp. paratuberculosis
cgugcgcccgacgccgg

SEQ ID NO: 2943091 - RNA, 20 nt, Mycobacterium avium subsp. paratuberculosis
cgugcgcccgacgccggacc

SEQ ID NO: 2943092 - RNA, 14 nt, Mycobacterium avium subsp. paratuberculosis
cgugcgccgcccac

SEQ ID NO: 2943093 - RNA, 15 nt, Mycobacterium avium subsp. paratuberculosis
cgugcgccgcccaca

SEQ ID NO: 2943094 - RNA, 11 nt, Mycobacterium avium subsp. paratuberculosis
cgugcgccgcg

SEQ ID NO: 2943095 - RNA, 21 nt, Mycobacterium avium subsp. paratuberculosis
cgugcgccgcggcggcucggc

SEQ ID NO: 2943096 - RNA, 12 nt, Mycobacterium avium subsp. paratuberculosis
cgugcgccggcc

SEQ ID NO: 2943097 - RNA, 14 nt, Mycobacterium avium subsp. paratuberculosis
cgugcgccggcggu

SEQ ID NO: 2943098 - RNA, 17 nt, Mycobacterium avium subsp. paratuberculosis
cgugcgccggcggugcg

SEQ ID NO: 2943099 - RNA, 21 nt, Mycobacterium avium subsp. paratuberculosis
cgugcgccggcggugcggcgg

SEQ ID NO: 2943100 - RNA, 22 nt, Mycobacterium avium subsp. paratuberculosis
cgugcgccggcggugcggcggg

SEQ ID NO: 2943101 - RNA, 15 nt, Mycobacterium avium subsp. paratuberculosis
cgugcgcgaagcugg

SEQ ID NO: 2943102 - RNA, 17 nt, Mycobacterium avium subsp. paratuberculosis
cgugcgcgccgaccgcg

SEQ ID NO: 2943103 - RNA, 18 nt, Mycobacterium avium subsp. paratuberculosis
cgugcgcgccgaccgcga

SEQ ID NO: 2943104 - RNA, 23 nt, Mycobacterium avium subsp. paratuberculosis
cgugcgcgcgcaccugaaccgcg

SEQ ID NO: 2943105 - RNA, 16 nt, Mycobacterium avium subsp. paratuberculosis
cgugcgcggccgccca

SEQ ID NO: 2943106 - RNA, 14 nt, Mycobacterium avium subsp. paratuberculosis
cgugcgcggcgacc

SEQ ID NO: 2943107 - RNA, 21 nt, Mycobacterium avium subsp. paratuberculosis
cgugcgcggcgaccaccucgg

SEQ ID NO: 2943108 - RNA, 16 nt, Mycobacterium avium subsp. paratuberculosis
cgugcgcggcgcgcga

SEQ ID NO: 2943109 - RNA, 14 nt, Mycobacterium avium subsp. paratuberculosis
cgugcgcggcuggc

SEQ ID NO: 2943110 - RNA, 18 nt, Mycobacterium avium subsp. paratuberculosis
cgugcgcggcuggccguc

SEQ ID NO: 2943111 - RNA, 20 nt, Mycobacterium avium subsp. paratuberculosis
cgugcgcgggaacgaucggc

SEQ ID NO: 2943112 - RNA, 13 nt, Mycobacterium avium subsp. paratuberculosis
cgugcgcgucgac

SEQ ID NO: 2943113 - RNA, 14 nt, Mycobacterium avium subsp. paratuberculosis
cgugcgcguggggc

SEQ ID NO: 2943114 - RNA, 21 nt, Mycobacterium avium subsp. paratuberculosis
cgugcgcucgaccucggcggc

SEQ ID NO: 2943115 - RNA, 22 nt, Mycobacterium avium subsp. paratuberculosis
cgugcgcucgaccucggcggcc

SEQ ID NO: 2943116 - RNA, 18 nt, Mycobacterium avium subsp. paratuberculosis
cgugcggauggccccggc

SEQ ID NO: 2943117 - RNA, 15 nt, Mycobacterium avium subsp. paratuberculosis
cgugcggcacgccgc

SEQ ID NO: 2943118 - RNA, 12 nt, Mycobacterium avium subsp. paratuberculosis
cgugcggccgca

SEQ ID NO: 2943119 - RNA, 18 nt, Mycobacterium avium subsp. paratuberculosis
cgugcggccgcagcgccc

SEQ ID NO: 2943120 - RNA, 19 nt, Mycobacterium avium subsp. paratuberculosis
cgugcggccggcgccggcg

SEQ ID NO: 2943121 - RNA, 11 nt, Mycobacterium avium subsp. paratuberculosis
cgugcggccuc

SEQ ID NO: 2943122 - RNA, 12 nt, Mycobacterium avium subsp. paratuberculosis
cgugcggccucg

SEQ ID NO: 2943123 - RNA, 15 nt, Mycobacterium avium subsp. paratuberculosis
cgugcggcgccgccc

SEQ ID NO: 2943124 - RNA, 16 nt, Mycobacterium avium subsp. paratuberculosis
cgugcggcgccgcccg

SEQ ID NO: 2943125 - RNA, 18 nt, Mycobacterium avium subsp. paratuberculosis
cgugcggcgcggucgcag

SEQ ID NO: 2943126 - RNA, 19 nt, Mycobacterium avium subsp. paratuberculosis
cgugcggcggcggcggucc

SEQ ID NO: 2943127 - RNA, 22 nt, Mycobacterium avium subsp. paratuberculosis
cgugcggcggggccucgaugcg

SEQ ID NO: 2943128 - RNA, 21 nt, Mycobacterium avium subsp. paratuberculosis
cgugcggcugcgcguucggcg

SEQ ID NO: 2943129 - RNA, 17 nt, Mycobacterium avium subsp. paratuberculosis
cgugcgggaugccgagc

SEQ ID NO: 2943130 - RNA, 19 nt, Mycobacterium avium subsp. paratuberculosis
cgugcgggaugccgagcag

SEQ ID NO: 2943131 - RNA, 22 nt, Mycobacterium avium subsp. paratuberculosis
cgugcgggaugccgagcagcuc

SEQ ID NO: 2943132 - RNA, 20 nt, Mycobacterium avium subsp. paratuberculosis
cgugcgggcuccgcacgacc

SEQ ID NO: 2943133 - RNA, 21 nt, Mycobacterium avium subsp. paratuberculosis
cgugcggggccucgucgccgc

SEQ ID NO: 2943134 - RNA, 15 nt, Mycobacterium avium subsp. paratuberculosis
cgugcggggugugca

SEQ ID NO: 2943135 - RNA, 15 nt, Mycobacterium avium subsp. paratuberculosis
cgugcgggucgcgcu

SEQ ID NO: 2943136 - RNA, 17 nt, Mycobacterium avium subsp. paratuberculosis
cgugcggguggccgggu

SEQ ID NO: 2943137 - RNA, 23 nt, Mycobacterium avium subsp. paratuberculosis
cgugcggguggccgggucgccgu

SEQ ID NO: 2943138 - RNA, 18 nt, Mycobacterium avium subsp. paratuberculosis
cgugcggguuggcgccgg

SEQ ID NO: 2943139 - RNA, 20 nt, Mycobacterium avium subsp. paratuberculosis
cgugcggguuggcgccggug

SEQ ID NO: 2943140 - RNA, 23 nt, Mycobacterium avium subsp. paratuberculosis
cgugcggguuggcgccggugaag

SEQ ID NO: 2943141 - RNA, 16 nt, Mycobacterium avium subsp. paratuberculosis
cgugcggucgcaccaa

SEQ ID NO: 2943142 - RNA, 15 nt, Mycobacterium avium subsp. paratuberculosis
cgugcggucgcggga

SEQ ID NO: 2943143 - RNA, 17 nt, Mycobacterium avium subsp. paratuberculosis
cgugcggucgcgggaca

SEQ ID NO: 2943144 - RNA, 14 nt, Mycobacterium avium subsp. paratuberculosis
cgugcgguggucgg

SEQ ID NO: 2943145 - RNA, 18 nt, Mycobacterium avium subsp. paratuberculosis
cgugcgguggucggcguc

SEQ ID NO: 2943146 - RNA, 19 nt, Mycobacterium avium subsp. paratuberculosis
cgugcgguuggcccgcggc

SEQ ID NO: 2943147 - RNA, 23 nt, Mycobacterium avium subsp. paratuberculosis
cgugcgguuggcccgcggcgccc

SEQ ID NO: 2943148 - RNA, 23 nt, Mycobacterium avium subsp. paratuberculosis
cgugcguacuucgcguuccgcca

SEQ ID NO: 2943149 - RNA, 14 nt, Mycobacterium avium subsp. paratuberculosis
cgugcgucacgcug

SEQ ID NO: 2943150 - RNA, 12 nt, Mycobacterium avium subsp. paratuberculosis
cgugcuccagca

SEQ ID NO: 2943151 - RNA, 15 nt, Mycobacterium avium subsp. paratuberculosis
cgugcuccagcaggc

SEQ ID NO: 2943152 - RNA, 14 nt, Mycobacterium avium subsp. paratuberculosis
cguggcagggccag

SEQ ID NO: 2943153 - RNA, 17 nt, Mycobacterium avium subsp. paratuberculosis
cguggcagggccagcag

SEQ ID NO: 2943154 - RNA, 19 nt, Mycobacterium avium subsp. paratuberculosis
cguggcagggccagcagcc

SEQ ID NO: 2943155 - RNA, 14 nt, Mycobacterium avium subsp. paratuberculosis
cguggccagcaccg

SEQ ID NO: 2943156 - RNA, 15 nt, Mycobacterium avium subsp. paratuberculosis
cguggccagcaccgu

SEQ ID NO: 2943157 - RNA, 19 nt, Mycobacterium avium subsp. paratuberculosis
cguggccagcaccgucagc

SEQ ID NO: 2943158 - RNA, 16 nt, Mycobacterium avium subsp. paratuberculosis
cguggccagcgccagc

SEQ ID NO: 2943159 - RNA, 20 nt, Mycobacterium avium subsp. paratuberculosis
cguggccagcgccagcgcca

SEQ ID NO: 2943160 - RNA, 14 nt, Mycobacterium avium subsp. paratuberculosis
cguggcccagccgg

SEQ ID NO: 2943161 - RNA, 18 nt, Mycobacterium avium subsp. paratuberculosis
cguggccccacgggccau

SEQ ID NO: 2943162 - RNA, 16 nt, Mycobacterium avium subsp. paratuberculosis
cguggccccagccacc

SEQ ID NO: 2943163 - RNA, 17 nt, Mycobacterium avium subsp. paratuberculosis
cguggccccagccaccg

SEQ ID NO: 2943164 - RNA, 23 nt, Mycobacterium avium subsp. paratuberculosis
cguggcccgcccagcgcagcauc

SEQ ID NO: 2943165 - RNA, 20 nt, Mycobacterium avium subsp. paratuberculosis
cguggcccggauggccgggc

SEQ ID NO: 2943166 - RNA, 23 nt, Mycobacterium avium subsp. paratuberculosis
cguggcccggucggaguccagca

SEQ ID NO: 2943167 - RNA, 17 nt, Mycobacterium avium subsp. paratuberculosis
cguggccgaacggcaug

SEQ ID NO: 2943168 - RNA, 16 nt, Mycobacterium avium subsp. paratuberculosis
cguggccgacgggaua

SEQ ID NO: 2943169 - RNA, 20 nt, Mycobacterium avium subsp. paratuberculosis
cguggccgccaggaucugcu

SEQ ID NO: 2943170 - RNA, 13 nt, Mycobacterium avium subsp. paratuberculosis
cguggccggcagg

SEQ ID NO: 2943171 - RNA, 15 nt, Mycobacterium avium subsp. paratuberculosis
cguggccgucacgcu

SEQ ID NO: 2943172 - RNA, 16 nt, Mycobacterium avium subsp. paratuberculosis
cguggccgucacgcug

SEQ ID NO: 2943173 - RNA, 19 nt, Mycobacterium avium subsp. paratuberculosis
cguggccgucacgcuggcg

SEQ ID NO: 2943174 - RNA, 20 nt, Mycobacterium avium subsp. paratuberculosis
cguggccgucacgcuggcgu

SEQ ID NO: 2943175 - RNA, 21 nt, Mycobacterium avium subsp. paratuberculosis
cguggccgugugcgcaucggc

SEQ ID NO: 2943176 - RNA, 16 nt, Mycobacterium avium subsp. paratuberculosis
cguggccugcgacuuc

SEQ ID NO: 2943177 - RNA, 22 nt, Mycobacterium avium subsp. paratuberculosis
cguggccugcgacuucuacggc

SEQ ID NO: 2943178 - RNA, 16 nt, Mycobacterium avium subsp. paratuberculosis
cguggcgaacgcgacc

SEQ ID NO: 2943179 - RNA, 16 nt, Mycobacterium avium subsp. paratuberculosis
cguggcgacaucgccg

SEQ ID NO: 2943180 - RNA, 19 nt, Mycobacterium avium subsp. paratuberculosis
cguggcgacaucgccgcgg

SEQ ID NO: 2943181 - RNA, 20 nt, Mycobacterium avium subsp. paratuberculosis
cguggcgacaucgccgcggc

SEQ ID NO: 2943182 - RNA, 20 nt, Mycobacterium avium subsp. paratuberculosis
cguggcgacgacgccgaucc

SEQ ID NO: 2943183 - RNA, 12 nt, Mycobacterium avium subsp. paratuberculosis
cguggcgcacag

SEQ ID NO: 2943184 - RNA, 14 nt, Mycobacterium avium subsp. paratuberculosis
cguggcgcacagcg

SEQ ID NO: 2943185 - RNA, 15 nt, Mycobacterium avium subsp. paratuberculosis
cguggcgcaucaccu

SEQ ID NO: 2943186 - RNA, 15 nt, Mycobacterium avium subsp. paratuberculosis
cguggcgccggcgcg

SEQ ID NO: 2943187 - RNA, 16 nt, Mycobacterium avium subsp. paratuberculosis
cguggcgccggcgcgc

SEQ ID NO: 2943188 - RNA, 13 nt, Mycobacterium avium subsp. paratuberculosis
cguggcgcgacgc

SEQ ID NO: 2943189 - RNA, 14 nt, Mycobacterium avium subsp. paratuberculosis
cguggcgcgacgcg

SEQ ID NO: 2943190 - RNA, 12 nt, Mycobacterium avium subsp. paratuberculosis
cguggcgcgccc

SEQ ID NO: 2943191 - RNA, 22 nt, Mycobacterium avium subsp. paratuberculosis
cguggcgcgccccggcccgucc

SEQ ID NO: 2943192 - RNA, 16 nt, Mycobacterium avium subsp. paratuberculosis
cguggcgcucagcggc

SEQ ID NO: 2943193 - RNA, 18 nt, Mycobacterium avium subsp. paratuberculosis
cguggcgcucagcggcag

SEQ ID NO: 2943194 - RNA, 15 nt, Mycobacterium avium subsp. paratuberculosis
cguggcggccgucgc

SEQ ID NO: 2943195 - RNA, 17 nt, Mycobacterium avium subsp. paratuberculosis
cguggcggccgucgcgc

SEQ ID NO: 2943196 - RNA, 22 nt, Mycobacterium avium subsp. paratuberculosis
cguggcggccgucgcgcaccac

SEQ ID NO: 2943197 - RNA, 23 nt, Mycobacterium avium subsp. paratuberculosis
cguggcggccgucgcgcaccacc

SEQ ID NO: 2943198 - RNA, 13 nt, Mycobacterium avium subsp. paratuberculosis
cguggcggcgggc

SEQ ID NO: 2943199 - RNA, 22 nt, Mycobacterium avium subsp. paratuberculosis
cguggcggcgggccagcucguc

SEQ ID NO: 2943200 - RNA, 13 nt, Mycobacterium avium subsp. paratuberculosis
cguggcggcggug

SEQ ID NO: 2943201 - RNA, 16 nt, Mycobacterium avium subsp. paratuberculosis
cguggcggcgguggcg

SEQ ID NO: 2943202 - RNA, 20 nt, Mycobacterium avium subsp. paratuberculosis
cguggcggcgguggcgauga

SEQ ID NO: 2943203 - RNA, 15 nt, Mycobacterium avium subsp. paratuberculosis
cguggcggcgguguc

SEQ ID NO: 2943204 - RNA, 21 nt, Mycobacterium avium subsp. paratuberculosis
cguggcggcggugucgcccag

SEQ ID NO: 2943205 - RNA, 22 nt, Mycobacterium avium subsp. paratuberculosis
cguggcggcggugucgcccagc

SEQ ID NO: 2943206 - RNA, 15 nt, Mycobacterium avium subsp. paratuberculosis
cguggcgggccaggc

SEQ ID NO: 2943207 - RNA, 17 nt, Mycobacterium avium subsp. paratuberculosis
cguggcgggcccgggcg

SEQ ID NO: 2943208 - RNA, 20 nt, Mycobacterium avium subsp. paratuberculosis
cguggcgggcccgggcgcug

SEQ ID NO: 2943209 - RNA, 20 nt, Mycobacterium avium subsp. paratuberculosis
cguggcgggggagccgugca

SEQ ID NO: 2943210 - RNA, 21 nt, Mycobacterium avium subsp. paratuberculosis
cguggcgggggagccgugcag

SEQ ID NO: 2943211 - RNA, 18 nt, Mycobacterium avium subsp. paratuberculosis
cguggcggucggugcgca

SEQ ID NO: 2943212 - RNA, 19 nt, Mycobacterium avium subsp. paratuberculosis
cguggcggucggugcgcag

SEQ ID NO: 2943213 - RNA, 17 nt, Mycobacterium avium subsp. paratuberculosis
cguggcgguggcggcga

SEQ ID NO: 2943214 - RNA, 13 nt, Mycobacterium avium subsp. paratuberculosis
cguggcgucggcg

SEQ ID NO: 2943215 - RNA, 19 nt, Mycobacterium avium subsp. paratuberculosis
cguggcgucggcgcgcacc

SEQ ID NO: 2943216 - RNA, 13 nt, Mycobacterium avium subsp. paratuberculosis
cguggcgucggug

SEQ ID NO: 2943217 - RNA, 13 nt, Mycobacterium avium subsp. paratuberculosis
cguggcgugccgg

SEQ ID NO: 2943218 - RNA, 16 nt, Mycobacterium avium subsp. paratuberculosis
cguggcgugccgggcg

SEQ ID NO: 2943219 - RNA, 17 nt, Mycobacterium avium subsp. paratuberculosis
cguggcucagcggcagg

SEQ ID NO: 2943220 - RNA, 15 nt, Mycobacterium avium subsp. paratuberculosis
cguggcucggcccgc

SEQ ID NO: 2943221 - RNA, 18 nt, Mycobacterium avium subsp. paratuberculosis
cguggcucucguccucga

SEQ ID NO: 2943222 - RNA, 20 nt, Mycobacterium avium subsp. paratuberculosis
cguggcugaacagcgcgccg

SEQ ID NO: 2943223 - RNA, 21 nt, Mycobacterium avium subsp. paratuberculosis
cguggcugaacagcgcgccga

SEQ ID NO: 2943224 - RNA, 22 nt, Mycobacterium avium subsp. paratuberculosis
cguggcugaacagcgcgccgaa

SEQ ID NO: 2943225 - RNA, 14 nt, Mycobacterium avium subsp. paratuberculosis
cguggcugaccgac

SEQ ID NO: 2943226 - RNA, 17 nt, Mycobacterium avium subsp. paratuberculosis
cguggcugaccgacggc

SEQ ID NO: 2943227 - RNA, 20 nt, Mycobacterium avium subsp. paratuberculosis
cguggcugaccgacggcgac

SEQ ID NO: 2943228 - RNA, 12 nt, Mycobacterium avium subsp. paratuberculosis
cguggcugaggc

SEQ ID NO: 2943229 - RNA, 17 nt, Mycobacterium avium subsp. paratuberculosis
cguggcugaggccgccc

SEQ ID NO: 2943230 - RNA, 19 nt, Mycobacterium avium subsp. paratuberculosis
cguggcuuucggcgccaac

SEQ ID NO: 2943231 - RNA, 15 nt, Mycobacterium avium subsp. paratuberculosis
cgugggaaccaccaa

SEQ ID NO: 2943232 - RNA, 22 nt, Mycobacterium avium subsp. paratuberculosis
cgugggcaacacgucguccggc

SEQ ID NO: 2943233 - RNA, 13 nt, Mycobacterium avium subsp. paratuberculosis
cgugggcaccggc

SEQ ID NO: 2943234 - RNA, 18 nt, Mycobacterium avium subsp. paratuberculosis
cgugggcaccggcaccgc

SEQ ID NO: 2943235 - RNA, 22 nt, Mycobacterium avium subsp. paratuberculosis
cgugggccaccacguacuccug

SEQ ID NO: 2943236 - RNA, 16 nt, Mycobacterium avium subsp. paratuberculosis
cgugggccaggaagaa

SEQ ID NO: 2943237 - RNA, 14 nt, Mycobacterium avium subsp. paratuberculosis
cgugguggugcgga

SEQ ID NO: 2943238 - RNA, 15 nt, Mycobacterium avium subsp. paratuberculosis
cgugguggugcggac

SEQ ID NO: 2943239 - RNA, 20 nt, Mycobacterium avium subsp. paratuberculosis
cguggugucggagaucggcg

SEQ ID NO: 2943240 - RNA, 14 nt, Mycobacterium avium subsp. paratuberculosis
cguggugugcacca

SEQ ID NO: 2943241 - RNA, 15 nt, Mycobacterium avium subsp. paratuberculosis
cguggugugcccgcg

SEQ ID NO: 2943242 - RNA, 20 nt, Mycobacterium avium subsp. paratuberculosis
cguggugugcccgcgggcca

SEQ ID NO: 2943243 - RNA, 22 nt, Mycobacterium avium subsp. paratuberculosis
cguggugugcccgcgggccaga

SEQ ID NO: 2943244 - RNA, 20 nt, Mycobacterium avium subsp. paratuberculosis
cgugguguugaucauccggc

SEQ ID NO: 2943245 - RNA, 14 nt, Mycobacterium avium subsp. paratuberculosis
cgugguugccccag

SEQ ID NO: 2943246 - RNA, 15 nt, Mycobacterium avium subsp. paratuberculosis
cgugguugccccagc

SEQ ID NO: 2943247 - RNA, 20 nt, Mycobacterium avium subsp. paratuberculosis
cgugguugcguucgccggcg

SEQ ID NO: 2943248 - RNA, 16 nt, Mycobacterium avium subsp. paratuberculosis
cguguacucggcgucg

SEQ ID NO: 2943249 - RNA, 17 nt, Mycobacterium avium subsp. paratuberculosis
cguguacucggcgucgc

SEQ ID NO: 2943250 - RNA, 15 nt, Mycobacterium avium subsp. paratuberculosis
cguguagccugcggc

SEQ ID NO: 2943251 - RNA, 16 nt, Mycobacterium avium subsp. paratuberculosis
cguguagccugcggcc

SEQ ID NO: 2943252 - RNA, 20 nt, Mycobacterium avium subsp. paratuberculosis
cguguagggcaacacgacca

SEQ ID NO: 2943253 - RNA, 15 nt, Mycobacterium avium subsp. paratuberculosis
cguguaguccagguc

SEQ ID NO: 2943254 - RNA, 17 nt, Mycobacterium avium subsp. paratuberculosis
cguguaguccaggucga

SEQ ID NO: 2943255 - RNA, 17 nt, Mycobacterium avium subsp. paratuberculosis
cgugucacuacccgcga

SEQ ID NO: 2943256 - RNA, 19 nt, Mycobacterium avium subsp. paratuberculosis
cguguccagaacucggcgg

SEQ ID NO: 2943257 - RNA, 20 nt, Mycobacterium avium subsp. paratuberculosis
cguguccagaacucggcggc

SEQ ID NO: 2943258 - RNA, 21 nt, Mycobacterium avium subsp. paratuberculosis
cgugucccggauggagcgcga

SEQ ID NO: 2943259 - RNA, 13 nt, Mycobacterium avium subsp. paratuberculosis
cgugucccggcgc

SEQ ID NO: 2943260 - RNA, 15 nt, Mycobacterium avium subsp. paratuberculosis
cgugucccggcgccc

SEQ ID NO: 2943261 - RNA, 19 nt, Mycobacterium avium subsp. paratuberculosis
cgugucccggcgcccuucg

SEQ ID NO: 2943262 - RNA, 14 nt, Mycobacterium avium subsp. paratuberculosis
cgugucccugcggc

SEQ ID NO: 2943263 - RNA, 17 nt, Mycobacterium avium subsp. paratuberculosis
cgugucccugcggcugc

SEQ ID NO: 2943264 - RNA, 14 nt, Mycobacterium avium subsp. paratuberculosis
cguguccgacgccg

SEQ ID NO: 2943265 - RNA, 19 nt, Mycobacterium avium subsp. paratuberculosis
cguguccgaugacgagcag

SEQ ID NO: 2943266 - RNA, 16 nt, Mycobacterium avium subsp. paratuberculosis
cguguccgcgccggcg

SEQ ID NO: 2943267 - RNA, 16 nt, Mycobacterium avium subsp. paratuberculosis
cguguccgucgccgga

SEQ ID NO: 2943268 - RNA, 19 nt, Mycobacterium avium subsp. paratuberculosis
cguguccgucgccggaggc

SEQ ID NO: 2943269 - RNA, 20 nt, Mycobacterium avium subsp. paratuberculosis
cguguccgucgccggaggcg

SEQ ID NO: 2943270 - RNA, 23 nt, Mycobacterium avium subsp. paratuberculosis
cgugucgagcacgucgacgccgg

SEQ ID NO: 2943271 - RNA, 17 nt, Mycobacterium avium subsp. paratuberculosis
cgugucgcccguggccc

SEQ ID NO: 2943272 - RNA, 15 nt, Mycobacterium avium subsp. paratuberculosis
cgugucgccggggcg

SEQ ID NO: 2943273 - RNA, 20 nt, Mycobacterium avium subsp. paratuberculosis
cgugucgccggggcggaucc

SEQ ID NO: 2943274 - RNA, 20 nt, Mycobacterium avium subsp. paratuberculosis
cgugucggcgaucgcgcgca

SEQ ID NO: 2943275 - RNA, 13 nt, Mycobacterium avium subsp. paratuberculosis
cgugucggcgggc

SEQ ID NO: 2943276 - RNA, 14 nt, Mycobacterium avium subsp. paratuberculosis
cgugucggcgggcg

SEQ ID NO: 2943277 - RNA, 16 nt, Mycobacterium avium subsp. paratuberculosis
cgugucggcgggcggg

SEQ ID NO: 2943278 - RNA, 22 nt, Mycobacterium avium subsp. paratuberculosis
cgugucgucgcugacgccgagc

SEQ ID NO: 2943279 - RNA, 17 nt, Mycobacterium avium subsp. paratuberculosis
cgugucgucgucgccgc

SEQ ID NO: 2943280 - RNA, 19 nt, Mycobacterium avium subsp. paratuberculosis
cgugucgucgucgccgccg

SEQ ID NO: 2943281 - RNA, 18 nt, Mycobacterium avium subsp. paratuberculosis
cgugucgugugcgugacg

SEQ ID NO: 2943282 - RNA, 13 nt, Mycobacterium avium subsp. paratuberculosis
cgugugccagccc

SEQ ID NO: 2943283 - RNA, 21 nt, Mycobacterium avium subsp. paratuberculosis
cgugugcccagcacgacgccg

SEQ ID NO: 2943284 - RNA, 22 nt, Mycobacterium avium subsp. paratuberculosis
cgugugcccagcacgacgccgc

SEQ ID NO: 2943285 - RNA, 22 nt, Mycobacterium avium subsp. paratuberculosis
cgugugcgcaucggcgacgccg

SEQ ID NO: 2943286 - RNA, 13 nt, Mycobacterium avium subsp. paratuberculosis
cguguggcacccg

SEQ ID NO: 2943287 - RNA, 22 nt, Mycobacterium avium subsp. paratuberculosis
cguguggccgcccucgcugccg

SEQ ID NO: 2943288 - RNA, 19 nt, Mycobacterium avium subsp. paratuberculosis
cgugugggaaaagacgcac

SEQ ID NO: 2943289 - RNA, 20 nt, Mycobacterium avium subsp. paratuberculosis
cguguucaacgcgccgaugc

SEQ ID NO: 2943290 - RNA, 18 nt, Mycobacterium avium subsp. paratuberculosis
cguguuccuugcggccgc

SEQ ID NO: 2943291 - RNA, 22 nt, Mycobacterium avium subsp. paratuberculosis
cguguucgccgaggaaccggca

SEQ ID NO: 2943292 - RNA, 14 nt, Mycobacterium avium subsp. paratuberculosis
cguguucgggaucg

SEQ ID NO: 2943293 - RNA, 20 nt, Mycobacterium avium subsp. paratuberculosis
cguguucgggaucggcgccc

SEQ ID NO: 2943294 - RNA, 16 nt, Mycobacterium avium subsp. paratuberculosis
cguguucucacggcga

SEQ ID NO: 2943295 - RNA, 21 nt, Mycobacterium avium subsp. paratuberculosis
cguguugagcucgcggcgcag

SEQ ID NO: 2943296 - RNA, 13 nt, Mycobacterium avium subsp. paratuberculosis
cguguugcaggcg

SEQ ID NO: 2943297 - RNA, 17 nt, Mycobacterium avium subsp. paratuberculosis
cguguugcaggcggacc

SEQ ID NO: 2943298 - RNA, 18 nt, Mycobacterium avium subsp. paratuberculosis
cguuacacccgcggaacg

SEQ ID NO: 2943299 - RNA, 15 nt, Mycobacterium avium subsp. paratuberculosis
cguuacgguagcacu

SEQ ID NO: 2943300 - RNA, 13 nt, Mycobacterium avium subsp. paratuberculosis
cguucaagccgcc

SEQ ID NO: 2943301 - RNA, 15 nt, Mycobacterium avium subsp. paratuberculosis
cguucaagccgccga

SEQ ID NO: 2943302 - RNA, 18 nt, Mycobacterium avium subsp. paratuberculosis
cguucaccucuucgggca

SEQ ID NO: 2943303 - RNA, 22 nt, Mycobacterium avium subsp. paratuberculosis
cguucaccugacgcaucaccac

SEQ ID NO: 2943304 - RNA, 17 nt, Mycobacterium avium subsp. paratuberculosis
cguucacgucgaucacg

SEQ ID NO: 2943305 - RNA, 20 nt, Mycobacterium avium subsp. paratuberculosis
cguucacgucgaucacgccg

SEQ ID NO: 2943306 - RNA, 12 nt, Mycobacterium avium subsp. paratuberculosis
cguucagcagcg

SEQ ID NO: 2943307 - RNA, 13 nt, Mycobacterium avium subsp. paratuberculosis
cguucagcagcgc

SEQ ID NO: 2943308 - RNA, 20 nt, Mycobacterium avium subsp. paratuberculosis
cguucagcgacuugccgccg

SEQ ID NO: 2943309 - RNA, 23 nt, Mycobacterium avium subsp. paratuberculosis
cguucagcgacuugccgccggcg

SEQ ID NO: 2943310 - RNA, 15 nt, Mycobacterium avium subsp. paratuberculosis
cguucagcgcggcca

SEQ ID NO: 2943311 - RNA, 17 nt, Mycobacterium avium subsp. paratuberculosis
cguucagcgcggccacc

SEQ ID NO: 2943312 - RNA, 19 nt, Mycobacterium avium subsp. paratuberculosis
cguucagcgcggccaccuc

SEQ ID NO: 2943313 - RNA, 15 nt, Mycobacterium avium subsp. paratuberculosis
cguucagcgggcggu

SEQ ID NO: 2943314 - RNA, 16 nt, Mycobacterium avium subsp. paratuberculosis
cguucagcugcagccg

SEQ ID NO: 2943315 - RNA, 17 nt, Mycobacterium avium subsp. paratuberculosis
cguucagcugcagccgg

SEQ ID NO: 2943316 - RNA, 18 nt, Mycobacterium avium subsp. paratuberculosis
cguucagcugcagccggc

SEQ ID NO: 2943317 - RNA, 20 nt, Mycobacterium avium subsp. paratuberculosis
cguucagcugcagccggccg

SEQ ID NO: 2943318 - RNA, 22 nt, Mycobacterium avium subsp. paratuberculosis
cguucagggugcaggcccgggc

SEQ ID NO: 2943319 - RNA, 15 nt, Mycobacterium avium subsp. paratuberculosis
cguucaggucgauca

SEQ ID NO: 2943320 - RNA, 16 nt, Mycobacterium avium subsp. paratuberculosis
cguucagugaccagug

SEQ ID NO: 2943321 - RNA, 20 nt, Mycobacterium avium subsp. paratuberculosis
cguucagugaccagugcaga

SEQ ID NO: 2943322 - RNA, 14 nt, Mycobacterium avium subsp. paratuberculosis
cguucuccccgccg

SEQ ID NO: 2943323 - RNA, 15 nt, Mycobacterium avium subsp. paratuberculosis
cguucucggcgaaca

SEQ ID NO: 2943324 - RNA, 22 nt, Mycobacterium avium subsp. paratuberculosis
cguucucgggaaaugcgucgcc

SEQ ID NO: 2943325 - RNA, 23 nt, Mycobacterium avium subsp. paratuberculosis
cguucugcaagaacccgaacgcg

SEQ ID NO: 2943326 - RNA, 13 nt, Mycobacterium avium subsp. paratuberculosis
cguucugcaccag

SEQ ID NO: 2943327 - RNA, 18 nt, Mycobacterium avium subsp. paratuberculosis
cguucuggcccgccaucg

SEQ ID NO: 2943328 - RNA, 20 nt, Mycobacterium avium subsp. paratuberculosis
cguugaaaguccuugcugcc

SEQ ID NO: 2943329 - RNA, 15 nt, Mycobacterium avium subsp. paratuberculosis
cguugacaccgggug

SEQ ID NO: 2943330 - RNA, 15 nt, Mycobacterium avium subsp. paratuberculosis
cguugaccaacgccg

SEQ ID NO: 2943331 - RNA, 16 nt, Mycobacterium avium subsp. paratuberculosis
cguugaccaacgccgc

SEQ ID NO: 2943332 - RNA, 19 nt, Mycobacterium avium subsp. paratuberculosis
cguugaccaacgccgccuc

SEQ ID NO: 2943333 - RNA, 20 nt, Mycobacterium avium subsp. paratuberculosis
cguugaccaacgccgccucc

SEQ ID NO: 2943334 - RNA, 21 nt, Mycobacterium avium subsp. paratuberculosis
cguugaccaacgccgccuccg

SEQ ID NO: 2943335 - RNA, 23 nt, Mycobacterium avium subsp. paratuberculosis
cguugaccaacgccgccuccgac

SEQ ID NO: 2943336 - RNA, 14 nt, Mycobacterium avium subsp. paratuberculosis
cguugaccaccagg

SEQ ID NO: 2943337 - RNA, 23 nt, Mycobacterium avium subsp. paratuberculosis
cguugaccaccagguaggcgacc

SEQ ID NO: 2943338 - RNA, 18 nt, Mycobacterium avium subsp. paratuberculosis
cguugaccccgacggcgc

SEQ ID NO: 2943339 - RNA, 22 nt, Mycobacterium avium subsp. paratuberculosis
cguugaccccgacggcgccgcg

SEQ ID NO: 2943340 - RNA, 18 nt, Mycobacterium avium subsp. paratuberculosis
cguugaccgacgccucca

SEQ ID NO: 2943341 - RNA, 23 nt, Mycobacterium avium subsp. paratuberculosis
cguugaccgacgccuccacauac

SEQ ID NO: 2943342 - RNA, 15 nt, Mycobacterium avium subsp. paratuberculosis
cguugaccgcggcga

SEQ ID NO: 2943343 - RNA, 17 nt, Mycobacterium avium subsp. paratuberculosis
cguugaccggccggucg

SEQ ID NO: 2943344 - RNA, 20 nt, Mycobacterium avium subsp. paratuberculosis
cguugaccgggccgcuggug

SEQ ID NO: 2943345 - RNA, 20 nt, Mycobacterium avium subsp. paratuberculosis
cguugaccgggucgccgauc

SEQ ID NO: 2943346 - RNA, 13 nt, Mycobacterium avium subsp. paratuberculosis
cguugacgcccuc

SEQ ID NO: 2943347 - RNA, 15 nt, Mycobacterium avium subsp. paratuberculosis
cguugacgcccuccu

SEQ ID NO: 2943348 - RNA, 19 nt, Mycobacterium avium subsp. paratuberculosis
cguugacgcccuccuggcg

SEQ ID NO: 2943349 - RNA, 15 nt, Mycobacterium avium subsp. paratuberculosis
cguugacgcugggcg

SEQ ID NO: 2943350 - RNA, 20 nt, Mycobacterium avium subsp. paratuberculosis
cguugacgcugggcggcgac

SEQ ID NO: 2943351 - RNA, 21 nt, Mycobacterium avium subsp. paratuberculosis
cguugacgcugggcggcgaca

SEQ ID NO: 2943352 - RNA, 13 nt, Mycobacterium avium subsp. paratuberculosis
cguugacgguguu

SEQ ID NO: 2943353 - RNA, 12 nt, Mycobacterium avium subsp. paratuberculosis
cguugagcacca

SEQ ID NO: 2943354 - RNA, 15 nt, Mycobacterium avium subsp. paratuberculosis
cguugagcaccacga

SEQ ID NO: 2943355 - RNA, 16 nt, Mycobacterium avium subsp. paratuberculosis
cguugagcaccacgag

SEQ ID NO: 2943356 - RNA, 12 nt, Mycobacterium avium subsp. paratuberculosis
cguugagcaccg

SEQ ID NO: 2943357 - RNA, 13 nt, Mycobacterium avium subsp. paratuberculosis
cguugagcaccgc

SEQ ID NO: 2943358 - RNA, 17 nt, Mycobacterium avium subsp. paratuberculosis
cguugagcacgcggacc

SEQ ID NO: 2943359 - RNA, 15 nt, Mycobacterium avium subsp. paratuberculosis
cguugagccggcgca

SEQ ID NO: 2943360 - RNA, 20 nt, Mycobacterium avium subsp. paratuberculosis
cguugagccggcgcaccgcg

SEQ ID NO: 2943361 - RNA, 21 nt, Mycobacterium avium subsp. paratuberculosis
cguugagcgucgccaccaccu

SEQ ID NO: 2943362 - RNA, 16 nt, Mycobacterium avium subsp. paratuberculosis
cguugaggcggcggcg

SEQ ID NO: 2943363 - RNA, 18 nt, Mycobacterium avium subsp. paratuberculosis
cguugagucccucggcga

SEQ ID NO: 2943364 - RNA, 22 nt, Mycobacterium avium subsp. paratuberculosis
cguugagugcgcuguggugacg

SEQ ID NO: 2943365 - RNA, 20 nt, Mycobacterium avium subsp. paratuberculosis
cguugaucaccgugaucgcc

SEQ ID NO: 2943366 - RNA, 23 nt, Mycobacterium avium subsp. paratuberculosis
cguugaucacguugucgcggccc

SEQ ID NO: 2943367 - RNA, 19 nt, Mycobacterium avium subsp. paratuberculosis
cguugaucagcgccaggug

SEQ ID NO: 2943368 - RNA, 15 nt, Mycobacterium avium subsp. paratuberculosis
cguugaucagggcgg

SEQ ID NO: 2943369 - RNA, 18 nt, Mycobacterium avium subsp. paratuberculosis
cguugaucagggcggcgc

SEQ ID NO: 2943370 - RNA, 19 nt, Mycobacterium avium subsp. paratuberculosis
cguugaucaugucgaugcc

SEQ ID NO: 2943371 - RNA, 15 nt, Mycobacterium avium subsp. paratuberculosis
cguugaucgcgccga

SEQ ID NO: 2943372 - RNA, 23 nt, Mycobacterium avium subsp. paratuberculosis
cguugaugaagaccuggccggcc

SEQ ID NO: 2943373 - RNA, 18 nt, Mycobacterium avium subsp. paratuberculosis
cguugaugaucgccgauc

SEQ ID NO: 2943374 - RNA, 17 nt, Mycobacterium avium subsp. paratuberculosis
cguugaugccgucgauc

SEQ ID NO: 2943375 - RNA, 18 nt, Mycobacterium avium subsp. paratuberculosis
cguugaugccgucgauca

SEQ ID NO: 2943376 - RNA, 19 nt, Mycobacterium avium subsp. paratuberculosis
cguugaugccgucgaucac

SEQ ID NO: 2943377 - RNA, 14 nt, Mycobacterium avium subsp. paratuberculosis
cguugaugcgggcg

SEQ ID NO: 2943378 - RNA, 14 nt, Mycobacterium avium subsp. paratuberculosis
cguugaugucggcc

SEQ ID NO: 2943379 - RNA, 21 nt, Mycobacterium avium subsp. paratuberculosis
cguugauugaccauccggucc

SEQ ID NO: 2943380 - RNA, 17 nt, Mycobacterium avium subsp. paratuberculosis
cguugcacaccaccagc

SEQ ID NO: 2943381 - RNA, 21 nt, Mycobacterium avium subsp. paratuberculosis
cguugcacaccaccagcgagg

SEQ ID NO: 2943382 - RNA, 18 nt, Mycobacterium avium subsp. paratuberculosis
cguugcacaggcacacga

SEQ ID NO: 2943383 - RNA, 20 nt, Mycobacterium avium subsp. paratuberculosis
cguugcacaggcacacgaac

SEQ ID NO: 2943384 - RNA, 14 nt, Mycobacterium avium subsp. paratuberculosis
cguugcacggcagc

SEQ ID NO: 2943385 - RNA, 15 nt, Mycobacterium avium subsp. paratuberculosis
cguugcagaacgcgc

SEQ ID NO: 2943386 - RNA, 12 nt, Mycobacterium avium subsp. paratuberculosis
cguugcagcaca

SEQ ID NO: 2943387 - RNA, 23 nt, Mycobacterium avium subsp. paratuberculosis
cguugcagcacagcgggauccca

SEQ ID NO: 2943388 - RNA, 19 nt, Mycobacterium avium subsp. paratuberculosis
cguugcagcgccgcggcgc

SEQ ID NO: 2943389 - RNA, 13 nt, Mycobacterium avium subsp. paratuberculosis
cguugccagccgg

SEQ ID NO: 2943390 - RNA, 16 nt, Mycobacterium avium subsp. paratuberculosis
cguugccagccggugc

SEQ ID NO: 2943391 - RNA, 16 nt, Mycobacterium avium subsp. paratuberculosis
cguugccaggccgcga

SEQ ID NO: 2943392 - RNA, 18 nt, Mycobacterium avium subsp. paratuberculosis
cguugccaggccgcgagc

SEQ ID NO: 2943393 - RNA, 15 nt, Mycobacterium avium subsp. paratuberculosis
cguugcccaggaagu

SEQ ID NO: 2943394 - RNA, 15 nt, Mycobacterium avium subsp. paratuberculosis
cguugcccgaucagc

SEQ ID NO: 2943395 - RNA, 18 nt, Mycobacterium avium subsp. paratuberculosis
cguugcccgaucagccgg

SEQ ID NO: 2943396 - RNA, 12 nt, Mycobacterium avium subsp. paratuberculosis
cguugcccgccg

SEQ ID NO: 2943397 - RNA, 16 nt, Mycobacterium avium subsp. paratuberculosis
cguugcccgccgcggc

SEQ ID NO: 2943398 - RNA, 18 nt, Mycobacterium avium subsp. paratuberculosis
cguugcccgccgcggcga

SEQ ID NO: 2943399 - RNA, 15 nt, Mycobacterium avium subsp. paratuberculosis
cguugcccgcugcgg

SEQ ID NO: 2943400 - RNA, 16 nt, Mycobacterium avium subsp. paratuberculosis
cguugcccgucgccuc

SEQ ID NO: 2943401 - RNA, 17 nt, Mycobacterium avium subsp. paratuberculosis
cguugcccgucgccucc

SEQ ID NO: 2943402 - RNA, 14 nt, Mycobacterium avium subsp. paratuberculosis
cguugcccugccug

SEQ ID NO: 2943403 - RNA, 15 nt, Mycobacterium avium subsp. paratuberculosis
cguugccgcacaccg

SEQ ID NO: 2943404 - RNA, 17 nt, Mycobacterium avium subsp. paratuberculosis
cguugccgcacaccgcg

SEQ ID NO: 2943405 - RNA, 19 nt, Mycobacterium avium subsp. paratuberculosis
cguugccgcacaccgcgca

SEQ ID NO: 2943406 - RNA, 21 nt, Mycobacterium avium subsp. paratuberculosis
cguugccgcacaccgcgcaga

SEQ ID NO: 2943407 - RNA, 19 nt, Mycobacterium avium subsp. paratuberculosis
cguugggccagcggcgccg

SEQ ID NO: 2943408 - RNA, 15 nt, Mycobacterium avium subsp. paratuberculosis
cguugggggcgccgc

SEQ ID NO: 2943409 - RNA, 15 nt, Mycobacterium avium subsp. paratuberculosis
cguugggggucgacu

SEQ ID NO: 2943410 - RNA, 20 nt, Mycobacterium avium subsp. paratuberculosis
cguugggguccucgauggcg

SEQ ID NO: 2943411 - RNA, 21 nt, Mycobacterium avium subsp. paratuberculosis
cguugggucucaucccgccga

SEQ ID NO: 2943412 - RNA, 16 nt, Mycobacterium avium subsp. paratuberculosis
cguuggucaccaucag

SEQ ID NO: 2943413 - RNA, 23 nt, Mycobacterium avium subsp. paratuberculosis
cguuggucaccaucagcggcucg

SEQ ID NO: 2943414 - RNA, 17 nt, Mycobacterium avium subsp. paratuberculosis
cguuggugacgcucacc

SEQ ID NO: 2943415 - RNA, 14 nt, Mycobacterium avium subsp. paratuberculosis
cguuggugaucgcc

SEQ ID NO: 2943416 - RNA, 18 nt, Mycobacterium avium subsp. paratuberculosis
cguuggugaucgccgacg

SEQ ID NO: 2943417 - RNA, 19 nt, Mycobacterium avium subsp. paratuberculosis
cguuggugaugcggucggc

SEQ ID NO: 2943418 - RNA, 20 nt, Mycobacterium avium subsp. paratuberculosis
cguuggugaugcggucggcg

SEQ ID NO: 2943419 - RNA, 22 nt, Mycobacterium avium subsp. paratuberculosis
cguuggugaugcggucggcgcg

SEQ ID NO: 2943420 - RNA, 12 nt, Mycobacterium avium subsp. paratuberculosis
cguuggugcggu

SEQ ID NO: 2943421 - RNA, 15 nt, Mycobacterium avium subsp. paratuberculosis
cguugguggucgacg

SEQ ID NO: 2943422 - RNA, 16 nt, Mycobacterium avium subsp. paratuberculosis
cguugguggucgacgc

SEQ ID NO: 2943423 - RNA, 18 nt, Mycobacterium avium subsp. paratuberculosis
cguugguggucgacgcgc

SEQ ID NO: 2943424 - RNA, 16 nt, Mycobacterium avium subsp. paratuberculosis
cguugguggucugcca

SEQ ID NO: 2943425 - RNA, 20 nt, Mycobacterium avium subsp. paratuberculosis
cguuguccacccccgcggug

SEQ ID NO: 2943426 - RNA, 21 nt, Mycobacterium avium subsp. paratuberculosis
cguuguccacccccgcgguga

SEQ ID NO: 2943427 - RNA, 22 nt, Mycobacterium avium subsp. paratuberculosis
cguuguccacccccgcggugag

SEQ ID NO: 2943428 - RNA, 14 nt, Mycobacterium avium subsp. paratuberculosis
cguuguccagcagc

SEQ ID NO: 2943429 - RNA, 16 nt, Mycobacterium avium subsp. paratuberculosis
cguuguccagcagcgc

SEQ ID NO: 2943430 - RNA, 18 nt, Mycobacterium avium subsp. paratuberculosis
cguuguccagcagcgccg

SEQ ID NO: 2943431 - RNA, 17 nt, Mycobacterium avium subsp. paratuberculosis
cguugucgagcaccgcg

SEQ ID NO: 2943432 - RNA, 18 nt, Mycobacterium avium subsp. paratuberculosis
cguugucgagcaccgcga

SEQ ID NO: 2943433 - RNA, 15 nt, Mycobacterium avium subsp. paratuberculosis
cguugucgagcgagc

SEQ ID NO: 2943434 - RNA, 23 nt, Mycobacterium avium subsp. paratuberculosis
cguugucgaggucggugaggcug

SEQ ID NO: 2943435 - RNA, 14 nt, Mycobacterium avium subsp. paratuberculosis
cguugucgcggccc

SEQ ID NO: 2943436 - RNA, 14 nt, Mycobacterium avium subsp. paratuberculosis
cguugucggcgacg

SEQ ID NO: 2943437 - RNA, 19 nt, Mycobacterium avium subsp. paratuberculosis
cguugucggcgacggcggg

SEQ ID NO: 2943438 - RNA, 15 nt, Mycobacterium avium subsp. paratuberculosis
cguugucgucgccgg

SEQ ID NO: 2943439 - RNA, 19 nt, Mycobacterium avium subsp. paratuberculosis
cguugucgucgccggccgc

SEQ ID NO: 2943440 - RNA, 12 nt, Mycobacterium avium subsp. paratuberculosis
cguugucgucgg

SEQ ID NO: 2943441 - RNA, 19 nt, Mycobacterium avium subsp. paratuberculosis
cguugucgucggggcuggc

SEQ ID NO: 2943442 - RNA, 14 nt, Mycobacterium avium subsp. paratuberculosis
cguugucucggcgc

SEQ ID NO: 2943443 - RNA, 16 nt, Mycobacterium avium subsp. paratuberculosis
cguugucucggcgccg

SEQ ID NO: 2943444 - RNA, 18 nt, Mycobacterium avium subsp. paratuberculosis
cguugucucggcgccguc

SEQ ID NO: 2943445 - RNA, 17 nt, Mycobacterium avium subsp. paratuberculosis
cguugugaauccagccg

SEQ ID NO: 2943446 - RNA, 23 nt, Mycobacterium avium subsp. paratuberculosis
cguugugaauccagccgugcggc

SEQ ID NO: 2943447 - RNA, 23 nt, Mycobacterium avium subsp. paratuberculosis
cguugugcaccggcacgucgagc

SEQ ID NO: 2943448 - RNA, 14 nt, Mycobacterium avium subsp. paratuberculosis
cguugugccaccgc

SEQ ID NO: 2943449 - RNA, 16 nt, Mycobacterium avium subsp. paratuberculosis
cguugugccaccgccg

SEQ ID NO: 2943450 - RNA, 16 nt, Mycobacterium avium subsp. paratuberculosis
cguugugcucgucgau

SEQ ID NO: 2943451 - RNA, 20 nt, Mycobacterium avium subsp. paratuberculosis
cguugugcuucuggcucaac

SEQ ID NO: 2943452 - RNA, 13 nt, Mycobacterium avium subsp. paratuberculosis
cguuguggccacc

SEQ ID NO: 2943453 - RNA, 15 nt, Mycobacterium avium subsp. paratuberculosis
cguuguggccacccu

SEQ ID NO: 2943454 - RNA, 16 nt, Mycobacterium avium subsp. paratuberculosis
cguuguggcggccagc

SEQ ID NO: 2943455 - RNA, 14 nt, Mycobacterium avium subsp. paratuberculosis
cguugugggccagc

SEQ ID NO: 2943456 - RNA, 15 nt, Mycobacterium avium subsp. paratuberculosis
cguugugggccagcg

SEQ ID NO: 2943457 - RNA, 15 nt, Mycobacterium avium subsp. paratuberculosis
cguuguucaggucga

SEQ ID NO: 2943458 - RNA, 21 nt, Mycobacterium avium subsp. paratuberculosis
cguuguucaggucgauggucu

SEQ ID NO: 2943459 - RNA, 13 nt, Mycobacterium avium subsp. paratuberculosis
cguuguugcgcgg

SEQ ID NO: 2943460 - RNA, 14 nt, Mycobacterium avium subsp. paratuberculosis
cguuguugcucggc

SEQ ID NO: 2943461 - RNA, 17 nt, Mycobacterium avium subsp. paratuberculosis
cguuguugcucggcggc

SEQ ID NO: 2943462 - RNA, 15 nt, Mycobacterium avium subsp. paratuberculosis
cguuguuggcggugg

SEQ ID NO: 2943463 - RNA, 16 nt, Mycobacterium avium subsp. paratuberculosis
cguuucagcagcgcgu

SEQ ID NO: 2943464 - RNA, 16 nt, Mycobacterium avium subsp. paratuberculosis
cguuuccagcgccggc

SEQ ID NO: 2943465 - RNA, 15 nt, Mycobacterium avium subsp. paratuberculosis
cguuuccguccggcg

SEQ ID NO: 2943466 - RNA, 21 nt, Mycobacterium avium subsp. paratuberculosis
cguuuccguccggcgacaugc

SEQ ID NO: 2943467 - RNA, 19 nt, Mycobacterium avium subsp. paratuberculosis
cguuuccuggugcaccagg

SEQ ID NO: 2943468 - RNA, 22 nt, Mycobacterium avium subsp. paratuberculosis
cguuucgugugguacagcgcca

SEQ ID NO: 2943469 - RNA, 16 nt, Mycobacterium avium subsp. paratuberculosis
cguuuggccugcggca

SEQ ID NO: 2943470 - RNA, 16 nt, Mycobacterium avium subsp. paratuberculosis
cguuuggcgccgccca

SEQ ID NO: 2943471 - RNA, 21 nt, Mycobacterium avium subsp. paratuberculosis
cguuuuccagccggcgcacca

SEQ ID NO: 2943472 - RNA, 15 nt, Mycobacterium avium subsp. paratuberculosis
cguuuucggcgcgca

SEQ ID NO: 2943473 - RNA, 21 nt, Mycobacterium avium subsp. paratuberculosis
cguuuuugugggugguccagg

SEQ ID NO: 2943474 - RNA, 18 nt, Mycobacterium avium subsp. paratuberculosis
cuaaacaauggccccggc

SEQ ID NO: 2943475 - RNA, 23 nt, Mycobacterium avium subsp. paratuberculosis
cuaaaccccacggccgcaacggc

SEQ ID NO: 2943476 - RNA, 12 nt, Mycobacterium avium subsp. paratuberculosis
cuaaagccgacu

SEQ ID NO: 2943477 - RNA, 14 nt, Mycobacterium avium subsp. paratuberculosis
cuaaccgcgggcau

SEQ ID NO: 2943478 - RNA, 22 nt, Mycobacterium avium subsp. paratuberculosis
cuaaccgcgggcaucgccguca

SEQ ID NO: 2943479 - RNA, 23 nt, Mycobacterium avium subsp. paratuberculosis
cuaacgccagcugggcagccaga

SEQ ID NO: 2943480 - RNA, 15 nt, Mycobacterium avium subsp. paratuberculosis
cuaacgugcccggcc

SEQ ID NO: 2943481 - RNA, 22 nt, Mycobacterium avium subsp. paratuberculosis
cuaacuguugucagccacucgc

SEQ ID NO: 2943482 - RNA, 24 nt, Mycobacterium avium subsp. paratuberculosis
cuaagccggcgucgggaccgucgc

SEQ ID NO: 2943483 - RNA, 15 nt, Mycobacterium avium subsp. paratuberculosis
cuaaugcaucgaugc

SEQ ID NO: 2943484 - RNA, 19 nt, Mycobacterium avium subsp. paratuberculosis
cuacacagcccccacgcuc

SEQ ID NO: 2943485 - RNA, 15 nt, Mycobacterium avium subsp. paratuberculosis
cuacaggugccggcg

SEQ ID NO: 2943486 - RNA, 12 nt, Mycobacterium avium subsp. paratuberculosis
cuaccagcccca

SEQ ID NO: 2943487 - RNA, 18 nt, Mycobacterium avium subsp. paratuberculosis
cuaccccgucgaaaccgu

SEQ ID NO: 2943488 - RNA, 20 nt, Mycobacterium avium subsp. paratuberculosis
cuacccgccgacgccugcgc

SEQ ID NO: 2943489 - RNA, 21 nt, Mycobacterium avium subsp. paratuberculosis
cuacccgcgauggcacacagc

SEQ ID NO: 2943490 - RNA, 18 nt, Mycobacterium avium subsp. paratuberculosis
cuacccggcgaaccggga

SEQ ID NO: 2943491 - RNA, 16 nt, Mycobacterium avium subsp. paratuberculosis
cuacccguccagcgcg

SEQ ID NO: 2943492 - RNA, 19 nt, Mycobacterium avium subsp. paratuberculosis
cuagugccgggggccgagc

SEQ ID NO: 2943493 - RNA, 15 nt, Mycobacterium avium subsp. paratuberculosis
cuaucgcccggcgcc

SEQ ID NO: 2943494 - RNA, 19 nt, Mycobacterium avium subsp. paratuberculosis
cuaucgcccggcgcccggc

SEQ ID NO: 2943495 - RNA, 12 nt, Mycobacterium avium subsp. paratuberculosis
cuauggcaucgc

SEQ ID NO: 2943496 - RNA, 19 nt, Mycobacterium avium subsp. paratuberculosis
cuauuggccgagccgggcg

SEQ ID NO: 2943497 - RNA, 22 nt, Mycobacterium avium subsp. paratuberculosis
cucaaaccguugaccaccaggu

SEQ ID NO: 2943498 - RNA, 20 nt, Mycobacterium avium subsp. paratuberculosis
cucaacacguccuggcgcca

SEQ ID NO: 2943499 - RNA, 15 nt, Mycobacterium avium subsp. paratuberculosis
cucaacccgggccgg

SEQ ID NO: 2943500 - RNA, 14 nt, Mycobacterium avium subsp. paratuberculosis
cucaaccgcccagc

SEQ ID NO: 2943501 - RNA, 14 nt, Mycobacterium avium subsp. paratuberculosis
cucaacggccggcg

SEQ ID NO: 2943502 - RNA, 19 nt, Mycobacterium avium subsp. paratuberculosis
cucaacggccggcgccgcc

SEQ ID NO: 2943503 - RNA, 12 nt, Mycobacterium avium subsp. paratuberculosis
cucaacggcucc

SEQ ID NO: 2943504 - RNA, 15 nt, Mycobacterium avium subsp. paratuberculosis
cucaacgguugucgc

SEQ ID NO: 2943505 - RNA, 21 nt, Mycobacterium avium subsp. paratuberculosis
cucaagaugauugcgugcccg

SEQ ID NO: 2943506 - RNA, 19 nt, Mycobacterium avium subsp. paratuberculosis
cucaaucuucuccgcggcc

SEQ ID NO: 2943507 - RNA, 22 nt, Mycobacterium avium subsp. paratuberculosis
cucacaaauccagcagcgcggu

SEQ ID NO: 2943508 - RNA, 13 nt, Mycobacterium avium subsp. paratuberculosis
cucacacagccgc

SEQ ID NO: 2943509 - RNA, 17 nt, Mycobacterium avium subsp. paratuberculosis
cucacacggggcagacc

SEQ ID NO: 2943510 - RNA, 22 nt, Mycobacterium avium subsp. paratuberculosis
cucacagcgacaacgggccgcc

SEQ ID NO: 2943511 - RNA, 14 nt, Mycobacterium avium subsp. paratuberculosis
cucacagcgcggcg

SEQ ID NO: 2943512 - RNA, 15 nt, Mycobacterium avium subsp. paratuberculosis
cucacagcgcggcgg

SEQ ID NO: 2943513 - RNA, 16 nt, Mycobacterium avium subsp. paratuberculosis
cucacagcgcggcggu

SEQ ID NO: 2943514 - RNA, 18 nt, Mycobacterium avium subsp. paratuberculosis
cucaccacgugccacugg

SEQ ID NO: 2943515 - RNA, 20 nt, Mycobacterium avium subsp. paratuberculosis
cucacccaaaaaggcgcggg

SEQ ID NO: 2943516 - RNA, 15 nt, Mycobacterium avium subsp. paratuberculosis
cucaccccagcgcga

SEQ ID NO: 2943517 - RNA, 18 nt, Mycobacterium avium subsp. paratuberculosis
cucaccccagcgcgacca

SEQ ID NO: 2943518 - RNA, 14 nt, Mycobacterium avium subsp. paratuberculosis
cucaccccgcuugc

SEQ ID NO: 2943519 - RNA, 15 nt, Mycobacterium avium subsp. paratuberculosis
cucaccccggccagg

SEQ ID NO: 2943520 - RNA, 13 nt, Mycobacterium avium subsp. paratuberculosis
cucacccggccca

SEQ ID NO: 2943521 - RNA, 19 nt, Mycobacterium avium subsp. paratuberculosis
cucacccggcccaccggcc

SEQ ID NO: 2943522 - RNA, 14 nt, Mycobacterium avium subsp. paratuberculosis
cucaccgagcuggg

SEQ ID NO: 2943523 - RNA, 17 nt, Mycobacterium avium subsp. paratuberculosis
cucaccgagcugggccg

SEQ ID NO: 2943524 - RNA, 20 nt, Mycobacterium avium subsp. paratuberculosis
cucaccgagcugggccggcg

SEQ ID NO: 2943525 - RNA, 23 nt, Mycobacterium avium subsp. paratuberculosis
cucaccgagcugggccggcgccg

SEQ ID NO: 2943526 - RNA, 20 nt, Mycobacterium avium subsp. paratuberculosis
cucaccgccgagccgcucca

SEQ ID NO: 2943527 - RNA, 13 nt, Mycobacterium avium subsp. paratuberculosis
cucaccgccgaug

SEQ ID NO: 2943528 - RNA, 15 nt, Mycobacterium avium subsp. paratuberculosis
cucaccgcgggccag

SEQ ID NO: 2943529 - RNA, 18 nt, Mycobacterium avium subsp. paratuberculosis
cucaccgcgggccaggcc

SEQ ID NO: 2943530 - RNA, 23 nt, Mycobacterium avium subsp. paratuberculosis
cucaccgcgggccaggcccaccg

SEQ ID NO: 2943531 - RNA, 16 nt, Mycobacterium avium subsp. paratuberculosis
cucaccgcggggugcc

SEQ ID NO: 2943532 - RNA, 20 nt, Mycobacterium avium subsp. paratuberculosis
cucaccgcggggugcccggc

SEQ ID NO: 2943533 - RNA, 20 nt, Mycobacterium avium subsp. paratuberculosis
cucaccggccagggccgccg

SEQ ID NO: 2943534 - RNA, 14 nt, Mycobacterium avium subsp. paratuberculosis
cucaccggcggcgg

SEQ ID NO: 2943535 - RNA, 17 nt, Mycobacterium avium subsp. paratuberculosis
cucaccggcggcggccu

SEQ ID NO: 2943536 - RNA, 16 nt, Mycobacterium avium subsp. paratuberculosis
cucaccggucagcugg

SEQ ID NO: 2943537 - RNA, 20 nt, Mycobacterium avium subsp. paratuberculosis
cucaccgguggccgcgucga

SEQ ID NO: 2943538 - RNA, 14 nt, Mycobacterium avium subsp. paratuberculosis
cucaccgucgcggu

SEQ ID NO: 2943539 - RNA, 22 nt, Mycobacterium avium subsp. paratuberculosis
cucaccgucgcggucagcucga

SEQ ID NO: 2943540 - RNA, 14 nt, Mycobacterium avium subsp. paratuberculosis
cucaccugcggccc

SEQ ID NO: 2943541 - RNA, 13 nt, Mycobacterium avium subsp. paratuberculosis
cucaccugcgugc

SEQ ID NO: 2943542 - RNA, 21 nt, Mycobacterium avium subsp. paratuberculosis
cucaccugcguugcggcacag

SEQ ID NO: 2943543 - RNA, 23 nt, Mycobacterium avium subsp. paratuberculosis
cucacgacgcggucugcggugcg

SEQ ID NO: 2943544 - RNA, 15 nt, Mycobacterium avium subsp. paratuberculosis
cucacgacuccuggc

SEQ ID NO: 2943545 - RNA, 18 nt, Mycobacterium avium subsp. paratuberculosis
cucacgacuccuggccga

SEQ ID NO: 2943546 - RNA, 20 nt, Mycobacterium avium subsp. paratuberculosis
cucacgacuccuggccgaac

SEQ ID NO: 2943547 - RNA, 13 nt, Mycobacterium avium subsp. paratuberculosis
cucacgcagggcc

SEQ ID NO: 2943548 - RNA, 17 nt, Mycobacterium avium subsp. paratuberculosis
cucacgccucgucgagc

SEQ ID NO: 2943549 - RNA, 19 nt, Mycobacterium avium subsp. paratuberculosis
cucacgccucgucgagcag

SEQ ID NO: 2943550 - RNA, 19 nt, Mycobacterium avium subsp. paratuberculosis
cucacggcggcagcgcggc

SEQ ID NO: 2943551 - RNA, 19 nt, Mycobacterium avium subsp. paratuberculosis
cucacggucggcguccagc

SEQ ID NO: 2943552 - RNA, 23 nt, Mycobacterium avium subsp. paratuberculosis
cucacggucggcguccagcgcgg

SEQ ID NO: 2943553 - RNA, 16 nt, Mycobacterium avium subsp. paratuberculosis
cucacguagucgaccg

SEQ ID NO: 2943554 - RNA, 16 nt, Mycobacterium avium subsp. paratuberculosis
cucacuccagcggcgg

SEQ ID NO: 2943555 - RNA, 15 nt, Mycobacterium avium subsp. paratuberculosis
cucagaacaggugcg

SEQ ID NO: 2943556 - RNA, 12 nt, Mycobacterium avium subsp. paratuberculosis
cucagaaggcgu

SEQ ID NO: 2943557 - RNA, 21 nt, Mycobacterium avium subsp. paratuberculosis
cucagaccauggcgcggcggc

SEQ ID NO: 2943558 - RNA, 22 nt, Mycobacterium avium subsp. paratuberculosis
cucagaccauggcgcggcggcc

SEQ ID NO: 2943559 - RNA, 23 nt, Mycobacterium avium subsp. paratuberculosis
cucagaccauggcgcggcggccg

SEQ ID NO: 2943560 - RNA, 14 nt, Mycobacterium avium subsp. paratuberculosis
cucagaggcgggca

SEQ ID NO: 2943561 - RNA, 18 nt, Mycobacterium avium subsp. paratuberculosis
cucagcacggccgcggcc

SEQ ID NO: 2943562 - RNA, 19 nt, Mycobacterium avium subsp. paratuberculosis
cucagcacggccgcggcca

SEQ ID NO: 2943563 - RNA, 14 nt, Mycobacterium avium subsp. paratuberculosis
cucagcagcaccgc

SEQ ID NO: 2943564 - RNA, 15 nt, Mycobacterium avium subsp. paratuberculosis
cucagcagcaccgca

SEQ ID NO: 2943565 - RNA, 15 nt, Mycobacterium avium subsp. paratuberculosis
cucagcagcgggccg

SEQ ID NO: 2943566 - RNA, 14 nt, Mycobacterium avium subsp. paratuberculosis
cucagcagggcggc

SEQ ID NO: 2943567 - RNA, 16 nt, Mycobacterium avium subsp. paratuberculosis
cucagcagggcggcac

SEQ ID NO: 2943568 - RNA, 19 nt, Mycobacterium avium subsp. paratuberculosis
cucagcagggcggcaccga

SEQ ID NO: 2943569 - RNA, 13 nt, Mycobacterium avium subsp. paratuberculosis
cucagccacgccg

SEQ ID NO: 2943570 - RNA, 15 nt, Mycobacterium avium subsp. paratuberculosis
cucagccccagcgga

SEQ ID NO: 2943571 - RNA, 20 nt, Mycobacterium avium subsp. paratuberculosis
cucagcccgauucagccggc

SEQ ID NO: 2943572 - RNA, 22 nt, Mycobacterium avium subsp. paratuberculosis
cucagcccgauucagccggcgg

SEQ ID NO: 2943573 - RNA, 12 nt, Mycobacterium avium subsp. paratuberculosis
cucagcccggca

SEQ ID NO: 2943574 - RNA, 14 nt, Mycobacterium avium subsp. paratuberculosis
cucagcccggcagc

SEQ ID NO: 2943575 - RNA, 12 nt, Mycobacterium avium subsp. paratuberculosis
cucagcccggcc

SEQ ID NO: 2943576 - RNA, 15 nt, Mycobacterium avium subsp. paratuberculosis
cucagcccggcccag

SEQ ID NO: 2943577 - RNA, 21 nt, Mycobacterium avium subsp. paratuberculosis
cucaugagcccuccagcuggu

SEQ ID NO: 2943578 - RNA, 14 nt, Mycobacterium avium subsp. paratuberculosis
cucaugcccgccac

SEQ ID NO: 2943579 - RNA, 20 nt, Mycobacterium avium subsp. paratuberculosis
cucaugcccgccacggccag

SEQ ID NO: 2943580 - RNA, 18 nt, Mycobacterium avium subsp. paratuberculosis
cucaugggcccggcccgu

SEQ ID NO: 2943581 - RNA, 21 nt, Mycobacterium avium subsp. paratuberculosis
cucaugucaaugccgcagccg

SEQ ID NO: 2943582 - RNA, 20 nt, Mycobacterium avium subsp. paratuberculosis
cucaugucguacgggcgcag

SEQ ID NO: 2943583 - RNA, 17 nt, Mycobacterium avium subsp. paratuberculosis
cucaugugauuacuccu

SEQ ID NO: 2943584 - RNA, 20 nt, Mycobacterium avium subsp. paratuberculosis
cucauguugugcaggcagcc

SEQ ID NO: 2943585 - RNA, 22 nt, Mycobacterium avium subsp. paratuberculosis
cuccaacagccgguccuuggcc

SEQ ID NO: 2943586 - RNA, 18 nt, Mycobacterium avium subsp. paratuberculosis
cuccaacggcaccaccac

SEQ ID NO: 2943587 - RNA, 14 nt, Mycobacterium avium subsp. paratuberculosis
cuccaacggccgca

SEQ ID NO: 2943588 - RNA, 15 nt, Mycobacterium avium subsp. paratuberculosis
cuccaacggccgcac

SEQ ID NO: 2943589 - RNA, 21 nt, Mycobacterium avium subsp. paratuberculosis
cuccaacugcauuucggacgg

SEQ ID NO: 2943590 - RNA, 13 nt, Mycobacterium avium subsp. paratuberculosis
cuccaaugcggcc

SEQ ID NO: 2943591 - RNA, 14 nt, Mycobacterium avium subsp. paratuberculosis
cuccaaugcggccg

SEQ ID NO: 2943592 - RNA, 22 nt, Mycobacterium avium subsp. paratuberculosis
cuccacacggcaggcggcccgc

SEQ ID NO: 2943593 - RNA, 18 nt, Mycobacterium avium subsp. paratuberculosis
cuccaccaaacgaaguga

SEQ ID NO: 2943594 - RNA, 12 nt, Mycobacterium avium subsp. paratuberculosis
cuccaccaccau

SEQ ID NO: 2943595 - RNA, 14 nt, Mycobacterium avium subsp. paratuberculosis
cuccaccaccaugu

SEQ ID NO: 2943596 - RNA, 14 nt, Mycobacterium avium subsp. paratuberculosis
cuccaccaccggcc

SEQ ID NO: 2943597 - RNA, 20 nt, Mycobacterium avium subsp. paratuberculosis
cuccaccaccggccgcgcgu

SEQ ID NO: 2943598 - RNA, 13 nt, Mycobacterium avium subsp. paratuberculosis
cuccaccagcgcg

SEQ ID NO: 2943599 - RNA, 21 nt, Mycobacterium avium subsp. paratuberculosis
cuccaccagguucgcgcagcu

SEQ ID NO: 2943600 - RNA, 22 nt, Mycobacterium avium subsp. paratuberculosis
cuccacccccuacgccguggcc

SEQ ID NO: 2943601 - RNA, 13 nt, Mycobacterium avium subsp. paratuberculosis
cuccacccgcccc

SEQ ID NO: 2943602 - RNA, 16 nt, Mycobacterium avium subsp. paratuberculosis
cuccacccugccgacc

SEQ ID NO: 2943603 - RNA, 23 nt, Mycobacterium avium subsp. paratuberculosis
cuccaccgaaaagcccgccgccu

SEQ ID NO: 2943604 - RNA, 20 nt, Mycobacterium avium subsp. paratuberculosis
cuccaccgagugcggcgcgg

SEQ ID NO: 2943605 - RNA, 22 nt, Mycobacterium avium subsp. paratuberculosis
cuccaccgagugcggcgcggug

SEQ ID NO: 2943606 - RNA, 14 nt, Mycobacterium avium subsp. paratuberculosis
cuccaccgccaccg

SEQ ID NO: 2943607 - RNA, 13 nt, Mycobacterium avium subsp. paratuberculosis
cuccaccgcgccg

SEQ ID NO: 2943608 - RNA, 18 nt, Mycobacterium avium subsp. paratuberculosis
cuccaccgcgccggcggc

SEQ ID NO: 2943609 - RNA, 14 nt, Mycobacterium avium subsp. paratuberculosis
cuccaccgucgaug

SEQ ID NO: 2943610 - RNA, 18 nt, Mycobacterium avium subsp. paratuberculosis
cuccaccguguucaccag

SEQ ID NO: 2943611 - RNA, 20 nt, Mycobacterium avium subsp. paratuberculosis
cuccaccguguucaccagcg

SEQ ID NO: 2943612 - RNA, 21 nt, Mycobacterium avium subsp. paratuberculosis
cuccaccucgggcauuggcag

SEQ ID NO: 2943613 - RNA, 19 nt, Mycobacterium avium subsp. paratuberculosis
cuccaccugcggcaccucg

SEQ ID NO: 2943614 - RNA, 16 nt, Mycobacterium avium subsp. paratuberculosis
cuccacgagccggucg

SEQ ID NO: 2943615 - RNA, 22 nt, Mycobacterium avium subsp. paratuberculosis
cuccacgaugcccgucacggcc

SEQ ID NO: 2943616 - RNA, 13 nt, Mycobacterium avium subsp. paratuberculosis
cuccacgccgccg

SEQ ID NO: 2943617 - RNA, 16 nt, Mycobacterium avium subsp. paratuberculosis
cuccacgccgccggga

SEQ ID NO: 2943618 - RNA, 23 nt, Mycobacterium avium subsp. paratuberculosis
cuccacgccgccgggaacagcga

SEQ ID NO: 2943619 - RNA, 18 nt, Mycobacterium avium subsp. paratuberculosis
cuccacgcguagccgacc

SEQ ID NO: 2943620 - RNA, 13 nt, Mycobacterium avium subsp. paratuberculosis
cuccacgcucgga

SEQ ID NO: 2943621 - RNA, 14 nt, Mycobacterium avium subsp. paratuberculosis
cuccacgcucggaa

SEQ ID NO: 2943622 - RNA, 19 nt, Mycobacterium avium subsp. paratuberculosis
cuccacggugcgcaccgac

SEQ ID NO: 2943623 - RNA, 17 nt, Mycobacterium avium subsp. paratuberculosis
cuccacgucaccgacgc

SEQ ID NO: 2943624 - RNA, 15 nt, Mycobacterium avium subsp. paratuberculosis
cuccagaucgccgcc

SEQ ID NO: 2943625 - RNA, 19 nt, Mycobacterium avium subsp. paratuberculosis
cuccagaucgccgcccauc

SEQ ID NO: 2943626 - RNA, 18 nt, Mycobacterium avium subsp. paratuberculosis
cuccagaugcgguggugg

SEQ ID NO: 2943627 - RNA, 10 nt, Mycobacterium avium subsp. paratuberculosis
cuccagcacc

SEQ ID NO: 2943628 - RNA, 12 nt, Mycobacterium avium subsp. paratuberculosis
cuccagcaccag

SEQ ID NO: 2943629 - RNA, 16 nt, Mycobacterium avium subsp. paratuberculosis
cuccagcaccagcacg

SEQ ID NO: 2943630 - RNA, 17 nt, Mycobacterium avium subsp. paratuberculosis
cuccagcacccgcaacg

SEQ ID NO: 2943631 - RNA, 14 nt, Mycobacterium avium subsp. paratuberculosis
cuccagcaccggcg

SEQ ID NO: 2943632 - RNA, 15 nt, Mycobacterium avium subsp. paratuberculosis
cuccagcaccggcgc

SEQ ID NO: 2943633 - RNA, 13 nt, Mycobacterium avium subsp. paratuberculosis
cuccagcaccguc

SEQ ID NO: 2943634 - RNA, 16 nt, Mycobacterium avium subsp. paratuberculosis
cuccagcaccgucggc

SEQ ID NO: 2943635 - RNA, 18 nt, Mycobacterium avium subsp. paratuberculosis
cuccagcacgaaggccgc

SEQ ID NO: 2943636 - RNA, 23 nt, Mycobacterium avium subsp. paratuberculosis
cuccagcacgaaggccgccgggu

SEQ ID NO: 2943637 - RNA, 13 nt, Mycobacterium avium subsp. paratuberculosis
cuccagcagcgcc

SEQ ID NO: 2943638 - RNA, 14 nt, Mycobacterium avium subsp. paratuberculosis
cuccagcagcgcca

SEQ ID NO: 2943639 - RNA, 15 nt, Mycobacterium avium subsp. paratuberculosis
cuccagcagcgccuu

SEQ ID NO: 2943640 - RNA, 17 nt, Mycobacterium avium subsp. paratuberculosis
cuccagcagcgccuugc

SEQ ID NO: 2943641 - RNA, 19 nt, Mycobacterium avium subsp. paratuberculosis
cuccagcagcuguugcggc

SEQ ID NO: 2943642 - RNA, 13 nt, Mycobacterium avium subsp. paratuberculosis
cuccagcagcuuc

SEQ ID NO: 2943643 - RNA, 15 nt, Mycobacterium avium subsp. paratuberculosis
cuccagcaggcgcgc

SEQ ID NO: 2943644 - RNA, 22 nt, Mycobacterium avium subsp. paratuberculosis
cuccagcaggcuggcguugggc

SEQ ID NO: 2943645 - RNA, 14 nt, Mycobacterium avium subsp. paratuberculosis
cuccagcagggaca

SEQ ID NO: 2943646 - RNA, 17 nt, Mycobacterium avium subsp. paratuberculosis
cuccagccacuccacca

SEQ ID NO: 2943647 - RNA, 14 nt, Mycobacterium avium subsp. paratuberculosis
cuccagccagcgcg

SEQ ID NO: 2943648 - RNA, 15 nt, Mycobacterium avium subsp. paratuberculosis
cuccagccagcgcgc

SEQ ID NO: 2943649 - RNA, 17 nt, Mycobacterium avium subsp. paratuberculosis
cuccagccagcgcgcga

SEQ ID NO: 2943650 - RNA, 14 nt, Mycobacterium avium subsp. paratuberculosis
cuccagccgccggu

SEQ ID NO: 2943651 - RNA, 23 nt, Mycobacterium avium subsp. paratuberculosis
cuccagccgccgguccagugccg

SEQ ID NO: 2943652 - RNA, 18 nt, Mycobacterium avium subsp. paratuberculosis
cuccagccgcgcggccgc

SEQ ID NO: 2943653 - RNA, 19 nt, Mycobacterium avium subsp. paratuberculosis
cuccagccgcgcggccgcc

SEQ ID NO: 2943654 - RNA, 15 nt, Mycobacterium avium subsp. paratuberculosis
cuccagccgcuccgc

SEQ ID NO: 2943655 - RNA, 23 nt, Mycobacterium avium subsp. paratuberculosis
cuccagccgcuccucguugaucc

SEQ ID NO: 2943656 - RNA, 13 nt, Mycobacterium avium subsp. paratuberculosis
cuccagcgcccgc

SEQ ID NO: 2943657 - RNA, 23 nt, Mycobacterium avium subsp. paratuberculosis
cuccagcgcgaucaacgggucga

SEQ ID NO: 2943658 - RNA, 16 nt, Mycobacterium avium subsp. paratuberculosis
cuccagcgcggucucg

SEQ ID NO: 2943659 - RNA, 14 nt, Mycobacterium avium subsp. paratuberculosis
cuccagcggccaca

SEQ ID NO: 2943660 - RNA, 13 nt, Mycobacterium avium subsp. paratuberculosis
cuccagcggccgc

SEQ ID NO: 2943661 - RNA, 15 nt, Mycobacterium avium subsp. paratuberculosis
cuccagcggccgcag

SEQ ID NO: 2943662 - RNA, 17 nt, Mycobacterium avium subsp. paratuberculosis
cucccgcuccauggcgg

SEQ ID NO: 2943663 - RNA, 15 nt, Mycobacterium avium subsp. paratuberculosis
cucccggaccaccag

SEQ ID NO: 2943664 - RNA, 17 nt, Mycobacterium avium subsp. paratuberculosis
cucccggaccaccagga

SEQ ID NO: 2943665 - RNA, 17 nt, Mycobacterium avium subsp. paratuberculosis
cucccggcagaucgcgg

SEQ ID NO: 2943666 - RNA, 20 nt, Mycobacterium avium subsp. paratuberculosis
cucccggcagaucgcggccc

SEQ ID NO: 2943667 - RNA, 13 nt, Mycobacterium avium subsp. paratuberculosis
cucccggccgacg

SEQ ID NO: 2943668 - RNA, 14 nt, Mycobacterium avium subsp. paratuberculosis
cucccggccgacga

SEQ ID NO: 2943669 - RNA, 15 nt, Mycobacterium avium subsp. paratuberculosis
cucccggccgacgau

SEQ ID NO: 2943670 - RNA, 15 nt, Mycobacterium avium subsp. paratuberculosis
cucccggcgcagcaa

SEQ ID NO: 2943671 - RNA, 21 nt, Mycobacterium avium subsp. paratuberculosis
cucccggcgccacgccgcgau

SEQ ID NO: 2943672 - RNA, 14 nt, Mycobacterium avium subsp. paratuberculosis
cucccggcgccgcc

SEQ ID NO: 2943673 - RNA, 12 nt, Mycobacterium avium subsp. paratuberculosis
cucccgggcggc

SEQ ID NO: 2943674 - RNA, 14 nt, Mycobacterium avium subsp. paratuberculosis
cucccgggcggcgc

SEQ ID NO: 2943675 - RNA, 15 nt, Mycobacterium avium subsp. paratuberculosis
cucccgggcggcgcc

SEQ ID NO: 2943676 - RNA, 16 nt, Mycobacterium avium subsp. paratuberculosis
cucccgggcggcgccg

SEQ ID NO: 2943677 - RNA, 12 nt, Mycobacterium avium subsp. paratuberculosis
cucccgggcggu

SEQ ID NO: 2943678 - RNA, 21 nt, Mycobacterium avium subsp. paratuberculosis
cucccgggcggucgcgucguc

SEQ ID NO: 2943679 - RNA, 17 nt, Mycobacterium avium subsp. paratuberculosis
cucccgggugcgcgucg

SEQ ID NO: 2943680 - RNA, 16 nt, Mycobacterium avium subsp. paratuberculosis
cucccggguggccucc

SEQ ID NO: 2943681 - RNA, 17 nt, Mycobacterium avium subsp. paratuberculosis
cucccggguggccuccg

SEQ ID NO: 2943682 - RNA, 18 nt, Mycobacterium avium subsp. paratuberculosis
cucccgguagaucgccgg

SEQ ID NO: 2943683 - RNA, 19 nt, Mycobacterium avium subsp. paratuberculosis
cucccgguaggcggcgaga

SEQ ID NO: 2943684 - RNA, 20 nt, Mycobacterium avium subsp. paratuberculosis
cucccggucguagucggccc

SEQ ID NO: 2943685 - RNA, 23 nt, Mycobacterium avium subsp. paratuberculosis
cucccggucguagucggcccgcc

SEQ ID NO: 2943686 - RNA, 15 nt, Mycobacterium avium subsp. paratuberculosis
cucccgucgcgacga

SEQ ID NO: 2943687 - RNA, 23 nt, Mycobacterium avium subsp. paratuberculosis
cucccgucgcgacgagcgggccg

SEQ ID NO: 2943688 - RNA, 21 nt, Mycobacterium avium subsp. paratuberculosis
cucccugagcuuuucgucggu

SEQ ID NO: 2943689 - RNA, 19 nt, Mycobacterium avium subsp. paratuberculosis
cucccuguuagggcgacca

SEQ ID NO: 2943690 - RNA, 21 nt, Mycobacterium avium subsp. paratuberculosis
cucccuguuagggcgaccacc

SEQ ID NO: 2943691 - RNA, 12 nt, Mycobacterium avium subsp. paratuberculosis
cuccgacagccc

SEQ ID NO: 2943692 - RNA, 13 nt, Mycobacterium avium subsp. paratuberculosis
cuccgacagcccc

SEQ ID NO: 2943693 - RNA, 16 nt, Mycobacterium avium subsp. paratuberculosis
cuccgacagcccccgc

SEQ ID NO: 2943694 - RNA, 21 nt, Mycobacterium avium subsp. paratuberculosis
cuccgacagcccccgcagccc

SEQ ID NO: 2943695 - RNA, 22 nt, Mycobacterium avium subsp. paratuberculosis
cuccgacagcccccgcagcccg

SEQ ID NO: 2943696 - RNA, 24 nt, Mycobacterium avium subsp. paratuberculosis
cuccgacagccgcaccggcgccgc

SEQ ID NO: 2943697 - RNA, 13 nt, Mycobacterium avium subsp. paratuberculosis
cuccgaccagccg

SEQ ID NO: 2943698 - RNA, 17 nt, Mycobacterium avium subsp. paratuberculosis
cuccgaccagccggucu

SEQ ID NO: 2943699 - RNA, 14 nt, Mycobacterium avium subsp. paratuberculosis
cuccgacgcggugg

SEQ ID NO: 2943700 - RNA, 16 nt, Mycobacterium avium subsp. paratuberculosis
cuccgacgcgguggcg

SEQ ID NO: 2943701 - RNA, 12 nt, Mycobacterium avium subsp. paratuberculosis
cuccgacuccag

SEQ ID NO: 2943702 - RNA, 14 nt, Mycobacterium avium subsp. paratuberculosis
cuccgacuccagca

SEQ ID NO: 2943703 - RNA, 18 nt, Mycobacterium avium subsp. paratuberculosis
cuccgacugugaauuccg

SEQ ID NO: 2943704 - RNA, 18 nt, Mycobacterium avium subsp. paratuberculosis
cuccgacuuacggcguga

SEQ ID NO: 2943705 - RNA, 19 nt, Mycobacterium avium subsp. paratuberculosis
cuccgagauggacagcacc

SEQ ID NO: 2943706 - RNA, 18 nt, Mycobacterium avium subsp. paratuberculosis
cuccgaggcguccuccuc

SEQ ID NO: 2943707 - RNA, 17 nt, Mycobacterium avium subsp. paratuberculosis
cuccgaggucagcgcgu

SEQ ID NO: 2943708 - RNA, 14 nt, Mycobacterium avium subsp. paratuberculosis
cuccgagucggcgu

SEQ ID NO: 2943709 - RNA, 15 nt, Mycobacterium avium subsp. paratuberculosis
cuccgagucggcguc

SEQ ID NO: 2943710 - RNA, 17 nt, Mycobacterium avium subsp. paratuberculosis
cuccgagucggcgucgg

SEQ ID NO: 2943711 - RNA, 16 nt, Mycobacterium avium subsp. paratuberculosis
cuccgcaugcccgggc

SEQ ID NO: 2943712 - RNA, 17 nt, Mycobacterium avium subsp. paratuberculosis
cuccgcaugcccgggcg

SEQ ID NO: 2943713 - RNA, 14 nt, Mycobacterium avium subsp. paratuberculosis
cuccgccacccugc

SEQ ID NO: 2943714 - RNA, 16 nt, Mycobacterium avium subsp. paratuberculosis
cuccgccaccuccucc

SEQ ID NO: 2943715 - RNA, 21 nt, Mycobacterium avium subsp. paratuberculosis
cuccgcccgggugcaggccca

SEQ ID NO: 2943716 - RNA, 16 nt, Mycobacterium avium subsp. paratuberculosis
cuccgccgacaccagg

SEQ ID NO: 2943717 - RNA, 12 nt, Mycobacterium avium subsp. paratuberculosis
cuccgccggcag

SEQ ID NO: 2943718 - RNA, 13 nt, Mycobacterium avium subsp. paratuberculosis
cuccgccggcagu

SEQ ID NO: 2943719 - RNA, 12 nt, Mycobacterium avium subsp. paratuberculosis
cuccgccgggcu

SEQ ID NO: 2943720 - RNA, 22 nt, Mycobacterium avium subsp. paratuberculosis
cuccgccuucgaguuuggccug

SEQ ID NO: 2943721 - RNA, 17 nt, Mycobacterium avium subsp. paratuberculosis
cuccgcgacaucggcgc

SEQ ID NO: 2943722 - RNA, 22 nt, Mycobacterium avium subsp. paratuberculosis
cuccgcgacaucggcgccgacg

SEQ ID NO: 2943723 - RNA, 14 nt, Mycobacterium avium subsp. paratuberculosis
cuccgcgauggccu

SEQ ID NO: 2943724 - RNA, 16 nt, Mycobacterium avium subsp. paratuberculosis
cuccgcgauggccucc

SEQ ID NO: 2943725 - RNA, 19 nt, Mycobacterium avium subsp. paratuberculosis
cuccgcgauggccuccgac

SEQ ID NO: 2943726 - RNA, 14 nt, Mycobacterium avium subsp. paratuberculosis
cuccgcgcgcggca

SEQ ID NO: 2943727 - RNA, 16 nt, Mycobacterium avium subsp. paratuberculosis
cuccgcgcgcggcacg

SEQ ID NO: 2943728 - RNA, 14 nt, Mycobacterium avium subsp. paratuberculosis
cuccgcgcgcggcc

SEQ ID NO: 2943729 - RNA, 20 nt, Mycobacterium avium subsp. paratuberculosis
cuccgcgcugaccagcguga

SEQ ID NO: 2943730 - RNA, 22 nt, Mycobacterium avium subsp. paratuberculosis
cuccgcggccagcucggucgcg

SEQ ID NO: 2943731 - RNA, 13 nt, Mycobacterium avium subsp. paratuberculosis
cuccgcggccgcg

SEQ ID NO: 2943732 - RNA, 15 nt, Mycobacterium avium subsp. paratuberculosis
cuccgcggccgcgcg

SEQ ID NO: 2943733 - RNA, 14 nt, Mycobacterium avium subsp. paratuberculosis
cuccgcggcgccgu

SEQ ID NO: 2943734 - RNA, 13 nt, Mycobacterium avium subsp. paratuberculosis
cuccgcggcgggc

SEQ ID NO: 2943735 - RNA, 16 nt, Mycobacterium avium subsp. paratuberculosis
cuccgcggcgggcgug

SEQ ID NO: 2943736 - RNA, 14 nt, Mycobacterium avium subsp. paratuberculosis
cuccgcggugcugc

SEQ ID NO: 2943737 - RNA, 21 nt, Mycobacterium avium subsp. paratuberculosis
cuccgcggugcugcagcgcga

SEQ ID NO: 2943738 - RNA, 15 nt, Mycobacterium avium subsp. paratuberculosis
cuccgcucgggcccg

SEQ ID NO: 2943739 - RNA, 16 nt, Mycobacterium avium subsp. paratuberculosis
cuccgcucgggcccgc

SEQ ID NO: 2943740 - RNA, 17 nt, Mycobacterium avium subsp. paratuberculosis
cuccgcucgggcccgcg

SEQ ID NO: 2943741 - RNA, 18 nt, Mycobacterium avium subsp. paratuberculosis
cuccggagugacgucgcg

SEQ ID NO: 2943742 - RNA, 20 nt, Mycobacterium avium subsp. paratuberculosis
cuccggagugacgucgcgcg

SEQ ID NO: 2943743 - RNA, 16 nt, Mycobacterium avium subsp. paratuberculosis
cuccggauggcggucg

SEQ ID NO: 2943744 - RNA, 22 nt, Mycobacterium avium subsp. paratuberculosis
cuccggcaacgaggccagggcc

SEQ ID NO: 2943745 - RNA, 13 nt, Mycobacterium avium subsp. paratuberculosis
cuccggcacguug

SEQ ID NO: 2943746 - RNA, 14 nt, Mycobacterium avium subsp. paratuberculosis
cuccggcaggccgc

SEQ ID NO: 2943747 - RNA, 14 nt, Mycobacterium avium subsp. paratuberculosis
cuccugcggugggc

SEQ ID NO: 2943748 - RNA, 22 nt, Mycobacterium avium subsp. paratuberculosis
cuccuggaaggacgucaggccg

SEQ ID NO: 2943749 - RNA, 20 nt, Mycobacterium avium subsp. paratuberculosis
cuccuggccccgaucaucaa

SEQ ID NO: 2943750 - RNA, 12 nt, Mycobacterium avium subsp. paratuberculosis
cuccuggccgcc

SEQ ID NO: 2943751 - RNA, 17 nt, Mycobacterium avium subsp. paratuberculosis
cuccuggccgccgugca

SEQ ID NO: 2943752 - RNA, 21 nt, Mycobacterium avium subsp. paratuberculosis
cuccuggggcagaucgucggc

SEQ ID NO: 2943753 - RNA, 17 nt, Mycobacterium avium subsp. paratuberculosis
cuccuguuggcccugcu

SEQ ID NO: 2943754 - RNA, 18 nt, Mycobacterium avium subsp. paratuberculosis
cuccuguuggcccugcuc

SEQ ID NO: 2943755 - RNA, 15 nt, Mycobacterium avium subsp. paratuberculosis
cuccuugagccgccg

SEQ ID NO: 2943756 - RNA, 20 nt, Mycobacterium avium subsp. paratuberculosis
cuccuugcgccgcaacaggu

SEQ ID NO: 2943757 - RNA, 17 nt, Mycobacterium avium subsp. paratuberculosis
cuccuugggagacugcg

SEQ ID NO: 2943758 - RNA, 13 nt, Mycobacterium avium subsp. paratuberculosis
cucgaaacccagc

SEQ ID NO: 2943759 - RNA, 14 nt, Mycobacterium avium subsp. paratuberculosis
cucgaaagccgcug

SEQ ID NO: 2943760 - RNA, 16 nt, Mycobacterium avium subsp. paratuberculosis
cucgaacaacccggcc

SEQ ID NO: 2943761 - RNA, 20 nt, Mycobacterium avium subsp. paratuberculosis
cucgaacaacccggccgcga

SEQ ID NO: 2943762 - RNA, 14 nt, Mycobacterium avium subsp. paratuberculosis
cucgaacacccggc

SEQ ID NO: 2943763 - RNA, 19 nt, Mycobacterium avium subsp. paratuberculosis
cucgaacaccgcaccgguc

SEQ ID NO: 2943764 - RNA, 12 nt, Mycobacterium avium subsp. paratuberculosis
cucgaaccgggc

SEQ ID NO: 2943765 - RNA, 19 nt, Mycobacterium avium subsp. paratuberculosis
cucgaaccgggcggugacc

SEQ ID NO: 2943766 - RNA, 19 nt, Mycobacterium avium subsp. paratuberculosis
cucgaaccggggcaccacg

SEQ ID NO: 2943767 - RNA, 15 nt, Mycobacterium avium subsp. paratuberculosis
cucgaacgcgccgau

SEQ ID NO: 2943768 - RNA, 12 nt, Mycobacterium avium subsp. paratuberculosis
cucgaacggccc

SEQ ID NO: 2943769 - RNA, 15 nt, Mycobacterium avium subsp. paratuberculosis
cucgaacggcccgga

SEQ ID NO: 2943770 - RNA, 19 nt, Mycobacterium avium subsp. paratuberculosis
cucgaacggcccggacgga

SEQ ID NO: 2943771 - RNA, 23 nt, Mycobacterium avium subsp. paratuberculosis
cucgaacucaccgguggccgcgu

SEQ ID NO: 2943772 - RNA, 15 nt, Mycobacterium avium subsp. paratuberculosis
cucgaagaagagggc

SEQ ID NO: 2943773 - RNA, 16 nt, Mycobacterium avium subsp. paratuberculosis
cucgaagaucgccugc

SEQ ID NO: 2943774 - RNA, 17 nt, Mycobacterium avium subsp. paratuberculosis
cucgaagauggucgcgc

SEQ ID NO: 2943775 - RNA, 19 nt, Mycobacterium avium subsp. paratuberculosis
cucgaagauggucgcgccg

SEQ ID NO: 2943776 - RNA, 19 nt, Mycobacterium avium subsp. paratuberculosis
cucgaagccgaucgcggcg

SEQ ID NO: 2943777 - RNA, 14 nt, Mycobacterium avium subsp. paratuberculosis
cucgaagcgcagca

SEQ ID NO: 2943778 - RNA, 23 nt, Mycobacterium avium subsp. paratuberculosis
cucgaagcgcagcagcucgucgu

SEQ ID NO: 2943779 - RNA, 16 nt, Mycobacterium avium subsp. paratuberculosis
cucgaagcugcgccac

SEQ ID NO: 2943780 - RNA, 18 nt, Mycobacterium avium subsp. paratuberculosis
cucgaaggcaacucgcga

SEQ ID NO: 2943781 - RNA, 14 nt, Mycobacterium avium subsp. paratuberculosis
cucgaagggcgcca

SEQ ID NO: 2943782 - RNA, 17 nt, Mycobacterium avium subsp. paratuberculosis
cucgaagggcgccagcc

SEQ ID NO: 2943783 - RNA, 19 nt, Mycobacterium avium subsp. paratuberculosis
cucgaagggcgccagccgu

SEQ ID NO: 2943784 - RNA, 13 nt, Mycobacterium avium subsp. paratuberculosis
cucgaaggugccc

SEQ ID NO: 2943785 - RNA, 23 nt, Mycobacterium avium subsp. paratuberculosis
cucgaaggugcccgcaucgccga

SEQ ID NO: 2943786 - RNA, 19 nt, Mycobacterium avium subsp. paratuberculosis
cucgaaguagagccgcugc

SEQ ID NO: 2943787 - RNA, 14 nt, Mycobacterium avium subsp. paratuberculosis
cucgaagucgccgg

SEQ ID NO: 2943788 - RNA, 15 nt, Mycobacterium avium subsp. paratuberculosis
cucgaagucgccggc

SEQ ID NO: 2943789 - RNA, 23 nt, Mycobacterium avium subsp. paratuberculosis
cucgaaguggacaugcagccgcc

SEQ ID NO: 2943790 - RNA, 20 nt, Mycobacterium avium subsp. paratuberculosis
cucgaaguucuccucgccgu

SEQ ID NO: 2943791 - RNA, 21 nt, Mycobacterium avium subsp. paratuberculosis
cucgaaguucuccucgccgua

SEQ ID NO: 2943792 - RNA, 15 nt, Mycobacterium avium subsp. paratuberculosis
cucgaauccgcgggc

SEQ ID NO: 2943793 - RNA, 21 nt, Mycobacterium avium subsp. paratuberculosis
cucgaaugcggcugccggcca

SEQ ID NO: 2943794 - RNA, 23 nt, Mycobacterium avium subsp. paratuberculosis
cucgaaugcggcugccggccaag

SEQ ID NO: 2943795 - RNA, 17 nt, Mycobacterium avium subsp. paratuberculosis
cucgacacgggccgcgc

SEQ ID NO: 2943796 - RNA, 19 nt, Mycobacterium avium subsp. paratuberculosis
cucgacacgggccgcgccg

SEQ ID NO: 2943797 - RNA, 17 nt, Mycobacterium avium subsp. paratuberculosis
cucgacaggcagcccgg

SEQ ID NO: 2943798 - RNA, 19 nt, Mycobacterium avium subsp. paratuberculosis
cucgacaggcagcccggcu

SEQ ID NO: 2943799 - RNA, 20 nt, Mycobacterium avium subsp. paratuberculosis
cucgacaggcagcccggcug

SEQ ID NO: 2943800 - RNA, 23 nt, Mycobacterium avium subsp. paratuberculosis
cucgacaggcagcccggcugcgc

SEQ ID NO: 2943801 - RNA, 16 nt, Mycobacterium avium subsp. paratuberculosis
cucgacaucggccgcc

SEQ ID NO: 2943802 - RNA, 13 nt, Mycobacterium avium subsp. paratuberculosis
cucgaccacccgc

SEQ ID NO: 2943803 - RNA, 22 nt, Mycobacterium avium subsp. paratuberculosis
cucgaccaccucuucgcggucc

SEQ ID NO: 2943804 - RNA, 18 nt, Mycobacterium avium subsp. paratuberculosis
cucgaccacgcacaccac

SEQ ID NO: 2943805 - RNA, 20 nt, Mycobacterium avium subsp. paratuberculosis
cucgaccacgcacaccaccg

SEQ ID NO: 2943806 - RNA, 24 nt, Mycobacterium avium subsp. paratuberculosis
cucgaccacgcacaccaccgacgc

SEQ ID NO: 2943807 - RNA, 16 nt, Mycobacterium avium subsp. paratuberculosis
cucgaccagcaccgca

SEQ ID NO: 2943808 - RNA, 13 nt, Mycobacterium avium subsp. paratuberculosis
cucgaccagcccc

SEQ ID NO: 2943809 - RNA, 17 nt, Mycobacterium avium subsp. paratuberculosis
cucgaccagccgggucc

SEQ ID NO: 2943810 - RNA, 14 nt, Mycobacterium avium subsp. paratuberculosis
cucgaccagccggu

SEQ ID NO: 2943811 - RNA, 16 nt, Mycobacterium avium subsp. paratuberculosis
cucgaccagccggugg

SEQ ID NO: 2943812 - RNA, 17 nt, Mycobacterium avium subsp. paratuberculosis
cucgaccagccggugga

SEQ ID NO: 2943813 - RNA, 15 nt, Mycobacterium avium subsp. paratuberculosis
cucgaccagcgccga

SEQ ID NO: 2943814 - RNA, 16 nt, Mycobacterium avium subsp. paratuberculosis
cucgaccagcgccgag

SEQ ID NO: 2943815 - RNA, 17 nt, Mycobacterium avium subsp. paratuberculosis
cucgaccagcgccgaga

SEQ ID NO: 2943816 - RNA, 13 nt, Mycobacterium avium subsp. paratuberculosis
cucgaccagcgcg

SEQ ID NO: 2943817 - RNA, 14 nt, Mycobacterium avium subsp. paratuberculosis
cucgaccagcgcgc

SEQ ID NO: 2943818 - RNA, 15 nt, Mycobacterium avium subsp. paratuberculosis
cucgaccagcgcgcc

SEQ ID NO: 2943819 - RNA, 16 nt, Mycobacterium avium subsp. paratuberculosis
cucgaccagcgcgccg

SEQ ID NO: 2943820 - RNA, 20 nt, Mycobacterium avium subsp. paratuberculosis
cucgaccagcgcgccgccca

SEQ ID NO: 2943821 - RNA, 13 nt, Mycobacterium avium subsp. paratuberculosis
cucgaccaggccg

SEQ ID NO: 2943822 - RNA, 17 nt, Mycobacterium avium subsp. paratuberculosis
cucgaccccgaaggcgu

SEQ ID NO: 2943823 - RNA, 14 nt, Mycobacterium avium subsp. paratuberculosis
cucgacccgcaccu

SEQ ID NO: 2943824 - RNA, 18 nt, Mycobacterium avium subsp. paratuberculosis
cucgacccgcaccucgaa

SEQ ID NO: 2943825 - RNA, 13 nt, Mycobacterium avium subsp. paratuberculosis
cucgacccgggcc

SEQ ID NO: 2943826 - RNA, 14 nt, Mycobacterium avium subsp. paratuberculosis
cucgacccgggcca

SEQ ID NO: 2943827 - RNA, 13 nt, Mycobacterium avium subsp. paratuberculosis
cucgaccgcggcg

SEQ ID NO: 2943828 - RNA, 14 nt, Mycobacterium avium subsp. paratuberculosis
cucgaccgcggcga

SEQ ID NO: 2943829 - RNA, 15 nt, Mycobacterium avium subsp. paratuberculosis
cucgaccgcggcgau

SEQ ID NO: 2943830 - RNA, 16 nt, Mycobacterium avium subsp. paratuberculosis
cucgaccgcggcgccg

SEQ ID NO: 2943831 - RNA, 16 nt, Mycobacterium avium subsp. paratuberculosis
cucgaccgcgguggcg

SEQ ID NO: 2943832 - RNA, 14 nt, Mycobacterium avium subsp. paratuberculosis
cucgagcucaccga

SEQ ID NO: 2943833 - RNA, 21 nt, Mycobacterium avium subsp. paratuberculosis
cucgagcucaccgacaagggc

SEQ ID NO: 2943834 - RNA, 14 nt, Mycobacterium avium subsp. paratuberculosis
cucgagcucggcga

SEQ ID NO: 2943835 - RNA, 15 nt, Mycobacterium avium subsp. paratuberculosis
cucgagcucggcgag

SEQ ID NO: 2943836 - RNA, 13 nt, Mycobacterium avium subsp. paratuberculosis
cucgagcuggccg

SEQ ID NO: 2943837 - RNA, 17 nt, Mycobacterium avium subsp. paratuberculosis
cucgagcuuccgccgag

SEQ ID NO: 2943838 - RNA, 19 nt, Mycobacterium avium subsp. paratuberculosis
cucgagcuuccgccgaguc

SEQ ID NO: 2943839 - RNA, 17 nt, Mycobacterium avium subsp. paratuberculosis
cucgagcuugccgucgu

SEQ ID NO: 2943840 - RNA, 19 nt, Mycobacterium avium subsp. paratuberculosis
cucgaggaacuugcgccgg

SEQ ID NO: 2943841 - RNA, 16 nt, Mycobacterium avium subsp. paratuberculosis
cucgaggaucgcggcc

SEQ ID NO: 2943842 - RNA, 17 nt, Mycobacterium avium subsp. paratuberculosis
cucgaggaucgcggcca

SEQ ID NO: 2943843 - RNA, 12 nt, Mycobacterium avium subsp. paratuberculosis
cucgaggccccg

SEQ ID NO: 2943844 - RNA, 13 nt, Mycobacterium avium subsp. paratuberculosis
cucgaggccccgc

SEQ ID NO: 2943845 - RNA, 12 nt, Mycobacterium avium subsp. paratuberculosis
cucgaggccgac

SEQ ID NO: 2943846 - RNA, 16 nt, Mycobacterium avium subsp. paratuberculosis
cucgaggccgacgugc

SEQ ID NO: 2943847 - RNA, 13 nt, Mycobacterium avium subsp. paratuberculosis
cucgaggccgcgg

SEQ ID NO: 2943848 - RNA, 14 nt, Mycobacterium avium subsp. paratuberculosis
cucgaggccgcggg

SEQ ID NO: 2943849 - RNA, 18 nt, Mycobacterium avium subsp. paratuberculosis
cucgagggccuccaccac

SEQ ID NO: 2943850 - RNA, 14 nt, Mycobacterium avium subsp. paratuberculosis
cucgagggcggcga

SEQ ID NO: 2943851 - RNA, 15 nt, Mycobacterium avium subsp. paratuberculosis
cucgagggcggcgac

SEQ ID NO: 2943852 - RNA, 22 nt, Mycobacterium avium subsp. paratuberculosis
cucgaggggcuuggcgacgaag

SEQ ID NO: 2943853 - RNA, 17 nt, Mycobacterium avium subsp. paratuberculosis
cucgagugccggcagcc

SEQ ID NO: 2943854 - RNA, 19 nt, Mycobacterium avium subsp. paratuberculosis
cucgagugccugcgcccac

SEQ ID NO: 2943855 - RNA, 16 nt, Mycobacterium avium subsp. paratuberculosis
cucgaguggcgaacgg

SEQ ID NO: 2943856 - RNA, 17 nt, Mycobacterium avium subsp. paratuberculosis
cucgaguuuggccagcu

SEQ ID NO: 2943857 - RNA, 18 nt, Mycobacterium avium subsp. paratuberculosis
cucgauaauggcggccgc

SEQ ID NO: 2943858 - RNA, 19 nt, Mycobacterium avium subsp. paratuberculosis
cucgauaauggcggccgcc

SEQ ID NO: 2943859 - RNA, 18 nt, Mycobacterium avium subsp. paratuberculosis
cucgaucaacgccggguc

SEQ ID NO: 2943860 - RNA, 12 nt, Mycobacterium avium subsp. paratuberculosis
cucgaucaccga

SEQ ID NO: 2943861 - RNA, 19 nt, Mycobacterium avium subsp. paratuberculosis
cucgaucaccgggcggccg

SEQ ID NO: 2943862 - RNA, 19 nt, Mycobacterium avium subsp. paratuberculosis
cucgaucagagcgggccga

SEQ ID NO: 2943863 - RNA, 23 nt, Mycobacterium avium subsp. paratuberculosis
cucgaucagagcgggccgaccgu

SEQ ID NO: 2943864 - RNA, 16 nt, Mycobacterium avium subsp. paratuberculosis
cucgaucagcaccgcc

SEQ ID NO: 2943865 - RNA, 19 nt, Mycobacterium avium subsp. paratuberculosis
cucgaucagccacaccgcc

SEQ ID NO: 2943866 - RNA, 20 nt, Mycobacterium avium subsp. paratuberculosis
cucgaucagccacaccgccg

SEQ ID NO: 2943867 - RNA, 22 nt, Mycobacterium avium subsp. paratuberculosis
cucgaucagccacaccgccggc

SEQ ID NO: 2943868 - RNA, 19 nt, Mycobacterium avium subsp. paratuberculosis
cucgaucaucaccaccgcc

SEQ ID NO: 2943869 - RNA, 20 nt, Mycobacterium avium subsp. paratuberculosis
cucgauccgguccagcccgg

SEQ ID NO: 2943870 - RNA, 17 nt, Mycobacterium avium subsp. paratuberculosis
cucgaucgacgacgcca

SEQ ID NO: 2943871 - RNA, 19 nt, Mycobacterium avium subsp. paratuberculosis
cucgaucgacgacgccagc

SEQ ID NO: 2943872 - RNA, 14 nt, Mycobacterium avium subsp. paratuberculosis
cucgaucgccaccg

SEQ ID NO: 2943873 - RNA, 16 nt, Mycobacterium avium subsp. paratuberculosis
cucgaucgccaccgag

SEQ ID NO: 2943874 - RNA, 14 nt, Mycobacterium avium subsp. paratuberculosis
cucgaucgccgcgc

SEQ ID NO: 2943875 - RNA, 17 nt, Mycobacterium avium subsp. paratuberculosis
cucgaucgccgcgccca

SEQ ID NO: 2943876 - RNA, 21 nt, Mycobacterium avium subsp. paratuberculosis
cucgaucgccgcgcccagcac

SEQ ID NO: 2943877 - RNA, 22 nt, Mycobacterium avium subsp. paratuberculosis
cucgaucgccgcgcccagcacg

SEQ ID NO: 2943878 - RNA, 22 nt, Mycobacterium avium subsp. paratuberculosis
cucgaucgcguucugcaccagc

SEQ ID NO: 2943879 - RNA, 14 nt, Mycobacterium avium subsp. paratuberculosis
cucgaucggcgcgc

SEQ ID NO: 2943880 - RNA, 16 nt, Mycobacterium avium subsp. paratuberculosis
cucgaucggcgcgccg

SEQ ID NO: 2943881 - RNA, 20 nt, Mycobacterium avium subsp. paratuberculosis
cucgaucggggaauccuggc

SEQ ID NO: 2943882 - RNA, 23 nt, Mycobacterium avium subsp. paratuberculosis
cucgaucggggaauccuggccga

SEQ ID NO: 2943883 - RNA, 23 nt, Mycobacterium avium subsp. paratuberculosis
cucgaucgucaggaaugcgacga

SEQ ID NO: 2943884 - RNA, 21 nt, Mycobacterium avium subsp. paratuberculosis
cucgaucguccgaggccccgc

SEQ ID NO: 2943885 - RNA, 23 nt, Mycobacterium avium subsp. paratuberculosis
cucgaucgugggcaacacgucgu

SEQ ID NO: 2943886 - RNA, 17 nt, Mycobacterium avium subsp. paratuberculosis
cucgaucugcagccggc

SEQ ID NO: 2943887 - RNA, 14 nt, Mycobacterium avium subsp. paratuberculosis
cucgaucuggcgga

SEQ ID NO: 2943888 - RNA, 22 nt, Mycobacterium avium subsp. paratuberculosis
cucgaucuggcggacccgcucc

SEQ ID NO: 2943889 - RNA, 19 nt, Mycobacterium avium subsp. paratuberculosis
cucgaucugggccaggauc

SEQ ID NO: 2943890 - RNA, 20 nt, Mycobacterium avium subsp. paratuberculosis
cucgaucugguucaccgcca

SEQ ID NO: 2943891 - RNA, 23 nt, Mycobacterium avium subsp. paratuberculosis
cucgaucugguucaccgccacca

SEQ ID NO: 2943892 - RNA, 19 nt, Mycobacterium avium subsp. paratuberculosis
cucgaucuugugcucgagc

SEQ ID NO: 2943893 - RNA, 23 nt, Mycobacterium avium subsp. paratuberculosis
cucgaugacccaccagccgagau

SEQ ID NO: 2943894 - RNA, 13 nt, Mycobacterium avium subsp. paratuberculosis
cucgaugaccucg

SEQ ID NO: 2943895 - RNA, 21 nt, Mycobacterium avium subsp. paratuberculosis
cucgaugacgccggacagcug

SEQ ID NO: 2943896 - RNA, 21 nt, Mycobacterium avium subsp. paratuberculosis
cucgaugcacggucggccccg

SEQ ID NO: 2943897 - RNA, 14 nt, Mycobacterium avium subsp. paratuberculosis
cucgaugcauucgu

SEQ ID NO: 2943898 - RNA, 14 nt, Mycobacterium avium subsp. paratuberculosis
cucgaugccgaccg

SEQ ID NO: 2943899 - RNA, 16 nt, Mycobacterium avium subsp. paratuberculosis
cucgaugccgaccgac

SEQ ID NO: 2943900 - RNA, 19 nt, Mycobacterium avium subsp. paratuberculosis
cucgaugccgaccgacagc

SEQ ID NO: 2943901 - RNA, 22 nt, Mycobacterium avium subsp. paratuberculosis
cucgaugccgaccgacagccgc

SEQ ID NO: 2943902 - RNA, 16 nt, Mycobacterium avium subsp. paratuberculosis
cucgaugccgugccgg

SEQ ID NO: 2943903 - RNA, 20 nt, Mycobacterium avium subsp. paratuberculosis
cucgaugccgugccggugga

SEQ ID NO: 2943904 - RNA, 19 nt, Mycobacterium avium subsp. paratuberculosis
cucgaugccguucgcgccg

SEQ ID NO: 2943905 - RNA, 21 nt, Mycobacterium avium subsp. paratuberculosis
cucgaugcgacgcaccucggc

SEQ ID NO: 2943906 - RNA, 22 nt, Mycobacterium avium subsp. paratuberculosis
cucgaugcgcaccgugccgccc

SEQ ID NO: 2943907 - RNA, 14 nt, Mycobacterium avium subsp. paratuberculosis
cucgaugcgcgcca

SEQ ID NO: 2943908 - RNA, 19 nt, Mycobacterium avium subsp. paratuberculosis
cucgaugcgcgccagcagc

SEQ ID NO: 2943909 - RNA, 23 nt, Mycobacterium avium subsp. paratuberculosis
cucgaugcgcgccagcagcgcgc

SEQ ID NO: 2943910 - RNA, 20 nt, Mycobacterium avium subsp. paratuberculosis
cucgaugcggcccugguuga

SEQ ID NO: 2943911 - RNA, 13 nt, Mycobacterium avium subsp. paratuberculosis
cucgaugcggccg

SEQ ID NO: 2943912 - RNA, 22 nt, Mycobacterium avium subsp. paratuberculosis
cucgauggaccggguggugggc

SEQ ID NO: 2943913 - RNA, 16 nt, Mycobacterium avium subsp. paratuberculosis
cucgauggacgccagc

SEQ ID NO: 2943914 - RNA, 16 nt, Mycobacterium avium subsp. paratuberculosis
cucgauggccacgcuc

SEQ ID NO: 2943915 - RNA, 14 nt, Mycobacterium avium subsp. paratuberculosis
cucgauggccagcg

SEQ ID NO: 2943916 - RNA, 13 nt, Mycobacterium avium subsp. paratuberculosis
cucgccgccgacg

SEQ ID NO: 2943917 - RNA, 14 nt, Mycobacterium avium subsp. paratuberculosis
cucgccgccgacga

SEQ ID NO: 2943918 - RNA, 19 nt, Mycobacterium avium subsp. paratuberculosis
cucgccgcgaacgacgacc

SEQ ID NO: 2943919 - RNA, 23 nt, Mycobacterium avium subsp. paratuberculosis
cucgccgcgcaucaucgcccagc

SEQ ID NO: 2943920 - RNA, 15 nt, Mycobacterium avium subsp. paratuberculosis
cucgccgcgccagca

SEQ ID NO: 2943921 - RNA, 14 nt, Mycobacterium avium subsp. paratuberculosis
cucgccgcgcggcc

SEQ ID NO: 2943922 - RNA, 13 nt, Mycobacterium avium subsp. paratuberculosis
cucgccgcggcca

SEQ ID NO: 2943923 - RNA, 14 nt, Mycobacterium avium subsp. paratuberculosis
cucgccgcggccac

SEQ ID NO: 2943924 - RNA, 16 nt, Mycobacterium avium subsp. paratuberculosis
cucgccgcggccacgc

SEQ ID NO: 2943925 - RNA, 20 nt, Mycobacterium avium subsp. paratuberculosis
cucgccgcggccacgcucgg

SEQ ID NO: 2943926 - RNA, 21 nt, Mycobacterium avium subsp. paratuberculosis
cucgccgcggccacgcucggg

SEQ ID NO: 2943927 - RNA, 11 nt, Mycobacterium avium subsp. paratuberculosis
cucgccgcggg

SEQ ID NO: 2943928 - RNA, 14 nt, Mycobacterium avium subsp. paratuberculosis
cucgccgcgggcca

SEQ ID NO: 2943929 - RNA, 17 nt, Mycobacterium avium subsp. paratuberculosis
cucgccgcgggccagcc

SEQ ID NO: 2943930 - RNA, 13 nt, Mycobacterium avium subsp. paratuberculosis
cucgccgcgggug

SEQ ID NO: 2943931 - RNA, 17 nt, Mycobacterium avium subsp. paratuberculosis
cucgccgcggucaucga

SEQ ID NO: 2943932 - RNA, 13 nt, Mycobacterium avium subsp. paratuberculosis
cucgccgcggugg

SEQ ID NO: 2943933 - RNA, 14 nt, Mycobacterium avium subsp. paratuberculosis
cucgccgcgguggu

SEQ ID NO: 2943934 - RNA, 18 nt, Mycobacterium avium subsp. paratuberculosis
cucgccgcgguggugggc

SEQ ID NO: 2943935 - RNA, 15 nt, Mycobacterium avium subsp. paratuberculosis
cucgccgcguacgcc

SEQ ID NO: 2943936 - RNA, 15 nt, Mycobacterium avium subsp. paratuberculosis
cucgccgcugucguc

SEQ ID NO: 2943937 - RNA, 16 nt, Mycobacterium avium subsp. paratuberculosis
cucgccgcugucgucg

SEQ ID NO: 2943938 - RNA, 17 nt, Mycobacterium avium subsp. paratuberculosis
cucgccggagagcccgu

SEQ ID NO: 2943939 - RNA, 17 nt, Mycobacterium avium subsp. paratuberculosis
cucgccggagcgcccca

SEQ ID NO: 2943940 - RNA, 22 nt, Mycobacterium avium subsp. paratuberculosis
cucgccggagcgccccagggcc

SEQ ID NO: 2943941 - RNA, 14 nt, Mycobacterium avium subsp. paratuberculosis
cucgccggcccgac

SEQ ID NO: 2943942 - RNA, 22 nt, Mycobacterium avium subsp. paratuberculosis
cucgccggccgccguggcccac

SEQ ID NO: 2943943 - RNA, 14 nt, Mycobacterium avium subsp. paratuberculosis
cucgccggccgcgg

SEQ ID NO: 2943944 - RNA, 15 nt, Mycobacterium avium subsp. paratuberculosis
cucgccggccgggcg

SEQ ID NO: 2943945 - RNA, 16 nt, Mycobacterium avium subsp. paratuberculosis
cucgccggcgccgggc

SEQ ID NO: 2943946 - RNA, 18 nt, Mycobacterium avium subsp. paratuberculosis
cucgccggcgccgggcgg

SEQ ID NO: 2943947 - RNA, 12 nt, Mycobacterium avium subsp. paratuberculosis
cucgccggcgcg

SEQ ID NO: 2943948 - RNA, 15 nt, Mycobacterium avium subsp. paratuberculosis
cucgccggcgcgcac

SEQ ID NO: 2943949 - RNA, 16 nt, Mycobacterium avium subsp. paratuberculosis
cucgccggcgcgcagc

SEQ ID NO: 2943950 - RNA, 13 nt, Mycobacterium avium subsp. paratuberculosis
cucgccggcgcgg

SEQ ID NO: 2943951 - RNA, 12 nt, Mycobacterium avium subsp. paratuberculosis
cucgccggcggc

SEQ ID NO: 2943952 - RNA, 16 nt, Mycobacterium avium subsp. paratuberculosis
cucgccggcggccgcc

SEQ ID NO: 2943953 - RNA, 17 nt, Mycobacterium avium subsp. paratuberculosis
cucgccggcggccgcca

SEQ ID NO: 2943954 - RNA, 20 nt, Mycobacterium avium subsp. paratuberculosis
cucgccggcggccgccacgc

SEQ ID NO: 2943955 - RNA, 13 nt, Mycobacterium avium subsp. paratuberculosis
cucgccggcggcg

SEQ ID NO: 2943956 - RNA, 14 nt, Mycobacterium avium subsp. paratuberculosis
cucgccggcggcgc

SEQ ID NO: 2943957 - RNA, 17 nt, Mycobacterium avium subsp. paratuberculosis
cucgccggcggcgccgg

SEQ ID NO: 2943958 - RNA, 18 nt, Mycobacterium avium subsp. paratuberculosis
cucgccggcgucuugauc

SEQ ID NO: 2943959 - RNA, 13 nt, Mycobacterium avium subsp. paratuberculosis
cucgccgggcccg

SEQ ID NO: 2943960 - RNA, 14 nt, Mycobacterium avium subsp. paratuberculosis
cucgccgggcccgc

SEQ ID NO: 2943961 - RNA, 18 nt, Mycobacterium avium subsp. paratuberculosis
cucgccgggcccgcucac

SEQ ID NO: 2943962 - RNA, 20 nt, Mycobacterium avium subsp. paratuberculosis
cucgccgggcccgcucaccu

SEQ ID NO: 2943963 - RNA, 20 nt, Mycobacterium avium subsp. paratuberculosis
cucgccggggaacaccggcg

SEQ ID NO: 2943964 - RNA, 22 nt, Mycobacterium avium subsp. paratuberculosis
cucgccggggacgacggcgggg

SEQ ID NO: 2943965 - RNA, 16 nt, Mycobacterium avium subsp. paratuberculosis
cucgccggucagcgca

SEQ ID NO: 2943966 - RNA, 20 nt, Mycobacterium avium subsp. paratuberculosis
cucgccggucagcgcauccu

SEQ ID NO: 2943967 - RNA, 16 nt, Mycobacterium avium subsp. paratuberculosis
cucgccgguggcggcg

SEQ ID NO: 2943968 - RNA, 23 nt, Mycobacterium avium subsp. paratuberculosis
cucgccgguggcggcgacaucga

SEQ ID NO: 2943969 - RNA, 18 nt, Mycobacterium avium subsp. paratuberculosis
cucgccguacgcgccggc

SEQ ID NO: 2943970 - RNA, 21 nt, Mycobacterium avium subsp. paratuberculosis
cucgccguacgcgccggccag

SEQ ID NO: 2943971 - RNA, 23 nt, Mycobacterium avium subsp. paratuberculosis
cucgccguacgcgccggccagcc

SEQ ID NO: 2943972 - RNA, 19 nt, Mycobacterium avium subsp. paratuberculosis
cucgccguacuugacgugc

SEQ ID NO: 2943973 - RNA, 21 nt, Mycobacterium avium subsp. paratuberculosis
cucgccguagaauccgccguu

SEQ ID NO: 2943974 - RNA, 14 nt, Mycobacterium avium subsp. paratuberculosis
cucgccguccccac

SEQ ID NO: 2943975 - RNA, 17 nt, Mycobacterium avium subsp. paratuberculosis
cucgccgucgaaggccg

SEQ ID NO: 2943976 - RNA, 20 nt, Mycobacterium avium subsp. paratuberculosis
cucgccgucgaaggccgggc

SEQ ID NO: 2943977 - RNA, 13 nt, Mycobacterium avium subsp. paratuberculosis
cucgccgucgcga

SEQ ID NO: 2943978 - RNA, 17 nt, Mycobacterium avium subsp. paratuberculosis
cucgccgugcagcaccu

SEQ ID NO: 2943979 - RNA, 14 nt, Mycobacterium avium subsp. paratuberculosis
cucgccguugcggg

SEQ ID NO: 2943980 - RNA, 23 nt, Mycobacterium avium subsp. paratuberculosis
cucgccguugcgggucggcguca

SEQ ID NO: 2943981 - RNA, 20 nt, Mycobacterium avium subsp. paratuberculosis
cucgccguuuugccgccgag

SEQ ID NO: 2943982 - RNA, 17 nt, Mycobacterium avium subsp. paratuberculosis
cucgccuacacagcccc

SEQ ID NO: 2943983 - RNA, 13 nt, Mycobacterium avium subsp. paratuberculosis
cucgccuccagca

SEQ ID NO: 2943984 - RNA, 19 nt, Mycobacterium avium subsp. paratuberculosis
cucgccucggggaucgcca

SEQ ID NO: 2943985 - RNA, 17 nt, Mycobacterium avium subsp. paratuberculosis
cucgccugcgagcguga

SEQ ID NO: 2943986 - RNA, 12 nt, Mycobacterium avium subsp. paratuberculosis
cucgccuuugau

SEQ ID NO: 2943987 - RNA, 16 nt, Mycobacterium avium subsp. paratuberculosis
cucgcgaagaucggag

SEQ ID NO: 2943988 - RNA, 19 nt, Mycobacterium avium subsp. paratuberculosis
cucgcgaagaucggagccg

SEQ ID NO: 2943989 - RNA, 12 nt, Mycobacterium avium subsp. paratuberculosis
cucgcgacgcgg

SEQ ID NO: 2943990 - RNA, 21 nt, Mycobacterium avium subsp. paratuberculosis
cucgcgacgcggcucgcgcgg

SEQ ID NO: 2943991 - RNA, 14 nt, Mycobacterium avium subsp. paratuberculosis
cucgcgaggccgcc

SEQ ID NO: 2943992 - RNA, 15 nt, Mycobacterium avium subsp. paratuberculosis
cucgcgaggccgcca

SEQ ID NO: 2943993 - RNA, 22 nt, Mycobacterium avium subsp. paratuberculosis
cucgcgagggcgggccagcucg

SEQ ID NO: 2943994 - RNA, 12 nt, Mycobacterium avium subsp. paratuberculosis
cucgcgauggcg

SEQ ID NO: 2943995 - RNA, 17 nt, Mycobacterium avium subsp. paratuberculosis
cucgcgcaacugggugg

SEQ ID NO: 2943996 - RNA, 22 nt, Mycobacterium avium subsp. paratuberculosis
cucgcgcaauaacggagcggcc

SEQ ID NO: 2943997 - RNA, 18 nt, Mycobacterium avium subsp. paratuberculosis
cucgcgcaaugccgccgc

SEQ ID NO: 2943998 - RNA, 13 nt, Mycobacterium avium subsp. paratuberculosis
cucgcgcacccgu

SEQ ID NO: 2943999 - RNA, 16 nt, Mycobacterium avium subsp. paratuberculosis
cucgcgcaccgcgggc

SEQ ID NO: 2944000 - RNA, 18 nt, Mycobacterium avium subsp. paratuberculosis
cucgcgcaccgcgggcuc

SEQ ID NO: 2944001 - RNA, 17 nt, Mycobacterium avium subsp. paratuberculosis
cucgcgguugcgggugg

SEQ ID NO: 2944002 - RNA, 23 nt, Mycobacterium avium subsp. paratuberculosis
cucgcgguugcggguggcggccg

SEQ ID NO: 2944003 - RNA, 17 nt, Mycobacterium avium subsp. paratuberculosis
cucgcgguugggccgcc

SEQ ID NO: 2944004 - RNA, 18 nt, Mycobacterium avium subsp. paratuberculosis
cucgcgguugggccgccg

SEQ ID NO: 2944005 - RNA, 18 nt, Mycobacterium avium subsp. paratuberculosis
cucgcgguugggccggcg

SEQ ID NO: 2944006 - RNA, 22 nt, Mycobacterium avium subsp. paratuberculosis
cucgcguagcgaggugugagga

SEQ ID NO: 2944007 - RNA, 13 nt, Mycobacterium avium subsp. paratuberculosis
cucgcguccccgc

SEQ ID NO: 2944008 - RNA, 16 nt, Mycobacterium avium subsp. paratuberculosis
cucgcgucgacgucgg

SEQ ID NO: 2944009 - RNA, 22 nt, Mycobacterium avium subsp. paratuberculosis
cucgcgucgacgucgggcacgg

SEQ ID NO: 2944010 - RNA, 15 nt, Mycobacterium avium subsp. paratuberculosis
cucgcgucgcgcggu

SEQ ID NO: 2944011 - RNA, 17 nt, Mycobacterium avium subsp. paratuberculosis
cucgcguggccugggcg

SEQ ID NO: 2944012 - RNA, 21 nt, Mycobacterium avium subsp. paratuberculosis
cucgcguggccugggcgacca

SEQ ID NO: 2944013 - RNA, 22 nt, Mycobacterium avium subsp. paratuberculosis
cucgcguucgcuuucgccgggc

SEQ ID NO: 2944014 - RNA, 22 nt, Mycobacterium avium subsp. paratuberculosis
cucgcguucgggcccggccgcc

SEQ ID NO: 2944015 - RNA, 16 nt, Mycobacterium avium subsp. paratuberculosis
cucgcuaaucgccgcg

SEQ ID NO: 2944016 - RNA, 19 nt, Mycobacterium avium subsp. paratuberculosis
cucgcuaaucgccgcgcgu

SEQ ID NO: 2944017 - RNA, 21 nt, Mycobacterium avium subsp. paratuberculosis
cucgcuacgcgagcugcuucg

SEQ ID NO: 2944018 - RNA, 22 nt, Mycobacterium avium subsp. paratuberculosis
cucgcuauaucgcaccggcgcc

SEQ ID NO: 2944019 - RNA, 22 nt, Mycobacterium avium subsp. paratuberculosis
cucgcucaacccgucgcggguc

SEQ ID NO: 2944020 - RNA, 16 nt, Mycobacterium avium subsp. paratuberculosis
cucgcucccgcgcggg

SEQ ID NO: 2944021 - RNA, 17 nt, Mycobacterium avium subsp. paratuberculosis
cucgcucccgcgcgggc

SEQ ID NO: 2944022 - RNA, 16 nt, Mycobacterium avium subsp. paratuberculosis
cucgcucugccgggcc

SEQ ID NO: 2944023 - RNA, 20 nt, Mycobacterium avium subsp. paratuberculosis
cucgcucugccgggccgcau

SEQ ID NO: 2944024 - RNA, 24 nt, Mycobacterium avium subsp. paratuberculosis
cucgcugacgucgaugccggccag

SEQ ID NO: 2944025 - RNA, 18 nt, Mycobacterium avium subsp. paratuberculosis
cucgcugagcgggacgcg

SEQ ID NO: 2944026 - RNA, 17 nt, Mycobacterium avium subsp. paratuberculosis
cucgcugaucucgacgg

SEQ ID NO: 2944027 - RNA, 20 nt, Mycobacterium avium subsp. paratuberculosis
cucgcugaucucgacggugg

SEQ ID NO: 2944028 - RNA, 14 nt, Mycobacterium avium subsp. paratuberculosis
cucgcugccgcccc

SEQ ID NO: 2944029 - RNA, 14 nt, Mycobacterium avium subsp. paratuberculosis
cucgcugccggccg

SEQ ID NO: 2944030 - RNA, 15 nt, Mycobacterium avium subsp. paratuberculosis
cucgcugcgcgagga

SEQ ID NO: 2944031 - RNA, 18 nt, Mycobacterium avium subsp. paratuberculosis
cucgcugcucugcgcgcg

SEQ ID NO: 2944032 - RNA, 19 nt, Mycobacterium avium subsp. paratuberculosis
cucgcuggcgaucaccuug

SEQ ID NO: 2944033 - RNA, 14 nt, Mycobacterium avium subsp. paratuberculosis
cucgcuggcggcgc

SEQ ID NO: 2944034 - RNA, 19 nt, Mycobacterium avium subsp. paratuberculosis
cucgcuugccagccgggcc

SEQ ID NO: 2944035 - RNA, 21 nt, Mycobacterium avium subsp. paratuberculosis
cucgcuugccagccgggccga

SEQ ID NO: 2944036 - RNA, 19 nt, Mycobacterium avium subsp. paratuberculosis
cucggaaugaacugccgcg

SEQ ID NO: 2944037 - RNA, 22 nt, Mycobacterium avium subsp. paratuberculosis
cucggaaugaacugccgcggca

SEQ ID NO: 2944038 - RNA, 23 nt, Mycobacterium avium subsp. paratuberculosis
cucggaaugaacugccgcggcac

SEQ ID NO: 2944039 - RNA, 20 nt, Mycobacterium avium subsp. paratuberculosis
cucggacagguggccgauca

SEQ ID NO: 2944040 - RNA, 21 nt, Mycobacterium avium subsp. paratuberculosis
cucggaccgguaggcgcaccg

SEQ ID NO: 2944041 - RNA, 22 nt, Mycobacterium avium subsp. paratuberculosis
cucggaccgguaggcgcaccgc

SEQ ID NO: 2944042 - RNA, 22 nt, Mycobacterium avium subsp. paratuberculosis
cucggacgacucguucgacgcc

SEQ ID NO: 2944043 - RNA, 23 nt, Mycobacterium avium subsp. paratuberculosis
cucggacgacucguucgacgccg

SEQ ID NO: 2944044 - RNA, 13 nt, Mycobacterium avium subsp. paratuberculosis
cucggacgcccgu

SEQ ID NO: 2944045 - RNA, 19 nt, Mycobacterium avium subsp. paratuberculosis
cucggacgcccgucgcgca

SEQ ID NO: 2944046 - RNA, 22 nt, Mycobacterium avium subsp. paratuberculosis
cucggagaugauggccgcgccg

SEQ ID NO: 2944047 - RNA, 23 nt, Mycobacterium avium subsp. paratuberculosis
cucggagaugauggccgcgccgc

SEQ ID NO: 2944048 - RNA, 16 nt, Mycobacterium avium subsp. paratuberculosis
cucggagcggugucgc

SEQ ID NO: 2944049 - RNA, 17 nt, Mycobacterium avium subsp. paratuberculosis
cucggaggaaccgugcg

SEQ ID NO: 2944050 - RNA, 23 nt, Mycobacterium avium subsp. paratuberculosis
cucggaggccaccgcgccgucuu

SEQ ID NO: 2944051 - RNA, 14 nt, Mycobacterium avium subsp. paratuberculosis
cucggaggugccgc

SEQ ID NO: 2944052 - RNA, 16 nt, Mycobacterium avium subsp. paratuberculosis
cucggaggugccgcgc

SEQ ID NO: 2944053 - RNA, 20 nt, Mycobacterium avium subsp. paratuberculosis
cucggaguaguccagcaccg

SEQ ID NO: 2944054 - RNA, 21 nt, Mycobacterium avium subsp. paratuberculosis
cucggaguaguccagcaccgc

SEQ ID NO: 2944055 - RNA, 22 nt, Mycobacterium avium subsp. paratuberculosis
cucggaguaguccagcaccgcc

SEQ ID NO: 2944056 - RNA, 15 nt, Mycobacterium avium subsp. paratuberculosis
cucggaguaguuccg

SEQ ID NO: 2944057 - RNA, 19 nt, Mycobacterium avium subsp. paratuberculosis
cucggaguaguuccggcgg

SEQ ID NO: 2944058 - RNA, 20 nt, Mycobacterium avium subsp. paratuberculosis
cucggaguaguuccggcggu

SEQ ID NO: 2944059 - RNA, 22 nt, Mycobacterium avium subsp. paratuberculosis
cucggaguugcgcagccgggcg

SEQ ID NO: 2944060 - RNA, 18 nt, Mycobacterium avium subsp. paratuberculosis
cucggaucccggggcgcg

SEQ ID NO: 2944061 - RNA, 19 nt, Mycobacterium avium subsp. paratuberculosis
cucggaucccggggcgcgc

SEQ ID NO: 2944062 - RNA, 20 nt, Mycobacterium avium subsp. paratuberculosis
cucggcaccagagcgccgga

SEQ ID NO: 2944063 - RNA, 16 nt, Mycobacterium avium subsp. paratuberculosis
cucggcaccgugccgc

SEQ ID NO: 2944064 - RNA, 20 nt, Mycobacterium avium subsp. paratuberculosis
cucggcaccgugccgcgcgg

SEQ ID NO: 2944065 - RNA, 21 nt, Mycobacterium avium subsp. paratuberculosis
cucggcaccgugccgcgcggc

SEQ ID NO: 2944066 - RNA, 12 nt, Mycobacterium avium subsp. paratuberculosis
cucggcagcccc

SEQ ID NO: 2944067 - RNA, 16 nt, Mycobacterium avium subsp. paratuberculosis
cucggcagccccgucg

SEQ ID NO: 2944068 - RNA, 13 nt, Mycobacterium avium subsp. paratuberculosis
cucggcagccggc

SEQ ID NO: 2944069 - RNA, 22 nt, Mycobacterium avium subsp. paratuberculosis
cucggcaggcggggaaggacuc

SEQ ID NO: 2944070 - RNA, 18 nt, Mycobacterium avium subsp. paratuberculosis
cucggcauaacgcaaccg

SEQ ID NO: 2944071 - RNA, 20 nt, Mycobacterium avium subsp. paratuberculosis
cucggcauaacgcaaccggu

SEQ ID NO: 2944072 - RNA, 13 nt, Mycobacterium avium subsp. paratuberculosis
cucggccaccacc

SEQ ID NO: 2944073 - RNA, 16 nt, Mycobacterium avium subsp. paratuberculosis
cucggccaccaccucg

SEQ ID NO: 2944074 - RNA, 21 nt, Mycobacterium avium subsp. paratuberculosis
cucggccaccagaugccgggc

SEQ ID NO: 2944075 - RNA, 16 nt, Mycobacterium avium subsp. paratuberculosis
cucggccaccagcgcc

SEQ ID NO: 2944076 - RNA, 19 nt, Mycobacterium avium subsp. paratuberculosis
cucggccaccaugucggcg

SEQ ID NO: 2944077 - RNA, 22 nt, Mycobacterium avium subsp. paratuberculosis
cucggccaccaugucggcgucg

SEQ ID NO: 2944078 - RNA, 14 nt, Mycobacterium avium subsp. paratuberculosis
cucggccaccgcgc

SEQ ID NO: 2944079 - RNA, 17 nt, Mycobacterium avium subsp. paratuberculosis
cucggccaccgcgcggu

SEQ ID NO: 2944080 - RNA, 19 nt, Mycobacterium avium subsp. paratuberculosis
cucggccaccgcgcggugc

SEQ ID NO: 2944081 - RNA, 15 nt, Mycobacterium avium subsp. paratuberculosis
cucggccaccuugcg

SEQ ID NO: 2944082 - RNA, 23 nt, Mycobacterium avium subsp. paratuberculosis
cucggccaccuugcgcgggucgc

SEQ ID NO: 2944083 - RNA, 19 nt, Mycobacterium avium subsp. paratuberculosis
cucggccacgacgcgccac

SEQ ID NO: 2944084 - RNA, 20 nt, Mycobacterium avium subsp. paratuberculosis
cucggccagcaccagcagcc

SEQ ID NO: 2944085 - RNA, 19 nt, Mycobacterium avium subsp. paratuberculosis
cucggcggacucggcgaag

SEQ ID NO: 2944086 - RNA, 14 nt, Mycobacterium avium subsp. paratuberculosis
cucggcggcaccgc

SEQ ID NO: 2944087 - RNA, 15 nt, Mycobacterium avium subsp. paratuberculosis
cucggcggcaccgcc

SEQ ID NO: 2944088 - RNA, 14 nt, Mycobacterium avium subsp. paratuberculosis
cucggcggccccuu

SEQ ID NO: 2944089 - RNA, 13 nt, Mycobacterium avium subsp. paratuberculosis
cucggcggcccgc

SEQ ID NO: 2944090 - RNA, 14 nt, Mycobacterium avium subsp. paratuberculosis
cucggcggccgagc

SEQ ID NO: 2944091 - RNA, 20 nt, Mycobacterium avium subsp. paratuberculosis
cucggcggccgagcgcaccg

SEQ ID NO: 2944092 - RNA, 22 nt, Mycobacterium avium subsp. paratuberculosis
cucggcggccgagcgcaccgcg

SEQ ID NO: 2944093 - RNA, 12 nt, Mycobacterium avium subsp. paratuberculosis
cucggcggccgc

SEQ ID NO: 2944094 - RNA, 13 nt, Mycobacterium avium subsp. paratuberculosis
cucggcggccgcc

SEQ ID NO: 2944095 - RNA, 23 nt, Mycobacterium avium subsp. paratuberculosis
cucggcggccgccuuggugaucc

SEQ ID NO: 2944096 - RNA, 15 nt, Mycobacterium avium subsp. paratuberculosis
cucggcggccgcguc

SEQ ID NO: 2944097 - RNA, 15 nt, Mycobacterium avium subsp. paratuberculosis
cucggcggccgggau

SEQ ID NO: 2944098 - RNA, 18 nt, Mycobacterium avium subsp. paratuberculosis
cucggcggccgggaugcc

SEQ ID NO: 2944099 - RNA, 14 nt, Mycobacterium avium subsp. paratuberculosis
cucggcggccgggu

SEQ ID NO: 2944100 - RNA, 19 nt, Mycobacterium avium subsp. paratuberculosis
cucggcggccgucggaucg

SEQ ID NO: 2944101 - RNA, 15 nt, Mycobacterium avium subsp. paratuberculosis
cucggcggccucgcc

SEQ ID NO: 2944102 - RNA, 16 nt, Mycobacterium avium subsp. paratuberculosis
cucggcggccugcuuc

SEQ ID NO: 2944103 - RNA, 13 nt, Mycobacterium avium subsp. paratuberculosis
cucggcggcgcag

SEQ ID NO: 2944104 - RNA, 17 nt, Mycobacterium avium subsp. paratuberculosis
cucggcggcgcccagga

SEQ ID NO: 2944105 - RNA, 16 nt, Mycobacterium avium subsp. paratuberculosis
cucggcggcgccgucg

SEQ ID NO: 2944106 - RNA, 13 nt, Mycobacterium avium subsp. paratuberculosis
cucggcggcgcgc

SEQ ID NO: 2944107 - RNA, 15 nt, Mycobacterium avium subsp. paratuberculosis
cucggcggcgcgcag

SEQ ID NO: 2944108 - RNA, 24 nt, Mycobacterium avium subsp. paratuberculosis
cucggcggcgcgcaggcgcgcggc

SEQ ID NO: 2944109 - RNA, 14 nt, Mycobacterium avium subsp. paratuberculosis
cucggcggcggcgc

SEQ ID NO: 2944110 - RNA, 17 nt, Mycobacterium avium subsp. paratuberculosis
cucggcggcggcgcgcc

SEQ ID NO: 2944111 - RNA, 18 nt, Mycobacterium avium subsp. paratuberculosis
cucggcggcggcgcgccg

SEQ ID NO: 2944112 - RNA, 20 nt, Mycobacterium avium subsp. paratuberculosis
cucggcggcggcgcgccggc

SEQ ID NO: 2944113 - RNA, 13 nt, Mycobacterium avium subsp. paratuberculosis
cucggcggcgggc

SEQ ID NO: 2944114 - RNA, 15 nt, Mycobacterium avium subsp. paratuberculosis
cucggcggcgggcag

SEQ ID NO: 2944115 - RNA, 18 nt, Mycobacterium avium subsp. paratuberculosis
cucggcggcucagcaacc

SEQ ID NO: 2944116 - RNA, 14 nt, Mycobacterium avium subsp. paratuberculosis
cucggcgggaucgg

SEQ ID NO: 2944117 - RNA, 18 nt, Mycobacterium avium subsp. paratuberculosis
cucggcgggccgcccggc

SEQ ID NO: 2944118 - RNA, 23 nt, Mycobacterium avium subsp. paratuberculosis
cucggcgggccgcccggcgcgcc

SEQ ID NO: 2944119 - RNA, 15 nt, Mycobacterium avium subsp. paratuberculosis
cucggcgggcucgcg

SEQ ID NO: 2944120 - RNA, 19 nt, Mycobacterium avium subsp. paratuberculosis
cucggcggguugcugagcc

SEQ ID NO: 2944121 - RNA, 22 nt, Mycobacterium avium subsp. paratuberculosis
cucggcggguugcugagccgcc

SEQ ID NO: 2944122 - RNA, 22 nt, Mycobacterium avium subsp. paratuberculosis
cucggcggugccguccucggcc

SEQ ID NO: 2944123 - RNA, 20 nt, Mycobacterium avium subsp. paratuberculosis
cucggcguauucgucgucgg

SEQ ID NO: 2944124 - RNA, 17 nt, Mycobacterium avium subsp. paratuberculosis
cucggcguccccggcgg

SEQ ID NO: 2944125 - RNA, 15 nt, Mycobacterium avium subsp. paratuberculosis
cucggcgucccggcg

SEQ ID NO: 2944126 - RNA, 18 nt, Mycobacterium avium subsp. paratuberculosis
cucggcguccgcggcgga

SEQ ID NO: 2944127 - RNA, 19 nt, Mycobacterium avium subsp. paratuberculosis
cucggcgucgaagcgcaug

SEQ ID NO: 2944128 - RNA, 22 nt, Mycobacterium avium subsp. paratuberculosis
cucggcgucgaagcgcaugccg

SEQ ID NO: 2944129 - RNA, 15 nt, Mycobacterium avium subsp. paratuberculosis
cucggcgucgcacgu

SEQ ID NO: 2944130 - RNA, 17 nt, Mycobacterium avium subsp. paratuberculosis
cucggcgucgcacgugg

SEQ ID NO: 2944131 - RNA, 14 nt, Mycobacterium avium subsp. paratuberculosis
cucggcgucgccga

SEQ ID NO: 2944132 - RNA, 13 nt, Mycobacterium avium subsp. paratuberculosis
cucggcgucggcg

SEQ ID NO: 2944133 - RNA, 14 nt, Mycobacterium avium subsp. paratuberculosis
cucggcgucucggc

SEQ ID NO: 2944134 - RNA, 14 nt, Mycobacterium avium subsp. paratuberculosis
cucggcgugcccgc

SEQ ID NO: 2944135 - RNA, 17 nt, Mycobacterium avium subsp. paratuberculosis
cucggcgugcccgccga

SEQ ID NO: 2944136 - RNA, 17 nt, Mycobacterium avium subsp. paratuberculosis
cucggcguggcaggcga

SEQ ID NO: 2944137 - RNA, 17 nt, Mycobacterium avium subsp. paratuberculosis
cucggcguggcgcucag

SEQ ID NO: 2944138 - RNA, 20 nt, Mycobacterium avium subsp. paratuberculosis
cucggcguggcgcucagcgg

SEQ ID NO: 2944139 - RNA, 21 nt, Mycobacterium avium subsp. paratuberculosis
cucggcguggcgcucagcggc

SEQ ID NO: 2944140 - RNA, 16 nt, Mycobacterium avium subsp. paratuberculosis
cucggcguugagccgg

SEQ ID NO: 2944141 - RNA, 21 nt, Mycobacterium avium subsp. paratuberculosis
cucggcguugagccggcgcac

SEQ ID NO: 2944142 - RNA, 23 nt, Mycobacterium avium subsp. paratuberculosis
cucggcguugagccggcgcaccg

SEQ ID NO: 2944143 - RNA, 15 nt, Mycobacterium avium subsp. paratuberculosis
cucggcucggccggc

SEQ ID NO: 2944144 - RNA, 16 nt, Mycobacterium avium subsp. paratuberculosis
cucggcuuccgagccg

SEQ ID NO: 2944145 - RNA, 20 nt, Mycobacterium avium subsp. paratuberculosis
cucggcuuccgagccgguga

SEQ ID NO: 2944146 - RNA, 16 nt, Mycobacterium avium subsp. paratuberculosis
cucggcuucgucgggu

SEQ ID NO: 2944147 - RNA, 19 nt, Mycobacterium avium subsp. paratuberculosis
cucgggaaaugcgucggca

SEQ ID NO: 2944148 - RNA, 16 nt, Mycobacterium avium subsp. paratuberculosis
cucgggaacggucagc

SEQ ID NO: 2944149 - RNA, 19 nt, Mycobacterium avium subsp. paratuberculosis
cucgggaacggucagccgc

SEQ ID NO: 2944150 - RNA, 23 nt, Mycobacterium avium subsp. paratuberculosis
cucgggaacggucagccgcggcu

SEQ ID NO: 2944151 - RNA, 16 nt, Mycobacterium avium subsp. paratuberculosis
cucgggauagccgagc

SEQ ID NO: 2944152 - RNA, 16 nt, Mycobacterium avium subsp. paratuberculosis
cucgggcaacgcgccg

SEQ ID NO: 2944153 - RNA, 17 nt, Mycobacterium avium subsp. paratuberculosis
cucgggcaacgcgccgg

SEQ ID NO: 2944154 - RNA, 19 nt, Mycobacterium avium subsp. paratuberculosis
cucgggcaacgcgccggcg

SEQ ID NO: 2944155 - RNA, 20 nt, Mycobacterium avium subsp. paratuberculosis
cucgggcaacgcgccggcgg

SEQ ID NO: 2944156 - RNA, 13 nt, Mycobacterium avium subsp. paratuberculosis
cucgggcaccacg

SEQ ID NO: 2944157 - RNA, 20 nt, Mycobacterium avium subsp. paratuberculosis
cucgggcaccacgccgacgu

SEQ ID NO: 2944158 - RNA, 19 nt, Mycobacterium avium subsp. paratuberculosis
cucgggcaccccugccgcc

SEQ ID NO: 2944159 - RNA, 15 nt, Mycobacterium avium subsp. paratuberculosis
cucgggcagcccgcc

SEQ ID NO: 2944160 - RNA, 19 nt, Mycobacterium avium subsp. paratuberculosis
cucgggcagcccgccgacc

SEQ ID NO: 2944161 - RNA, 20 nt, Mycobacterium avium subsp. paratuberculosis
cucgggcagcgugucccggu

SEQ ID NO: 2944162 - RNA, 14 nt, Mycobacterium avium subsp. paratuberculosis
cucgggcaggaugg

SEQ ID NO: 2944163 - RNA, 20 nt, Mycobacterium avium subsp. paratuberculosis
cucgggcauuggcagcucgg

SEQ ID NO: 2944164 - RNA, 12 nt, Mycobacterium avium subsp. paratuberculosis
cucgggccagcc

SEQ ID NO: 2944165 - RNA, 18 nt, Mycobacterium avium subsp. paratuberculosis
cucgggcccgcgcaccgu

SEQ ID NO: 2944166 - RNA, 13 nt, Mycobacterium avium subsp. paratuberculosis
cucgggccggcag

SEQ ID NO: 2944167 - RNA, 20 nt, Mycobacterium avium subsp. paratuberculosis
cucgggccggcagccggcca

SEQ ID NO: 2944168 - RNA, 17 nt, Mycobacterium avium subsp. paratuberculosis
cucgggccggcgccgac

SEQ ID NO: 2944169 - RNA, 21 nt, Mycobacterium avium subsp. paratuberculosis
cucgggccggcgccgacgacg

SEQ ID NO: 2944170 - RNA, 13 nt, Mycobacterium avium subsp. paratuberculosis
cucgguggccacc

SEQ ID NO: 2944171 - RNA, 13 nt, Mycobacterium avium subsp. paratuberculosis
cucgguggccucg

SEQ ID NO: 2944172 - RNA, 21 nt, Mycobacterium avium subsp. paratuberculosis
cucgguggcgguggccacggc

SEQ ID NO: 2944173 - RNA, 23 nt, Mycobacterium avium subsp. paratuberculosis
cucgguggcgguggccacggcgu

SEQ ID NO: 2944174 - RNA, 16 nt, Mycobacterium avium subsp. paratuberculosis
cucgguggucgacgag

SEQ ID NO: 2944175 - RNA, 14 nt, Mycobacterium avium subsp. paratuberculosis
cucgguggucgcgu

SEQ ID NO: 2944176 - RNA, 14 nt, Mycobacterium avium subsp. paratuberculosis
cucgguguacagcg

SEQ ID NO: 2944177 - RNA, 14 nt, Mycobacterium avium subsp. paratuberculosis
cucgguguagagca

SEQ ID NO: 2944178 - RNA, 17 nt, Mycobacterium avium subsp. paratuberculosis
cucgguguagagcaccu

SEQ ID NO: 2944179 - RNA, 18 nt, Mycobacterium avium subsp. paratuberculosis
cucgguguagagcaccuc

SEQ ID NO: 2944180 - RNA, 22 nt, Mycobacterium avium subsp. paratuberculosis
cucgguguagagcaccucgaug

SEQ ID NO: 2944181 - RNA, 14 nt, Mycobacterium avium subsp. paratuberculosis
cucggugucgaggu

SEQ ID NO: 2944182 - RNA, 23 nt, Mycobacterium avium subsp. paratuberculosis
cucggugucggacuugucgccgu

SEQ ID NO: 2944183 - RNA, 14 nt, Mycobacterium avium subsp. paratuberculosis
cucggugucgucga

SEQ ID NO: 2944184 - RNA, 22 nt, Mycobacterium avium subsp. paratuberculosis
cucggugucuuugcccuugaug

SEQ ID NO: 2944185 - RNA, 22 nt, Mycobacterium avium subsp. paratuberculosis
cucggugugcugacccagcgcg

SEQ ID NO: 2944186 - RNA, 23 nt, Mycobacterium avium subsp. paratuberculosis
cucgguuucgaacugggucugcc

SEQ ID NO: 2944187 - RNA, 13 nt, Mycobacterium avium subsp. paratuberculosis
cucguaacgccac

SEQ ID NO: 2944188 - RNA, 23 nt, Mycobacterium avium subsp. paratuberculosis
cucguacgacacgaugggucagg

SEQ ID NO: 2944189 - RNA, 23 nt, Mycobacterium avium subsp. paratuberculosis
cucguagcccaccucgagcacgc

SEQ ID NO: 2944190 - RNA, 16 nt, Mycobacterium avium subsp. paratuberculosis
cucguagcggccgcac

SEQ ID NO: 2944191 - RNA, 20 nt, Mycobacterium avium subsp. paratuberculosis
cucguagcggccgcacgcga

SEQ ID NO: 2944192 - RNA, 14 nt, Mycobacterium avium subsp. paratuberculosis
cucguagcgggcga

SEQ ID NO: 2944193 - RNA, 19 nt, Mycobacterium avium subsp. paratuberculosis
cucguagguggccagcacg

SEQ ID NO: 2944194 - RNA, 18 nt, Mycobacterium avium subsp. paratuberculosis
cucguaguuggggccggc

SEQ ID NO: 2944195 - RNA, 19 nt, Mycobacterium avium subsp. paratuberculosis
cucguaguuggggccggcc

SEQ ID NO: 2944196 - RNA, 23 nt, Mycobacterium avium subsp. paratuberculosis
cucguaguuggggccggccgccc

SEQ ID NO: 2944197 - RNA, 21 nt, Mycobacterium avium subsp. paratuberculosis
cucgucaaccgcagucguucg

SEQ ID NO: 2944198 - RNA, 21 nt, Mycobacterium avium subsp. paratuberculosis
cucgucagcgcgggccagcag

SEQ ID NO: 2944199 - RNA, 22 nt, Mycobacterium avium subsp. paratuberculosis
cucgucagcgcgggccagcagu

SEQ ID NO: 2944200 - RNA, 14 nt, Mycobacterium avium subsp. paratuberculosis
cucguccagcccgg

SEQ ID NO: 2944201 - RNA, 18 nt, Mycobacterium avium subsp. paratuberculosis
cucguccagcccggucac

SEQ ID NO: 2944202 - RNA, 17 nt, Mycobacterium avium subsp. paratuberculosis
cucguccagcgucgcgg

SEQ ID NO: 2944203 - RNA, 19 nt, Mycobacterium avium subsp. paratuberculosis
cucguccaggugcacccgc

SEQ ID NO: 2944204 - RNA, 21 nt, Mycobacterium avium subsp. paratuberculosis
cucguccaggugcacccgcgg

SEQ ID NO: 2944205 - RNA, 16 nt, Mycobacterium avium subsp. paratuberculosis
cucgucccacggcggg

SEQ ID NO: 2944206 - RNA, 17 nt, Mycobacterium avium subsp. paratuberculosis
cucgucccacggcgggg

SEQ ID NO: 2944207 - RNA, 14 nt, Mycobacterium avium subsp. paratuberculosis
cucgucccagcgca

SEQ ID NO: 2944208 - RNA, 16 nt, Mycobacterium avium subsp. paratuberculosis
cucguccgacagcgcc

SEQ ID NO: 2944209 - RNA, 14 nt, Mycobacterium avium subsp. paratuberculosis
cucguccgcgcugg

SEQ ID NO: 2944210 - RNA, 16 nt, Mycobacterium avium subsp. paratuberculosis
cucguccgcgcuggcg

SEQ ID NO: 2944211 - RNA, 16 nt, Mycobacterium avium subsp. paratuberculosis
cucguccgcggcggcg

SEQ ID NO: 2944212 - RNA, 12 nt, Mycobacterium avium subsp. paratuberculosis
cucguccucccg

SEQ ID NO: 2944213 - RNA, 14 nt, Mycobacterium avium subsp. paratuberculosis
cucguccucccggu

SEQ ID NO: 2944214 - RNA, 22 nt, Mycobacterium avium subsp. paratuberculosis
cucguccucccgguagccgaca

SEQ ID NO: 2944215 - RNA, 20 nt, Mycobacterium avium subsp. paratuberculosis
cucguccucgaaagccgcug

SEQ ID NO: 2944216 - RNA, 22 nt, Mycobacterium avium subsp. paratuberculosis
cucguccugauuuuggggacgc

SEQ ID NO: 2944217 - RNA, 23 nt, Mycobacterium avium subsp. paratuberculosis
cucguccuggcgcuggugcagca

SEQ ID NO: 2944218 - RNA, 17 nt, Mycobacterium avium subsp. paratuberculosis
cucguccugggccggga

SEQ ID NO: 2944219 - RNA, 17 nt, Mycobacterium avium subsp. paratuberculosis
cucgucgaacucgugga

SEQ ID NO: 2944220 - RNA, 17 nt, Mycobacterium avium subsp. paratuberculosis
cucgucgaagccgauca

SEQ ID NO: 2944221 - RNA, 17 nt, Mycobacterium avium subsp. paratuberculosis
cucgucgaccgcggccu

SEQ ID NO: 2944222 - RNA, 15 nt, Mycobacterium avium subsp. paratuberculosis
cucgucgacgauggc

SEQ ID NO: 2944223 - RNA, 21 nt, Mycobacterium avium subsp. paratuberculosis
cucgucgacgauggcccggac

SEQ ID NO: 2944224 - RNA, 16 nt, Mycobacterium avium subsp. paratuberculosis
cucgucgacgcccacc

SEQ ID NO: 2944225 - RNA, 23 nt, Mycobacterium avium subsp. paratuberculosis
cucgucgacgcugaccguggugu

SEQ ID NO: 2944226 - RNA, 20 nt, Mycobacterium avium subsp. paratuberculosis
cucgucgacguccucgcccg

SEQ ID NO: 2944227 - RNA, 15 nt, Mycobacterium avium subsp. paratuberculosis
cucgucgagcauccg

SEQ ID NO: 2944228 - RNA, 21 nt, Mycobacterium avium subsp. paratuberculosis
cucgucgagcauccggcgcac

SEQ ID NO: 2944229 - RNA, 23 nt, Mycobacterium avium subsp. paratuberculosis
cucgucgagccggccggacaccg

SEQ ID NO: 2944230 - RNA, 16 nt, Mycobacterium avium subsp. paratuberculosis
cucgucgagccgggcc

SEQ ID NO: 2944231 - RNA, 23 nt, Mycobacterium avium subsp. paratuberculosis
cucgucgaucgacgccgacaucg

SEQ ID NO: 2944232 - RNA, 16 nt, Mycobacterium avium subsp. paratuberculosis
cucgucgaugcacgcc

SEQ ID NO: 2944233 - RNA, 20 nt, Mycobacterium avium subsp. paratuberculosis
cucgucgaugcacgccggaa

SEQ ID NO: 2944234 - RNA, 11 nt, Mycobacterium avium subsp. paratuberculosis
cucgucgaugg

SEQ ID NO: 2944235 - RNA, 17 nt, Mycobacterium avium subsp. paratuberculosis
cucgucgaugggcucga

SEQ ID NO: 2944236 - RNA, 13 nt, Mycobacterium avium subsp. paratuberculosis
cucgucgauguag

SEQ ID NO: 2944237 - RNA, 15 nt, Mycobacterium avium subsp. paratuberculosis
cucgucgaugucggc

SEQ ID NO: 2944238 - RNA, 21 nt, Mycobacterium avium subsp. paratuberculosis
cucgucgaugucggcggcccg

SEQ ID NO: 2944239 - RNA, 22 nt, Mycobacterium avium subsp. paratuberculosis
cucgucgaugucggcggcccgg

SEQ ID NO: 2944240 - RNA, 20 nt, Mycobacterium avium subsp. paratuberculosis
cucgucgcacaaccgggcca

SEQ ID NO: 2944241 - RNA, 23 nt, Mycobacterium avium subsp. paratuberculosis
cucgucgcacaaccgggccaacg

SEQ ID NO: 2944242 - RNA, 14 nt, Mycobacterium avium subsp. paratuberculosis
cucgucgccgcggu

SEQ ID NO: 2944243 - RNA, 14 nt, Mycobacterium avium subsp. paratuberculosis
cucgucgcgcagcu

SEQ ID NO: 2944244 - RNA, 20 nt, Mycobacterium avium subsp. paratuberculosis
cucgucgcggaacagccggc

SEQ ID NO: 2944245 - RNA, 12 nt, Mycobacterium avium subsp. paratuberculosis
cucgucgcggag

SEQ ID NO: 2944246 - RNA, 14 nt, Mycobacterium avium subsp. paratuberculosis
cucgucgcggcugc

SEQ ID NO: 2944247 - RNA, 14 nt, Mycobacterium avium subsp. paratuberculosis
cucgucgcgggcgc

SEQ ID NO: 2944248 - RNA, 22 nt, Mycobacterium avium subsp. paratuberculosis
cucgucgcgguugaucacaccg

SEQ ID NO: 2944249 - RNA, 18 nt, Mycobacterium avium subsp. paratuberculosis
cucgucggaggcgucgac

SEQ ID NO: 2944250 - RNA, 14 nt, Mycobacterium avium subsp. paratuberculosis
cucgucggccagcg

SEQ ID NO: 2944251 - RNA, 11 nt, Mycobacterium avium subsp. paratuberculosis
cucgucggccg

SEQ ID NO: 2944252 - RNA, 19 nt, Mycobacterium avium subsp. paratuberculosis
cucgucggccgcgacgacc

SEQ ID NO: 2944253 - RNA, 13 nt, Mycobacterium avium subsp. paratuberculosis
cucgucggcgaac

SEQ ID NO: 2944254 - RNA, 22 nt, Mycobacterium avium subsp. paratuberculosis
cucucguugaugcugugcgcuu

SEQ ID NO: 2944255 - RNA, 23 nt, Mycobacterium avium subsp. paratuberculosis
cucugacggcucuucggcgccga

SEQ ID NO: 2944256 - RNA, 16 nt, Mycobacterium avium subsp. paratuberculosis
cucugauuugaaauuc

SEQ ID NO: 2944257 - RNA, 15 nt, Mycobacterium avium subsp. paratuberculosis
cucugccacggcgga

SEQ ID NO: 2944258 - RNA, 13 nt, Mycobacterium avium subsp. paratuberculosis
cucugccgggccg

SEQ ID NO: 2944259 - RNA, 22 nt, Mycobacterium avium subsp. paratuberculosis
cucugcgaccacccggacgaug

SEQ ID NO: 2944260 - RNA, 15 nt, Mycobacterium avium subsp. paratuberculosis
cucugcgcgagcagc

SEQ ID NO: 2944261 - RNA, 12 nt, Mycobacterium avium subsp. paratuberculosis
cucugcgcgcca

SEQ ID NO: 2944262 - RNA, 20 nt, Mycobacterium avium subsp. paratuberculosis
cucuggcgugacgcucgacg

SEQ ID NO: 2944263 - RNA, 18 nt, Mycobacterium avium subsp. paratuberculosis
cucuggcgugacgcucgg

SEQ ID NO: 2944264 - RNA, 20 nt, Mycobacterium avium subsp. paratuberculosis
cucuggcgugacgcucggcg

SEQ ID NO: 2944265 - RNA, 12 nt, Mycobacterium avium subsp. paratuberculosis
cucugucgucga

SEQ ID NO: 2944266 - RNA, 15 nt, Mycobacterium avium subsp. paratuberculosis
cucuuccucgggcag

SEQ ID NO: 2944267 - RNA, 22 nt, Mycobacterium avium subsp. paratuberculosis
cucuuccucgggcagucugccg

SEQ ID NO: 2944268 - RNA, 14 nt, Mycobacterium avium subsp. paratuberculosis
cucuucgacccgca

SEQ ID NO: 2944269 - RNA, 14 nt, Mycobacterium avium subsp. paratuberculosis
cucuucgacccggu

SEQ ID NO: 2944270 - RNA, 22 nt, Mycobacterium avium subsp. paratuberculosis
cucuucgacccgguagcgcagc

SEQ ID NO: 2944271 - RNA, 23 nt, Mycobacterium avium subsp. paratuberculosis
cucuucgacccgguagcgcagca

SEQ ID NO: 2944272 - RNA, 13 nt, Mycobacterium avium subsp. paratuberculosis
cucuucgaugccg

SEQ ID NO: 2944273 - RNA, 20 nt, Mycobacterium avium subsp. paratuberculosis
cucuucgcagcgcucagugu

SEQ ID NO: 2944274 - RNA, 18 nt, Mycobacterium avium subsp. paratuberculosis
cucuucgccggacagccg

SEQ ID NO: 2944275 - RNA, 19 nt, Mycobacterium avium subsp. paratuberculosis
cucuucgccggacagccgg

SEQ ID NO: 2944276 - RNA, 20 nt, Mycobacterium avium subsp. paratuberculosis
cucuucgcggauccgggccg

SEQ ID NO: 2944277 - RNA, 15 nt, Mycobacterium avium subsp. paratuberculosis
cucuucgcggcgggg

SEQ ID NO: 2944278 - RNA, 14 nt, Mycobacterium avium subsp. paratuberculosis
cucuucggcgccgg

SEQ ID NO: 2944279 - RNA, 17 nt, Mycobacterium avium subsp. paratuberculosis
cucuucggcgcgccggc

SEQ ID NO: 2944280 - RNA, 13 nt, Mycobacterium avium subsp. paratuberculosis
cucuucgggcugc

SEQ ID NO: 2944281 - RNA, 17 nt, Mycobacterium avium subsp. paratuberculosis
cucuucggggguggcca

SEQ ID NO: 2944282 - RNA, 21 nt, Mycobacterium avium subsp. paratuberculosis
cucuucggggguggccagcuu

SEQ ID NO: 2944283 - RNA, 24 nt, Mycobacterium avium subsp. paratuberculosis
cucuucggugguguggaucuccag

SEQ ID NO: 2944284 - RNA, 20 nt, Mycobacterium avium subsp. paratuberculosis
cucuucgucggccggcaguu

SEQ ID NO: 2944285 - RNA, 19 nt, Mycobacterium avium subsp. paratuberculosis
cucuucucguucugcgugc

SEQ ID NO: 2944286 - RNA, 14 nt, Mycobacterium avium subsp. paratuberculosis
cucuucuuccugcu

SEQ ID NO: 2944287 - RNA, 16 nt, Mycobacterium avium subsp. paratuberculosis
cucuugaugcagcgcc

SEQ ID NO: 2944288 - RNA, 20 nt, Mycobacterium avium subsp. paratuberculosis
cucuugaugcagcgccucgg

SEQ ID NO: 2944289 - RNA, 17 nt, Mycobacterium avium subsp. paratuberculosis
cucuugcgugcgggucg

SEQ ID NO: 2944290 - RNA, 16 nt, Mycobacterium avium subsp. paratuberculosis
cucuugggacuggaug

SEQ ID NO: 2944291 - RNA, 20 nt, Mycobacterium avium subsp. paratuberculosis
cucuuggugguggucgucga

SEQ ID NO: 2944292 - RNA, 17 nt, Mycobacterium avium subsp. paratuberculosis
cugaaagccgaggcgca

SEQ ID NO: 2944293 - RNA, 21 nt, Mycobacterium avium subsp. paratuberculosis
cugaaagccgaggcgcaacac

SEQ ID NO: 2944294 - RNA, 15 nt, Mycobacterium avium subsp. paratuberculosis
cugaacaaccccacc

SEQ ID NO: 2944295 - RNA, 13 nt, Mycobacterium avium subsp. paratuberculosis
cugaacagcagca

SEQ ID NO: 2944296 - RNA, 18 nt, Mycobacterium avium subsp. paratuberculosis
cugaacagcagcagcagc

SEQ ID NO: 2944297 - RNA, 13 nt, Mycobacterium avium subsp. paratuberculosis
cugaacagcccga

SEQ ID NO: 2944298 - RNA, 16 nt, Mycobacterium avium subsp. paratuberculosis
cugaaccaccgcgccc

SEQ ID NO: 2944299 - RNA, 22 nt, Mycobacterium avium subsp. paratuberculosis
cugaaccagcucgugcagcugu

SEQ ID NO: 2944300 - RNA, 17 nt, Mycobacterium avium subsp. paratuberculosis
cugaaccgguagucguc

SEQ ID NO: 2944301 - RNA, 19 nt, Mycobacterium avium subsp. paratuberculosis
cugaaccgguagucgucga

SEQ ID NO: 2944302 - RNA, 23 nt, Mycobacterium avium subsp. paratuberculosis
cugaaccgguagucgucgagguu

SEQ ID NO: 2944303 - RNA, 18 nt, Mycobacterium avium subsp. paratuberculosis
cugaaccugcugggcggc

SEQ ID NO: 2944304 - RNA, 12 nt, Mycobacterium avium subsp. paratuberculosis
cugaacgccagc

SEQ ID NO: 2944305 - RNA, 21 nt, Mycobacterium avium subsp. paratuberculosis
cugaacgccagcagccgcagc

SEQ ID NO: 2944306 - RNA, 23 nt, Mycobacterium avium subsp. paratuberculosis
cugaacgccagcagccgcagcag

SEQ ID NO: 2944307 - RNA, 20 nt, Mycobacterium avium subsp. paratuberculosis
cugaacgccugccggcgccg

SEQ ID NO: 2944308 - RNA, 16 nt, Mycobacterium avium subsp. paratuberculosis
cugaacgcgauccagg

SEQ ID NO: 2944309 - RNA, 21 nt, Mycobacterium avium subsp. paratuberculosis
cugaacgcggugggcaccagc

SEQ ID NO: 2944310 - RNA, 14 nt, Mycobacterium avium subsp. paratuberculosis
cugaacgcgucguu

SEQ ID NO: 2944311 - RNA, 16 nt, Mycobacterium avium subsp. paratuberculosis
cugaacggccgcgcag

SEQ ID NO: 2944312 - RNA, 13 nt, Mycobacterium avium subsp. paratuberculosis
cugaacgggcagc

SEQ ID NO: 2944313 - RNA, 16 nt, Mycobacterium avium subsp. paratuberculosis
cugaacgucuugggcg

SEQ ID NO: 2944314 - RNA, 13 nt, Mycobacterium avium subsp. paratuberculosis
cugaacugcucga

SEQ ID NO: 2944315 - RNA, 18 nt, Mycobacterium avium subsp. paratuberculosis
cugaacugcucgaccagc

SEQ ID NO: 2944316 - RNA, 20 nt, Mycobacterium avium subsp. paratuberculosis
cugaacugcucgaccagcgc

SEQ ID NO: 2944317 - RNA, 18 nt, Mycobacterium avium subsp. paratuberculosis
cugaagaagaugggcgcc

SEQ ID NO: 2944318 - RNA, 21 nt, Mycobacterium avium subsp. paratuberculosis
cugaagaagaugggcgccgag

SEQ ID NO: 2944319 - RNA, 16 nt, Mycobacterium avium subsp. paratuberculosis
cugaagaagcggccgu

SEQ ID NO: 2944320 - RNA, 18 nt, Mycobacterium avium subsp. paratuberculosis
cugaagaucaacagccgc

SEQ ID NO: 2944321 - RNA, 15 nt, Mycobacterium avium subsp. paratuberculosis
cugaagcccaccgcc

SEQ ID NO: 2944322 - RNA, 18 nt, Mycobacterium avium subsp. paratuberculosis
cugaagcccaccgccguu

SEQ ID NO: 2944323 - RNA, 19 nt, Mycobacterium avium subsp. paratuberculosis
cugaagccgaacgcgcugu

SEQ ID NO: 2944324 - RNA, 13 nt, Mycobacterium avium subsp. paratuberculosis
cugaaggcgcggg

SEQ ID NO: 2944325 - RNA, 15 nt, Mycobacterium avium subsp. paratuberculosis
cugaagugcagcgca

SEQ ID NO: 2944326 - RNA, 18 nt, Mycobacterium avium subsp. paratuberculosis
cugaaucccuccggcagg

SEQ ID NO: 2944327 - RNA, 21 nt, Mycobacterium avium subsp. paratuberculosis
cugaaugaacgaccugguuga

SEQ ID NO: 2944328 - RNA, 15 nt, Mycobacterium avium subsp. paratuberculosis
cugaauuccuggccg

SEQ ID NO: 2944329 - RNA, 16 nt, Mycobacterium avium subsp. paratuberculosis
cugaauuccuggccgg

SEQ ID NO: 2944330 - RNA, 16 nt, Mycobacterium avium subsp. paratuberculosis
cugaauucggccaccg

SEQ ID NO: 2944331 - RNA, 21 nt, Mycobacterium avium subsp. paratuberculosis
cugaauucuguugucggcucg

SEQ ID NO: 2944332 - RNA, 14 nt, Mycobacterium avium subsp. paratuberculosis
cugacaaagcacaa

SEQ ID NO: 2944333 - RNA, 14 nt, Mycobacterium avium subsp. paratuberculosis
cugacacagcaccg

SEQ ID NO: 2944334 - RNA, 17 nt, Mycobacterium avium subsp. paratuberculosis
cugacacagcaccggcg

SEQ ID NO: 2944335 - RNA, 16 nt, Mycobacterium avium subsp. paratuberculosis
cugacagacccgaucg

SEQ ID NO: 2944336 - RNA, 14 nt, Mycobacterium avium subsp. paratuberculosis
cugaccaaggacaa

SEQ ID NO: 2944337 - RNA, 14 nt, Mycobacterium avium subsp. paratuberculosis
cugaccaaggccga

SEQ ID NO: 2944338 - RNA, 23 nt, Mycobacterium avium subsp. paratuberculosis
cugaccaaggccgacagguagca

SEQ ID NO: 2944339 - RNA, 13 nt, Mycobacterium avium subsp. paratuberculosis
cugagcaaccgcc

SEQ ID NO: 2944340 - RNA, 18 nt, Mycobacterium avium subsp. paratuberculosis
cugagcaaccgccgaaac

SEQ ID NO: 2944341 - RNA, 14 nt, Mycobacterium avium subsp. paratuberculosis
cugagcaaccgguu

SEQ ID NO: 2944342 - RNA, 18 nt, Mycobacterium avium subsp. paratuberculosis
cugagcaauucggugacg

SEQ ID NO: 2944343 - RNA, 21 nt, Mycobacterium avium subsp. paratuberculosis
cugagcacccgcagcucgccg

SEQ ID NO: 2944344 - RNA, 23 nt, Mycobacterium avium subsp. paratuberculosis
cugagcacccgcagcucgccgag

SEQ ID NO: 2944345 - RNA, 18 nt, Mycobacterium avium subsp. paratuberculosis
cugagcacccgcccggac

SEQ ID NO: 2944346 - RNA, 22 nt, Mycobacterium avium subsp. paratuberculosis
cugagcacccgcccggacgcgc

SEQ ID NO: 2944347 - RNA, 15 nt, Mycobacterium avium subsp. paratuberculosis
cugagcacggugggc

SEQ ID NO: 2944348 - RNA, 14 nt, Mycobacterium avium subsp. paratuberculosis
cugagcagcacccg

SEQ ID NO: 2944349 - RNA, 14 nt, Mycobacterium avium subsp. paratuberculosis
cugagcagcagguc

SEQ ID NO: 2944350 - RNA, 16 nt, Mycobacterium avium subsp. paratuberculosis
cugagcagcaggucgg

SEQ ID NO: 2944351 - RNA, 18 nt, Mycobacterium avium subsp. paratuberculosis
cugagcagcaggucggcg

SEQ ID NO: 2944352 - RNA, 21 nt, Mycobacterium avium subsp. paratuberculosis
cugagcagcaggucggcgugc

SEQ ID NO: 2944353 - RNA, 13 nt, Mycobacterium avium subsp. paratuberculosis
cugagcagcucgc

SEQ ID NO: 2944354 - RNA, 23 nt, Mycobacterium avium subsp. paratuberculosis
cugagcagcucgcggauccgcag

SEQ ID NO: 2944355 - RNA, 17 nt, Mycobacterium avium subsp. paratuberculosis
cugagcaggcuggcaug

SEQ ID NO: 2944356 - RNA, 17 nt, Mycobacterium avium subsp. paratuberculosis
cugagcccggcgacgaa

SEQ ID NO: 2944357 - RNA, 18 nt, Mycobacterium avium subsp. paratuberculosis
cugagcccggcgacgaag

SEQ ID NO: 2944358 - RNA, 13 nt, Mycobacterium avium subsp. paratuberculosis
cugagccgccgag

SEQ ID NO: 2944359 - RNA, 17 nt, Mycobacterium avium subsp. paratuberculosis
cugagccgccgagccgg

SEQ ID NO: 2944360 - RNA, 16 nt, Mycobacterium avium subsp. paratuberculosis
cugagccgccggggcg

SEQ ID NO: 2944361 - RNA, 19 nt, Mycobacterium avium subsp. paratuberculosis
cugagccgccggggcgccg

SEQ ID NO: 2944362 - RNA, 12 nt, Mycobacterium avium subsp. paratuberculosis
cugagccggccc

SEQ ID NO: 2944363 - RNA, 21 nt, Mycobacterium avium subsp. paratuberculosis
cugagccggcccugcggccag

SEQ ID NO: 2944364 - RNA, 14 nt, Mycobacterium avium subsp. paratuberculosis
cugagcgccaggcc

SEQ ID NO: 2944365 - RNA, 14 nt, Mycobacterium avium subsp. paratuberculosis
cugagcgcccgguc

SEQ ID NO: 2944366 - RNA, 18 nt, Mycobacterium avium subsp. paratuberculosis
cugagcgcccggucgagg

SEQ ID NO: 2944367 - RNA, 17 nt, Mycobacterium avium subsp. paratuberculosis
cugagcgggacgcgcag

SEQ ID NO: 2944368 - RNA, 21 nt, Mycobacterium avium subsp. paratuberculosis
cugagcggguaaccgcagccg

SEQ ID NO: 2944369 - RNA, 21 nt, Mycobacterium avium subsp. paratuberculosis
cugagcgggucggccggcggg

SEQ ID NO: 2944370 - RNA, 13 nt, Mycobacterium avium subsp. paratuberculosis
cugagcugcgccc

SEQ ID NO: 2944371 - RNA, 15 nt, Mycobacterium avium subsp. paratuberculosis
cugagcugcgcccac

SEQ ID NO: 2944372 - RNA, 20 nt, Mycobacterium avium subsp. paratuberculosis
cugagcugguuucgggucga

SEQ ID NO: 2944373 - RNA, 17 nt, Mycobacterium avium subsp. paratuberculosis
cugagcugugccgcggu

SEQ ID NO: 2944374 - RNA, 18 nt, Mycobacterium avium subsp. paratuberculosis
cugagcuucugcccggcc

SEQ ID NO: 2944375 - RNA, 17 nt, Mycobacterium avium subsp. paratuberculosis
cugaggaugguggugca

SEQ ID NO: 2944376 - RNA, 21 nt, Mycobacterium avium subsp. paratuberculosis
cugaggccgccccggccgcgc

SEQ ID NO: 2944377 - RNA, 22 nt, Mycobacterium avium subsp. paratuberculosis
cugaggccgccccggccgcgca

SEQ ID NO: 2944378 - RNA, 21 nt, Mycobacterium avium subsp. paratuberculosis
cugagguagucccgcgccugg

SEQ ID NO: 2944379 - RNA, 13 nt, Mycobacterium avium subsp. paratuberculosis
cugaguucgguga

SEQ ID NO: 2944380 - RNA, 22 nt, Mycobacterium avium subsp. paratuberculosis
cugaguucggugaacugcagcc

SEQ ID NO: 2944381 - RNA, 18 nt, Mycobacterium avium subsp. paratuberculosis
cugauacccgcgcggcgc

SEQ ID NO: 2944382 - RNA, 18 nt, Mycobacterium avium subsp. paratuberculosis
cugauacgacguccgggc

SEQ ID NO: 2944383 - RNA, 20 nt, Mycobacterium avium subsp. paratuberculosis
cugauacgacguccgggccg

SEQ ID NO: 2944384 - RNA, 21 nt, Mycobacterium avium subsp. paratuberculosis
cugauacgacguccgggccgc

SEQ ID NO: 2944385 - RNA, 14 nt, Mycobacterium avium subsp. paratuberculosis
cugauagcccgccg

SEQ ID NO: 2944386 - RNA, 18 nt, Mycobacterium avium subsp. paratuberculosis
cugauagcccgccgcggc

SEQ ID NO: 2944387 - RNA, 22 nt, Mycobacterium avium subsp. paratuberculosis
cugauagcccgccgcggcgacc

SEQ ID NO: 2944388 - RNA, 23 nt, Mycobacterium avium subsp. paratuberculosis
cugauagcccgccgcggcgaccg

SEQ ID NO: 2944389 - RNA, 17 nt, Mycobacterium avium subsp. paratuberculosis
cugauaggucagcucga

SEQ ID NO: 2944390 - RNA, 16 nt, Mycobacterium avium subsp. paratuberculosis
cugaucacaugggcga

SEQ ID NO: 2944391 - RNA, 17 nt, Mycobacterium avium subsp. paratuberculosis
cugaucacaugggcgac

SEQ ID NO: 2944392 - RNA, 17 nt, Mycobacterium avium subsp. paratuberculosis
cugaucaccacggucag

SEQ ID NO: 2944393 - RNA, 13 nt, Mycobacterium avium subsp. paratuberculosis
cugaucaccgcgc

SEQ ID NO: 2944394 - RNA, 20 nt, Mycobacterium avium subsp. paratuberculosis
cugaucaccgcgcucggcga

SEQ ID NO: 2944395 - RNA, 23 nt, Mycobacterium avium subsp. paratuberculosis
cugaucagccggcgagcgcgcug

SEQ ID NO: 2944396 - RNA, 22 nt, Mycobacterium avium subsp. paratuberculosis
cugaucaugaagucgcggaugc

SEQ ID NO: 2944397 - RNA, 16 nt, Mycobacterium avium subsp. paratuberculosis
cugauccaccaucuuc

SEQ ID NO: 2944398 - RNA, 17 nt, Mycobacterium avium subsp. paratuberculosis
cugauccaccaucuucc

SEQ ID NO: 2944399 - RNA, 14 nt, Mycobacterium avium subsp. paratuberculosis
cugauccagcagcg

SEQ ID NO: 2944400 - RNA, 15 nt, Mycobacterium avium subsp. paratuberculosis
cugauccccagcggc

SEQ ID NO: 2944401 - RNA, 18 nt, Mycobacterium avium subsp. paratuberculosis
cugauccccagcggcacg

SEQ ID NO: 2944402 - RNA, 18 nt, Mycobacterium avium subsp. paratuberculosis
cugauccgcaggaugccg

SEQ ID NO: 2944403 - RNA, 13 nt, Mycobacterium avium subsp. paratuberculosis
cugauccgcgguc

SEQ ID NO: 2944404 - RNA, 20 nt, Mycobacterium avium subsp. paratuberculosis
cugaucgagcucggccuuga

SEQ ID NO: 2944405 - RNA, 14 nt, Mycobacterium avium subsp. paratuberculosis
cugaucgaguccuc

SEQ ID NO: 2944406 - RNA, 16 nt, Mycobacterium avium subsp. paratuberculosis
cugaucgaguccucgc

SEQ ID NO: 2944407 - RNA, 17 nt, Mycobacterium avium subsp. paratuberculosis
cugaucgaguccucgcg

SEQ ID NO: 2944408 - RNA, 20 nt, Mycobacterium avium subsp. paratuberculosis
cugaucgaguuccgcgucgg

SEQ ID NO: 2944409 - RNA, 14 nt, Mycobacterium avium subsp. paratuberculosis
cugaucgcccagca

SEQ ID NO: 2944410 - RNA, 15 nt, Mycobacterium avium subsp. paratuberculosis
cugaucgcccagcac

SEQ ID NO: 2944411 - RNA, 17 nt, Mycobacterium avium subsp. paratuberculosis
cugaucgcccagcaccg

SEQ ID NO: 2944412 - RNA, 22 nt, Mycobacterium avium subsp. paratuberculosis
cugaucgcccagcaccgcgacg

SEQ ID NO: 2944413 - RNA, 16 nt, Mycobacterium avium subsp. paratuberculosis
cugaucgccgcuugca

SEQ ID NO: 2944414 - RNA, 22 nt, Mycobacterium avium subsp. paratuberculosis
cugaucgcggccggcgagucgc

SEQ ID NO: 2944415 - RNA, 20 nt, Mycobacterium avium subsp. paratuberculosis
cugaucgcggcgagcagcgc

SEQ ID NO: 2944416 - RNA, 19 nt, Mycobacterium avium subsp. paratuberculosis
cugaucgcguagcgccggu

SEQ ID NO: 2944417 - RNA, 19 nt, Mycobacterium avium subsp. paratuberculosis
cugaucgcgucgacggcgc

SEQ ID NO: 2944418 - RNA, 14 nt, Mycobacterium avium subsp. paratuberculosis
cugaucggccgcaa

SEQ ID NO: 2944419 - RNA, 15 nt, Mycobacterium avium subsp. paratuberculosis
cugaucggccgcaag

SEQ ID NO: 2944420 - RNA, 16 nt, Mycobacterium avium subsp. paratuberculosis
cugaucuacgucggcu

SEQ ID NO: 2944421 - RNA, 14 nt, Mycobacterium avium subsp. paratuberculosis
cugaucucggcggu

SEQ ID NO: 2944422 - RNA, 21 nt, Mycobacterium avium subsp. paratuberculosis
cugaucucggcggucugucgc

SEQ ID NO: 2944423 - RNA, 22 nt, Mycobacterium avium subsp. paratuberculosis
cugaucuucgagacacgcgccg

SEQ ID NO: 2944424 - RNA, 19 nt, Mycobacterium avium subsp. paratuberculosis
cugcacgcgcgggucgucg

SEQ ID NO: 2944425 - RNA, 22 nt, Mycobacterium avium subsp. paratuberculosis
cugcacgcgcgggucgucggcc

SEQ ID NO: 2944426 - RNA, 19 nt, Mycobacterium avium subsp. paratuberculosis
cugcacgcuguccgcguga

SEQ ID NO: 2944427 - RNA, 14 nt, Mycobacterium avium subsp. paratuberculosis
cugcacgggcgugu

SEQ ID NO: 2944428 - RNA, 23 nt, Mycobacterium avium subsp. paratuberculosis
cugcacgggcguguaguccaggu

SEQ ID NO: 2944429 - RNA, 20 nt, Mycobacterium avium subsp. paratuberculosis
cugcacggggacgucgucgu

SEQ ID NO: 2944430 - RNA, 13 nt, Mycobacterium avium subsp. paratuberculosis
cugcacggggugc

SEQ ID NO: 2944431 - RNA, 23 nt, Mycobacterium avium subsp. paratuberculosis
cugcacggggugcgugacgggcu

SEQ ID NO: 2944432 - RNA, 14 nt, Mycobacterium avium subsp. paratuberculosis
cugcacggugccgc

SEQ ID NO: 2944433 - RNA, 17 nt, Mycobacterium avium subsp. paratuberculosis
cugcacggugcgccggc

SEQ ID NO: 2944434 - RNA, 18 nt, Mycobacterium avium subsp. paratuberculosis
cugcacggugcgccggca

SEQ ID NO: 2944435 - RNA, 22 nt, Mycobacterium avium subsp. paratuberculosis
cugcacgucacgggccaggcgc

SEQ ID NO: 2944436 - RNA, 23 nt, Mycobacterium avium subsp. paratuberculosis
cugcacguccgccuccgaccagc

SEQ ID NO: 2944437 - RNA, 22 nt, Mycobacterium avium subsp. paratuberculosis
cugcacguccuugggcuccucg

SEQ ID NO: 2944438 - RNA, 17 nt, Mycobacterium avium subsp. paratuberculosis
cugcacgucgccggcga

SEQ ID NO: 2944439 - RNA, 18 nt, Mycobacterium avium subsp. paratuberculosis
cugcacgucgccggcgac

SEQ ID NO: 2944440 - RNA, 22 nt, Mycobacterium avium subsp. paratuberculosis
cugcacgucgccggcgaccgcc

SEQ ID NO: 2944441 - RNA, 16 nt, Mycobacterium avium subsp. paratuberculosis
cugcacgucggcgcgc

SEQ ID NO: 2944442 - RNA, 18 nt, Mycobacterium avium subsp. paratuberculosis
cugcacgucggcgcgcag

SEQ ID NO: 2944443 - RNA, 17 nt, Mycobacterium avium subsp. paratuberculosis
cugcacgucggcggccg

SEQ ID NO: 2944444 - RNA, 21 nt, Mycobacterium avium subsp. paratuberculosis
cugcacgucggcggccgcgaa

SEQ ID NO: 2944445 - RNA, 17 nt, Mycobacterium avium subsp. paratuberculosis
cugcacuaccccgucga

SEQ ID NO: 2944446 - RNA, 22 nt, Mycobacterium avium subsp. paratuberculosis
cugcacucagagcagcgccugc

SEQ ID NO: 2944447 - RNA, 13 nt, Mycobacterium avium subsp. paratuberculosis
cugcacugcgguu

SEQ ID NO: 2944448 - RNA, 23 nt, Mycobacterium avium subsp. paratuberculosis
cugcagaccgaacgucacggcga

SEQ ID NO: 2944449 - RNA, 23 nt, Mycobacterium avium subsp. paratuberculosis
cugcagagcggugacaucgccac

SEQ ID NO: 2944450 - RNA, 15 nt, Mycobacterium avium subsp. paratuberculosis
cugcagauaggaccc

SEQ ID NO: 2944451 - RNA, 17 nt, Mycobacterium avium subsp. paratuberculosis
cugcagauaggacccgg

SEQ ID NO: 2944452 - RNA, 18 nt, Mycobacterium avium subsp. paratuberculosis
cugcagauaggacccggc

SEQ ID NO: 2944453 - RNA, 21 nt, Mycobacterium avium subsp. paratuberculosis
cugcagauaggacccggcgag

SEQ ID NO: 2944454 - RNA, 17 nt, Mycobacterium avium subsp. paratuberculosis
cugcagcaacucgcgcu

SEQ ID NO: 2944455 - RNA, 20 nt, Mycobacterium avium subsp. paratuberculosis
cugcagcaacucgcgcuccc

SEQ ID NO: 2944456 - RNA, 14 nt, Mycobacterium avium subsp. paratuberculosis
cugcagcaccaggc

SEQ ID NO: 2944457 - RNA, 23 nt, Mycobacterium avium subsp. paratuberculosis
cugcagcaccaggcccucgccgc

SEQ ID NO: 2944458 - RNA, 14 nt, Mycobacterium avium subsp. paratuberculosis
cugcagcaccgaac

SEQ ID NO: 2944459 - RNA, 19 nt, Mycobacterium avium subsp. paratuberculosis
cugcagcaccgaaccggcg

SEQ ID NO: 2944460 - RNA, 12 nt, Mycobacterium avium subsp. paratuberculosis
cugcagcacgcc

SEQ ID NO: 2944461 - RNA, 21 nt, Mycobacterium avium subsp. paratuberculosis
cugcagcagaugcgccucgau

SEQ ID NO: 2944462 - RNA, 11 nt, Mycobacterium avium subsp. paratuberculosis
cugcagcagcc

SEQ ID NO: 2944463 - RNA, 14 nt, Mycobacterium avium subsp. paratuberculosis
cugcagcagcccga

SEQ ID NO: 2944464 - RNA, 22 nt, Mycobacterium avium subsp. paratuberculosis
cugcagcagcccgaucaccccc

SEQ ID NO: 2944465 - RNA, 12 nt, Mycobacterium avium subsp. paratuberculosis
cugcagcagcga

SEQ ID NO: 2944466 - RNA, 14 nt, Mycobacterium avium subsp. paratuberculosis
cugcagcagcgacu

SEQ ID NO: 2944467 - RNA, 19 nt, Mycobacterium avium subsp. paratuberculosis
cugcagcauuuccgagcga

SEQ ID NO: 2944468 - RNA, 14 nt, Mycobacterium avium subsp. paratuberculosis
cugcagccggccgg

SEQ ID NO: 2944469 - RNA, 17 nt, Mycobacterium avium subsp. paratuberculosis
cugcagccggccggcgg

SEQ ID NO: 2944470 - RNA, 13 nt, Mycobacterium avium subsp. paratuberculosis
cugcagccggcgc

SEQ ID NO: 2944471 - RNA, 17 nt, Mycobacterium avium subsp. paratuberculosis
cugcagccggcgcggca

SEQ ID NO: 2944472 - RNA, 23 nt, Mycobacterium avium subsp. paratuberculosis
cugcagccgggcggcggccuccg

SEQ ID NO: 2944473 - RNA, 14 nt, Mycobacterium avium subsp. paratuberculosis
cugcagccgggugg

SEQ ID NO: 2944474 - RNA, 19 nt, Mycobacterium avium subsp. paratuberculosis
cugcagccggguggcccgc

SEQ ID NO: 2944475 - RNA, 21 nt, Mycobacterium avium subsp. paratuberculosis
cugcagccggguggcccgccc

SEQ ID NO: 2944476 - RNA, 13 nt, Mycobacterium avium subsp. paratuberculosis
cugcagcgacgga

SEQ ID NO: 2944477 - RNA, 21 nt, Mycobacterium avium subsp. paratuberculosis
cugcagcgacggaucggccgc

SEQ ID NO: 2944478 - RNA, 22 nt, Mycobacterium avium subsp. paratuberculosis
cugcagcgacggaucggccgcg

SEQ ID NO: 2944479 - RNA, 23 nt, Mycobacterium avium subsp. paratuberculosis
cugcagcgacggaucggccgcgu

SEQ ID NO: 2944480 - RNA, 15 nt, Mycobacterium avium subsp. paratuberculosis
cugcagcgagaccuc

SEQ ID NO: 2944481 - RNA, 22 nt, Mycobacterium avium subsp. paratuberculosis
cugcagcgagaccucccggcgc

SEQ ID NO: 2944482 - RNA, 13 nt, Mycobacterium avium subsp. paratuberculosis
cugcagcgcccgg

SEQ ID NO: 2944483 - RNA, 14 nt, Mycobacterium avium subsp. paratuberculosis
cugcagcgcccggg

SEQ ID NO: 2944484 - RNA, 15 nt, Mycobacterium avium subsp. paratuberculosis
cugcagcgcccgggc

SEQ ID NO: 2944485 - RNA, 13 nt, Mycobacterium avium subsp. paratuberculosis
cugcagcgccgag

SEQ ID NO: 2944486 - RNA, 16 nt, Mycobacterium avium subsp. paratuberculosis
cugcagcgccgaggcc

SEQ ID NO: 2944487 - RNA, 13 nt, Mycobacterium avium subsp. paratuberculosis
cugcagcgccgcc

SEQ ID NO: 2944488 - RNA, 14 nt, Mycobacterium avium subsp. paratuberculosis
cugcagcgccgccc

SEQ ID NO: 2944489 - RNA, 12 nt, Mycobacterium avium subsp. paratuberculosis
cugcagcgccuu

SEQ ID NO: 2944490 - RNA, 18 nt, Mycobacterium avium subsp. paratuberculosis
cugcagcgcgaggcgcag

SEQ ID NO: 2944491 - RNA, 15 nt, Mycobacterium avium subsp. paratuberculosis
cugcagcgcggucau

SEQ ID NO: 2944492 - RNA, 21 nt, Mycobacterium avium subsp. paratuberculosis
cugcagcggaaacgacgucgc

SEQ ID NO: 2944493 - RNA, 16 nt, Mycobacterium avium subsp. paratuberculosis
cugcagcggcggccag

SEQ ID NO: 2944494 - RNA, 20 nt, Mycobacterium avium subsp. paratuberculosis
cugcagcuccucggcggccu

SEQ ID NO: 2944495 - RNA, 20 nt, Mycobacterium avium subsp. paratuberculosis
cugcagcucgccggcgcgca

SEQ ID NO: 2944496 - RNA, 14 nt, Mycobacterium avium subsp. paratuberculosis
cugcagcucggugc

SEQ ID NO: 2944497 - RNA, 16 nt, Mycobacterium avium subsp. paratuberculosis
cugcaggaacaaccgc

SEQ ID NO: 2944498 - RNA, 22 nt, Mycobacterium avium subsp. paratuberculosis
cugcaggaacaaccgcagcggc

SEQ ID NO: 2944499 - RNA, 16 nt, Mycobacterium avium subsp. paratuberculosis
cugcaggcaggccggc

SEQ ID NO: 2944500 - RNA, 19 nt, Mycobacterium avium subsp. paratuberculosis
cugcaggcaggccggcagc

SEQ ID NO: 2944501 - RNA, 21 nt, Mycobacterium avium subsp. paratuberculosis
cugcaggcaggccggcagccg

SEQ ID NO: 2944502 - RNA, 14 nt, Mycobacterium avium subsp. paratuberculosis
cugcaggccccagu

SEQ ID NO: 2944503 - RNA, 13 nt, Mycobacterium avium subsp. paratuberculosis
cugcaggcccggg

SEQ ID NO: 2944504 - RNA, 14 nt, Mycobacterium avium subsp. paratuberculosis
cugcaggcccucga

SEQ ID NO: 2944505 - RNA, 15 nt, Mycobacterium avium subsp. paratuberculosis
cugcaggccgagccg

SEQ ID NO: 2944506 - RNA, 14 nt, Mycobacterium avium subsp. paratuberculosis
cugcaggccgaggc

SEQ ID NO: 2944507 - RNA, 14 nt, Mycobacterium avium subsp. paratuberculosis
cugcaggcgacgaa

SEQ ID NO: 2944508 - RNA, 23 nt, Mycobacterium avium subsp. paratuberculosis
cugcaggcgacgaaaaugcccag

SEQ ID NO: 2944509 - RNA, 14 nt, Mycobacterium avium subsp. paratuberculosis
cugcccgacccgca

SEQ ID NO: 2944510 - RNA, 14 nt, Mycobacterium avium subsp. paratuberculosis
cugcccgaccgcgc

SEQ ID NO: 2944511 - RNA, 13 nt, Mycobacterium avium subsp. paratuberculosis
cugcccgauggug

SEQ ID NO: 2944512 - RNA, 15 nt, Mycobacterium avium subsp. paratuberculosis
cugcccgauggugaa

SEQ ID NO: 2944513 - RNA, 14 nt, Mycobacterium avium subsp. paratuberculosis
cugcccgcccgaga

SEQ ID NO: 2944514 - RNA, 13 nt, Mycobacterium avium subsp. paratuberculosis
cugcccgccgacg

SEQ ID NO: 2944515 - RNA, 14 nt, Mycobacterium avium subsp. paratuberculosis
cugcccgccgacgc

SEQ ID NO: 2944516 - RNA, 14 nt, Mycobacterium avium subsp. paratuberculosis
cugcccgccgcggc

SEQ ID NO: 2944517 - RNA, 16 nt, Mycobacterium avium subsp. paratuberculosis
cugcccgccgcggccg

SEQ ID NO: 2944518 - RNA, 16 nt, Mycobacterium avium subsp. paratuberculosis
cugcccgccgcggugc

SEQ ID NO: 2944519 - RNA, 18 nt, Mycobacterium avium subsp. paratuberculosis
cugcccgccgcguacagc

SEQ ID NO: 2944520 - RNA, 18 nt, Mycobacterium avium subsp. paratuberculosis
cugcccgcgacggcgagc

SEQ ID NO: 2944521 - RNA, 20 nt, Mycobacterium avium subsp. paratuberculosis
cugcccgcgacggcgagccg

SEQ ID NO: 2944522 - RNA, 22 nt, Mycobacterium avium subsp. paratuberculosis
cugcccgcgacugucggcgccc

SEQ ID NO: 2944523 - RNA, 15 nt, Mycobacterium avium subsp. paratuberculosis
cugcccgcgaucgcc

SEQ ID NO: 2944524 - RNA, 16 nt, Mycobacterium avium subsp. paratuberculosis
cugcccgcgaucgcca

SEQ ID NO: 2944525 - RNA, 18 nt, Mycobacterium avium subsp. paratuberculosis
cugcccgcgaucgccagc

SEQ ID NO: 2944526 - RNA, 13 nt, Mycobacterium avium subsp. paratuberculosis
cugcccgcgcagg

SEQ ID NO: 2944527 - RNA, 16 nt, Mycobacterium avium subsp. paratuberculosis
cugcccgcgcaggccc

SEQ ID NO: 2944528 - RNA, 18 nt, Mycobacterium avium subsp. paratuberculosis
cugcccgcgcaggccccg

SEQ ID NO: 2944529 - RNA, 15 nt, Mycobacterium avium subsp. paratuberculosis
cugcccgcggccgcc

SEQ ID NO: 2944530 - RNA, 17 nt, Mycobacterium avium subsp. paratuberculosis
cugcccgcggccgccgc

SEQ ID NO: 2944531 - RNA, 19 nt, Mycobacterium avium subsp. paratuberculosis
cugcccgcggccgccgccg

SEQ ID NO: 2944532 - RNA, 23 nt, Mycobacterium avium subsp. paratuberculosis
cugcccgcggccgccgccgcggc

SEQ ID NO: 2944533 - RNA, 17 nt, Mycobacterium avium subsp. paratuberculosis
cugcccgcggguggccu

SEQ ID NO: 2944534 - RNA, 20 nt, Mycobacterium avium subsp. paratuberculosis
cugcccgcggguggccuuca

SEQ ID NO: 2944535 - RNA, 22 nt, Mycobacterium avium subsp. paratuberculosis
cugcccggaguccggcucggug

SEQ ID NO: 2944536 - RNA, 14 nt, Mycobacterium avium subsp. paratuberculosis
cugcccggcaaccg

SEQ ID NO: 2944537 - RNA, 14 nt, Mycobacterium avium subsp. paratuberculosis
cugcccggccagca

SEQ ID NO: 2944538 - RNA, 15 nt, Mycobacterium avium subsp. paratuberculosis
cugcccggccagcag

SEQ ID NO: 2944539 - RNA, 16 nt, Mycobacterium avium subsp. paratuberculosis
cugcccggccagcagg

SEQ ID NO: 2944540 - RNA, 14 nt, Mycobacterium avium subsp. paratuberculosis
cugcccggcgccgg

SEQ ID NO: 2944541 - RNA, 12 nt, Mycobacterium avium subsp. paratuberculosis
cugcccggcgcg

SEQ ID NO: 2944542 - RNA, 13 nt, Mycobacterium avium subsp. paratuberculosis
cugcccggcgcgg

SEQ ID NO: 2944543 - RNA, 23 nt, Mycobacterium avium subsp. paratuberculosis
cugcccggcgcuaaagccgaccg

SEQ ID NO: 2944544 - RNA, 12 nt, Mycobacterium avium subsp. paratuberculosis
cugcccggcggu

SEQ ID NO: 2944545 - RNA, 16 nt, Mycobacterium avium subsp. paratuberculosis
cugcccggcggugccg

SEQ ID NO: 2944546 - RNA, 20 nt, Mycobacterium avium subsp. paratuberculosis
cugcccgggcaucccgccga

SEQ ID NO: 2944547 - RNA, 22 nt, Mycobacterium avium subsp. paratuberculosis
cugcccgggcaucccgccgaac

SEQ ID NO: 2944548 - RNA, 15 nt, Mycobacterium avium subsp. paratuberculosis
cugcccgggcccgau

SEQ ID NO: 2944549 - RNA, 22 nt, Mycobacterium avium subsp. paratuberculosis
cugcccgggcccgauggcggcc

SEQ ID NO: 2944550 - RNA, 16 nt, Mycobacterium avium subsp. paratuberculosis
cugcccgggcgccgag

SEQ ID NO: 2944551 - RNA, 22 nt, Mycobacterium avium subsp. paratuberculosis
cugcccgggcuguugaccacgg

SEQ ID NO: 2944552 - RNA, 17 nt, Mycobacterium avium subsp. paratuberculosis
cugcccggucugcggcc

SEQ ID NO: 2944553 - RNA, 16 nt, Mycobacterium avium subsp. paratuberculosis
cugcccguagucggcg

SEQ ID NO: 2944554 - RNA, 21 nt, Mycobacterium avium subsp. paratuberculosis
cugcccgucgggcgcggcggc

SEQ ID NO: 2944555 - RNA, 20 nt, Mycobacterium avium subsp. paratuberculosis
cugcccgugccgcaccuggu

SEQ ID NO: 2944556 - RNA, 23 nt, Mycobacterium avium subsp. paratuberculosis
cugcccucuuccucgcuguccug

SEQ ID NO: 2944557 - RNA, 19 nt, Mycobacterium avium subsp. paratuberculosis
cugcccugaagcugggcgc

SEQ ID NO: 2944558 - RNA, 23 nt, Mycobacterium avium subsp. paratuberculosis
cugcccugggaggaagugcacgc

SEQ ID NO: 2944559 - RNA, 13 nt, Mycobacterium avium subsp. paratuberculosis
cugccgaccagga

SEQ ID NO: 2944560 - RNA, 12 nt, Mycobacterium avium subsp. paratuberculosis
cugccgacccgg

SEQ ID NO: 2944561 - RNA, 15 nt, Mycobacterium avium subsp. paratuberculosis
cugccgacccggcgu

SEQ ID NO: 2944562 - RNA, 17 nt, Mycobacterium avium subsp. paratuberculosis
cugccgacccggcguag

SEQ ID NO: 2944563 - RNA, 18 nt, Mycobacterium avium subsp. paratuberculosis
cugccgaccucgauggcg

SEQ ID NO: 2944564 - RNA, 19 nt, Mycobacterium avium subsp. paratuberculosis
cugccgaccugcgcgacgg

SEQ ID NO: 2944565 - RNA, 14 nt, Mycobacterium avium subsp. paratuberculosis
cugccgacgauguc

SEQ ID NO: 2944566 - RNA, 13 nt, Mycobacterium avium subsp. paratuberculosis
cugccgagcaccu

SEQ ID NO: 2944567 - RNA, 22 nt, Mycobacterium avium subsp. paratuberculosis
cugccgagcaccucgucgccgu

SEQ ID NO: 2944568 - RNA, 18 nt, Mycobacterium avium subsp. paratuberculosis
cugccgagcaucagcugc

SEQ ID NO: 2944569 - RNA, 20 nt, Mycobacterium avium subsp. paratuberculosis
cugccgaugcugagcggguc

SEQ ID NO: 2944570 - RNA, 23 nt, Mycobacterium avium subsp. paratuberculosis
cugccgaugcugagcgggucggc

SEQ ID NO: 2944571 - RNA, 17 nt, Mycobacterium avium subsp. paratuberculosis
cugccgcaacgggccgc

SEQ ID NO: 2944572 - RNA, 18 nt, Mycobacterium avium subsp. paratuberculosis
cugccgcaacgggccgca

SEQ ID NO: 2944573 - RNA, 20 nt, Mycobacterium avium subsp. paratuberculosis
cugccgcaacgggccgcagc

SEQ ID NO: 2944574 - RNA, 21 nt, Mycobacterium avium subsp. paratuberculosis
cugccgcaccccgugguagac

SEQ ID NO: 2944575 - RNA, 15 nt, Mycobacterium avium subsp. paratuberculosis
cugccgccaccgcga

SEQ ID NO: 2944576 - RNA, 16 nt, Mycobacterium avium subsp. paratuberculosis
cugccgccaccgcgaa

SEQ ID NO: 2944577 - RNA, 17 nt, Mycobacterium avium subsp. paratuberculosis
cugccgcccccgcuggc

SEQ ID NO: 2944578 - RNA, 19 nt, Mycobacterium avium subsp. paratuberculosis
cugccgcccccgcuggcga

SEQ ID NO: 2944579 - RNA, 16 nt, Mycobacterium avium subsp. paratuberculosis
cugccgccgcccaggc

SEQ ID NO: 2944580 - RNA, 17 nt, Mycobacterium avium subsp. paratuberculosis
cugccgccgcccaggcc

SEQ ID NO: 2944581 - RNA, 22 nt, Mycobacterium avium subsp. paratuberculosis
cugccgccgccgcugucgaugg

SEQ ID NO: 2944582 - RNA, 13 nt, Mycobacterium avium subsp. paratuberculosis
cugccgccgccgg

SEQ ID NO: 2944583 - RNA, 13 nt, Mycobacterium avium subsp. paratuberculosis
cugccgccggcga

SEQ ID NO: 2944584 - RNA, 18 nt, Mycobacterium avium subsp. paratuberculosis
cugccgcgacucgguguc

SEQ ID NO: 2944585 - RNA, 19 nt, Mycobacterium avium subsp. paratuberculosis
cugccgcgacucggugucg

SEQ ID NO: 2944586 - RNA, 22 nt, Mycobacterium avium subsp. paratuberculosis
cugccgcgacucggugucgcuc

SEQ ID NO: 2944587 - RNA, 16 nt, Mycobacterium avium subsp. paratuberculosis
cugccgcgccccgagc

SEQ ID NO: 2944588 - RNA, 21 nt, Mycobacterium avium subsp. paratuberculosis
cugccgcgccccgagcagcgg

SEQ ID NO: 2944589 - RNA, 18 nt, Mycobacterium avium subsp. paratuberculosis
cugccgcgcgccgacaga

SEQ ID NO: 2944590 - RNA, 16 nt, Mycobacterium avium subsp. paratuberculosis
cugccgcugcgccggc

SEQ ID NO: 2944591 - RNA, 19 nt, Mycobacterium avium subsp. paratuberculosis
cugccgcugcgccggcgcg

SEQ ID NO: 2944592 - RNA, 16 nt, Mycobacterium avium subsp. paratuberculosis
cugccgcuggcgucga

SEQ ID NO: 2944593 - RNA, 19 nt, Mycobacterium avium subsp. paratuberculosis
cugccgcuggcgucgaucg

SEQ ID NO: 2944594 - RNA, 16 nt, Mycobacterium avium subsp. paratuberculosis
cugcgaccacccggac

SEQ ID NO: 2944595 - RNA, 15 nt, Mycobacterium avium subsp. paratuberculosis
cugcgaccgccgccg

SEQ ID NO: 2944596 - RNA, 21 nt, Mycobacterium avium subsp. paratuberculosis
cugcgaccgccgccgcgacca

SEQ ID NO: 2944597 - RNA, 21 nt, Mycobacterium avium subsp. paratuberculosis
cugcgacgcgaacgcgccccg

SEQ ID NO: 2944598 - RNA, 22 nt, Mycobacterium avium subsp. paratuberculosis
cugcgacuucuacggcgggccg

SEQ ID NO: 2944599 - RNA, 23 nt, Mycobacterium avium subsp. paratuberculosis
cugcgacuucuacggcgggccgg

SEQ ID NO: 2944600 - RNA, 15 nt, Mycobacterium avium subsp. paratuberculosis
cugcgagaucggcag

SEQ ID NO: 2944601 - RNA, 16 nt, Mycobacterium avium subsp. paratuberculosis
cugcgagaugcccacc

SEQ ID NO: 2944602 - RNA, 17 nt, Mycobacterium avium subsp. paratuberculosis
cugcgagaugcccaccc

SEQ ID NO: 2944603 - RNA, 14 nt, Mycobacterium avium subsp. paratuberculosis
cugcgagcacaccc

SEQ ID NO: 2944604 - RNA, 13 nt, Mycobacterium avium subsp. paratuberculosis
cugcgagcccggc

SEQ ID NO: 2944605 - RNA, 14 nt, Mycobacterium avium subsp. paratuberculosis
cugcgaggcgggca

SEQ ID NO: 2944606 - RNA, 16 nt, Mycobacterium avium subsp. paratuberculosis
cugcgaggcgggcaca

SEQ ID NO: 2944607 - RNA, 22 nt, Mycobacterium avium subsp. paratuberculosis
cugcgaggcgggcacacgcggu

SEQ ID NO: 2944608 - RNA, 13 nt, Mycobacterium avium subsp. paratuberculosis
cugcgaucgccga

SEQ ID NO: 2944609 - RNA, 23 nt, Mycobacterium avium subsp. paratuberculosis
cugcgaucgccgacgccagcacg

SEQ ID NO: 2944610 - RNA, 18 nt, Mycobacterium avium subsp. paratuberculosis
cugcgaugauggucaccg

SEQ ID NO: 2944611 - RNA, 20 nt, Mycobacterium avium subsp. paratuberculosis
cugcgaugauggucaccguc

SEQ ID NO: 2944612 - RNA, 19 nt, Mycobacterium avium subsp. paratuberculosis
cugcgcaacaccucggcga

SEQ ID NO: 2944613 - RNA, 22 nt, Mycobacterium avium subsp. paratuberculosis
cugcgcaacaccucggcgacgu

SEQ ID NO: 2944614 - RNA, 13 nt, Mycobacterium avium subsp. paratuberculosis
cugcgcaccgcca

SEQ ID NO: 2944615 - RNA, 20 nt, Mycobacterium avium subsp. paratuberculosis
cugcgcaccgccagcaccga

SEQ ID NO: 2944616 - RNA, 13 nt, Mycobacterium avium subsp. paratuberculosis
cugcgcaccgcgg

SEQ ID NO: 2944617 - RNA, 18 nt, Mycobacterium avium subsp. paratuberculosis
cugcgcacguagcccagc

SEQ ID NO: 2944618 - RNA, 16 nt, Mycobacterium avium subsp. paratuberculosis
cugcgcagcaccgucc

SEQ ID NO: 2944619 - RNA, 16 nt, Mycobacterium avium subsp. paratuberculosis
cugcgcagcagcgcca

SEQ ID NO: 2944620 - RNA, 21 nt, Mycobacterium avium subsp. paratuberculosis
cugcgcagcagcgccagcagc

SEQ ID NO: 2944621 - RNA, 14 nt, Mycobacterium avium subsp. paratuberculosis
cugcgcagccgugc

SEQ ID NO: 2944622 - RNA, 17 nt, Mycobacterium avium subsp. paratuberculosis
cugcgcagcgcagcacc

SEQ ID NO: 2944623 - RNA, 16 nt, Mycobacterium avium subsp. paratuberculosis
cugcgcaucgagcugc

SEQ ID NO: 2944624 - RNA, 12 nt, Mycobacterium avium subsp. paratuberculosis
cugcgccacaac

SEQ ID NO: 2944625 - RNA, 22 nt, Mycobacterium avium subsp. paratuberculosis
cugcgccacaacuggccgggau

SEQ ID NO: 2944626 - RNA, 15 nt, Mycobacterium avium subsp. paratuberculosis
cugcgccagcagcag

SEQ ID NO: 2944627 - RNA, 21 nt, Mycobacterium avium subsp. paratuberculosis
cugcgccagcagcagcgcggc

SEQ ID NO: 2944628 - RNA, 23 nt, Mycobacterium avium subsp. paratuberculosis
cugcgccagcuccagcagcccgg

SEQ ID NO: 2944629 - RNA, 16 nt, Mycobacterium avium subsp. paratuberculosis
cugcgccaggauccgc

SEQ ID NO: 2944630 - RNA, 20 nt, Mycobacterium avium subsp. paratuberculosis
cugcgccaggauccgcccgc

SEQ ID NO: 2944631 - RNA, 17 nt, Mycobacterium avium subsp. paratuberculosis
cugcgcccacaggucca

SEQ ID NO: 2944632 - RNA, 23 nt, Mycobacterium avium subsp. paratuberculosis
cugcgcccacagguccagcgucc

SEQ ID NO: 2944633 - RNA, 15 nt, Mycobacterium avium subsp. paratuberculosis
cugcgcccagcgcgc

SEQ ID NO: 2944634 - RNA, 12 nt, Mycobacterium avium subsp. paratuberculosis
cugcgccccggc

SEQ ID NO: 2944635 - RNA, 14 nt, Mycobacterium avium subsp. paratuberculosis
cugcgccccggcgu

SEQ ID NO: 2944636 - RNA, 15 nt, Mycobacterium avium subsp. paratuberculosis
cugcgccccggcguc

SEQ ID NO: 2944637 - RNA, 17 nt, Mycobacterium avium subsp. paratuberculosis
cugcgccccggcgucga

SEQ ID NO: 2944638 - RNA, 16 nt, Mycobacterium avium subsp. paratuberculosis
cugcgcccgaucggcg

SEQ ID NO: 2944639 - RNA, 19 nt, Mycobacterium avium subsp. paratuberculosis
cugcgcccgaucggcguga

SEQ ID NO: 2944640 - RNA, 15 nt, Mycobacterium avium subsp. paratuberculosis
cugcgcccgccgcca

SEQ ID NO: 2944641 - RNA, 20 nt, Mycobacterium avium subsp. paratuberculosis
cugcgcccgccgccaccacg

SEQ ID NO: 2944642 - RNA, 14 nt, Mycobacterium avium subsp. paratuberculosis
cugcgccgacuuga

SEQ ID NO: 2944643 - RNA, 23 nt, Mycobacterium avium subsp. paratuberculosis
cugcgccgacuugaucgcggcgu

SEQ ID NO: 2944644 - RNA, 14 nt, Mycobacterium avium subsp. paratuberculosis
cugcgccgcggugc

SEQ ID NO: 2944645 - RNA, 23 nt, Mycobacterium avium subsp. paratuberculosis
cugcgccgcggugcgccacgccc

SEQ ID NO: 2944646 - RNA, 16 nt, Mycobacterium avium subsp. paratuberculosis
cugcgccgcgucgacg

SEQ ID NO: 2944647 - RNA, 21 nt, Mycobacterium avium subsp. paratuberculosis
cugcgccggcaacuggccgcc

SEQ ID NO: 2944648 - RNA, 16 nt, Mycobacterium avium subsp. paratuberculosis
cugcgccggcgcggcc

SEQ ID NO: 2944649 - RNA, 18 nt, Mycobacterium avium subsp. paratuberculosis
cugcgccggcgcggccag

SEQ ID NO: 2944650 - RNA, 19 nt, Mycobacterium avium subsp. paratuberculosis
cugcgccggcgcggccagc

SEQ ID NO: 2944651 - RNA, 22 nt, Mycobacterium avium subsp. paratuberculosis
cugcgccggcgguaugcccggg

SEQ ID NO: 2944652 - RNA, 14 nt, Mycobacterium avium subsp. paratuberculosis
cugcgccggcggug

SEQ ID NO: 2944653 - RNA, 18 nt, Mycobacterium avium subsp. paratuberculosis
cugcgccggcggugucga

SEQ ID NO: 2944654 - RNA, 24 nt, Mycobacterium avium subsp. paratuberculosis
cugcgccggcuuucgaagagccgg

SEQ ID NO: 2944655 - RNA, 15 nt, Mycobacterium avium subsp. paratuberculosis
cugcgccggggccgc

SEQ ID NO: 2944656 - RNA, 18 nt, Mycobacterium avium subsp. paratuberculosis
cugcgccggggccgcggc

SEQ ID NO: 2944657 - RNA, 19 nt, Mycobacterium avium subsp. paratuberculosis
cugcgccggggccgcggcu

SEQ ID NO: 2944658 - RNA, 19 nt, Mycobacterium avium subsp. paratuberculosis
cugcgccgucaucgacacc

SEQ ID NO: 2944659 - RNA, 14 nt, Mycobacterium avium subsp. paratuberculosis
cugcgccuuggccu

SEQ ID NO: 2944660 - RNA, 18 nt, Mycobacterium avium subsp. paratuberculosis
cugcgccuuuugcacccg

SEQ ID NO: 2944661 - RNA, 19 nt, Mycobacterium avium subsp. paratuberculosis
cugcgccuuuugcacccgc

SEQ ID NO: 2944662 - RNA, 20 nt, Mycobacterium avium subsp. paratuberculosis
cugcgccuuuugcacccgcc

SEQ ID NO: 2944663 - RNA, 23 nt, Mycobacterium avium subsp. paratuberculosis
cugcgcgaacagcgaagccacgg

SEQ ID NO: 2944664 - RNA, 15 nt, Mycobacterium avium subsp. paratuberculosis
cugcgcgaccaaacg

SEQ ID NO: 2944665 - RNA, 16 nt, Mycobacterium avium subsp. paratuberculosis
cugcgcgaccucuucg

SEQ ID NO: 2944666 - RNA, 15 nt, Mycobacterium avium subsp. paratuberculosis
cugcgcgaccugcuu

SEQ ID NO: 2944667 - RNA, 20 nt, Mycobacterium avium subsp. paratuberculosis
cugcgcgacgaauccgguga

SEQ ID NO: 2944668 - RNA, 19 nt, Mycobacterium avium subsp. paratuberculosis
cugcgcgacgcugauggcg

SEQ ID NO: 2944669 - RNA, 20 nt, Mycobacterium avium subsp. paratuberculosis
cugcgcgacgcugauggcga

SEQ ID NO: 2944670 - RNA, 15 nt, Mycobacterium avium subsp. paratuberculosis
cugcgcgaucgccgg

SEQ ID NO: 2944671 - RNA, 17 nt, Mycobacterium avium subsp. paratuberculosis
cugcgcgaucgccggau

SEQ ID NO: 2944672 - RNA, 18 nt, Mycobacterium avium subsp. paratuberculosis
cugcgcgccccggcccgg

SEQ ID NO: 2944673 - RNA, 20 nt, Mycobacterium avium subsp. paratuberculosis
cugcgcgccccggcccggcg

SEQ ID NO: 2944674 - RNA, 13 nt, Mycobacterium avium subsp. paratuberculosis
cugcgcgcccgag

SEQ ID NO: 2944675 - RNA, 12 nt, Mycobacterium avium subsp. paratuberculosis
cugcgcgccgau

SEQ ID NO: 2944676 - RNA, 22 nt, Mycobacterium avium subsp. paratuberculosis
cugcgcgccgcccucgccgaac

SEQ ID NO: 2944677 - RNA, 13 nt, Mycobacterium avium subsp. paratuberculosis
cugcgcgcggugc

SEQ ID NO: 2944678 - RNA, 19 nt, Mycobacterium avium subsp. paratuberculosis
cugcgggccaggcgggacg

SEQ ID NO: 2944679 - RNA, 18 nt, Mycobacterium avium subsp. paratuberculosis
cugcgggccaucgacucc

SEQ ID NO: 2944680 - RNA, 11 nt, Mycobacterium avium subsp. paratuberculosis
cugcgggccca

SEQ ID NO: 2944681 - RNA, 14 nt, Mycobacterium avium subsp. paratuberculosis
cugcgggcccaccg

SEQ ID NO: 2944682 - RNA, 19 nt, Mycobacterium avium subsp. paratuberculosis
cugcgggcccagcucggug

SEQ ID NO: 2944683 - RNA, 14 nt, Mycobacterium avium subsp. paratuberculosis
cugcgggcgccggc

SEQ ID NO: 2944684 - RNA, 17 nt, Mycobacterium avium subsp. paratuberculosis
cugcgggcgccggcugc

SEQ ID NO: 2944685 - RNA, 18 nt, Mycobacterium avium subsp. paratuberculosis
cugcgggcgccggcugcc

SEQ ID NO: 2944686 - RNA, 14 nt, Mycobacterium avium subsp. paratuberculosis
cugcgggcgggccg

SEQ ID NO: 2944687 - RNA, 16 nt, Mycobacterium avium subsp. paratuberculosis
cugcgggcgggccgcc

SEQ ID NO: 2944688 - RNA, 19 nt, Mycobacterium avium subsp. paratuberculosis
cugcgggcgggccgccagg

SEQ ID NO: 2944689 - RNA, 20 nt, Mycobacterium avium subsp. paratuberculosis
cugcgggcgggccgccaggu

SEQ ID NO: 2944690 - RNA, 21 nt, Mycobacterium avium subsp. paratuberculosis
cugcggggccuucucgccguu

SEQ ID NO: 2944691 - RNA, 15 nt, Mycobacterium avium subsp. paratuberculosis
cugcgggucagcagc

SEQ ID NO: 2944692 - RNA, 13 nt, Mycobacterium avium subsp. paratuberculosis
cugcgggucucgc

SEQ ID NO: 2944693 - RNA, 13 nt, Mycobacterium avium subsp. paratuberculosis
cugcgggugcggc

SEQ ID NO: 2944694 - RNA, 15 nt, Mycobacterium avium subsp. paratuberculosis
cugcgggugcggcca

SEQ ID NO: 2944695 - RNA, 18 nt, Mycobacterium avium subsp. paratuberculosis
cugcgggugcggccagcg

SEQ ID NO: 2944696 - RNA, 20 nt, Mycobacterium avium subsp. paratuberculosis
cugcgggugcggccagcgca

SEQ ID NO: 2944697 - RNA, 23 nt, Mycobacterium avium subsp. paratuberculosis
cugcggguugcgggccaggcacg

SEQ ID NO: 2944698 - RNA, 19 nt, Mycobacterium avium subsp. paratuberculosis
cugcgguacacguggccga

SEQ ID NO: 2944699 - RNA, 17 nt, Mycobacterium avium subsp. paratuberculosis
cugcgguagaggcgggc

SEQ ID NO: 2944700 - RNA, 17 nt, Mycobacterium avium subsp. paratuberculosis
cugcgguaugccaagcc

SEQ ID NO: 2944701 - RNA, 19 nt, Mycobacterium avium subsp. paratuberculosis
cugcggugagcugaucgcg

SEQ ID NO: 2944702 - RNA, 19 nt, Mycobacterium avium subsp. paratuberculosis
cugcggugaugcgcggcga

SEQ ID NO: 2944703 - RNA, 14 nt, Mycobacterium avium subsp. paratuberculosis
cugcggugggcgcu

SEQ ID NO: 2944704 - RNA, 18 nt, Mycobacterium avium subsp. paratuberculosis
cugcggugugggcagcca

SEQ ID NO: 2944705 - RNA, 17 nt, Mycobacterium avium subsp. paratuberculosis
cugcgguucacaaaggc

SEQ ID NO: 2944706 - RNA, 17 nt, Mycobacterium avium subsp. paratuberculosis
cugcgguuccgggcgcu

SEQ ID NO: 2944707 - RNA, 15 nt, Mycobacterium avium subsp. paratuberculosis
cugcgguucgggccc

SEQ ID NO: 2944708 - RNA, 16 nt, Mycobacterium avium subsp. paratuberculosis
cugcgguucgggcccc

SEQ ID NO: 2944709 - RNA, 18 nt, Mycobacterium avium subsp. paratuberculosis
cugcgguucgggccccau

SEQ ID NO: 2944710 - RNA, 17 nt, Mycobacterium avium subsp. paratuberculosis
cugcgguucgucgcggc

SEQ ID NO: 2944711 - RNA, 18 nt, Mycobacterium avium subsp. paratuberculosis
cugcgguuggccggccgg

SEQ ID NO: 2944712 - RNA, 20 nt, Mycobacterium avium subsp. paratuberculosis
cugcgguuggccggccgggc

SEQ ID NO: 2944713 - RNA, 16 nt, Mycobacterium avium subsp. paratuberculosis
cugcgucacuccucga

SEQ ID NO: 2944714 - RNA, 15 nt, Mycobacterium avium subsp. paratuberculosis
cugcgucaucggcuc

SEQ ID NO: 2944715 - RNA, 14 nt, Mycobacterium avium subsp. paratuberculosis
cugcgucaugccgu

SEQ ID NO: 2944716 - RNA, 21 nt, Mycobacterium avium subsp. paratuberculosis
cugcgucauggagaucaccgc

SEQ ID NO: 2944717 - RNA, 21 nt, Mycobacterium avium subsp. paratuberculosis
cugcguccgauaccagccgcg

SEQ ID NO: 2944718 - RNA, 14 nt, Mycobacterium avium subsp. paratuberculosis
cugcguccggcccg

SEQ ID NO: 2944719 - RNA, 17 nt, Mycobacterium avium subsp. paratuberculosis
cugcguccggcccggcg

SEQ ID NO: 2944720 - RNA, 18 nt, Mycobacterium avium subsp. paratuberculosis
cugcguccggcccggcgu

SEQ ID NO: 2944721 - RNA, 17 nt, Mycobacterium avium subsp. paratuberculosis
cugcgucggcaccagcg

SEQ ID NO: 2944722 - RNA, 14 nt, Mycobacterium avium subsp. paratuberculosis
cugcgugcgggugg

SEQ ID NO: 2944723 - RNA, 14 nt, Mycobacterium avium subsp. paratuberculosis
cugcgugcugggca

SEQ ID NO: 2944724 - RNA, 18 nt, Mycobacterium avium subsp. paratuberculosis
cugcgugcugggcaccgu

SEQ ID NO: 2944725 - RNA, 12 nt, Mycobacterium avium subsp. paratuberculosis
cugcguguggcg

SEQ ID NO: 2944726 - RNA, 15 nt, Mycobacterium avium subsp. paratuberculosis
cugcguucggcgauc

SEQ ID NO: 2944727 - RNA, 23 nt, Mycobacterium avium subsp. paratuberculosis
cugcuaccuagcuugggugagcu

SEQ ID NO: 2944728 - RNA, 13 nt, Mycobacterium avium subsp. paratuberculosis
cugcucagcggcc

SEQ ID NO: 2944729 - RNA, 14 nt, Mycobacterium avium subsp. paratuberculosis
cugcucccaggacg

SEQ ID NO: 2944730 - RNA, 17 nt, Mycobacterium avium subsp. paratuberculosis
cugcucccaggacggcg

SEQ ID NO: 2944731 - RNA, 21 nt, Mycobacterium avium subsp. paratuberculosis
cugcucccaggacggcgcggu

SEQ ID NO: 2944732 - RNA, 14 nt, Mycobacterium avium subsp. paratuberculosis
cugcucccaggcgu

SEQ ID NO: 2944733 - RNA, 18 nt, Mycobacterium avium subsp. paratuberculosis
cugcuccgggggcaccgc

SEQ ID NO: 2944734 - RNA, 19 nt, Mycobacterium avium subsp. paratuberculosis
cugcuccgggggcaccgcc

SEQ ID NO: 2944735 - RNA, 23 nt, Mycobacterium avium subsp. paratuberculosis
cugcuccggguccgcggugaugc

SEQ ID NO: 2944736 - RNA, 23 nt, Mycobacterium avium subsp. paratuberculosis
cugcuccggugaaccgcugacca

SEQ ID NO: 2944737 - RNA, 22 nt, Mycobacterium avium subsp. paratuberculosis
cugcuccucgaaccucgcggcg

SEQ ID NO: 2944738 - RNA, 18 nt, Mycobacterium avium subsp. paratuberculosis
cugcucgaaccgcgagac

SEQ ID NO: 2944739 - RNA, 21 nt, Mycobacterium avium subsp. paratuberculosis
cugcucgaaggcaacucgcga

SEQ ID NO: 2944740 - RNA, 13 nt, Mycobacterium avium subsp. paratuberculosis
cugcucgaccagc

SEQ ID NO: 2944741 - RNA, 16 nt, Mycobacterium avium subsp. paratuberculosis
cugcucgaccagcccc

SEQ ID NO: 2944742 - RNA, 14 nt, Mycobacterium avium subsp. paratuberculosis
cugcucgaccagcg

SEQ ID NO: 2944743 - RNA, 17 nt, Mycobacterium avium subsp. paratuberculosis
cugcucgaccucggcga

SEQ ID NO: 2944744 - RNA, 23 nt, Mycobacterium avium subsp. paratuberculosis
cugcucgaccucggcgaccagcg

SEQ ID NO: 2944745 - RNA, 22 nt, Mycobacterium avium subsp. paratuberculosis
cugcucgagcaucuccagccgg

SEQ ID NO: 2944746 - RNA, 13 nt, Mycobacterium avium subsp. paratuberculosis
cugcucgagggcc

SEQ ID NO: 2944747 - RNA, 17 nt, Mycobacterium avium subsp. paratuberculosis
cugcucgagggccucca

SEQ ID NO: 2944748 - RNA, 22 nt, Mycobacterium avium subsp. paratuberculosis
cugcucgagggccuccaccacc

SEQ ID NO: 2944749 - RNA, 20 nt, Mycobacterium avium subsp. paratuberculosis
cugcucgaucucggccaccg

SEQ ID NO: 2944750 - RNA, 20 nt, Mycobacterium avium subsp. paratuberculosis
cugcucgaugcgcgccagca

SEQ ID NO: 2944751 - RNA, 23 nt, Mycobacterium avium subsp. paratuberculosis
cugcucgcagauggucgggacgu

SEQ ID NO: 2944752 - RNA, 15 nt, Mycobacterium avium subsp. paratuberculosis
cugcucgccggcuac

SEQ ID NO: 2944753 - RNA, 17 nt, Mycobacterium avium subsp. paratuberculosis
cugcucgccggcuaccg

SEQ ID NO: 2944754 - RNA, 17 nt, Mycobacterium avium subsp. paratuberculosis
cugcucgcgauuggccu

SEQ ID NO: 2944755 - RNA, 18 nt, Mycobacterium avium subsp. paratuberculosis
cugcucgcuugccagccg

SEQ ID NO: 2944756 - RNA, 22 nt, Mycobacterium avium subsp. paratuberculosis
cugcucgcuugccagccgggcc

SEQ ID NO: 2944757 - RNA, 20 nt, Mycobacterium avium subsp. paratuberculosis
cugcucggaggaaccgugcg

SEQ ID NO: 2944758 - RNA, 22 nt, Mycobacterium avium subsp. paratuberculosis
cugcucggaggaaccgugcguc

SEQ ID NO: 2944759 - RNA, 24 nt, Mycobacterium avium subsp. paratuberculosis
cugcucggccaccgcgcggugcac

SEQ ID NO: 2944760 - RNA, 23 nt, Mycobacterium avium subsp. paratuberculosis
cugcucggcgacgcugugcucgg

SEQ ID NO: 2944761 - RNA, 15 nt, Mycobacterium avium subsp. paratuberculosis
cugcucggcggcuca

SEQ ID NO: 2944762 - RNA, 23 nt, Mycobacterium avium subsp. paratuberculosis
cuggaagcgcaucgccggcgcgc

SEQ ID NO: 2944763 - RNA, 22 nt, Mycobacterium avium subsp. paratuberculosis
cuggaaggacgucaggccgguc

SEQ ID NO: 2944764 - RNA, 16 nt, Mycobacterium avium subsp. paratuberculosis
cuggaaguucgcuggc

SEQ ID NO: 2944765 - RNA, 23 nt, Mycobacterium avium subsp. paratuberculosis
cuggaauaccuugccggagugcg

SEQ ID NO: 2944766 - RNA, 19 nt, Mycobacterium avium subsp. paratuberculosis
cuggacagccacagcucgg

SEQ ID NO: 2944767 - RNA, 22 nt, Mycobacterium avium subsp. paratuberculosis
cuggacagggucguucagcuga

SEQ ID NO: 2944768 - RNA, 21 nt, Mycobacterium avium subsp. paratuberculosis
cuggacauucacgaggccggg

SEQ ID NO: 2944769 - RNA, 22 nt, Mycobacterium avium subsp. paratuberculosis
cuggacauucacgaggccgggc

SEQ ID NO: 2944770 - RNA, 16 nt, Mycobacterium avium subsp. paratuberculosis
cuggacgccgcacgcg

SEQ ID NO: 2944771 - RNA, 21 nt, Mycobacterium avium subsp. paratuberculosis
cuggacgccgcacgcgaccgc

SEQ ID NO: 2944772 - RNA, 19 nt, Mycobacterium avium subsp. paratuberculosis
cuggacggcccgacgacgc

SEQ ID NO: 2944773 - RNA, 18 nt, Mycobacterium avium subsp. paratuberculosis
cuggacgguuucaccgcc

SEQ ID NO: 2944774 - RNA, 19 nt, Mycobacterium avium subsp. paratuberculosis
cuggacgguuucaccgccg

SEQ ID NO: 2944775 - RNA, 22 nt, Mycobacterium avium subsp. paratuberculosis
cuggacgguuucaccgccgucc

SEQ ID NO: 2944776 - RNA, 14 nt, Mycobacterium avium subsp. paratuberculosis
cuggacgucgucgc

SEQ ID NO: 2944777 - RNA, 16 nt, Mycobacterium avium subsp. paratuberculosis
cuggacgucgucgcug

SEQ ID NO: 2944778 - RNA, 17 nt, Mycobacterium avium subsp. paratuberculosis
cuggacgucgucgcugu

SEQ ID NO: 2944779 - RNA, 23 nt, Mycobacterium avium subsp. paratuberculosis
cuggacgucgucgcuguccucga

SEQ ID NO: 2944780 - RNA, 20 nt, Mycobacterium avium subsp. paratuberculosis
cuggacguuggggugguugu

SEQ ID NO: 2944781 - RNA, 17 nt, Mycobacterium avium subsp. paratuberculosis
cuggagaggcccggcag

SEQ ID NO: 2944782 - RNA, 21 nt, Mycobacterium avium subsp. paratuberculosis
cuggagaggcccggcagccgg

SEQ ID NO: 2944783 - RNA, 13 nt, Mycobacterium avium subsp. paratuberculosis
cuggaggccaacg

SEQ ID NO: 2944784 - RNA, 18 nt, Mycobacterium avium subsp. paratuberculosis
cuggaggccaacgagcgc

SEQ ID NO: 2944785 - RNA, 22 nt, Mycobacterium avium subsp. paratuberculosis
cuggaggccaacgagcgcgccg

SEQ ID NO: 2944786 - RNA, 17 nt, Mycobacterium avium subsp. paratuberculosis
cuggaguaggugcccga

SEQ ID NO: 2944787 - RNA, 19 nt, Mycobacterium avium subsp. paratuberculosis
cuggaguaggugcccgagc

SEQ ID NO: 2944788 - RNA, 13 nt, Mycobacterium avium subsp. paratuberculosis
cuggagugcugca

SEQ ID NO: 2944789 - RNA, 17 nt, Mycobacterium avium subsp. paratuberculosis
cuggagugcugcagacc

SEQ ID NO: 2944790 - RNA, 19 nt, Mycobacterium avium subsp. paratuberculosis
cuggagugcugcagaccga

SEQ ID NO: 2944791 - RNA, 22 nt, Mycobacterium avium subsp. paratuberculosis
cuggauccccucacuccagcgg

SEQ ID NO: 2944792 - RNA, 19 nt, Mycobacterium avium subsp. paratuberculosis
cuggaucgcgcaggugaug

SEQ ID NO: 2944793 - RNA, 13 nt, Mycobacterium avium subsp. paratuberculosis
cuggaugaacagc

SEQ ID NO: 2944794 - RNA, 14 nt, Mycobacterium avium subsp. paratuberculosis
cuggaugaacagca

SEQ ID NO: 2944795 - RNA, 23 nt, Mycobacterium avium subsp. paratuberculosis
cuggaugaacagcacgugcccgc

SEQ ID NO: 2944796 - RNA, 16 nt, Mycobacterium avium subsp. paratuberculosis
cuggaugaaggucgcg

SEQ ID NO: 2944797 - RNA, 17 nt, Mycobacterium avium subsp. paratuberculosis
cuggaugaaggucgcgg

SEQ ID NO: 2944798 - RNA, 18 nt, Mycobacterium avium subsp. paratuberculosis
cuggaugaaggucgcgga

SEQ ID NO: 2944799 - RNA, 23 nt, Mycobacterium avium subsp. paratuberculosis
cuggaugaucgucucggccgcgg

SEQ ID NO: 2944800 - RNA, 14 nt, Mycobacterium avium subsp. paratuberculosis
cuggaugcccaggg

SEQ ID NO: 2944801 - RNA, 15 nt, Mycobacterium avium subsp. paratuberculosis
cuggaugcccagggc

SEQ ID NO: 2944802 - RNA, 22 nt, Mycobacterium avium subsp. paratuberculosis
cuggaugcccagggcgcgucca

SEQ ID NO: 2944803 - RNA, 24 nt, Mycobacterium avium subsp. paratuberculosis
cuggaugccgcccuugcucgcggc

SEQ ID NO: 2944804 - RNA, 14 nt, Mycobacterium avium subsp. paratuberculosis
cuggaugccguagg

SEQ ID NO: 2944805 - RNA, 15 nt, Mycobacterium avium subsp. paratuberculosis
cuggaugcgccgugc

SEQ ID NO: 2944806 - RNA, 14 nt, Mycobacterium avium subsp. paratuberculosis
cuggaugcggucgu

SEQ ID NO: 2944807 - RNA, 16 nt, Mycobacterium avium subsp. paratuberculosis
cuggaugcggucgucg

SEQ ID NO: 2944808 - RNA, 17 nt, Mycobacterium avium subsp. paratuberculosis
cuggaugcggucgucgc

SEQ ID NO: 2944809 - RNA, 23 nt, Mycobacterium avium subsp. paratuberculosis
cuggaugcggucgucgcccaccg

SEQ ID NO: 2944810 - RNA, 17 nt, Mycobacterium avium subsp. paratuberculosis
cuggauggcgcccagcc

SEQ ID NO: 2944811 - RNA, 14 nt, Mycobacterium avium subsp. paratuberculosis
cuggauggucucgc

SEQ ID NO: 2944812 - RNA, 19 nt, Mycobacterium avium subsp. paratuberculosis
cuggauggucucgcgcacc

SEQ ID NO: 2944813 - RNA, 20 nt, Mycobacterium avium subsp. paratuberculosis
cuggauguccaggccgucga

SEQ ID NO: 2944814 - RNA, 22 nt, Mycobacterium avium subsp. paratuberculosis
cuggcaacguccucgaggguuu

SEQ ID NO: 2944815 - RNA, 15 nt, Mycobacterium avium subsp. paratuberculosis
cuggcacgacgccgc

SEQ ID NO: 2944816 - RNA, 17 nt, Mycobacterium avium subsp. paratuberculosis
cuggcacgacgccgccg

SEQ ID NO: 2944817 - RNA, 15 nt, Mycobacterium avium subsp. paratuberculosis
cuggcacggcugcuc

SEQ ID NO: 2944818 - RNA, 16 nt, Mycobacterium avium subsp. paratuberculosis
cuggcacggcugcucc

SEQ ID NO: 2944819 - RNA, 20 nt, Mycobacterium avium subsp. paratuberculosis
cuggcacuccuugcugucgg

SEQ ID NO: 2944820 - RNA, 16 nt, Mycobacterium avium subsp. paratuberculosis
cuggcagccggccggc

SEQ ID NO: 2944821 - RNA, 18 nt, Mycobacterium avium subsp. paratuberculosis
cuggcagccggccggcag

SEQ ID NO: 2944822 - RNA, 14 nt, Mycobacterium avium subsp. paratuberculosis
cuggcagcugccga

SEQ ID NO: 2944823 - RNA, 22 nt, Mycobacterium avium subsp. paratuberculosis
cuggcaggacgggcaccaguag

SEQ ID NO: 2944824 - RNA, 14 nt, Mycobacterium avium subsp. paratuberculosis
cuggcaggucgcgc

SEQ ID NO: 2944825 - RNA, 16 nt, Mycobacterium avium subsp. paratuberculosis
cuggcaggucgcgccg

SEQ ID NO: 2944826 - RNA, 19 nt, Mycobacterium avium subsp. paratuberculosis
cuggcaggugagccgggug

SEQ ID NO: 2944827 - RNA, 21 nt, Mycobacterium avium subsp. paratuberculosis
cuggcaggugagccgggugcc

SEQ ID NO: 2944828 - RNA, 16 nt, Mycobacterium avium subsp. paratuberculosis
cuggcaucgucggcgc

SEQ ID NO: 2944829 - RNA, 18 nt, Mycobacterium avium subsp. paratuberculosis
cuggcaugccggaacacc

SEQ ID NO: 2944830 - RNA, 12 nt, Mycobacterium avium subsp. paratuberculosis
cuggccaccagc

SEQ ID NO: 2944831 - RNA, 16 nt, Mycobacterium avium subsp. paratuberculosis
cuggccaccagcagca

SEQ ID NO: 2944832 - RNA, 16 nt, Mycobacterium avium subsp. paratuberculosis
cuggccaccgaagccg

SEQ ID NO: 2944833 - RNA, 18 nt, Mycobacterium avium subsp. paratuberculosis
cuggccaccgcaucgccg

SEQ ID NO: 2944834 - RNA, 19 nt, Mycobacterium avium subsp. paratuberculosis
cuggccaccgcaucgccga

SEQ ID NO: 2944835 - RNA, 18 nt, Mycobacterium avium subsp. paratuberculosis
cuggccaccucgacggcg

SEQ ID NO: 2944836 - RNA, 18 nt, Mycobacterium avium subsp. paratuberculosis
cuggccacgauccggggc

SEQ ID NO: 2944837 - RNA, 20 nt, Mycobacterium avium subsp. paratuberculosis
cuggccacgauccggggcag

SEQ ID NO: 2944838 - RNA, 15 nt, Mycobacterium avium subsp. paratuberculosis
cuggccagcaccagc

SEQ ID NO: 2944839 - RNA, 17 nt, Mycobacterium avium subsp. paratuberculosis
cuggccagcaccagcgc

SEQ ID NO: 2944840 - RNA, 19 nt, Mycobacterium avium subsp. paratuberculosis
cuggccagcaccagcgcgc

SEQ ID NO: 2944841 - RNA, 20 nt, Mycobacterium avium subsp. paratuberculosis
cuggccagcaccagcgcgcg

SEQ ID NO: 2944842 - RNA, 22 nt, Mycobacterium avium subsp. paratuberculosis
cuggccagcaccagcgcgcggg

SEQ ID NO: 2944843 - RNA, 14 nt, Mycobacterium avium subsp. paratuberculosis
cuggccagcaccgc

SEQ ID NO: 2944844 - RNA, 13 nt, Mycobacterium avium subsp. paratuberculosis
cuggccagcgcga

SEQ ID NO: 2944845 - RNA, 13 nt, Mycobacterium avium subsp. paratuberculosis
cuggccaggcuca

SEQ ID NO: 2944846 - RNA, 21 nt, Mycobacterium avium subsp. paratuberculosis
cuggcgaucaccuugcggccg

SEQ ID NO: 2944847 - RNA, 20 nt, Mycobacterium avium subsp. paratuberculosis
cuggcgaucaucgucgucac

SEQ ID NO: 2944848 - RNA, 16 nt, Mycobacterium avium subsp. paratuberculosis
cuggcgauggugccga

SEQ ID NO: 2944849 - RNA, 19 nt, Mycobacterium avium subsp. paratuberculosis
cuggcgauggugccgaagc

SEQ ID NO: 2944850 - RNA, 22 nt, Mycobacterium avium subsp. paratuberculosis
cuggcgauggugccgaagcgcc

SEQ ID NO: 2944851 - RNA, 14 nt, Mycobacterium avium subsp. paratuberculosis
cuggcgcaccgccg

SEQ ID NO: 2944852 - RNA, 15 nt, Mycobacterium avium subsp. paratuberculosis
cuggcgcaccgggac

SEQ ID NO: 2944853 - RNA, 17 nt, Mycobacterium avium subsp. paratuberculosis
cuggcgcagcaccgacu

SEQ ID NO: 2944854 - RNA, 19 nt, Mycobacterium avium subsp. paratuberculosis
cuggcgcagcaccgacucc

SEQ ID NO: 2944855 - RNA, 23 nt, Mycobacterium avium subsp. paratuberculosis
cuggcgcagcaccgacuccuccg

SEQ ID NO: 2944856 - RNA, 20 nt, Mycobacterium avium subsp. paratuberculosis
cuggcgcagcgucaacggcu

SEQ ID NO: 2944857 - RNA, 13 nt, Mycobacterium avium subsp. paratuberculosis
cuggcgcaggcgc

SEQ ID NO: 2944858 - RNA, 17 nt, Mycobacterium avium subsp. paratuberculosis
cuggcgcagggcguucg

SEQ ID NO: 2944859 - RNA, 13 nt, Mycobacterium avium subsp. paratuberculosis
cuggcgcaucagc

SEQ ID NO: 2944860 - RNA, 23 nt, Mycobacterium avium subsp. paratuberculosis
cuggcgcaucagcggggcgucca

SEQ ID NO: 2944861 - RNA, 12 nt, Mycobacterium avium subsp. paratuberculosis
cuggcgccgaac

SEQ ID NO: 2944862 - RNA, 18 nt, Mycobacterium avium subsp. paratuberculosis
cuggcgcuccagccacuc

SEQ ID NO: 2944863 - RNA, 16 nt, Mycobacterium avium subsp. paratuberculosis
cuggcgcugccagucg

SEQ ID NO: 2944864 - RNA, 16 nt, Mycobacterium avium subsp. paratuberculosis
cuggcgcugcucggag

SEQ ID NO: 2944865 - RNA, 20 nt, Mycobacterium avium subsp. paratuberculosis
cuggcgcugggagcgggcca

SEQ ID NO: 2944866 - RNA, 14 nt, Mycobacterium avium subsp. paratuberculosis
cuggcgcuggugca

SEQ ID NO: 2944867 - RNA, 22 nt, Mycobacterium avium subsp. paratuberculosis
cuggcgcuugcguucccagccc

SEQ ID NO: 2944868 - RNA, 14 nt, Mycobacterium avium subsp. paratuberculosis
cuggcggaaggccg

SEQ ID NO: 2944869 - RNA, 17 nt, Mycobacterium avium subsp. paratuberculosis
cuggcggaaggccgcgc

SEQ ID NO: 2944870 - RNA, 19 nt, Mycobacterium avium subsp. paratuberculosis
cuggcggaaggccgcgcgg

SEQ ID NO: 2944871 - RNA, 24 nt, Mycobacterium avium subsp. paratuberculosis
cuggcggacccgcucccgggacag

SEQ ID NO: 2944872 - RNA, 13 nt, Mycobacterium avium subsp. paratuberculosis
cuggcggauggcg

SEQ ID NO: 2944873 - RNA, 14 nt, Mycobacterium avium subsp. paratuberculosis
cuggcggauggcgc

SEQ ID NO: 2944874 - RNA, 15 nt, Mycobacterium avium subsp. paratuberculosis
cuggcggauggcgcc

SEQ ID NO: 2944875 - RNA, 19 nt, Mycobacterium avium subsp. paratuberculosis
cuggcggcaacggccauga

SEQ ID NO: 2944876 - RNA, 16 nt, Mycobacterium avium subsp. paratuberculosis
cuggcggccaucgccg

SEQ ID NO: 2944877 - RNA, 12 nt, Mycobacterium avium subsp. paratuberculosis
cuggcggccggc

SEQ ID NO: 2944878 - RNA, 13 nt, Mycobacterium avium subsp. paratuberculosis
cuggcggccuucu

SEQ ID NO: 2944879 - RNA, 14 nt, Mycobacterium avium subsp. paratuberculosis
cuggcggccuucuu

SEQ ID NO: 2944880 - RNA, 14 nt, Mycobacterium avium subsp. paratuberculosis
cuggcggcgacccg

SEQ ID NO: 2944881 - RNA, 13 nt, Mycobacterium avium subsp. paratuberculosis
cuggcggcgauca

SEQ ID NO: 2944882 - RNA, 18 nt, Mycobacterium avium subsp. paratuberculosis
cuggcggcgaucaccgcc

SEQ ID NO: 2944883 - RNA, 23 nt, Mycobacterium avium subsp. paratuberculosis
cuggcggcgaucaccgccgcggc

SEQ ID NO: 2944884 - RNA, 19 nt, Mycobacterium avium subsp. paratuberculosis
cuggcgggcgaagcgaaag

SEQ ID NO: 2944885 - RNA, 21 nt, Mycobacterium avium subsp. paratuberculosis
cuggcgggcgaucgccucggc

SEQ ID NO: 2944886 - RNA, 14 nt, Mycobacterium avium subsp. paratuberculosis
cuggcgggcggccc

SEQ ID NO: 2944887 - RNA, 18 nt, Mycobacterium avium subsp. paratuberculosis
cuggcgggcggcccgcac

SEQ ID NO: 2944888 - RNA, 16 nt, Mycobacterium avium subsp. paratuberculosis
cuggcgggcgguccag

SEQ ID NO: 2944889 - RNA, 17 nt, Mycobacterium avium subsp. paratuberculosis
cuggcggguacagccgc

SEQ ID NO: 2944890 - RNA, 22 nt, Mycobacterium avium subsp. paratuberculosis
cuggcggguguucagccccucg

SEQ ID NO: 2944891 - RNA, 23 nt, Mycobacterium avium subsp. paratuberculosis
cuggcggucgcugaccccgcucg

SEQ ID NO: 2944892 - RNA, 17 nt, Mycobacterium avium subsp. paratuberculosis
cuggcgguuggacaggc

SEQ ID NO: 2944893 - RNA, 22 nt, Mycobacterium avium subsp. paratuberculosis
cuggcgguuggacaggccggcg

SEQ ID NO: 2944894 - RNA, 17 nt, Mycobacterium avium subsp. paratuberculosis
cuggcguagagccgcuc

SEQ ID NO: 2944895 - RNA, 19 nt, Mycobacterium avium subsp. paratuberculosis
cuggcguagagccgcucgc

SEQ ID NO: 2944896 - RNA, 20 nt, Mycobacterium avium subsp. paratuberculosis
cuggcguagaucugcacgcu

SEQ ID NO: 2944897 - RNA, 22 nt, Mycobacterium avium subsp. paratuberculosis
cuggcguagaucugcacgcugu

SEQ ID NO: 2944898 - RNA, 16 nt, Mycobacterium avium subsp. paratuberculosis
cuggcguccaggucgc

SEQ ID NO: 2944899 - RNA, 21 nt, Mycobacterium avium subsp. paratuberculosis
cuggcguccaggucgcccucg

SEQ ID NO: 2944900 - RNA, 14 nt, Mycobacterium avium subsp. paratuberculosis
cuggcgucgaacgu

SEQ ID NO: 2944901 - RNA, 17 nt, Mycobacterium avium subsp. paratuberculosis
cuggcgucgggcuugcg

SEQ ID NO: 2944902 - RNA, 20 nt, Mycobacterium avium subsp. paratuberculosis
cuggcgucguuggcgccguc

SEQ ID NO: 2944903 - RNA, 22 nt, Mycobacterium avium subsp. paratuberculosis
cuggcgugaaucuuggccagca

SEQ ID NO: 2944904 - RNA, 22 nt, Mycobacterium avium subsp. paratuberculosis
cuggcgugacacucggucaccg

SEQ ID NO: 2944905 - RNA, 15 nt, Mycobacterium avium subsp. paratuberculosis
cuggcgugacgcucg

SEQ ID NO: 2944906 - RNA, 16 nt, Mycobacterium avium subsp. paratuberculosis
cuggcgugacgcucga

SEQ ID NO: 2944907 - RNA, 17 nt, Mycobacterium avium subsp. paratuberculosis
cuggcgugacgcucgac

SEQ ID NO: 2944908 - RNA, 23 nt, Mycobacterium avium subsp. paratuberculosis
cuggcgugacgcucgacggccgg

SEQ ID NO: 2944909 - RNA, 18 nt, Mycobacterium avium subsp. paratuberculosis
cuggcgugacgcucgagg

SEQ ID NO: 2944910 - RNA, 18 nt, Mycobacterium avium subsp. paratuberculosis
cuggcgugacgcucgccg

SEQ ID NO: 2944911 - RNA, 20 nt, Mycobacterium avium subsp. paratuberculosis
cuggcgugacgcucgccggc

SEQ ID NO: 2944912 - RNA, 22 nt, Mycobacterium avium subsp. paratuberculosis
cuggcgugacgcucgccggcgg

SEQ ID NO: 2944913 - RNA, 16 nt, Mycobacterium avium subsp. paratuberculosis
cuggcgugacgcucgg

SEQ ID NO: 2944914 - RNA, 17 nt, Mycobacterium avium subsp. paratuberculosis
cuggcgugacgcucggc

SEQ ID NO: 2944915 - RNA, 18 nt, Mycobacterium avium subsp. paratuberculosis
cuggcgugacgcucggcc

SEQ ID NO: 2944916 - RNA, 22 nt, Mycobacterium avium subsp. paratuberculosis
cuggcgugacgcucggccgugg

SEQ ID NO: 2944917 - RNA, 23 nt, Mycobacterium avium subsp. paratuberculosis
cuggcgugacgcucggccguggc

SEQ ID NO: 2944918 - RNA, 20 nt, Mycobacterium avium subsp. paratuberculosis
cuggcgugacgcucggcgcc

SEQ ID NO: 2944919 - RNA, 21 nt, Mycobacterium avium subsp. paratuberculosis
cuggcgugacgcucggcgccg

SEQ ID NO: 2944920 - RNA, 22 nt, Mycobacterium avium subsp. paratuberculosis
cuggcgugacgcucggcgccgc

SEQ ID NO: 2944921 - RNA, 23 nt, Mycobacterium avium subsp. paratuberculosis
cuggcgugacgcucggcgccggc

SEQ ID NO: 2944922 - RNA, 16 nt, Mycobacterium avium subsp. paratuberculosis
cuggcgugacggucga

SEQ ID NO: 2944923 - RNA, 19 nt, Mycobacterium avium subsp. paratuberculosis
cuggcgugacggucgaccu

SEQ ID NO: 2944924 - RNA, 18 nt, Mycobacterium avium subsp. paratuberculosis
cuggcgugacguucguca

SEQ ID NO: 2944925 - RNA, 17 nt, Mycobacterium avium subsp. paratuberculosis
cuggcgugcggcgcggu

SEQ ID NO: 2944926 - RNA, 20 nt, Mycobacterium avium subsp. paratuberculosis
cuggcgugcuugaacgccgc

SEQ ID NO: 2944927 - RNA, 22 nt, Mycobacterium avium subsp. paratuberculosis
cuggcgugcuugaacgccgccc

SEQ ID NO: 2944928 - RNA, 20 nt, Mycobacterium avium subsp. paratuberculosis
cuggcguggcgccggcgcgc

SEQ ID NO: 2944929 - RNA, 21 nt, Mycobacterium avium subsp. paratuberculosis
cuggcguggcgccggcgcgcg

SEQ ID NO: 2944930 - RNA, 15 nt, Mycobacterium avium subsp. paratuberculosis
cugggcggcgcgcug

SEQ ID NO: 2944931 - RNA, 19 nt, Mycobacterium avium subsp. paratuberculosis
cugggcggcgcgcugcggc

SEQ ID NO: 2944932 - RNA, 19 nt, Mycobacterium avium subsp. paratuberculosis
cugggcggcgcggcggucg

SEQ ID NO: 2944933 - RNA, 13 nt, Mycobacterium avium subsp. paratuberculosis
cugggcggcggcg

SEQ ID NO: 2944934 - RNA, 16 nt, Mycobacterium avium subsp. paratuberculosis
cugggcggcggcggga

SEQ ID NO: 2944935 - RNA, 15 nt, Mycobacterium avium subsp. paratuberculosis
cugggcgggcagccg

SEQ ID NO: 2944936 - RNA, 17 nt, Mycobacterium avium subsp. paratuberculosis
cugggcgggcucgagcc

SEQ ID NO: 2944937 - RNA, 22 nt, Mycobacterium avium subsp. paratuberculosis
cugggcgggcucgagccccagu

SEQ ID NO: 2944938 - RNA, 14 nt, Mycobacterium avium subsp. paratuberculosis
cugggcguacagcg

SEQ ID NO: 2944939 - RNA, 17 nt, Mycobacterium avium subsp. paratuberculosis
cugggcguacagcggcg

SEQ ID NO: 2944940 - RNA, 20 nt, Mycobacterium avium subsp. paratuberculosis
cugggcguacagcggcgcca

SEQ ID NO: 2944941 - RNA, 23 nt, Mycobacterium avium subsp. paratuberculosis
cugggcguacugcucggcgcggc

SEQ ID NO: 2944942 - RNA, 14 nt, Mycobacterium avium subsp. paratuberculosis
cugggcgucggcgc

SEQ ID NO: 2944943 - RNA, 14 nt, Mycobacterium avium subsp. paratuberculosis
cugggcgucgucgg

SEQ ID NO: 2944944 - RNA, 19 nt, Mycobacterium avium subsp. paratuberculosis
cugggcgucgucggccggc

SEQ ID NO: 2944945 - RNA, 14 nt, Mycobacterium avium subsp. paratuberculosis
cugggcguggugcg

SEQ ID NO: 2944946 - RNA, 20 nt, Mycobacterium avium subsp. paratuberculosis
cugggcguugccggucucga

SEQ ID NO: 2944947 - RNA, 15 nt, Mycobacterium avium subsp. paratuberculosis
cugggcuggccgucc

SEQ ID NO: 2944948 - RNA, 16 nt, Mycobacterium avium subsp. paratuberculosis
cugggcuggccguccg

SEQ ID NO: 2944949 - RNA, 18 nt, Mycobacterium avium subsp. paratuberculosis
cuggggcagaucgucggc

SEQ ID NO: 2944950 - RNA, 13 nt, Mycobacterium avium subsp. paratuberculosis
cuggggcgcaccg

SEQ ID NO: 2944951 - RNA, 15 nt, Mycobacterium avium subsp. paratuberculosis
cugggggucggugac

SEQ ID NO: 2944952 - RNA, 18 nt, Mycobacterium avium subsp. paratuberculosis
cuggggguggcgucgacg

SEQ ID NO: 2944953 - RNA, 21 nt, Mycobacterium avium subsp. paratuberculosis
cugggguaguucugcucgauc

SEQ ID NO: 2944954 - RNA, 15 nt, Mycobacterium avium subsp. paratuberculosis
cuggggugcccacca

SEQ ID NO: 2944955 - RNA, 15 nt, Mycobacterium avium subsp. paratuberculosis
cugggucaccacggu

SEQ ID NO: 2944956 - RNA, 16 nt, Mycobacterium avium subsp. paratuberculosis
cugggucaccgucacg

SEQ ID NO: 2944957 - RNA, 20 nt, Mycobacterium avium subsp. paratuberculosis
cugggucaccgucacgucgu

SEQ ID NO: 2944958 - RNA, 14 nt, Mycobacterium avium subsp. paratuberculosis
cugggucaucaccu

SEQ ID NO: 2944959 - RNA, 15 nt, Mycobacterium avium subsp. paratuberculosis
cuggguccgauugcc

SEQ ID NO: 2944960 - RNA, 19 nt, Mycobacterium avium subsp. paratuberculosis
cugggucugcggccggggc

SEQ ID NO: 2944961 - RNA, 15 nt, Mycobacterium avium subsp. paratuberculosis
cugggugaacacccc

SEQ ID NO: 2944962 - RNA, 23 nt, Mycobacterium avium subsp. paratuberculosis
cugggugagcaacagcgcuucgc

SEQ ID NO: 2944963 - RNA, 15 nt, Mycobacterium avium subsp. paratuberculosis
cugggugagcgacac

SEQ ID NO: 2944964 - RNA, 20 nt, Mycobacterium avium subsp. paratuberculosis
cugggugagcgacaccaggu

SEQ ID NO: 2944965 - RNA, 18 nt, Mycobacterium avium subsp. paratuberculosis
cugggugaguucgucggc

SEQ ID NO: 2944966 - RNA, 20 nt, Mycobacterium avium subsp. paratuberculosis
cugggugaguucgucggcga

SEQ ID NO: 2944967 - RNA, 14 nt, Mycobacterium avium subsp. paratuberculosis
cugggugccgcggu

SEQ ID NO: 2944968 - RNA, 17 nt, Mycobacterium avium subsp. paratuberculosis
cugggugcgcggcgccg

SEQ ID NO: 2944969 - RNA, 17 nt, Mycobacterium avium subsp. paratuberculosis
cugggugcgcgggcgcc

SEQ ID NO: 2944970 - RNA, 19 nt, Mycobacterium avium subsp. paratuberculosis
cugggugcgcgggcgcccg

SEQ ID NO: 2944971 - RNA, 15 nt, Mycobacterium avium subsp. paratuberculosis
cugggugcgggcugc

SEQ ID NO: 2944972 - RNA, 19 nt, Mycobacterium avium subsp. paratuberculosis
cugggugcgggcugcacca

SEQ ID NO: 2944973 - RNA, 20 nt, Mycobacterium avium subsp. paratuberculosis
cugggugggugcggugcggc

SEQ ID NO: 2944974 - RNA, 15 nt, Mycobacterium avium subsp. paratuberculosis
cuggguugcucgccg

SEQ ID NO: 2944975 - RNA, 18 nt, Mycobacterium avium subsp. paratuberculosis
cuggguuugggucaucga

SEQ ID NO: 2944976 - RNA, 18 nt, Mycobacterium avium subsp. paratuberculosis
cugguaaccgcccgagca

SEQ ID NO: 2944977 - RNA, 14 nt, Mycobacterium avium subsp. paratuberculosis
cugguacagcaccg

SEQ ID NO: 2944978 - RNA, 15 nt, Mycobacterium avium subsp. paratuberculosis
cugguacagcaccgc

SEQ ID NO: 2944979 - RNA, 15 nt, Mycobacterium avium subsp. paratuberculosis
cugguacccgauggu

SEQ ID NO: 2944980 - RNA, 13 nt, Mycobacterium avium subsp. paratuberculosis
cugguacgcgccg

SEQ ID NO: 2944981 - RNA, 20 nt, Mycobacterium avium subsp. paratuberculosis
cugguacgcgccgucgucgu

SEQ ID NO: 2944982 - RNA, 23 nt, Mycobacterium avium subsp. paratuberculosis
cugguagacccggggguccaggg

SEQ ID NO: 2944983 - RNA, 17 nt, Mycobacterium avium subsp. paratuberculosis
cugguagaugccgaagc

SEQ ID NO: 2944984 - RNA, 21 nt, Mycobacterium avium subsp. paratuberculosis
cugguagaugguggccgucgg

SEQ ID NO: 2944985 - RNA, 19 nt, Mycobacterium avium subsp. paratuberculosis
cugguagcugagcagcagg

SEQ ID NO: 2944986 - RNA, 13 nt, Mycobacterium avium subsp. paratuberculosis
cugguaggccgcc

SEQ ID NO: 2944987 - RNA, 16 nt, Mycobacterium avium subsp. paratuberculosis
cugguaggcggccggg

SEQ ID NO: 2944988 - RNA, 17 nt, Mycobacterium avium subsp. paratuberculosis
cugguaggcggccggga

SEQ ID NO: 2944989 - RNA, 13 nt, Mycobacterium avium subsp. paratuberculosis
cugguaggcggcg

SEQ ID NO: 2944990 - RNA, 23 nt, Mycobacterium avium subsp. paratuberculosis
cugguaguacaccgggcuggugu

SEQ ID NO: 2944991 - RNA, 22 nt, Mycobacterium avium subsp. paratuberculosis
cugguaguggcgugcggccucg

SEQ ID NO: 2944992 - RNA, 18 nt, Mycobacterium avium subsp. paratuberculosis
cuggucaacucgacccgc

SEQ ID NO: 2944993 - RNA, 19 nt, Mycobacterium avium subsp. paratuberculosis
cuggucacccacuggcggc

SEQ ID NO: 2944994 - RNA, 15 nt, Mycobacterium avium subsp. paratuberculosis
cuggucaguacagcu

SEQ ID NO: 2944995 - RNA, 18 nt, Mycobacterium avium subsp. paratuberculosis
cuggucaugaaggcgacg

SEQ ID NO: 2944996 - RNA, 20 nt, Mycobacterium avium subsp. paratuberculosis
cuggucaugaaggcgacguc

SEQ ID NO: 2944997 - RNA, 21 nt, Mycobacterium avium subsp. paratuberculosis
cuggucaugaaggcgacgucg

SEQ ID NO: 2944998 - RNA, 22 nt, Mycobacterium avium subsp. paratuberculosis
cuggucaugaaggcgacgucgg

SEQ ID NO: 2944999 - RNA, 13 nt, Mycobacterium avium subsp. paratuberculosis
cuggucaugccgu

SEQ ID NO: 2945000 - RNA, 16 nt, Mycobacterium avium subsp. paratuberculosis
cuggucaugccgucga

SEQ ID NO: 2945001 - RNA, 18 nt, Mycobacterium avium subsp. paratuberculosis
cuggucaugccgucgacg

SEQ ID NO: 2945002 - RNA, 20 nt, Mycobacterium avium subsp. paratuberculosis
cuggucaugccgucgacgac

SEQ ID NO: 2945003 - RNA, 15 nt, Mycobacterium avium subsp. paratuberculosis
cugguccaccgcggc

SEQ ID NO: 2945004 - RNA, 17 nt, Mycobacterium avium subsp. paratuberculosis
cugguccaccgcggcgg

SEQ ID NO: 2945005 - RNA, 22 nt, Mycobacterium avium subsp. paratuberculosis
cugguccagcgugcgcggcugg

SEQ ID NO: 2945006 - RNA, 17 nt, Mycobacterium avium subsp. paratuberculosis
cugguccggccggccga

SEQ ID NO: 2945007 - RNA, 19 nt, Mycobacterium avium subsp. paratuberculosis
cugguccuccaacggcacc

SEQ ID NO: 2945008 - RNA, 22 nt, Mycobacterium avium subsp. paratuberculosis
cugguccuccaacggcaccacc

SEQ ID NO: 2945009 - RNA, 14 nt, Mycobacterium avium subsp. paratuberculosis
cugguccucccggg

SEQ ID NO: 2945010 - RNA, 18 nt, Mycobacterium avium subsp. paratuberculosis
cugguccucccggguggg

SEQ ID NO: 2945011 - RNA, 19 nt, Mycobacterium avium subsp. paratuberculosis
cugguccucgauccggucc

SEQ ID NO: 2945012 - RNA, 12 nt, Mycobacterium avium subsp. paratuberculosis
cugguccugccc

SEQ ID NO: 2945013 - RNA, 13 nt, Mycobacterium avium subsp. paratuberculosis
cugguccugcccc

SEQ ID NO: 2945014 - RNA, 13 nt, Mycobacterium avium subsp. paratuberculosis
cugguccugcggc

SEQ ID NO: 2945015 - RNA, 20 nt, Mycobacterium avium subsp. paratuberculosis
cugguuccacagcugcaggc

SEQ ID NO: 2945016 - RNA, 21 nt, Mycobacterium avium subsp. paratuberculosis
cugguuccacagcugcaggcu

SEQ ID NO: 2945017 - RNA, 22 nt, Mycobacterium avium subsp. paratuberculosis
cugguugauccagcggcgcacc

SEQ ID NO: 2945018 - RNA, 23 nt, Mycobacterium avium subsp. paratuberculosis
cugguugauccagcggcgcaccg

SEQ ID NO: 2945019 - RNA, 19 nt, Mycobacterium avium subsp. paratuberculosis
cugguuggcccgcaccacc

SEQ ID NO: 2945020 - RNA, 17 nt, Mycobacterium avium subsp. paratuberculosis
cugguuggucaauccgg

SEQ ID NO: 2945021 - RNA, 17 nt, Mycobacterium avium subsp. paratuberculosis
cugguuguagucgucga

SEQ ID NO: 2945022 - RNA, 20 nt, Mycobacterium avium subsp. paratuberculosis
cugguuguagucgucgaccg

SEQ ID NO: 2945023 - RNA, 19 nt, Mycobacterium avium subsp. paratuberculosis
cugguuuuacacaccagcg

SEQ ID NO: 2945024 - RNA, 18 nt, Mycobacterium avium subsp. paratuberculosis
cuguagcacccggccggc

SEQ ID NO: 2945025 - RNA, 20 nt, Mycobacterium avium subsp. paratuberculosis
cuguagcacccggccggcga

SEQ ID NO: 2945026 - RNA, 22 nt, Mycobacterium avium subsp. paratuberculosis
cuguagcacccggccggcgaaa

SEQ ID NO: 2945027 - RNA, 15 nt, Mycobacterium avium subsp. paratuberculosis
cuguagcucacggug

SEQ ID NO: 2945028 - RNA, 14 nt, Mycobacterium avium subsp. paratuberculosis
cuguaggccagccg

SEQ ID NO: 2945029 - RNA, 15 nt, Mycobacterium avium subsp. paratuberculosis
cuguagggccaccac

SEQ ID NO: 2945030 - RNA, 17 nt, Mycobacterium avium subsp. paratuberculosis
cuguagggccaccacgc

SEQ ID NO: 2945031 - RNA, 15 nt, Mycobacterium avium subsp. paratuberculosis
cuguaguagccgggg

SEQ ID NO: 2945032 - RNA, 15 nt, Mycobacterium avium subsp. paratuberculosis
cuguauuaagcuggc

SEQ ID NO: 2945033 - RNA, 22 nt, Mycobacterium avium subsp. paratuberculosis
cuguccacaucggugaucacga

SEQ ID NO: 2945034 - RNA, 17 nt, Mycobacterium avium subsp. paratuberculosis
cuguccaccugcaccug

SEQ ID NO: 2945035 - RNA, 19 nt, Mycobacterium avium subsp. paratuberculosis
cuguccaccugcaccuggg

SEQ ID NO: 2945036 - RNA, 14 nt, Mycobacterium avium subsp. paratuberculosis
cuguccagcagcga

SEQ ID NO: 2945037 - RNA, 22 nt, Mycobacterium avium subsp. paratuberculosis
cuguccagcagcgagaaccggc

SEQ ID NO: 2945038 - RNA, 12 nt, Mycobacterium avium subsp. paratuberculosis
cuguccaggccg

SEQ ID NO: 2945039 - RNA, 17 nt, Mycobacterium avium subsp. paratuberculosis
cuguccaggccgaggcu

SEQ ID NO: 2945040 - RNA, 14 nt, Mycobacterium avium subsp. paratuberculosis
cugucccggccgcg

SEQ ID NO: 2945041 - RNA, 13 nt, Mycobacterium avium subsp. paratuberculosis
cuguccgaccagc

SEQ ID NO: 2945042 - RNA, 19 nt, Mycobacterium avium subsp. paratuberculosis
cuguccggucucggucgcg

SEQ ID NO: 2945043 - RNA, 13 nt, Mycobacterium avium subsp. paratuberculosis
cuguccucccagc

SEQ ID NO: 2945044 - RNA, 14 nt, Mycobacterium avium subsp. paratuberculosis
cuguccucccagcg

SEQ ID NO: 2945045 - RNA, 17 nt, Mycobacterium avium subsp. paratuberculosis
cuguccucccagcgccc

SEQ ID NO: 2945046 - RNA, 22 nt, Mycobacterium avium subsp. paratuberculosis
cuguccucccagcgcccgggcg

SEQ ID NO: 2945047 - RNA, 12 nt, Mycobacterium avium subsp. paratuberculosis
cuguccugcggu

SEQ ID NO: 2945048 - RNA, 20 nt, Mycobacterium avium subsp. paratuberculosis
cugucgaacaccgugccguc

SEQ ID NO: 2945049 - RNA, 13 nt, Mycobacterium avium subsp. paratuberculosis
cugucgauggcgg

SEQ ID NO: 2945050 - RNA, 16 nt, Mycobacterium avium subsp. paratuberculosis
cugucgcccucgaucg

SEQ ID NO: 2945051 - RNA, 18 nt, Mycobacterium avium subsp. paratuberculosis
cugucgcccucgaucgcg

SEQ ID NO: 2945052 - RNA, 14 nt, Mycobacterium avium subsp. paratuberculosis
cugucgcgcgaaca

SEQ ID NO: 2945053 - RNA, 15 nt, Mycobacterium avium subsp. paratuberculosis
cugucgcgcgaacag

SEQ ID NO: 2945054 - RNA, 15 nt, Mycobacterium avium subsp. paratuberculosis
cugucggaggccucc

SEQ ID NO: 2945055 - RNA, 17 nt, Mycobacterium avium subsp. paratuberculosis
cugucggaggccuccag

SEQ ID NO: 2945056 - RNA, 18 nt, Mycobacterium avium subsp. paratuberculosis
cugucggcgcggacguga

SEQ ID NO: 2945057 - RNA, 19 nt, Mycobacterium avium subsp. paratuberculosis
cugucggcgcggacgugau

SEQ ID NO: 2945058 - RNA, 22 nt, Mycobacterium avium subsp. paratuberculosis
cugucggcucgcccgcgacugu

SEQ ID NO: 2945059 - RNA, 16 nt, Mycobacterium avium subsp. paratuberculosis
cugucggcucgccugc

SEQ ID NO: 2945060 - RNA, 15 nt, Mycobacterium avium subsp. paratuberculosis
cugucggggucgcgg

SEQ ID NO: 2945061 - RNA, 16 nt, Mycobacterium avium subsp. paratuberculosis
cugucggggucgcggc

SEQ ID NO: 2945062 - RNA, 20 nt, Mycobacterium avium subsp. paratuberculosis
cugucggggucgcggcccgc

SEQ ID NO: 2945063 - RNA, 14 nt, Mycobacterium avium subsp. paratuberculosis
cugucgggugccgc

SEQ ID NO: 2945064 - RNA, 22 nt, Mycobacterium avium subsp. paratuberculosis
cugucggugacgaggagggugu

SEQ ID NO: 2945065 - RNA, 22 nt, Mycobacterium avium subsp. paratuberculosis
cugucggugugagcggugaccu

SEQ ID NO: 2945066 - RNA, 16 nt, Mycobacterium avium subsp. paratuberculosis
cugucguagcggccca

SEQ ID NO: 2945067 - RNA, 20 nt, Mycobacterium avium subsp. paratuberculosis
cugucgucgaccaacgccau

SEQ ID NO: 2945068 - RNA, 13 nt, Mycobacterium avium subsp. paratuberculosis
cugugaggcaccg

SEQ ID NO: 2945069 - RNA, 16 nt, Mycobacterium avium subsp. paratuberculosis
cugugaggcaccgaac

SEQ ID NO: 2945070 - RNA, 15 nt, Mycobacterium avium subsp. paratuberculosis
cugugaucgcugacg

SEQ ID NO: 2945071 - RNA, 20 nt, Mycobacterium avium subsp. paratuberculosis
cugugccgcggugcggcccg

SEQ ID NO: 2945072 - RNA, 21 nt, Mycobacterium avium subsp. paratuberculosis
cugugccgcggugcggcccgc

SEQ ID NO: 2945073 - RNA, 14 nt, Mycobacterium avium subsp. paratuberculosis
cugugccggcgggu

SEQ ID NO: 2945074 - RNA, 19 nt, Mycobacterium avium subsp. paratuberculosis
cugugccggcgggucagca

SEQ ID NO: 2945075 - RNA, 22 nt, Mycobacterium avium subsp. paratuberculosis
cugugccggcgggucagcagcg

SEQ ID NO: 2945076 - RNA, 15 nt, Mycobacterium avium subsp. paratuberculosis
cugugcgacggcguc

SEQ ID NO: 2945077 - RNA, 18 nt, Mycobacterium avium subsp. paratuberculosis
cugugcgacggcgucggc

SEQ ID NO: 2945078 - RNA, 15 nt, Mycobacterium avium subsp. paratuberculosis
cugugcgccagagac

SEQ ID NO: 2945079 - RNA, 18 nt, Mycobacterium avium subsp. paratuberculosis
cugugcgccccacggcgc

SEQ ID NO: 2945080 - RNA, 19 nt, Mycobacterium avium subsp. paratuberculosis
cugugcgcuugggucgccg

SEQ ID NO: 2945081 - RNA, 14 nt, Mycobacterium avium subsp. paratuberculosis
cugugcggcccggc

SEQ ID NO: 2945082 - RNA, 19 nt, Mycobacterium avium subsp. paratuberculosis
cugugcgggugaggccagg

SEQ ID NO: 2945083 - RNA, 16 nt, Mycobacterium avium subsp. paratuberculosis
cuguggaagggccccg

SEQ ID NO: 2945084 - RNA, 19 nt, Mycobacterium avium subsp. paratuberculosis
cuguggcgcacagaucguc

SEQ ID NO: 2945085 - RNA, 14 nt, Mycobacterium avium subsp. paratuberculosis
cugugggccagcag

SEQ ID NO: 2945086 - RNA, 16 nt, Mycobacterium avium subsp. paratuberculosis
cugugggcgcagggcc

SEQ ID NO: 2945087 - RNA, 17 nt, Mycobacterium avium subsp. paratuberculosis
cugugguccucgucacc

SEQ ID NO: 2945088 - RNA, 22 nt, Mycobacterium avium subsp. paratuberculosis
cuguggucgguagggucgggug

SEQ ID NO: 2945089 - RNA, 15 nt, Mycobacterium avium subsp. paratuberculosis
cuguggugacggccc

SEQ ID NO: 2945090 - RNA, 19 nt, Mycobacterium avium subsp. paratuberculosis
cuguggugacggccccaga

SEQ ID NO: 2945091 - RNA, 14 nt, Mycobacterium avium subsp. paratuberculosis
cugugguggcggua

SEQ ID NO: 2945092 - RNA, 21 nt, Mycobacterium avium subsp. paratuberculosis
cuguuaagacuucggcgaacu

SEQ ID NO: 2945093 - RNA, 20 nt, Mycobacterium avium subsp. paratuberculosis
cuguuagccucgccagccgu

SEQ ID NO: 2945094 - RNA, 15 nt, Mycobacterium avium subsp. paratuberculosis
cuguuagggcgacca

SEQ ID NO: 2945095 - RNA, 22 nt, Mycobacterium avium subsp. paratuberculosis
cuguucacuacuuuuccgguua

SEQ ID NO: 2945096 - RNA, 18 nt, Mycobacterium avium subsp. paratuberculosis
cuguuccaacaacuucga

SEQ ID NO: 2945097 - RNA, 14 nt, Mycobacterium avium subsp. paratuberculosis
cuguuccccggcgg

SEQ ID NO: 2945098 - RNA, 16 nt, Mycobacterium avium subsp. paratuberculosis
cuguucgccgucgcgg

SEQ ID NO: 2945099 - RNA, 17 nt, Mycobacterium avium subsp. paratuberculosis
cuguucgccgucgcggg

SEQ ID NO: 2945100 - RNA, 17 nt, Mycobacterium avium subsp. paratuberculosis
cuuccccggcggccggc

SEQ ID NO: 2945101 - RNA, 23 nt, Mycobacterium avium subsp. paratuberculosis
cuuccccggcggccggccccggc

SEQ ID NO: 2945102 - RNA, 15 nt, Mycobacterium avium subsp. paratuberculosis
cuucccggccgccaa

SEQ ID NO: 2945103 - RNA, 12 nt, Mycobacterium avium subsp. paratuberculosis
cuucccggcggu

SEQ ID NO: 2945104 - RNA, 18 nt, Mycobacterium avium subsp. paratuberculosis
cuuccgagacguggucgg

SEQ ID NO: 2945105 - RNA, 17 nt, Mycobacterium avium subsp. paratuberculosis
cuuccgcaacaucguca

SEQ ID NO: 2945106 - RNA, 16 nt, Mycobacterium avium subsp. paratuberculosis
cuuccgccacgcccag

SEQ ID NO: 2945107 - RNA, 16 nt, Mycobacterium avium subsp. paratuberculosis
cuuccgcccggcgagc

SEQ ID NO: 2945108 - RNA, 17 nt, Mycobacterium avium subsp. paratuberculosis
cuuccgccgagucgcgc

SEQ ID NO: 2945109 - RNA, 19 nt, Mycobacterium avium subsp. paratuberculosis
cuuccgccgagucgcgccg

SEQ ID NO: 2945110 - RNA, 23 nt, Mycobacterium avium subsp. paratuberculosis
cuuccgccgagucgcgccgcguc

SEQ ID NO: 2945111 - RNA, 20 nt, Mycobacterium avium subsp. paratuberculosis
cuuccgccucggcgaggucg

SEQ ID NO: 2945112 - RNA, 18 nt, Mycobacterium avium subsp. paratuberculosis
cuuccgcgcgucgggggu

SEQ ID NO: 2945113 - RNA, 16 nt, Mycobacterium avium subsp. paratuberculosis
cuuccggaacgacgcg

SEQ ID NO: 2945114 - RNA, 23 nt, Mycobacterium avium subsp. paratuberculosis
cuuccgggaagucgucguugagc

SEQ ID NO: 2945115 - RNA, 14 nt, Mycobacterium avium subsp. paratuberculosis
cuuccgggccaccg

SEQ ID NO: 2945116 - RNA, 15 nt, Mycobacterium avium subsp. paratuberculosis
cuuccuccucggcgc

SEQ ID NO: 2945117 - RNA, 13 nt, Mycobacterium avium subsp. paratuberculosis
cuuccuccucuuc

SEQ ID NO: 2945118 - RNA, 13 nt, Mycobacterium avium subsp. paratuberculosis
cuuccucgcggaa

SEQ ID NO: 2945119 - RNA, 22 nt, Mycobacterium avium subsp. paratuberculosis
cuuccucgcuguccugccgggc

SEQ ID NO: 2945120 - RNA, 18 nt, Mycobacterium avium subsp. paratuberculosis
cuuccucggcgcucgccg

SEQ ID NO: 2945121 - RNA, 17 nt, Mycobacterium avium subsp. paratuberculosis
cuuccugggacagccgg

SEQ ID NO: 2945122 - RNA, 18 nt, Mycobacterium avium subsp. paratuberculosis
cuuccugggacagccggu

SEQ ID NO: 2945123 - RNA, 23 nt, Mycobacterium avium subsp. paratuberculosis
cuuccugggacagccggucgacg

SEQ ID NO: 2945124 - RNA, 14 nt, Mycobacterium avium subsp. paratuberculosis
cuucgaacgcccgc

SEQ ID NO: 2945125 - RNA, 16 nt, Mycobacterium avium subsp. paratuberculosis
cuucgaacgcccgcac

SEQ ID NO: 2945126 - RNA, 21 nt, Mycobacterium avium subsp. paratuberculosis
cuucgaacgcgacgaagcggu

SEQ ID NO: 2945127 - RNA, 21 nt, Mycobacterium avium subsp. paratuberculosis
cuucgaaugcgaugagcucgc

SEQ ID NO: 2945128 - RNA, 12 nt, Mycobacterium avium subsp. paratuberculosis
cuucgacccgca

SEQ ID NO: 2945129 - RNA, 20 nt, Mycobacterium avium subsp. paratuberculosis
cuucgacccgcauccgccgg

SEQ ID NO: 2945130 - RNA, 22 nt, Mycobacterium avium subsp. paratuberculosis
cuucgacgauguuggcgacgac

SEQ ID NO: 2945131 - RNA, 14 nt, Mycobacterium avium subsp. paratuberculosis
cuucgacggcagcg

SEQ ID NO: 2945132 - RNA, 15 nt, Mycobacterium avium subsp. paratuberculosis
cuucgacggccggcc

SEQ ID NO: 2945133 - RNA, 14 nt, Mycobacterium avium subsp. paratuberculosis
cuucgacggugaug

SEQ ID NO: 2945134 - RNA, 17 nt, Mycobacterium avium subsp. paratuberculosis
cuucgagacacgcgccg

SEQ ID NO: 2945135 - RNA, 16 nt, Mycobacterium avium subsp. paratuberculosis
cuucgagccgccgccg

SEQ ID NO: 2945136 - RNA, 21 nt, Mycobacterium avium subsp. paratuberculosis
cuucgaggugcacgcccagac

SEQ ID NO: 2945137 - RNA, 18 nt, Mycobacterium avium subsp. paratuberculosis
cuucgaugacggccguac

SEQ ID NO: 2945138 - RNA, 18 nt, Mycobacterium avium subsp. paratuberculosis
cuucgauggccaucgucg

SEQ ID NO: 2945139 - RNA, 20 nt, Mycobacterium avium subsp. paratuberculosis
cuucgaugggaaccgcucgg

SEQ ID NO: 2945140 - RNA, 15 nt, Mycobacterium avium subsp. paratuberculosis
cuucgaugucgccgg

SEQ ID NO: 2945141 - RNA, 16 nt, Mycobacterium avium subsp. paratuberculosis
cuucgaugucgccggc

SEQ ID NO: 2945142 - RNA, 21 nt, Mycobacterium avium subsp. paratuberculosis
cuucgccgcaaccuucuuggc

SEQ ID NO: 2945143 - RNA, 22 nt, Mycobacterium avium subsp. paratuberculosis
cuucgccgcaaccuucuuggcc

SEQ ID NO: 2945144 - RNA, 13 nt, Mycobacterium avium subsp. paratuberculosis
cuucgccgcacgu

SEQ ID NO: 2945145 - RNA, 21 nt, Mycobacterium avium subsp. paratuberculosis
cuucgccgcagccuucuuggc

SEQ ID NO: 2945146 - RNA, 18 nt, Mycobacterium avium subsp. paratuberculosis
cuucgccgccgcaccggc

SEQ ID NO: 2945147 - RNA, 17 nt, Mycobacterium avium subsp. paratuberculosis
cuucgccggacagccgg

SEQ ID NO: 2945148 - RNA, 21 nt, Mycobacterium avium subsp. paratuberculosis
cuucgccggcgcuuugccguc

SEQ ID NO: 2945149 - RNA, 17 nt, Mycobacterium avium subsp. paratuberculosis
cuucgccggggccuucu

SEQ ID NO: 2945150 - RNA, 21 nt, Mycobacterium avium subsp. paratuberculosis
cuucgccggggccuucuuggc

SEQ ID NO: 2945151 - RNA, 23 nt, Mycobacterium avium subsp. paratuberculosis
cuucgccggggccuucuuggcgg

SEQ ID NO: 2945152 - RNA, 18 nt, Mycobacterium avium subsp. paratuberculosis
cuucgcgaagaacgacgc

SEQ ID NO: 2945153 - RNA, 16 nt, Mycobacterium avium subsp. paratuberculosis
cuucgcgcgcggcgug

SEQ ID NO: 2945154 - RNA, 23 nt, Mycobacterium avium subsp. paratuberculosis
cuucgcgggcggcgcagucggcc

SEQ ID NO: 2945155 - RNA, 16 nt, Mycobacterium avium subsp. paratuberculosis
cuucgcgggugccuuc

SEQ ID NO: 2945156 - RNA, 18 nt, Mycobacterium avium subsp. paratuberculosis
cuucgcgggugccuucuu

SEQ ID NO: 2945157 - RNA, 20 nt, Mycobacterium avium subsp. paratuberculosis
cuucgcgggugccuucuugg

SEQ ID NO: 2945158 - RNA, 13 nt, Mycobacterium avium subsp. paratuberculosis
cuucgcugccgcc

SEQ ID NO: 2945159 - RNA, 15 nt, Mycobacterium avium subsp. paratuberculosis
cuucgcugcgccggc

SEQ ID NO: 2945160 - RNA, 15 nt, Mycobacterium avium subsp. paratuberculosis
cuucggcacgaagcc

SEQ ID NO: 2945161 - RNA, 14 nt, Mycobacterium avium subsp. paratuberculosis
cuucggccagcgcg

SEQ ID NO: 2945162 - RNA, 22 nt, Mycobacterium avium subsp. paratuberculosis
cuucggccaucgacuccaccac

SEQ ID NO: 2945163 - RNA, 19 nt, Mycobacterium avium subsp. paratuberculosis
cuucggcgcccgcuccggc

SEQ ID NO: 2945164 - RNA, 22 nt, Mycobacterium avium subsp. paratuberculosis
cuucggcgcccgcuccggcgga

SEQ ID NO: 2945165 - RNA, 15 nt, Mycobacterium avium subsp. paratuberculosis
cuucggcgccgagca

SEQ ID NO: 2945166 - RNA, 13 nt, Mycobacterium avium subsp. paratuberculosis
cuucggcgcgccg

SEQ ID NO: 2945167 - RNA, 18 nt, Mycobacterium avium subsp. paratuberculosis
cuucggcgcgccggcgau

SEQ ID NO: 2945168 - RNA, 15 nt, Mycobacterium avium subsp. paratuberculosis
cuucggcgucacucu

SEQ ID NO: 2945169 - RNA, 18 nt, Mycobacterium avium subsp. paratuberculosis
cuucggcgucacucuggc

SEQ ID NO: 2945170 - RNA, 17 nt, Mycobacterium avium subsp. paratuberculosis
cuucggcgugucgggug

SEQ ID NO: 2945171 - RNA, 13 nt, Mycobacterium avium subsp. paratuberculosis
cuucggcucggcg

SEQ ID NO: 2945172 - RNA, 15 nt, Mycobacterium avium subsp. paratuberculosis
cuucggcucggcgac

SEQ ID NO: 2945173 - RNA, 19 nt, Mycobacterium avium subsp. paratuberculosis
cuucggcucggcgacaaca

SEQ ID NO: 2945174 - RNA, 17 nt, Mycobacterium avium subsp. paratuberculosis
cuucggcuuucucgcca

SEQ ID NO: 2945175 - RNA, 20 nt, Mycobacterium avium subsp. paratuberculosis
cuucggggauguagccgccg

SEQ ID NO: 2945176 - RNA, 18 nt, Mycobacterium avium subsp. paratuberculosis
cuucggggguggccagcu

SEQ ID NO: 2945177 - RNA, 19 nt, Mycobacterium avium subsp. paratuberculosis
cuucggggguggccagcuu

SEQ ID NO: 2945178 - RNA, 21 nt, Mycobacterium avium subsp. paratuberculosis
cuucgggucgccggucuggua

SEQ ID NO: 2945179 - RNA, 15 nt, Mycobacterium avium subsp. paratuberculosis
cuucggucccggcgg

SEQ ID NO: 2945180 - RNA, 16 nt, Mycobacterium avium subsp. paratuberculosis
cuucggucccggcggg

SEQ ID NO: 2945181 - RNA, 18 nt, Mycobacterium avium subsp. paratuberculosis
cuucggucgcgacccggu

SEQ ID NO: 2945182 - RNA, 19 nt, Mycobacterium avium subsp. paratuberculosis
cuucggucgcgacccgguc

SEQ ID NO: 2945183 - RNA, 23 nt, Mycobacterium avium subsp. paratuberculosis
cuucggugguguggaucuccagc

SEQ ID NO: 2945184 - RNA, 17 nt, Mycobacterium avium subsp. paratuberculosis
cuugacgaguuccaccu

SEQ ID NO: 2945185 - RNA, 19 nt, Mycobacterium avium subsp. paratuberculosis
cuugacgaguuccaccucg

SEQ ID NO: 2945186 - RNA, 17 nt, Mycobacterium avium subsp. paratuberculosis
cuugacgauccccuggu

SEQ ID NO: 2945187 - RNA, 12 nt, Mycobacterium avium subsp. paratuberculosis
cuugacgccgau

SEQ ID NO: 2945188 - RNA, 16 nt, Mycobacterium avium subsp. paratuberculosis
cuugacgccgccgaac

SEQ ID NO: 2945189 - RNA, 14 nt, Mycobacterium avium subsp. paratuberculosis
cuugacggccgcgg

SEQ ID NO: 2945190 - RNA, 15 nt, Mycobacterium avium subsp. paratuberculosis
cuugacggccgcggc

SEQ ID NO: 2945191 - RNA, 16 nt, Mycobacterium avium subsp. paratuberculosis
cuugacggccgcggcg

SEQ ID NO: 2945192 - RNA, 19 nt, Mycobacterium avium subsp. paratuberculosis
cuugacggccgcggcggug

SEQ ID NO: 2945193 - RNA, 23 nt, Mycobacterium avium subsp. paratuberculosis
cuugacggccgcggcggugccgg

SEQ ID NO: 2945194 - RNA, 14 nt, Mycobacterium avium subsp. paratuberculosis
cuugacggccgggc

SEQ ID NO: 2945195 - RNA, 13 nt, Mycobacterium avium subsp. paratuberculosis
cuugacggcgacg

SEQ ID NO: 2945196 - RNA, 18 nt, Mycobacterium avium subsp. paratuberculosis
cuugacggcuuccgcgga

SEQ ID NO: 2945197 - RNA, 16 nt, Mycobacterium avium subsp. paratuberculosis
cuugacgucggucagc

SEQ ID NO: 2945198 - RNA, 23 nt, Mycobacterium avium subsp. paratuberculosis
cuugacguggaaauugcugacca

SEQ ID NO: 2945199 - RNA, 17 nt, Mycobacterium avium subsp. paratuberculosis
cuugagcaagcaguccc

SEQ ID NO: 2945200 - RNA, 19 nt, Mycobacterium avium subsp. paratuberculosis
cuugagcacggugaucagc

SEQ ID NO: 2945201 - RNA, 15 nt, Mycobacterium avium subsp. paratuberculosis
cuugagcccccaccu

SEQ ID NO: 2945202 - RNA, 16 nt, Mycobacterium avium subsp. paratuberculosis
cuugagcccccaccug

SEQ ID NO: 2945203 - RNA, 16 nt, Mycobacterium avium subsp. paratuberculosis
cuugagcccgucgacg

SEQ ID NO: 2945204 - RNA, 22 nt, Mycobacterium avium subsp. paratuberculosis
cuugagccgccacggggcccgc

SEQ ID NO: 2945205 - RNA, 13 nt, Mycobacterium avium subsp. paratuberculosis
cuugagccggucc

SEQ ID NO: 2945206 - RNA, 20 nt, Mycobacterium avium subsp. paratuberculosis
cuugagcgccagcgcggugc

SEQ ID NO: 2945207 - RNA, 14 nt, Mycobacterium avium subsp. paratuberculosis
cuugagcgcgucgu

SEQ ID NO: 2945208 - RNA, 24 nt, Mycobacterium avium subsp. paratuberculosis
cuugagcgcgucgucgccgaaaag

SEQ ID NO: 2945209 - RNA, 23 nt, Mycobacterium avium subsp. paratuberculosis
cuugagcuucccggcggucgccg

SEQ ID NO: 2945210 - RNA, 15 nt, Mycobacterium avium subsp. paratuberculosis
cuugagggucaagau

SEQ ID NO: 2945211 - RNA, 18 nt, Mycobacterium avium subsp. paratuberculosis
cuugagguagucgcgcag

SEQ ID NO: 2945212 - RNA, 20 nt, Mycobacterium avium subsp. paratuberculosis
cuugagguagucgcgcagcu

SEQ ID NO: 2945213 - RNA, 23 nt, Mycobacterium avium subsp. paratuberculosis
cuugaucagguccuugcgcgccg

SEQ ID NO: 2945214 - RNA, 16 nt, Mycobacterium avium subsp. paratuberculosis
cuugaucaggucgccg

SEQ ID NO: 2945215 - RNA, 23 nt, Mycobacterium avium subsp. paratuberculosis
cuugaucaggucgccgauccagc

SEQ ID NO: 2945216 - RNA, 15 nt, Mycobacterium avium subsp. paratuberculosis
cuugauccggccgcg

SEQ ID NO: 2945217 - RNA, 17 nt, Mycobacterium avium subsp. paratuberculosis
cuugauccggccgcgga

SEQ ID NO: 2945218 - RNA, 17 nt, Mycobacterium avium subsp. paratuberculosis
cuugaucucgaccuucu

SEQ ID NO: 2945219 - RNA, 15 nt, Mycobacterium avium subsp. paratuberculosis
cuugaucucggcggc

SEQ ID NO: 2945220 - RNA, 16 nt, Mycobacterium avium subsp. paratuberculosis
cuugaucucggcggcg

SEQ ID NO: 2945221 - RNA, 17 nt, Mycobacterium avium subsp. paratuberculosis
cuugaucucgucgcggc

SEQ ID NO: 2945222 - RNA, 15 nt, Mycobacterium avium subsp. paratuberculosis
cuugaugaacgccuc

SEQ ID NO: 2945223 - RNA, 23 nt, Mycobacterium avium subsp. paratuberculosis
cuugaugaacgcguugaccagac

SEQ ID NO: 2945224 - RNA, 13 nt, Mycobacterium avium subsp. paratuberculosis
cuugaugaugccg

SEQ ID NO: 2945225 - RNA, 20 nt, Mycobacterium avium subsp. paratuberculosis
cuugaugaugcugucgguga

SEQ ID NO: 2945226 - RNA, 17 nt, Mycobacterium avium subsp. paratuberculosis
cuugaugaugucggcgg

SEQ ID NO: 2945227 - RNA, 15 nt, Mycobacterium avium subsp. paratuberculosis
cuugaugcagcgccu

SEQ ID NO: 2945228 - RNA, 16 nt, Mycobacterium avium subsp. paratuberculosis
cuugaugcugcccggc

SEQ ID NO: 2945229 - RNA, 18 nt, Mycobacterium avium subsp. paratuberculosis
cuugaugcugcccggcgc

SEQ ID NO: 2945230 - RNA, 16 nt, Mycobacterium avium subsp. paratuberculosis
cuugauggcggcgcgg

SEQ ID NO: 2945231 - RNA, 13 nt, Mycobacterium avium subsp. paratuberculosis
cuugcaaggcggg

SEQ ID NO: 2945232 - RNA, 15 nt, Mycobacterium avium subsp. paratuberculosis
cuugcacccagcgga

SEQ ID NO: 2945233 - RNA, 23 nt, Mycobacterium avium subsp. paratuberculosis
cuugcagcccgcguccagcagca

SEQ ID NO: 2945234 - RNA, 15 nt, Mycobacterium avium subsp. paratuberculosis
cuugcagcuguccug

SEQ ID NO: 2945235 - RNA, 18 nt, Mycobacterium avium subsp. paratuberculosis
cuugcagcuguccugcca

SEQ ID NO: 2945236 - RNA, 20 nt, Mycobacterium avium subsp. paratuberculosis
cuugccagccgggccgagcg

SEQ ID NO: 2945237 - RNA, 16 nt, Mycobacterium avium subsp. paratuberculosis
cuugccaugucgaagg

SEQ ID NO: 2945238 - RNA, 19 nt, Mycobacterium avium subsp. paratuberculosis
cuugcccaggugcagaccg

SEQ ID NO: 2945239 - RNA, 13 nt, Mycobacterium avium subsp. paratuberculosis
cuugccccaccac

SEQ ID NO: 2945240 - RNA, 22 nt, Mycobacterium avium subsp. paratuberculosis
cuugccccaccaccgccggccc

SEQ ID NO: 2945241 - RNA, 19 nt, Mycobacterium avium subsp. paratuberculosis
cuugcccgaauugcgcugc

SEQ ID NO: 2945242 - RNA, 18 nt, Mycobacterium avium subsp. paratuberculosis
cuugcccggacgaugccg

SEQ ID NO: 2945243 - RNA, 13 nt, Mycobacterium avium subsp. paratuberculosis
cuugcccggcgag

SEQ ID NO: 2945244 - RNA, 22 nt, Mycobacterium avium subsp. paratuberculosis
cuugcccucguagaaggaccgg

SEQ ID NO: 2945245 - RNA, 19 nt, Mycobacterium avium subsp. paratuberculosis
cuugcccugguacgcgccg

SEQ ID NO: 2945246 - RNA, 22 nt, Mycobacterium avium subsp. paratuberculosis
cuugcccugguacgcgccgucg

SEQ ID NO: 2945247 - RNA, 20 nt, Mycobacterium avium subsp. paratuberculosis
cuugccgaaguccuugaccc

SEQ ID NO: 2945248 - RNA, 19 nt, Mycobacterium avium subsp. paratuberculosis
cuugccgacgugaugcacc

SEQ ID NO: 2945249 - RNA, 17 nt, Mycobacterium avium subsp. paratuberculosis
cuugccgaucagcguca

SEQ ID NO: 2945250 - RNA, 23 nt, Mycobacterium avium subsp. paratuberculosis
cuugccgaucagcgucagcaccg

SEQ ID NO: 2945251 - RNA, 18 nt, Mycobacterium avium subsp. paratuberculosis
cuugccgaucgccgcggc

SEQ ID NO: 2945252 - RNA, 13 nt, Mycobacterium avium subsp. paratuberculosis
cuugccgccgcag

SEQ ID NO: 2945253 - RNA, 14 nt, Mycobacterium avium subsp. paratuberculosis
cuugccgccgcagc

SEQ ID NO: 2945254 - RNA, 18 nt, Mycobacterium avium subsp. paratuberculosis
cuugccgccgcagcgcag

SEQ ID NO: 2945255 - RNA, 14 nt, Mycobacterium avium subsp. paratuberculosis
cuugccgccgcgga

SEQ ID NO: 2945256 - RNA, 14 nt, Mycobacterium avium subsp. paratuberculosis
cuugccgccggcgc

SEQ ID NO: 2945257 - RNA, 21 nt, Mycobacterium avium subsp. paratuberculosis
cuugccgcugaaauccggggu

SEQ ID NO: 2945258 - RNA, 21 nt, Mycobacterium avium subsp. paratuberculosis
cuugccggagcccagcuuggc

SEQ ID NO: 2945259 - RNA, 23 nt, Mycobacterium avium subsp. paratuberculosis
cuugccggagcccagcuuggcgc

SEQ ID NO: 2945260 - RNA, 23 nt, Mycobacterium avium subsp. paratuberculosis
cuugccggagugcggauuaccgu

SEQ ID NO: 2945261 - RNA, 22 nt, Mycobacterium avium subsp. paratuberculosis
cuugccggauugcgagccgguc

SEQ ID NO: 2945262 - RNA, 23 nt, Mycobacterium avium subsp. paratuberculosis
cuugccggucuuguagucgacca

SEQ ID NO: 2945263 - RNA, 14 nt, Mycobacterium avium subsp. paratuberculosis
cuugccgucgacgc

SEQ ID NO: 2945264 - RNA, 15 nt, Mycobacterium avium subsp. paratuberculosis
cuugccgucgacgcg

SEQ ID NO: 2945265 - RNA, 15 nt, Mycobacterium avium subsp. paratuberculosis
cuugccgucgagcag

SEQ ID NO: 2945266 - RNA, 18 nt, Mycobacterium avium subsp. paratuberculosis
cuugccgucggccgccga

SEQ ID NO: 2945267 - RNA, 19 nt, Mycobacterium avium subsp. paratuberculosis
cuugccgucggccgccgac

SEQ ID NO: 2945268 - RNA, 23 nt, Mycobacterium avium subsp. paratuberculosis
cuugccgucguugacgcccuccu

SEQ ID NO: 2945269 - RNA, 17 nt, Mycobacterium avium subsp. paratuberculosis
cuugcgaccgccgcuag

SEQ ID NO: 2945270 - RNA, 16 nt, Mycobacterium avium subsp. paratuberculosis
cuugcgaucgccgcgc

SEQ ID NO: 2945271 - RNA, 17 nt, Mycobacterium avium subsp. paratuberculosis
cuugcgcaacagcgugc

SEQ ID NO: 2945272 - RNA, 17 nt, Mycobacterium avium subsp. paratuberculosis
cuugcgcaccacgucgg

SEQ ID NO: 2945273 - RNA, 20 nt, Mycobacterium avium subsp. paratuberculosis
cuugcgcaccggagccuugg

SEQ ID NO: 2945274 - RNA, 24 nt, Mycobacterium avium subsp. paratuberculosis
cuugcgcaccggagccuuggucgc

SEQ ID NO: 2945275 - RNA, 14 nt, Mycobacterium avium subsp. paratuberculosis
cuugcgcagcaccu

SEQ ID NO: 2945276 - RNA, 12 nt, Mycobacterium avium subsp. paratuberculosis
cuugcgcagcag

SEQ ID NO: 2945277 - RNA, 14 nt, Mycobacterium avium subsp. paratuberculosis
cuugcgcagcagca

SEQ ID NO: 2945278 - RNA, 13 nt, Mycobacterium avium subsp. paratuberculosis
cuugcgcagccgg

SEQ ID NO: 2945279 - RNA, 17 nt, Mycobacterium avium subsp. paratuberculosis
cuugcgcagccggcagc

SEQ ID NO: 2945280 - RNA, 16 nt, Mycobacterium avium subsp. paratuberculosis
cuugcgccacuugucc

SEQ ID NO: 2945281 - RNA, 14 nt, Mycobacterium avium subsp. paratuberculosis
cuugcgccaucccc

SEQ ID NO: 2945282 - RNA, 15 nt, Mycobacterium avium subsp. paratuberculosis
cuugcgccccggcgg

SEQ ID NO: 2945283 - RNA, 17 nt, Mycobacterium avium subsp. paratuberculosis
cuugcgccccggcgggc

SEQ ID NO: 2945284 - RNA, 15 nt, Mycobacterium avium subsp. paratuberculosis
cuugcgccgcaacag

SEQ ID NO: 2945285 - RNA, 14 nt, Mycobacterium avium subsp. paratuberculosis
cuugcgccgcagcg

SEQ ID NO: 2945286 - RNA, 21 nt, Mycobacterium avium subsp. paratuberculosis
cuugcgccggguggccggggc

SEQ ID NO: 2945287 - RNA, 19 nt, Mycobacterium avium subsp. paratuberculosis
cuugcgcgggucgccgggc

SEQ ID NO: 2945288 - RNA, 17 nt, Mycobacterium avium subsp. paratuberculosis
cuugcgcucggucgcgg

SEQ ID NO: 2945289 - RNA, 14 nt, Mycobacterium avium subsp. paratuberculosis
cuugcggccgccga

SEQ ID NO: 2945290 - RNA, 22 nt, Mycobacterium avium subsp. paratuberculosis
cuugcggccgccgaucaacagg

SEQ ID NO: 2945291 - RNA, 14 nt, Mycobacterium avium subsp. paratuberculosis
cuugcggccgcgac

SEQ ID NO: 2945292 - RNA, 15 nt, Mycobacterium avium subsp. paratuberculosis
cuugcggccggcggc

SEQ ID NO: 2945293 - RNA, 14 nt, Mycobacterium avium subsp. paratuberculosis
cuugcggcgcaacc

SEQ ID NO: 2945294 - RNA, 16 nt, Mycobacterium avium subsp. paratuberculosis
cuugcggcgcagccag

SEQ ID NO: 2945295 - RNA, 15 nt, Mycobacterium avium subsp. paratuberculosis
cuugcggcgcgaugc

SEQ ID NO: 2945296 - RNA, 21 nt, Mycobacterium avium subsp. paratuberculosis
cuugcgggccggagccuucuu

SEQ ID NO: 2945297 - RNA, 14 nt, Mycobacterium avium subsp. paratuberculosis
cuugcgggcggcag

SEQ ID NO: 2945298 - RNA, 13 nt, Mycobacterium avium subsp. paratuberculosis
cuugcgggugauc

SEQ ID NO: 2945299 - RNA, 19 nt, Mycobacterium avium subsp. paratuberculosis
cuugcgggugauccagccc

SEQ ID NO: 2945300 - RNA, 16 nt, Mycobacterium avium subsp. paratuberculosis
cuugcgguuggccgga

SEQ ID NO: 2945301 - RNA, 21 nt, Mycobacterium avium subsp. paratuberculosis
cuugcgugcgggucgcgcggc

SEQ ID NO: 2945302 - RNA, 18 nt, Mycobacterium avium subsp. paratuberculosis
cuugcguucccagcccgg

SEQ ID NO: 2945303 - RNA, 17 nt, Mycobacterium avium subsp. paratuberculosis
cuugcguuccucgacgg

SEQ ID NO: 2945304 - RNA, 15 nt, Mycobacterium avium subsp. paratuberculosis
cuugcguugcgcggc

SEQ ID NO: 2945305 - RNA, 15 nt, Mycobacterium avium subsp. paratuberculosis
cuugcuccacacugg

SEQ ID NO: 2945306 - RNA, 21 nt, Mycobacterium avium subsp. paratuberculosis
cuugcucuucaggaacccgaa

SEQ ID NO: 2945307 - RNA, 16 nt, Mycobacterium avium subsp. paratuberculosis
cuugcugacgccgcgg

SEQ ID NO: 2945308 - RNA, 19 nt, Mycobacterium avium subsp. paratuberculosis
cuugcugacgccgcggugc

SEQ ID NO: 2945309 - RNA, 22 nt, Mycobacterium avium subsp. paratuberculosis
cuugcugagccggcccugcggc

SEQ ID NO: 2945310 - RNA, 20 nt, Mycobacterium avium subsp. paratuberculosis
cuugcugauccccagcggca

SEQ ID NO: 2945311 - RNA, 17 nt, Mycobacterium avium subsp. paratuberculosis
cuugcugcccgcggccg

SEQ ID NO: 2945312 - RNA, 14 nt, Mycobacterium avium subsp. paratuberculosis
cuugcugccgucgg

SEQ ID NO: 2945313 - RNA, 22 nt, Mycobacterium avium subsp. paratuberculosis
cuugcuggcggccuucuuggcc

SEQ ID NO: 2945314 - RNA, 12 nt, Mycobacterium avium subsp. paratuberculosis
cuuggacagcag

SEQ ID NO: 2945315 - RNA, 16 nt, Mycobacterium avium subsp. paratuberculosis
cuuggacagcagcagc

SEQ ID NO: 2945316 - RNA, 20 nt, Mycobacterium avium subsp. paratuberculosis
cuuggacgaaacccggcgga

SEQ ID NO: 2945317 - RNA, 19 nt, Mycobacterium avium subsp. paratuberculosis
cuuggagccgagcaccggg

SEQ ID NO: 2945318 - RNA, 20 nt, Mycobacterium avium subsp. paratuberculosis
cuuggagccgagcaccgggc

SEQ ID NO: 2945319 - RNA, 14 nt, Mycobacterium avium subsp. paratuberculosis
cuuggcacgggccc

SEQ ID NO: 2945320 - RNA, 17 nt, Mycobacterium avium subsp. paratuberculosis
cuuggcauuuccggcua

SEQ ID NO: 2945321 - RNA, 18 nt, Mycobacterium avium subsp. paratuberculosis
cuuggcauuuccggcuau

SEQ ID NO: 2945322 - RNA, 19 nt, Mycobacterium avium subsp. paratuberculosis
cuuggccagcagccgcgac

SEQ ID NO: 2945323 - RNA, 20 nt, Mycobacterium avium subsp. paratuberculosis
cuuggccagcagugccacca

SEQ ID NO: 2945324 - RNA, 16 nt, Mycobacterium avium subsp. paratuberculosis
cuuggccagcucggcg

SEQ ID NO: 2945325 - RNA, 14 nt, Mycobacterium avium subsp. paratuberculosis
cuuggccaggcggg

SEQ ID NO: 2945326 - RNA, 19 nt, Mycobacterium avium subsp. paratuberculosis
cuuggccaggcgggccacc

SEQ ID NO: 2945327 - RNA, 20 nt, Mycobacterium avium subsp. paratuberculosis
cuuggccaggcgggccacca

SEQ ID NO: 2945328 - RNA, 15 nt, Mycobacterium avium subsp. paratuberculosis
cuuggcccgcgcggc

SEQ ID NO: 2945329 - RNA, 18 nt, Mycobacterium avium subsp. paratuberculosis
cuuggcccgcgcggccgc

SEQ ID NO: 2945330 - RNA, 19 nt, Mycobacterium avium subsp. paratuberculosis
cuuggccgcaggcggccag

SEQ ID NO: 2945331 - RNA, 14 nt, Mycobacterium avium subsp. paratuberculosis
cuuggccgcgccgc

SEQ ID NO: 2945332 - RNA, 17 nt, Mycobacterium avium subsp. paratuberculosis
cuuggccgcgccgccga

SEQ ID NO: 2945333 - RNA, 18 nt, Mycobacterium avium subsp. paratuberculosis
cuuggccgcgccgccgac

SEQ ID NO: 2945334 - RNA, 18 nt, Mycobacterium avium subsp. paratuberculosis
cuuggccggagccuucuu

SEQ ID NO: 2945335 - RNA, 17 nt, Mycobacterium avium subsp. paratuberculosis
cuuggccggugcgccga

SEQ ID NO: 2945336 - RNA, 19 nt, Mycobacterium avium subsp. paratuberculosis
cuuggccggugcgccgacc

SEQ ID NO: 2945337 - RNA, 21 nt, Mycobacterium avium subsp. paratuberculosis
cuuggccguaggucgggucga

SEQ ID NO: 2945338 - RNA, 14 nt, Mycobacterium avium subsp. paratuberculosis
cuuggccuccaccg

SEQ ID NO: 2945339 - RNA, 14 nt, Mycobacterium avium subsp. paratuberculosis
cuuggccugcuugg

SEQ ID NO: 2945340 - RNA, 19 nt, Mycobacterium avium subsp. paratuberculosis
cuuggccugcuugggcagc

SEQ ID NO: 2945341 - RNA, 17 nt, Mycobacterium avium subsp. paratuberculosis
cuuggcgaagucgcagu

SEQ ID NO: 2945342 - RNA, 16 nt, Mycobacterium avium subsp. paratuberculosis
cuuggcgcagccgguc

SEQ ID NO: 2945343 - RNA, 13 nt, Mycobacterium avium subsp. paratuberculosis
cuuggcgcgccgc

SEQ ID NO: 2945344 - RNA, 16 nt, Mycobacterium avium subsp. paratuberculosis
cuuggcgcgccgcacc

SEQ ID NO: 2945345 - RNA, 16 nt, Mycobacterium avium subsp. paratuberculosis
cuuggcgcgcucggug

SEQ ID NO: 2945346 - RNA, 24 nt, Mycobacterium avium subsp. paratuberculosis
cuuggcggccaccaucuccgcggc

SEQ ID NO: 2945347 - RNA, 17 nt, Mycobacterium avium subsp. paratuberculosis
cuuggcggccacgacgg

SEQ ID NO: 2945348 - RNA, 15 nt, Mycobacterium avium subsp. paratuberculosis
cuuggcggccagcgc

SEQ ID NO: 2945349 - RNA, 20 nt, Mycobacterium avium subsp. paratuberculosis
cuuggcggccugcucgaagc

SEQ ID NO: 2945350 - RNA, 14 nt, Mycobacterium avium subsp. paratuberculosis
cuuggcggcggccu

SEQ ID NO: 2945351 - RNA, 19 nt, Mycobacterium avium subsp. paratuberculosis
cuuggcggcggucuucuug

SEQ ID NO: 2945352 - RNA, 13 nt, Mycobacterium avium subsp. paratuberculosis
cuuggcgggcgcc

SEQ ID NO: 2945353 - RNA, 19 nt, Mycobacterium avium subsp. paratuberculosis
cuuucgcgucugcucgccg

SEQ ID NO: 2945354 - RNA, 21 nt, Mycobacterium avium subsp. paratuberculosis
cuuucgcgucugcucgccggc

SEQ ID NO: 2945355 - RNA, 20 nt, Mycobacterium avium subsp. paratuberculosis
cuuucgggcggccugccggc

SEQ ID NO: 2945356 - RNA, 16 nt, Mycobacterium avium subsp. paratuberculosis
cuuucggugcgcaguu

SEQ ID NO: 2945357 - RNA, 14 nt, Mycobacterium avium subsp. paratuberculosis
cuuucgucgcuugg

SEQ ID NO: 2945358 - RNA, 18 nt, Mycobacterium avium subsp. paratuberculosis
cuuucuugcugagcugcg

SEQ ID NO: 2945359 - RNA, 18 nt, Mycobacterium avium subsp. paratuberculosis
cuuugaaccuggccacca

SEQ ID NO: 2945360 - RNA, 20 nt, Mycobacterium avium subsp. paratuberculosis
cuuugaaccuggccaccagc

SEQ ID NO: 2945361 - RNA, 22 nt, Mycobacterium avium subsp. paratuberculosis
cuuugagcauuggcgauggccu

SEQ ID NO: 2945362 - RNA, 17 nt, Mycobacterium avium subsp. paratuberculosis
cuuugccgugcucggcg

SEQ ID NO: 2945363 - RNA, 16 nt, Mycobacterium avium subsp. paratuberculosis
cuuugccguggcggcg

SEQ ID NO: 2945364 - RNA, 16 nt, Mycobacterium avium subsp. paratuberculosis
cuuugccguuccagcc

SEQ ID NO: 2945365 - RNA, 20 nt, Mycobacterium avium subsp. paratuberculosis
cuuugccuuagcccggccgc

SEQ ID NO: 2945366 - RNA, 21 nt, Mycobacterium avium subsp. paratuberculosis
cuuugcggcgaaccgggcccg

SEQ ID NO: 2945367 - RNA, 19 nt, Mycobacterium avium subsp. paratuberculosis
cuuugggaagaggcgcgcu

SEQ ID NO: 2945368 - RNA, 19 nt, Mycobacterium avium subsp. paratuberculosis
cuuuguacaagugaugacc

SEQ ID NO: 2945369 - RNA, 19 nt, Mycobacterium avium subsp. paratuberculosis
cuuuuaaggagcaaucgcu

SEQ ID NO: 2945370 - RNA, 20 nt, Mycobacterium avium subsp. paratuberculosis
cuuuugcgucugcucgccag

SEQ ID NO: 2945371 - RNA, 17 nt, Mycobacterium avium subsp. paratuberculosis
cuuuugugucugcucgc

SEQ ID NO: 2945372 - RNA, 20 nt, Mycobacterium avium subsp. paratuberculosis
cuuuuugaccaccggcacca

SEQ ID NO: 2945373 - RNA, 16 nt, Mycobacterium avium subsp. paratuberculosis
gaaaaaacggcggcgg

SEQ ID NO: 2945374 - RNA, 13 nt, Mycobacterium avium subsp. paratuberculosis
gaaaaacgcgacg

SEQ ID NO: 2945375 - RNA, 15 nt, Mycobacterium avium subsp. paratuberculosis
gaaaaacgcgacggc

SEQ ID NO: 2945376 - RNA, 19 nt, Mycobacterium avium subsp. paratuberculosis
gaaaaacgcgguguagucg

SEQ ID NO: 2945377 - RNA, 20 nt, Mycobacterium avium subsp. paratuberculosis
gaaaaccaccugaccgcggg

SEQ ID NO: 2945378 - RNA, 23 nt, Mycobacterium avium subsp. paratuberculosis
gaaaaccaccugaccgcgggccc

SEQ ID NO: 2945379 - RNA, 17 nt, Mycobacterium avium subsp. paratuberculosis
gaaaaccagcaccggca

SEQ ID NO: 2945380 - RNA, 15 nt, Mycobacterium avium subsp. paratuberculosis
gaaaaccagcgacgc

SEQ ID NO: 2945381 - RNA, 20 nt, Mycobacterium avium subsp. paratuberculosis
gaaaaccagcgacgccagcg

SEQ ID NO: 2945382 - RNA, 21 nt, Mycobacterium avium subsp. paratuberculosis
gaaaaccagcgacgccagcgg

SEQ ID NO: 2945383 - RNA, 21 nt, Mycobacterium avium subsp. paratuberculosis
gaaaaccccaccccgagcagg

SEQ ID NO: 2945384 - RNA, 23 nt, Mycobacterium avium subsp. paratuberculosis
gaaaagcgaccagcgcgccggcc

SEQ ID NO: 2945385 - RNA, 18 nt, Mycobacterium avium subsp. paratuberculosis
gaaaaggucgaacagcuc

SEQ ID NO: 2945386 - RNA, 18 nt, Mycobacterium avium subsp. paratuberculosis
gaaaaguucggcgggggc

SEQ ID NO: 2945387 - RNA, 22 nt, Mycobacterium avium subsp. paratuberculosis
gaaaauccagaacagccagucg

SEQ ID NO: 2945388 - RNA, 21 nt, Mycobacterium avium subsp. paratuberculosis
gaaaauguccuccugcgccgg

SEQ ID NO: 2945389 - RNA, 21 nt, Mycobacterium avium subsp. paratuberculosis
gaaacaacgcaaugcgucgcg

SEQ ID NO: 2945390 - RNA, 14 nt, Mycobacterium avium subsp. paratuberculosis
gaaacacagcagca

SEQ ID NO: 2945391 - RNA, 15 nt, Mycobacterium avium subsp. paratuberculosis
gaaaccaccugccgc

SEQ ID NO: 2945392 - RNA, 17 nt, Mycobacterium avium subsp. paratuberculosis
gaaaccauuccgccaga

SEQ ID NO: 2945393 - RNA, 19 nt, Mycobacterium avium subsp. paratuberculosis
gaaaccauugcaccgcaac

SEQ ID NO: 2945394 - RNA, 13 nt, Mycobacterium avium subsp. paratuberculosis
gaaacccccggga

SEQ ID NO: 2945395 - RNA, 12 nt, Mycobacterium avium subsp. paratuberculosis
gaaacccggcgg

SEQ ID NO: 2945396 - RNA, 11 nt, Mycobacterium avium subsp. paratuberculosis
gaaaccggaug

SEQ ID NO: 2945397 - RNA, 16 nt, Mycobacterium avium subsp. paratuberculosis
gaaaccggaugaugcc

SEQ ID NO: 2945398 - RNA, 13 nt, Mycobacterium avium subsp. paratuberculosis
gaaaccggccagc

SEQ ID NO: 2945399 - RNA, 16 nt, Mycobacterium avium subsp. paratuberculosis
gaaaccggccagcagc

SEQ ID NO: 2945400 - RNA, 19 nt, Mycobacterium avium subsp. paratuberculosis
gaaaccggccagcagcagc

SEQ ID NO: 2945401 - RNA, 22 nt, Mycobacterium avium subsp. paratuberculosis
gaaaccggccagcagcagcccg

SEQ ID NO: 2945402 - RNA, 22 nt, Mycobacterium avium subsp. paratuberculosis
gaaaccggcgggaacucgaugc

SEQ ID NO: 2945403 - RNA, 13 nt, Mycobacterium avium subsp. paratuberculosis
gaaaccgucggcc

SEQ ID NO: 2945404 - RNA, 16 nt, Mycobacterium avium subsp. paratuberculosis
gaaaccgucuccggcg

SEQ ID NO: 2945405 - RNA, 21 nt, Mycobacterium avium subsp. paratuberculosis
gaaaccguggaagucgccguc

SEQ ID NO: 2945406 - RNA, 19 nt, Mycobacterium avium subsp. paratuberculosis
gaaaccguuggccugcgcg

SEQ ID NO: 2945407 - RNA, 23 nt, Mycobacterium avium subsp. paratuberculosis
gaaaccguuuucacagcucaccu

SEQ ID NO: 2945408 - RNA, 15 nt, Mycobacterium avium subsp. paratuberculosis
gaaacgacgucgcca

SEQ ID NO: 2945409 - RNA, 16 nt, Mycobacterium avium subsp. paratuberculosis
gaaacgacgucgccac

SEQ ID NO: 2945410 - RNA, 13 nt, Mycobacterium avium subsp. paratuberculosis
gaaacgcccggcu

SEQ ID NO: 2945411 - RNA, 23 nt, Mycobacterium avium subsp. paratuberculosis
gaaacgcgcgcaguugcgcggcg

SEQ ID NO: 2945412 - RNA, 14 nt, Mycobacterium avium subsp. paratuberculosis
gaaacggaugggcg

SEQ ID NO: 2945413 - RNA, 17 nt, Mycobacterium avium subsp. paratuberculosis
gaaacggcccaucacgu

SEQ ID NO: 2945414 - RNA, 13 nt, Mycobacterium avium subsp. paratuberculosis
gaaacggcugcug

SEQ ID NO: 2945415 - RNA, 19 nt, Mycobacterium avium subsp. paratuberculosis
gaaacggcugcugcgcggc

SEQ ID NO: 2945416 - RNA, 16 nt, Mycobacterium avium subsp. paratuberculosis
gaaacgucgcagcccg

SEQ ID NO: 2945417 - RNA, 21 nt, Mycobacterium avium subsp. paratuberculosis
gaaacuagcuucacgcucggc

SEQ ID NO: 2945418 - RNA, 21 nt, Mycobacterium avium subsp. paratuberculosis
gaaacuagcuucacguucggc

SEQ ID NO: 2945419 - RNA, 20 nt, Mycobacterium avium subsp. paratuberculosis
gaaacuaguuucacguucgg

SEQ ID NO: 2945420 - RNA, 23 nt, Mycobacterium avium subsp. paratuberculosis
gaaacuaguuucacguucggcgg

SEQ ID NO: 2945421 - RNA, 21 nt, Mycobacterium avium subsp. paratuberculosis
gaaacucaccgcgucagcagc

SEQ ID NO: 2945422 - RNA, 16 nt, Mycobacterium avium subsp. paratuberculosis
gaaacucguugccagc

SEQ ID NO: 2945423 - RNA, 20 nt, Mycobacterium avium subsp. paratuberculosis
gaaacucguugccagccggu

SEQ ID NO: 2945424 - RNA, 21 nt, Mycobacterium avium subsp. paratuberculosis
gaaacucguugccagccggug

SEQ ID NO: 2945425 - RNA, 23 nt, Mycobacterium avium subsp. paratuberculosis
gaaacugaccuucucccgcggca

SEQ ID NO: 2945426 - RNA, 17 nt, Mycobacterium avium subsp. paratuberculosis
gaaacuuccgcccggcg

SEQ ID NO: 2945427 - RNA, 23 nt, Mycobacterium avium subsp. paratuberculosis
gaaagaucgucuugaccgcccgg

SEQ ID NO: 2945428 - RNA, 13 nt, Mycobacterium avium subsp. paratuberculosis
gaaagccacccgc

SEQ ID NO: 2945429 - RNA, 14 nt, Mycobacterium avium subsp. paratuberculosis
gaaagccacccgcg

SEQ ID NO: 2945430 - RNA, 12 nt, Mycobacterium avium subsp. paratuberculosis
gaaagccgcgaa

SEQ ID NO: 2945431 - RNA, 17 nt, Mycobacterium avium subsp. paratuberculosis
gaaagccgcugucugcg

SEQ ID NO: 2945432 - RNA, 19 nt, Mycobacterium avium subsp. paratuberculosis
gaaagcgcgagggcucaac

SEQ ID NO: 2945433 - RNA, 18 nt, Mycobacterium avium subsp. paratuberculosis
gaaagcgcuuucgcuggu

SEQ ID NO: 2945434 - RNA, 20 nt, Mycobacterium avium subsp. paratuberculosis
gaaagcgggugaccgacagc

SEQ ID NO: 2945435 - RNA, 12 nt, Mycobacterium avium subsp. paratuberculosis
gaaagcgucggc

SEQ ID NO: 2945436 - RNA, 13 nt, Mycobacterium avium subsp. paratuberculosis
gaaaggaaggcgc

SEQ ID NO: 2945437 - RNA, 16 nt, Mycobacterium avium subsp. paratuberculosis
gaacagcaccgccacg

SEQ ID NO: 2945438 - RNA, 20 nt, Mycobacterium avium subsp. paratuberculosis
gaacagcaccgccacggcga

SEQ ID NO: 2945439 - RNA, 13 nt, Mycobacterium avium subsp. paratuberculosis
gaacagcacgccg

SEQ ID NO: 2945440 - RNA, 14 nt, Mycobacterium avium subsp. paratuberculosis
gaacagcacgccgg

SEQ ID NO: 2945441 - RNA, 15 nt, Mycobacterium avium subsp. paratuberculosis
gaacagcacgccggc

SEQ ID NO: 2945442 - RNA, 11 nt, Mycobacterium avium subsp. paratuberculosis
gaacagcagca

SEQ ID NO: 2945443 - RNA, 14 nt, Mycobacterium avium subsp. paratuberculosis
gaacagcagcaccc

SEQ ID NO: 2945444 - RNA, 18 nt, Mycobacterium avium subsp. paratuberculosis
gaacagcagcagcagcgg

SEQ ID NO: 2945445 - RNA, 22 nt, Mycobacterium avium subsp. paratuberculosis
gaacagcagcagcagcggcagc

SEQ ID NO: 2945446 - RNA, 20 nt, Mycobacterium avium subsp. paratuberculosis
gaacagcagccacgacacca

SEQ ID NO: 2945447 - RNA, 14 nt, Mycobacterium avium subsp. paratuberculosis
gaacagcagcgcgc

SEQ ID NO: 2945448 - RNA, 12 nt, Mycobacterium avium subsp. paratuberculosis
gaacagcaggcc

SEQ ID NO: 2945449 - RNA, 14 nt, Mycobacterium avium subsp. paratuberculosis
gaacagccaggcga

SEQ ID NO: 2945450 - RNA, 17 nt, Mycobacterium avium subsp. paratuberculosis
gaacagccagucgaaga

SEQ ID NO: 2945451 - RNA, 13 nt, Mycobacterium avium subsp. paratuberculosis
gaacagccgggcc

SEQ ID NO: 2945452 - RNA, 14 nt, Mycobacterium avium subsp. paratuberculosis
gaacagccgggccg

SEQ ID NO: 2945453 - RNA, 15 nt, Mycobacterium avium subsp. paratuberculosis
gaacagccgggccgc

SEQ ID NO: 2945454 - RNA, 16 nt, Mycobacterium avium subsp. paratuberculosis
gaacagccgggccgcc

SEQ ID NO: 2945455 - RNA, 17 nt, Mycobacterium avium subsp. paratuberculosis
gaacagccgggccgccc

SEQ ID NO: 2945456 - RNA, 19 nt, Mycobacterium avium subsp. paratuberculosis
gaacagccgggccgcccgc

SEQ ID NO: 2945457 - RNA, 20 nt, Mycobacterium avium subsp. paratuberculosis
gaacagccgguccgaccgcc

SEQ ID NO: 2945458 - RNA, 18 nt, Mycobacterium avium subsp. paratuberculosis
gaacagcgaagccacgga

SEQ ID NO: 2945459 - RNA, 15 nt, Mycobacterium avium subsp. paratuberculosis
gaacagcgacgucug

SEQ ID NO: 2945460 - RNA, 23 nt, Mycobacterium avium subsp. paratuberculosis
gaacagcgacgucugcggcucgg

SEQ ID NO: 2945461 - RNA, 24 nt, Mycobacterium avium subsp. paratuberculosis
gaacagcgacgucugcggcucggc

SEQ ID NO: 2945462 - RNA, 15 nt, Mycobacterium avium subsp. paratuberculosis
gaacagcgccagggu

SEQ ID NO: 2945463 - RNA, 13 nt, Mycobacterium avium subsp. paratuberculosis
gaacagcgcccgg

SEQ ID NO: 2945464 - RNA, 12 nt, Mycobacterium avium subsp. paratuberculosis
gaacagcgccgg

SEQ ID NO: 2945465 - RNA, 15 nt, Mycobacterium avium subsp. paratuberculosis
gaacagcgcgcccga

SEQ ID NO: 2945466 - RNA, 20 nt, Mycobacterium avium subsp. paratuberculosis
gaacagcgcgcccgacgguc

SEQ ID NO: 2945467 - RNA, 15 nt, Mycobacterium avium subsp. paratuberculosis
gaacagcgcgccgaa

SEQ ID NO: 2945468 - RNA, 12 nt, Mycobacterium avium subsp. paratuberculosis
gaacagcgcggc

SEQ ID NO: 2945469 - RNA, 13 nt, Mycobacterium avium subsp. paratuberculosis
gaacagcgcggcc

SEQ ID NO: 2945470 - RNA, 18 nt, Mycobacterium avium subsp. paratuberculosis
gaacagcgggaacaccac

SEQ ID NO: 2945471 - RNA, 15 nt, Mycobacterium avium subsp. paratuberculosis
gaacagcgggccggc

SEQ ID NO: 2945472 - RNA, 16 nt, Mycobacterium avium subsp. paratuberculosis
gaacagcgggccggcg

SEQ ID NO: 2945473 - RNA, 22 nt, Mycobacterium avium subsp. paratuberculosis
gaacagcggggugcccaccacc

SEQ ID NO: 2945474 - RNA, 23 nt, Mycobacterium avium subsp. paratuberculosis
gaacagcggguucuucagggcgg

SEQ ID NO: 2945475 - RNA, 15 nt, Mycobacterium avium subsp. paratuberculosis
gaacagcgucgccga

SEQ ID NO: 2945476 - RNA, 17 nt, Mycobacterium avium subsp. paratuberculosis
gaacagcgucgccgacg

SEQ ID NO: 2945477 - RNA, 18 nt, Mycobacterium avium subsp. paratuberculosis
gaacagcgucgccgacgg

SEQ ID NO: 2945478 - RNA, 20 nt, Mycobacterium avium subsp. paratuberculosis
gaacagcgucgccgacgggc

SEQ ID NO: 2945479 - RNA, 16 nt, Mycobacterium avium subsp. paratuberculosis
gaacagcucgaccagc

SEQ ID NO: 2945480 - RNA, 17 nt, Mycobacterium avium subsp. paratuberculosis
gaacagcuggucccaca

SEQ ID NO: 2945481 - RNA, 15 nt, Mycobacterium avium subsp. paratuberculosis
gaacagcuuggcgca

SEQ ID NO: 2945482 - RNA, 15 nt, Mycobacterium avium subsp. paratuberculosis
gaacaggaugcagcc

SEQ ID NO: 2945483 - RNA, 19 nt, Mycobacterium avium subsp. paratuberculosis
gaacaggaugcagccggcc

SEQ ID NO: 2945484 - RNA, 16 nt, Mycobacterium avium subsp. paratuberculosis
gaacaggaugcgggug

SEQ ID NO: 2945485 - RNA, 17 nt, Mycobacterium avium subsp. paratuberculosis
gaacaggaugcggguga

SEQ ID NO: 2945486 - RNA, 18 nt, Mycobacterium avium subsp. paratuberculosis
gaacaggccgagcgcgcu

SEQ ID NO: 2945487 - RNA, 15 nt, Mycobacterium avium subsp. paratuberculosis
gaacaggcuggccag

SEQ ID NO: 2945488 - RNA, 16 nt, Mycobacterium avium subsp. paratuberculosis
gaacaggcuggccagc

SEQ ID NO: 2945489 - RNA, 22 nt, Mycobacterium avium subsp. paratuberculosis
gaacaggcuggccagcucggcg

SEQ ID NO: 2945490 - RNA, 19 nt, Mycobacterium avium subsp. paratuberculosis
gaacagggcgacggcggcg

SEQ ID NO: 2945491 - RNA, 13 nt, Mycobacterium avium subsp. paratuberculosis
gaacagggcggcg

SEQ ID NO: 2945492 - RNA, 16 nt, Mycobacterium avium subsp. paratuberculosis
gaacagggcggcgggc

SEQ ID NO: 2945493 - RNA, 18 nt, Mycobacterium avium subsp. paratuberculosis
gaacagggcggcgggccc

SEQ ID NO: 2945494 - RNA, 20 nt, Mycobacterium avium subsp. paratuberculosis
gaacagggcggcgggcccgg

SEQ ID NO: 2945495 - RNA, 23 nt, Mycobacterium avium subsp. paratuberculosis
gaacagggcggcgggcccggcga

SEQ ID NO: 2945496 - RNA, 19 nt, Mycobacterium avium subsp. paratuberculosis
gaacagggugacgauccac

SEQ ID NO: 2945497 - RNA, 16 nt, Mycobacterium avium subsp. paratuberculosis
gaacagguaggcggcg

SEQ ID NO: 2945498 - RNA, 20 nt, Mycobacterium avium subsp. paratuberculosis
gaacagguaggcggcgccgu

SEQ ID NO: 2945499 - RNA, 23 nt, Mycobacterium avium subsp. paratuberculosis
gaacagguaggcggcgccgucga

SEQ ID NO: 2945500 - RNA, 18 nt, Mycobacterium avium subsp. paratuberculosis
gaacagucggccggcguu

SEQ ID NO: 2945501 - RNA, 16 nt, Mycobacterium avium subsp. paratuberculosis
gaacaguuccucggcg

SEQ ID NO: 2945502 - RNA, 23 nt, Mycobacterium avium subsp. paratuberculosis
gaacaguucgacguagcccgccg

SEQ ID NO: 2945503 - RNA, 16 nt, Mycobacterium avium subsp. paratuberculosis
gaacaguucggugcac

SEQ ID NO: 2945504 - RNA, 21 nt, Mycobacterium avium subsp. paratuberculosis
gaacaguucggugcacggcgc

SEQ ID NO: 2945505 - RNA, 18 nt, Mycobacterium avium subsp. paratuberculosis
gaacaguucggugcgggu

SEQ ID NO: 2945506 - RNA, 20 nt, Mycobacterium avium subsp. paratuberculosis
gaacaucccggagccgucgg

SEQ ID NO: 2945507 - RNA, 17 nt, Mycobacterium avium subsp. paratuberculosis
gaacaucgagcccaccg

SEQ ID NO: 2945508 - RNA, 20 nt, Mycobacterium avium subsp. paratuberculosis
gaacaucgagcccaccgcgc

SEQ ID NO: 2945509 - RNA, 14 nt, Mycobacterium avium subsp. paratuberculosis
gaacaucgccagca

SEQ ID NO: 2945510 - RNA, 19 nt, Mycobacterium avium subsp. paratuberculosis
gaacaucgccucggccgcg

SEQ ID NO: 2945511 - RNA, 18 nt, Mycobacterium avium subsp. paratuberculosis
gaacaucggcacgugucc

SEQ ID NO: 2945512 - RNA, 16 nt, Mycobacterium avium subsp. paratuberculosis
gaacaucuccagcgcg

SEQ ID NO: 2945513 - RNA, 18 nt, Mycobacterium avium subsp. paratuberculosis
gaacaucuccagcgcggu

SEQ ID NO: 2945514 - RNA, 20 nt, Mycobacterium avium subsp. paratuberculosis
gaacaucuugaucugggugc

SEQ ID NO: 2945515 - RNA, 14 nt, Mycobacterium avium subsp. paratuberculosis
gaacaucuuggggu

SEQ ID NO: 2945516 - RNA, 21 nt, Mycobacterium avium subsp. paratuberculosis
gaacaucuuggucagccgcgg

SEQ ID NO: 2945517 - RNA, 22 nt, Mycobacterium avium subsp. paratuberculosis
gaacaucuuggucagccgcggc

SEQ ID NO: 2945518 - RNA, 17 nt, Mycobacterium avium subsp. paratuberculosis
gaacaugcugccgccgg

SEQ ID NO: 2945519 - RNA, 18 nt, Mycobacterium avium subsp. paratuberculosis
gaacaugcugccgccggc

SEQ ID NO: 2945520 - RNA, 19 nt, Mycobacterium avium subsp. paratuberculosis
gaacaugcugccgccggcg

SEQ ID NO: 2945521 - RNA, 20 nt, Mycobacterium avium subsp. paratuberculosis
gaacaugcugccgccggcga

SEQ ID NO: 2945522 - RNA, 14 nt, Mycobacterium avium subsp. paratuberculosis
gaaccgcucgucgg

SEQ ID NO: 2945523 - RNA, 19 nt, Mycobacterium avium subsp. paratuberculosis
gaaccgcucgucgggaacg

SEQ ID NO: 2945524 - RNA, 19 nt, Mycobacterium avium subsp. paratuberculosis
gaaccgcugcaugccgucg

SEQ ID NO: 2945525 - RNA, 21 nt, Mycobacterium avium subsp. paratuberculosis
gaaccgcugcaugccgucgau

SEQ ID NO: 2945526 - RNA, 24 nt, Mycobacterium avium subsp. paratuberculosis
gaaccgcugcggauaaccguccac

SEQ ID NO: 2945527 - RNA, 14 nt, Mycobacterium avium subsp. paratuberculosis
gaaccgcugcuccg

SEQ ID NO: 2945528 - RNA, 16 nt, Mycobacterium avium subsp. paratuberculosis
gaaccgcugcuccggg

SEQ ID NO: 2945529 - RNA, 19 nt, Mycobacterium avium subsp. paratuberculosis
gaaccgcugcuccgggucc

SEQ ID NO: 2945530 - RNA, 22 nt, Mycobacterium avium subsp. paratuberculosis
gaaccgcugcuccggguccgcg

SEQ ID NO: 2945531 - RNA, 16 nt, Mycobacterium avium subsp. paratuberculosis
gaaccgcugcugcucg

SEQ ID NO: 2945532 - RNA, 19 nt, Mycobacterium avium subsp. paratuberculosis
gaaccgcugcugcucggcc

SEQ ID NO: 2945533 - RNA, 21 nt, Mycobacterium avium subsp. paratuberculosis
gaaccgcugcugcucggccgc

SEQ ID NO: 2945534 - RNA, 19 nt, Mycobacterium avium subsp. paratuberculosis
gaaccgcuugcccagcccc

SEQ ID NO: 2945535 - RNA, 20 nt, Mycobacterium avium subsp. paratuberculosis
gaaccgcuugcccagccccu

SEQ ID NO: 2945536 - RNA, 18 nt, Mycobacterium avium subsp. paratuberculosis
gaaccggaucuggcccug

SEQ ID NO: 2945537 - RNA, 14 nt, Mycobacterium avium subsp. paratuberculosis
gaaccggcagccgg

SEQ ID NO: 2945538 - RNA, 15 nt, Mycobacterium avium subsp. paratuberculosis
gaaccggccaccacg

SEQ ID NO: 2945539 - RNA, 22 nt, Mycobacterium avium subsp. paratuberculosis
gaaccggccaccacgugcgcgu

SEQ ID NO: 2945540 - RNA, 17 nt, Mycobacterium avium subsp. paratuberculosis
gaaccggcccagcagcg

SEQ ID NO: 2945541 - RNA, 19 nt, Mycobacterium avium subsp. paratuberculosis
gaaccggccggggcgccac

SEQ ID NO: 2945542 - RNA, 15 nt, Mycobacterium avium subsp. paratuberculosis
gaaccggcuggacac

SEQ ID NO: 2945543 - RNA, 23 nt, Mycobacterium avium subsp. paratuberculosis
gaaccgggacagccgcgccgaca

SEQ ID NO: 2945544 - RNA, 22 nt, Mycobacterium avium subsp. paratuberculosis
gaaccgggagaacucgacgauc

SEQ ID NO: 2945545 - RNA, 15 nt, Mycobacterium avium subsp. paratuberculosis
gaaccgggcacccgg

SEQ ID NO: 2945546 - RNA, 17 nt, Mycobacterium avium subsp. paratuberculosis
gaaccgggcacccggcg

SEQ ID NO: 2945547 - RNA, 20 nt, Mycobacterium avium subsp. paratuberculosis
gaaccgggcacccggcgcgg

SEQ ID NO: 2945548 - RNA, 21 nt, Mycobacterium avium subsp. paratuberculosis
gaaccgggcacccggcgcggc

SEQ ID NO: 2945549 - RNA, 14 nt, Mycobacterium avium subsp. paratuberculosis
gaaccgggccagga

SEQ ID NO: 2945550 - RNA, 17 nt, Mycobacterium avium subsp. paratuberculosis
gaaccgggccaggauga

SEQ ID NO: 2945551 - RNA, 17 nt, Mycobacterium avium subsp. paratuberculosis
gaaccgggcccguaggu

SEQ ID NO: 2945552 - RNA, 17 nt, Mycobacterium avium subsp. paratuberculosis
gaaccgggccgcuggcc

SEQ ID NO: 2945553 - RNA, 15 nt, Mycobacterium avium subsp. paratuberculosis
gaaccgggcgcgcag

SEQ ID NO: 2945554 - RNA, 16 nt, Mycobacterium avium subsp. paratuberculosis
gaaccgggcgcgcaga

SEQ ID NO: 2945555 - RNA, 11 nt, Mycobacterium avium subsp. paratuberculosis
gaaccggggcc

SEQ ID NO: 2945556 - RNA, 14 nt, Mycobacterium avium subsp. paratuberculosis
gaaccggggccagc

SEQ ID NO: 2945557 - RNA, 15 nt, Mycobacterium avium subsp. paratuberculosis
gaaccggggccagca

SEQ ID NO: 2945558 - RNA, 22 nt, Mycobacterium avium subsp. paratuberculosis
gaaccggggccagcacgccccc

SEQ ID NO: 2945559 - RNA, 15 nt, Mycobacterium avium subsp. paratuberculosis
gaaccggggccgcac

SEQ ID NO: 2945560 - RNA, 16 nt, Mycobacterium avium subsp. paratuberculosis
gaaccggggccgcacc

SEQ ID NO: 2945561 - RNA, 17 nt, Mycobacterium avium subsp. paratuberculosis
gaaccgggucagcacca

SEQ ID NO: 2945562 - RNA, 20 nt, Mycobacterium avium subsp. paratuberculosis
gaaccgggucagcaccacca

SEQ ID NO: 2945563 - RNA, 18 nt, Mycobacterium avium subsp. paratuberculosis
gaaccgguagucgucgag

SEQ ID NO: 2945564 - RNA, 23 nt, Mycobacterium avium subsp. paratuberculosis
gaaccggucguuggccuccucgg

SEQ ID NO: 2945565 - RNA, 16 nt, Mycobacterium avium subsp. paratuberculosis
gaaccgugcacgaucg

SEQ ID NO: 2945566 - RNA, 13 nt, Mycobacterium avium subsp. paratuberculosis
gaaccguucgucg

SEQ ID NO: 2945567 - RNA, 18 nt, Mycobacterium avium subsp. paratuberculosis
gaaccguucgucgucgcg

SEQ ID NO: 2945568 - RNA, 22 nt, Mycobacterium avium subsp. paratuberculosis
gaaccguucgucgucgcgcagg

SEQ ID NO: 2945569 - RNA, 15 nt, Mycobacterium avium subsp. paratuberculosis
gaaccguuugucccu

SEQ ID NO: 2945570 - RNA, 23 nt, Mycobacterium avium subsp. paratuberculosis
gaaccucgagauucugcagccgc

SEQ ID NO: 2945571 - RNA, 15 nt, Mycobacterium avium subsp. paratuberculosis
gaaccucgcggcggc

SEQ ID NO: 2945572 - RNA, 17 nt, Mycobacterium avium subsp. paratuberculosis
gaaccucgcggcggcgu

SEQ ID NO: 2945573 - RNA, 14 nt, Mycobacterium avium subsp. paratuberculosis
gaaccugcugggcg

SEQ ID NO: 2945574 - RNA, 20 nt, Mycobacterium avium subsp. paratuberculosis
gaaccugcugggcggcacca

SEQ ID NO: 2945575 - RNA, 12 nt, Mycobacterium avium subsp. paratuberculosis
gaaccuggccac

SEQ ID NO: 2945576 - RNA, 14 nt, Mycobacterium avium subsp. paratuberculosis
gaaccuggccacca

SEQ ID NO: 2945577 - RNA, 19 nt, Mycobacterium avium subsp. paratuberculosis
gaaccuggccaccagcagc

SEQ ID NO: 2945578 - RNA, 21 nt, Mycobacterium avium subsp. paratuberculosis
gaaccuggccaccagcagcag

SEQ ID NO: 2945579 - RNA, 15 nt, Mycobacterium avium subsp. paratuberculosis
gaaccuggcugccug

SEQ ID NO: 2945580 - RNA, 14 nt, Mycobacterium avium subsp. paratuberculosis
gaacgaaucgucgc

SEQ ID NO: 2945581 - RNA, 18 nt, Mycobacterium avium subsp. paratuberculosis
gaacgaaucgucgccguc

SEQ ID NO: 2945582 - RNA, 14 nt, Mycobacterium avium subsp. paratuberculosis
gaacgacagcagga

SEQ ID NO: 2945583 - RNA, 16 nt, Mycobacterium avium subsp. paratuberculosis
gaacgacagcaggauc

SEQ ID NO: 2945584 - RNA, 15 nt, Mycobacterium avium subsp. paratuberculosis
gaacgaccgggugaa

SEQ ID NO: 2945585 - RNA, 15 nt, Mycobacterium avium subsp. paratuberculosis
gaacgacgagccguc

SEQ ID NO: 2945586 - RNA, 14 nt, Mycobacterium avium subsp. paratuberculosis
gaacgacgccaccg

SEQ ID NO: 2945587 - RNA, 13 nt, Mycobacterium avium subsp. paratuberculosis
gaacgacgccaga

SEQ ID NO: 2945588 - RNA, 17 nt, Mycobacterium avium subsp. paratuberculosis
gaacgacgcgcucagcc

SEQ ID NO: 2945589 - RNA, 24 nt, Mycobacterium avium subsp. paratuberculosis
gaacgacgcggcacgccgcucguc

SEQ ID NO: 2945590 - RNA, 22 nt, Mycobacterium avium subsp. paratuberculosis
gaacgacggugcgcccgucguc

SEQ ID NO: 2945591 - RNA, 20 nt, Mycobacterium avium subsp. paratuberculosis
gaacgacguguucaacgcgc

SEQ ID NO: 2945592 - RNA, 18 nt, Mycobacterium avium subsp. paratuberculosis
gaacgagaaggcggcguc

SEQ ID NO: 2945593 - RNA, 17 nt, Mycobacterium avium subsp. paratuberculosis
gaacgagccggacaucu

SEQ ID NO: 2945594 - RNA, 23 nt, Mycobacterium avium subsp. paratuberculosis
gaacgagccggacaucucccgca

SEQ ID NO: 2945595 - RNA, 15 nt, Mycobacterium avium subsp. paratuberculosis
gaacgaggccgacgu

SEQ ID NO: 2945596 - RNA, 17 nt, Mycobacterium avium subsp. paratuberculosis
gaacgaggccgacgugg

SEQ ID NO: 2945597 - RNA, 12 nt, Mycobacterium avium subsp. paratuberculosis
gaacgaggccgc

SEQ ID NO: 2945598 - RNA, 23 nt, Mycobacterium avium subsp. paratuberculosis
gaacgaggccgcgccgugcgcca

SEQ ID NO: 2945599 - RNA, 17 nt, Mycobacterium avium subsp. paratuberculosis
gaacgaguuucccgucg

SEQ ID NO: 2945600 - RNA, 20 nt, Mycobacterium avium subsp. paratuberculosis
gaacgaguuucccgucgucg

SEQ ID NO: 2945601 - RNA, 18 nt, Mycobacterium avium subsp. paratuberculosis
gaacgaucggcuccagcg

SEQ ID NO: 2945602 - RNA, 16 nt, Mycobacterium avium subsp. paratuberculosis
gaacgcaagaagucgg

SEQ ID NO: 2945603 - RNA, 17 nt, Mycobacterium avium subsp. paratuberculosis
gaacgcaaucgcccagu

SEQ ID NO: 2945604 - RNA, 13 nt, Mycobacterium avium subsp. paratuberculosis
gaacgcaccaccg

SEQ ID NO: 2945605 - RNA, 16 nt, Mycobacterium avium subsp. paratuberculosis
gaacgcaccaccgcgg

SEQ ID NO: 2945606 - RNA, 19 nt, Mycobacterium avium subsp. paratuberculosis
gaacgccaccaccuccucg

SEQ ID NO: 2945607 - RNA, 18 nt, Mycobacterium avium subsp. paratuberculosis
gaacggcaaccugggcgg

SEQ ID NO: 2945608 - RNA, 21 nt, Mycobacterium avium subsp. paratuberculosis
gaacggcaaccugggcggcgg

SEQ ID NO: 2945609 - RNA, 12 nt, Mycobacterium avium subsp. paratuberculosis
gaacggcaacgg

SEQ ID NO: 2945610 - RNA, 16 nt, Mycobacterium avium subsp. paratuberculosis
gaacggcaacggcggc

SEQ ID NO: 2945611 - RNA, 20 nt, Mycobacterium avium subsp. paratuberculosis
gaacggcaccccgcggucgg

SEQ ID NO: 2945612 - RNA, 17 nt, Mycobacterium avium subsp. paratuberculosis
gaacggcacccgcagcu

SEQ ID NO: 2945613 - RNA, 23 nt, Mycobacterium avium subsp. paratuberculosis
gaacggcacccgcagcuccagcg

SEQ ID NO: 2945614 - RNA, 21 nt, Mycobacterium avium subsp. paratuberculosis
gaacggcacguugcccaggaa

SEQ ID NO: 2945615 - RNA, 19 nt, Mycobacterium avium subsp. paratuberculosis
gaacggcagcucgucgacg

SEQ ID NO: 2945616 - RNA, 15 nt, Mycobacterium avium subsp. paratuberculosis
gaacggcccgccgcc

SEQ ID NO: 2945617 - RNA, 18 nt, Mycobacterium avium subsp. paratuberculosis
gaacggcccgccgccggc

SEQ ID NO: 2945618 - RNA, 13 nt, Mycobacterium avium subsp. paratuberculosis
gaacggcccggac

SEQ ID NO: 2945619 - RNA, 15 nt, Mycobacterium avium subsp. paratuberculosis
gaacggccgcgcaga

SEQ ID NO: 2945620 - RNA, 20 nt, Mycobacterium avium subsp. paratuberculosis
gaacggccggauggccagca

SEQ ID NO: 2945621 - RNA, 21 nt, Mycobacterium avium subsp. paratuberculosis
gaacggccggauggccagcag

SEQ ID NO: 2945622 - RNA, 15 nt, Mycobacterium avium subsp. paratuberculosis
gaacggcggcagcga

SEQ ID NO: 2945623 - RNA, 17 nt, Mycobacterium avium subsp. paratuberculosis
gaacggcggcagcgagg

SEQ ID NO: 2945624 - RNA, 14 nt, Mycobacterium avium subsp. paratuberculosis
gaacggcgggcccg

SEQ ID NO: 2945625 - RNA, 22 nt, Mycobacterium avium subsp. paratuberculosis
gaacggcggggccuccaccagc

SEQ ID NO: 2945626 - RNA, 23 nt, Mycobacterium avium subsp. paratuberculosis
gaacggcggggccuccaccagcg

SEQ ID NO: 2945627 - RNA, 16 nt, Mycobacterium avium subsp. paratuberculosis
gaacggcuugcgcucg

SEQ ID NO: 2945628 - RNA, 22 nt, Mycobacterium avium subsp. paratuberculosis
gaacggcuugcgcucggccggg

SEQ ID NO: 2945629 - RNA, 22 nt, Mycobacterium avium subsp. paratuberculosis
gaacgggaugaacucgugcggc

SEQ ID NO: 2945630 - RNA, 15 nt, Mycobacterium avium subsp. paratuberculosis
gaacgggcagccacg

SEQ ID NO: 2945631 - RNA, 18 nt, Mycobacterium avium subsp. paratuberculosis
gaacgggccaagcaccgg

SEQ ID NO: 2945632 - RNA, 24 nt, Mycobacterium avium subsp. paratuberculosis
gaacgggccaagcaccgggauggc

SEQ ID NO: 2945633 - RNA, 14 nt, Mycobacterium avium subsp. paratuberculosis
gaacgggccgcacu

SEQ ID NO: 2945634 - RNA, 20 nt, Mycobacterium avium subsp. paratuberculosis
gaacgggccgggcaccgcgc

SEQ ID NO: 2945635 - RNA, 21 nt, Mycobacterium avium subsp. paratuberculosis
gaacgggccgggcaccgcgcc

SEQ ID NO: 2945636 - RNA, 23 nt, Mycobacterium avium subsp. paratuberculosis
gaacgggucgaucucggcgcagg

SEQ ID NO: 2945637 - RNA, 21 nt, Mycobacterium avium subsp. paratuberculosis
gaacgggugaccggcggccag

SEQ ID NO: 2945638 - RNA, 17 nt, Mycobacterium avium subsp. paratuberculosis
gaacgggugcggcgcuc

SEQ ID NO: 2945639 - RNA, 18 nt, Mycobacterium avium subsp. paratuberculosis
gaacgggugcggcgcucg

SEQ ID NO: 2945640 - RNA, 19 nt, Mycobacterium avium subsp. paratuberculosis
gaacggucagccgcggcuc

SEQ ID NO: 2945641 - RNA, 19 nt, Mycobacterium avium subsp. paratuberculosis
gaacggucggggcggcggg

SEQ ID NO: 2945642 - RNA, 24 nt, Mycobacterium avium subsp. paratuberculosis
gaacggugucacguccacgccgcg

SEQ ID NO: 2945643 - RNA, 20 nt, Mycobacterium avium subsp. paratuberculosis
gaacgguuuuucccagcggc

SEQ ID NO: 2945644 - RNA, 14 nt, Mycobacterium avium subsp. paratuberculosis
gaacgucaggaucc

SEQ ID NO: 2945645 - RNA, 20 nt, Mycobacterium avium subsp. paratuberculosis
gaacgucaggcccagcgagg

SEQ ID NO: 2945646 - RNA, 13 nt, Mycobacterium avium subsp. paratuberculosis
gaacgucaggccg

SEQ ID NO: 2945647 - RNA, 17 nt, Mycobacterium avium subsp. paratuberculosis
gaacgucauggccagcu

SEQ ID NO: 2945648 - RNA, 15 nt, Mycobacterium avium subsp. paratuberculosis
gaacgucccguuggu

SEQ ID NO: 2945649 - RNA, 18 nt, Mycobacterium avium subsp. paratuberculosis
gaacgucccguuggucuc

SEQ ID NO: 2945650 - RNA, 17 nt, Mycobacterium avium subsp. paratuberculosis
gaacgucgagcgcggcc

SEQ ID NO: 2945651 - RNA, 19 nt, Mycobacterium avium subsp. paratuberculosis
gaacgucgagcgcggcccg

SEQ ID NO: 2945652 - RNA, 17 nt, Mycobacterium avium subsp. paratuberculosis
gaacgucgauccccgca

SEQ ID NO: 2945653 - RNA, 17 nt, Mycobacterium avium subsp. paratuberculosis
gaacgucgucagcaccg

SEQ ID NO: 2945654 - RNA, 17 nt, Mycobacterium avium subsp. paratuberculosis
gaacgucuugggcgcga

SEQ ID NO: 2945655 - RNA, 15 nt, Mycobacterium avium subsp. paratuberculosis
gaacgugauggcgaa

SEQ ID NO: 2945656 - RNA, 13 nt, Mycobacterium avium subsp. paratuberculosis
gaacgugcgcggc

SEQ ID NO: 2945657 - RNA, 14 nt, Mycobacterium avium subsp. paratuberculosis
gaacgugcgcggcg

SEQ ID NO: 2945658 - RNA, 16 nt, Mycobacterium avium subsp. paratuberculosis
gaacuacuucgucagc

SEQ ID NO: 2945659 - RNA, 20 nt, Mycobacterium avium subsp. paratuberculosis
gaacuacuucgucagcagcg

SEQ ID NO: 2945660 - RNA, 19 nt, Mycobacterium avium subsp. paratuberculosis
gaacucaccgguggccgcg

SEQ ID NO: 2945661 - RNA, 16 nt, Mycobacterium avium subsp. paratuberculosis
gaacucaggcgcgcac

SEQ ID NO: 2945662 - RNA, 18 nt, Mycobacterium avium subsp. paratuberculosis
gaacucaggcgcgcacgu

SEQ ID NO: 2945663 - RNA, 17 nt, Mycobacterium avium subsp. paratuberculosis
gaacuccacccugccga

SEQ ID NO: 2945664 - RNA, 17 nt, Mycobacterium avium subsp. paratuberculosis
gaacuccagaucgccgc

SEQ ID NO: 2945665 - RNA, 13 nt, Mycobacterium avium subsp. paratuberculosis
gaacuccagcagc

SEQ ID NO: 2945666 - RNA, 21 nt, Mycobacterium avium subsp. paratuberculosis
gaacuccauccgccgucgacc

SEQ ID NO: 2945667 - RNA, 14 nt, Mycobacterium avium subsp. paratuberculosis
gaacuccgacucca

SEQ ID NO: 2945668 - RNA, 18 nt, Mycobacterium avium subsp. paratuberculosis
gaacuccgacuccagcag

SEQ ID NO: 2945669 - RNA, 13 nt, Mycobacterium avium subsp. paratuberculosis
gaacuccgccgaa

SEQ ID NO: 2945670 - RNA, 14 nt, Mycobacterium avium subsp. paratuberculosis
gaacuccgccgaac

SEQ ID NO: 2945671 - RNA, 16 nt, Mycobacterium avium subsp. paratuberculosis
gaacuccgccgaaccg

SEQ ID NO: 2945672 - RNA, 16 nt, Mycobacterium avium subsp. paratuberculosis
gaacuccgcgauggcc

SEQ ID NO: 2945673 - RNA, 23 nt, Mycobacterium avium subsp. paratuberculosis
gaacuccgcgauggccuccgacc

SEQ ID NO: 2945674 - RNA, 13 nt, Mycobacterium avium subsp. paratuberculosis
gaacuccgcgcgc

SEQ ID NO: 2945675 - RNA, 17 nt, Mycobacterium avium subsp. paratuberculosis
gaacuccgcgcgcggca

SEQ ID NO: 2945676 - RNA, 16 nt, Mycobacterium avium subsp. paratuberculosis
gaacuccgucucgccg

SEQ ID NO: 2945677 - RNA, 19 nt, Mycobacterium avium subsp. paratuberculosis
gaacuccugcucgcgggcc

SEQ ID NO: 2945678 - RNA, 20 nt, Mycobacterium avium subsp. paratuberculosis
gaacuccugcucgcgggcca

SEQ ID NO: 2945679 - RNA, 17 nt, Mycobacterium avium subsp. paratuberculosis
gaacuccuugacccggc

SEQ ID NO: 2945680 - RNA, 15 nt, Mycobacterium avium subsp. paratuberculosis
gaacucgacggagug

SEQ ID NO: 2945681 - RNA, 14 nt, Mycobacterium avium subsp. paratuberculosis
gaacucgacgucga

SEQ ID NO: 2945682 - RNA, 20 nt, Mycobacterium avium subsp. paratuberculosis
gaacucgaucugcagccggc

SEQ ID NO: 2945683 - RNA, 21 nt, Mycobacterium avium subsp. paratuberculosis
gaacucgaucugcagccggcg

SEQ ID NO: 2945684 - RNA, 14 nt, Mycobacterium avium subsp. paratuberculosis
gaacucgccgaucg

SEQ ID NO: 2945685 - RNA, 12 nt, Mycobacterium avium subsp. paratuberculosis
gaacucgcgggc

SEQ ID NO: 2945686 - RNA, 22 nt, Mycobacterium avium subsp. paratuberculosis
gaacucgcgggcgagcagcgcc

SEQ ID NO: 2945687 - RNA, 12 nt, Mycobacterium avium subsp. paratuberculosis
gaacucggccag

SEQ ID NO: 2945688 - RNA, 14 nt, Mycobacterium avium subsp. paratuberculosis
gaacucggccagcu

SEQ ID NO: 2945689 - RNA, 16 nt, Mycobacterium avium subsp. paratuberculosis
gaacucggccagggcu

SEQ ID NO: 2945690 - RNA, 21 nt, Mycobacterium avium subsp. paratuberculosis
gaacucggccagggcucgugc

SEQ ID NO: 2945691 - RNA, 14 nt, Mycobacterium avium subsp. paratuberculosis
gaacucggccggca

SEQ ID NO: 2945692 - RNA, 18 nt, Mycobacterium avium subsp. paratuberculosis
gaagaugucggugccgau

SEQ ID NO: 2945693 - RNA, 17 nt, Mycobacterium avium subsp. paratuberculosis
gaagauguugcggcggc

SEQ ID NO: 2945694 - RNA, 18 nt, Mycobacterium avium subsp. paratuberculosis
gaagauguugcggcggcc

SEQ ID NO: 2945695 - RNA, 19 nt, Mycobacterium avium subsp. paratuberculosis
gaagauguugcggcggccg

SEQ ID NO: 2945696 - RNA, 23 nt, Mycobacterium avium subsp. paratuberculosis
gaagcacaccguucccaccggcu

SEQ ID NO: 2945697 - RNA, 20 nt, Mycobacterium avium subsp. paratuberculosis
gaagcacgaccacacccgca

SEQ ID NO: 2945698 - RNA, 17 nt, Mycobacterium avium subsp. paratuberculosis
gaagcagaacgccauca

SEQ ID NO: 2945699 - RNA, 21 nt, Mycobacterium avium subsp. paratuberculosis
gaagcagaacuucuccgccgg

SEQ ID NO: 2945700 - RNA, 13 nt, Mycobacterium avium subsp. paratuberculosis
gaagcagccuucu

SEQ ID NO: 2945701 - RNA, 12 nt, Mycobacterium avium subsp. paratuberculosis
gaagccaggugu

SEQ ID NO: 2945702 - RNA, 15 nt, Mycobacterium avium subsp. paratuberculosis
gaagcccaccgccgu

SEQ ID NO: 2945703 - RNA, 13 nt, Mycobacterium avium subsp. paratuberculosis
gaagcccaccgcg

SEQ ID NO: 2945704 - RNA, 14 nt, Mycobacterium avium subsp. paratuberculosis
gaagcccaccgcgg

SEQ ID NO: 2945705 - RNA, 19 nt, Mycobacterium avium subsp. paratuberculosis
gaagcccaccgcggugacc

SEQ ID NO: 2945706 - RNA, 14 nt, Mycobacterium avium subsp. paratuberculosis
gaagcccagcaccc

SEQ ID NO: 2945707 - RNA, 17 nt, Mycobacterium avium subsp. paratuberculosis
gaagcccagcacccgcu

SEQ ID NO: 2945708 - RNA, 17 nt, Mycobacterium avium subsp. paratuberculosis
gaagcccagcgcguuga

SEQ ID NO: 2945709 - RNA, 18 nt, Mycobacterium avium subsp. paratuberculosis
gaagcccaugccgaugcc

SEQ ID NO: 2945710 - RNA, 15 nt, Mycobacterium avium subsp. paratuberculosis
gaagccccaggcccg

SEQ ID NO: 2945711 - RNA, 23 nt, Mycobacterium avium subsp. paratuberculosis
gaagccccgguuccaaccaccgu

SEQ ID NO: 2945712 - RNA, 21 nt, Mycobacterium avium subsp. paratuberculosis
gaagcccgacaucugccgggc

SEQ ID NO: 2945713 - RNA, 22 nt, Mycobacterium avium subsp. paratuberculosis
gaagcccgacaucugccgggcg

SEQ ID NO: 2945714 - RNA, 15 nt, Mycobacterium avium subsp. paratuberculosis
gaagcccgcagcgaa

SEQ ID NO: 2945715 - RNA, 22 nt, Mycobacterium avium subsp. paratuberculosis
gaagcccgugccgaugccggcc

SEQ ID NO: 2945716 - RNA, 15 nt, Mycobacterium avium subsp. paratuberculosis
gaagcccucgucgaa

SEQ ID NO: 2945717 - RNA, 23 nt, Mycobacterium avium subsp. paratuberculosis
gaagcccucuucgaucaggcgca

SEQ ID NO: 2945718 - RNA, 13 nt, Mycobacterium avium subsp. paratuberculosis
gaagcccugcucg

SEQ ID NO: 2945719 - RNA, 22 nt, Mycobacterium avium subsp. paratuberculosis
gaagcccugcucggugaugccg

SEQ ID NO: 2945720 - RNA, 15 nt, Mycobacterium avium subsp. paratuberculosis
gaagcccuucaccuc

SEQ ID NO: 2945721 - RNA, 19 nt, Mycobacterium avium subsp. paratuberculosis
gaagcccuucaccucggcc

SEQ ID NO: 2945722 - RNA, 20 nt, Mycobacterium avium subsp. paratuberculosis
gaagccgaacgacagcagga

SEQ ID NO: 2945723 - RNA, 13 nt, Mycobacterium avium subsp. paratuberculosis
gaagccgacgccg

SEQ ID NO: 2945724 - RNA, 14 nt, Mycobacterium avium subsp. paratuberculosis
gaagccgacgccgu

SEQ ID NO: 2945725 - RNA, 13 nt, Mycobacterium avium subsp. paratuberculosis
gaagccgacgucc

SEQ ID NO: 2945726 - RNA, 22 nt, Mycobacterium avium subsp. paratuberculosis
gaagccgagcgguccaacgggc

SEQ ID NO: 2945727 - RNA, 22 nt, Mycobacterium avium subsp. paratuberculosis
gaagccgaggucgccgacgccg

SEQ ID NO: 2945728 - RNA, 20 nt, Mycobacterium avium subsp. paratuberculosis
gaagccgaggucgcggcggc

SEQ ID NO: 2945729 - RNA, 22 nt, Mycobacterium avium subsp. paratuberculosis
gaagccgaggucgcggcggccg

SEQ ID NO: 2945730 - RNA, 14 nt, Mycobacterium avium subsp. paratuberculosis
gaagccgcagcagg

SEQ ID NO: 2945731 - RNA, 12 nt, Mycobacterium avium subsp. paratuberculosis
gaagccgccgac

SEQ ID NO: 2945732 - RNA, 13 nt, Mycobacterium avium subsp. paratuberculosis
gaagccgccgacg

SEQ ID NO: 2945733 - RNA, 12 nt, Mycobacterium avium subsp. paratuberculosis
gaagccgccgcc

SEQ ID NO: 2945734 - RNA, 20 nt, Mycobacterium avium subsp. paratuberculosis
gaagccgccgcccugcggga

SEQ ID NO: 2945735 - RNA, 15 nt, Mycobacterium avium subsp. paratuberculosis
gaagccgcggacggc

SEQ ID NO: 2945736 - RNA, 16 nt, Mycobacterium avium subsp. paratuberculosis
gaagccgcggacggcg

SEQ ID NO: 2945737 - RNA, 21 nt, Mycobacterium avium subsp. paratuberculosis
gaagccggccaguucccgggc

SEQ ID NO: 2945738 - RNA, 20 nt, Mycobacterium avium subsp. paratuberculosis
gaagccggcgaacuccaccc

SEQ ID NO: 2945739 - RNA, 16 nt, Mycobacterium avium subsp. paratuberculosis
gaagccggcgacgacc

SEQ ID NO: 2945740 - RNA, 19 nt, Mycobacterium avium subsp. paratuberculosis
gaagccggcgacgaccgca

SEQ ID NO: 2945741 - RNA, 15 nt, Mycobacterium avium subsp. paratuberculosis
gaagccggcgcaggu

SEQ ID NO: 2945742 - RNA, 22 nt, Mycobacterium avium subsp. paratuberculosis
gaagccggcgcagguguccagc

SEQ ID NO: 2945743 - RNA, 18 nt, Mycobacterium avium subsp. paratuberculosis
gaagccggugcccaucgc

SEQ ID NO: 2945744 - RNA, 13 nt, Mycobacterium avium subsp. paratuberculosis
gaagccguagacg

SEQ ID NO: 2945745 - RNA, 19 nt, Mycobacterium avium subsp. paratuberculosis
gaagccgugcacgccgucg

SEQ ID NO: 2945746 - RNA, 20 nt, Mycobacterium avium subsp. paratuberculosis
gaagccgugcacgccgucgu

SEQ ID NO: 2945747 - RNA, 14 nt, Mycobacterium avium subsp. paratuberculosis
gaagccgugggugc

SEQ ID NO: 2945748 - RNA, 16 nt, Mycobacterium avium subsp. paratuberculosis
gaagccgugggugccg

SEQ ID NO: 2945749 - RNA, 22 nt, Mycobacterium avium subsp. paratuberculosis
gaagccgugggugccgacgagc

SEQ ID NO: 2945750 - RNA, 23 nt, Mycobacterium avium subsp. paratuberculosis
gaagccgugggugccgacgagcu

SEQ ID NO: 2945751 - RNA, 21 nt, Mycobacterium avium subsp. paratuberculosis
gaagccguugaugcgcaccgc

SEQ ID NO: 2945752 - RNA, 16 nt, Mycobacterium avium subsp. paratuberculosis
gaagccguugccgccg

SEQ ID NO: 2945753 - RNA, 18 nt, Mycobacterium avium subsp. paratuberculosis
gaagccguugccgccgcg

SEQ ID NO: 2945754 - RNA, 20 nt, Mycobacterium avium subsp. paratuberculosis
gaagccguugccgccgcgcg

SEQ ID NO: 2945755 - RNA, 21 nt, Mycobacterium avium subsp. paratuberculosis
gaagccguugccgccgcgcgc

SEQ ID NO: 2945756 - RNA, 23 nt, Mycobacterium avium subsp. paratuberculosis
gaagccguugccgccgcgcgcgg

SEQ ID NO: 2945757 - RNA, 20 nt, Mycobacterium avium subsp. paratuberculosis
gaagccuggcacgacgccgc

SEQ ID NO: 2945758 - RNA, 17 nt, Mycobacterium avium subsp. paratuberculosis
gaagccuguuggccaga

SEQ ID NO: 2945759 - RNA, 17 nt, Mycobacterium avium subsp. paratuberculosis
gaagcgacaaaggaggg

SEQ ID NO: 2945760 - RNA, 13 nt, Mycobacterium avium subsp. paratuberculosis
gaagcgcagcacc

SEQ ID NO: 2945761 - RNA, 14 nt, Mycobacterium avium subsp. paratuberculosis
gaagcgcagcagcu

SEQ ID NO: 2945762 - RNA, 15 nt, Mycobacterium avium subsp. paratuberculosis
gaagcgcagcagcuc

SEQ ID NO: 2945763 - RNA, 16 nt, Mycobacterium avium subsp. paratuberculosis
gaagcgcagcagcucg

SEQ ID NO: 2945764 - RNA, 13 nt, Mycobacterium avium subsp. paratuberculosis
gaagcgcagcguc

SEQ ID NO: 2945765 - RNA, 17 nt, Mycobacterium avium subsp. paratuberculosis
gaagcgcagcgucuccu

SEQ ID NO: 2945766 - RNA, 16 nt, Mycobacterium avium subsp. paratuberculosis
gaagcgcaucgccggc

SEQ ID NO: 2945767 - RNA, 17 nt, Mycobacterium avium subsp. paratuberculosis
gaagcgcaucgccggcg

SEQ ID NO: 2945768 - RNA, 20 nt, Mycobacterium avium subsp. paratuberculosis
gaagcgcgaccccuacgggc

SEQ ID NO: 2945769 - RNA, 13 nt, Mycobacterium avium subsp. paratuberculosis
gaagcgcgcaucg

SEQ ID NO: 2945770 - RNA, 19 nt, Mycobacterium avium subsp. paratuberculosis
gaagcgcuaacaaaagccc

SEQ ID NO: 2945771 - RNA, 19 nt, Mycobacterium avium subsp. paratuberculosis
gaagcgcuuucccugcucg

SEQ ID NO: 2945772 - RNA, 14 nt, Mycobacterium avium subsp. paratuberculosis
gaagcggcccgaga

SEQ ID NO: 2945773 - RNA, 15 nt, Mycobacterium avium subsp. paratuberculosis
gaagcggcccgagau

SEQ ID NO: 2945774 - RNA, 22 nt, Mycobacterium avium subsp. paratuberculosis
gaagcggcccuguucgccgucg

SEQ ID NO: 2945775 - RNA, 13 nt, Mycobacterium avium subsp. paratuberculosis
gaagcggccgggg

SEQ ID NO: 2945776 - RNA, 16 nt, Mycobacterium avium subsp. paratuberculosis
gaagcggcgcgggucg

SEQ ID NO: 2945777 - RNA, 15 nt, Mycobacterium avium subsp. paratuberculosis
gaaguccugcgccgc

SEQ ID NO: 2945778 - RNA, 12 nt, Mycobacterium avium subsp. paratuberculosis
gaagucgaccgc

SEQ ID NO: 2945779 - RNA, 19 nt, Mycobacterium avium subsp. paratuberculosis
gaagucgacggcggugacg

SEQ ID NO: 2945780 - RNA, 21 nt, Mycobacterium avium subsp. paratuberculosis
gaagucgauugccgcggccgc

SEQ ID NO: 2945781 - RNA, 22 nt, Mycobacterium avium subsp. paratuberculosis
gaagucgcccgcguugcggcgc

SEQ ID NO: 2945782 - RNA, 17 nt, Mycobacterium avium subsp. paratuberculosis
gaagucgccggccagga

SEQ ID NO: 2945783 - RNA, 19 nt, Mycobacterium avium subsp. paratuberculosis
gaagucgccguccggggcc

SEQ ID NO: 2945784 - RNA, 20 nt, Mycobacterium avium subsp. paratuberculosis
gaagucggucugcggagaac

SEQ ID NO: 2945785 - RNA, 19 nt, Mycobacterium avium subsp. paratuberculosis
gaagucggugcccagcgcg

SEQ ID NO: 2945786 - RNA, 17 nt, Mycobacterium avium subsp. paratuberculosis
gaagucguucagcugca

SEQ ID NO: 2945787 - RNA, 22 nt, Mycobacterium avium subsp. paratuberculosis
gaagucguucagcugcagccgg

SEQ ID NO: 2945788 - RNA, 14 nt, Mycobacterium avium subsp. paratuberculosis
gaagucuucggcca

SEQ ID NO: 2945789 - RNA, 16 nt, Mycobacterium avium subsp. paratuberculosis
gaagucuucggccauc

SEQ ID NO: 2945790 - RNA, 18 nt, Mycobacterium avium subsp. paratuberculosis
gaagugcacgccgaggcg

SEQ ID NO: 2945791 - RNA, 17 nt, Mycobacterium avium subsp. paratuberculosis
gaagugcacucggcgau

SEQ ID NO: 2945792 - RNA, 22 nt, Mycobacterium avium subsp. paratuberculosis
gaagugccggcgaaccucaccc

SEQ ID NO: 2945793 - RNA, 12 nt, Mycobacterium avium subsp. paratuberculosis
gaagugccggcu

SEQ ID NO: 2945794 - RNA, 15 nt, Mycobacterium avium subsp. paratuberculosis
gaagugcgccagcga

SEQ ID NO: 2945795 - RNA, 22 nt, Mycobacterium avium subsp. paratuberculosis
gaagugcgccagcgacggccgg

SEQ ID NO: 2945796 - RNA, 23 nt, Mycobacterium avium subsp. paratuberculosis
gaagugcucgaacgcgccgaucg

SEQ ID NO: 2945797 - RNA, 20 nt, Mycobacterium avium subsp. paratuberculosis
gaagugcucgagcacaucgg

SEQ ID NO: 2945798 - RNA, 22 nt, Mycobacterium avium subsp. paratuberculosis
gaagugcucgagcacaucggcg

SEQ ID NO: 2945799 - RNA, 14 nt, Mycobacterium avium subsp. paratuberculosis
gaaguggacaugca

SEQ ID NO: 2945800 - RNA, 22 nt, Mycobacterium avium subsp. paratuberculosis
gaaguggcagcgcuccugcagc

SEQ ID NO: 2945801 - RNA, 14 nt, Mycobacterium avium subsp. paratuberculosis
gaagugggccauca

SEQ ID NO: 2945802 - RNA, 16 nt, Mycobacterium avium subsp. paratuberculosis
gaagugggccaucauc

SEQ ID NO: 2945803 - RNA, 16 nt, Mycobacterium avium subsp. paratuberculosis
gaaguucaccaccgcg

SEQ ID NO: 2945804 - RNA, 17 nt, Mycobacterium avium subsp. paratuberculosis
gaaguuccagccgaucg

SEQ ID NO: 2945805 - RNA, 12 nt, Mycobacterium avium subsp. paratuberculosis
gaaguucgcugg

SEQ ID NO: 2945806 - RNA, 20 nt, Mycobacterium avium subsp. paratuberculosis
gaaguucuccagcacgaagg

SEQ ID NO: 2945807 - RNA, 17 nt, Mycobacterium avium subsp. paratuberculosis
gaaguugaagacgcgaa

SEQ ID NO: 2945808 - RNA, 15 nt, Mycobacterium avium subsp. paratuberculosis
gaaguugaucgcggc

SEQ ID NO: 2945809 - RNA, 12 nt, Mycobacterium avium subsp. paratuberculosis
gaaguugccgcc

SEQ ID NO: 2945810 - RNA, 14 nt, Mycobacterium avium subsp. paratuberculosis
gaaguugccgccgc

SEQ ID NO: 2945811 - RNA, 17 nt, Mycobacterium avium subsp. paratuberculosis
gaaguugccggucaggc

SEQ ID NO: 2945812 - RNA, 18 nt, Mycobacterium avium subsp. paratuberculosis
gaaguugccggucaggca

SEQ ID NO: 2945813 - RNA, 15 nt, Mycobacterium avium subsp. paratuberculosis
gaaguuggccaccgg

SEQ ID NO: 2945814 - RNA, 13 nt, Mycobacterium avium subsp. paratuberculosis
gaaguuggccucc

SEQ ID NO: 2945815 - RNA, 15 nt, Mycobacterium avium subsp. paratuberculosis
gaaguuggcggcggu

SEQ ID NO: 2945816 - RNA, 20 nt, Mycobacterium avium subsp. paratuberculosis
gaaguuguagacguagugca

SEQ ID NO: 2945817 - RNA, 18 nt, Mycobacterium avium subsp. paratuberculosis
gaaguuuccccaccaggc

SEQ ID NO: 2945818 - RNA, 19 nt, Mycobacterium avium subsp. paratuberculosis
gaaguuuccccaccaggcg

SEQ ID NO: 2945819 - RNA, 14 nt, Mycobacterium avium subsp. paratuberculosis
gaauaacgccggcc

SEQ ID NO: 2945820 - RNA, 23 nt, Mycobacterium avium subsp. paratuberculosis
gaauaacgccggccccggcgacg

SEQ ID NO: 2945821 - RNA, 15 nt, Mycobacterium avium subsp. paratuberculosis
gaauaccacugcgcg

SEQ ID NO: 2945822 - RNA, 22 nt, Mycobacterium avium subsp. paratuberculosis
gaauaccagggcgaggaacccg

SEQ ID NO: 2945823 - RNA, 16 nt, Mycobacterium avium subsp. paratuberculosis
gaauaccaucaacccg

SEQ ID NO: 2945824 - RNA, 19 nt, Mycobacterium avium subsp. paratuberculosis
gaauaccaucaacccgagc

SEQ ID NO: 2945825 - RNA, 23 nt, Mycobacterium avium subsp. paratuberculosis
gaauaccaucaacccgagcaccg

SEQ ID NO: 2945826 - RNA, 16 nt, Mycobacterium avium subsp. paratuberculosis
gaauacccgcccagca

SEQ ID NO: 2945827 - RNA, 20 nt, Mycobacterium avium subsp. paratuberculosis
gaauacccgcccagcaccag

SEQ ID NO: 2945828 - RNA, 19 nt, Mycobacterium avium subsp. paratuberculosis
gaauacccuccgggcggca

SEQ ID NO: 2945829 - RNA, 16 nt, Mycobacterium avium subsp. paratuberculosis
gaauacccuucggccg

SEQ ID NO: 2945830 - RNA, 20 nt, Mycobacterium avium subsp. paratuberculosis
gaauacccuucggccggcag

SEQ ID NO: 2945831 - RNA, 17 nt, Mycobacterium avium subsp. paratuberculosis
gaauacgccaucagcac

SEQ ID NO: 2945832 - RNA, 13 nt, Mycobacterium avium subsp. paratuberculosis
gaauaggccgcgu

SEQ ID NO: 2945833 - RNA, 18 nt, Mycobacterium avium subsp. paratuberculosis
gaaucacacugccgguca

SEQ ID NO: 2945834 - RNA, 14 nt, Mycobacterium avium subsp. paratuberculosis
gaaucaccaagcgc

SEQ ID NO: 2945835 - RNA, 19 nt, Mycobacterium avium subsp. paratuberculosis
gaaucaccuugcccugcgu

SEQ ID NO: 2945836 - RNA, 22 nt, Mycobacterium avium subsp. paratuberculosis
gaaucaccuugcccugcgugca

SEQ ID NO: 2945837 - RNA, 17 nt, Mycobacterium avium subsp. paratuberculosis
gaaucacuuccgcggca

SEQ ID NO: 2945838 - RNA, 13 nt, Mycobacterium avium subsp. paratuberculosis
gaauccagccgug

SEQ ID NO: 2945839 - RNA, 20 nt, Mycobacterium avium subsp. paratuberculosis
gaauccagccgugcggcuug

SEQ ID NO: 2945840 - RNA, 14 nt, Mycobacterium avium subsp. paratuberculosis
gaaucccacccgca

SEQ ID NO: 2945841 - RNA, 15 nt, Mycobacterium avium subsp. paratuberculosis
gaaucccacccgcaa

SEQ ID NO: 2945842 - RNA, 14 nt, Mycobacterium avium subsp. paratuberculosis
gaaucccuccggca

SEQ ID NO: 2945843 - RNA, 17 nt, Mycobacterium avium subsp. paratuberculosis
gaaucccuccggcaggc

SEQ ID NO: 2945844 - RNA, 19 nt, Mycobacterium avium subsp. paratuberculosis
gaaucccuccggcaggccg

SEQ ID NO: 2945845 - RNA, 14 nt, Mycobacterium avium subsp. paratuberculosis
gaauccgagcaucg

SEQ ID NO: 2945846 - RNA, 13 nt, Mycobacterium avium subsp. paratuberculosis
gaauccgcgcagc

SEQ ID NO: 2945847 - RNA, 16 nt, Mycobacterium avium subsp. paratuberculosis
gaauccgcgcagcagc

SEQ ID NO: 2945848 - RNA, 14 nt, Mycobacterium avium subsp. paratuberculosis
gaauccggcggcgc

SEQ ID NO: 2945849 - RNA, 20 nt, Mycobacterium avium subsp. paratuberculosis
gaauccgggugucgacgccg

SEQ ID NO: 2945850 - RNA, 21 nt, Mycobacterium avium subsp. paratuberculosis
gaauccggucaacgccgcgcg

SEQ ID NO: 2945851 - RNA, 16 nt, Mycobacterium avium subsp. paratuberculosis
gaauccggugaccgcc

SEQ ID NO: 2945852 - RNA, 13 nt, Mycobacterium avium subsp. paratuberculosis
gaauccuggccga

SEQ ID NO: 2945853 - RNA, 22 nt, Mycobacterium avium subsp. paratuberculosis
gaauccuggccgauggucagcu

SEQ ID NO: 2945854 - RNA, 22 nt, Mycobacterium avium subsp. paratuberculosis
gaauccuguugguagcccagga

SEQ ID NO: 2945855 - RNA, 19 nt, Mycobacterium avium subsp. paratuberculosis
gaaucgacaccgcacggcc

SEQ ID NO: 2945856 - RNA, 15 nt, Mycobacterium avium subsp. paratuberculosis
gaaucgaccggguug

SEQ ID NO: 2945857 - RNA, 22 nt, Mycobacterium avium subsp. paratuberculosis
gaaucgauaacgcgcgcgccgu

SEQ ID NO: 2945858 - RNA, 16 nt, Mycobacterium avium subsp. paratuberculosis
gaaucgcaagcagagc

SEQ ID NO: 2945859 - RNA, 12 nt, Mycobacterium avium subsp. paratuberculosis
gaaucgcccggg

SEQ ID NO: 2945860 - RNA, 15 nt, Mycobacterium avium subsp. paratuberculosis
gaaucgccgagcucg

SEQ ID NO: 2945861 - RNA, 17 nt, Mycobacterium avium subsp. paratuberculosis
gaaucgccuacugcgcc

SEQ ID NO: 2945862 - RNA, 17 nt, Mycobacterium avium subsp. paratuberculosis
gacaccagggugcgcac

SEQ ID NO: 2945863 - RNA, 19 nt, Mycobacterium avium subsp. paratuberculosis
gacaccagggugcgcacga

SEQ ID NO: 2945864 - RNA, 20 nt, Mycobacterium avium subsp. paratuberculosis
gacaccagucgcacaaccgu

SEQ ID NO: 2945865 - RNA, 14 nt, Mycobacterium avium subsp. paratuberculosis
gacacccagcggcg

SEQ ID NO: 2945866 - RNA, 15 nt, Mycobacterium avium subsp. paratuberculosis
gacaccccacaccgu

SEQ ID NO: 2945867 - RNA, 21 nt, Mycobacterium avium subsp. paratuberculosis
gacacccccgauccgccguug

SEQ ID NO: 2945868 - RNA, 20 nt, Mycobacterium avium subsp. paratuberculosis
gacaccccgcgagucaccgg

SEQ ID NO: 2945869 - RNA, 16 nt, Mycobacterium avium subsp. paratuberculosis
gacaccccgcucggcc

SEQ ID NO: 2945870 - RNA, 19 nt, Mycobacterium avium subsp. paratuberculosis
gacaccccgcucggccagc

SEQ ID NO: 2945871 - RNA, 23 nt, Mycobacterium avium subsp. paratuberculosis
gacaccccgcucggccagcgcgc

SEQ ID NO: 2945872 - RNA, 16 nt, Mycobacterium avium subsp. paratuberculosis
gacaccccggcgauga

SEQ ID NO: 2945873 - RNA, 17 nt, Mycobacterium avium subsp. paratuberculosis
gacaccccggcgaugac

SEQ ID NO: 2945874 - RNA, 22 nt, Mycobacterium avium subsp. paratuberculosis
gacaccccguaggugcacagcc

SEQ ID NO: 2945875 - RNA, 20 nt, Mycobacterium avium subsp. paratuberculosis
gacacccgacgaagccgccg

SEQ ID NO: 2945876 - RNA, 14 nt, Mycobacterium avium subsp. paratuberculosis
gacacccgcgcggu

SEQ ID NO: 2945877 - RNA, 20 nt, Mycobacterium avium subsp. paratuberculosis
gacacccucgcgcaggaaca

SEQ ID NO: 2945878 - RNA, 16 nt, Mycobacterium avium subsp. paratuberculosis
gacacccucgggguag

SEQ ID NO: 2945879 - RNA, 23 nt, Mycobacterium avium subsp. paratuberculosis
gacacccucgggguagccggccc

SEQ ID NO: 2945880 - RNA, 17 nt, Mycobacterium avium subsp. paratuberculosis
gacacccuucaucagca

SEQ ID NO: 2945881 - RNA, 19 nt, Mycobacterium avium subsp. paratuberculosis
gacacccuucaucagcacc

SEQ ID NO: 2945882 - RNA, 20 nt, Mycobacterium avium subsp. paratuberculosis
gacacccuucaucagcaccg

SEQ ID NO: 2945883 - RNA, 23 nt, Mycobacterium avium subsp. paratuberculosis
gacacccuucaucagcaccgcga

SEQ ID NO: 2945884 - RNA, 16 nt, Mycobacterium avium subsp. paratuberculosis
gacaccgaacccacca

SEQ ID NO: 2945885 - RNA, 20 nt, Mycobacterium avium subsp. paratuberculosis
gacaccgaacccaccagcgc

SEQ ID NO: 2945886 - RNA, 22 nt, Mycobacterium avium subsp. paratuberculosis
gacaccgaacccaccagcgccu

SEQ ID NO: 2945887 - RNA, 18 nt, Mycobacterium avium subsp. paratuberculosis
gacaccgaaccgccccgc

SEQ ID NO: 2945888 - RNA, 21 nt, Mycobacterium avium subsp. paratuberculosis
gacaccgaaccgccccgcgcg

SEQ ID NO: 2945889 - RNA, 13 nt, Mycobacterium avium subsp. paratuberculosis
gacaccgacgacc

SEQ ID NO: 2945890 - RNA, 18 nt, Mycobacterium avium subsp. paratuberculosis
gacaccgacgaccaucag

SEQ ID NO: 2945891 - RNA, 19 nt, Mycobacterium avium subsp. paratuberculosis
gacaccgcacggcccauca

SEQ ID NO: 2945892 - RNA, 23 nt, Mycobacterium avium subsp. paratuberculosis
gacaccgcacggcccaucaccag

SEQ ID NO: 2945893 - RNA, 13 nt, Mycobacterium avium subsp. paratuberculosis
gacaccgcauggc

SEQ ID NO: 2945894 - RNA, 17 nt, Mycobacterium avium subsp. paratuberculosis
gacaccgcauggccggc

SEQ ID NO: 2945895 - RNA, 18 nt, Mycobacterium avium subsp. paratuberculosis
gacaccgcauggccggcg

SEQ ID NO: 2945896 - RNA, 13 nt, Mycobacterium avium subsp. paratuberculosis
gacaccgccagca

SEQ ID NO: 2945897 - RNA, 14 nt, Mycobacterium avium subsp. paratuberculosis
gacaccgccagcag

SEQ ID NO: 2945898 - RNA, 15 nt, Mycobacterium avium subsp. paratuberculosis
gacaccgccagcagc

SEQ ID NO: 2945899 - RNA, 18 nt, Mycobacterium avium subsp. paratuberculosis
gacaccgccccgccgcgc

SEQ ID NO: 2945900 - RNA, 20 nt, Mycobacterium avium subsp. paratuberculosis
gacaccgccccgccgcgccg

SEQ ID NO: 2945901 - RNA, 21 nt, Mycobacterium avium subsp. paratuberculosis
gacaccgccccgccgcgccgg

SEQ ID NO: 2945902 - RNA, 23 nt, Mycobacterium avium subsp. paratuberculosis
gacaccgccuucgacggccggcc

SEQ ID NO: 2945903 - RNA, 19 nt, Mycobacterium avium subsp. paratuberculosis
gacaccgcgaucaccaccc

SEQ ID NO: 2945904 - RNA, 17 nt, Mycobacterium avium subsp. paratuberculosis
gacaccgcggaccaccg

SEQ ID NO: 2945905 - RNA, 15 nt, Mycobacterium avium subsp. paratuberculosis
gacaccgcuggccga

SEQ ID NO: 2945906 - RNA, 18 nt, Mycobacterium avium subsp. paratuberculosis
gacaccgcuggccgaggc

SEQ ID NO: 2945907 - RNA, 20 nt, Mycobacterium avium subsp. paratuberculosis
gacaccgcuggccgaggccu

SEQ ID NO: 2945908 - RNA, 15 nt, Mycobacterium avium subsp. paratuberculosis
gacaccggacugcuu

SEQ ID NO: 2945909 - RNA, 18 nt, Mycobacterium avium subsp. paratuberculosis
gacaccggcacgucggcc

SEQ ID NO: 2945910 - RNA, 13 nt, Mycobacterium avium subsp. paratuberculosis
gacaccggccggg

SEQ ID NO: 2945911 - RNA, 14 nt, Mycobacterium avium subsp. paratuberculosis
gacaccggccggga

SEQ ID NO: 2945912 - RNA, 20 nt, Mycobacterium avium subsp. paratuberculosis
gacaccgggcaccgacauca

SEQ ID NO: 2945913 - RNA, 21 nt, Mycobacterium avium subsp. paratuberculosis
gacaccgggcaccgacaucag

SEQ ID NO: 2945914 - RNA, 14 nt, Mycobacterium avium subsp. paratuberculosis
gacaccgggugcgu

SEQ ID NO: 2945915 - RNA, 20 nt, Mycobacterium avium subsp. paratuberculosis
gacaccgggugcguccagac

SEQ ID NO: 2945916 - RNA, 17 nt, Mycobacterium avium subsp. paratuberculosis
gacaccgucgccgugau

SEQ ID NO: 2945917 - RNA, 14 nt, Mycobacterium avium subsp. paratuberculosis
gacaccgucgcgca

SEQ ID NO: 2945918 - RNA, 15 nt, Mycobacterium avium subsp. paratuberculosis
gacaccgucgcgcac

SEQ ID NO: 2945919 - RNA, 16 nt, Mycobacterium avium subsp. paratuberculosis
gacaccgucgcgcacc

SEQ ID NO: 2945920 - RNA, 17 nt, Mycobacterium avium subsp. paratuberculosis
gacaccgucgcgcaccc

SEQ ID NO: 2945921 - RNA, 19 nt, Mycobacterium avium subsp. paratuberculosis
gacaccgucgcgcacccag

SEQ ID NO: 2945922 - RNA, 14 nt, Mycobacterium avium subsp. paratuberculosis
gacaccgugguggc

SEQ ID NO: 2945923 - RNA, 23 nt, Mycobacterium avium subsp. paratuberculosis
gacaccuccuuggguucggcggc

SEQ ID NO: 2945924 - RNA, 16 nt, Mycobacterium avium subsp. paratuberculosis
gacaccucgccguccu

SEQ ID NO: 2945925 - RNA, 15 nt, Mycobacterium avium subsp. paratuberculosis
gacaccucggccagc

SEQ ID NO: 2945926 - RNA, 16 nt, Mycobacterium avium subsp. paratuberculosis
gacaccucggccagcg

SEQ ID NO: 2945927 - RNA, 18 nt, Mycobacterium avium subsp. paratuberculosis
gacaccucggccagcgcc

SEQ ID NO: 2945928 - RNA, 20 nt, Mycobacterium avium subsp. paratuberculosis
gacaccucggccagcgccgc

SEQ ID NO: 2945929 - RNA, 21 nt, Mycobacterium avium subsp. paratuberculosis
gacaccucggccagcgccgcg

SEQ ID NO: 2945930 - RNA, 22 nt, Mycobacterium avium subsp. paratuberculosis
gacaccugcucaccgagcuggg

SEQ ID NO: 2945931 - RNA, 23 nt, Mycobacterium avium subsp. paratuberculosis
gacaccugcucaccgagcugggc

SEQ ID NO: 2945932 - RNA, 15 nt, Mycobacterium avium subsp. paratuberculosis
gacaccuuggcggcc

SEQ ID NO: 2945933 - RNA, 21 nt, Mycobacterium avium subsp. paratuberculosis
gacacgaauacccuucggccg

SEQ ID NO: 2945934 - RNA, 23 nt, Mycobacterium avium subsp. paratuberculosis
gacacgaauacccuucggccggc

SEQ ID NO: 2945935 - RNA, 20 nt, Mycobacterium avium subsp. paratuberculosis
gacacgaucggcaugacgcc

SEQ ID NO: 2945936 - RNA, 16 nt, Mycobacterium avium subsp. paratuberculosis
gacacgaugggucagg

SEQ ID NO: 2945937 - RNA, 20 nt, Mycobacterium avium subsp. paratuberculosis
gacacgauguugaugucgcg

SEQ ID NO: 2945938 - RNA, 22 nt, Mycobacterium avium subsp. paratuberculosis
gacacgauguugaugucgcgcg

SEQ ID NO: 2945939 - RNA, 14 nt, Mycobacterium avium subsp. paratuberculosis
gacacgccccgaug

SEQ ID NO: 2945940 - RNA, 16 nt, Mycobacterium avium subsp. paratuberculosis
gacacgccccgauggu

SEQ ID NO: 2945941 - RNA, 17 nt, Mycobacterium avium subsp. paratuberculosis
gacacgccccgauggua

SEQ ID NO: 2945942 - RNA, 15 nt, Mycobacterium avium subsp. paratuberculosis
gacacgcccugguag

SEQ ID NO: 2945943 - RNA, 13 nt, Mycobacterium avium subsp. paratuberculosis
gacacgcgccggc

SEQ ID NO: 2945944 - RNA, 14 nt, Mycobacterium avium subsp. paratuberculosis
gacacgcgccggcg

SEQ ID NO: 2945945 - RNA, 17 nt, Mycobacterium avium subsp. paratuberculosis
gacacgcgccggcgcgg

SEQ ID NO: 2945946 - RNA, 19 nt, Mycobacterium avium subsp. paratuberculosis
gacauccaggaccgcgcgc

SEQ ID NO: 2945947 - RNA, 23 nt, Mycobacterium avium subsp. paratuberculosis
gacauccaggaccgcgcgccggc

SEQ ID NO: 2945948 - RNA, 17 nt, Mycobacterium avium subsp. paratuberculosis
gacauccauugggccgc

SEQ ID NO: 2945949 - RNA, 23 nt, Mycobacterium avium subsp. paratuberculosis
gacauccgugagggaccuccagc

SEQ ID NO: 2945950 - RNA, 22 nt, Mycobacterium avium subsp. paratuberculosis
gacauccugcgcaucgagcugc

SEQ ID NO: 2945951 - RNA, 20 nt, Mycobacterium avium subsp. paratuberculosis
gacaucgaaugcagcggcuc

SEQ ID NO: 2945952 - RNA, 17 nt, Mycobacterium avium subsp. paratuberculosis
gacaucgccaccuggaa

SEQ ID NO: 2945953 - RNA, 19 nt, Mycobacterium avium subsp. paratuberculosis
gacaucgccaucagcagcg

SEQ ID NO: 2945954 - RNA, 20 nt, Mycobacterium avium subsp. paratuberculosis
gacaucgccaucagcagcgc

SEQ ID NO: 2945955 - RNA, 12 nt, Mycobacterium avium subsp. paratuberculosis
gacaucgccgcg

SEQ ID NO: 2945956 - RNA, 14 nt, Mycobacterium avium subsp. paratuberculosis
gacaucgccggcga

SEQ ID NO: 2945957 - RNA, 21 nt, Mycobacterium avium subsp. paratuberculosis
gacaucgccggcgaccgugcc

SEQ ID NO: 2945958 - RNA, 14 nt, Mycobacterium avium subsp. paratuberculosis
gacaucggcacacg

SEQ ID NO: 2945959 - RNA, 19 nt, Mycobacterium avium subsp. paratuberculosis
gacaucggcagcagggugc

SEQ ID NO: 2945960 - RNA, 23 nt, Mycobacterium avium subsp. paratuberculosis
gacaucggcagcagggugccgcc

SEQ ID NO: 2945961 - RNA, 13 nt, Mycobacterium avium subsp. paratuberculosis
gacaucggccgcc

SEQ ID NO: 2945962 - RNA, 18 nt, Mycobacterium avium subsp. paratuberculosis
gacaucggugaccgucgc

SEQ ID NO: 2945963 - RNA, 22 nt, Mycobacterium avium subsp. paratuberculosis
gacaucggugaccgucgccgac

SEQ ID NO: 2945964 - RNA, 14 nt, Mycobacterium avium subsp. paratuberculosis
gacaucgucgcgcc

SEQ ID NO: 2945965 - RNA, 21 nt, Mycobacterium avium subsp. paratuberculosis
gacaucuccggcacguugacg

SEQ ID NO: 2945966 - RNA, 18 nt, Mycobacterium avium subsp. paratuberculosis
gacaucucgacggugacc

SEQ ID NO: 2945967 - RNA, 22 nt, Mycobacterium avium subsp. paratuberculosis
gacaucugccgggcggcgacgu

SEQ ID NO: 2945968 - RNA, 17 nt, Mycobacterium avium subsp. paratuberculosis
gacaugaagcccccguu

SEQ ID NO: 2945969 - RNA, 16 nt, Mycobacterium avium subsp. paratuberculosis
gacaugaccaccgcgu

SEQ ID NO: 2945970 - RNA, 17 nt, Mycobacterium avium subsp. paratuberculosis
gacaugaccaccgcguc

SEQ ID NO: 2945971 - RNA, 14 nt, Mycobacterium avium subsp. paratuberculosis
gacaugcagccgcc

SEQ ID NO: 2945972 - RNA, 18 nt, Mycobacterium avium subsp. paratuberculosis
gacaugcccgcggugcag

SEQ ID NO: 2945973 - RNA, 19 nt, Mycobacterium avium subsp. paratuberculosis
gacaugcccggcgacggcg

SEQ ID NO: 2945974 - RNA, 20 nt, Mycobacterium avium subsp. paratuberculosis
gacaugcccggcgacggcgc

SEQ ID NO: 2945975 - RNA, 13 nt, Mycobacterium avium subsp. paratuberculosis
gacaugccgagca

SEQ ID NO: 2945976 - RNA, 15 nt, Mycobacterium avium subsp. paratuberculosis
gacaugccgagcagc

SEQ ID NO: 2945977 - RNA, 17 nt, Mycobacterium avium subsp. paratuberculosis
gacaugccgagcagcac

SEQ ID NO: 2945978 - RNA, 18 nt, Mycobacterium avium subsp. paratuberculosis
gacaugccgagcagcacc

SEQ ID NO: 2945979 - RNA, 22 nt, Mycobacterium avium subsp. paratuberculosis
gacaugccgagcagcaccgcga

SEQ ID NO: 2945980 - RNA, 12 nt, Mycobacterium avium subsp. paratuberculosis
gacaugccggcg

SEQ ID NO: 2945981 - RNA, 14 nt, Mycobacterium avium subsp. paratuberculosis
gacaugccggcgcc

SEQ ID NO: 2945982 - RNA, 16 nt, Mycobacterium avium subsp. paratuberculosis
gacaugcgcagcgccc

SEQ ID NO: 2945983 - RNA, 13 nt, Mycobacterium avium subsp. paratuberculosis
gacaugcugggcu

SEQ ID NO: 2945984 - RNA, 13 nt, Mycobacterium avium subsp. paratuberculosis
gacauggacgcgg

SEQ ID NO: 2945985 - RNA, 15 nt, Mycobacterium avium subsp. paratuberculosis
gacauggacgcggcc

SEQ ID NO: 2945986 - RNA, 21 nt, Mycobacterium avium subsp. paratuberculosis
gacauggucgggcgcaccacg

SEQ ID NO: 2945987 - RNA, 22 nt, Mycobacterium avium subsp. paratuberculosis
gacauggucgggcgcaccacga

SEQ ID NO: 2945988 - RNA, 18 nt, Mycobacterium avium subsp. paratuberculosis
gacaugugagguggcugg

SEQ ID NO: 2945989 - RNA, 21 nt, Mycobacterium avium subsp. paratuberculosis
gacauucggggccaccaggcc

SEQ ID NO: 2945990 - RNA, 19 nt, Mycobacterium avium subsp. paratuberculosis
gacauuggccgcgcgcagg

SEQ ID NO: 2945991 - RNA, 14 nt, Mycobacterium avium subsp. paratuberculosis
gacauugggggcuu

SEQ ID NO: 2945992 - RNA, 12 nt, Mycobacterium avium subsp. paratuberculosis
gaccaacacccc

SEQ ID NO: 2945993 - RNA, 20 nt, Mycobacterium avium subsp. paratuberculosis
gaccaacacccccgcgcugc

SEQ ID NO: 2945994 - RNA, 14 nt, Mycobacterium avium subsp. paratuberculosis
gaccaacgggcggc

SEQ ID NO: 2945995 - RNA, 15 nt, Mycobacterium avium subsp. paratuberculosis
gaccaacgggcggcg

SEQ ID NO: 2945996 - RNA, 19 nt, Mycobacterium avium subsp. paratuberculosis
gaccaacgggcggcggauc

SEQ ID NO: 2945997 - RNA, 16 nt, Mycobacterium avium subsp. paratuberculosis
gaccaacuccaccgcc

SEQ ID NO: 2945998 - RNA, 17 nt, Mycobacterium avium subsp. paratuberculosis
gaccaacuccaccgccc

SEQ ID NO: 2945999 - RNA, 19 nt, Mycobacterium avium subsp. paratuberculosis
gaccaacuccaccgcccgg

SEQ ID NO: 2946000 - RNA, 22 nt, Mycobacterium avium subsp. paratuberculosis
gaccaacuccaccgcccggaug

SEQ ID NO: 2946001 - RNA, 15 nt, Mycobacterium avium subsp. paratuberculosis
gaccaagccccgcag

SEQ ID NO: 2946002 - RNA, 13 nt, Mycobacterium avium subsp. paratuberculosis
gaccaaggccgac

SEQ ID NO: 2946003 - RNA, 17 nt, Mycobacterium avium subsp. paratuberculosis
gaccacaagggccaccg

SEQ ID NO: 2946004 - RNA, 20 nt, Mycobacterium avium subsp. paratuberculosis
gaccacaagggccaccgggc

SEQ ID NO: 2946005 - RNA, 22 nt, Mycobacterium avium subsp. paratuberculosis
gaccacaagggccaccgggccg

SEQ ID NO: 2946006 - RNA, 15 nt, Mycobacterium avium subsp. paratuberculosis
gaccacacccgcacg

SEQ ID NO: 2946007 - RNA, 12 nt, Mycobacterium avium subsp. paratuberculosis
gaccacaccgcc

SEQ ID NO: 2946008 - RNA, 13 nt, Mycobacterium avium subsp. paratuberculosis
gaccacaccgccg

SEQ ID NO: 2946009 - RNA, 16 nt, Mycobacterium avium subsp. paratuberculosis
gaccacaccgccggcc

SEQ ID NO: 2946010 - RNA, 19 nt, Mycobacterium avium subsp. paratuberculosis
gaccacaccgccggccacg

SEQ ID NO: 2946011 - RNA, 12 nt, Mycobacterium avium subsp. paratuberculosis
gaccacaccggc

SEQ ID NO: 2946012 - RNA, 19 nt, Mycobacterium avium subsp. paratuberculosis
gaccacaccggcgcugccc

SEQ ID NO: 2946013 - RNA, 22 nt, Mycobacterium avium subsp. paratuberculosis
gaccacaccggcgcugcccgcg

SEQ ID NO: 2946014 - RNA, 16 nt, Mycobacterium avium subsp. paratuberculosis
gaccacaccgucgacg

SEQ ID NO: 2946015 - RNA, 13 nt, Mycobacterium avium subsp. paratuberculosis
gaccacagcgccu

SEQ ID NO: 2946016 - RNA, 19 nt, Mycobacterium avium subsp. paratuberculosis
gaccacagcgccucgucga

SEQ ID NO: 2946017 - RNA, 20 nt, Mycobacterium avium subsp. paratuberculosis
gaccaccaccgcccacagca

SEQ ID NO: 2946018 - RNA, 16 nt, Mycobacterium avium subsp. paratuberculosis
gaccaccacgaccagu

SEQ ID NO: 2946019 - RNA, 15 nt, Mycobacterium avium subsp. paratuberculosis
gaccaccacggccgc

SEQ ID NO: 2946020 - RNA, 14 nt, Mycobacterium avium subsp. paratuberculosis
gaccaccagccgca

SEQ ID NO: 2946021 - RNA, 17 nt, Mycobacterium avium subsp. paratuberculosis
gaccaccagcgugcugc

SEQ ID NO: 2946022 - RNA, 17 nt, Mycobacterium avium subsp. paratuberculosis
gaccaccaggagcaccu

SEQ ID NO: 2946023 - RNA, 20 nt, Mycobacterium avium subsp. paratuberculosis
gaccaccaggagcaccugcg

SEQ ID NO: 2946024 - RNA, 23 nt, Mycobacterium avium subsp. paratuberculosis
gaccaccaggagcaccugcgcga

SEQ ID NO: 2946025 - RNA, 23 nt, Mycobacterium avium subsp. paratuberculosis
gaccaccaugauguagcggcggu

SEQ ID NO: 2946026 - RNA, 22 nt, Mycobacterium avium subsp. paratuberculosis
gaccacccacucccagccgccg

SEQ ID NO: 2946027 - RNA, 14 nt, Mycobacterium avium subsp. paratuberculosis
gaccacccccagcc

SEQ ID NO: 2946028 - RNA, 17 nt, Mycobacterium avium subsp. paratuberculosis
gaccacccccagcccgc

SEQ ID NO: 2946029 - RNA, 22 nt, Mycobacterium avium subsp. paratuberculosis
gaccacccccagcccgccgggc

SEQ ID NO: 2946030 - RNA, 14 nt, Mycobacterium avium subsp. paratuberculosis
gaccacccgcagcg

SEQ ID NO: 2946031 - RNA, 21 nt, Mycobacterium avium subsp. paratuberculosis
gaccagcgccucggccugcgc

SEQ ID NO: 2946032 - RNA, 19 nt, Mycobacterium avium subsp. paratuberculosis
gaccagcgcgaacagcgcg

SEQ ID NO: 2946033 - RNA, 11 nt, Mycobacterium avium subsp. paratuberculosis
gaccagcgcgc

SEQ ID NO: 2946034 - RNA, 13 nt, Mycobacterium avium subsp. paratuberculosis
gaccagcgcgccg

SEQ ID NO: 2946035 - RNA, 15 nt, Mycobacterium avium subsp. paratuberculosis
gaccagcgcgccgcc

SEQ ID NO: 2946036 - RNA, 19 nt, Mycobacterium avium subsp. paratuberculosis
gaccagcgcgccgcccagc

SEQ ID NO: 2946037 - RNA, 16 nt, Mycobacterium avium subsp. paratuberculosis
gaccagcgcgccggcc

SEQ ID NO: 2946038 - RNA, 17 nt, Mycobacterium avium subsp. paratuberculosis
gaccagcgcgccggcca

SEQ ID NO: 2946039 - RNA, 21 nt, Mycobacterium avium subsp. paratuberculosis
gaccagcgcgccggccagcag

SEQ ID NO: 2946040 - RNA, 13 nt, Mycobacterium avium subsp. paratuberculosis
gaccagcgcggug

SEQ ID NO: 2946041 - RNA, 16 nt, Mycobacterium avium subsp. paratuberculosis
gaccagcgcggugccg

SEQ ID NO: 2946042 - RNA, 17 nt, Mycobacterium avium subsp. paratuberculosis
gaccagcgcggugccgg

SEQ ID NO: 2946043 - RNA, 16 nt, Mycobacterium avium subsp. paratuberculosis
gaccagcggcagcacg

SEQ ID NO: 2946044 - RNA, 15 nt, Mycobacterium avium subsp. paratuberculosis
gaccagcggcagcag

SEQ ID NO: 2946045 - RNA, 17 nt, Mycobacterium avium subsp. paratuberculosis
gaccagcggcagcagca

SEQ ID NO: 2946046 - RNA, 18 nt, Mycobacterium avium subsp. paratuberculosis
gaccagcggcagcagcac

SEQ ID NO: 2946047 - RNA, 19 nt, Mycobacterium avium subsp. paratuberculosis
gaccagcggcagcagcacc

SEQ ID NO: 2946048 - RNA, 22 nt, Mycobacterium avium subsp. paratuberculosis
gaccagcggcagcagcaccagc

SEQ ID NO: 2946049 - RNA, 16 nt, Mycobacterium avium subsp. paratuberculosis
gaccagcggcccaccg

SEQ ID NO: 2946050 - RNA, 17 nt, Mycobacterium avium subsp. paratuberculosis
gaccagcggcccaccgc

SEQ ID NO: 2946051 - RNA, 19 nt, Mycobacterium avium subsp. paratuberculosis
gaccagcggcccaccgcga

SEQ ID NO: 2946052 - RNA, 13 nt, Mycobacterium avium subsp. paratuberculosis
gaccagcggcgcg

SEQ ID NO: 2946053 - RNA, 14 nt, Mycobacterium avium subsp. paratuberculosis
gaccagcggcgcgc

SEQ ID NO: 2946054 - RNA, 16 nt, Mycobacterium avium subsp. paratuberculosis
gaccagcggcgcgccg

SEQ ID NO: 2946055 - RNA, 17 nt, Mycobacterium avium subsp. paratuberculosis
gaccagcggcgcgccgg

SEQ ID NO: 2946056 - RNA, 20 nt, Mycobacterium avium subsp. paratuberculosis
gaccagcggcgcgccgggca

SEQ ID NO: 2946057 - RNA, 13 nt, Mycobacterium avium subsp. paratuberculosis
gaccagcgggccg

SEQ ID NO: 2946058 - RNA, 23 nt, Mycobacterium avium subsp. paratuberculosis
gaccagcgggccgacagcacgcc

SEQ ID NO: 2946059 - RNA, 20 nt, Mycobacterium avium subsp. paratuberculosis
gaccagcgggcugucggcgc

SEQ ID NO: 2946060 - RNA, 23 nt, Mycobacterium avium subsp. paratuberculosis
gaccagcgggcugucggcgccca

SEQ ID NO: 2946061 - RNA, 21 nt, Mycobacterium avium subsp. paratuberculosis
gaccagcgggucgauggcgac

SEQ ID NO: 2946062 - RNA, 15 nt, Mycobacterium avium subsp. paratuberculosis
gaccagcgguuugga

SEQ ID NO: 2946063 - RNA, 17 nt, Mycobacterium avium subsp. paratuberculosis
gaccagcgugaccucga

SEQ ID NO: 2946064 - RNA, 20 nt, Mycobacterium avium subsp. paratuberculosis
gaccagcgugaccucgacgg

SEQ ID NO: 2946065 - RNA, 22 nt, Mycobacterium avium subsp. paratuberculosis
gaccagcgugaccucgacggug

SEQ ID NO: 2946066 - RNA, 23 nt, Mycobacterium avium subsp. paratuberculosis
gaccagcgugaccucgacggugc

SEQ ID NO: 2946067 - RNA, 13 nt, Mycobacterium avium subsp. paratuberculosis
gaccagcgugacg

SEQ ID NO: 2946068 - RNA, 15 nt, Mycobacterium avium subsp. paratuberculosis
gaccagcgugucgcc

SEQ ID NO: 2946069 - RNA, 16 nt, Mycobacterium avium subsp. paratuberculosis
gaccagcgugucgccg

SEQ ID NO: 2946070 - RNA, 20 nt, Mycobacterium avium subsp. paratuberculosis
gaccagcgugucgccggggc

SEQ ID NO: 2946071 - RNA, 22 nt, Mycobacterium avium subsp. paratuberculosis
gaccagcgugucgccggggcgg

SEQ ID NO: 2946072 - RNA, 22 nt, Mycobacterium avium subsp. paratuberculosis
gaccagcugcgaaucgucggcg

SEQ ID NO: 2946073 - RNA, 23 nt, Mycobacterium avium subsp. paratuberculosis
gaccagcugcgaaucgucggcga

SEQ ID NO: 2946074 - RNA, 19 nt, Mycobacterium avium subsp. paratuberculosis
gaccagcuugaagcccucg

SEQ ID NO: 2946075 - RNA, 23 nt, Mycobacterium avium subsp. paratuberculosis
gaccagcuugaagcccucgucga

SEQ ID NO: 2946076 - RNA, 20 nt, Mycobacterium avium subsp. paratuberculosis
gaccaggaaguacaccaccg

SEQ ID NO: 2946077 - RNA, 22 nt, Mycobacterium avium subsp. paratuberculosis
gaccaggaaguacaccaccgcg

SEQ ID NO: 2946078 - RNA, 23 nt, Mycobacterium avium subsp. paratuberculosis
gaccaggaaguacaccaccgcgg

SEQ ID NO: 2946079 - RNA, 18 nt, Mycobacterium avium subsp. paratuberculosis
gaccaggaccagguugga

SEQ ID NO: 2946080 - RNA, 16 nt, Mycobacterium avium subsp. paratuberculosis
gaccaggacgucggcc

SEQ ID NO: 2946081 - RNA, 17 nt, Mycobacterium avium subsp. paratuberculosis
gaccaggacgucggccg

SEQ ID NO: 2946082 - RNA, 20 nt, Mycobacterium avium subsp. paratuberculosis
gaccaggaugcccaggauga

SEQ ID NO: 2946083 - RNA, 19 nt, Mycobacterium avium subsp. paratuberculosis
gaccaggaugucuccgcgc

SEQ ID NO: 2946084 - RNA, 15 nt, Mycobacterium avium subsp. paratuberculosis
gaccaggcccagcgg

SEQ ID NO: 2946085 - RNA, 13 nt, Mycobacterium avium subsp. paratuberculosis
gaccaggccgaug

SEQ ID NO: 2946086 - RNA, 17 nt, Mycobacterium avium subsp. paratuberculosis
gaccaggccgaugauga

SEQ ID NO: 2946087 - RNA, 14 nt, Mycobacterium avium subsp. paratuberculosis
gaccaggcucacgc

SEQ ID NO: 2946088 - RNA, 18 nt, Mycobacterium avium subsp. paratuberculosis
gaccaggcucacgcugcc

SEQ ID NO: 2946089 - RNA, 14 nt, Mycobacterium avium subsp. paratuberculosis
gaccaggcucgcga

SEQ ID NO: 2946090 - RNA, 22 nt, Mycobacterium avium subsp. paratuberculosis
gaccaggcucgcgagggcgggc

SEQ ID NO: 2946091 - RNA, 17 nt, Mycobacterium avium subsp. paratuberculosis
gaccaggcuugccccgu

SEQ ID NO: 2946092 - RNA, 17 nt, Mycobacterium avium subsp. paratuberculosis
gaccagggccucgucgu

SEQ ID NO: 2946093 - RNA, 13 nt, Mycobacterium avium subsp. paratuberculosis
gaccagggcgauc

SEQ ID NO: 2946094 - RNA, 18 nt, Mycobacterium avium subsp. paratuberculosis
gaccagggcgaucaccgc

SEQ ID NO: 2946095 - RNA, 22 nt, Mycobacterium avium subsp. paratuberculosis
gaccagggcgaucaccgcggcc

SEQ ID NO: 2946096 - RNA, 15 nt, Mycobacterium avium subsp. paratuberculosis
gaccagggcgguggc

SEQ ID NO: 2946097 - RNA, 20 nt, Mycobacterium avium subsp. paratuberculosis
gaccagggcgguggcggcga

SEQ ID NO: 2946098 - RNA, 16 nt, Mycobacterium avium subsp. paratuberculosis
gaccaggguggucagc

SEQ ID NO: 2946099 - RNA, 18 nt, Mycobacterium avium subsp. paratuberculosis
gaccaggguggucagcgu

SEQ ID NO: 2946100 - RNA, 20 nt, Mycobacterium avium subsp. paratuberculosis
gaccaggguggucagcgucu

SEQ ID NO: 2946101 - RNA, 23 nt, Mycobacterium avium subsp. paratuberculosis
gaccaggguggucagcgucucgg

SEQ ID NO: 2946102 - RNA, 21 nt, Mycobacterium avium subsp. paratuberculosis
gaccagguaggcgcccugcga

SEQ ID NO: 2946103 - RNA, 19 nt, Mycobacterium avium subsp. paratuberculosis
gaccagguccgguucgacc

SEQ ID NO: 2946104 - RNA, 22 nt, Mycobacterium avium subsp. paratuberculosis
gaccagguccgguucgaccggc

SEQ ID NO: 2946105 - RNA, 15 nt, Mycobacterium avium subsp. paratuberculosis
gaccaggucgccggc

SEQ ID NO: 2946106 - RNA, 16 nt, Mycobacterium avium subsp. paratuberculosis
gaccaggucgccggcg

SEQ ID NO: 2946107 - RNA, 17 nt, Mycobacterium avium subsp. paratuberculosis
gaccaggucgccggcgg

SEQ ID NO: 2946108 - RNA, 13 nt, Mycobacterium avium subsp. paratuberculosis
gaccaggucggcc

SEQ ID NO: 2946109 - RNA, 20 nt, Mycobacterium avium subsp. paratuberculosis
gaccaggucggccuucagcg

SEQ ID NO: 2946110 - RNA, 16 nt, Mycobacterium avium subsp. paratuberculosis
gaccaggugggcggcc

SEQ ID NO: 2946111 - RNA, 19 nt, Mycobacterium avium subsp. paratuberculosis
gaccaggugggcggccacc

SEQ ID NO: 2946112 - RNA, 21 nt, Mycobacterium avium subsp. paratuberculosis
gaccaguagaaguggccgacc

SEQ ID NO: 2946113 - RNA, 20 nt, Mycobacterium avium subsp. paratuberculosis
gaccaguaggccagcaucuc

SEQ ID NO: 2946114 - RNA, 15 nt, Mycobacterium avium subsp. paratuberculosis
gaccagucggcgucu

SEQ ID NO: 2946115 - RNA, 22 nt, Mycobacterium avium subsp. paratuberculosis
gacccgaccuuuugcccggcga

SEQ ID NO: 2946116 - RNA, 22 nt, Mycobacterium avium subsp. paratuberculosis
gacccgacgggaacucggccag

SEQ ID NO: 2946117 - RNA, 18 nt, Mycobacterium avium subsp. paratuberculosis
gacccgagagcugcugcc

SEQ ID NO: 2946118 - RNA, 20 nt, Mycobacterium avium subsp. paratuberculosis
gacccgaucgaucaucgccu

SEQ ID NO: 2946119 - RNA, 16 nt, Mycobacterium avium subsp. paratuberculosis
gacccgcaaggccgcc

SEQ ID NO: 2946120 - RNA, 17 nt, Mycobacterium avium subsp. paratuberculosis
gacccgcaaggccgcca

SEQ ID NO: 2946121 - RNA, 15 nt, Mycobacterium avium subsp. paratuberculosis
gacccgcaccaccgc

SEQ ID NO: 2946122 - RNA, 12 nt, Mycobacterium avium subsp. paratuberculosis
gacccgcaccgg

SEQ ID NO: 2946123 - RNA, 20 nt, Mycobacterium avium subsp. paratuberculosis
gacccgcacgaugccgcgcu

SEQ ID NO: 2946124 - RNA, 19 nt, Mycobacterium avium subsp. paratuberculosis
gacccgcauccgccgggcg

SEQ ID NO: 2946125 - RNA, 17 nt, Mycobacterium avium subsp. paratuberculosis
gacccgccccgacagca

SEQ ID NO: 2946126 - RNA, 14 nt, Mycobacterium avium subsp. paratuberculosis
gacccgccgcaaca

SEQ ID NO: 2946127 - RNA, 17 nt, Mycobacterium avium subsp. paratuberculosis
gacccgccgcaacagcc

SEQ ID NO: 2946128 - RNA, 19 nt, Mycobacterium avium subsp. paratuberculosis
gacccgccgcaacagccgg

SEQ ID NO: 2946129 - RNA, 20 nt, Mycobacterium avium subsp. paratuberculosis
gacccgccgcaacagccggc

SEQ ID NO: 2946130 - RNA, 21 nt, Mycobacterium avium subsp. paratuberculosis
gacccgccgcaacagccggcc

SEQ ID NO: 2946131 - RNA, 22 nt, Mycobacterium avium subsp. paratuberculosis
gacccgccgcagcccgccagga

SEQ ID NO: 2946132 - RNA, 12 nt, Mycobacterium avium subsp. paratuberculosis
gacccgccgcgg

SEQ ID NO: 2946133 - RNA, 15 nt, Mycobacterium avium subsp. paratuberculosis
gacccgccgcggcaa

SEQ ID NO: 2946134 - RNA, 22 nt, Mycobacterium avium subsp. paratuberculosis
gacccgccgcggcaacgccagc

SEQ ID NO: 2946135 - RNA, 15 nt, Mycobacterium avium subsp. paratuberculosis
gacccgccgugacau

SEQ ID NO: 2946136 - RNA, 22 nt, Mycobacterium avium subsp. paratuberculosis
gacccgccuacuugaccagcgu

SEQ ID NO: 2946137 - RNA, 19 nt, Mycobacterium avium subsp. paratuberculosis
gacccgccuggccaccucg

SEQ ID NO: 2946138 - RNA, 20 nt, Mycobacterium avium subsp. paratuberculosis
gacccgccuggccaccucga

SEQ ID NO: 2946139 - RNA, 13 nt, Mycobacterium avium subsp. paratuberculosis
gacccgcgacccc

SEQ ID NO: 2946140 - RNA, 14 nt, Mycobacterium avium subsp. paratuberculosis
gacccgcggcgccg

SEQ ID NO: 2946141 - RNA, 15 nt, Mycobacterium avium subsp. paratuberculosis
gacccgcggcgccgc

SEQ ID NO: 2946142 - RNA, 16 nt, Mycobacterium avium subsp. paratuberculosis
gacccgcggcgccgcg

SEQ ID NO: 2946143 - RNA, 14 nt, Mycobacterium avium subsp. paratuberculosis
gacccgcuccagcg

SEQ ID NO: 2946144 - RNA, 18 nt, Mycobacterium avium subsp. paratuberculosis
gacccgcuccagcggcca

SEQ ID NO: 2946145 - RNA, 20 nt, Mycobacterium avium subsp. paratuberculosis
gacccgcuccagcggccaca

SEQ ID NO: 2946146 - RNA, 23 nt, Mycobacterium avium subsp. paratuberculosis
gacccgcucccgggacagcccga

SEQ ID NO: 2946147 - RNA, 19 nt, Mycobacterium avium subsp. paratuberculosis
gacccgcuccgacgcggug

SEQ ID NO: 2946148 - RNA, 13 nt, Mycobacterium avium subsp. paratuberculosis
gacccgcucgacg

SEQ ID NO: 2946149 - RNA, 14 nt, Mycobacterium avium subsp. paratuberculosis
gacccgcucgacgc

SEQ ID NO: 2946150 - RNA, 17 nt, Mycobacterium avium subsp. paratuberculosis
gacccgcucgacgcgca

SEQ ID NO: 2946151 - RNA, 15 nt, Mycobacterium avium subsp. paratuberculosis
gacccgcucgggcgc

SEQ ID NO: 2946152 - RNA, 14 nt, Mycobacterium avium subsp. paratuberculosis
gacccgcugcagcu

SEQ ID NO: 2946153 - RNA, 16 nt, Mycobacterium avium subsp. paratuberculosis
gacccgcugcagcuuc

SEQ ID NO: 2946154 - RNA, 19 nt, Mycobacterium avium subsp. paratuberculosis
gacccgcuggaacagcggg

SEQ ID NO: 2946155 - RNA, 21 nt, Mycobacterium avium subsp. paratuberculosis
gacccgcuggaacagcgggcc

SEQ ID NO: 2946156 - RNA, 14 nt, Mycobacterium avium subsp. paratuberculosis
gacccggaacccgc

SEQ ID NO: 2946157 - RNA, 18 nt, Mycobacterium avium subsp. paratuberculosis
gacccggaccgggugacc

SEQ ID NO: 2946158 - RNA, 19 nt, Mycobacterium avium subsp. paratuberculosis
gacccggaccgggugaccg

SEQ ID NO: 2946159 - RNA, 14 nt, Mycobacterium avium subsp. paratuberculosis
gacccggaggcggc

SEQ ID NO: 2946160 - RNA, 15 nt, Mycobacterium avium subsp. paratuberculosis
gacccggauacacgg

SEQ ID NO: 2946161 - RNA, 13 nt, Mycobacterium avium subsp. paratuberculosis
gacccggccaccg

SEQ ID NO: 2946162 - RNA, 14 nt, Mycobacterium avium subsp. paratuberculosis
gacccggccaccgc

SEQ ID NO: 2946163 - RNA, 15 nt, Mycobacterium avium subsp. paratuberculosis
gacccggccaccgcc

SEQ ID NO: 2946164 - RNA, 17 nt, Mycobacterium avium subsp. paratuberculosis
gacccggccaccgccgc

SEQ ID NO: 2946165 - RNA, 14 nt, Mycobacterium avium subsp. paratuberculosis
gacccggccagcgg

SEQ ID NO: 2946166 - RNA, 18 nt, Mycobacterium avium subsp. paratuberculosis
gacccggccagcggcagc

SEQ ID NO: 2946167 - RNA, 22 nt, Mycobacterium avium subsp. paratuberculosis
gacccggcccaucaccggaccg

SEQ ID NO: 2946168 - RNA, 15 nt, Mycobacterium avium subsp. paratuberculosis
gacccggccgagcgc

SEQ ID NO: 2946169 - RNA, 15 nt, Mycobacterium avium subsp. paratuberculosis
gacccggccgauggu

SEQ ID NO: 2946170 - RNA, 12 nt, Mycobacterium avium subsp. paratuberculosis
gacccggccgca

SEQ ID NO: 2946171 - RNA, 14 nt, Mycobacterium avium subsp. paratuberculosis
gacccggccgcaca

SEQ ID NO: 2946172 - RNA, 19 nt, Mycobacterium avium subsp. paratuberculosis
gacccggccgcacaccacc

SEQ ID NO: 2946173 - RNA, 20 nt, Mycobacterium avium subsp. paratuberculosis
gacccggccgcacaccacca

SEQ ID NO: 2946174 - RNA, 13 nt, Mycobacterium avium subsp. paratuberculosis
gacccggccgcgc

SEQ ID NO: 2946175 - RNA, 17 nt, Mycobacterium avium subsp. paratuberculosis
gacccggccggucgccu

SEQ ID NO: 2946176 - RNA, 19 nt, Mycobacterium avium subsp. paratuberculosis
gacccggccgugcgcagca

SEQ ID NO: 2946177 - RNA, 18 nt, Mycobacterium avium subsp. paratuberculosis
gacccggccguggacccg

SEQ ID NO: 2946178 - RNA, 20 nt, Mycobacterium avium subsp. paratuberculosis
gacccggccguugggccagc

SEQ ID NO: 2946179 - RNA, 22 nt, Mycobacterium avium subsp. paratuberculosis
gacccggccguugggccagcgg

SEQ ID NO: 2946180 - RNA, 23 nt, Mycobacterium avium subsp. paratuberculosis
gacccggccguugggccagcggc

SEQ ID NO: 2946181 - RNA, 20 nt, Mycobacterium avium subsp. paratuberculosis
gacccggcguaguucgucga

SEQ ID NO: 2946182 - RNA, 19 nt, Mycobacterium avium subsp. paratuberculosis
gacccgggccagcaggauc

SEQ ID NO: 2946183 - RNA, 13 nt, Mycobacterium avium subsp. paratuberculosis
gacccgggccgcc

SEQ ID NO: 2946184 - RNA, 20 nt, Mycobacterium avium subsp. paratuberculosis
gacccgggccgccacggcgc

SEQ ID NO: 2946185 - RNA, 16 nt, Mycobacterium avium subsp. paratuberculosis
gacccgggcggccugc

SEQ ID NO: 2946186 - RNA, 12 nt, Mycobacterium avium subsp. paratuberculosis
gacccggggguc

SEQ ID NO: 2946187 - RNA, 15 nt, Mycobacterium avium subsp. paratuberculosis
gacccgguagcgcag

SEQ ID NO: 2946188 - RNA, 16 nt, Mycobacterium avium subsp. paratuberculosis
gacccgguagcgcagc

SEQ ID NO: 2946189 - RNA, 12 nt, Mycobacterium avium subsp. paratuberculosis
gacccggucagc

SEQ ID NO: 2946190 - RNA, 14 nt, Mycobacterium avium subsp. paratuberculosis
gacccgguccuuga

SEQ ID NO: 2946191 - RNA, 17 nt, Mycobacterium avium subsp. paratuberculosis
gacccggucggccgcgu

SEQ ID NO: 2946192 - RNA, 23 nt, Mycobacterium avium subsp. paratuberculosis
gacccggucggccgcgugcaccu

SEQ ID NO: 2946193 - RNA, 18 nt, Mycobacterium avium subsp. paratuberculosis
gacccgguggcccggucg

SEQ ID NO: 2946194 - RNA, 17 nt, Mycobacterium avium subsp. paratuberculosis
gacccgguugauccgga

SEQ ID NO: 2946195 - RNA, 17 nt, Mycobacterium avium subsp. paratuberculosis
gacccguaauugaucgu

SEQ ID NO: 2946196 - RNA, 17 nt, Mycobacterium avium subsp. paratuberculosis
gacccguacuucucgaa

SEQ ID NO: 2946197 - RNA, 21 nt, Mycobacterium avium subsp. paratuberculosis
gacccguccagcagcaugucg

SEQ ID NO: 2946198 - RNA, 15 nt, Mycobacterium avium subsp. paratuberculosis
gacccguccagcgug

SEQ ID NO: 2946199 - RNA, 18 nt, Mycobacterium avium subsp. paratuberculosis
gacccguccagcgugugc

SEQ ID NO: 2946200 - RNA, 14 nt, Mycobacterium avium subsp. paratuberculosis
gaccgccgagcggg

SEQ ID NO: 2946201 - RNA, 16 nt, Mycobacterium avium subsp. paratuberculosis
gaccgccgagcgggcg

SEQ ID NO: 2946202 - RNA, 17 nt, Mycobacterium avium subsp. paratuberculosis
gaccgccgagcgggcga

SEQ ID NO: 2946203 - RNA, 18 nt, Mycobacterium avium subsp. paratuberculosis
gaccgccgagcgggcgau

SEQ ID NO: 2946204 - RNA, 17 nt, Mycobacterium avium subsp. paratuberculosis
gaccgccgccauccgcg

SEQ ID NO: 2946205 - RNA, 21 nt, Mycobacterium avium subsp. paratuberculosis
gaccgccgccauccgcgccga

SEQ ID NO: 2946206 - RNA, 19 nt, Mycobacterium avium subsp. paratuberculosis
gaccgccgccauccguucg

SEQ ID NO: 2946207 - RNA, 20 nt, Mycobacterium avium subsp. paratuberculosis
gaccgccgccauccguucgg

SEQ ID NO: 2946208 - RNA, 13 nt, Mycobacterium avium subsp. paratuberculosis
gaccgccgccgcg

SEQ ID NO: 2946209 - RNA, 15 nt, Mycobacterium avium subsp. paratuberculosis
gaccgccgccgcgac

SEQ ID NO: 2946210 - RNA, 15 nt, Mycobacterium avium subsp. paratuberculosis
gaccgccgcgcucgg

SEQ ID NO: 2946211 - RNA, 15 nt, Mycobacterium avium subsp. paratuberculosis
gaccgccgcggccgc

SEQ ID NO: 2946212 - RNA, 22 nt, Mycobacterium avium subsp. paratuberculosis
gaccgccgcggccgccuucacg

SEQ ID NO: 2946213 - RNA, 21 nt, Mycobacterium avium subsp. paratuberculosis
gaccgccgcggcgcccggcgc

SEQ ID NO: 2946214 - RNA, 14 nt, Mycobacterium avium subsp. paratuberculosis
gaccgccgcggcgg

SEQ ID NO: 2946215 - RNA, 16 nt, Mycobacterium avium subsp. paratuberculosis
gaccgccgcggcggcc

SEQ ID NO: 2946216 - RNA, 18 nt, Mycobacterium avium subsp. paratuberculosis
gaccgccgcggcggccug

SEQ ID NO: 2946217 - RNA, 23 nt, Mycobacterium avium subsp. paratuberculosis
gaccgccgcguacagccagcccg

SEQ ID NO: 2946218 - RNA, 14 nt, Mycobacterium avium subsp. paratuberculosis
gaccgccgcuaggu

SEQ ID NO: 2946219 - RNA, 15 nt, Mycobacterium avium subsp. paratuberculosis
gaccgccggugcgca

SEQ ID NO: 2946220 - RNA, 17 nt, Mycobacterium avium subsp. paratuberculosis
gaccgccguggcguuac

SEQ ID NO: 2946221 - RNA, 20 nt, Mycobacterium avium subsp. paratuberculosis
gaccgccucgauggcccgcu

SEQ ID NO: 2946222 - RNA, 23 nt, Mycobacterium avium subsp. paratuberculosis
gaccgccucgauggcccgcucgg

SEQ ID NO: 2946223 - RNA, 24 nt, Mycobacterium avium subsp. paratuberculosis
gaccgccucgauggcccgcucggu

SEQ ID NO: 2946224 - RNA, 16 nt, Mycobacterium avium subsp. paratuberculosis
gaccgccucgucggga

SEQ ID NO: 2946225 - RNA, 15 nt, Mycobacterium avium subsp. paratuberculosis
gaccgccugcggcag

SEQ ID NO: 2946226 - RNA, 14 nt, Mycobacterium avium subsp. paratuberculosis
gaccgccugcuuga

SEQ ID NO: 2946227 - RNA, 21 nt, Mycobacterium avium subsp. paratuberculosis
gaccgccuuggcgcgcucggu

SEQ ID NO: 2946228 - RNA, 20 nt, Mycobacterium avium subsp. paratuberculosis
gaccgccuugucggcgaugu

SEQ ID NO: 2946229 - RNA, 21 nt, Mycobacterium avium subsp. paratuberculosis
gaccgccuugucggcgauguc

SEQ ID NO: 2946230 - RNA, 21 nt, Mycobacterium avium subsp. paratuberculosis
gaccgcgaagguggcacgcca

SEQ ID NO: 2946231 - RNA, 22 nt, Mycobacterium avium subsp. paratuberculosis
gaccgcgacgcugccggugguc

SEQ ID NO: 2946232 - RNA, 12 nt, Mycobacterium avium subsp. paratuberculosis
gaccgcgacggc

SEQ ID NO: 2946233 - RNA, 14 nt, Mycobacterium avium subsp. paratuberculosis
gaccgcgacggcgc

SEQ ID NO: 2946234 - RNA, 15 nt, Mycobacterium avium subsp. paratuberculosis
gaccgcgacggcgcc

SEQ ID NO: 2946235 - RNA, 17 nt, Mycobacterium avium subsp. paratuberculosis
gaccgcgacggcgcccg

SEQ ID NO: 2946236 - RNA, 18 nt, Mycobacterium avium subsp. paratuberculosis
gaccgcgacggcgcccgc

SEQ ID NO: 2946237 - RNA, 21 nt, Mycobacterium avium subsp. paratuberculosis
gaccgcgacggcgcccgcccc

SEQ ID NO: 2946238 - RNA, 19 nt, Mycobacterium avium subsp. paratuberculosis
gaccgcgacgggcucggcg

SEQ ID NO: 2946239 - RNA, 23 nt, Mycobacterium avium subsp. paratuberculosis
gaccgcgaucagccccagggugc

SEQ ID NO: 2946240 - RNA, 19 nt, Mycobacterium avium subsp. paratuberculosis
gaccgcgaucagggccgcg

SEQ ID NO: 2946241 - RNA, 20 nt, Mycobacterium avium subsp. paratuberculosis
gaccgcgaucagggccgcgg

SEQ ID NO: 2946242 - RNA, 19 nt, Mycobacterium avium subsp. paratuberculosis
gaccgcgaugcagaacagc

SEQ ID NO: 2946243 - RNA, 22 nt, Mycobacterium avium subsp. paratuberculosis
gaccgcgaugcagaacagccgg

SEQ ID NO: 2946244 - RNA, 20 nt, Mycobacterium avium subsp. paratuberculosis
gaccgcgaugcgacaccgcg

SEQ ID NO: 2946245 - RNA, 21 nt, Mycobacterium avium subsp. paratuberculosis
gaccgcgcaggcggcgacggc

SEQ ID NO: 2946246 - RNA, 12 nt, Mycobacterium avium subsp. paratuberculosis
gaccgcgccgcg

SEQ ID NO: 2946247 - RNA, 16 nt, Mycobacterium avium subsp. paratuberculosis
gaccgcgccgcgggug

SEQ ID NO: 2946248 - RNA, 12 nt, Mycobacterium avium subsp. paratuberculosis
gaccgcgccggg

SEQ ID NO: 2946249 - RNA, 12 nt, Mycobacterium avium subsp. paratuberculosis
gaccgcgcgccg

SEQ ID NO: 2946250 - RNA, 15 nt, Mycobacterium avium subsp. paratuberculosis
gaccgcgcgccggcc

SEQ ID NO: 2946251 - RNA, 16 nt, Mycobacterium avium subsp. paratuberculosis
gaccgcgcgccggcca

SEQ ID NO: 2946252 - RNA, 19 nt, Mycobacterium avium subsp. paratuberculosis
gaccgcgcgccggccagca

SEQ ID NO: 2946253 - RNA, 14 nt, Mycobacterium avium subsp. paratuberculosis
gaccgcgcgcggcg

SEQ ID NO: 2946254 - RNA, 15 nt, Mycobacterium avium subsp. paratuberculosis
gaccgcgcgcggcgc

SEQ ID NO: 2946255 - RNA, 18 nt, Mycobacterium avium subsp. paratuberculosis
gaccgcgcgcggcgccgc

SEQ ID NO: 2946256 - RNA, 19 nt, Mycobacterium avium subsp. paratuberculosis
gaccgcgcgggccagcgcc

SEQ ID NO: 2946257 - RNA, 20 nt, Mycobacterium avium subsp. paratuberculosis
gaccgcgcgggccagcgccu

SEQ ID NO: 2946258 - RNA, 16 nt, Mycobacterium avium subsp. paratuberculosis
gaccgcggacacgcgg

SEQ ID NO: 2946259 - RNA, 18 nt, Mycobacterium avium subsp. paratuberculosis
gaccgcggauaaggcgaa

SEQ ID NO: 2946260 - RNA, 13 nt, Mycobacterium avium subsp. paratuberculosis
gaccgcggaugac

SEQ ID NO: 2946261 - RNA, 22 nt, Mycobacterium avium subsp. paratuberculosis
gaccgcggaugacgggugcuca

SEQ ID NO: 2946262 - RNA, 13 nt, Mycobacterium avium subsp. paratuberculosis
gaccgcggccgcg

SEQ ID NO: 2946263 - RNA, 14 nt, Mycobacterium avium subsp. paratuberculosis
gaccgcggccgcga

SEQ ID NO: 2946264 - RNA, 16 nt, Mycobacterium avium subsp. paratuberculosis
gaccgcggccgcgacg

SEQ ID NO: 2946265 - RNA, 17 nt, Mycobacterium avium subsp. paratuberculosis
gaccgcggccucgucga

SEQ ID NO: 2946266 - RNA, 12 nt, Mycobacterium avium subsp. paratuberculosis
gaccgcggccug

SEQ ID NO: 2946267 - RNA, 20 nt, Mycobacterium avium subsp. paratuberculosis
gaccgcggcgauggcccgcu

SEQ ID NO: 2946268 - RNA, 23 nt, Mycobacterium avium subsp. paratuberculosis
gaccgcggcgauggcccgcugcg

SEQ ID NO: 2946269 - RNA, 14 nt, Mycobacterium avium subsp. paratuberculosis
gaccgcggcgccga

SEQ ID NO: 2946270 - RNA, 17 nt, Mycobacterium avium subsp. paratuberculosis
gaccgcggcgccgaugg

SEQ ID NO: 2946271 - RNA, 14 nt, Mycobacterium avium subsp. paratuberculosis
gaccgcggcgggca

SEQ ID NO: 2946272 - RNA, 17 nt, Mycobacterium avium subsp. paratuberculosis
gaccgcggcggucgcca

SEQ ID NO: 2946273 - RNA, 17 nt, Mycobacterium avium subsp. paratuberculosis
gaccgcggcuccggccg

SEQ ID NO: 2946274 - RNA, 19 nt, Mycobacterium avium subsp. paratuberculosis
gaccgcggcuccggccgcg

SEQ ID NO: 2946275 - RNA, 16 nt, Mycobacterium avium subsp. paratuberculosis
gaccgcgggcccgccg

SEQ ID NO: 2946276 - RNA, 22 nt, Mycobacterium avium subsp. paratuberculosis
gaccgcgggcgcauaccagcgc

SEQ ID NO: 2946277 - RNA, 12 nt, Mycobacterium avium subsp. paratuberculosis
gaccgcggguga

SEQ ID NO: 2946278 - RNA, 22 nt, Mycobacterium avium subsp. paratuberculosis
gaccgcgggugaggggcgcgcg

SEQ ID NO: 2946279 - RNA, 22 nt, Mycobacterium avium subsp. paratuberculosis
gaccgcggucaccggucggugc

SEQ ID NO: 2946280 - RNA, 21 nt, Mycobacterium avium subsp. paratuberculosis
gaccgcggucgcggcgccggu

SEQ ID NO: 2946281 - RNA, 16 nt, Mycobacterium avium subsp. paratuberculosis
gaccgcggucgggucc

SEQ ID NO: 2946282 - RNA, 20 nt, Mycobacterium avium subsp. paratuberculosis
gaccgcgguggcggugcggu

SEQ ID NO: 2946283 - RNA, 17 nt, Mycobacterium avium subsp. paratuberculosis
gaccgcguacagggcgu

SEQ ID NO: 2946284 - RNA, 20 nt, Mycobacterium avium subsp. paratuberculosis
gaccgcguccgaggcgguuc

SEQ ID NO: 2946285 - RNA, 13 nt, Mycobacterium avium subsp. paratuberculosis
gaccggguccgag

SEQ ID NO: 2946286 - RNA, 14 nt, Mycobacterium avium subsp. paratuberculosis
gaccgggucgccga

SEQ ID NO: 2946287 - RNA, 15 nt, Mycobacterium avium subsp. paratuberculosis
gaccgggucgccgau

SEQ ID NO: 2946288 - RNA, 17 nt, Mycobacterium avium subsp. paratuberculosis
gaccgggucguagccga

SEQ ID NO: 2946289 - RNA, 15 nt, Mycobacterium avium subsp. paratuberculosis
gaccgggucugccac

SEQ ID NO: 2946290 - RNA, 23 nt, Mycobacterium avium subsp. paratuberculosis
gaccgggucugccacgcccaccg

SEQ ID NO: 2946291 - RNA, 21 nt, Mycobacterium avium subsp. paratuberculosis
gaccgggugaacgaggccgcg

SEQ ID NO: 2946292 - RNA, 23 nt, Mycobacterium avium subsp. paratuberculosis
gaccgggugaacgaggccgcgcc

SEQ ID NO: 2946293 - RNA, 13 nt, Mycobacterium avium subsp. paratuberculosis
gaccggguggugg

SEQ ID NO: 2946294 - RNA, 21 nt, Mycobacterium avium subsp. paratuberculosis
gaccggguuugaggcccacgu

SEQ ID NO: 2946295 - RNA, 20 nt, Mycobacterium avium subsp. paratuberculosis
gaccgguaggcgcaccgccg

SEQ ID NO: 2946296 - RNA, 23 nt, Mycobacterium avium subsp. paratuberculosis
gaccgguaggcgcaccgccgggc

SEQ ID NO: 2946297 - RNA, 16 nt, Mycobacterium avium subsp. paratuberculosis
gaccgguccgccgccg

SEQ ID NO: 2946298 - RNA, 19 nt, Mycobacterium avium subsp. paratuberculosis
gaccgguccgccgccggcg

SEQ ID NO: 2946299 - RNA, 16 nt, Mycobacterium avium subsp. paratuberculosis
gaccgguccgugccac

SEQ ID NO: 2946300 - RNA, 21 nt, Mycobacterium avium subsp. paratuberculosis
gaccgguccgugccacggccg

SEQ ID NO: 2946301 - RNA, 23 nt, Mycobacterium avium subsp. paratuberculosis
gaccgguccgugccacggccgcg

SEQ ID NO: 2946302 - RNA, 18 nt, Mycobacterium avium subsp. paratuberculosis
gaccggucucgaccgcgg

SEQ ID NO: 2946303 - RNA, 15 nt, Mycobacterium avium subsp. paratuberculosis
gaccggugagcaccg

SEQ ID NO: 2946304 - RNA, 18 nt, Mycobacterium avium subsp. paratuberculosis
gaccggugagcaccggga

SEQ ID NO: 2946305 - RNA, 16 nt, Mycobacterium avium subsp. paratuberculosis
gaccggugcgcccgcg

SEQ ID NO: 2946306 - RNA, 20 nt, Mycobacterium avium subsp. paratuberculosis
gaccggugcgcgcaccaggc

SEQ ID NO: 2946307 - RNA, 15 nt, Mycobacterium avium subsp. paratuberculosis
gaccgguugcccgga

SEQ ID NO: 2946308 - RNA, 20 nt, Mycobacterium avium subsp. paratuberculosis
gaccgucacccccggcgcga

SEQ ID NO: 2946309 - RNA, 17 nt, Mycobacterium avium subsp. paratuberculosis
gaccgucaccguggcgg

SEQ ID NO: 2946310 - RNA, 12 nt, Mycobacterium avium subsp. paratuberculosis
gaccgucacgcu

SEQ ID NO: 2946311 - RNA, 20 nt, Mycobacterium avium subsp. paratuberculosis
gaccgucaucaucaccggga

SEQ ID NO: 2946312 - RNA, 19 nt, Mycobacterium avium subsp. paratuberculosis
gaccguccccguccgugca

SEQ ID NO: 2946313 - RNA, 19 nt, Mycobacterium avium subsp. paratuberculosis
gaccgucgccgaccagccg

SEQ ID NO: 2946314 - RNA, 21 nt, Mycobacterium avium subsp. paratuberculosis
gaccgucgccgaccagccgag

SEQ ID NO: 2946315 - RNA, 13 nt, Mycobacterium avium subsp. paratuberculosis
gaccgucgcgcag

SEQ ID NO: 2946316 - RNA, 15 nt, Mycobacterium avium subsp. paratuberculosis
gaccgucgcgcagcc

SEQ ID NO: 2946317 - RNA, 14 nt, Mycobacterium avium subsp. paratuberculosis
gaccgucggccaga

SEQ ID NO: 2946318 - RNA, 20 nt, Mycobacterium avium subsp. paratuberculosis
gaccgucgggacggccagca

SEQ ID NO: 2946319 - RNA, 21 nt, Mycobacterium avium subsp. paratuberculosis
gaccgucgggacggccagcag

SEQ ID NO: 2946320 - RNA, 21 nt, Mycobacterium avium subsp. paratuberculosis
gaccgucggugcggggcgggu

SEQ ID NO: 2946321 - RNA, 19 nt, Mycobacterium avium subsp. paratuberculosis
gaccgucuccaacugcauu

SEQ ID NO: 2946322 - RNA, 18 nt, Mycobacterium avium subsp. paratuberculosis
gaccgucuucuucagccg

SEQ ID NO: 2946323 - RNA, 20 nt, Mycobacterium avium subsp. paratuberculosis
gaccgucuucuucagccgca

SEQ ID NO: 2946324 - RNA, 23 nt, Mycobacterium avium subsp. paratuberculosis
gaccgugaggcccggcgugggcc

SEQ ID NO: 2946325 - RNA, 22 nt, Mycobacterium avium subsp. paratuberculosis
gaccgugcccaccagccggccg

SEQ ID NO: 2946326 - RNA, 14 nt, Mycobacterium avium subsp. paratuberculosis
gaccgugcgacuug

SEQ ID NO: 2946327 - RNA, 19 nt, Mycobacterium avium subsp. paratuberculosis
gaccguggaggacgaggcc

SEQ ID NO: 2946328 - RNA, 24 nt, Mycobacterium avium subsp. paratuberculosis
gaccguggaggcguagugcgccca

SEQ ID NO: 2946329 - RNA, 20 nt, Mycobacterium avium subsp. paratuberculosis
gaccguggugucggagaucg

SEQ ID NO: 2946330 - RNA, 13 nt, Mycobacterium avium subsp. paratuberculosis
gaccguugaccga

SEQ ID NO: 2946331 - RNA, 18 nt, Mycobacterium avium subsp. paratuberculosis
gaccguugaccgacgccu

SEQ ID NO: 2946332 - RNA, 15 nt, Mycobacterium avium subsp. paratuberculosis
gaccguugacgaccu

SEQ ID NO: 2946333 - RNA, 17 nt, Mycobacterium avium subsp. paratuberculosis
gaccguugacgaccuug

SEQ ID NO: 2946334 - RNA, 16 nt, Mycobacterium avium subsp. paratuberculosis
gaccucacggucggcg

SEQ ID NO: 2946335 - RNA, 18 nt, Mycobacterium avium subsp. paratuberculosis
gaccuccaaugcgcccug

SEQ ID NO: 2946336 - RNA, 13 nt, Mycobacterium avium subsp. paratuberculosis
gaccuccacccgc

SEQ ID NO: 2946337 - RNA, 18 nt, Mycobacterium avium subsp. paratuberculosis
gaccucccccgacgccga

SEQ ID NO: 2946338 - RNA, 14 nt, Mycobacterium avium subsp. paratuberculosis
gaccucccggcgcc

SEQ ID NO: 2946339 - RNA, 17 nt, Mycobacterium avium subsp. paratuberculosis
gaccucccggcgccacg

SEQ ID NO: 2946340 - RNA, 14 nt, Mycobacterium avium subsp. paratuberculosis
gaccuccgugccga

SEQ ID NO: 2946341 - RNA, 17 nt, Mycobacterium avium subsp. paratuberculosis
gaccuccucgaccccga

SEQ ID NO: 2946342 - RNA, 15 nt, Mycobacterium avium subsp. paratuberculosis
gaccuccugcaaggc

SEQ ID NO: 2946343 - RNA, 20 nt, Mycobacterium avium subsp. paratuberculosis
gaccuccugcaaggcccccg

SEQ ID NO: 2946344 - RNA, 23 nt, Mycobacterium avium subsp. paratuberculosis
gaccuccugcuggcguucgccga

SEQ ID NO: 2946345 - RNA, 23 nt, Mycobacterium avium subsp. paratuberculosis
gaccucgaagauggucgcgccgc

SEQ ID NO: 2946346 - RNA, 15 nt, Mycobacterium avium subsp. paratuberculosis
gaccucgaagcagcc

SEQ ID NO: 2946347 - RNA, 16 nt, Mycobacterium avium subsp. paratuberculosis
gaccucgaagcagccu

SEQ ID NO: 2946348 - RNA, 20 nt, Mycobacterium avium subsp. paratuberculosis
gaccucgacacgggccgcgc

SEQ ID NO: 2946349 - RNA, 14 nt, Mycobacterium avium subsp. paratuberculosis
gaccucgaccagcc

SEQ ID NO: 2946350 - RNA, 15 nt, Mycobacterium avium subsp. paratuberculosis
gaccucgaccagccg

SEQ ID NO: 2946351 - RNA, 18 nt, Mycobacterium avium subsp. paratuberculosis
gaccucgacggugcugcc

SEQ ID NO: 2946352 - RNA, 16 nt, Mycobacterium avium subsp. paratuberculosis
gaccucgagcaccggc

SEQ ID NO: 2946353 - RNA, 15 nt, Mycobacterium avium subsp. paratuberculosis
gaccucgagcgucac

SEQ ID NO: 2946354 - RNA, 18 nt, Mycobacterium avium subsp. paratuberculosis
gaccucgagcgucacgcu

SEQ ID NO: 2946355 - RNA, 19 nt, Mycobacterium avium subsp. paratuberculosis
gaccucgagcgucacgcug

SEQ ID NO: 2946356 - RNA, 14 nt, Mycobacterium avium subsp. paratuberculosis
gaccucgaggccga

SEQ ID NO: 2946357 - RNA, 21 nt, Mycobacterium avium subsp. paratuberculosis
gaccucgauggcgacgcacga

SEQ ID NO: 2946358 - RNA, 15 nt, Mycobacterium avium subsp. paratuberculosis
gaccucgcccgccgc

SEQ ID NO: 2946359 - RNA, 14 nt, Mycobacterium avium subsp. paratuberculosis
gaccucgccgacgg

SEQ ID NO: 2946360 - RNA, 20 nt, Mycobacterium avium subsp. paratuberculosis
gaccucgccgacgucccagc

SEQ ID NO: 2946361 - RNA, 21 nt, Mycobacterium avium subsp. paratuberculosis
gaccucgccgacgucccagca

SEQ ID NO: 2946362 - RNA, 14 nt, Mycobacterium avium subsp. paratuberculosis
gaccucgccgagca

SEQ ID NO: 2946363 - RNA, 17 nt, Mycobacterium avium subsp. paratuberculosis
gaccucgccgagcagcc

SEQ ID NO: 2946364 - RNA, 13 nt, Mycobacterium avium subsp. paratuberculosis
gaccucgcgcagc

SEQ ID NO: 2946365 - RNA, 15 nt, Mycobacterium avium subsp. paratuberculosis
gaccucgcgcagccc

SEQ ID NO: 2946366 - RNA, 23 nt, Mycobacterium avium subsp. paratuberculosis
gaccucgcgcagcccccggacca

SEQ ID NO: 2946367 - RNA, 14 nt, Mycobacterium avium subsp. paratuberculosis
gaccucgcgcccgg

SEQ ID NO: 2946368 - RNA, 16 nt, Mycobacterium avium subsp. paratuberculosis
gaccucgcgcccggcg

SEQ ID NO: 2946369 - RNA, 18 nt, Mycobacterium avium subsp. paratuberculosis
gaccuugucgggccgcgg

SEQ ID NO: 2946370 - RNA, 16 nt, Mycobacterium avium subsp. paratuberculosis
gaccuuuugcccggcg

SEQ ID NO: 2946371 - RNA, 15 nt, Mycobacterium avium subsp. paratuberculosis
gacgaaaaugcccag

SEQ ID NO: 2946372 - RNA, 16 nt, Mycobacterium avium subsp. paratuberculosis
gacgaaaccgccaugc

SEQ ID NO: 2946373 - RNA, 14 nt, Mycobacterium avium subsp. paratuberculosis
gacgaaaucgucgg

SEQ ID NO: 2946374 - RNA, 17 nt, Mycobacterium avium subsp. paratuberculosis
gacgaaaucgucgggca

SEQ ID NO: 2946375 - RNA, 18 nt, Mycobacterium avium subsp. paratuberculosis
gacgaaaucgucgggccg

SEQ ID NO: 2946376 - RNA, 15 nt, Mycobacterium avium subsp. paratuberculosis
gacgaacaccaccgg

SEQ ID NO: 2946377 - RNA, 16 nt, Mycobacterium avium subsp. paratuberculosis
gacgaacaccaccggc

SEQ ID NO: 2946378 - RNA, 17 nt, Mycobacterium avium subsp. paratuberculosis
gacgaacaccaccggca

SEQ ID NO: 2946379 - RNA, 18 nt, Mycobacterium avium subsp. paratuberculosis
gacgaacaccaccggcaa

SEQ ID NO: 2946380 - RNA, 17 nt, Mycobacterium avium subsp. paratuberculosis
gacgaacagcaccgcca

SEQ ID NO: 2946381 - RNA, 14 nt, Mycobacterium avium subsp. paratuberculosis
gacgaacaucgacg

SEQ ID NO: 2946382 - RNA, 23 nt, Mycobacterium avium subsp. paratuberculosis
gacgaacaucgagcccaccgcgc

SEQ ID NO: 2946383 - RNA, 17 nt, Mycobacterium avium subsp. paratuberculosis
gacgaacaugcugccgc

SEQ ID NO: 2946384 - RNA, 23 nt, Mycobacterium avium subsp. paratuberculosis
gacgaacaugcugccgccggcga

SEQ ID NO: 2946385 - RNA, 18 nt, Mycobacterium avium subsp. paratuberculosis
gacgaacccgccgcggcc

SEQ ID NO: 2946386 - RNA, 17 nt, Mycobacterium avium subsp. paratuberculosis
gacgaaccgccacacgu

SEQ ID NO: 2946387 - RNA, 13 nt, Mycobacterium avium subsp. paratuberculosis
gacgaacgacgug

SEQ ID NO: 2946388 - RNA, 14 nt, Mycobacterium avium subsp. paratuberculosis
gacgaacgacgugu

SEQ ID NO: 2946389 - RNA, 14 nt, Mycobacterium avium subsp. paratuberculosis
gacgaacgccacca

SEQ ID NO: 2946390 - RNA, 17 nt, Mycobacterium avium subsp. paratuberculosis
gacgaacgccaccacgg

SEQ ID NO: 2946391 - RNA, 17 nt, Mycobacterium avium subsp. paratuberculosis
gacgaacgccggcauca

SEQ ID NO: 2946392 - RNA, 23 nt, Mycobacterium avium subsp. paratuberculosis
gacgaacgccggcaucagcgaga

SEQ ID NO: 2946393 - RNA, 16 nt, Mycobacterium avium subsp. paratuberculosis
gacgaacgcgccgccc

SEQ ID NO: 2946394 - RNA, 17 nt, Mycobacterium avium subsp. paratuberculosis
gacgaacgcgccgccca

SEQ ID NO: 2946395 - RNA, 15 nt, Mycobacterium avium subsp. paratuberculosis
gacgaacgcggccgc

SEQ ID NO: 2946396 - RNA, 16 nt, Mycobacterium avium subsp. paratuberculosis
gacgaacgcggccgcc

SEQ ID NO: 2946397 - RNA, 17 nt, Mycobacterium avium subsp. paratuberculosis
gacgaacgcggccgcca

SEQ ID NO: 2946398 - RNA, 16 nt, Mycobacterium avium subsp. paratuberculosis
gacgaacgcggcggag

SEQ ID NO: 2946399 - RNA, 22 nt, Mycobacterium avium subsp. paratuberculosis
gacgaacgcggcggaggccugc

SEQ ID NO: 2946400 - RNA, 20 nt, Mycobacterium avium subsp. paratuberculosis
gacgaacgcuuccagcacca

SEQ ID NO: 2946401 - RNA, 23 nt, Mycobacterium avium subsp. paratuberculosis
gacgaacgcuuccagcaccaccc

SEQ ID NO: 2946402 - RNA, 19 nt, Mycobacterium avium subsp. paratuberculosis
gacgaacucaagggcguca

SEQ ID NO: 2946403 - RNA, 21 nt, Mycobacterium avium subsp. paratuberculosis
gacgaacuccgagccggugga

SEQ ID NO: 2946404 - RNA, 16 nt, Mycobacterium avium subsp. paratuberculosis
gacgaacuccgcgcgc

SEQ ID NO: 2946405 - RNA, 17 nt, Mycobacterium avium subsp. paratuberculosis
gacgaacuccugcucgc

SEQ ID NO: 2946406 - RNA, 22 nt, Mycobacterium avium subsp. paratuberculosis
gacgaacuccugcucgcgggcc

SEQ ID NO: 2946407 - RNA, 15 nt, Mycobacterium avium subsp. paratuberculosis
gacgaacuuggacgg

SEQ ID NO: 2946408 - RNA, 20 nt, Mycobacterium avium subsp. paratuberculosis
gacgaagaaggacgccucgc

SEQ ID NO: 2946409 - RNA, 17 nt, Mycobacterium avium subsp. paratuberculosis
gacgaagaccgggucgu

SEQ ID NO: 2946410 - RNA, 20 nt, Mycobacterium avium subsp. paratuberculosis
gacgaagaucccgcuggcca

SEQ ID NO: 2946411 - RNA, 18 nt, Mycobacterium avium subsp. paratuberculosis
gacgaagaugcgcccggu

SEQ ID NO: 2946412 - RNA, 16 nt, Mycobacterium avium subsp. paratuberculosis
gacgaagcagcucgcg

SEQ ID NO: 2946413 - RNA, 13 nt, Mycobacterium avium subsp. paratuberculosis
gacgaagccgccg

SEQ ID NO: 2946414 - RNA, 19 nt, Mycobacterium avium subsp. paratuberculosis
gacgaagccgccgcccucg

SEQ ID NO: 2946415 - RNA, 23 nt, Mycobacterium avium subsp. paratuberculosis
gacgaagccgccgcccucgguga

SEQ ID NO: 2946416 - RNA, 14 nt, Mycobacterium avium subsp. paratuberculosis
gacgaagcggucgc

SEQ ID NO: 2946417 - RNA, 17 nt, Mycobacterium avium subsp. paratuberculosis
gacgaaggugcgcacga

SEQ ID NO: 2946418 - RNA, 23 nt, Mycobacterium avium subsp. paratuberculosis
gacgaaguagaagaucagcgcca

SEQ ID NO: 2946419 - RNA, 19 nt, Mycobacterium avium subsp. paratuberculosis
gacgaagucgacggcggug

SEQ ID NO: 2946420 - RNA, 15 nt, Mycobacterium avium subsp. paratuberculosis
gacgaagucggucag

SEQ ID NO: 2946421 - RNA, 20 nt, Mycobacterium avium subsp. paratuberculosis
gacgaagucggucagcgucg

SEQ ID NO: 2946422 - RNA, 15 nt, Mycobacterium avium subsp. paratuberculosis
gacgaauagccuucg

SEQ ID NO: 2946423 - RNA, 15 nt, Mycobacterium avium subsp. paratuberculosis
gacgaaucccgccuc

SEQ ID NO: 2946424 - RNA, 14 nt, Mycobacterium avium subsp. paratuberculosis
gacgaaugucucga

SEQ ID NO: 2946425 - RNA, 16 nt, Mycobacterium avium subsp. paratuberculosis
gacgaauuccgcaccg

SEQ ID NO: 2946426 - RNA, 18 nt, Mycobacterium avium subsp. paratuberculosis
gacgacaccaccgugcug

SEQ ID NO: 2946427 - RNA, 20 nt, Mycobacterium avium subsp. paratuberculosis
gacgacaccaccgugcuggc

SEQ ID NO: 2946428 - RNA, 20 nt, Mycobacterium avium subsp. paratuberculosis
gacgaccaggaugcccagga

SEQ ID NO: 2946429 - RNA, 22 nt, Mycobacterium avium subsp. paratuberculosis
gacgaccagguccaccccgcca

SEQ ID NO: 2946430 - RNA, 13 nt, Mycobacterium avium subsp. paratuberculosis
gacgaccaucagc

SEQ ID NO: 2946431 - RNA, 19 nt, Mycobacterium avium subsp. paratuberculosis
gacgacccgagagcugcug

SEQ ID NO: 2946432 - RNA, 20 nt, Mycobacterium avium subsp. paratuberculosis
gacgacccguaggagcugac

SEQ ID NO: 2946433 - RNA, 16 nt, Mycobacterium avium subsp. paratuberculosis
gacgaccgcaccgacc

SEQ ID NO: 2946434 - RNA, 23 nt, Mycobacterium avium subsp. paratuberculosis
gacgaccgcaccgaccagcggga

SEQ ID NO: 2946435 - RNA, 13 nt, Mycobacterium avium subsp. paratuberculosis
gacgaccgcgacg

SEQ ID NO: 2946436 - RNA, 16 nt, Mycobacterium avium subsp. paratuberculosis
gacgaccgcgacggcg

SEQ ID NO: 2946437 - RNA, 11 nt, Mycobacterium avium subsp. paratuberculosis
gacgaccgcgu

SEQ ID NO: 2946438 - RNA, 21 nt, Mycobacterium avium subsp. paratuberculosis
gacgaccggcagccgcgccca

SEQ ID NO: 2946439 - RNA, 18 nt, Mycobacterium avium subsp. paratuberculosis
gacgaccucccccgacgc

SEQ ID NO: 2946440 - RNA, 22 nt, Mycobacterium avium subsp. paratuberculosis
gacgaccucccccgacgccgac

SEQ ID NO: 2946441 - RNA, 16 nt, Mycobacterium avium subsp. paratuberculosis
gacgaccucgcccgcc

SEQ ID NO: 2946442 - RNA, 18 nt, Mycobacterium avium subsp. paratuberculosis
gacgaccucgcccgccgc

SEQ ID NO: 2946443 - RNA, 19 nt, Mycobacterium avium subsp. paratuberculosis
gacgaccucgcccgccgcg

SEQ ID NO: 2946444 - RNA, 20 nt, Mycobacterium avium subsp. paratuberculosis
gacgaccucgcccgccgcga

SEQ ID NO: 2946445 - RNA, 13 nt, Mycobacterium avium subsp. paratuberculosis
gacgaccucgccg

SEQ ID NO: 2946446 - RNA, 18 nt, Mycobacterium avium subsp. paratuberculosis
gacgaccucgucgucgau

SEQ ID NO: 2946447 - RNA, 16 nt, Mycobacterium avium subsp. paratuberculosis
gacgaccugggcgccg

SEQ ID NO: 2946448 - RNA, 17 nt, Mycobacterium avium subsp. paratuberculosis
gacgaccugggcgccgu

SEQ ID NO: 2946449 - RNA, 18 nt, Mycobacterium avium subsp. paratuberculosis
gacgaccugggcgccguc

SEQ ID NO: 2946450 - RNA, 19 nt, Mycobacterium avium subsp. paratuberculosis
gacgaccugggcgccgucg

SEQ ID NO: 2946451 - RNA, 17 nt, Mycobacterium avium subsp. paratuberculosis
gacgaccuggucgccgc

SEQ ID NO: 2946452 - RNA, 19 nt, Mycobacterium avium subsp. paratuberculosis
gacgaccuggucgccgccg

SEQ ID NO: 2946453 - RNA, 19 nt, Mycobacterium avium subsp. paratuberculosis
gacgaccuucuggccuugc

SEQ ID NO: 2946454 - RNA, 16 nt, Mycobacterium avium subsp. paratuberculosis
gacgauccgggccggu

SEQ ID NO: 2946455 - RNA, 18 nt, Mycobacterium avium subsp. paratuberculosis
gacgauccgggccggucg

SEQ ID NO: 2946456 - RNA, 16 nt, Mycobacterium avium subsp. paratuberculosis
gacgaucgcgccggcc

SEQ ID NO: 2946457 - RNA, 18 nt, Mycobacterium avium subsp. paratuberculosis
gacgaucgcgccggccgc

SEQ ID NO: 2946458 - RNA, 22 nt, Mycobacterium avium subsp. paratuberculosis
gacgaucgcgccggccgccgcg

SEQ ID NO: 2946459 - RNA, 14 nt, Mycobacterium avium subsp. paratuberculosis
gacgaucggcucga

SEQ ID NO: 2946460 - RNA, 16 nt, Mycobacterium avium subsp. paratuberculosis
gacgaucggcucgagc

SEQ ID NO: 2946461 - RNA, 13 nt, Mycobacterium avium subsp. paratuberculosis
gacgaucgucgac

SEQ ID NO: 2946462 - RNA, 16 nt, Mycobacterium avium subsp. paratuberculosis
gacgaucucgccgucc

SEQ ID NO: 2946463 - RNA, 19 nt, Mycobacterium avium subsp. paratuberculosis
gacgaucucgugggucagc

SEQ ID NO: 2946464 - RNA, 20 nt, Mycobacterium avium subsp. paratuberculosis
gacgaucucgugggucagcu

SEQ ID NO: 2946465 - RNA, 13 nt, Mycobacterium avium subsp. paratuberculosis
gacgaucuggcgc

SEQ ID NO: 2946466 - RNA, 16 nt, Mycobacterium avium subsp. paratuberculosis
gacgaucuguaguugc

SEQ ID NO: 2946467 - RNA, 20 nt, Mycobacterium avium subsp. paratuberculosis
gacgaugaaaccccagccgg

SEQ ID NO: 2946468 - RNA, 19 nt, Mycobacterium avium subsp. paratuberculosis
gacgaugaacagucggccg

SEQ ID NO: 2946469 - RNA, 17 nt, Mycobacterium avium subsp. paratuberculosis
gacgaugagggccagca

SEQ ID NO: 2946470 - RNA, 20 nt, Mycobacterium avium subsp. paratuberculosis
gacgaugagggugaugacgu

SEQ ID NO: 2946471 - RNA, 19 nt, Mycobacterium avium subsp. paratuberculosis
gacgaugaugucgcccggc

SEQ ID NO: 2946472 - RNA, 20 nt, Mycobacterium avium subsp. paratuberculosis
gacgaugaugucgcccggcg

SEQ ID NO: 2946473 - RNA, 22 nt, Mycobacterium avium subsp. paratuberculosis
gacgaugaugucgcccggcggc

SEQ ID NO: 2946474 - RNA, 23 nt, Mycobacterium avium subsp. paratuberculosis
gacgaugaugucgcccggcggca

SEQ ID NO: 2946475 - RNA, 19 nt, Mycobacterium avium subsp. paratuberculosis
gacgaugaugucggccggc

SEQ ID NO: 2946476 - RNA, 14 nt, Mycobacterium avium subsp. paratuberculosis
gacgaugcccagcc

SEQ ID NO: 2946477 - RNA, 16 nt, Mycobacterium avium subsp. paratuberculosis
gacgaugcccggggug

SEQ ID NO: 2946478 - RNA, 14 nt, Mycobacterium avium subsp. paratuberculosis
gacgaugccgcggc

SEQ ID NO: 2946479 - RNA, 14 nt, Mycobacterium avium subsp. paratuberculosis
gacgaugccggccg

SEQ ID NO: 2946480 - RNA, 13 nt, Mycobacterium avium subsp. paratuberculosis
gacgaugcggccg

SEQ ID NO: 2946481 - RNA, 15 nt, Mycobacterium avium subsp. paratuberculosis
gacgaugcggccggc

SEQ ID NO: 2946482 - RNA, 18 nt, Mycobacterium avium subsp. paratuberculosis
gacgaugcggccggcggg

SEQ ID NO: 2946483 - RNA, 17 nt, Mycobacterium avium subsp. paratuberculosis
gacgaugcggggccggc

SEQ ID NO: 2946484 - RNA, 20 nt, Mycobacterium avium subsp. paratuberculosis
gacgaugcggggccggcggc

SEQ ID NO: 2946485 - RNA, 23 nt, Mycobacterium avium subsp. paratuberculosis
gacgaugcggggccggcggcggc

SEQ ID NO: 2946486 - RNA, 19 nt, Mycobacterium avium subsp. paratuberculosis
gacgaugcggggcggcggg

SEQ ID NO: 2946487 - RNA, 15 nt, Mycobacterium avium subsp. paratuberculosis
gacgaugcguucggg

SEQ ID NO: 2946488 - RNA, 18 nt, Mycobacterium avium subsp. paratuberculosis
gacgauggacgaagugcc

SEQ ID NO: 2946489 - RNA, 14 nt, Mycobacterium avium subsp. paratuberculosis
gacgauggccaggc

SEQ ID NO: 2946490 - RNA, 13 nt, Mycobacterium avium subsp. paratuberculosis
gacgauggcccgg

SEQ ID NO: 2946491 - RNA, 22 nt, Mycobacterium avium subsp. paratuberculosis
gacgauggcccggaccgccgcg

SEQ ID NO: 2946492 - RNA, 12 nt, Mycobacterium avium subsp. paratuberculosis
gacgauggcgac

SEQ ID NO: 2946493 - RNA, 15 nt, Mycobacterium avium subsp. paratuberculosis
gacgauggcgaccgc

SEQ ID NO: 2946494 - RNA, 16 nt, Mycobacterium avium subsp. paratuberculosis
gacgauggcgaccgcg

SEQ ID NO: 2946495 - RNA, 21 nt, Mycobacterium avium subsp. paratuberculosis
gacgauggucuggaugaucgu

SEQ ID NO: 2946496 - RNA, 16 nt, Mycobacterium avium subsp. paratuberculosis
gacgauguccgccggc

SEQ ID NO: 2946497 - RNA, 22 nt, Mycobacterium avium subsp. paratuberculosis
gacgaugucgaaacccaggaac

SEQ ID NO: 2946498 - RNA, 19 nt, Mycobacterium avium subsp. paratuberculosis
gacgaugucgacccgcggc

SEQ ID NO: 2946499 - RNA, 17 nt, Mycobacterium avium subsp. paratuberculosis
gacgaugucgaugacgg

SEQ ID NO: 2946500 - RNA, 20 nt, Mycobacterium avium subsp. paratuberculosis
gacgaugucgaugacggcgg

SEQ ID NO: 2946501 - RNA, 22 nt, Mycobacterium avium subsp. paratuberculosis
gacgaugucgaugacggcggcg

SEQ ID NO: 2946502 - RNA, 23 nt, Mycobacterium avium subsp. paratuberculosis
gacgaugucgaugacggcggcgc

SEQ ID NO: 2946503 - RNA, 14 nt, Mycobacterium avium subsp. paratuberculosis
gacgaugucgucgc

SEQ ID NO: 2946504 - RNA, 13 nt, Mycobacterium avium subsp. paratuberculosis
gacgauucgcgau

SEQ ID NO: 2946505 - RNA, 21 nt, Mycobacterium avium subsp. paratuberculosis
gacgauugugugccaagcggu

SEQ ID NO: 2946506 - RNA, 17 nt, Mycobacterium avium subsp. paratuberculosis
gacgcaaaagccccgcg

SEQ ID NO: 2946507 - RNA, 16 nt, Mycobacterium avium subsp. paratuberculosis
gacgcaccacgagcag

SEQ ID NO: 2946508 - RNA, 20 nt, Mycobacterium avium subsp. paratuberculosis
gacgcaccacgagcagccga

SEQ ID NO: 2946509 - RNA, 18 nt, Mycobacterium avium subsp. paratuberculosis
gacgcaccucgcucagcc

SEQ ID NO: 2946510 - RNA, 20 nt, Mycobacterium avium subsp. paratuberculosis
gacgcaccucgcucagcccg

SEQ ID NO: 2946511 - RNA, 17 nt, Mycobacterium avium subsp. paratuberculosis
gacgcacgaaaccgcgu

SEQ ID NO: 2946512 - RNA, 14 nt, Mycobacterium avium subsp. paratuberculosis
gacgcacgccggcg

SEQ ID NO: 2946513 - RNA, 15 nt, Mycobacterium avium subsp. paratuberculosis
gacgcacgccggcgg

SEQ ID NO: 2946514 - RNA, 16 nt, Mycobacterium avium subsp. paratuberculosis
gacgcacgccggcggg

SEQ ID NO: 2946515 - RNA, 19 nt, Mycobacterium avium subsp. paratuberculosis
gacgcacgccggcgggggu

SEQ ID NO: 2946516 - RNA, 16 nt, Mycobacterium avium subsp. paratuberculosis
gacgcacgucggcagg

SEQ ID NO: 2946517 - RNA, 14 nt, Mycobacterium avium subsp. paratuberculosis
gacgcagcgaucgg

SEQ ID NO: 2946518 - RNA, 19 nt, Mycobacterium avium subsp. paratuberculosis
gacgcagcgaucggcggcu

SEQ ID NO: 2946519 - RNA, 14 nt, Mycobacterium avium subsp. paratuberculosis
gacgcaucaccacg

SEQ ID NO: 2946520 - RNA, 15 nt, Mycobacterium avium subsp. paratuberculosis
gacgcauccacggcc

SEQ ID NO: 2946521 - RNA, 18 nt, Mycobacterium avium subsp. paratuberculosis
gacgcauccacggccggu

SEQ ID NO: 2946522 - RNA, 20 nt, Mycobacterium avium subsp. paratuberculosis
gacgcauucaaugucgcccu

SEQ ID NO: 2946523 - RNA, 23 nt, Mycobacterium avium subsp. paratuberculosis
gacgccaccaucgaguaggccca

SEQ ID NO: 2946524 - RNA, 16 nt, Mycobacterium avium subsp. paratuberculosis
gacgccacggggcugc

SEQ ID NO: 2946525 - RNA, 20 nt, Mycobacterium avium subsp. paratuberculosis
gacgccacggggcugcgggc

SEQ ID NO: 2946526 - RNA, 11 nt, Mycobacterium avium subsp. paratuberculosis
gacgccagcac

SEQ ID NO: 2946527 - RNA, 12 nt, Mycobacterium avium subsp. paratuberculosis
gacgccagcacc

SEQ ID NO: 2946528 - RNA, 24 nt, Mycobacterium avium subsp. paratuberculosis
gacgccagcacguggccgggcucg

SEQ ID NO: 2946529 - RNA, 20 nt, Mycobacterium avium subsp. paratuberculosis
gacgccagcaugaucaccgc

SEQ ID NO: 2946530 - RNA, 22 nt, Mycobacterium avium subsp. paratuberculosis
gacgccagcaugaucaccgcca

SEQ ID NO: 2946531 - RNA, 23 nt, Mycobacterium avium subsp. paratuberculosis
gacgccagcaugaucaccgccag

SEQ ID NO: 2946532 - RNA, 15 nt, Mycobacterium avium subsp. paratuberculosis
gacgccagcggcagc

SEQ ID NO: 2946533 - RNA, 19 nt, Mycobacterium avium subsp. paratuberculosis
gacgccagcggcagcgcca

SEQ ID NO: 2946534 - RNA, 18 nt, Mycobacterium avium subsp. paratuberculosis
gacgccagcgggccgugc

SEQ ID NO: 2946535 - RNA, 13 nt, Mycobacterium avium subsp. paratuberculosis
gacgccagcugcc

SEQ ID NO: 2946536 - RNA, 19 nt, Mycobacterium avium subsp. paratuberculosis
gacgccaguggcugcacgu

SEQ ID NO: 2946537 - RNA, 21 nt, Mycobacterium avium subsp. paratuberculosis
gacgccaguucgucggccguc

SEQ ID NO: 2946538 - RNA, 17 nt, Mycobacterium avium subsp. paratuberculosis
gacgccaugggcccagc

SEQ ID NO: 2946539 - RNA, 12 nt, Mycobacterium avium subsp. paratuberculosis
gacgccggcagc

SEQ ID NO: 2946540 - RNA, 16 nt, Mycobacterium avium subsp. paratuberculosis
gacgccggcagccgcu

SEQ ID NO: 2946541 - RNA, 17 nt, Mycobacterium avium subsp. paratuberculosis
gacgccggcagccgcuc

SEQ ID NO: 2946542 - RNA, 19 nt, Mycobacterium avium subsp. paratuberculosis
gacgccggcagccgcucgg

SEQ ID NO: 2946543 - RNA, 14 nt, Mycobacterium avium subsp. paratuberculosis
gacgccggccacca

SEQ ID NO: 2946544 - RNA, 14 nt, Mycobacterium avium subsp. paratuberculosis
gacgccggccucuc

SEQ ID NO: 2946545 - RNA, 23 nt, Mycobacterium avium subsp. paratuberculosis
gacgccggccucucgucgacgau

SEQ ID NO: 2946546 - RNA, 23 nt, Mycobacterium avium subsp. paratuberculosis
gacgccggcgaggcggucggcgg

SEQ ID NO: 2946547 - RNA, 17 nt, Mycobacterium avium subsp. paratuberculosis
gacgccgggcagcgcgc

SEQ ID NO: 2946548 - RNA, 18 nt, Mycobacterium avium subsp. paratuberculosis
gacgccgggcagcgcgcg

SEQ ID NO: 2946549 - RNA, 15 nt, Mycobacterium avium subsp. paratuberculosis
gacgccgggccgccg

SEQ ID NO: 2946550 - RNA, 15 nt, Mycobacterium avium subsp. paratuberculosis
gacgccgggcgcccg

SEQ ID NO: 2946551 - RNA, 15 nt, Mycobacterium avium subsp. paratuberculosis
gacgccggucgcugc

SEQ ID NO: 2946552 - RNA, 16 nt, Mycobacterium avium subsp. paratuberculosis
gacgccggucgcugcg

SEQ ID NO: 2946553 - RNA, 17 nt, Mycobacterium avium subsp. paratuberculosis
gacgccggucgcugcga

SEQ ID NO: 2946554 - RNA, 22 nt, Mycobacterium avium subsp. paratuberculosis
gacgccggugaaaccggcgccg

SEQ ID NO: 2946555 - RNA, 17 nt, Mycobacterium avium subsp. paratuberculosis
gacgccguccgacgugc

SEQ ID NO: 2946556 - RNA, 20 nt, Mycobacterium avium subsp. paratuberculosis
gacgccgucgagccugguga

SEQ ID NO: 2946557 - RNA, 17 nt, Mycobacterium avium subsp. paratuberculosis
gacgccgucgaugacgc

SEQ ID NO: 2946558 - RNA, 15 nt, Mycobacterium avium subsp. paratuberculosis
gacgccgugcugccg

SEQ ID NO: 2946559 - RNA, 16 nt, Mycobacterium avium subsp. paratuberculosis
gacgccgugcugccgg

SEQ ID NO: 2946560 - RNA, 19 nt, Mycobacterium avium subsp. paratuberculosis
gacgccgugguccagccgg

SEQ ID NO: 2946561 - RNA, 23 nt, Mycobacterium avium subsp. paratuberculosis
gacgccgugguccagccggucgc

SEQ ID NO: 2946562 - RNA, 22 nt, Mycobacterium avium subsp. paratuberculosis
gacgccguucagguaggucaac

SEQ ID NO: 2946563 - RNA, 19 nt, Mycobacterium avium subsp. paratuberculosis
gacgccguugcggugcucg

SEQ ID NO: 2946564 - RNA, 22 nt, Mycobacterium avium subsp. paratuberculosis
gacgccguugcggugcucgucg

SEQ ID NO: 2946565 - RNA, 17 nt, Mycobacterium avium subsp. paratuberculosis
gacgccucaggcgagca

SEQ ID NO: 2946566 - RNA, 15 nt, Mycobacterium avium subsp. paratuberculosis
gacgccucccccacc

SEQ ID NO: 2946567 - RNA, 18 nt, Mycobacterium avium subsp. paratuberculosis
gacgccucccccacccgc

SEQ ID NO: 2946568 - RNA, 14 nt, Mycobacterium avium subsp. paratuberculosis
gacgccucgcgcag

SEQ ID NO: 2946569 - RNA, 19 nt, Mycobacterium avium subsp. paratuberculosis
gacgccucgcgcagcgcgu

SEQ ID NO: 2946570 - RNA, 13 nt, Mycobacterium avium subsp. paratuberculosis
gacgccucggugc

SEQ ID NO: 2946571 - RNA, 14 nt, Mycobacterium avium subsp. paratuberculosis
gacgccucggugcg

SEQ ID NO: 2946572 - RNA, 19 nt, Mycobacterium avium subsp. paratuberculosis
gacgcgaaagcacccgaca

SEQ ID NO: 2946573 - RNA, 15 nt, Mycobacterium avium subsp. paratuberculosis
gacgcgaagucgccg

SEQ ID NO: 2946574 - RNA, 16 nt, Mycobacterium avium subsp. paratuberculosis
gacgcgaagucgccgc

SEQ ID NO: 2946575 - RNA, 17 nt, Mycobacterium avium subsp. paratuberculosis
gacgcgaagucgccgcc

SEQ ID NO: 2946576 - RNA, 19 nt, Mycobacterium avium subsp. paratuberculosis
gacgcgaagucgccgcccg

SEQ ID NO: 2946577 - RNA, 17 nt, Mycobacterium avium subsp. paratuberculosis
gacgcgaaugucgacca

SEQ ID NO: 2946578 - RNA, 13 nt, Mycobacterium avium subsp. paratuberculosis
gacgcgaccaggc

SEQ ID NO: 2946579 - RNA, 23 nt, Mycobacterium avium subsp. paratuberculosis
gacgcgaccaggcccagcggauc

SEQ ID NO: 2946580 - RNA, 13 nt, Mycobacterium avium subsp. paratuberculosis
gacgcgaccgcgc

SEQ ID NO: 2946581 - RNA, 15 nt, Mycobacterium avium subsp. paratuberculosis
gacgcgaccgcgcgg

SEQ ID NO: 2946582 - RNA, 13 nt, Mycobacterium avium subsp. paratuberculosis
gacgcgaccggcc

SEQ ID NO: 2946583 - RNA, 14 nt, Mycobacterium avium subsp. paratuberculosis
gacgcgaccggccc

SEQ ID NO: 2946584 - RNA, 18 nt, Mycobacterium avium subsp. paratuberculosis
gacgcgacgcgcucggcg

SEQ ID NO: 2946585 - RNA, 17 nt, Mycobacterium avium subsp. paratuberculosis
gacgcgacggucgugcu

SEQ ID NO: 2946586 - RNA, 19 nt, Mycobacterium avium subsp. paratuberculosis
gacgcgacggucgugcugg

SEQ ID NO: 2946587 - RNA, 23 nt, Mycobacterium avium subsp. paratuberculosis
gacgcgacggucgugcugggccg

SEQ ID NO: 2946588 - RNA, 16 nt, Mycobacterium avium subsp. paratuberculosis
gacgcgauggcgcugg

SEQ ID NO: 2946589 - RNA, 22 nt, Mycobacterium avium subsp. paratuberculosis
gacgcgauggcgcuggccgcga

SEQ ID NO: 2946590 - RNA, 23 nt, Mycobacterium avium subsp. paratuberculosis
gacgcgauggcgcuggccgcgaa

SEQ ID NO: 2946591 - RNA, 16 nt, Mycobacterium avium subsp. paratuberculosis
gacgcgcaccagggcc

SEQ ID NO: 2946592 - RNA, 17 nt, Mycobacterium avium subsp. paratuberculosis
gacgcgcaccagggccg

SEQ ID NO: 2946593 - RNA, 18 nt, Mycobacterium avium subsp. paratuberculosis
gacgcgcacccgggaccg

SEQ ID NO: 2946594 - RNA, 12 nt, Mycobacterium avium subsp. paratuberculosis
gacgcgcaccgc

SEQ ID NO: 2946595 - RNA, 16 nt, Mycobacterium avium subsp. paratuberculosis
gacgcgcaccgccacc

SEQ ID NO: 2946596 - RNA, 12 nt, Mycobacterium avium subsp. paratuberculosis
gacgcgcagauc

SEQ ID NO: 2946597 - RNA, 15 nt, Mycobacterium avium subsp. paratuberculosis
gacgcgccacgcccc

SEQ ID NO: 2946598 - RNA, 13 nt, Mycobacterium avium subsp. paratuberculosis
gacgcgcccggcg

SEQ ID NO: 2946599 - RNA, 22 nt, Mycobacterium avium subsp. paratuberculosis
gacgcgccgcacugcacggccu

SEQ ID NO: 2946600 - RNA, 16 nt, Mycobacterium avium subsp. paratuberculosis
gacgcgccggcccaga

SEQ ID NO: 2946601 - RNA, 13 nt, Mycobacterium avium subsp. paratuberculosis
gacgcgcgcggcg

SEQ ID NO: 2946602 - RNA, 15 nt, Mycobacterium avium subsp. paratuberculosis
gacgcgcgcggcguc

SEQ ID NO: 2946603 - RNA, 13 nt, Mycobacterium avium subsp. paratuberculosis
gacgcgcucggcg

SEQ ID NO: 2946604 - RNA, 22 nt, Mycobacterium avium subsp. paratuberculosis
gacgcgcucggcgaccgccggu

SEQ ID NO: 2946605 - RNA, 23 nt, Mycobacterium avium subsp. paratuberculosis
gacgcgcucggcgaccgccggug

SEQ ID NO: 2946606 - RNA, 14 nt, Mycobacterium avium subsp. paratuberculosis
gacgcggcacgccg

SEQ ID NO: 2946607 - RNA, 15 nt, Mycobacterium avium subsp. paratuberculosis
gacgcggcacgccgc

SEQ ID NO: 2946608 - RNA, 18 nt, Mycobacterium avium subsp. paratuberculosis
gacgcggcacgccgcucg

SEQ ID NO: 2946609 - RNA, 17 nt, Mycobacterium avium subsp. paratuberculosis
gacgcggcaggcgcccc

SEQ ID NO: 2946610 - RNA, 14 nt, Mycobacterium avium subsp. paratuberculosis
gacgcggccagcgc

SEQ ID NO: 2946611 - RNA, 15 nt, Mycobacterium avium subsp. paratuberculosis
gacgcggccagcgcc

SEQ ID NO: 2946612 - RNA, 18 nt, Mycobacterium avium subsp. paratuberculosis
gacgcggccagcgcccgc

SEQ ID NO: 2946613 - RNA, 17 nt, Mycobacterium avium subsp. paratuberculosis
gacgcggccucaccgcg

SEQ ID NO: 2946614 - RNA, 18 nt, Mycobacterium avium subsp. paratuberculosis
gacgcggccucaccgcgg

SEQ ID NO: 2946615 - RNA, 20 nt, Mycobacterium avium subsp. paratuberculosis
gacgcggccucaccgcgggc

SEQ ID NO: 2946616 - RNA, 18 nt, Mycobacterium avium subsp. paratuberculosis
gacgcggccucgaagcug

SEQ ID NO: 2946617 - RNA, 22 nt, Mycobacterium avium subsp. paratuberculosis
gacgcggccucgaagcuggaau

SEQ ID NO: 2946618 - RNA, 14 nt, Mycobacterium avium subsp. paratuberculosis
gacgcggcgaccac

SEQ ID NO: 2946619 - RNA, 20 nt, Mycobacterium avium subsp. paratuberculosis
gacgcggcgaccaccaccgc

SEQ ID NO: 2946620 - RNA, 13 nt, Mycobacterium avium subsp. paratuberculosis
gacgcggcgcgac

SEQ ID NO: 2946621 - RNA, 14 nt, Mycobacterium avium subsp. paratuberculosis
gacgcggcgcgcga

SEQ ID NO: 2946622 - RNA, 15 nt, Mycobacterium avium subsp. paratuberculosis
gacgcggcgcgcgau

SEQ ID NO: 2946623 - RNA, 22 nt, Mycobacterium avium subsp. paratuberculosis
gacgcggcggacgauguccgcc

SEQ ID NO: 2946624 - RNA, 18 nt, Mycobacterium avium subsp. paratuberculosis
gacgcugccgcgccgcca

SEQ ID NO: 2946625 - RNA, 19 nt, Mycobacterium avium subsp. paratuberculosis
gacgcugccgcuggcgucg

SEQ ID NO: 2946626 - RNA, 15 nt, Mycobacterium avium subsp. paratuberculosis
gacgcugccggggcg

SEQ ID NO: 2946627 - RNA, 16 nt, Mycobacterium avium subsp. paratuberculosis
gacgcugccggggcgc

SEQ ID NO: 2946628 - RNA, 19 nt, Mycobacterium avium subsp. paratuberculosis
gacgcugccggggcgcagc

SEQ ID NO: 2946629 - RNA, 15 nt, Mycobacterium avium subsp. paratuberculosis
gacgcuggccacgau

SEQ ID NO: 2946630 - RNA, 14 nt, Mycobacterium avium subsp. paratuberculosis
gacgcuggccgaga

SEQ ID NO: 2946631 - RNA, 14 nt, Mycobacterium avium subsp. paratuberculosis
gacgcugggcggcg

SEQ ID NO: 2946632 - RNA, 15 nt, Mycobacterium avium subsp. paratuberculosis
gacgcugggcggcga

SEQ ID NO: 2946633 - RNA, 12 nt, Mycobacterium avium subsp. paratuberculosis
gacgcugguggc

SEQ ID NO: 2946634 - RNA, 14 nt, Mycobacterium avium subsp. paratuberculosis
gacgcugugcucgg

SEQ ID NO: 2946635 - RNA, 20 nt, Mycobacterium avium subsp. paratuberculosis
gacgcuugggguuuggcgac

SEQ ID NO: 2946636 - RNA, 14 nt, Mycobacterium avium subsp. paratuberculosis
gacggacacccgcg

SEQ ID NO: 2946637 - RNA, 16 nt, Mycobacterium avium subsp. paratuberculosis
gacggacacccgcgcg

SEQ ID NO: 2946638 - RNA, 17 nt, Mycobacterium avium subsp. paratuberculosis
gacggagccgugcccga

SEQ ID NO: 2946639 - RNA, 16 nt, Mycobacterium avium subsp. paratuberculosis
gacggaguuggaucgc

SEQ ID NO: 2946640 - RNA, 18 nt, Mycobacterium avium subsp. paratuberculosis
gacggaguuggaucgccg

SEQ ID NO: 2946641 - RNA, 23 nt, Mycobacterium avium subsp. paratuberculosis
gacggauaacucuacugcugcgg

SEQ ID NO: 2946642 - RNA, 23 nt, Mycobacterium avium subsp. paratuberculosis
gacggaucgagucccgcgcggcg

SEQ ID NO: 2946643 - RNA, 13 nt, Mycobacterium avium subsp. paratuberculosis
gacggaucggccg

SEQ ID NO: 2946644 - RNA, 14 nt, Mycobacterium avium subsp. paratuberculosis
gacggaucggccgc

SEQ ID NO: 2946645 - RNA, 15 nt, Mycobacterium avium subsp. paratuberculosis
gacggaucggccgcg

SEQ ID NO: 2946646 - RNA, 16 nt, Mycobacterium avium subsp. paratuberculosis
gacggaucggccgcgu

SEQ ID NO: 2946647 - RNA, 14 nt, Mycobacterium avium subsp. paratuberculosis
gacggaucugcucg

SEQ ID NO: 2946648 - RNA, 15 nt, Mycobacterium avium subsp. paratuberculosis
gacggaucugcucgu

SEQ ID NO: 2946649 - RNA, 16 nt, Mycobacterium avium subsp. paratuberculosis
gacggaugugacgcgg

SEQ ID NO: 2946650 - RNA, 15 nt, Mycobacterium avium subsp. paratuberculosis
gacggauucccgaac

SEQ ID NO: 2946651 - RNA, 23 nt, Mycobacterium avium subsp. paratuberculosis
gacggauucccgaacagggcgac

SEQ ID NO: 2946652 - RNA, 16 nt, Mycobacterium avium subsp. paratuberculosis
gacggcaauacggggc

SEQ ID NO: 2946653 - RNA, 15 nt, Mycobacterium avium subsp. paratuberculosis
gacggcaauccggcc

SEQ ID NO: 2946654 - RNA, 16 nt, Mycobacterium avium subsp. paratuberculosis
gacggcaauccggccc

SEQ ID NO: 2946655 - RNA, 15 nt, Mycobacterium avium subsp. paratuberculosis
gacggcacccggccc

SEQ ID NO: 2946656 - RNA, 13 nt, Mycobacterium avium subsp. paratuberculosis
gacggcaccgacg

SEQ ID NO: 2946657 - RNA, 23 nt, Mycobacterium avium subsp. paratuberculosis
gacggcaccgacggagccgagca

SEQ ID NO: 2946658 - RNA, 19 nt, Mycobacterium avium subsp. paratuberculosis
gacggcagcaccgccgaca

SEQ ID NO: 2946659 - RNA, 13 nt, Mycobacterium avium subsp. paratuberculosis
gacggcagcaccu

SEQ ID NO: 2946660 - RNA, 18 nt, Mycobacterium avium subsp. paratuberculosis
gacggcagcaccucgcgc

SEQ ID NO: 2946661 - RNA, 19 nt, Mycobacterium avium subsp. paratuberculosis
gacggcagcaccucgcgca

SEQ ID NO: 2946662 - RNA, 21 nt, Mycobacterium avium subsp. paratuberculosis
gacggcagcgcgauccggggg

SEQ ID NO: 2946663 - RNA, 13 nt, Mycobacterium avium subsp. paratuberculosis
gacggcagcgcua

SEQ ID NO: 2946664 - RNA, 16 nt, Mycobacterium avium subsp. paratuberculosis
gacggcagcggcacca

SEQ ID NO: 2946665 - RNA, 15 nt, Mycobacterium avium subsp. paratuberculosis
gacggcaucggcgcc

SEQ ID NO: 2946666 - RNA, 13 nt, Mycobacterium avium subsp. paratuberculosis
gacggcaugccgg

SEQ ID NO: 2946667 - RNA, 17 nt, Mycobacterium avium subsp. paratuberculosis
gacggcaugccgggcca

SEQ ID NO: 2946668 - RNA, 20 nt, Mycobacterium avium subsp. paratuberculosis
gacggcaugccgggccagcc

SEQ ID NO: 2946669 - RNA, 17 nt, Mycobacterium avium subsp. paratuberculosis
gacggcauugcagcgga

SEQ ID NO: 2946670 - RNA, 13 nt, Mycobacterium avium subsp. paratuberculosis
gacggccaccgcg

SEQ ID NO: 2946671 - RNA, 16 nt, Mycobacterium avium subsp. paratuberculosis
gacggccaccgcgacg

SEQ ID NO: 2946672 - RNA, 15 nt, Mycobacterium avium subsp. paratuberculosis
gacggccagaccgca

SEQ ID NO: 2946673 - RNA, 11 nt, Mycobacterium avium subsp. paratuberculosis
gacggccagca

SEQ ID NO: 2946674 - RNA, 13 nt, Mycobacterium avium subsp. paratuberculosis
gacggccagcagg

SEQ ID NO: 2946675 - RNA, 17 nt, Mycobacterium avium subsp. paratuberculosis
gacggccagcagggcgc

SEQ ID NO: 2946676 - RNA, 19 nt, Mycobacterium avium subsp. paratuberculosis
gacggccagcagggcgccg

SEQ ID NO: 2946677 - RNA, 20 nt, Mycobacterium avium subsp. paratuberculosis
gacggccagcagggcgccga

SEQ ID NO: 2946678 - RNA, 24 nt, Mycobacterium avium subsp. paratuberculosis
gacggccagcagggcgccgacgau

SEQ ID NO: 2946679 - RNA, 14 nt, Mycobacterium avium subsp. paratuberculosis
gacggccagcgcgg

SEQ ID NO: 2946680 - RNA, 15 nt, Mycobacterium avium subsp. paratuberculosis
gacggccagcgcggc

SEQ ID NO: 2946681 - RNA, 21 nt, Mycobacterium avium subsp. paratuberculosis
gacggccagcugauagccgcc

SEQ ID NO: 2946682 - RNA, 20 nt, Mycobacterium avium subsp. paratuberculosis
gacggcccacgucgcgccga

SEQ ID NO: 2946683 - RNA, 13 nt, Mycobacterium avium subsp. paratuberculosis
gacggccccccgg

SEQ ID NO: 2946684 - RNA, 15 nt, Mycobacterium avium subsp. paratuberculosis
gacggccccccgggc

SEQ ID NO: 2946685 - RNA, 16 nt, Mycobacterium avium subsp. paratuberculosis
gacggccccccgggca

SEQ ID NO: 2946686 - RNA, 13 nt, Mycobacterium avium subsp. paratuberculosis
gacggcccgacga

SEQ ID NO: 2946687 - RNA, 16 nt, Mycobacterium avium subsp. paratuberculosis
gacggcccgacgacgc

SEQ ID NO: 2946688 - RNA, 18 nt, Mycobacterium avium subsp. paratuberculosis
gacggcccgccggagccg

SEQ ID NO: 2946689 - RNA, 18 nt, Mycobacterium avium subsp. paratuberculosis
gacggccgcaccccaccc

SEQ ID NO: 2946690 - RNA, 21 nt, Mycobacterium avium subsp. paratuberculosis
gacggccgcaccccacccgcg

SEQ ID NO: 2946691 - RNA, 21 nt, Mycobacterium avium subsp. paratuberculosis
gacggccgccgauuccggccg

SEQ ID NO: 2946692 - RNA, 23 nt, Mycobacterium avium subsp. paratuberculosis
gacggccgccgauuccggccggc

SEQ ID NO: 2946693 - RNA, 13 nt, Mycobacterium avium subsp. paratuberculosis
gacggccgccgcg

SEQ ID NO: 2946694 - RNA, 16 nt, Mycobacterium avium subsp. paratuberculosis
gacggccgcgccgaac

SEQ ID NO: 2946695 - RNA, 21 nt, Mycobacterium avium subsp. paratuberculosis
gacggccgcgccgaacaccac

SEQ ID NO: 2946696 - RNA, 16 nt, Mycobacterium avium subsp. paratuberculosis
gacggccgcgccguug

SEQ ID NO: 2946697 - RNA, 20 nt, Mycobacterium avium subsp. paratuberculosis
gacggccgcggcgcggcccg

SEQ ID NO: 2946698 - RNA, 22 nt, Mycobacterium avium subsp. paratuberculosis
gacggccgcggcgcggcccggc

SEQ ID NO: 2946699 - RNA, 15 nt, Mycobacterium avium subsp. paratuberculosis
gacggccggcccugc

SEQ ID NO: 2946700 - RNA, 19 nt, Mycobacterium avium subsp. paratuberculosis
gacggccggcccugcacgc

SEQ ID NO: 2946701 - RNA, 20 nt, Mycobacterium avium subsp. paratuberculosis
gacggccggcccugcacgca

SEQ ID NO: 2946702 - RNA, 14 nt, Mycobacterium avium subsp. paratuberculosis
gacggccggcguca

SEQ ID NO: 2946703 - RNA, 15 nt, Mycobacterium avium subsp. paratuberculosis
gacggccggcgucac

SEQ ID NO: 2946704 - RNA, 20 nt, Mycobacterium avium subsp. paratuberculosis
gacggccgggcccucggacg

SEQ ID NO: 2946705 - RNA, 14 nt, Mycobacterium avium subsp. paratuberculosis
gacggccgggucag

SEQ ID NO: 2946706 - RNA, 14 nt, Mycobacterium avium subsp. paratuberculosis
gacggccggugacu

SEQ ID NO: 2946707 - RNA, 23 nt, Mycobacterium avium subsp. paratuberculosis
gacggccggugacuccuccucgg

SEQ ID NO: 2946708 - RNA, 14 nt, Mycobacterium avium subsp. paratuberculosis
gacggccgugaugc

SEQ ID NO: 2946709 - RNA, 20 nt, Mycobacterium avium subsp. paratuberculosis
gacgggaccacccgcagcgc

SEQ ID NO: 2946710 - RNA, 22 nt, Mycobacterium avium subsp. paratuberculosis
gacgggaccacccgcagcgcgg

SEQ ID NO: 2946711 - RNA, 18 nt, Mycobacterium avium subsp. paratuberculosis
gacgggaccgcacgccgg

SEQ ID NO: 2946712 - RNA, 14 nt, Mycobacterium avium subsp. paratuberculosis
gacgggacguuggc

SEQ ID NO: 2946713 - RNA, 19 nt, Mycobacterium avium subsp. paratuberculosis
gacgggagucgggcccgcc

SEQ ID NO: 2946714 - RNA, 16 nt, Mycobacterium avium subsp. paratuberculosis
gacgggauccggauug

SEQ ID NO: 2946715 - RNA, 14 nt, Mycobacterium avium subsp. paratuberculosis
gacgggaucggcgc

SEQ ID NO: 2946716 - RNA, 18 nt, Mycobacterium avium subsp. paratuberculosis
gacgggaucggcgcgucg

SEQ ID NO: 2946717 - RNA, 20 nt, Mycobacterium avium subsp. paratuberculosis
gacgggaucggcgcgucggc

SEQ ID NO: 2946718 - RNA, 13 nt, Mycobacterium avium subsp. paratuberculosis
gacgggcaccagu

SEQ ID NO: 2946719 - RNA, 14 nt, Mycobacterium avium subsp. paratuberculosis
gacgggcacccgcg

SEQ ID NO: 2946720 - RNA, 23 nt, Mycobacterium avium subsp. paratuberculosis
gacgggcacccgcgcgucgcgca

SEQ ID NO: 2946721 - RNA, 15 nt, Mycobacterium avium subsp. paratuberculosis
gacgggcauccggcu

SEQ ID NO: 2946722 - RNA, 23 nt, Mycobacterium avium subsp. paratuberculosis
gacgggcauccggcucagaaggc

SEQ ID NO: 2946723 - RNA, 20 nt, Mycobacterium avium subsp. paratuberculosis
gacgggcaugccgucggcgc

SEQ ID NO: 2946724 - RNA, 22 nt, Mycobacterium avium subsp. paratuberculosis
gacgggcaugccgucggcgccc

SEQ ID NO: 2946725 - RNA, 16 nt, Mycobacterium avium subsp. paratuberculosis
gacgggccaccagcgc

SEQ ID NO: 2946726 - RNA, 17 nt, Mycobacterium avium subsp. paratuberculosis
gacgggccaccagcgca

SEQ ID NO: 2946727 - RNA, 18 nt, Mycobacterium avium subsp. paratuberculosis
gacgggcccagcgcgacg

SEQ ID NO: 2946728 - RNA, 13 nt, Mycobacterium avium subsp. paratuberculosis
gacgggccgcauc

SEQ ID NO: 2946729 - RNA, 16 nt, Mycobacterium avium subsp. paratuberculosis
gacgggccgcauccgc

SEQ ID NO: 2946730 - RNA, 22 nt, Mycobacterium avium subsp. paratuberculosis
gacgggccgcauccgcgagccg

SEQ ID NO: 2946731 - RNA, 12 nt, Mycobacterium avium subsp. paratuberculosis
gacgggccgcgg

SEQ ID NO: 2946732 - RNA, 15 nt, Mycobacterium avium subsp. paratuberculosis
gacgggccgcggcca

SEQ ID NO: 2946733 - RNA, 13 nt, Mycobacterium avium subsp. paratuberculosis
gacgggccgggca

SEQ ID NO: 2946734 - RNA, 23 nt, Mycobacterium avium subsp. paratuberculosis
gacgggccgggcacgucgacgcc

SEQ ID NO: 2946735 - RNA, 23 nt, Mycobacterium avium subsp. paratuberculosis
gacgggcggggggcgagccggcc

SEQ ID NO: 2946736 - RNA, 14 nt, Mycobacterium avium subsp. paratuberculosis
gacgggcgucggcg

SEQ ID NO: 2946737 - RNA, 15 nt, Mycobacterium avium subsp. paratuberculosis
gacgggcgucggcgg

SEQ ID NO: 2946738 - RNA, 16 nt, Mycobacterium avium subsp. paratuberculosis
gacgggcgugccggcg

SEQ ID NO: 2946739 - RNA, 17 nt, Mycobacterium avium subsp. paratuberculosis
gacgggcgugccggcgg

SEQ ID NO: 2946740 - RNA, 21 nt, Mycobacterium avium subsp. paratuberculosis
gacgggcguguagccugcggc

SEQ ID NO: 2946741 - RNA, 14 nt, Mycobacterium avium subsp. paratuberculosis
gacgggcucggcgu

SEQ ID NO: 2946742 - RNA, 16 nt, Mycobacterium avium subsp. paratuberculosis
gacgggcugauccgcg

SEQ ID NO: 2946743 - RNA, 17 nt, Mycobacterium avium subsp. paratuberculosis
gacgggcugcugcacgu

SEQ ID NO: 2946744 - RNA, 21 nt, Mycobacterium avium subsp. paratuberculosis
gacgggcugucccggccgcga

SEQ ID NO: 2946745 - RNA, 18 nt, Mycobacterium avium subsp. paratuberculosis
gacggggcgaugccgaca

SEQ ID NO: 2946746 - RNA, 22 nt, Mycobacterium avium subsp. paratuberculosis
gacgggguucaguagcagcguc

SEQ ID NO: 2946747 - RNA, 17 nt, Mycobacterium avium subsp. paratuberculosis
gacgggucgaccgccgc

SEQ ID NO: 2946748 - RNA, 13 nt, Mycobacterium avium subsp. paratuberculosis
gacgggucggcgg

SEQ ID NO: 2946749 - RNA, 15 nt, Mycobacterium avium subsp. paratuberculosis
gacgggucggcggcg

SEQ ID NO: 2946750 - RNA, 22 nt, Mycobacterium avium subsp. paratuberculosis
gacgggucggugguucgcgcga

SEQ ID NO: 2946751 - RNA, 23 nt, Mycobacterium avium subsp. paratuberculosis
gacgggucggugguucgcgcgau

SEQ ID NO: 2946752 - RNA, 20 nt, Mycobacterium avium subsp. paratuberculosis
gacgggugcucagguugcgc

SEQ ID NO: 2946753 - RNA, 13 nt, Mycobacterium avium subsp. paratuberculosis
gacgggugggugg

SEQ ID NO: 2946754 - RNA, 16 nt, Mycobacterium avium subsp. paratuberculosis
gacggguugcggaucg

SEQ ID NO: 2946755 - RNA, 16 nt, Mycobacterium avium subsp. paratuberculosis
gacggguugcggucca

SEQ ID NO: 2946756 - RNA, 19 nt, Mycobacterium avium subsp. paratuberculosis
gacggguugcgguccacgu

SEQ ID NO: 2946757 - RNA, 18 nt, Mycobacterium avium subsp. paratuberculosis
gacggguugggcgccagc

SEQ ID NO: 2946758 - RNA, 19 nt, Mycobacterium avium subsp. paratuberculosis
gacggguugggcgccagca

SEQ ID NO: 2946759 - RNA, 18 nt, Mycobacterium avium subsp. paratuberculosis
gacggguuggucggcgcg

SEQ ID NO: 2946760 - RNA, 16 nt, Mycobacterium avium subsp. paratuberculosis
gacgguaugcccgccg

SEQ ID NO: 2946761 - RNA, 13 nt, Mycobacterium avium subsp. paratuberculosis
gacggucaccggc

SEQ ID NO: 2946762 - RNA, 18 nt, Mycobacterium avium subsp. paratuberculosis
gacggucaccggcaggcg

SEQ ID NO: 2946763 - RNA, 13 nt, Mycobacterium avium subsp. paratuberculosis
gacggucacgcug

SEQ ID NO: 2946764 - RNA, 17 nt, Mycobacterium avium subsp. paratuberculosis
gacggucacgcuggcgu

SEQ ID NO: 2946765 - RNA, 20 nt, Mycobacterium avium subsp. paratuberculosis
gacggucacgcuggcgugac

SEQ ID NO: 2946766 - RNA, 15 nt, Mycobacterium avium subsp. paratuberculosis
gacggucacggccgc

SEQ ID NO: 2946767 - RNA, 16 nt, Mycobacterium avium subsp. paratuberculosis
gacggucacggccgcc

SEQ ID NO: 2946768 - RNA, 20 nt, Mycobacterium avium subsp. paratuberculosis
gacggucacggccgccagca

SEQ ID NO: 2946769 - RNA, 21 nt, Mycobacterium avium subsp. paratuberculosis
gacggucacggccgccagcag

SEQ ID NO: 2946770 - RNA, 22 nt, Mycobacterium avium subsp. paratuberculosis
gacggucacggccgccagcagc

SEQ ID NO: 2946771 - RNA, 14 nt, Mycobacterium avium subsp. paratuberculosis
gacggucagcacgc

SEQ ID NO: 2946772 - RNA, 13 nt, Mycobacterium avium subsp. paratuberculosis
gacggucagcgcg

SEQ ID NO: 2946773 - RNA, 15 nt, Mycobacterium avium subsp. paratuberculosis
gacggucagcgcgcc

SEQ ID NO: 2946774 - RNA, 18 nt, Mycobacterium avium subsp. paratuberculosis
gacggucagguucuucug

SEQ ID NO: 2946775 - RNA, 13 nt, Mycobacterium avium subsp. paratuberculosis
gacggucaugccg

SEQ ID NO: 2946776 - RNA, 15 nt, Mycobacterium avium subsp. paratuberculosis
gacggucaugccgag

SEQ ID NO: 2946777 - RNA, 20 nt, Mycobacterium avium subsp. paratuberculosis
gacggucaugccgagccgcu

SEQ ID NO: 2946778 - RNA, 19 nt, Mycobacterium avium subsp. paratuberculosis
gacggucccgacgcugacg

SEQ ID NO: 2946779 - RNA, 20 nt, Mycobacterium avium subsp. paratuberculosis
gacgguccgcucaucgucgu

SEQ ID NO: 2946780 - RNA, 18 nt, Mycobacterium avium subsp. paratuberculosis
gacggucgaccucgagcg

SEQ ID NO: 2946781 - RNA, 13 nt, Mycobacterium avium subsp. paratuberculosis
gacggucgccgac

SEQ ID NO: 2946782 - RNA, 14 nt, Mycobacterium avium subsp. paratuberculosis
gacggucgccgacu

SEQ ID NO: 2946783 - RNA, 13 nt, Mycobacterium avium subsp. paratuberculosis
gacggucgggccc

SEQ ID NO: 2946784 - RNA, 20 nt, Mycobacterium avium subsp. paratuberculosis
gacggucgugcugggccggg

SEQ ID NO: 2946785 - RNA, 17 nt, Mycobacterium avium subsp. paratuberculosis
gacggucugcaccggga

SEQ ID NO: 2946786 - RNA, 21 nt, Mycobacterium avium subsp. paratuberculosis
gacggucugcaccgggaugac

SEQ ID NO: 2946787 - RNA, 16 nt, Mycobacterium avium subsp. paratuberculosis
gacggucugccgggac

SEQ ID NO: 2946788 - RNA, 22 nt, Mycobacterium avium subsp. paratuberculosis
gacggucugcggugugggcagc

SEQ ID NO: 2946789 - RNA, 19 nt, Mycobacterium avium subsp. paratuberculosis
gacggucugggaggcggcg

SEQ ID NO: 2946790 - RNA, 17 nt, Mycobacterium avium subsp. paratuberculosis
gacggucuucccgccgc

SEQ ID NO: 2946791 - RNA, 18 nt, Mycobacterium avium subsp. paratuberculosis
gacggucuucccgccgcc

SEQ ID NO: 2946792 - RNA, 22 nt, Mycobacterium avium subsp. paratuberculosis
gacggucuucccgccgccgucg

SEQ ID NO: 2946793 - RNA, 16 nt, Mycobacterium avium subsp. paratuberculosis
gacggucuugcggccg

SEQ ID NO: 2946794 - RNA, 19 nt, Mycobacterium avium subsp. paratuberculosis
gacggucuugcggccguca

SEQ ID NO: 2946795 - RNA, 23 nt, Mycobacterium avium subsp. paratuberculosis
gacggugaacuucaccgucugcu

SEQ ID NO: 2946796 - RNA, 16 nt, Mycobacterium avium subsp. paratuberculosis
gacggugaccggcgcg

SEQ ID NO: 2946797 - RNA, 17 nt, Mycobacterium avium subsp. paratuberculosis
gacggugaccggcucga

SEQ ID NO: 2946798 - RNA, 15 nt, Mycobacterium avium subsp. paratuberculosis
gacggugaccucguc

SEQ ID NO: 2946799 - RNA, 15 nt, Mycobacterium avium subsp. paratuberculosis
gacggugacgccgga

SEQ ID NO: 2946800 - RNA, 19 nt, Mycobacterium avium subsp. paratuberculosis
gacggugaggucgggcucg

SEQ ID NO: 2946801 - RNA, 17 nt, Mycobacterium avium subsp. paratuberculosis
gacggugaucagggucc

SEQ ID NO: 2946802 - RNA, 15 nt, Mycobacterium avium subsp. paratuberculosis
gacggugaugucgcc

SEQ ID NO: 2946803 - RNA, 19 nt, Mycobacterium avium subsp. paratuberculosis
gacggugaugucgccggcg

SEQ ID NO: 2946804 - RNA, 23 nt, Mycobacterium avium subsp. paratuberculosis
gacggugaugucgccggcggcga

SEQ ID NO: 2946805 - RNA, 13 nt, Mycobacterium avium subsp. paratuberculosis
gacggugcagccg

SEQ ID NO: 2946806 - RNA, 14 nt, Mycobacterium avium subsp. paratuberculosis
gacggugcagccgg

SEQ ID NO: 2946807 - RNA, 18 nt, Mycobacterium avium subsp. paratuberculosis
gacggugcaugcgcuggc

SEQ ID NO: 2946808 - RNA, 21 nt, Mycobacterium avium subsp. paratuberculosis
gacggugcaugcgcuggcgaa

SEQ ID NO: 2946809 - RNA, 13 nt, Mycobacterium avium subsp. paratuberculosis
gacggugccgccg

SEQ ID NO: 2946810 - RNA, 14 nt, Mycobacterium avium subsp. paratuberculosis
gacggugccgccgu

SEQ ID NO: 2946811 - RNA, 17 nt, Mycobacterium avium subsp. paratuberculosis
gacggugccgccgugcg

SEQ ID NO: 2946812 - RNA, 15 nt, Mycobacterium avium subsp. paratuberculosis
gacggugcgcccguc

SEQ ID NO: 2946813 - RNA, 23 nt, Mycobacterium avium subsp. paratuberculosis
gacggugcgcccgucgucgccga

SEQ ID NO: 2946814 - RNA, 17 nt, Mycobacterium avium subsp. paratuberculosis
gacgguggagcggccca

SEQ ID NO: 2946815 - RNA, 20 nt, Mycobacterium avium subsp. paratuberculosis
gacgguggcccccaccacga

SEQ ID NO: 2946816 - RNA, 22 nt, Mycobacterium avium subsp. paratuberculosis
gacgguggcccccaccacgaag

SEQ ID NO: 2946817 - RNA, 13 nt, Mycobacterium avium subsp. paratuberculosis
gacgguggccucg

SEQ ID NO: 2946818 - RNA, 16 nt, Mycobacterium avium subsp. paratuberculosis
gacgguggccucggcg

SEQ ID NO: 2946819 - RNA, 17 nt, Mycobacterium avium subsp. paratuberculosis
gacgguggccucggcgc

SEQ ID NO: 2946820 - RNA, 20 nt, Mycobacterium avium subsp. paratuberculosis
gacgguggcgaagcacgacc

SEQ ID NO: 2946821 - RNA, 14 nt, Mycobacterium avium subsp. paratuberculosis
gacgguggcggcga

SEQ ID NO: 2946822 - RNA, 23 nt, Mycobacterium avium subsp. paratuberculosis
gacgguggcggcgaugucgucga

SEQ ID NO: 2946823 - RNA, 14 nt, Mycobacterium avium subsp. paratuberculosis
gacgguggcgggcc

SEQ ID NO: 2946824 - RNA, 21 nt, Mycobacterium avium subsp. paratuberculosis
gacgguggcgggccgccgggu

SEQ ID NO: 2946825 - RNA, 19 nt, Mycobacterium avium subsp. paratuberculosis
gacgguggcguccucgacg

SEQ ID NO: 2946826 - RNA, 21 nt, Mycobacterium avium subsp. paratuberculosis
gacgguggcguccucgacggu

SEQ ID NO: 2946827 - RNA, 14 nt, Mycobacterium avium subsp. paratuberculosis
gacggugggcccgc

SEQ ID NO: 2946828 - RNA, 16 nt, Mycobacterium avium subsp. paratuberculosis
gacggugggcccgccg

SEQ ID NO: 2946829 - RNA, 23 nt, Mycobacterium avium subsp. paratuberculosis
gacggugggcccgccgucgacca

SEQ ID NO: 2946830 - RNA, 16 nt, Mycobacterium avium subsp. paratuberculosis
gacgguggggcuggcc

SEQ ID NO: 2946831 - RNA, 17 nt, Mycobacterium avium subsp. paratuberculosis
gacgguggggcuggccg

SEQ ID NO: 2946832 - RNA, 20 nt, Mycobacterium avium subsp. paratuberculosis
gacgguggggcuggccgcac

SEQ ID NO: 2946833 - RNA, 21 nt, Mycobacterium avium subsp. paratuberculosis
gacgguggggcuggccgcacg

SEQ ID NO: 2946834 - RNA, 14 nt, Mycobacterium avium subsp. paratuberculosis
gacggugguggccu

SEQ ID NO: 2946835 - RNA, 16 nt, Mycobacterium avium subsp. paratuberculosis
gacgguguaggacgcc

SEQ ID NO: 2946836 - RNA, 18 nt, Mycobacterium avium subsp. paratuberculosis
gacgguguccgcggcguc

SEQ ID NO: 2946837 - RNA, 20 nt, Mycobacterium avium subsp. paratuberculosis
gacgguguccgcggcgucgg

SEQ ID NO: 2946838 - RNA, 14 nt, Mycobacterium avium subsp. paratuberculosis
gacggugucgcccu

SEQ ID NO: 2946839 - RNA, 20 nt, Mycobacterium avium subsp. paratuberculosis
gacggugucguagacgacgu

SEQ ID NO: 2946840 - RNA, 23 nt, Mycobacterium avium subsp. paratuberculosis
gacggugucguagacgacgucga

SEQ ID NO: 2946841 - RNA, 14 nt, Mycobacterium avium subsp. paratuberculosis
gacggugugcgggu

SEQ ID NO: 2946842 - RNA, 19 nt, Mycobacterium avium subsp. paratuberculosis
gacgguugccucggccagc

SEQ ID NO: 2946843 - RNA, 16 nt, Mycobacterium avium subsp. paratuberculosis
gacgguuguucagccc

SEQ ID NO: 2946844 - RNA, 17 nt, Mycobacterium avium subsp. paratuberculosis
gacgguuguucagcccg

SEQ ID NO: 2946845 - RNA, 22 nt, Mycobacterium avium subsp. paratuberculosis
gacgguuguucagcccggucag

SEQ ID NO: 2946846 - RNA, 20 nt, Mycobacterium avium subsp. paratuberculosis
gacgguuucaccgccguccc

SEQ ID NO: 2946847 - RNA, 15 nt, Mycobacterium avium subsp. paratuberculosis
gacgguuucugccgg

SEQ ID NO: 2946848 - RNA, 17 nt, Mycobacterium avium subsp. paratuberculosis
gacgguuucugccggcc

SEQ ID NO: 2946849 - RNA, 18 nt, Mycobacterium avium subsp. paratuberculosis
gacgguuucugccggccg

SEQ ID NO: 2946850 - RNA, 21 nt, Mycobacterium avium subsp. paratuberculosis
gacgguuucugccggccgccg

SEQ ID NO: 2946851 - RNA, 17 nt, Mycobacterium avium subsp. paratuberculosis
gacgguuugcccggcga

SEQ ID NO: 2946852 - RNA, 15 nt, Mycobacterium avium subsp. paratuberculosis
gacgguuuuggucug

SEQ ID NO: 2946853 - RNA, 16 nt, Mycobacterium avium subsp. paratuberculosis
gacgguuuuggucugc

SEQ ID NO: 2946854 - RNA, 22 nt, Mycobacterium avium subsp. paratuberculosis
gacguaagccauggcggcccgc

SEQ ID NO: 2946855 - RNA, 23 nt, Mycobacterium avium subsp. paratuberculosis
gacguaagccauggcggcccgcg

SEQ ID NO: 2946856 - RNA, 20 nt, Mycobacterium avium subsp. paratuberculosis
gacguacagcgagccgucga

SEQ ID NO: 2946857 - RNA, 17 nt, Mycobacterium avium subsp. paratuberculosis
gacguacccccgcacgc

SEQ ID NO: 2946858 - RNA, 22 nt, Mycobacterium avium subsp. paratuberculosis
gacguacccccgcacgccagca

SEQ ID NO: 2946859 - RNA, 23 nt, Mycobacterium avium subsp. paratuberculosis
gacguagcaccagucggccauca

SEQ ID NO: 2946860 - RNA, 14 nt, Mycobacterium avium subsp. paratuberculosis
gacguagcccgccg

SEQ ID NO: 2946861 - RNA, 14 nt, Mycobacterium avium subsp. paratuberculosis
gacguaggacagca

SEQ ID NO: 2946862 - RNA, 17 nt, Mycobacterium avium subsp. paratuberculosis
gacguaggacagcacca

SEQ ID NO: 2946863 - RNA, 17 nt, Mycobacterium avium subsp. paratuberculosis
gacguaggcggccagca

SEQ ID NO: 2946864 - RNA, 18 nt, Mycobacterium avium subsp. paratuberculosis
gacguaguccggccaguc

SEQ ID NO: 2946865 - RNA, 14 nt, Mycobacterium avium subsp. paratuberculosis
gacguagucgcgca

SEQ ID NO: 2946866 - RNA, 17 nt, Mycobacterium avium subsp. paratuberculosis
gacguagucgcgcacca

SEQ ID NO: 2946867 - RNA, 17 nt, Mycobacterium avium subsp. paratuberculosis
gacguagucgcugagcg

SEQ ID NO: 2946868 - RNA, 21 nt, Mycobacterium avium subsp. paratuberculosis
gacguagugcagccgcccguc

SEQ ID NO: 2946869 - RNA, 20 nt, Mycobacterium avium subsp. paratuberculosis
gacgucaacaccguggugga

SEQ ID NO: 2946870 - RNA, 13 nt, Mycobacterium avium subsp. paratuberculosis
gacgucaccaccg

SEQ ID NO: 2946871 - RNA, 15 nt, Mycobacterium avium subsp. paratuberculosis
gacgucacgacgguc

SEQ ID NO: 2946872 - RNA, 21 nt, Mycobacterium avium subsp. paratuberculosis
gacgucacgacggucacggcc

SEQ ID NO: 2946873 - RNA, 17 nt, Mycobacterium avium subsp. paratuberculosis
gacgucagcccgcgucg

SEQ ID NO: 2946874 - RNA, 18 nt, Mycobacterium avium subsp. paratuberculosis
gacgucagcccgcgucgc

SEQ ID NO: 2946875 - RNA, 18 nt, Mycobacterium avium subsp. paratuberculosis
gacgucagcucccccgac

SEQ ID NO: 2946876 - RNA, 15 nt, Mycobacterium avium subsp. paratuberculosis
gacgucaggccgguc

SEQ ID NO: 2946877 - RNA, 17 nt, Mycobacterium avium subsp. paratuberculosis
gacgucaggccggucag

SEQ ID NO: 2946878 - RNA, 20 nt, Mycobacterium avium subsp. paratuberculosis
gacgucgucgaugccgaucg

SEQ ID NO: 2946879 - RNA, 14 nt, Mycobacterium avium subsp. paratuberculosis
gacgucgucgccca

SEQ ID NO: 2946880 - RNA, 17 nt, Mycobacterium avium subsp. paratuberculosis
gacgucgucgcccaccc

SEQ ID NO: 2946881 - RNA, 17 nt, Mycobacterium avium subsp. paratuberculosis
gacgucgucgcggcgcu

SEQ ID NO: 2946882 - RNA, 22 nt, Mycobacterium avium subsp. paratuberculosis
gacgucgucgcggcgcugccgg

SEQ ID NO: 2946883 - RNA, 15 nt, Mycobacterium avium subsp. paratuberculosis
gacgucgugcacgcc

SEQ ID NO: 2946884 - RNA, 21 nt, Mycobacterium avium subsp. paratuberculosis
gacgucguggcccggauggcc

SEQ ID NO: 2946885 - RNA, 16 nt, Mycobacterium avium subsp. paratuberculosis
gacgucgugggcgauc

SEQ ID NO: 2946886 - RNA, 19 nt, Mycobacterium avium subsp. paratuberculosis
gacgucguuuuccagccgg

SEQ ID NO: 2946887 - RNA, 14 nt, Mycobacterium avium subsp. paratuberculosis
gacgucugcggcuc

SEQ ID NO: 2946888 - RNA, 19 nt, Mycobacterium avium subsp. paratuberculosis
gacgucugcggcucggcgc

SEQ ID NO: 2946889 - RNA, 14 nt, Mycobacterium avium subsp. paratuberculosis
gacgucugggccgc

SEQ ID NO: 2946890 - RNA, 15 nt, Mycobacterium avium subsp. paratuberculosis
gacgucugggccgcc

SEQ ID NO: 2946891 - RNA, 16 nt, Mycobacterium avium subsp. paratuberculosis
gacgucugggccgccg

SEQ ID NO: 2946892 - RNA, 19 nt, Mycobacterium avium subsp. paratuberculosis
gacgucugggccgccgagc

SEQ ID NO: 2946893 - RNA, 19 nt, Mycobacterium avium subsp. paratuberculosis
gacgucugguuggccggcg

SEQ ID NO: 2946894 - RNA, 20 nt, Mycobacterium avium subsp. paratuberculosis
gacgucugguuggccggcgg

SEQ ID NO: 2946895 - RNA, 21 nt, Mycobacterium avium subsp. paratuberculosis
gacgucugguuggccggcggg

SEQ ID NO: 2946896 - RNA, 20 nt, Mycobacterium avium subsp. paratuberculosis
gacgugaaaucccccgaccc

SEQ ID NO: 2946897 - RNA, 21 nt, Mycobacterium avium subsp. paratuberculosis
gacgugaaaucccccgacccg

SEQ ID NO: 2946898 - RNA, 22 nt, Mycobacterium avium subsp. paratuberculosis
gacgugacgaccuggucgccgc

SEQ ID NO: 2946899 - RNA, 21 nt, Mycobacterium avium subsp. paratuberculosis
gacgugacgugccccucgacc

SEQ ID NO: 2946900 - RNA, 20 nt, Mycobacterium avium subsp. paratuberculosis
gacgugauaucccuugccgc

SEQ ID NO: 2946901 - RNA, 17 nt, Mycobacterium avium subsp. paratuberculosis
gacgugaucgcgguggc

SEQ ID NO: 2946902 - RNA, 19 nt, Mycobacterium avium subsp. paratuberculosis
gacgugaucgcgguggccg

SEQ ID NO: 2946903 - RNA, 21 nt, Mycobacterium avium subsp. paratuberculosis
gacgugaucgcgguggccgua

SEQ ID NO: 2946904 - RNA, 16 nt, Mycobacterium avium subsp. paratuberculosis
gacgugaucuggucgg

SEQ ID NO: 2946905 - RNA, 21 nt, Mycobacterium avium subsp. paratuberculosis
gacgugaucuggucggccagc

SEQ ID NO: 2946906 - RNA, 14 nt, Mycobacterium avium subsp. paratuberculosis
gacgugcaccaccg

SEQ ID NO: 2946907 - RNA, 15 nt, Mycobacterium avium subsp. paratuberculosis
gacgugcaccaccgc

SEQ ID NO: 2946908 - RNA, 13 nt, Mycobacterium avium subsp. paratuberculosis
gacgugcaccggc

SEQ ID NO: 2946909 - RNA, 14 nt, Mycobacterium avium subsp. paratuberculosis
gacgugcaccggcg

SEQ ID NO: 2946910 - RNA, 14 nt, Mycobacterium avium subsp. paratuberculosis
gacgugcaccugca

SEQ ID NO: 2946911 - RNA, 17 nt, Mycobacterium avium subsp. paratuberculosis
gacgugcaccugcagcc

SEQ ID NO: 2946912 - RNA, 16 nt, Mycobacterium avium subsp. paratuberculosis
gacgugcacgcguucg

SEQ ID NO: 2946913 - RNA, 12 nt, Mycobacterium avium subsp. paratuberculosis
gacgugcagcgc

SEQ ID NO: 2946914 - RNA, 17 nt, Mycobacterium avium subsp. paratuberculosis
gacgugcagcgccagca

SEQ ID NO: 2946915 - RNA, 13 nt, Mycobacterium avium subsp. paratuberculosis
gacgugcccuucc

SEQ ID NO: 2946916 - RNA, 18 nt, Mycobacterium avium subsp. paratuberculosis
gacgugcccuuccccggc

SEQ ID NO: 2946917 - RNA, 22 nt, Mycobacterium avium subsp. paratuberculosis
gacgugcccuuccccggcggcc

SEQ ID NO: 2946918 - RNA, 23 nt, Mycobacterium avium subsp. paratuberculosis
gacgugcccuuccccggcggccg

SEQ ID NO: 2946919 - RNA, 13 nt, Mycobacterium avium subsp. paratuberculosis
gacgugccggcgg

SEQ ID NO: 2946920 - RNA, 17 nt, Mycobacterium avium subsp. paratuberculosis
gacgugcgacaccggcg

SEQ ID NO: 2946921 - RNA, 12 nt, Mycobacterium avium subsp. paratuberculosis
gacgugcgcggc

SEQ ID NO: 2946922 - RNA, 13 nt, Mycobacterium avium subsp. paratuberculosis
gacgugcgcggcg

SEQ ID NO: 2946923 - RNA, 13 nt, Mycobacterium avium subsp. paratuberculosis
gacgugcucggcg

SEQ ID NO: 2946924 - RNA, 19 nt, Mycobacterium avium subsp. paratuberculosis
gacgugcucggcggccgcc

SEQ ID NO: 2946925 - RNA, 19 nt, Mycobacterium avium subsp. paratuberculosis
gacgugcuuggccagcucg

SEQ ID NO: 2946926 - RNA, 20 nt, Mycobacterium avium subsp. paratuberculosis
gacgugcuuggccagcucgg

SEQ ID NO: 2946927 - RNA, 20 nt, Mycobacterium avium subsp. paratuberculosis
gacguggaaauugcugacca

SEQ ID NO: 2946928 - RNA, 17 nt, Mycobacterium avium subsp. paratuberculosis
gacguggagucgaagcg

SEQ ID NO: 2946929 - RNA, 18 nt, Mycobacterium avium subsp. paratuberculosis
gacguggagucgaagcgg

SEQ ID NO: 2946930 - RNA, 22 nt, Mycobacterium avium subsp. paratuberculosis
gacguggaucucgaacggcccg

SEQ ID NO: 2946931 - RNA, 16 nt, Mycobacterium avium subsp. paratuberculosis
gacguggcaacgugcc

SEQ ID NO: 2946932 - RNA, 15 nt, Mycobacterium avium subsp. paratuberculosis
gacguggcggccguc

SEQ ID NO: 2946933 - RNA, 17 nt, Mycobacterium avium subsp. paratuberculosis
gacguggcggccgucgc

SEQ ID NO: 2946934 - RNA, 13 nt, Mycobacterium avium subsp. paratuberculosis
gacguggcggcgg

SEQ ID NO: 2946935 - RNA, 14 nt, Mycobacterium avium subsp. paratuberculosis
gacguggcggcggu

SEQ ID NO: 2946936 - RNA, 15 nt, Mycobacterium avium subsp. paratuberculosis
gacguggcggcggug

SEQ ID NO: 2946937 - RNA, 13 nt, Mycobacterium avium subsp. paratuberculosis
gacguggcucagc

SEQ ID NO: 2946938 - RNA, 14 nt, Mycobacterium avium subsp. paratuberculosis
gacguggguggugg

SEQ ID NO: 2946939 - RNA, 15 nt, Mycobacterium avium subsp. paratuberculosis
gacgugggugguggu

SEQ ID NO: 2946940 - RNA, 23 nt, Mycobacterium avium subsp. paratuberculosis
gacguggugcaccgccagcgcgg

SEQ ID NO: 2946941 - RNA, 24 nt, Mycobacterium avium subsp. paratuberculosis
gacguggugcaccgccagcgcggc

SEQ ID NO: 2946942 - RNA, 21 nt, Mycobacterium avium subsp. paratuberculosis
gacgugguggaugaugccggc

SEQ ID NO: 2946943 - RNA, 16 nt, Mycobacterium avium subsp. paratuberculosis
gacgugguugcguucg

SEQ ID NO: 2946944 - RNA, 17 nt, Mycobacterium avium subsp. paratuberculosis
gacgugguugcguucgc

SEQ ID NO: 2946945 - RNA, 16 nt, Mycobacterium avium subsp. paratuberculosis
gacguguggcacccgg

SEQ ID NO: 2946946 - RNA, 18 nt, Mycobacterium avium subsp. paratuberculosis
gacguguggcacccgggu

SEQ ID NO: 2946947 - RNA, 19 nt, Mycobacterium avium subsp. paratuberculosis
gacguguucaacgcgccga

SEQ ID NO: 2946948 - RNA, 16 nt, Mycobacterium avium subsp. paratuberculosis
gacguucgagucggcc

SEQ ID NO: 2946949 - RNA, 16 nt, Mycobacterium avium subsp. paratuberculosis
gacguucgccgccagc

SEQ ID NO: 2946950 - RNA, 18 nt, Mycobacterium avium subsp. paratuberculosis
gacguucgccgccagcac

SEQ ID NO: 2946951 - RNA, 13 nt, Mycobacterium avium subsp. paratuberculosis
gacguucggccaa

SEQ ID NO: 2946952 - RNA, 14 nt, Mycobacterium avium subsp. paratuberculosis
gacguugaccgcga

SEQ ID NO: 2946953 - RNA, 16 nt, Mycobacterium avium subsp. paratuberculosis
gacguugagcacccgg

SEQ ID NO: 2946954 - RNA, 15 nt, Mycobacterium avium subsp. paratuberculosis
gacguugaggcggcg

SEQ ID NO: 2946955 - RNA, 16 nt, Mycobacterium avium subsp. paratuberculosis
gacguugaggcggcgg

SEQ ID NO: 2946956 - RNA, 17 nt, Mycobacterium avium subsp. paratuberculosis
gacguugaugucgucca

SEQ ID NO: 2946957 - RNA, 13 nt, Mycobacterium avium subsp. paratuberculosis
gacguugccgauc

SEQ ID NO: 2946958 - RNA, 22 nt, Mycobacterium avium subsp. paratuberculosis
gacguugccgaucccggccagc

SEQ ID NO: 2946959 - RNA, 13 nt, Mycobacterium avium subsp. paratuberculosis
gacguugccgcac

SEQ ID NO: 2946960 - RNA, 15 nt, Mycobacterium avium subsp. paratuberculosis
gacguugccgcacac

SEQ ID NO: 2946961 - RNA, 12 nt, Mycobacterium avium subsp. paratuberculosis
gacguuggagaa

SEQ ID NO: 2946962 - RNA, 16 nt, Mycobacterium avium subsp. paratuberculosis
gacguuggccagcacc

SEQ ID NO: 2946963 - RNA, 16 nt, Mycobacterium avium subsp. paratuberculosis
gacugcgcaccgccag

SEQ ID NO: 2946964 - RNA, 17 nt, Mycobacterium avium subsp. paratuberculosis
gacugcgcaccgccagc

SEQ ID NO: 2946965 - RNA, 19 nt, Mycobacterium avium subsp. paratuberculosis
gacugcgcaccgccagcac

SEQ ID NO: 2946966 - RNA, 20 nt, Mycobacterium avium subsp. paratuberculosis
gacugcgcaccgccagcacc

SEQ ID NO: 2946967 - RNA, 11 nt, Mycobacterium avium subsp. paratuberculosis
gacugcgccgg

SEQ ID NO: 2946968 - RNA, 12 nt, Mycobacterium avium subsp. paratuberculosis
gacugcgccggg

SEQ ID NO: 2946969 - RNA, 14 nt, Mycobacterium avium subsp. paratuberculosis
gacugcgccggggc

SEQ ID NO: 2946970 - RNA, 16 nt, Mycobacterium avium subsp. paratuberculosis
gacugcgcggccggcg

SEQ ID NO: 2946971 - RNA, 19 nt, Mycobacterium avium subsp. paratuberculosis
gacugcgcggccggcgugu

SEQ ID NO: 2946972 - RNA, 14 nt, Mycobacterium avium subsp. paratuberculosis
gacugcuugggcgc

SEQ ID NO: 2946973 - RNA, 23 nt, Mycobacterium avium subsp. paratuberculosis
gacugcuugggcgccucgccgac

SEQ ID NO: 2946974 - RNA, 18 nt, Mycobacterium avium subsp. paratuberculosis
gacuggaccgugccggaa

SEQ ID NO: 2946975 - RNA, 14 nt, Mycobacterium avium subsp. paratuberculosis
gacuggaucaucga

SEQ ID NO: 2946976 - RNA, 14 nt, Mycobacterium avium subsp. paratuberculosis
gacuggccaccgcg

SEQ ID NO: 2946977 - RNA, 19 nt, Mycobacterium avium subsp. paratuberculosis
gacuggccaccgcgaucuc

SEQ ID NO: 2946978 - RNA, 19 nt, Mycobacterium avium subsp. paratuberculosis
gacuggcccacgcagccgu

SEQ ID NO: 2946979 - RNA, 21 nt, Mycobacterium avium subsp. paratuberculosis
gacuggcccacgcagccgucg

SEQ ID NO: 2946980 - RNA, 22 nt, Mycobacterium avium subsp. paratuberculosis
gacuggcccacgcagccgucga

SEQ ID NO: 2946981 - RNA, 14 nt, Mycobacterium avium subsp. paratuberculosis
gacuggcggcggcg

SEQ ID NO: 2946982 - RNA, 21 nt, Mycobacterium avium subsp. paratuberculosis
gacuggcggcggcgguccccg

SEQ ID NO: 2946983 - RNA, 21 nt, Mycobacterium avium subsp. paratuberculosis
gacuggcugagcagcacccga

SEQ ID NO: 2946984 - RNA, 17 nt, Mycobacterium avium subsp. paratuberculosis
gacugggccaggucgcu

SEQ ID NO: 2946985 - RNA, 14 nt, Mycobacterium avium subsp. paratuberculosis
gacugggcgauugc

SEQ ID NO: 2946986 - RNA, 21 nt, Mycobacterium avium subsp. paratuberculosis
gacugggcgccgccggcgucg

SEQ ID NO: 2946987 - RNA, 22 nt, Mycobacterium avium subsp. paratuberculosis
gacugggucaccgucacgucgu

SEQ ID NO: 2946988 - RNA, 13 nt, Mycobacterium avium subsp. paratuberculosis
gacugggugcgcg

SEQ ID NO: 2946989 - RNA, 19 nt, Mycobacterium avium subsp. paratuberculosis
gacuggugauagaucaucc

SEQ ID NO: 2946990 - RNA, 19 nt, Mycobacterium avium subsp. paratuberculosis
gacuggugggcgucguggu

SEQ ID NO: 2946991 - RNA, 20 nt, Mycobacterium avium subsp. paratuberculosis
gacuggugggcgucgugguc

SEQ ID NO: 2946992 - RNA, 15 nt, Mycobacterium avium subsp. paratuberculosis
gacugucggcgcccc

SEQ ID NO: 2946993 - RNA, 20 nt, Mycobacterium avium subsp. paratuberculosis
gacugugaauuccgacgugc

SEQ ID NO: 2946994 - RNA, 20 nt, Mycobacterium avium subsp. paratuberculosis
gacuguuugaugccgucggu

SEQ ID NO: 2946995 - RNA, 23 nt, Mycobacterium avium subsp. paratuberculosis
gacuguuugaugccgucgguggu

SEQ ID NO: 2946996 - RNA, 15 nt, Mycobacterium avium subsp. paratuberculosis
gacuucacaggccgc

SEQ ID NO: 2946997 - RNA, 13 nt, Mycobacterium avium subsp. paratuberculosis
gacuucauggcga

SEQ ID NO: 2946998 - RNA, 19 nt, Mycobacterium avium subsp. paratuberculosis
gacuuccacuuacgcgagc

SEQ ID NO: 2946999 - RNA, 20 nt, Mycobacterium avium subsp. paratuberculosis
gacuucccaguccggccagc

SEQ ID NO: 2947000 - RNA, 14 nt, Mycobacterium avium subsp. paratuberculosis
gacuucgcgugccg

SEQ ID NO: 2947001 - RNA, 15 nt, Mycobacterium avium subsp. paratuberculosis
gacuucgcgugccgc

SEQ ID NO: 2947002 - RNA, 17 nt, Mycobacterium avium subsp. paratuberculosis
gacuucggaggucagca

SEQ ID NO: 2947003 - RNA, 15 nt, Mycobacterium avium subsp. paratuberculosis
gacuucggcucggcg

SEQ ID NO: 2947004 - RNA, 17 nt, Mycobacterium avium subsp. paratuberculosis
gacuucggcucggcgac

SEQ ID NO: 2947005 - RNA, 16 nt, Mycobacterium avium subsp. paratuberculosis
gacuucguuggugguc

SEQ ID NO: 2947006 - RNA, 17 nt, Mycobacterium avium subsp. paratuberculosis
gacuucuucagcuugac

SEQ ID NO: 2947007 - RNA, 16 nt, Mycobacterium avium subsp. paratuberculosis
gacuugaccagcagcu

SEQ ID NO: 2947008 - RNA, 22 nt, Mycobacterium avium subsp. paratuberculosis
gacuugcgcgccgugacgccga

SEQ ID NO: 2947009 - RNA, 16 nt, Mycobacterium avium subsp. paratuberculosis
gacuuggucagcccgc

SEQ ID NO: 2947010 - RNA, 16 nt, Mycobacterium avium subsp. paratuberculosis
gacuugguggccagca

SEQ ID NO: 2947011 - RNA, 18 nt, Mycobacterium avium subsp. paratuberculosis
gagaaaauccagaacagc

SEQ ID NO: 2947012 - RNA, 19 nt, Mycobacterium avium subsp. paratuberculosis
gagaaaggccagcacgcag

SEQ ID NO: 2947013 - RNA, 12 nt, Mycobacterium avium subsp. paratuberculosis
gagaacaggccg

SEQ ID NO: 2947014 - RNA, 22 nt, Mycobacterium avium subsp. paratuberculosis
gagaacaggccgagcgcgcugg

SEQ ID NO: 2947015 - RNA, 20 nt, Mycobacterium avium subsp. paratuberculosis
gagaacagguaggacaccga

SEQ ID NO: 2947016 - RNA, 13 nt, Mycobacterium avium subsp. paratuberculosis
gagaacaucagcc

SEQ ID NO: 2947017 - RNA, 18 nt, Mycobacterium avium subsp. paratuberculosis
gagaacauuucgucgaag

SEQ ID NO: 2947018 - RNA, 15 nt, Mycobacterium avium subsp. paratuberculosis
gagaaccggcgcaga

SEQ ID NO: 2947019 - RNA, 15 nt, Mycobacterium avium subsp. paratuberculosis
gagaacgucaggccc

SEQ ID NO: 2947020 - RNA, 23 nt, Mycobacterium avium subsp. paratuberculosis
gagaacgucaggcccagcgaggc

SEQ ID NO: 2947021 - RNA, 15 nt, Mycobacterium avium subsp. paratuberculosis
gagaacgucgcgucc

SEQ ID NO: 2947022 - RNA, 12 nt, Mycobacterium avium subsp. paratuberculosis
gagaaggccgcg

SEQ ID NO: 2947023 - RNA, 14 nt, Mycobacterium avium subsp. paratuberculosis
gagaaggccgcgcg

SEQ ID NO: 2947024 - RNA, 23 nt, Mycobacterium avium subsp. paratuberculosis
gagaaggugucgcacugcuucgg

SEQ ID NO: 2947025 - RNA, 21 nt, Mycobacterium avium subsp. paratuberculosis
gagaaguccuuguggcccagg

SEQ ID NO: 2947026 - RNA, 15 nt, Mycobacterium avium subsp. paratuberculosis
gagacacgcgccggc

SEQ ID NO: 2947027 - RNA, 19 nt, Mycobacterium avium subsp. paratuberculosis
gagaccaggucggccuuca

SEQ ID NO: 2947028 - RNA, 15 nt, Mycobacterium avium subsp. paratuberculosis
gagaccaugccgccg

SEQ ID NO: 2947029 - RNA, 17 nt, Mycobacterium avium subsp. paratuberculosis
gagaccaugucggccag

SEQ ID NO: 2947030 - RNA, 20 nt, Mycobacterium avium subsp. paratuberculosis
gagacccgcccggagaacuc

SEQ ID NO: 2947031 - RNA, 20 nt, Mycobacterium avium subsp. paratuberculosis
gagaccgucggugcggggcg

SEQ ID NO: 2947032 - RNA, 22 nt, Mycobacterium avium subsp. paratuberculosis
gagaccgucggugcggggcggg

SEQ ID NO: 2947033 - RNA, 21 nt, Mycobacterium avium subsp. paratuberculosis
gagaccucccggcgccacgcc

SEQ ID NO: 2947034 - RNA, 13 nt, Mycobacterium avium subsp. paratuberculosis
gagaccuccugcu

SEQ ID NO: 2947035 - RNA, 13 nt, Mycobacterium avium subsp. paratuberculosis
gagaccuuggcgc

SEQ ID NO: 2947036 - RNA, 20 nt, Mycobacterium avium subsp. paratuberculosis
gagacgaccaggaugcccag

SEQ ID NO: 2947037 - RNA, 22 nt, Mycobacterium avium subsp. paratuberculosis
gagacgaccaggaugcccagga

SEQ ID NO: 2947038 - RNA, 15 nt, Mycobacterium avium subsp. paratuberculosis
gagacgacccaacgu

SEQ ID NO: 2947039 - RNA, 13 nt, Mycobacterium avium subsp. paratuberculosis
gagacgacgccac

SEQ ID NO: 2947040 - RNA, 14 nt, Mycobacterium avium subsp. paratuberculosis
gagacgacgccacc

SEQ ID NO: 2947041 - RNA, 15 nt, Mycobacterium avium subsp. paratuberculosis
gagacgacucuucca

SEQ ID NO: 2947042 - RNA, 21 nt, Mycobacterium avium subsp. paratuberculosis
gagacgagccgccgcgggucg

SEQ ID NO: 2947043 - RNA, 18 nt, Mycobacterium avium subsp. paratuberculosis
gagacgaucucgccgucc

SEQ ID NO: 2947044 - RNA, 14 nt, Mycobacterium avium subsp. paratuberculosis
gagacggccagcag

SEQ ID NO: 2947045 - RNA, 15 nt, Mycobacterium avium subsp. paratuberculosis
gagacggccagcagc

SEQ ID NO: 2947046 - RNA, 16 nt, Mycobacterium avium subsp. paratuberculosis
gagacggccagcagca

SEQ ID NO: 2947047 - RNA, 19 nt, Mycobacterium avium subsp. paratuberculosis
gagacggccagcagcaccg

SEQ ID NO: 2947048 - RNA, 14 nt, Mycobacterium avium subsp. paratuberculosis
gagcacagcggcgg

SEQ ID NO: 2947049 - RNA, 15 nt, Mycobacterium avium subsp. paratuberculosis
gagcacagcggcgga

SEQ ID NO: 2947050 - RNA, 11 nt, Mycobacterium avium subsp. paratuberculosis
gagcaccacca

SEQ ID NO: 2947051 - RNA, 12 nt, Mycobacterium avium subsp. paratuberculosis
gagcaccacgag

SEQ ID NO: 2947052 - RNA, 18 nt, Mycobacterium avium subsp. paratuberculosis
gagcaccacggcccgcgc

SEQ ID NO: 2947053 - RNA, 20 nt, Mycobacterium avium subsp. paratuberculosis
gagcaccacggcccgcgccc

SEQ ID NO: 2947054 - RNA, 14 nt, Mycobacterium avium subsp. paratuberculosis
gagcaccagcccgg

SEQ ID NO: 2947055 - RNA, 19 nt, Mycobacterium avium subsp. paratuberculosis
gagcaccagcccggccagc

SEQ ID NO: 2947056 - RNA, 11 nt, Mycobacterium avium subsp. paratuberculosis
gagcaccagcg

SEQ ID NO: 2947057 - RNA, 21 nt, Mycobacterium avium subsp. paratuberculosis
gagcaccagcgucgacgcggu

SEQ ID NO: 2947058 - RNA, 17 nt, Mycobacterium avium subsp. paratuberculosis
gagcaccaggcgcacca

SEQ ID NO: 2947059 - RNA, 12 nt, Mycobacterium avium subsp. paratuberculosis
gagcacccagaa

SEQ ID NO: 2947060 - RNA, 20 nt, Mycobacterium avium subsp. paratuberculosis
gagcacccagaaacaccauc

SEQ ID NO: 2947061 - RNA, 21 nt, Mycobacterium avium subsp. paratuberculosis
gagcacccagaaacaccaucg

SEQ ID NO: 2947062 - RNA, 22 nt, Mycobacterium avium subsp. paratuberculosis
gagcaccccggcggccgcgucg

SEQ ID NO: 2947063 - RNA, 20 nt, Mycobacterium avium subsp. paratuberculosis
gagcaccccgucgagcagcc

SEQ ID NO: 2947064 - RNA, 23 nt, Mycobacterium avium subsp. paratuberculosis
gagcaccccgucgagcagccgca

SEQ ID NO: 2947065 - RNA, 22 nt, Mycobacterium avium subsp. paratuberculosis
gagcacccgcagcucgccgagc

SEQ ID NO: 2947066 - RNA, 15 nt, Mycobacterium avium subsp. paratuberculosis
gagcacccgcccgga

SEQ ID NO: 2947067 - RNA, 18 nt, Mycobacterium avium subsp. paratuberculosis
gagcacccgcccggacgc

SEQ ID NO: 2947068 - RNA, 23 nt, Mycobacterium avium subsp. paratuberculosis
gagcacccggauggucugcagcg

SEQ ID NO: 2947069 - RNA, 17 nt, Mycobacterium avium subsp. paratuberculosis
gagcaccgaaaccuuga

SEQ ID NO: 2947070 - RNA, 22 nt, Mycobacterium avium subsp. paratuberculosis
gagcaccgcauaggaccggaug

SEQ ID NO: 2947071 - RNA, 14 nt, Mycobacterium avium subsp. paratuberculosis
gagcaccgccgucc

SEQ ID NO: 2947072 - RNA, 21 nt, Mycobacterium avium subsp. paratuberculosis
gagcaccgccgucccgucacg

SEQ ID NO: 2947073 - RNA, 19 nt, Mycobacterium avium subsp. paratuberculosis
gagcaccgcgaccagcucg

SEQ ID NO: 2947074 - RNA, 20 nt, Mycobacterium avium subsp. paratuberculosis
gagcaccgcgaccagcucgg

SEQ ID NO: 2947075 - RNA, 22 nt, Mycobacterium avium subsp. paratuberculosis
gagcaccgcgaccagcucgggc

SEQ ID NO: 2947076 - RNA, 19 nt, Mycobacterium avium subsp. paratuberculosis
gagcaccgcgaucgccgac

SEQ ID NO: 2947077 - RNA, 13 nt, Mycobacterium avium subsp. paratuberculosis
gagcaccgcgcuc

SEQ ID NO: 2947078 - RNA, 21 nt, Mycobacterium avium subsp. paratuberculosis
gagcaccgcgcucaccgcggg

SEQ ID NO: 2947079 - RNA, 20 nt, Mycobacterium avium subsp. paratuberculosis
gagcaccgcguccgcgucgu

SEQ ID NO: 2947080 - RNA, 14 nt, Mycobacterium avium subsp. paratuberculosis
gagcaccggcagcc

SEQ ID NO: 2947081 - RNA, 17 nt, Mycobacterium avium subsp. paratuberculosis
gagcaccggcagccgca

SEQ ID NO: 2947082 - RNA, 18 nt, Mycobacterium avium subsp. paratuberculosis
gagcaccggcagccgcag

SEQ ID NO: 2947083 - RNA, 13 nt, Mycobacterium avium subsp. paratuberculosis
gagcaccggcggc

SEQ ID NO: 2947084 - RNA, 23 nt, Mycobacterium avium subsp. paratuberculosis
gagcaccggcuggugcagcagcu

SEQ ID NO: 2947085 - RNA, 18 nt, Mycobacterium avium subsp. paratuberculosis
gagcaccgggaacagcca

SEQ ID NO: 2947086 - RNA, 20 nt, Mycobacterium avium subsp. paratuberculosis
gagcaccgggaacagccagg

SEQ ID NO: 2947087 - RNA, 13 nt, Mycobacterium avium subsp. paratuberculosis
gagcaccgggccg

SEQ ID NO: 2947088 - RNA, 15 nt, Mycobacterium avium subsp. paratuberculosis
gagcaccgggccgaa

SEQ ID NO: 2947089 - RNA, 13 nt, Mycobacterium avium subsp. paratuberculosis
gagcaccgggcgu

SEQ ID NO: 2947090 - RNA, 13 nt, Mycobacterium avium subsp. paratuberculosis
gagcaccgugccg

SEQ ID NO: 2947091 - RNA, 22 nt, Mycobacterium avium subsp. paratuberculosis
gagcaccguugugacccgcucg

SEQ ID NO: 2947092 - RNA, 14 nt, Mycobacterium avium subsp. paratuberculosis
gagcaccucgucgc

SEQ ID NO: 2947093 - RNA, 13 nt, Mycobacterium avium subsp. paratuberculosis
gagcaccugcgcg

SEQ ID NO: 2947094 - RNA, 14 nt, Mycobacterium avium subsp. paratuberculosis
gagcaccugcgcga

SEQ ID NO: 2947095 - RNA, 18 nt, Mycobacterium avium subsp. paratuberculosis
gagcacgaacgcggccgc

SEQ ID NO: 2947096 - RNA, 19 nt, Mycobacterium avium subsp. paratuberculosis
gagcacgaacgcggccgcc

SEQ ID NO: 2947097 - RNA, 20 nt, Mycobacterium avium subsp. paratuberculosis
gagcacgaaguacagcguca

SEQ ID NO: 2947098 - RNA, 18 nt, Mycobacterium avium subsp. paratuberculosis
gagcacgaccgccagcag

SEQ ID NO: 2947099 - RNA, 20 nt, Mycobacterium avium subsp. paratuberculosis
gagcacgcagccgcgcccga

SEQ ID NO: 2947100 - RNA, 14 nt, Mycobacterium avium subsp. paratuberculosis
gagcacgcccgcga

SEQ ID NO: 2947101 - RNA, 23 nt, Mycobacterium avium subsp. paratuberculosis
gagcacgcccgcgaucggcgcca

SEQ ID NO: 2947102 - RNA, 12 nt, Mycobacterium avium subsp. paratuberculosis
gagcacgccgcc

SEQ ID NO: 2947103 - RNA, 14 nt, Mycobacterium avium subsp. paratuberculosis
gagcacgcggccgc

SEQ ID NO: 2947104 - RNA, 16 nt, Mycobacterium avium subsp. paratuberculosis
gagcacgcggccgcgc

SEQ ID NO: 2947105 - RNA, 22 nt, Mycobacterium avium subsp. paratuberculosis
gagcacgcggccgcgccggccg

SEQ ID NO: 2947106 - RNA, 22 nt, Mycobacterium avium subsp. paratuberculosis
gagcacgggaugaucggcgccu

SEQ ID NO: 2947107 - RNA, 13 nt, Mycobacterium avium subsp. paratuberculosis
gagcacggugaac

SEQ ID NO: 2947108 - RNA, 19 nt, Mycobacterium avium subsp. paratuberculosis
gagcacggugggcgccggg

SEQ ID NO: 2947109 - RNA, 22 nt, Mycobacterium avium subsp. paratuberculosis
gagcacggugggcgccggguca

SEQ ID NO: 2947110 - RNA, 15 nt, Mycobacterium avium subsp. paratuberculosis
gagcacgucgacgcc

SEQ ID NO: 2947111 - RNA, 17 nt, Mycobacterium avium subsp. paratuberculosis
gagcacucgauggcggc

SEQ ID NO: 2947112 - RNA, 18 nt, Mycobacterium avium subsp. paratuberculosis
gagcacucgcgggacggc

SEQ ID NO: 2947113 - RNA, 21 nt, Mycobacterium avium subsp. paratuberculosis
gagcacucgcgggacggcggc

SEQ ID NO: 2947114 - RNA, 22 nt, Mycobacterium avium subsp. paratuberculosis
gagcacucgcgggacggcggcg

SEQ ID NO: 2947115 - RNA, 18 nt, Mycobacterium avium subsp. paratuberculosis
gagcagacacaaaagcac

SEQ ID NO: 2947116 - RNA, 19 nt, Mycobacterium avium subsp. paratuberculosis
gagcagacacaaaagcacc

SEQ ID NO: 2947117 - RNA, 18 nt, Mycobacterium avium subsp. paratuberculosis
gagcagacacaaaagcgc

SEQ ID NO: 2947118 - RNA, 21 nt, Mycobacterium avium subsp. paratuberculosis
gagcagacacaaaagcgcccg

SEQ ID NO: 2947119 - RNA, 15 nt, Mycobacterium avium subsp. paratuberculosis
gagcagacccgccgc

SEQ ID NO: 2947120 - RNA, 21 nt, Mycobacterium avium subsp. paratuberculosis
gagcagacccgccgcggcaac

SEQ ID NO: 2947121 - RNA, 18 nt, Mycobacterium avium subsp. paratuberculosis
gagcagacgcaaaaaccc

SEQ ID NO: 2947122 - RNA, 21 nt, Mycobacterium avium subsp. paratuberculosis
gagcagacgcaaaagccccca

SEQ ID NO: 2947123 - RNA, 23 nt, Mycobacterium avium subsp. paratuberculosis
gagcagacgcaaaagccccgcga

SEQ ID NO: 2947124 - RNA, 19 nt, Mycobacterium avium subsp. paratuberculosis
gagcagacgcgaaagcacc

SEQ ID NO: 2947125 - RNA, 20 nt, Mycobacterium avium subsp. paratuberculosis
gagcagacgcgaaagcaccc

SEQ ID NO: 2947126 - RNA, 21 nt, Mycobacterium avium subsp. paratuberculosis
gagcagacgcgaaagcacccg

SEQ ID NO: 2947127 - RNA, 17 nt, Mycobacterium avium subsp. paratuberculosis
gagcagcaagagcaggc

SEQ ID NO: 2947128 - RNA, 15 nt, Mycobacterium avium subsp. paratuberculosis
gagcagcaccacccg

SEQ ID NO: 2947129 - RNA, 18 nt, Mycobacterium avium subsp. paratuberculosis
gagcagcaccacccgcac

SEQ ID NO: 2947130 - RNA, 20 nt, Mycobacterium avium subsp. paratuberculosis
gagcagcaccacccgcaccu

SEQ ID NO: 2947131 - RNA, 24 nt, Mycobacterium avium subsp. paratuberculosis
gagcagcaccacccgcaccucgcc

SEQ ID NO: 2947132 - RNA, 19 nt, Mycobacterium avium subsp. paratuberculosis
gagcccgacggcagcaccg

SEQ ID NO: 2947133 - RNA, 22 nt, Mycobacterium avium subsp. paratuberculosis
gagcccgacggcagcaccgccg

SEQ ID NO: 2947134 - RNA, 22 nt, Mycobacterium avium subsp. paratuberculosis
gagcccgaugcuggccaucgcc

SEQ ID NO: 2947135 - RNA, 14 nt, Mycobacterium avium subsp. paratuberculosis
gagcccgccggcgg

SEQ ID NO: 2947136 - RNA, 15 nt, Mycobacterium avium subsp. paratuberculosis
gagcccgccggcggc

SEQ ID NO: 2947137 - RNA, 17 nt, Mycobacterium avium subsp. paratuberculosis
gagcccgccggcggcga

SEQ ID NO: 2947138 - RNA, 13 nt, Mycobacterium avium subsp. paratuberculosis
gagcccgcgccca

SEQ ID NO: 2947139 - RNA, 16 nt, Mycobacterium avium subsp. paratuberculosis
gagcccggaccggccg

SEQ ID NO: 2947140 - RNA, 16 nt, Mycobacterium avium subsp. paratuberculosis
gagcccggccaguccg

SEQ ID NO: 2947141 - RNA, 18 nt, Mycobacterium avium subsp. paratuberculosis
gagcccggccaguccggc

SEQ ID NO: 2947142 - RNA, 21 nt, Mycobacterium avium subsp. paratuberculosis
gagcccggcgacgaagcagcu

SEQ ID NO: 2947143 - RNA, 16 nt, Mycobacterium avium subsp. paratuberculosis
gagcccggcgacgucg

SEQ ID NO: 2947144 - RNA, 13 nt, Mycobacterium avium subsp. paratuberculosis
gagcccgggaacg

SEQ ID NO: 2947145 - RNA, 15 nt, Mycobacterium avium subsp. paratuberculosis
gagcccgggaacguc

SEQ ID NO: 2947146 - RNA, 14 nt, Mycobacterium avium subsp. paratuberculosis
gagcccgggcaggc

SEQ ID NO: 2947147 - RNA, 16 nt, Mycobacterium avium subsp. paratuberculosis
gagcccgggcaggcgg

SEQ ID NO: 2947148 - RNA, 15 nt, Mycobacterium avium subsp. paratuberculosis
gagcccgucgacguc

SEQ ID NO: 2947149 - RNA, 19 nt, Mycobacterium avium subsp. paratuberculosis
gagcccgucgacgucgaga

SEQ ID NO: 2947150 - RNA, 13 nt, Mycobacterium avium subsp. paratuberculosis
gagcccgucgucg

SEQ ID NO: 2947151 - RNA, 16 nt, Mycobacterium avium subsp. paratuberculosis
gagcccuccagcuggu

SEQ ID NO: 2947152 - RNA, 15 nt, Mycobacterium avium subsp. paratuberculosis
gagcccugcgccagc

SEQ ID NO: 2947153 - RNA, 15 nt, Mycobacterium avium subsp. paratuberculosis
gagcccuucgcggug

SEQ ID NO: 2947154 - RNA, 22 nt, Mycobacterium avium subsp. paratuberculosis
gagcccuuugcgcugcccgaug

SEQ ID NO: 2947155 - RNA, 19 nt, Mycobacterium avium subsp. paratuberculosis
gagccgaagaucaccgcgu

SEQ ID NO: 2947156 - RNA, 15 nt, Mycobacterium avium subsp. paratuberculosis
gagccgacagucgcg

SEQ ID NO: 2947157 - RNA, 16 nt, Mycobacterium avium subsp. paratuberculosis
gagccgacagucgcgg

SEQ ID NO: 2947158 - RNA, 13 nt, Mycobacterium avium subsp. paratuberculosis
gagccgaccagcg

SEQ ID NO: 2947159 - RNA, 15 nt, Mycobacterium avium subsp. paratuberculosis
gagccgaccagcgcg

SEQ ID NO: 2947160 - RNA, 14 nt, Mycobacterium avium subsp. paratuberculosis
gagccgacccgggc

SEQ ID NO: 2947161 - RNA, 16 nt, Mycobacterium avium subsp. paratuberculosis
gagccgaccucggcga

SEQ ID NO: 2947162 - RNA, 17 nt, Mycobacterium avium subsp. paratuberculosis
gagccgaccucggcgac

SEQ ID NO: 2947163 - RNA, 16 nt, Mycobacterium avium subsp. paratuberculosis
gagccgagcaccaggc

SEQ ID NO: 2947164 - RNA, 19 nt, Mycobacterium avium subsp. paratuberculosis
gagccgagcaccaggcgca

SEQ ID NO: 2947165 - RNA, 22 nt, Mycobacterium avium subsp. paratuberculosis
gagccgagcaccaggcgcacca

SEQ ID NO: 2947166 - RNA, 13 nt, Mycobacterium avium subsp. paratuberculosis
gagccgagcaccg

SEQ ID NO: 2947167 - RNA, 18 nt, Mycobacterium avium subsp. paratuberculosis
gagccgagcaccggcagc

SEQ ID NO: 2947168 - RNA, 23 nt, Mycobacterium avium subsp. paratuberculosis
gagccgagcaccggcagcaccgc

SEQ ID NO: 2947169 - RNA, 18 nt, Mycobacterium avium subsp. paratuberculosis
gagccgagcaccgggcug

SEQ ID NO: 2947170 - RNA, 18 nt, Mycobacterium avium subsp. paratuberculosis
gagccgagccgacccggg

SEQ ID NO: 2947171 - RNA, 20 nt, Mycobacterium avium subsp. paratuberculosis
gagccgaggaucugguaugc

SEQ ID NO: 2947172 - RNA, 22 nt, Mycobacterium avium subsp. paratuberculosis
gagccgaugcccagcagcgggg

SEQ ID NO: 2947173 - RNA, 12 nt, Mycobacterium avium subsp. paratuberculosis
gagccgcaccgc

SEQ ID NO: 2947174 - RNA, 14 nt, Mycobacterium avium subsp. paratuberculosis
gagccgcaccgccu

SEQ ID NO: 2947175 - RNA, 13 nt, Mycobacterium avium subsp. paratuberculosis
gagccgcagccgg

SEQ ID NO: 2947176 - RNA, 14 nt, Mycobacterium avium subsp. paratuberculosis
gagccgcagccggg

SEQ ID NO: 2947177 - RNA, 16 nt, Mycobacterium avium subsp. paratuberculosis
gagccgccacagcgcc

SEQ ID NO: 2947178 - RNA, 22 nt, Mycobacterium avium subsp. paratuberculosis
gagccgcccacguucagcgacu

SEQ ID NO: 2947179 - RNA, 12 nt, Mycobacterium avium subsp. paratuberculosis
gagccgcccagg

SEQ ID NO: 2947180 - RNA, 17 nt, Mycobacterium avium subsp. paratuberculosis
gagccgcccaggcgggc

SEQ ID NO: 2947181 - RNA, 19 nt, Mycobacterium avium subsp. paratuberculosis
gagccgcccaggcgggcca

SEQ ID NO: 2947182 - RNA, 11 nt, Mycobacterium avium subsp. paratuberculosis
gagccgccgag

SEQ ID NO: 2947183 - RNA, 12 nt, Mycobacterium avium subsp. paratuberculosis
gagccgccgagc

SEQ ID NO: 2947184 - RNA, 13 nt, Mycobacterium avium subsp. paratuberculosis
gagccgccgagcc

SEQ ID NO: 2947185 - RNA, 14 nt, Mycobacterium avium subsp. paratuberculosis
gagccgccgccggc

SEQ ID NO: 2947186 - RNA, 21 nt, Mycobacterium avium subsp. paratuberculosis
gagccgccgcggcaccuucac

SEQ ID NO: 2947187 - RNA, 16 nt, Mycobacterium avium subsp. paratuberculosis
gagccgccgcgggucg

SEQ ID NO: 2947188 - RNA, 19 nt, Mycobacterium avium subsp. paratuberculosis
gagccgccgcgggucggcg

SEQ ID NO: 2947189 - RNA, 20 nt, Mycobacterium avium subsp. paratuberculosis
gagccgccggaucggcagcg

SEQ ID NO: 2947190 - RNA, 13 nt, Mycobacterium avium subsp. paratuberculosis
gagccgccggggc

SEQ ID NO: 2947191 - RNA, 23 nt, Mycobacterium avium subsp. paratuberculosis
gagccgccugcgcgccgucggcg

SEQ ID NO: 2947192 - RNA, 23 nt, Mycobacterium avium subsp. paratuberculosis
gagccgcggauggccucggcgau

SEQ ID NO: 2947193 - RNA, 13 nt, Mycobacterium avium subsp. paratuberculosis
gagccgcggcccg

SEQ ID NO: 2947194 - RNA, 14 nt, Mycobacterium avium subsp. paratuberculosis
gagccgcggcccgc

SEQ ID NO: 2947195 - RNA, 13 nt, Mycobacterium avium subsp. paratuberculosis
gagccgcggguga

SEQ ID NO: 2947196 - RNA, 11 nt, Mycobacterium avium subsp. paratuberculosis
gagccgcucca

SEQ ID NO: 2947197 - RNA, 13 nt, Mycobacterium avium subsp. paratuberculosis
gagccgcucccgc

SEQ ID NO: 2947198 - RNA, 16 nt, Mycobacterium avium subsp. paratuberculosis
gagccgcucccgcagc

SEQ ID NO: 2947199 - RNA, 18 nt, Mycobacterium avium subsp. paratuberculosis
gagccgcucccgcagcgg

SEQ ID NO: 2947200 - RNA, 13 nt, Mycobacterium avium subsp. paratuberculosis
gagccgcucgccg

SEQ ID NO: 2947201 - RNA, 14 nt, Mycobacterium avium subsp. paratuberculosis
gagccgcucgcgca

SEQ ID NO: 2947202 - RNA, 16 nt, Mycobacterium avium subsp. paratuberculosis
gagccgcucgcgcacc

SEQ ID NO: 2947203 - RNA, 19 nt, Mycobacterium avium subsp. paratuberculosis
gagccgcucgcgcaccggg

SEQ ID NO: 2947204 - RNA, 20 nt, Mycobacterium avium subsp. paratuberculosis
gagccgcucgcgcaccggga

SEQ ID NO: 2947205 - RNA, 15 nt, Mycobacterium avium subsp. paratuberculosis
gagccgcucgucgag

SEQ ID NO: 2947206 - RNA, 22 nt, Mycobacterium avium subsp. paratuberculosis
gagccgcugagcuucugcccgg

SEQ ID NO: 2947207 - RNA, 15 nt, Mycobacterium avium subsp. paratuberculosis
gagccggaucggggu

SEQ ID NO: 2947208 - RNA, 17 nt, Mycobacterium avium subsp. paratuberculosis
gagccggaugcggccga

SEQ ID NO: 2947209 - RNA, 16 nt, Mycobacterium avium subsp. paratuberculosis
gagccggcacgcgcgc

SEQ ID NO: 2947210 - RNA, 15 nt, Mycobacterium avium subsp. paratuberculosis
gagccggcacggccg

SEQ ID NO: 2947211 - RNA, 18 nt, Mycobacterium avium subsp. paratuberculosis
gagccggcacggccggcc

SEQ ID NO: 2947212 - RNA, 21 nt, Mycobacterium avium subsp. paratuberculosis
gagccggcacggccggccggc

SEQ ID NO: 2947213 - RNA, 15 nt, Mycobacterium avium subsp. paratuberculosis
gagccggcccugcgg

SEQ ID NO: 2947214 - RNA, 15 nt, Mycobacterium avium subsp. paratuberculosis
gagccggccgccgaa

SEQ ID NO: 2947215 - RNA, 12 nt, Mycobacterium avium subsp. paratuberculosis
gagccggccgga

SEQ ID NO: 2947216 - RNA, 14 nt, Mycobacterium avium subsp. paratuberculosis
gagccggccggaca

SEQ ID NO: 2947217 - RNA, 16 nt, Mycobacterium avium subsp. paratuberculosis
gagccggccucgccgg

SEQ ID NO: 2947218 - RNA, 20 nt, Mycobacterium avium subsp. paratuberculosis
gagcgcaccagauucaccag

SEQ ID NO: 2947219 - RNA, 12 nt, Mycobacterium avium subsp. paratuberculosis
gagcgcaccgcc

SEQ ID NO: 2947220 - RNA, 13 nt, Mycobacterium avium subsp. paratuberculosis
gagcgcagcaggu

SEQ ID NO: 2947221 - RNA, 16 nt, Mycobacterium avium subsp. paratuberculosis
gagcgcagcgccaggc

SEQ ID NO: 2947222 - RNA, 18 nt, Mycobacterium avium subsp. paratuberculosis
gagcgcagcgccaggcag

SEQ ID NO: 2947223 - RNA, 13 nt, Mycobacterium avium subsp. paratuberculosis
gagcgcagcgggg

SEQ ID NO: 2947224 - RNA, 19 nt, Mycobacterium avium subsp. paratuberculosis
gagcgccaccccgaacccg

SEQ ID NO: 2947225 - RNA, 13 nt, Mycobacterium avium subsp. paratuberculosis
gagcgccagcgcg

SEQ ID NO: 2947226 - RNA, 14 nt, Mycobacterium avium subsp. paratuberculosis
gagcgccagcgcgg

SEQ ID NO: 2947227 - RNA, 20 nt, Mycobacterium avium subsp. paratuberculosis
gagcgccagcgcggugccca

SEQ ID NO: 2947228 - RNA, 13 nt, Mycobacterium avium subsp. paratuberculosis
gagcgccaggcca

SEQ ID NO: 2947229 - RNA, 14 nt, Mycobacterium avium subsp. paratuberculosis
gagcgccaggccau

SEQ ID NO: 2947230 - RNA, 15 nt, Mycobacterium avium subsp. paratuberculosis
gagcgccccagggcc

SEQ ID NO: 2947231 - RNA, 14 nt, Mycobacterium avium subsp. paratuberculosis
gagcgcccggccag

SEQ ID NO: 2947232 - RNA, 15 nt, Mycobacterium avium subsp. paratuberculosis
gagcgcccggccagc

SEQ ID NO: 2947233 - RNA, 19 nt, Mycobacterium avium subsp. paratuberculosis
gagcgcccggccagccggc

SEQ ID NO: 2947234 - RNA, 13 nt, Mycobacterium avium subsp. paratuberculosis
gagcgcccgggcg

SEQ ID NO: 2947235 - RNA, 13 nt, Mycobacterium avium subsp. paratuberculosis
gagcgcccggucg

SEQ ID NO: 2947236 - RNA, 14 nt, Mycobacterium avium subsp. paratuberculosis
gagcgccggacucg

SEQ ID NO: 2947237 - RNA, 13 nt, Mycobacterium avium subsp. paratuberculosis
gagcgccggggcg

SEQ ID NO: 2947238 - RNA, 14 nt, Mycobacterium avium subsp. paratuberculosis
gagcgcgaaaacca

SEQ ID NO: 2947239 - RNA, 17 nt, Mycobacterium avium subsp. paratuberculosis
gagcgcgaaaaccagca

SEQ ID NO: 2947240 - RNA, 23 nt, Mycobacterium avium subsp. paratuberculosis
gagcgcgaaaaccagcaccggca

SEQ ID NO: 2947241 - RNA, 18 nt, Mycobacterium avium subsp. paratuberculosis
gagcgcgccgagcagcug

SEQ ID NO: 2947242 - RNA, 19 nt, Mycobacterium avium subsp. paratuberculosis
gagcgcgccgagcagcugg

SEQ ID NO: 2947243 - RNA, 16 nt, Mycobacterium avium subsp. paratuberculosis
gagcgcgccgaggugg

SEQ ID NO: 2947244 - RNA, 15 nt, Mycobacterium avium subsp. paratuberculosis
gagcgcgccgccgcc

SEQ ID NO: 2947245 - RNA, 21 nt, Mycobacterium avium subsp. paratuberculosis
gagcgcgccgccgccgcccac

SEQ ID NO: 2947246 - RNA, 19 nt, Mycobacterium avium subsp. paratuberculosis
gagcgcgcggugaugaccu

SEQ ID NO: 2947247 - RNA, 18 nt, Mycobacterium avium subsp. paratuberculosis
gagcgcgcucaaccgccc

SEQ ID NO: 2947248 - RNA, 21 nt, Mycobacterium avium subsp. paratuberculosis
gagcgcgcucaaccgcccagc

SEQ ID NO: 2947249 - RNA, 17 nt, Mycobacterium avium subsp. paratuberculosis
gagcgcgcugaucgccg

SEQ ID NO: 2947250 - RNA, 19 nt, Mycobacterium avium subsp. paratuberculosis
gagcgcgcuugggguucuu

SEQ ID NO: 2947251 - RNA, 10 nt, Mycobacterium avium subsp. paratuberculosis
gagcgcggca

SEQ ID NO: 2947252 - RNA, 13 nt, Mycobacterium avium subsp. paratuberculosis
gagcgcggcaugc

SEQ ID NO: 2947253 - RNA, 17 nt, Mycobacterium avium subsp. paratuberculosis
gagcgcggcaugccgcc

SEQ ID NO: 2947254 - RNA, 19 nt, Mycobacterium avium subsp. paratuberculosis
gagcgcggcaugccgcccg

SEQ ID NO: 2947255 - RNA, 13 nt, Mycobacterium avium subsp. paratuberculosis
gagcgcggcccgc

SEQ ID NO: 2947256 - RNA, 14 nt, Mycobacterium avium subsp. paratuberculosis
gagcgcggcccgcc

SEQ ID NO: 2947257 - RNA, 17 nt, Mycobacterium avium subsp. paratuberculosis
gagcgcggcccgccgaa

SEQ ID NO: 2947258 - RNA, 14 nt, Mycobacterium avium subsp. paratuberculosis
gagcgcgggcaccg

SEQ ID NO: 2947259 - RNA, 14 nt, Mycobacterium avium subsp. paratuberculosis
gagcgcgucgacca

SEQ ID NO: 2947260 - RNA, 18 nt, Mycobacterium avium subsp. paratuberculosis
gagcgcgucgaccagccg

SEQ ID NO: 2947261 - RNA, 18 nt, Mycobacterium avium subsp. paratuberculosis
gagcgcgucgucgccgaa

SEQ ID NO: 2947262 - RNA, 14 nt, Mycobacterium avium subsp. paratuberculosis
gagcgcgucguugc

SEQ ID NO: 2947263 - RNA, 18 nt, Mycobacterium avium subsp. paratuberculosis
gagcgcgugcacgaacgc

SEQ ID NO: 2947264 - RNA, 23 nt, Mycobacterium avium subsp. paratuberculosis
gagcgcgugcacgaacgcggcca

SEQ ID NO: 2947265 - RNA, 13 nt, Mycobacterium avium subsp. paratuberculosis
gagcgcuccacca

SEQ ID NO: 2947266 - RNA, 16 nt, Mycobacterium avium subsp. paratuberculosis
gagcgcuccaccaccg

SEQ ID NO: 2947267 - RNA, 18 nt, Mycobacterium avium subsp. paratuberculosis
gagcgcucggacucagga

SEQ ID NO: 2947268 - RNA, 22 nt, Mycobacterium avium subsp. paratuberculosis
gagcgcuggccuugaucgggua

SEQ ID NO: 2947269 - RNA, 13 nt, Mycobacterium avium subsp. paratuberculosis
gagcgcuggucgg

SEQ ID NO: 2947270 - RNA, 16 nt, Mycobacterium avium subsp. paratuberculosis
gagcgcuggucggcga

SEQ ID NO: 2947271 - RNA, 13 nt, Mycobacterium avium subsp. paratuberculosis
gagcggaucggcg

SEQ ID NO: 2947272 - RNA, 16 nt, Mycobacterium avium subsp. paratuberculosis
gagcggaucggcggcg

SEQ ID NO: 2947273 - RNA, 15 nt, Mycobacterium avium subsp. paratuberculosis
gagcggauggcgccg

SEQ ID NO: 2947274 - RNA, 20 nt, Mycobacterium avium subsp. paratuberculosis
gagcggauggcgccgucgag

SEQ ID NO: 2947275 - RNA, 19 nt, Mycobacterium avium subsp. paratuberculosis
gagcggcaccuuggugagc

SEQ ID NO: 2947276 - RNA, 22 nt, Mycobacterium avium subsp. paratuberculosis
gagcggcacgaucggcagcgcc

SEQ ID NO: 2947277 - RNA, 13 nt, Mycobacterium avium subsp. paratuberculosis
gagcggcccaaca

SEQ ID NO: 2947278 - RNA, 15 nt, Mycobacterium avium subsp. paratuberculosis
gagcggcccagcucg

SEQ ID NO: 2947279 - RNA, 16 nt, Mycobacterium avium subsp. paratuberculosis
gagcggcccagcucgg

SEQ ID NO: 2947280 - RNA, 19 nt, Mycobacterium avium subsp. paratuberculosis
gagcggcccagcucgguga

SEQ ID NO: 2947281 - RNA, 19 nt, Mycobacterium avium subsp. paratuberculosis
gagcggcccgcaccgaugg

SEQ ID NO: 2947282 - RNA, 13 nt, Mycobacterium avium subsp. paratuberculosis
gagcggcccugcg

SEQ ID NO: 2947283 - RNA, 15 nt, Mycobacterium avium subsp. paratuberculosis
gagcggcccugcgcg

SEQ ID NO: 2947284 - RNA, 18 nt, Mycobacterium avium subsp. paratuberculosis
gagcggcccugcgcggcc

SEQ ID NO: 2947285 - RNA, 19 nt, Mycobacterium avium subsp. paratuberculosis
gagcggcccugcgcggccu

SEQ ID NO: 2947286 - RNA, 21 nt, Mycobacterium avium subsp. paratuberculosis
gagcggcccugcgcggccugc

SEQ ID NO: 2947287 - RNA, 16 nt, Mycobacterium avium subsp. paratuberculosis
gagcggccgcagcgca

SEQ ID NO: 2947288 - RNA, 17 nt, Mycobacterium avium subsp. paratuberculosis
gagcggccgcagcgcau

SEQ ID NO: 2947289 - RNA, 20 nt, Mycobacterium avium subsp. paratuberculosis
gagcggcgacuccagcagcg

SEQ ID NO: 2947290 - RNA, 16 nt, Mycobacterium avium subsp. paratuberculosis
gagcggcgcaggccgg

SEQ ID NO: 2947291 - RNA, 14 nt, Mycobacterium avium subsp. paratuberculosis
gagcggcgccacgu

SEQ ID NO: 2947292 - RNA, 16 nt, Mycobacterium avium subsp. paratuberculosis
gagcggcgccacgugg

SEQ ID NO: 2947293 - RNA, 21 nt, Mycobacterium avium subsp. paratuberculosis
gagcggcgcguccauggucga

SEQ ID NO: 2947294 - RNA, 19 nt, Mycobacterium avium subsp. paratuberculosis
gagcggcgcugcagcagcc

SEQ ID NO: 2947295 - RNA, 13 nt, Mycobacterium avium subsp. paratuberculosis
gagcggcgguauc

SEQ ID NO: 2947296 - RNA, 17 nt, Mycobacterium avium subsp. paratuberculosis
gagcggcugcuggucga

SEQ ID NO: 2947297 - RNA, 18 nt, Mycobacterium avium subsp. paratuberculosis
gagcggcugcuggucgac

SEQ ID NO: 2947298 - RNA, 20 nt, Mycobacterium avium subsp. paratuberculosis
gagcggcugcuggucgacgu

SEQ ID NO: 2947299 - RNA, 22 nt, Mycobacterium avium subsp. paratuberculosis
gagcggcugcuggucgacguca

SEQ ID NO: 2947300 - RNA, 16 nt, Mycobacterium avium subsp. paratuberculosis
gagcggcuugccgccg

SEQ ID NO: 2947301 - RNA, 18 nt, Mycobacterium avium subsp. paratuberculosis
gagcggcuugccgccgca

SEQ ID NO: 2947302 - RNA, 12 nt, Mycobacterium avium subsp. paratuberculosis
gagcgggaacgc

SEQ ID NO: 2947303 - RNA, 20 nt, Mycobacterium avium subsp. paratuberculosis
gagcugacgggaccgcacgc

SEQ ID NO: 2947304 - RNA, 18 nt, Mycobacterium avium subsp. paratuberculosis
gagcugcaacgcgucggc

SEQ ID NO: 2947305 - RNA, 21 nt, Mycobacterium avium subsp. paratuberculosis
gagcugcaacgcgucggcgcc

SEQ ID NO: 2947306 - RNA, 12 nt, Mycobacterium avium subsp. paratuberculosis
gagcugccggcg

SEQ ID NO: 2947307 - RNA, 19 nt, Mycobacterium avium subsp. paratuberculosis
gagcugccggcgaccagcc

SEQ ID NO: 2947308 - RNA, 15 nt, Mycobacterium avium subsp. paratuberculosis
gagcugccggcggcc

SEQ ID NO: 2947309 - RNA, 18 nt, Mycobacterium avium subsp. paratuberculosis
gagcugccggcggccgcc

SEQ ID NO: 2947310 - RNA, 18 nt, Mycobacterium avium subsp. paratuberculosis
gagcugcgcccacgugcc

SEQ ID NO: 2947311 - RNA, 17 nt, Mycobacterium avium subsp. paratuberculosis
gagcugcgcgccccggc

SEQ ID NO: 2947312 - RNA, 23 nt, Mycobacterium avium subsp. paratuberculosis
gagcugcgcgccccggcccggcg

SEQ ID NO: 2947313 - RNA, 13 nt, Mycobacterium avium subsp. paratuberculosis
gagcugcgggugc

SEQ ID NO: 2947314 - RNA, 16 nt, Mycobacterium avium subsp. paratuberculosis
gagcugcuucgucgcc

SEQ ID NO: 2947315 - RNA, 22 nt, Mycobacterium avium subsp. paratuberculosis
gagcugcuucgucgccgggcug

SEQ ID NO: 2947316 - RNA, 20 nt, Mycobacterium avium subsp. paratuberculosis
gagcuggccgcccaccacga

SEQ ID NO: 2947317 - RNA, 12 nt, Mycobacterium avium subsp. paratuberculosis
gagcuggccgcg

SEQ ID NO: 2947318 - RNA, 14 nt, Mycobacterium avium subsp. paratuberculosis
gagcuggccgcgca

SEQ ID NO: 2947319 - RNA, 19 nt, Mycobacterium avium subsp. paratuberculosis
gagcuggccgcgcagcgug

SEQ ID NO: 2947320 - RNA, 22 nt, Mycobacterium avium subsp. paratuberculosis
gagcuggccgcgcagcgugucg

SEQ ID NO: 2947321 - RNA, 22 nt, Mycobacterium avium subsp. paratuberculosis
gagcuggccguugauggaagcg

SEQ ID NO: 2947322 - RNA, 13 nt, Mycobacterium avium subsp. paratuberculosis
gagcugggcccgc

SEQ ID NO: 2947323 - RNA, 21 nt, Mycobacterium avium subsp. paratuberculosis
gagcugggcccgcgcaucccg

SEQ ID NO: 2947324 - RNA, 14 nt, Mycobacterium avium subsp. paratuberculosis
gagcugggccggcg

SEQ ID NO: 2947325 - RNA, 15 nt, Mycobacterium avium subsp. paratuberculosis
gagcugggccggcgc

SEQ ID NO: 2947326 - RNA, 22 nt, Mycobacterium avium subsp. paratuberculosis
gagcugggccggcgccgaagcc

SEQ ID NO: 2947327 - RNA, 16 nt, Mycobacterium avium subsp. paratuberculosis
gagcugggcggcgcgc

SEQ ID NO: 2947328 - RNA, 14 nt, Mycobacterium avium subsp. paratuberculosis
gagcuggugcagcg

SEQ ID NO: 2947329 - RNA, 15 nt, Mycobacterium avium subsp. paratuberculosis
gagcuggugcagcga

SEQ ID NO: 2947330 - RNA, 19 nt, Mycobacterium avium subsp. paratuberculosis
gagcugugccgcggugcgg

SEQ ID NO: 2947331 - RNA, 16 nt, Mycobacterium avium subsp. paratuberculosis
gagcuucaugcccuug

SEQ ID NO: 2947332 - RNA, 15 nt, Mycobacterium avium subsp. paratuberculosis
gagcuuccgccgagu

SEQ ID NO: 2947333 - RNA, 22 nt, Mycobacterium avium subsp. paratuberculosis
gagcuucucggugaucacccgc

SEQ ID NO: 2947334 - RNA, 21 nt, Mycobacterium avium subsp. paratuberculosis
gagcuucugcccggccagcag

SEQ ID NO: 2947335 - RNA, 14 nt, Mycobacterium avium subsp. paratuberculosis
gagcuuggcgggcg

SEQ ID NO: 2947336 - RNA, 13 nt, Mycobacterium avium subsp. paratuberculosis
gagcuuggcggug

SEQ ID NO: 2947337 - RNA, 16 nt, Mycobacterium avium subsp. paratuberculosis
gagcuuguccugcacc

SEQ ID NO: 2947338 - RNA, 20 nt, Mycobacterium avium subsp. paratuberculosis
gagcuuuucgucggugcgcg

SEQ ID NO: 2947339 - RNA, 23 nt, Mycobacterium avium subsp. paratuberculosis
gagcuuuucgucggugcgcgccg

SEQ ID NO: 2947340 - RNA, 15 nt, Mycobacterium avium subsp. paratuberculosis
gaggaaagcucgcga

SEQ ID NO: 2947341 - RNA, 20 nt, Mycobacterium avium subsp. paratuberculosis
gaggaacagacucagcccgg

SEQ ID NO: 2947342 - RNA, 22 nt, Mycobacterium avium subsp. paratuberculosis
gaggaacagacucagcccggcc

SEQ ID NO: 2947343 - RNA, 17 nt, Mycobacterium avium subsp. paratuberculosis
gaggaacccgaccgcga

SEQ ID NO: 2947344 - RNA, 16 nt, Mycobacterium avium subsp. paratuberculosis
gaggaaccgugcgucc

SEQ ID NO: 2947345 - RNA, 19 nt, Mycobacterium avium subsp. paratuberculosis
gaggaacucagcgcccagg

SEQ ID NO: 2947346 - RNA, 19 nt, Mycobacterium avium subsp. paratuberculosis
gaggaaucgcggcaggcga

SEQ ID NO: 2947347 - RNA, 14 nt, Mycobacterium avium subsp. paratuberculosis
gaggacagcaccgc

SEQ ID NO: 2947348 - RNA, 15 nt, Mycobacterium avium subsp. paratuberculosis
gaggacagcgcggug

SEQ ID NO: 2947349 - RNA, 13 nt, Mycobacterium avium subsp. paratuberculosis
gaggaccggcgcc

SEQ ID NO: 2947350 - RNA, 13 nt, Mycobacterium avium subsp. paratuberculosis
gaggacgaggccc

SEQ ID NO: 2947351 - RNA, 16 nt, Mycobacterium avium subsp. paratuberculosis
gaggacgaggcccgca

SEQ ID NO: 2947352 - RNA, 21 nt, Mycobacterium avium subsp. paratuberculosis
gaggacggcuuggguguggcg

SEQ ID NO: 2947353 - RNA, 14 nt, Mycobacterium avium subsp. paratuberculosis
gaggacgucgagcg

SEQ ID NO: 2947354 - RNA, 16 nt, Mycobacterium avium subsp. paratuberculosis
gaggacgucgucgacg

SEQ ID NO: 2947355 - RNA, 19 nt, Mycobacterium avium subsp. paratuberculosis
gaggacgucgucgacgucc

SEQ ID NO: 2947356 - RNA, 21 nt, Mycobacterium avium subsp. paratuberculosis
gaggagacgucggccgggucg

SEQ ID NO: 2947357 - RNA, 15 nt, Mycobacterium avium subsp. paratuberculosis
gaggaggccgcggcg

SEQ ID NO: 2947358 - RNA, 22 nt, Mycobacterium avium subsp. paratuberculosis
gaggaggccgcggcgacaccca

SEQ ID NO: 2947359 - RNA, 23 nt, Mycobacterium avium subsp. paratuberculosis
gaggaggggucggugcggaugcu

SEQ ID NO: 2947360 - RNA, 16 nt, Mycobacterium avium subsp. paratuberculosis
gaggagggugucggcg

SEQ ID NO: 2947361 - RNA, 22 nt, Mycobacterium avium subsp. paratuberculosis
gaggagggugucggcggggccg

SEQ ID NO: 2947362 - RNA, 23 nt, Mycobacterium avium subsp. paratuberculosis
gaggagggugucggcggggccgg

SEQ ID NO: 2947363 - RNA, 20 nt, Mycobacterium avium subsp. paratuberculosis
gaggagucgggcaaucggac

SEQ ID NO: 2947364 - RNA, 19 nt, Mycobacterium avium subsp. paratuberculosis
gaggaguuuuucggggugg

SEQ ID NO: 2947365 - RNA, 23 nt, Mycobacterium avium subsp. paratuberculosis
gaggaguuuuucgggguggugga

SEQ ID NO: 2947366 - RNA, 23 nt, Mycobacterium avium subsp. paratuberculosis
gaggaucgcaggauggccugcac

SEQ ID NO: 2947367 - RNA, 12 nt, Mycobacterium avium subsp. paratuberculosis
gaggaucgcgau

SEQ ID NO: 2947368 - RNA, 20 nt, Mycobacterium avium subsp. paratuberculosis
gaggaucugcacgucggcgg

SEQ ID NO: 2947369 - RNA, 10 nt, Mycobacterium avium subsp. paratuberculosis
gaggaucugg

SEQ ID NO: 2947370 - RNA, 16 nt, Mycobacterium avium subsp. paratuberculosis
gaggaucugggcggcg

SEQ ID NO: 2947371 - RNA, 17 nt, Mycobacterium avium subsp. paratuberculosis
gaggaucugggcggcgg

SEQ ID NO: 2947372 - RNA, 18 nt, Mycobacterium avium subsp. paratuberculosis
gaggaucugggcggcggg

SEQ ID NO: 2947373 - RNA, 22 nt, Mycobacterium avium subsp. paratuberculosis
gaggaucugggcggcgggacgg

SEQ ID NO: 2947374 - RNA, 14 nt, Mycobacterium avium subsp. paratuberculosis
gaggaugacgacgg

SEQ ID NO: 2947375 - RNA, 23 nt, Mycobacterium avium subsp. paratuberculosis
gaggaugccgcccaccaccggcu

SEQ ID NO: 2947376 - RNA, 18 nt, Mycobacterium avium subsp. paratuberculosis
gaggaugcgcaccacgcc

SEQ ID NO: 2947377 - RNA, 19 nt, Mycobacterium avium subsp. paratuberculosis
gaggauggggucgcgggcg

SEQ ID NO: 2947378 - RNA, 20 nt, Mycobacterium avium subsp. paratuberculosis
gaggaugguggugcaggcga

SEQ ID NO: 2947379 - RNA, 21 nt, Mycobacterium avium subsp. paratuberculosis
gaggaugguggugcaggcgaa

SEQ ID NO: 2947380 - RNA, 15 nt, Mycobacterium avium subsp. paratuberculosis
gaggaugucgacgau

SEQ ID NO: 2947381 - RNA, 21 nt, Mycobacterium avium subsp. paratuberculosis
gaggauuucgcgaucgaggau

SEQ ID NO: 2947382 - RNA, 19 nt, Mycobacterium avium subsp. paratuberculosis
gaggcaaggccuuggugug

SEQ ID NO: 2947383 - RNA, 10 nt, Mycobacterium avium subsp. paratuberculosis
gaggcacccg

SEQ ID NO: 2947384 - RNA, 15 nt, Mycobacterium avium subsp. paratuberculosis
gaggcacccgcugca

SEQ ID NO: 2947385 - RNA, 23 nt, Mycobacterium avium subsp. paratuberculosis
gaggcacccgcugcaccagcccg

SEQ ID NO: 2947386 - RNA, 15 nt, Mycobacterium avium subsp. paratuberculosis
gaggcaccgaacgcc

SEQ ID NO: 2947387 - RNA, 15 nt, Mycobacterium avium subsp. paratuberculosis
gaggcgugcagcccg

SEQ ID NO: 2947388 - RNA, 22 nt, Mycobacterium avium subsp. paratuberculosis
gaggcguugcgucccgcgccgg

SEQ ID NO: 2947389 - RNA, 20 nt, Mycobacterium avium subsp. paratuberculosis
gaggcguuggcccgcacccg

SEQ ID NO: 2947390 - RNA, 19 nt, Mycobacterium avium subsp. paratuberculosis
gaggcguuuucggugugcc

SEQ ID NO: 2947391 - RNA, 23 nt, Mycobacterium avium subsp. paratuberculosis
gaggcguuuucggugugccgcug

SEQ ID NO: 2947392 - RNA, 21 nt, Mycobacterium avium subsp. paratuberculosis
gaggcuauugggucagcuccc

SEQ ID NO: 2947393 - RNA, 16 nt, Mycobacterium avium subsp. paratuberculosis
gaggcucaggccggug

SEQ ID NO: 2947394 - RNA, 17 nt, Mycobacterium avium subsp. paratuberculosis
gaggcucaggccggugg

SEQ ID NO: 2947395 - RNA, 21 nt, Mycobacterium avium subsp. paratuberculosis
gaggcucaggccgguggcgac

SEQ ID NO: 2947396 - RNA, 13 nt, Mycobacterium avium subsp. paratuberculosis
gaggcuggcgauc

SEQ ID NO: 2947397 - RNA, 19 nt, Mycobacterium avium subsp. paratuberculosis
gaggcuggguugcucgccg

SEQ ID NO: 2947398 - RNA, 15 nt, Mycobacterium avium subsp. paratuberculosis
gaggcuguccagcag

SEQ ID NO: 2947399 - RNA, 16 nt, Mycobacterium avium subsp. paratuberculosis
gaggcuguccagcagc

SEQ ID NO: 2947400 - RNA, 20 nt, Mycobacterium avium subsp. paratuberculosis
gaggcugucggaggccucca

SEQ ID NO: 2947401 - RNA, 21 nt, Mycobacterium avium subsp. paratuberculosis
gagggaacgccgaucaccggc

SEQ ID NO: 2947402 - RNA, 15 nt, Mycobacterium avium subsp. paratuberculosis
gagggaccuccagcg

SEQ ID NO: 2947403 - RNA, 19 nt, Mycobacterium avium subsp. paratuberculosis
gagggcaacgucuggccac

SEQ ID NO: 2947404 - RNA, 14 nt, Mycobacterium avium subsp. paratuberculosis
gagggccaccggcu

SEQ ID NO: 2947405 - RNA, 17 nt, Mycobacterium avium subsp. paratuberculosis
gagggccaccggcuccu

SEQ ID NO: 2947406 - RNA, 13 nt, Mycobacterium avium subsp. paratuberculosis
gagggccagcagc

SEQ ID NO: 2947407 - RNA, 13 nt, Mycobacterium avium subsp. paratuberculosis
gagggccagcagu

SEQ ID NO: 2947408 - RNA, 19 nt, Mycobacterium avium subsp. paratuberculosis
gagggccagcagucgugac

SEQ ID NO: 2947409 - RNA, 20 nt, Mycobacterium avium subsp. paratuberculosis
gagggccagcagucgugacg

SEQ ID NO: 2947410 - RNA, 17 nt, Mycobacterium avium subsp. paratuberculosis
gagggccauccggccgg

SEQ ID NO: 2947411 - RNA, 19 nt, Mycobacterium avium subsp. paratuberculosis
gagggccauccggccggcg

SEQ ID NO: 2947412 - RNA, 22 nt, Mycobacterium avium subsp. paratuberculosis
gagggccgaacgauggugugca

SEQ ID NO: 2947413 - RNA, 16 nt, Mycobacterium avium subsp. paratuberculosis
gagggccuccaccacc

SEQ ID NO: 2947414 - RNA, 19 nt, Mycobacterium avium subsp. paratuberculosis
gagggccuccaccaccaug

SEQ ID NO: 2947415 - RNA, 15 nt, Mycobacterium avium subsp. paratuberculosis
gagggcgacgaugcc

SEQ ID NO: 2947416 - RNA, 19 nt, Mycobacterium avium subsp. paratuberculosis
gagggcgacgaugccggcc

SEQ ID NO: 2947417 - RNA, 21 nt, Mycobacterium avium subsp. paratuberculosis
gagggcgacgaugccggccgg

SEQ ID NO: 2947418 - RNA, 13 nt, Mycobacterium avium subsp. paratuberculosis
gagggcgccguug

SEQ ID NO: 2947419 - RNA, 14 nt, Mycobacterium avium subsp. paratuberculosis
gagggcgccguugu

SEQ ID NO: 2947420 - RNA, 13 nt, Mycobacterium avium subsp. paratuberculosis
gagggcgcggcgu

SEQ ID NO: 2947421 - RNA, 20 nt, Mycobacterium avium subsp. paratuberculosis
gagggcgcggcguagccgcc

SEQ ID NO: 2947422 - RNA, 19 nt, Mycobacterium avium subsp. paratuberculosis
gagggcguucgcggugggc

SEQ ID NO: 2947423 - RNA, 18 nt, Mycobacterium avium subsp. paratuberculosis
gagggcuaaccaccggug

SEQ ID NO: 2947424 - RNA, 18 nt, Mycobacterium avium subsp. paratuberculosis
gagggcucaacaggcgag

SEQ ID NO: 2947425 - RNA, 19 nt, Mycobacterium avium subsp. paratuberculosis
gaggggcagcagcgcccac

SEQ ID NO: 2947426 - RNA, 12 nt, Mycobacterium avium subsp. paratuberculosis
gaggggcgcggc

SEQ ID NO: 2947427 - RNA, 22 nt, Mycobacterium avium subsp. paratuberculosis
gagggguccggggcacgguggg

SEQ ID NO: 2947428 - RNA, 23 nt, Mycobacterium avium subsp. paratuberculosis
gagggucaagauaccggccggcg

SEQ ID NO: 2947429 - RNA, 21 nt, Mycobacterium avium subsp. paratuberculosis
gagggucgccaggccaccgca

SEQ ID NO: 2947430 - RNA, 22 nt, Mycobacterium avium subsp. paratuberculosis
gagggucgccaggccaccgcac

SEQ ID NO: 2947431 - RNA, 16 nt, Mycobacterium avium subsp. paratuberculosis
gagggugucggcgauc

SEQ ID NO: 2947432 - RNA, 18 nt, Mycobacterium avium subsp. paratuberculosis
gaggguucgguggccccg

SEQ ID NO: 2947433 - RNA, 16 nt, Mycobacterium avium subsp. paratuberculosis
gaggguuggcgugucg

SEQ ID NO: 2947434 - RNA, 20 nt, Mycobacterium avium subsp. paratuberculosis
gagguaauggugggcguggc

SEQ ID NO: 2947435 - RNA, 14 nt, Mycobacterium avium subsp. paratuberculosis
gagguacugcagca

SEQ ID NO: 2947436 - RNA, 14 nt, Mycobacterium avium subsp. paratuberculosis
gagguagaccgccg

SEQ ID NO: 2947437 - RNA, 13 nt, Mycobacterium avium subsp. paratuberculosis
gagguagccgcgc

SEQ ID NO: 2947438 - RNA, 19 nt, Mycobacterium avium subsp. paratuberculosis
gagguaggccaccgggucg

SEQ ID NO: 2947439 - RNA, 14 nt, Mycobacterium avium subsp. paratuberculosis
gagguaggcgagau

SEQ ID NO: 2947440 - RNA, 22 nt, Mycobacterium avium subsp. paratuberculosis
gagguagucccgcgccuggcgc

SEQ ID NO: 2947441 - RNA, 19 nt, Mycobacterium avium subsp. paratuberculosis
gaggucaccaccgagccgg

SEQ ID NO: 2947442 - RNA, 18 nt, Mycobacterium avium subsp. paratuberculosis
gaggucagcagggugacg

SEQ ID NO: 2947443 - RNA, 23 nt, Mycobacterium avium subsp. paratuberculosis
gaggucagcggcccgaucaccag

SEQ ID NO: 2947444 - RNA, 17 nt, Mycobacterium avium subsp. paratuberculosis
gaggucauaucgacggc

SEQ ID NO: 2947445 - RNA, 14 nt, Mycobacterium avium subsp. paratuberculosis
gaggucauggcgac

SEQ ID NO: 2947446 - RNA, 19 nt, Mycobacterium avium subsp. paratuberculosis
gaggucauggcgaccgcga

SEQ ID NO: 2947447 - RNA, 18 nt, Mycobacterium avium subsp. paratuberculosis
gagguccucgcgcaacug

SEQ ID NO: 2947448 - RNA, 21 nt, Mycobacterium avium subsp. paratuberculosis
gaggucgaaccacgcggcggc

SEQ ID NO: 2947449 - RNA, 13 nt, Mycobacterium avium subsp. paratuberculosis
gaggucgacggag

SEQ ID NO: 2947450 - RNA, 22 nt, Mycobacterium avium subsp. paratuberculosis
gaggucgacggagucgucggcg

SEQ ID NO: 2947451 - RNA, 12 nt, Mycobacterium avium subsp. paratuberculosis
gaggucgccgac

SEQ ID NO: 2947452 - RNA, 19 nt, Mycobacterium avium subsp. paratuberculosis
gaggucgccgacgccgucg

SEQ ID NO: 2947453 - RNA, 13 nt, Mycobacterium avium subsp. paratuberculosis
gaggucgccggug

SEQ ID NO: 2947454 - RNA, 16 nt, Mycobacterium avium subsp. paratuberculosis
gaggucgcgaccgccg

SEQ ID NO: 2947455 - RNA, 17 nt, Mycobacterium avium subsp. paratuberculosis
gaggucgcgaccgccgg

SEQ ID NO: 2947456 - RNA, 16 nt, Mycobacterium avium subsp. paratuberculosis
gaggucgcggcggccg

SEQ ID NO: 2947457 - RNA, 17 nt, Mycobacterium avium subsp. paratuberculosis
gaggucgcggcggccgg

SEQ ID NO: 2947458 - RNA, 18 nt, Mycobacterium avium subsp. paratuberculosis
gaggucgcggcggccggc

SEQ ID NO: 2947459 - RNA, 14 nt, Mycobacterium avium subsp. paratuberculosis
gaggucggacgccu

SEQ ID NO: 2947460 - RNA, 23 nt, Mycobacterium avium subsp. paratuberculosis
gaggucggacgccucccccaccc

SEQ ID NO: 2947461 - RNA, 13 nt, Mycobacterium avium subsp. paratuberculosis
gaggucggccagc

SEQ ID NO: 2947462 - RNA, 15 nt, Mycobacterium avium subsp. paratuberculosis
gaggucggccagcag

SEQ ID NO: 2947463 - RNA, 22 nt, Mycobacterium avium subsp. paratuberculosis
gaggucgggauacucguccucc

SEQ ID NO: 2947464 - RNA, 17 nt, Mycobacterium avium subsp. paratuberculosis
gaggucggugaggcugg

SEQ ID NO: 2947465 - RNA, 19 nt, Mycobacterium avium subsp. paratuberculosis
gaggucgucgagggccacc

SEQ ID NO: 2947466 - RNA, 19 nt, Mycobacterium avium subsp. paratuberculosis
gaggucgucgggcgccggu

SEQ ID NO: 2947467 - RNA, 22 nt, Mycobacterium avium subsp. paratuberculosis
gaggucgucgggcgccgguucc

SEQ ID NO: 2947468 - RNA, 19 nt, Mycobacterium avium subsp. paratuberculosis
gaggucuucggucccggcg

SEQ ID NO: 2947469 - RNA, 13 nt, Mycobacterium avium subsp. paratuberculosis
gaggugaagccgu

SEQ ID NO: 2947470 - RNA, 18 nt, Mycobacterium avium subsp. paratuberculosis
gaggugaauaccacugcg

SEQ ID NO: 2947471 - RNA, 21 nt, Mycobacterium avium subsp. paratuberculosis
gagucguagaggggccggacg

SEQ ID NO: 2947472 - RNA, 17 nt, Mycobacterium avium subsp. paratuberculosis
gagucuacuuggccagc

SEQ ID NO: 2947473 - RNA, 15 nt, Mycobacterium avium subsp. paratuberculosis
gagugaccgccagca

SEQ ID NO: 2947474 - RNA, 19 nt, Mycobacterium avium subsp. paratuberculosis
gagugacguugagcacccg

SEQ ID NO: 2947475 - RNA, 16 nt, Mycobacterium avium subsp. paratuberculosis
gagugaggacgaggcg

SEQ ID NO: 2947476 - RNA, 16 nt, Mycobacterium avium subsp. paratuberculosis
gagugaggccgaggcg

SEQ ID NO: 2947477 - RNA, 17 nt, Mycobacterium avium subsp. paratuberculosis
gagugaggccgaggcga

SEQ ID NO: 2947478 - RNA, 19 nt, Mycobacterium avium subsp. paratuberculosis
gagugaggccgaggcgagu

SEQ ID NO: 2947479 - RNA, 20 nt, Mycobacterium avium subsp. paratuberculosis
gagugcaacuaccgacggca

SEQ ID NO: 2947480 - RNA, 16 nt, Mycobacterium avium subsp. paratuberculosis
gagugcaccuugaucu

SEQ ID NO: 2947481 - RNA, 16 nt, Mycobacterium avium subsp. paratuberculosis
gagugcgaaacucacc

SEQ ID NO: 2947482 - RNA, 19 nt, Mycobacterium avium subsp. paratuberculosis
gagugcgaaucaucguggc

SEQ ID NO: 2947483 - RNA, 17 nt, Mycobacterium avium subsp. paratuberculosis
gagugcgccgugcagca

SEQ ID NO: 2947484 - RNA, 16 nt, Mycobacterium avium subsp. paratuberculosis
gagugcgcugugguga

SEQ ID NO: 2947485 - RNA, 15 nt, Mycobacterium avium subsp. paratuberculosis
gagugcggcccaccc

SEQ ID NO: 2947486 - RNA, 15 nt, Mycobacterium avium subsp. paratuberculosis
gagugcggcgcggug

SEQ ID NO: 2947487 - RNA, 22 nt, Mycobacterium avium subsp. paratuberculosis
gagugcgugucacuacccgcga

SEQ ID NO: 2947488 - RNA, 18 nt, Mycobacterium avium subsp. paratuberculosis
gagugcugcagaccgaac

SEQ ID NO: 2947489 - RNA, 16 nt, Mycobacterium avium subsp. paratuberculosis
gaguggaacagccgga

SEQ ID NO: 2947490 - RNA, 20 nt, Mycobacterium avium subsp. paratuberculosis
gaguggccggcguccaggcg

SEQ ID NO: 2947491 - RNA, 24 nt, Mycobacterium avium subsp. paratuberculosis
gaguggcgaacgggugaguaacac

SEQ ID NO: 2947492 - RNA, 18 nt, Mycobacterium avium subsp. paratuberculosis
gaguucacccguggcuga

SEQ ID NO: 2947493 - RNA, 18 nt, Mycobacterium avium subsp. paratuberculosis
gaguucagaagucgcccg

SEQ ID NO: 2947494 - RNA, 19 nt, Mycobacterium avium subsp. paratuberculosis
gaguucagaagucgcccgc

SEQ ID NO: 2947495 - RNA, 18 nt, Mycobacterium avium subsp. paratuberculosis
gaguuccucgugcgugcg

SEQ ID NO: 2947496 - RNA, 19 nt, Mycobacterium avium subsp. paratuberculosis
gaguucgaccuccacccgc

SEQ ID NO: 2947497 - RNA, 16 nt, Mycobacterium avium subsp. paratuberculosis
gaguucgccgucgacg

SEQ ID NO: 2947498 - RNA, 22 nt, Mycobacterium avium subsp. paratuberculosis
gaguucgccgucgacggugauc

SEQ ID NO: 2947499 - RNA, 17 nt, Mycobacterium avium subsp. paratuberculosis
gaguucgcggcgcagca

SEQ ID NO: 2947500 - RNA, 18 nt, Mycobacterium avium subsp. paratuberculosis
gaguucgcggcgcagcac

SEQ ID NO: 2947501 - RNA, 21 nt, Mycobacterium avium subsp. paratuberculosis
gaguucggccagaucggccag

SEQ ID NO: 2947502 - RNA, 22 nt, Mycobacterium avium subsp. paratuberculosis
gaguucggccagaucggccagg

SEQ ID NO: 2947503 - RNA, 14 nt, Mycobacterium avium subsp. paratuberculosis
gaguucgucggcga

SEQ ID NO: 2947504 - RNA, 15 nt, Mycobacterium avium subsp. paratuberculosis
gaguucgucggcgau

SEQ ID NO: 2947505 - RNA, 21 nt, Mycobacterium avium subsp. paratuberculosis
gaguucugguaggcggccggg

SEQ ID NO: 2947506 - RNA, 22 nt, Mycobacterium avium subsp. paratuberculosis
gaguucugguaggcggccggga

SEQ ID NO: 2947507 - RNA, 17 nt, Mycobacterium avium subsp. paratuberculosis
gaguugccccguguggu

SEQ ID NO: 2947508 - RNA, 13 nt, Mycobacterium avium subsp. paratuberculosis
gaguuggccggca

SEQ ID NO: 2947509 - RNA, 15 nt, Mycobacterium avium subsp. paratuberculosis
gaguuugcccucguc

SEQ ID NO: 2947510 - RNA, 15 nt, Mycobacterium avium subsp. paratuberculosis
gaguuuggccagcuc

SEQ ID NO: 2947511 - RNA, 18 nt, Mycobacterium avium subsp. paratuberculosis
gaguuuuucgggguggug

SEQ ID NO: 2947512 - RNA, 17 nt, Mycobacterium avium subsp. paratuberculosis
gauaaccguccacaccg

SEQ ID NO: 2947513 - RNA, 16 nt, Mycobacterium avium subsp. paratuberculosis
gauaaccucggcggcg

SEQ ID NO: 2947514 - RNA, 23 nt, Mycobacterium avium subsp. paratuberculosis
gauaacucuacugcugcgggugc

SEQ ID NO: 2947515 - RNA, 22 nt, Mycobacterium avium subsp. paratuberculosis
gauaagcggauugaccagcacg

SEQ ID NO: 2947516 - RNA, 23 nt, Mycobacterium avium subsp. paratuberculosis
gauaagcggauugaccagcacgu

SEQ ID NO: 2947517 - RNA, 21 nt, Mycobacterium avium subsp. paratuberculosis
gauaauggcggccgccgcgau

SEQ ID NO: 2947518 - RNA, 17 nt, Mycobacterium avium subsp. paratuberculosis
gauacaggagggccagg

SEQ ID NO: 2947519 - RNA, 17 nt, Mycobacterium avium subsp. paratuberculosis
gauacaucucgguggug

SEQ ID NO: 2947520 - RNA, 20 nt, Mycobacterium avium subsp. paratuberculosis
gauaccagccgcggacggcc

SEQ ID NO: 2947521 - RNA, 14 nt, Mycobacterium avium subsp. paratuberculosis
gauacccgcgcggc

SEQ ID NO: 2947522 - RNA, 16 nt, Mycobacterium avium subsp. paratuberculosis
gauacccgcgcggcgc

SEQ ID NO: 2947523 - RNA, 20 nt, Mycobacterium avium subsp. paratuberculosis
gauacccgcgcggcgcaggu

SEQ ID NO: 2947524 - RNA, 13 nt, Mycobacterium avium subsp. paratuberculosis
gauacccgcggcc

SEQ ID NO: 2947525 - RNA, 18 nt, Mycobacterium avium subsp. paratuberculosis
gauacccguugcgcccca

SEQ ID NO: 2947526 - RNA, 15 nt, Mycobacterium avium subsp. paratuberculosis
gauaccgcgaccgcc

SEQ ID NO: 2947527 - RNA, 16 nt, Mycobacterium avium subsp. paratuberculosis
gauaccggccagcacg

SEQ ID NO: 2947528 - RNA, 17 nt, Mycobacterium avium subsp. paratuberculosis
gauaccggccagcacga

SEQ ID NO: 2947529 - RNA, 19 nt, Mycobacterium avium subsp. paratuberculosis
gauaccggccagcacgaac

SEQ ID NO: 2947530 - RNA, 17 nt, Mycobacterium avium subsp. paratuberculosis
gauaccggcccagcgcg

SEQ ID NO: 2947531 - RNA, 14 nt, Mycobacterium avium subsp. paratuberculosis
gauaccggccggcg

SEQ ID NO: 2947532 - RNA, 16 nt, Mycobacterium avium subsp. paratuberculosis
gauaccggccggcgcg

SEQ ID NO: 2947533 - RNA, 19 nt, Mycobacterium avium subsp. paratuberculosis
gauacgacguccgggccgc

SEQ ID NO: 2947534 - RNA, 14 nt, Mycobacterium avium subsp. paratuberculosis
gauacgcgacgaac

SEQ ID NO: 2947535 - RNA, 20 nt, Mycobacterium avium subsp. paratuberculosis
gauacgcgacgaaccgccac

SEQ ID NO: 2947536 - RNA, 21 nt, Mycobacterium avium subsp. paratuberculosis
gauacgcgacgaaccgccaca

SEQ ID NO: 2947537 - RNA, 18 nt, Mycobacterium avium subsp. paratuberculosis
gauacggucgcaccgcgg

SEQ ID NO: 2947538 - RNA, 22 nt, Mycobacterium avium subsp. paratuberculosis
gauacgucuugucggggaaggg

SEQ ID NO: 2947539 - RNA, 13 nt, Mycobacterium avium subsp. paratuberculosis
gauacuccucgcg

SEQ ID NO: 2947540 - RNA, 15 nt, Mycobacterium avium subsp. paratuberculosis
gauacuccucgcggu

SEQ ID NO: 2947541 - RNA, 15 nt, Mycobacterium avium subsp. paratuberculosis
gauacuccucgguga

SEQ ID NO: 2947542 - RNA, 21 nt, Mycobacterium avium subsp. paratuberculosis
gauacucgggcaacgcgccgg

SEQ ID NO: 2947543 - RNA, 22 nt, Mycobacterium avium subsp. paratuberculosis
gauacucgggcaacgcgccggc

SEQ ID NO: 2947544 - RNA, 15 nt, Mycobacterium avium subsp. paratuberculosis
gauagagcaccgcgc

SEQ ID NO: 2947545 - RNA, 21 nt, Mycobacterium avium subsp. paratuberculosis
gauagcccagccagccggugg

SEQ ID NO: 2947546 - RNA, 17 nt, Mycobacterium avium subsp. paratuberculosis
gauagccccgccaggcg

SEQ ID NO: 2947547 - RNA, 13 nt, Mycobacterium avium subsp. paratuberculosis
gauagcccgccgc

SEQ ID NO: 2947548 - RNA, 14 nt, Mycobacterium avium subsp. paratuberculosis
gauagcccgccgcg

SEQ ID NO: 2947549 - RNA, 21 nt, Mycobacterium avium subsp. paratuberculosis
gauagcccgccgcggcgaccg

SEQ ID NO: 2947550 - RNA, 21 nt, Mycobacterium avium subsp. paratuberculosis
gauagccggugaucgcggcgc

SEQ ID NO: 2947551 - RNA, 19 nt, Mycobacterium avium subsp. paratuberculosis
gauagccgucggcggaggu

SEQ ID NO: 2947552 - RNA, 12 nt, Mycobacterium avium subsp. paratuberculosis
gauagcggccgc

SEQ ID NO: 2947553 - RNA, 15 nt, Mycobacterium avium subsp. paratuberculosis
gauaggccagcgcgu

SEQ ID NO: 2947554 - RNA, 20 nt, Mycobacterium avium subsp. paratuberculosis
gauaggccucguggaacacc

SEQ ID NO: 2947555 - RNA, 16 nt, Mycobacterium avium subsp. paratuberculosis
gaucacgacgcgaccg

SEQ ID NO: 2947556 - RNA, 19 nt, Mycobacterium avium subsp. paratuberculosis
gaucacgccgccggggcgc

SEQ ID NO: 2947557 - RNA, 15 nt, Mycobacterium avium subsp. paratuberculosis
gaucacgcggcggga

SEQ ID NO: 2947558 - RNA, 16 nt, Mycobacterium avium subsp. paratuberculosis
gaucacgcggcgggaa

SEQ ID NO: 2947559 - RNA, 15 nt, Mycobacterium avium subsp. paratuberculosis
gaucacggugaucgc

SEQ ID NO: 2947560 - RNA, 17 nt, Mycobacterium avium subsp. paratuberculosis
gaucacguucaccugac

SEQ ID NO: 2947561 - RNA, 18 nt, Mycobacterium avium subsp. paratuberculosis
gaucacguucucggcgaa

SEQ ID NO: 2947562 - RNA, 15 nt, Mycobacterium avium subsp. paratuberculosis
gaucacguugucgcg

SEQ ID NO: 2947563 - RNA, 19 nt, Mycobacterium avium subsp. paratuberculosis
gaucacguugucgcggccc

SEQ ID NO: 2947564 - RNA, 18 nt, Mycobacterium avium subsp. paratuberculosis
gaucagacccagcgucag

SEQ ID NO: 2947565 - RNA, 13 nt, Mycobacterium avium subsp. paratuberculosis
gaucagagcgggc

SEQ ID NO: 2947566 - RNA, 17 nt, Mycobacterium avium subsp. paratuberculosis
gaucagagcgggccgac

SEQ ID NO: 2947567 - RNA, 16 nt, Mycobacterium avium subsp. paratuberculosis
gaucagaugcucgucg

SEQ ID NO: 2947568 - RNA, 15 nt, Mycobacterium avium subsp. paratuberculosis
gaucagcaccaggug

SEQ ID NO: 2947569 - RNA, 16 nt, Mycobacterium avium subsp. paratuberculosis
gaucagcaccaggugg

SEQ ID NO: 2947570 - RNA, 20 nt, Mycobacterium avium subsp. paratuberculosis
gaucagcaccagguggcccg

SEQ ID NO: 2947571 - RNA, 22 nt, Mycobacterium avium subsp. paratuberculosis
gaucagcaccgacgcggcgacc

SEQ ID NO: 2947572 - RNA, 13 nt, Mycobacterium avium subsp. paratuberculosis
gaucagcaccgcc

SEQ ID NO: 2947573 - RNA, 14 nt, Mycobacterium avium subsp. paratuberculosis
gaucagcaccgcca

SEQ ID NO: 2947574 - RNA, 13 nt, Mycobacterium avium subsp. paratuberculosis
gaucagcaccguc

SEQ ID NO: 2947575 - RNA, 18 nt, Mycobacterium avium subsp. paratuberculosis
gaucagcacgucgcggcc

SEQ ID NO: 2947576 - RNA, 23 nt, Mycobacterium avium subsp. paratuberculosis
gaucagcacuucauggucgucgu

SEQ ID NO: 2947577 - RNA, 14 nt, Mycobacterium avium subsp. paratuberculosis
gaucagcagcaccc

SEQ ID NO: 2947578 - RNA, 16 nt, Mycobacterium avium subsp. paratuberculosis
gaucagcagcacccgg

SEQ ID NO: 2947579 - RNA, 16 nt, Mycobacterium avium subsp. paratuberculosis
gaucagcagcaccggc

SEQ ID NO: 2947580 - RNA, 14 nt, Mycobacterium avium subsp. paratuberculosis
gaucagcagcaccu

SEQ ID NO: 2947581 - RNA, 11 nt, Mycobacterium avium subsp. paratuberculosis
gaucagcagcc

SEQ ID NO: 2947582 - RNA, 13 nt, Mycobacterium avium subsp. paratuberculosis
gaucagcagccgg

SEQ ID NO: 2947583 - RNA, 16 nt, Mycobacterium avium subsp. paratuberculosis
gaucagcagccguucc

SEQ ID NO: 2947584 - RNA, 17 nt, Mycobacterium avium subsp. paratuberculosis
gaucagcagcucggugg

SEQ ID NO: 2947585 - RNA, 19 nt, Mycobacterium avium subsp. paratuberculosis
gaucagcaggcccucggcc

SEQ ID NO: 2947586 - RNA, 19 nt, Mycobacterium avium subsp. paratuberculosis
gaucagcaggcuggcggcg

SEQ ID NO: 2947587 - RNA, 21 nt, Mycobacterium avium subsp. paratuberculosis
gaucagcaggcuggcggcgau

SEQ ID NO: 2947588 - RNA, 22 nt, Mycobacterium avium subsp. paratuberculosis
gaucagcagugccccguccggc

SEQ ID NO: 2947589 - RNA, 17 nt, Mycobacterium avium subsp. paratuberculosis
gaucagcaugacgaacu

SEQ ID NO: 2947590 - RNA, 20 nt, Mycobacterium avium subsp. paratuberculosis
gaucagcaugucgcccgcgu

SEQ ID NO: 2947591 - RNA, 16 nt, Mycobacterium avium subsp. paratuberculosis
gaucagccacaccgcc

SEQ ID NO: 2947592 - RNA, 20 nt, Mycobacterium avium subsp. paratuberculosis
gaucagccacaccgccggcg

SEQ ID NO: 2947593 - RNA, 20 nt, Mycobacterium avium subsp. paratuberculosis
gaucagccccagggugcgcc

SEQ ID NO: 2947594 - RNA, 16 nt, Mycobacterium avium subsp. paratuberculosis
gaucagcccggcccgc

SEQ ID NO: 2947595 - RNA, 12 nt, Mycobacterium avium subsp. paratuberculosis
gaucagcccggg

SEQ ID NO: 2947596 - RNA, 14 nt, Mycobacterium avium subsp. paratuberculosis
gaucagccgcccga

SEQ ID NO: 2947597 - RNA, 20 nt, Mycobacterium avium subsp. paratuberculosis
gaucagccgcgacagccgcc

SEQ ID NO: 2947598 - RNA, 22 nt, Mycobacterium avium subsp. paratuberculosis
gaucagccgcgacagccgcccg

SEQ ID NO: 2947599 - RNA, 19 nt, Mycobacterium avium subsp. paratuberculosis
gaucagccggcgagcgcgc

SEQ ID NO: 2947600 - RNA, 20 nt, Mycobacterium avium subsp. paratuberculosis
gaucagccggcgagcgcgcu

SEQ ID NO: 2947601 - RNA, 20 nt, Mycobacterium avium subsp. paratuberculosis
gaucagccggguagcgccgc

SEQ ID NO: 2947602 - RNA, 21 nt, Mycobacterium avium subsp. paratuberculosis
gaucagccggguagcgccgcc

SEQ ID NO: 2947603 - RNA, 20 nt, Mycobacterium avium subsp. paratuberculosis
gaucagccguaccgauccgc

SEQ ID NO: 2947604 - RNA, 18 nt, Mycobacterium avium subsp. paratuberculosis
gaucagcgacggcccgcc

SEQ ID NO: 2947605 - RNA, 14 nt, Mycobacterium avium subsp. paratuberculosis
gaucagcgccagca

SEQ ID NO: 2947606 - RNA, 16 nt, Mycobacterium avium subsp. paratuberculosis
gaucagcgccaggugg

SEQ ID NO: 2947607 - RNA, 20 nt, Mycobacterium avium subsp. paratuberculosis
gaucagcgccagguggguga

SEQ ID NO: 2947608 - RNA, 12 nt, Mycobacterium avium subsp. paratuberculosis
gaucagcgccgu

SEQ ID NO: 2947609 - RNA, 22 nt, Mycobacterium avium subsp. paratuberculosis
gaucagcgccguggcccggucg

SEQ ID NO: 2947610 - RNA, 21 nt, Mycobacterium avium subsp. paratuberculosis
gaucagcgcgcacagcgccac

SEQ ID NO: 2947611 - RNA, 24 nt, Mycobacterium avium subsp. paratuberculosis
gaucagcgcgcacagcgccacacc

SEQ ID NO: 2947612 - RNA, 12 nt, Mycobacterium avium subsp. paratuberculosis
gaucagcgcgcc

SEQ ID NO: 2947613 - RNA, 14 nt, Mycobacterium avium subsp. paratuberculosis
gaucagcgcgccca

SEQ ID NO: 2947614 - RNA, 18 nt, Mycobacterium avium subsp. paratuberculosis
gaucagcgcgcccaggcc

SEQ ID NO: 2947615 - RNA, 13 nt, Mycobacterium avium subsp. paratuberculosis
gaucagcggcggg

SEQ ID NO: 2947616 - RNA, 15 nt, Mycobacterium avium subsp. paratuberculosis
gaucagcggcgggcc

SEQ ID NO: 2947617 - RNA, 20 nt, Mycobacterium avium subsp. paratuberculosis
gaucagcggcgggcccagca

SEQ ID NO: 2947618 - RNA, 22 nt, Mycobacterium avium subsp. paratuberculosis
gaucagcggcgggcccagcaga

SEQ ID NO: 2947619 - RNA, 17 nt, Mycobacterium avium subsp. paratuberculosis
gaucagcgggacgaggg

SEQ ID NO: 2947620 - RNA, 18 nt, Mycobacterium avium subsp. paratuberculosis
gaucagcgggcuguccgc

SEQ ID NO: 2947621 - RNA, 20 nt, Mycobacterium avium subsp. paratuberculosis
gaucagcgggcuguccgcgu

SEQ ID NO: 2947622 - RNA, 18 nt, Mycobacterium avium subsp. paratuberculosis
gaucagcgguccacccga

SEQ ID NO: 2947623 - RNA, 14 nt, Mycobacterium avium subsp. paratuberculosis
gaucagcgucagca

SEQ ID NO: 2947624 - RNA, 16 nt, Mycobacterium avium subsp. paratuberculosis
gaucagcgucagcacc

SEQ ID NO: 2947625 - RNA, 19 nt, Mycobacterium avium subsp. paratuberculosis
gaucagcgucagcaccgcg

SEQ ID NO: 2947626 - RNA, 14 nt, Mycobacterium avium subsp. paratuberculosis
gaucagcgucgcga

SEQ ID NO: 2947627 - RNA, 12 nt, Mycobacterium avium subsp. paratuberculosis
gaucagcguggu

SEQ ID NO: 2947628 - RNA, 16 nt, Mycobacterium avium subsp. paratuberculosis
gaucagcguggucagc

SEQ ID NO: 2947629 - RNA, 17 nt, Mycobacterium avium subsp. paratuberculosis
gaucagcguggucagcg

SEQ ID NO: 2947630 - RNA, 20 nt, Mycobacterium avium subsp. paratuberculosis
gaucagcguggucagcgucu

SEQ ID NO: 2947631 - RNA, 18 nt, Mycobacterium avium subsp. paratuberculosis
gaucagcguuccggcggc

SEQ ID NO: 2947632 - RNA, 20 nt, Mycobacterium avium subsp. paratuberculosis
gaucagcguuccggcggccg

SEQ ID NO: 2947633 - RNA, 16 nt, Mycobacterium avium subsp. paratuberculosis
gaucagcuccucgcgg

SEQ ID NO: 2947634 - RNA, 13 nt, Mycobacterium avium subsp. paratuberculosis
gaucagcucgccg

SEQ ID NO: 2947635 - RNA, 15 nt, Mycobacterium avium subsp. paratuberculosis
gaucagcucgccgau

SEQ ID NO: 2947636 - RNA, 23 nt, Mycobacterium avium subsp. paratuberculosis
gaucagcucgccgaugucggccg

SEQ ID NO: 2947637 - RNA, 13 nt, Mycobacterium avium subsp. paratuberculosis
gaucagcucgcgg

SEQ ID NO: 2947638 - RNA, 19 nt, Mycobacterium avium subsp. paratuberculosis
gaucagcucguggcgggcc

SEQ ID NO: 2947639 - RNA, 20 nt, Mycobacterium avium subsp. paratuberculosis
gaucagcucguggcgggccc

SEQ ID NO: 2947640 - RNA, 19 nt, Mycobacterium avium subsp. paratuberculosis
gaucccggccacgucgaug

SEQ ID NO: 2947641 - RNA, 23 nt, Mycobacterium avium subsp. paratuberculosis
gaucccggccacgucgaugccga

SEQ ID NO: 2947642 - RNA, 16 nt, Mycobacterium avium subsp. paratuberculosis
gaucccggccagcacc

SEQ ID NO: 2947643 - RNA, 19 nt, Mycobacterium avium subsp. paratuberculosis
gaucccggccagcacccgc

SEQ ID NO: 2947644 - RNA, 21 nt, Mycobacterium avium subsp. paratuberculosis
gaucccggccagcacccgcug

SEQ ID NO: 2947645 - RNA, 21 nt, Mycobacterium avium subsp. paratuberculosis
gaucccggcgagcacgccgcc

SEQ ID NO: 2947646 - RNA, 23 nt, Mycobacterium avium subsp. paratuberculosis
gaucccgggccguucagcgggcg

SEQ ID NO: 2947647 - RNA, 15 nt, Mycobacterium avium subsp. paratuberculosis
gaucccggggcgcgc

SEQ ID NO: 2947648 - RNA, 20 nt, Mycobacterium avium subsp. paratuberculosis
gaucccggugaugccggcau

SEQ ID NO: 2947649 - RNA, 23 nt, Mycobacterium avium subsp. paratuberculosis
gaucccgguucccggcaccacca

SEQ ID NO: 2947650 - RNA, 17 nt, Mycobacterium avium subsp. paratuberculosis
gaucccguaggucgccu

SEQ ID NO: 2947651 - RNA, 14 nt, Mycobacterium avium subsp. paratuberculosis
gaucccgucgucgg

SEQ ID NO: 2947652 - RNA, 20 nt, Mycobacterium avium subsp. paratuberculosis
gaucccgucgucggcgccgc

SEQ ID NO: 2947653 - RNA, 22 nt, Mycobacterium avium subsp. paratuberculosis
gaucccgucgucggcgccgcgc

SEQ ID NO: 2947654 - RNA, 21 nt, Mycobacterium avium subsp. paratuberculosis
gaucccugcgcucagcacgcg

SEQ ID NO: 2947655 - RNA, 17 nt, Mycobacterium avium subsp. paratuberculosis
gauccgaggcgucaggg

SEQ ID NO: 2947656 - RNA, 16 nt, Mycobacterium avium subsp. paratuberculosis
gauccgaucugcucga

SEQ ID NO: 2947657 - RNA, 22 nt, Mycobacterium avium subsp. paratuberculosis
gauccgaugacgcugccgcgcc

SEQ ID NO: 2947658 - RNA, 23 nt, Mycobacterium avium subsp. paratuberculosis
gauccgaugacgcugccgcgccg

SEQ ID NO: 2947659 - RNA, 15 nt, Mycobacterium avium subsp. paratuberculosis
gauccgaugcagggc

SEQ ID NO: 2947660 - RNA, 14 nt, Mycobacterium avium subsp. paratuberculosis
gauccgcaccgggc

SEQ ID NO: 2947661 - RNA, 16 nt, Mycobacterium avium subsp. paratuberculosis
gauccgcaccgggcag

SEQ ID NO: 2947662 - RNA, 15 nt, Mycobacterium avium subsp. paratuberculosis
gauccgcagccgcug

SEQ ID NO: 2947663 - RNA, 13 nt, Mycobacterium avium subsp. paratuberculosis
gauccgcagcuga

SEQ ID NO: 2947664 - RNA, 20 nt, Mycobacterium avium subsp. paratuberculosis
gauccgcaggaaagcgucac

SEQ ID NO: 2947665 - RNA, 20 nt, Mycobacterium avium subsp. paratuberculosis
gauccgcccgccgguggccg

SEQ ID NO: 2947666 - RNA, 16 nt, Mycobacterium avium subsp. paratuberculosis
gauccgcccggcccgc

SEQ ID NO: 2947667 - RNA, 13 nt, Mycobacterium avium subsp. paratuberculosis
gauccgccguugc

SEQ ID NO: 2947668 - RNA, 14 nt, Mycobacterium avium subsp. paratuberculosis
gauccgccugcccu

SEQ ID NO: 2947669 - RNA, 14 nt, Mycobacterium avium subsp. paratuberculosis
gauccgccugcgcg

SEQ ID NO: 2947670 - RNA, 13 nt, Mycobacterium avium subsp. paratuberculosis
gauccgcgccgcc

SEQ ID NO: 2947671 - RNA, 14 nt, Mycobacterium avium subsp. paratuberculosis
gauccgcgccgccg

SEQ ID NO: 2947672 - RNA, 22 nt, Mycobacterium avium subsp. paratuberculosis
gauccgcgccgccgccagccag

SEQ ID NO: 2947673 - RNA, 14 nt, Mycobacterium avium subsp. paratuberculosis
gauccgcgccgcga

SEQ ID NO: 2947674 - RNA, 15 nt, Mycobacterium avium subsp. paratuberculosis
gauccgcgccgcgau

SEQ ID NO: 2947675 - RNA, 22 nt, Mycobacterium avium subsp. paratuberculosis
gauccgcgccgcgaugcaacac

SEQ ID NO: 2947676 - RNA, 24 nt, Mycobacterium avium subsp. paratuberculosis
gauccgcgccgcgaugcaacaccg

SEQ ID NO: 2947677 - RNA, 16 nt, Mycobacterium avium subsp. paratuberculosis
gauccgcgcggccacc

SEQ ID NO: 2947678 - RNA, 18 nt, Mycobacterium avium subsp. paratuberculosis
gauccgcgcggccaccag

SEQ ID NO: 2947679 - RNA, 22 nt, Mycobacterium avium subsp. paratuberculosis
gauccgcgcggccaccagcgcg

SEQ ID NO: 2947680 - RNA, 13 nt, Mycobacterium avium subsp. paratuberculosis
gauccgcgcggcg

SEQ ID NO: 2947681 - RNA, 14 nt, Mycobacterium avium subsp. paratuberculosis
gauccgcggcgccg

SEQ ID NO: 2947682 - RNA, 17 nt, Mycobacterium avium subsp. paratuberculosis
gauccgcggcgccgggc

SEQ ID NO: 2947683 - RNA, 21 nt, Mycobacterium avium subsp. paratuberculosis
gauccgcguggcucucguccu

SEQ ID NO: 2947684 - RNA, 23 nt, Mycobacterium avium subsp. paratuberculosis
gauccgcugcggauccgacgaac

SEQ ID NO: 2947685 - RNA, 15 nt, Mycobacterium avium subsp. paratuberculosis
gauccggacgaccug

SEQ ID NO: 2947686 - RNA, 20 nt, Mycobacterium avium subsp. paratuberculosis
gauccggacgaccugggcgc

SEQ ID NO: 2947687 - RNA, 17 nt, Mycobacterium avium subsp. paratuberculosis
gauccggaugaucuuga

SEQ ID NO: 2947688 - RNA, 19 nt, Mycobacterium avium subsp. paratuberculosis
gauccggauugccgggcag

SEQ ID NO: 2947689 - RNA, 13 nt, Mycobacterium avium subsp. paratuberculosis
gauccggccgcgg

SEQ ID NO: 2947690 - RNA, 17 nt, Mycobacterium avium subsp. paratuberculosis
gauccggccgcggauga

SEQ ID NO: 2947691 - RNA, 18 nt, Mycobacterium avium subsp. paratuberculosis
gauccggccggcggcggu

SEQ ID NO: 2947692 - RNA, 16 nt, Mycobacterium avium subsp. paratuberculosis
gauccggcgcccgaug

SEQ ID NO: 2947693 - RNA, 15 nt, Mycobacterium avium subsp. paratuberculosis
gauccggcgccgcgg

SEQ ID NO: 2947694 - RNA, 15 nt, Mycobacterium avium subsp. paratuberculosis
gauccggcgcgccgc

SEQ ID NO: 2947695 - RNA, 16 nt, Mycobacterium avium subsp. paratuberculosis
gauccggcgcgccgcg

SEQ ID NO: 2947696 - RNA, 18 nt, Mycobacterium avium subsp. paratuberculosis
gauccggcgcgccgcgau

SEQ ID NO: 2947697 - RNA, 22 nt, Mycobacterium avium subsp. paratuberculosis
gauccggcgucucagucggcca

SEQ ID NO: 2947698 - RNA, 17 nt, Mycobacterium avium subsp. paratuberculosis
gauccggcuccacagca

SEQ ID NO: 2947699 - RNA, 21 nt, Mycobacterium avium subsp. paratuberculosis
gauccggcuccacagcaguuc

SEQ ID NO: 2947700 - RNA, 20 nt, Mycobacterium avium subsp. paratuberculosis
gauccggcugagcagcucgc

SEQ ID NO: 2947701 - RNA, 20 nt, Mycobacterium avium subsp. paratuberculosis
gauccgggcacgcagcggcg

SEQ ID NO: 2947702 - RNA, 21 nt, Mycobacterium avium subsp. paratuberculosis
gauccgggcacgcagcggcgu

SEQ ID NO: 2947703 - RNA, 15 nt, Mycobacterium avium subsp. paratuberculosis
gauccgggccggcgu

SEQ ID NO: 2947704 - RNA, 22 nt, Mycobacterium avium subsp. paratuberculosis
gauccgggcgccauccgccacc

SEQ ID NO: 2947705 - RNA, 13 nt, Mycobacterium avium subsp. paratuberculosis
gauccgggcgccg

SEQ ID NO: 2947706 - RNA, 20 nt, Mycobacterium avium subsp. paratuberculosis
gauccgggcgccggccggcg

SEQ ID NO: 2947707 - RNA, 17 nt, Mycobacterium avium subsp. paratuberculosis
gauccggggcacgauga

SEQ ID NO: 2947708 - RNA, 23 nt, Mycobacterium avium subsp. paratuberculosis
gauccggggggcggggucgaagu

SEQ ID NO: 2947709 - RNA, 17 nt, Mycobacterium avium subsp. paratuberculosis
gauccgguaccagaucg

SEQ ID NO: 2947710 - RNA, 18 nt, Mycobacterium avium subsp. paratuberculosis
gauccgguaccagaucga

SEQ ID NO: 2947711 - RNA, 14 nt, Mycobacterium avium subsp. paratuberculosis
gauccgguccagcc

SEQ ID NO: 2947712 - RNA, 15 nt, Mycobacterium avium subsp. paratuberculosis
gauccgguccagccc

SEQ ID NO: 2947713 - RNA, 16 nt, Mycobacterium avium subsp. paratuberculosis
gauccgguccagcccg

SEQ ID NO: 2947714 - RNA, 14 nt, Mycobacterium avium subsp. paratuberculosis
gauccggucgauga

SEQ ID NO: 2947715 - RNA, 21 nt, Mycobacterium avium subsp. paratuberculosis
gauccggugaccgcgacgcug

SEQ ID NO: 2947716 - RNA, 17 nt, Mycobacterium avium subsp. paratuberculosis
gauccgucaucucguca

SEQ ID NO: 2947717 - RNA, 16 nt, Mycobacterium avium subsp. paratuberculosis
gauccgucgccccgca

SEQ ID NO: 2947718 - RNA, 19 nt, Mycobacterium avium subsp. paratuberculosis
gauccucgccgcgggccag

SEQ ID NO: 2947719 - RNA, 20 nt, Mycobacterium avium subsp. paratuberculosis
gauccucgccgcgggccagc

SEQ ID NO: 2947720 - RNA, 21 nt, Mycobacterium avium subsp. paratuberculosis
gauccucgccgcgggccagcc

SEQ ID NO: 2947721 - RNA, 18 nt, Mycobacterium avium subsp. paratuberculosis
gauccucgucuccggcgg

SEQ ID NO: 2947722 - RNA, 20 nt, Mycobacterium avium subsp. paratuberculosis
gauccucgucuccggcggca

SEQ ID NO: 2947723 - RNA, 17 nt, Mycobacterium avium subsp. paratuberculosis
gauccugcagcuggcga

SEQ ID NO: 2947724 - RNA, 22 nt, Mycobacterium avium subsp. paratuberculosis
gaucgccaguccggcgccgacc

SEQ ID NO: 2947725 - RNA, 22 nt, Mycobacterium avium subsp. paratuberculosis
gaucgccaugcuggcacuccuu

SEQ ID NO: 2947726 - RNA, 14 nt, Mycobacterium avium subsp. paratuberculosis
gaucgcccacccgc

SEQ ID NO: 2947727 - RNA, 15 nt, Mycobacterium avium subsp. paratuberculosis
gaucgcccaccuggu

SEQ ID NO: 2947728 - RNA, 17 nt, Mycobacterium avium subsp. paratuberculosis
gaucgcccagcaccgcg

SEQ ID NO: 2947729 - RNA, 17 nt, Mycobacterium avium subsp. paratuberculosis
gaucgcccaucaccgca

SEQ ID NO: 2947730 - RNA, 18 nt, Mycobacterium avium subsp. paratuberculosis
gaucgcccaucaccgcac

SEQ ID NO: 2947731 - RNA, 21 nt, Mycobacterium avium subsp. paratuberculosis
gaucgcccauuugccggugua

SEQ ID NO: 2947732 - RNA, 14 nt, Mycobacterium avium subsp. paratuberculosis
gaucgccccgccgu

SEQ ID NO: 2947733 - RNA, 15 nt, Mycobacterium avium subsp. paratuberculosis
gaucgccccgccguu

SEQ ID NO: 2947734 - RNA, 13 nt, Mycobacterium avium subsp. paratuberculosis
gaucgccccgggg

SEQ ID NO: 2947735 - RNA, 15 nt, Mycobacterium avium subsp. paratuberculosis
gaucgcccgccgcga

SEQ ID NO: 2947736 - RNA, 20 nt, Mycobacterium avium subsp. paratuberculosis
gaucgcccgcuccgcgggca

SEQ ID NO: 2947737 - RNA, 13 nt, Mycobacterium avium subsp. paratuberculosis
gaucgcccgggcg

SEQ ID NO: 2947738 - RNA, 14 nt, Mycobacterium avium subsp. paratuberculosis
gaucgcccgggcgg

SEQ ID NO: 2947739 - RNA, 20 nt, Mycobacterium avium subsp. paratuberculosis
gaucgcccgguaggccgccg

SEQ ID NO: 2947740 - RNA, 17 nt, Mycobacterium avium subsp. paratuberculosis
gaucgccgacccgguug

SEQ ID NO: 2947741 - RNA, 14 nt, Mycobacterium avium subsp. paratuberculosis
gaucgccgacgcca

SEQ ID NO: 2947742 - RNA, 18 nt, Mycobacterium avium subsp. paratuberculosis
gaucgccgacgccagcac

SEQ ID NO: 2947743 - RNA, 19 nt, Mycobacterium avium subsp. paratuberculosis
gaucgccgacgccagcacg

SEQ ID NO: 2947744 - RNA, 20 nt, Mycobacterium avium subsp. paratuberculosis
gaucgccgacgccagcacgu

SEQ ID NO: 2947745 - RNA, 13 nt, Mycobacterium avium subsp. paratuberculosis
gaucgccgacguc

SEQ ID NO: 2947746 - RNA, 19 nt, Mycobacterium avium subsp. paratuberculosis
gaucgccgagguagccgcg

SEQ ID NO: 2947747 - RNA, 20 nt, Mycobacterium avium subsp. paratuberculosis
gaucgccgagguagccgcgc

SEQ ID NO: 2947748 - RNA, 21 nt, Mycobacterium avium subsp. paratuberculosis
gaucgccgagguagccgcgca

SEQ ID NO: 2947749 - RNA, 20 nt, Mycobacterium avium subsp. paratuberculosis
gaucgccgagucgaucgcca

SEQ ID NO: 2947750 - RNA, 17 nt, Mycobacterium avium subsp. paratuberculosis
gaucgccgauccggcgc

SEQ ID NO: 2947751 - RNA, 19 nt, Mycobacterium avium subsp. paratuberculosis
gaucgccgauccggcgccg

SEQ ID NO: 2947752 - RNA, 21 nt, Mycobacterium avium subsp. paratuberculosis
gaucgccgauccggcgccgcg

SEQ ID NO: 2947753 - RNA, 22 nt, Mycobacterium avium subsp. paratuberculosis
gaucgccgcaacuugcccgacg

SEQ ID NO: 2947754 - RNA, 14 nt, Mycobacterium avium subsp. paratuberculosis
gaucgccgcccacu

SEQ ID NO: 2947755 - RNA, 17 nt, Mycobacterium avium subsp. paratuberculosis
gaucgccgcccaucggc

SEQ ID NO: 2947756 - RNA, 18 nt, Mycobacterium avium subsp. paratuberculosis
gaucgccgcccaucggca

SEQ ID NO: 2947757 - RNA, 23 nt, Mycobacterium avium subsp. paratuberculosis
gaucgccgcccaucggcagcccg

SEQ ID NO: 2947758 - RNA, 12 nt, Mycobacterium avium subsp. paratuberculosis
gaucgccgcgaa

SEQ ID NO: 2947759 - RNA, 14 nt, Mycobacterium avium subsp. paratuberculosis
gaucgccgcgaaca

SEQ ID NO: 2947760 - RNA, 12 nt, Mycobacterium avium subsp. paratuberculosis
gaucgccgcgca

SEQ ID NO: 2947761 - RNA, 14 nt, Mycobacterium avium subsp. paratuberculosis
gaucgccgcgccca

SEQ ID NO: 2947762 - RNA, 16 nt, Mycobacterium avium subsp. paratuberculosis
gaucgccgcgcccagc

SEQ ID NO: 2947763 - RNA, 17 nt, Mycobacterium avium subsp. paratuberculosis
gaucgccgcgcccagca

SEQ ID NO: 2947764 - RNA, 20 nt, Mycobacterium avium subsp. paratuberculosis
gaucgccgcgcccagcacgu

SEQ ID NO: 2947765 - RNA, 14 nt, Mycobacterium avium subsp. paratuberculosis
gaucgccgcuugca

SEQ ID NO: 2947766 - RNA, 18 nt, Mycobacterium avium subsp. paratuberculosis
gaucgccggacagcgggc

SEQ ID NO: 2947767 - RNA, 19 nt, Mycobacterium avium subsp. paratuberculosis
gaucgccggacagcgggcc

SEQ ID NO: 2947768 - RNA, 20 nt, Mycobacterium avium subsp. paratuberculosis
gaucgccggacagcgggccg

SEQ ID NO: 2947769 - RNA, 15 nt, Mycobacterium avium subsp. paratuberculosis
gaucgccggaucgag

SEQ ID NO: 2947770 - RNA, 23 nt, Mycobacterium avium subsp. paratuberculosis
gaucgccggaucggucucggugg

SEQ ID NO: 2947771 - RNA, 16 nt, Mycobacterium avium subsp. paratuberculosis
gaucgccggcgccgga

SEQ ID NO: 2947772 - RNA, 13 nt, Mycobacterium avium subsp. paratuberculosis
gaucgccggggcg

SEQ ID NO: 2947773 - RNA, 13 nt, Mycobacterium avium subsp. paratuberculosis
gaucgccgggucg

SEQ ID NO: 2947774 - RNA, 14 nt, Mycobacterium avium subsp. paratuberculosis
gaucgccgggucgc

SEQ ID NO: 2947775 - RNA, 20 nt, Mycobacterium avium subsp. paratuberculosis
gaucgccgggucgcacgccg

SEQ ID NO: 2947776 - RNA, 22 nt, Mycobacterium avium subsp. paratuberculosis
gaucgccgggucgcacgccggu

SEQ ID NO: 2947777 - RNA, 17 nt, Mycobacterium avium subsp. paratuberculosis
gaucgccggugcggccg

SEQ ID NO: 2947778 - RNA, 18 nt, Mycobacterium avium subsp. paratuberculosis
gaucgccggugcggccgc

SEQ ID NO: 2947779 - RNA, 19 nt, Mycobacterium avium subsp. paratuberculosis
gaucgccggugcggccgcg

SEQ ID NO: 2947780 - RNA, 15 nt, Mycobacterium avium subsp. paratuberculosis
gaucgccgugagauc

SEQ ID NO: 2947781 - RNA, 23 nt, Mycobacterium avium subsp. paratuberculosis
gaucgccgugagauccagcagcc

SEQ ID NO: 2947782 - RNA, 16 nt, Mycobacterium avium subsp. paratuberculosis
gaucgccuccgucagc

SEQ ID NO: 2947783 - RNA, 22 nt, Mycobacterium avium subsp. paratuberculosis
gaucgccuccgucagcgccgcc

SEQ ID NO: 2947784 - RNA, 22 nt, Mycobacterium avium subsp. paratuberculosis
gaucgccuccucauaggcguac

SEQ ID NO: 2947785 - RNA, 14 nt, Mycobacterium avium subsp. paratuberculosis
gaucgccugauacg

SEQ ID NO: 2947786 - RNA, 21 nt, Mycobacterium avium subsp. paratuberculosis
gaucgccugauacgacguccg

SEQ ID NO: 2947787 - RNA, 18 nt, Mycobacterium avium subsp. paratuberculosis
gaucgccuggcagcugcc

SEQ ID NO: 2947788 - RNA, 17 nt, Mycobacterium avium subsp. paratuberculosis
gaucgcgaacgcgccgg

SEQ ID NO: 2947789 - RNA, 20 nt, Mycobacterium avium subsp. paratuberculosis
gaucgcgaacgcgccgguga

SEQ ID NO: 2947790 - RNA, 21 nt, Mycobacterium avium subsp. paratuberculosis
gaucgcgaagaccagcguguc

SEQ ID NO: 2947791 - RNA, 17 nt, Mycobacterium avium subsp. paratuberculosis
gaucgcgaccaccggcc

SEQ ID NO: 2947792 - RNA, 20 nt, Mycobacterium avium subsp. paratuberculosis
gaucgcgaccaccggccgac

SEQ ID NO: 2947793 - RNA, 20 nt, Mycobacterium avium subsp. paratuberculosis
gaucgcgacggccggggcca

SEQ ID NO: 2947794 - RNA, 12 nt, Mycobacterium avium subsp. paratuberculosis
gaucgcgaucac

SEQ ID NO: 2947795 - RNA, 17 nt, Mycobacterium avium subsp. paratuberculosis
gaucgcgaucaccgcgg

SEQ ID NO: 2947796 - RNA, 18 nt, Mycobacterium avium subsp. paratuberculosis
gaucgcgaucaccgcggc

SEQ ID NO: 2947797 - RNA, 21 nt, Mycobacterium avium subsp. paratuberculosis
gaucgcgauccgggcgccggc

SEQ ID NO: 2947798 - RNA, 22 nt, Mycobacterium avium subsp. paratuberculosis
gaucgcgauccgggcgccggcc

SEQ ID NO: 2947799 - RNA, 14 nt, Mycobacterium avium subsp. paratuberculosis
gaucgcgaucgccg

SEQ ID NO: 2947800 - RNA, 18 nt, Mycobacterium avium subsp. paratuberculosis
gaucgcgaugucgacgga

SEQ ID NO: 2947801 - RNA, 17 nt, Mycobacterium avium subsp. paratuberculosis
gaucgcgcaggugaugc

SEQ ID NO: 2947802 - RNA, 16 nt, Mycobacterium avium subsp. paratuberculosis
gaucgcgcaucacccg

SEQ ID NO: 2947803 - RNA, 22 nt, Mycobacterium avium subsp. paratuberculosis
gaucgcgcaucacccggcgcgc

SEQ ID NO: 2947804 - RNA, 23 nt, Mycobacterium avium subsp. paratuberculosis
gaucgcgcaucacccggcgcgcg

SEQ ID NO: 2947805 - RNA, 12 nt, Mycobacterium avium subsp. paratuberculosis
gaucgcgccggc

SEQ ID NO: 2947806 - RNA, 14 nt, Mycobacterium avium subsp. paratuberculosis
gaucgcgccggccg

SEQ ID NO: 2947807 - RNA, 15 nt, Mycobacterium avium subsp. paratuberculosis
gaucgcgccggccgc

SEQ ID NO: 2947808 - RNA, 19 nt, Mycobacterium avium subsp. paratuberculosis
gaucgcgccggccgccgcg

SEQ ID NO: 2947809 - RNA, 22 nt, Mycobacterium avium subsp. paratuberculosis
gaucggcgagccgggaccgugc

SEQ ID NO: 2947810 - RNA, 19 nt, Mycobacterium avium subsp. paratuberculosis
gaucggcgccacgaccagc

SEQ ID NO: 2947811 - RNA, 17 nt, Mycobacterium avium subsp. paratuberculosis
gaucggcgcccaccgcg

SEQ ID NO: 2947812 - RNA, 22 nt, Mycobacterium avium subsp. paratuberculosis
gaucggcgcccaccgcggcgcg

SEQ ID NO: 2947813 - RNA, 19 nt, Mycobacterium avium subsp. paratuberculosis
gaucggcgccuugguccgc

SEQ ID NO: 2947814 - RNA, 17 nt, Mycobacterium avium subsp. paratuberculosis
gaucggcgcgaagucga

SEQ ID NO: 2947815 - RNA, 15 nt, Mycobacterium avium subsp. paratuberculosis
gaucggcgcgccgaa

SEQ ID NO: 2947816 - RNA, 15 nt, Mycobacterium avium subsp. paratuberculosis
gaucggcgcggcgaa

SEQ ID NO: 2947817 - RNA, 15 nt, Mycobacterium avium subsp. paratuberculosis
gaucggcgcgucggc

SEQ ID NO: 2947818 - RNA, 23 nt, Mycobacterium avium subsp. paratuberculosis
gaucggcggaacccggguggccc

SEQ ID NO: 2947819 - RNA, 16 nt, Mycobacterium avium subsp. paratuberculosis
gaucggcggccaccag

SEQ ID NO: 2947820 - RNA, 19 nt, Mycobacterium avium subsp. paratuberculosis
gaucggcggccaccagccg

SEQ ID NO: 2947821 - RNA, 20 nt, Mycobacterium avium subsp. paratuberculosis
gaucggcggccaccagccgg

SEQ ID NO: 2947822 - RNA, 21 nt, Mycobacterium avium subsp. paratuberculosis
gaucggcggccaccagccggc

SEQ ID NO: 2947823 - RNA, 15 nt, Mycobacterium avium subsp. paratuberculosis
gaucggcggccugcg

SEQ ID NO: 2947824 - RNA, 20 nt, Mycobacterium avium subsp. paratuberculosis
gaucggcggccugcggcggc

SEQ ID NO: 2947825 - RNA, 23 nt, Mycobacterium avium subsp. paratuberculosis
gaucggcggcgacggcgacggcc

SEQ ID NO: 2947826 - RNA, 12 nt, Mycobacterium avium subsp. paratuberculosis
gaucggcggcgg

SEQ ID NO: 2947827 - RNA, 13 nt, Mycobacterium avium subsp. paratuberculosis
gaucggcggcucg

SEQ ID NO: 2947828 - RNA, 15 nt, Mycobacterium avium subsp. paratuberculosis
gaucggcggcucgcc

SEQ ID NO: 2947829 - RNA, 14 nt, Mycobacterium avium subsp. paratuberculosis
gaucggcgggaccc

SEQ ID NO: 2947830 - RNA, 18 nt, Mycobacterium avium subsp. paratuberculosis
gaucggcgggacccgcga

SEQ ID NO: 2947831 - RNA, 20 nt, Mycobacterium avium subsp. paratuberculosis
gaucggcgggacccgcgacc

SEQ ID NO: 2947832 - RNA, 16 nt, Mycobacterium avium subsp. paratuberculosis
gaucggcgggcgccga

SEQ ID NO: 2947833 - RNA, 23 nt, Mycobacterium avium subsp. paratuberculosis
gaucggcgggugcgggcgcugca

SEQ ID NO: 2947834 - RNA, 18 nt, Mycobacterium avium subsp. paratuberculosis
gaucggcgguccgccgca

SEQ ID NO: 2947835 - RNA, 17 nt, Mycobacterium avium subsp. paratuberculosis
gaucggcgugccggacu

SEQ ID NO: 2947836 - RNA, 16 nt, Mycobacterium avium subsp. paratuberculosis
gaucggcuagcagcuc

SEQ ID NO: 2947837 - RNA, 18 nt, Mycobacterium avium subsp. paratuberculosis
gaucggcuagcagcuccg

SEQ ID NO: 2947838 - RNA, 23 nt, Mycobacterium avium subsp. paratuberculosis
gaucggcuagcagcuccggucgg

SEQ ID NO: 2947839 - RNA, 16 nt, Mycobacterium avium subsp. paratuberculosis
gaucggcuccagcgcc

SEQ ID NO: 2947840 - RNA, 20 nt, Mycobacterium avium subsp. paratuberculosis
gaucggcuccagcgcccgcc

SEQ ID NO: 2947841 - RNA, 21 nt, Mycobacterium avium subsp. paratuberculosis
gaucggcuccagcgcccgccg

SEQ ID NO: 2947842 - RNA, 22 nt, Mycobacterium avium subsp. paratuberculosis
gaucggcuccagcgcccgccgc

SEQ ID NO: 2947843 - RNA, 19 nt, Mycobacterium avium subsp. paratuberculosis
gaucggcugcgggccagcg

SEQ ID NO: 2947844 - RNA, 22 nt, Mycobacterium avium subsp. paratuberculosis
gaucggcuuggggaagccggcc

SEQ ID NO: 2947845 - RNA, 23 nt, Mycobacterium avium subsp. paratuberculosis
gaucggcuuggggaagccggcca

SEQ ID NO: 2947846 - RNA, 18 nt, Mycobacterium avium subsp. paratuberculosis
gaucggcuuggugggcgc

SEQ ID NO: 2947847 - RNA, 16 nt, Mycobacterium avium subsp. paratuberculosis
gaucgggaacagcccg

SEQ ID NO: 2947848 - RNA, 17 nt, Mycobacterium avium subsp. paratuberculosis
gaucgggaacagcccgc

SEQ ID NO: 2947849 - RNA, 20 nt, Mycobacterium avium subsp. paratuberculosis
gaucgggaacggguagugca

SEQ ID NO: 2947850 - RNA, 15 nt, Mycobacterium avium subsp. paratuberculosis
gaucgggaaguccuc

SEQ ID NO: 2947851 - RNA, 15 nt, Mycobacterium avium subsp. paratuberculosis
gaucgggaccgucac

SEQ ID NO: 2947852 - RNA, 13 nt, Mycobacterium avium subsp. paratuberculosis
gaucgggaucggc

SEQ ID NO: 2947853 - RNA, 19 nt, Mycobacterium avium subsp. paratuberculosis
gaucgggcguugcgccgcg

SEQ ID NO: 2947854 - RNA, 19 nt, Mycobacterium avium subsp. paratuberculosis
gaucggggaauccuggccg

SEQ ID NO: 2947855 - RNA, 20 nt, Mycobacterium avium subsp. paratuberculosis
gaucggggaauccuggccga

SEQ ID NO: 2947856 - RNA, 14 nt, Mycobacterium avium subsp. paratuberculosis
gaucggggccagga

SEQ ID NO: 2947857 - RNA, 17 nt, Mycobacterium avium subsp. paratuberculosis
gaucggggcccaccccg

SEQ ID NO: 2947858 - RNA, 21 nt, Mycobacterium avium subsp. paratuberculosis
gaucggggcccaccccggaca

SEQ ID NO: 2947859 - RNA, 14 nt, Mycobacterium avium subsp. paratuberculosis
gaucggggcgcagc

SEQ ID NO: 2947860 - RNA, 14 nt, Mycobacterium avium subsp. paratuberculosis
gaucggggugccgc

SEQ ID NO: 2947861 - RNA, 21 nt, Mycobacterium avium subsp. paratuberculosis
gaucggguaacccuccggcgc

SEQ ID NO: 2947862 - RNA, 16 nt, Mycobacterium avium subsp. paratuberculosis
gaucggguagacgucg

SEQ ID NO: 2947863 - RNA, 21 nt, Mycobacterium avium subsp. paratuberculosis
gaucgggucaccggccgagcc

SEQ ID NO: 2947864 - RNA, 15 nt, Mycobacterium avium subsp. paratuberculosis
gaucgggucccagau

SEQ ID NO: 2947865 - RNA, 19 nt, Mycobacterium avium subsp. paratuberculosis
gaucgggucccagaugcgc

SEQ ID NO: 2947866 - RNA, 20 nt, Mycobacterium avium subsp. paratuberculosis
gaucgggucccagaugcgcg

SEQ ID NO: 2947867 - RNA, 14 nt, Mycobacterium avium subsp. paratuberculosis
gaucgggucgcccg

SEQ ID NO: 2947868 - RNA, 17 nt, Mycobacterium avium subsp. paratuberculosis
gaucgggugagacggcc

SEQ ID NO: 2947869 - RNA, 21 nt, Mycobacterium avium subsp. paratuberculosis
gaucgggugagacggccagca

SEQ ID NO: 2947870 - RNA, 13 nt, Mycobacterium avium subsp. paratuberculosis
gaucggguggccc

SEQ ID NO: 2947871 - RNA, 16 nt, Mycobacterium avium subsp. paratuberculosis
gaucgguagcaggacc

SEQ ID NO: 2947872 - RNA, 15 nt, Mycobacterium avium subsp. paratuberculosis
gaucggucucggugg

SEQ ID NO: 2947873 - RNA, 13 nt, Mycobacterium avium subsp. paratuberculosis
gaucggucugccu

SEQ ID NO: 2947874 - RNA, 17 nt, Mycobacterium avium subsp. paratuberculosis
gaucggucugccuggcg

SEQ ID NO: 2947875 - RNA, 19 nt, Mycobacterium avium subsp. paratuberculosis
gaucggugaacccgccggc

SEQ ID NO: 2947876 - RNA, 20 nt, Mycobacterium avium subsp. paratuberculosis
gaucggugaacccgccggcg

SEQ ID NO: 2947877 - RNA, 18 nt, Mycobacterium avium subsp. paratuberculosis
gaucggugaagcggcgcg

SEQ ID NO: 2947878 - RNA, 13 nt, Mycobacterium avium subsp. paratuberculosis
gaucggugcaggc

SEQ ID NO: 2947879 - RNA, 17 nt, Mycobacterium avium subsp. paratuberculosis
gaucggugcaggccgcg

SEQ ID NO: 2947880 - RNA, 15 nt, Mycobacterium avium subsp. paratuberculosis
gaucggugcccgcgg

SEQ ID NO: 2947881 - RNA, 13 nt, Mycobacterium avium subsp. paratuberculosis
gaucggugccgac

SEQ ID NO: 2947882 - RNA, 21 nt, Mycobacterium avium subsp. paratuberculosis
gaucggugccgacggugcgug

SEQ ID NO: 2947883 - RNA, 13 nt, Mycobacterium avium subsp. paratuberculosis
gaucggugcgcgg

SEQ ID NO: 2947884 - RNA, 14 nt, Mycobacterium avium subsp. paratuberculosis
gaucggugcgcggc

SEQ ID NO: 2947885 - RNA, 18 nt, Mycobacterium avium subsp. paratuberculosis
gaucggugcgcggcgaag

SEQ ID NO: 2947886 - RNA, 20 nt, Mycobacterium avium subsp. paratuberculosis
gaucgguguccagccgcacg

SEQ ID NO: 2947887 - RNA, 22 nt, Mycobacterium avium subsp. paratuberculosis
gaucgucaccgaccccucggcg

SEQ ID NO: 2947888 - RNA, 22 nt, Mycobacterium avium subsp. paratuberculosis
gaucgucaccgugccgucgcug

SEQ ID NO: 2947889 - RNA, 19 nt, Mycobacterium avium subsp. paratuberculosis
gaucgucaugccuuggccg

SEQ ID NO: 2947890 - RNA, 20 nt, Mycobacterium avium subsp. paratuberculosis
gaucguccaucgcgucgucc

SEQ ID NO: 2947891 - RNA, 22 nt, Mycobacterium avium subsp. paratuberculosis
gaucgucgaccugcucgucggu

SEQ ID NO: 2947892 - RNA, 18 nt, Mycobacterium avium subsp. paratuberculosis
gaucgucgagugcucgau

SEQ ID NO: 2947893 - RNA, 17 nt, Mycobacterium avium subsp. paratuberculosis
gaucucgucgcgcagcu

SEQ ID NO: 2947894 - RNA, 15 nt, Mycobacterium avium subsp. paratuberculosis
gaucucgucgcggcu

SEQ ID NO: 2947895 - RNA, 22 nt, Mycobacterium avium subsp. paratuberculosis
gaucucgucggcggcggccugc

SEQ ID NO: 2947896 - RNA, 16 nt, Mycobacterium avium subsp. paratuberculosis
gaucucgucgggcacc

SEQ ID NO: 2947897 - RNA, 16 nt, Mycobacterium avium subsp. paratuberculosis
gaucucgucggugagg

SEQ ID NO: 2947898 - RNA, 15 nt, Mycobacterium avium subsp. paratuberculosis
gaucucgugccgcac

SEQ ID NO: 2947899 - RNA, 18 nt, Mycobacterium avium subsp. paratuberculosis
gaucucgugccgcacccg

SEQ ID NO: 2947900 - RNA, 20 nt, Mycobacterium avium subsp. paratuberculosis
gaucucgugccgcacccgau

SEQ ID NO: 2947901 - RNA, 17 nt, Mycobacterium avium subsp. paratuberculosis
gaucucuucgccggaca

SEQ ID NO: 2947902 - RNA, 18 nt, Mycobacterium avium subsp. paratuberculosis
gaucugaccgagcagcgg

SEQ ID NO: 2947903 - RNA, 21 nt, Mycobacterium avium subsp. paratuberculosis
gaucugaccgagcagcggggu

SEQ ID NO: 2947904 - RNA, 20 nt, Mycobacterium avium subsp. paratuberculosis
gaucugauaggucagcucga

SEQ ID NO: 2947905 - RNA, 18 nt, Mycobacterium avium subsp. paratuberculosis
gaucugcacgucggcggc

SEQ ID NO: 2947906 - RNA, 19 nt, Mycobacterium avium subsp. paratuberculosis
gaucugcacgucggcggcc

SEQ ID NO: 2947907 - RNA, 20 nt, Mycobacterium avium subsp. paratuberculosis
gaucugcacgucggcggccg

SEQ ID NO: 2947908 - RNA, 15 nt, Mycobacterium avium subsp. paratuberculosis
gaucugcgcaagaag

SEQ ID NO: 2947909 - RNA, 18 nt, Mycobacterium avium subsp. paratuberculosis
gaucugcgcaagaagggc

SEQ ID NO: 2947910 - RNA, 19 nt, Mycobacterium avium subsp. paratuberculosis
gaucugcgucauggagauc

SEQ ID NO: 2947911 - RNA, 18 nt, Mycobacterium avium subsp. paratuberculosis
gaucugcuccgggguggc

SEQ ID NO: 2947912 - RNA, 14 nt, Mycobacterium avium subsp. paratuberculosis
gaucugcuccucgg

SEQ ID NO: 2947913 - RNA, 15 nt, Mycobacterium avium subsp. paratuberculosis
gaucugcuccucggu

SEQ ID NO: 2947914 - RNA, 22 nt, Mycobacterium avium subsp. paratuberculosis
gaucugcucgaugcggcccugg

SEQ ID NO: 2947915 - RNA, 23 nt, Mycobacterium avium subsp. paratuberculosis
gaucugcucgaugcggcccuggu

SEQ ID NO: 2947916 - RNA, 12 nt, Mycobacterium avium subsp. paratuberculosis
gaucugcucggc

SEQ ID NO: 2947917 - RNA, 21 nt, Mycobacterium avium subsp. paratuberculosis
gaucugcucgugcaaaccgga

SEQ ID NO: 2947918 - RNA, 13 nt, Mycobacterium avium subsp. paratuberculosis
gaucuggcccugg

SEQ ID NO: 2947919 - RNA, 16 nt, Mycobacterium avium subsp. paratuberculosis
gaucugggaucggugc

SEQ ID NO: 2947920 - RNA, 18 nt, Mycobacterium avium subsp. paratuberculosis
gaucugggaucggugcgc

SEQ ID NO: 2947921 - RNA, 19 nt, Mycobacterium avium subsp. paratuberculosis
gaucugggaucggugcgcg

SEQ ID NO: 2947922 - RNA, 14 nt, Mycobacterium avium subsp. paratuberculosis
gaucugggcggcgg

SEQ ID NO: 2947923 - RNA, 15 nt, Mycobacterium avium subsp. paratuberculosis
gaucugggcggcggg

SEQ ID NO: 2947924 - RNA, 19 nt, Mycobacterium avium subsp. paratuberculosis
gaucugggcggcgggacgg

SEQ ID NO: 2947925 - RNA, 20 nt, Mycobacterium avium subsp. paratuberculosis
gaucugggugagcgacacca

SEQ ID NO: 2947926 - RNA, 23 nt, Mycobacterium avium subsp. paratuberculosis
gaucuggguuugggucaucgacu

SEQ ID NO: 2947927 - RNA, 22 nt, Mycobacterium avium subsp. paratuberculosis
gaucugguaugccuuggcccgc

SEQ ID NO: 2947928 - RNA, 15 nt, Mycobacterium avium subsp. paratuberculosis
gaucuggucggccag

SEQ ID NO: 2947929 - RNA, 16 nt, Mycobacterium avium subsp. paratuberculosis
gaucuggucggccagc

SEQ ID NO: 2947930 - RNA, 18 nt, Mycobacterium avium subsp. paratuberculosis
gaucuggucggccagcgc

SEQ ID NO: 2947931 - RNA, 19 nt, Mycobacterium avium subsp. paratuberculosis
gaucuggucggccagcgcg

SEQ ID NO: 2947932 - RNA, 21 nt, Mycobacterium avium subsp. paratuberculosis
gaucuggucggccagcgcgcg

SEQ ID NO: 2947933 - RNA, 22 nt, Mycobacterium avium subsp. paratuberculosis
gaucuggucggccagcgcgcgc

SEQ ID NO: 2947934 - RNA, 13 nt, Mycobacterium avium subsp. paratuberculosis
gaucuggugcgcg

SEQ ID NO: 2947935 - RNA, 16 nt, Mycobacterium avium subsp. paratuberculosis
gaucuggugcgcgcgc

SEQ ID NO: 2947936 - RNA, 18 nt, Mycobacterium avium subsp. paratuberculosis
gaucuggugggcgggcac

SEQ ID NO: 2947937 - RNA, 17 nt, Mycobacterium avium subsp. paratuberculosis
gaucugguucaccgcca

SEQ ID NO: 2947938 - RNA, 23 nt, Mycobacterium avium subsp. paratuberculosis
gaucugguucaccgccaccagca

SEQ ID NO: 2947939 - RNA, 15 nt, Mycobacterium avium subsp. paratuberculosis
gaucuguucggcggc

SEQ ID NO: 2947940 - RNA, 19 nt, Mycobacterium avium subsp. paratuberculosis
gaucuguucggcggcgauc

SEQ ID NO: 2947941 - RNA, 20 nt, Mycobacterium avium subsp. paratuberculosis
gaucuuccaucacgccccgg

SEQ ID NO: 2947942 - RNA, 15 nt, Mycobacterium avium subsp. paratuberculosis
gaucuucgcggcgua

SEQ ID NO: 2947943 - RNA, 14 nt, Mycobacterium avium subsp. paratuberculosis
gaucuucucgcugc

SEQ ID NO: 2947944 - RNA, 14 nt, Mycobacterium avium subsp. paratuberculosis
gaucuugacggcga

SEQ ID NO: 2947945 - RNA, 13 nt, Mycobacterium avium subsp. paratuberculosis
gaucuugaucgcc

SEQ ID NO: 2947946 - RNA, 19 nt, Mycobacterium avium subsp. paratuberculosis
gaucuugccgucggccgcc

SEQ ID NO: 2947947 - RNA, 19 nt, Mycobacterium avium subsp. paratuberculosis
gaucuugcgaaagcgcggg

SEQ ID NO: 2947948 - RNA, 16 nt, Mycobacterium avium subsp. paratuberculosis
gaucuuggugaagccg

SEQ ID NO: 2947949 - RNA, 18 nt, Mycobacterium avium subsp. paratuberculosis
gaucuuugcauacagcag

SEQ ID NO: 2947950 - RNA, 18 nt, Mycobacterium avium subsp. paratuberculosis
gaugaaaccccagccggc

SEQ ID NO: 2947951 - RNA, 17 nt, Mycobacterium avium subsp. paratuberculosis
gaugaaaccggccagca

SEQ ID NO: 2947952 - RNA, 17 nt, Mycobacterium avium subsp. paratuberculosis
gaugaaacuuccgcccg

SEQ ID NO: 2947953 - RNA, 21 nt, Mycobacterium avium subsp. paratuberculosis
gaugaaacuuccgcccggcga

SEQ ID NO: 2947954 - RNA, 16 nt, Mycobacterium avium subsp. paratuberculosis
gaugaacacggucgcc

SEQ ID NO: 2947955 - RNA, 19 nt, Mycobacterium avium subsp. paratuberculosis
gaugaacacggucgccggc

SEQ ID NO: 2947956 - RNA, 12 nt, Mycobacterium avium subsp. paratuberculosis
gaugaacagcac

SEQ ID NO: 2947957 - RNA, 23 nt, Mycobacterium avium subsp. paratuberculosis
gaugaacgccucgagcgcccggg

SEQ ID NO: 2947958 - RNA, 18 nt, Mycobacterium avium subsp. paratuberculosis
gaugaacgcguugaccag

SEQ ID NO: 2947959 - RNA, 23 nt, Mycobacterium avium subsp. paratuberculosis
gaugaacgucccguuggucucga

SEQ ID NO: 2947960 - RNA, 23 nt, Mycobacterium avium subsp. paratuberculosis
gaugaacucgcgggcgagcagcg

SEQ ID NO: 2947961 - RNA, 22 nt, Mycobacterium avium subsp. paratuberculosis
gaugaacucgugcggcgccgcc

SEQ ID NO: 2947962 - RNA, 23 nt, Mycobacterium avium subsp. paratuberculosis
gaugaacuugccgaucaccucga

SEQ ID NO: 2947963 - RNA, 19 nt, Mycobacterium avium subsp. paratuberculosis
gaugaagaccuggccggcc

SEQ ID NO: 2947964 - RNA, 23 nt, Mycobacterium avium subsp. paratuberculosis
gaugaagaugaucucgccgagcg

SEQ ID NO: 2947965 - RNA, 13 nt, Mycobacterium avium subsp. paratuberculosis
gaugaagccgccc

SEQ ID NO: 2947966 - RNA, 15 nt, Mycobacterium avium subsp. paratuberculosis
gaugaagccgccgac

SEQ ID NO: 2947967 - RNA, 19 nt, Mycobacterium avium subsp. paratuberculosis
gaugaaggucgcggacugg

SEQ ID NO: 2947968 - RNA, 23 nt, Mycobacterium avium subsp. paratuberculosis
gaugaagugcgccagcgacggcc

SEQ ID NO: 2947969 - RNA, 20 nt, Mycobacterium avium subsp. paratuberculosis
gaugaauccgcgcagcagcg

SEQ ID NO: 2947970 - RNA, 20 nt, Mycobacterium avium subsp. paratuberculosis
gaugaaucgucccgucgacc

SEQ ID NO: 2947971 - RNA, 15 nt, Mycobacterium avium subsp. paratuberculosis
gaugaauucggcgau

SEQ ID NO: 2947972 - RNA, 21 nt, Mycobacterium avium subsp. paratuberculosis
gaugacaaccaucgaggcgau

SEQ ID NO: 2947973 - RNA, 23 nt, Mycobacterium avium subsp. paratuberculosis
gaugacaaccaucgaggcgauca

SEQ ID NO: 2947974 - RNA, 23 nt, Mycobacterium avium subsp. paratuberculosis
gaugacaccgcggaccaccgcgu

SEQ ID NO: 2947975 - RNA, 14 nt, Mycobacterium avium subsp. paratuberculosis
gaugaccacccucg

SEQ ID NO: 2947976 - RNA, 18 nt, Mycobacterium avium subsp. paratuberculosis
gaugaccaccgcugugga

SEQ ID NO: 2947977 - RNA, 22 nt, Mycobacterium avium subsp. paratuberculosis
gaugaugccgucacugucggcg

SEQ ID NO: 2947978 - RNA, 23 nt, Mycobacterium avium subsp. paratuberculosis
gaugaugccgucacugucggcgc

SEQ ID NO: 2947979 - RNA, 16 nt, Mycobacterium avium subsp. paratuberculosis
gaugauggccgcgccg

SEQ ID NO: 2947980 - RNA, 15 nt, Mycobacterium avium subsp. paratuberculosis
gaugaugggcgaucg

SEQ ID NO: 2947981 - RNA, 16 nt, Mycobacterium avium subsp. paratuberculosis
gaugaugggcgaucga

SEQ ID NO: 2947982 - RNA, 13 nt, Mycobacterium avium subsp. paratuberculosis
gaugaugguggcg

SEQ ID NO: 2947983 - RNA, 15 nt, Mycobacterium avium subsp. paratuberculosis
gaugaugucguuggu

SEQ ID NO: 2947984 - RNA, 17 nt, Mycobacterium avium subsp. paratuberculosis
gaugauguucuccggcc

SEQ ID NO: 2947985 - RNA, 23 nt, Mycobacterium avium subsp. paratuberculosis
gaugauuucggcguggcgguggc

SEQ ID NO: 2947986 - RNA, 21 nt, Mycobacterium avium subsp. paratuberculosis
gaugcacaaccgcugcugcug

SEQ ID NO: 2947987 - RNA, 18 nt, Mycobacterium avium subsp. paratuberculosis
gaugcaccggcagccaga

SEQ ID NO: 2947988 - RNA, 20 nt, Mycobacterium avium subsp. paratuberculosis
gaugcacuucgcuguaguag

SEQ ID NO: 2947989 - RNA, 15 nt, Mycobacterium avium subsp. paratuberculosis
gaugcagaucaccac

SEQ ID NO: 2947990 - RNA, 18 nt, Mycobacterium avium subsp. paratuberculosis
gaugcagaucaccacggu

SEQ ID NO: 2947991 - RNA, 21 nt, Mycobacterium avium subsp. paratuberculosis
gaugcagcacauccagcccug

SEQ ID NO: 2947992 - RNA, 12 nt, Mycobacterium avium subsp. paratuberculosis
gaugcagcgccu

SEQ ID NO: 2947993 - RNA, 14 nt, Mycobacterium avium subsp. paratuberculosis
gaugccagacgaac

SEQ ID NO: 2947994 - RNA, 17 nt, Mycobacterium avium subsp. paratuberculosis
gaugccagacgaacgcg

SEQ ID NO: 2947995 - RNA, 21 nt, Mycobacterium avium subsp. paratuberculosis
gaugccagacgaacgcggccg

SEQ ID NO: 2947996 - RNA, 23 nt, Mycobacterium avium subsp. paratuberculosis
gaugccagacgaacgcggccgcc

SEQ ID NO: 2947997 - RNA, 21 nt, Mycobacterium avium subsp. paratuberculosis
gaugccagcagguccgccggu

SEQ ID NO: 2947998 - RNA, 22 nt, Mycobacterium avium subsp. paratuberculosis
gaugccaguccugggccggggc

SEQ ID NO: 2947999 - RNA, 12 nt, Mycobacterium avium subsp. paratuberculosis
gaugcccacccg

SEQ ID NO: 2948000 - RNA, 18 nt, Mycobacterium avium subsp. paratuberculosis
gaugcccacccgcucggc

SEQ ID NO: 2948001 - RNA, 19 nt, Mycobacterium avium subsp. paratuberculosis
gaugcccacccgcucggcg

SEQ ID NO: 2948002 - RNA, 21 nt, Mycobacterium avium subsp. paratuberculosis
gaugcccacccgcucggcgau

SEQ ID NO: 2948003 - RNA, 13 nt, Mycobacterium avium subsp. paratuberculosis
gaugcccagcacc

SEQ ID NO: 2948004 - RNA, 14 nt, Mycobacterium avium subsp. paratuberculosis
gaugcccagcagcg

SEQ ID NO: 2948005 - RNA, 24 nt, Mycobacterium avium subsp. paratuberculosis
gaugcccagcagcggggcgagcug

SEQ ID NO: 2948006 - RNA, 14 nt, Mycobacterium avium subsp. paratuberculosis
gaugcccagcagga

SEQ ID NO: 2948007 - RNA, 13 nt, Mycobacterium avium subsp. paratuberculosis
gaugcccagcccc

SEQ ID NO: 2948008 - RNA, 13 nt, Mycobacterium avium subsp. paratuberculosis
gaugcccagcgcg

SEQ ID NO: 2948009 - RNA, 17 nt, Mycobacterium avium subsp. paratuberculosis
gaugcccagcgcgcggu

SEQ ID NO: 2948010 - RNA, 19 nt, Mycobacterium avium subsp. paratuberculosis
gaugcccagcgcgcggugc

SEQ ID NO: 2948011 - RNA, 17 nt, Mycobacterium avium subsp. paratuberculosis
gaugcccaggcccacca

SEQ ID NO: 2948012 - RNA, 22 nt, Mycobacterium avium subsp. paratuberculosis
gaugcccaggcccaccagcugg

SEQ ID NO: 2948013 - RNA, 13 nt, Mycobacterium avium subsp. paratuberculosis
gaugcccaggccg

SEQ ID NO: 2948014 - RNA, 14 nt, Mycobacterium avium subsp. paratuberculosis
gaugcccaggccgg

SEQ ID NO: 2948015 - RNA, 15 nt, Mycobacterium avium subsp. paratuberculosis
gaugcccaggccggc

SEQ ID NO: 2948016 - RNA, 16 nt, Mycobacterium avium subsp. paratuberculosis
gaugcccaggccggcg

SEQ ID NO: 2948017 - RNA, 15 nt, Mycobacterium avium subsp. paratuberculosis
gaugcccagggcgcg

SEQ ID NO: 2948018 - RNA, 16 nt, Mycobacterium avium subsp. paratuberculosis
gaugcccaucacgccc

SEQ ID NO: 2948019 - RNA, 19 nt, Mycobacterium avium subsp. paratuberculosis
gaugcccaucacgccccag

SEQ ID NO: 2948020 - RNA, 15 nt, Mycobacterium avium subsp. paratuberculosis
gaugccccaggcgaa

SEQ ID NO: 2948021 - RNA, 17 nt, Mycobacterium avium subsp. paratuberculosis
gaugccccaggcgaaca

SEQ ID NO: 2948022 - RNA, 17 nt, Mycobacterium avium subsp. paratuberculosis
gaugcccgacaccgccc

SEQ ID NO: 2948023 - RNA, 19 nt, Mycobacterium avium subsp. paratuberculosis
gaugcccgccccgcccggc

SEQ ID NO: 2948024 - RNA, 21 nt, Mycobacterium avium subsp. paratuberculosis
gaugcccgccccgcccggcgg

SEQ ID NO: 2948025 - RNA, 21 nt, Mycobacterium avium subsp. paratuberculosis
gaugcccgccccggacaucca

SEQ ID NO: 2948026 - RNA, 14 nt, Mycobacterium avium subsp. paratuberculosis
gaugcccgccggcc

SEQ ID NO: 2948027 - RNA, 19 nt, Mycobacterium avium subsp. paratuberculosis
gaugcccgcguccugcagc

SEQ ID NO: 2948028 - RNA, 12 nt, Mycobacterium avium subsp. paratuberculosis
gaugcccgggcc

SEQ ID NO: 2948029 - RNA, 16 nt, Mycobacterium avium subsp. paratuberculosis
gaugcccgggccgucc

SEQ ID NO: 2948030 - RNA, 14 nt, Mycobacterium avium subsp. paratuberculosis
gaugcccggggugc

SEQ ID NO: 2948031 - RNA, 21 nt, Mycobacterium avium subsp. paratuberculosis
gaugcccggggugcuggcgua

SEQ ID NO: 2948032 - RNA, 19 nt, Mycobacterium avium subsp. paratuberculosis
gaugcccgucacggccguc

SEQ ID NO: 2948033 - RNA, 19 nt, Mycobacterium avium subsp. paratuberculosis
gaugcccgugaucgccacg

SEQ ID NO: 2948034 - RNA, 16 nt, Mycobacterium avium subsp. paratuberculosis
gaugcccuccagcacc

SEQ ID NO: 2948035 - RNA, 15 nt, Mycobacterium avium subsp. paratuberculosis
gaugcccucgccggu

SEQ ID NO: 2948036 - RNA, 16 nt, Mycobacterium avium subsp. paratuberculosis
gaugcccugccccauc

SEQ ID NO: 2948037 - RNA, 17 nt, Mycobacterium avium subsp. paratuberculosis
gaugcccuuggccagca

SEQ ID NO: 2948038 - RNA, 17 nt, Mycobacterium avium subsp. paratuberculosis
gaugcccuuggcggcca

SEQ ID NO: 2948039 - RNA, 17 nt, Mycobacterium avium subsp. paratuberculosis
gaugccgaaccgcugcg

SEQ ID NO: 2948040 - RNA, 16 nt, Mycobacterium avium subsp. paratuberculosis
gaugccgacaccccac

SEQ ID NO: 2948041 - RNA, 23 nt, Mycobacterium avium subsp. paratuberculosis
gaugccgaccaacacccccgcgc

SEQ ID NO: 2948042 - RNA, 15 nt, Mycobacterium avium subsp. paratuberculosis
gaugccgaccgacag

SEQ ID NO: 2948043 - RNA, 21 nt, Mycobacterium avium subsp. paratuberculosis
gaugccgaccgacagccgcac

SEQ ID NO: 2948044 - RNA, 14 nt, Mycobacterium avium subsp. paratuberculosis
gaugccgacgucgg

SEQ ID NO: 2948045 - RNA, 16 nt, Mycobacterium avium subsp. paratuberculosis
gaugccgacgucggug

SEQ ID NO: 2948046 - RNA, 18 nt, Mycobacterium avium subsp. paratuberculosis
gaugccgagcagcucggc

SEQ ID NO: 2948047 - RNA, 22 nt, Mycobacterium avium subsp. paratuberculosis
gaugccgaggauuucgcgaucg

SEQ ID NO: 2948048 - RNA, 21 nt, Mycobacterium avium subsp. paratuberculosis
gaugccgaguuccugcgaccg

SEQ ID NO: 2948049 - RNA, 23 nt, Mycobacterium avium subsp. paratuberculosis
gaugccgaucacggugaucgccg

SEQ ID NO: 2948050 - RNA, 13 nt, Mycobacterium avium subsp. paratuberculosis
gaugccgaucggg

SEQ ID NO: 2948051 - RNA, 15 nt, Mycobacterium avium subsp. paratuberculosis
gaugccgcccaccac

SEQ ID NO: 2948052 - RNA, 16 nt, Mycobacterium avium subsp. paratuberculosis
gaugccgcccagcagc

SEQ ID NO: 2948053 - RNA, 20 nt, Mycobacterium avium subsp. paratuberculosis
gaugccgcccaucagcagga

SEQ ID NO: 2948054 - RNA, 21 nt, Mycobacterium avium subsp. paratuberculosis
gaugccgcccaucagcaggac

SEQ ID NO: 2948055 - RNA, 17 nt, Mycobacterium avium subsp. paratuberculosis
gaugccgccccugcugg

SEQ ID NO: 2948056 - RNA, 22 nt, Mycobacterium avium subsp. paratuberculosis
gaugccgcccuugcucgcggcg

SEQ ID NO: 2948057 - RNA, 18 nt, Mycobacterium avium subsp. paratuberculosis
gaugccgccgaagcggcg

SEQ ID NO: 2948058 - RNA, 13 nt, Mycobacterium avium subsp. paratuberculosis
gaugccgccgacg

SEQ ID NO: 2948059 - RNA, 23 nt, Mycobacterium avium subsp. paratuberculosis
gaugccgccgagggccagcagcc

SEQ ID NO: 2948060 - RNA, 15 nt, Mycobacterium avium subsp. paratuberculosis
gaugccgccgccagc

SEQ ID NO: 2948061 - RNA, 22 nt, Mycobacterium avium subsp. paratuberculosis
gaugccgccgccagcgcggggu

SEQ ID NO: 2948062 - RNA, 14 nt, Mycobacterium avium subsp. paratuberculosis
gaugcgcgacggcc

SEQ ID NO: 2948063 - RNA, 24 nt, Mycobacterium avium subsp. paratuberculosis
gaugcgcgacggccucgccgucgc

SEQ ID NO: 2948064 - RNA, 18 nt, Mycobacterium avium subsp. paratuberculosis
gaugcgcgccaccaggcg

SEQ ID NO: 2948065 - RNA, 14 nt, Mycobacterium avium subsp. paratuberculosis
gaugcgcgccgacg

SEQ ID NO: 2948066 - RNA, 18 nt, Mycobacterium avium subsp. paratuberculosis
gaugcgcgccgacgacca

SEQ ID NO: 2948067 - RNA, 19 nt, Mycobacterium avium subsp. paratuberculosis
gaugcgcgccuccgacgac

SEQ ID NO: 2948068 - RNA, 23 nt, Mycobacterium avium subsp. paratuberculosis
gaugcgcggcccguugagcaccg

SEQ ID NO: 2948069 - RNA, 14 nt, Mycobacterium avium subsp. paratuberculosis
gaugcgcgucgcgg

SEQ ID NO: 2948070 - RNA, 17 nt, Mycobacterium avium subsp. paratuberculosis
gaugcgcgucgcggcgc

SEQ ID NO: 2948071 - RNA, 14 nt, Mycobacterium avium subsp. paratuberculosis
gaugcgcuccagca

SEQ ID NO: 2948072 - RNA, 21 nt, Mycobacterium avium subsp. paratuberculosis
gaugcgcuccagcaggcuggc

SEQ ID NO: 2948073 - RNA, 14 nt, Mycobacterium avium subsp. paratuberculosis
gaugcgcucggcga

SEQ ID NO: 2948074 - RNA, 13 nt, Mycobacterium avium subsp. paratuberculosis
gaugcgcuggugc

SEQ ID NO: 2948075 - RNA, 16 nt, Mycobacterium avium subsp. paratuberculosis
gaugcgcugugcgggu

SEQ ID NO: 2948076 - RNA, 18 nt, Mycobacterium avium subsp. paratuberculosis
gaugcgcugugcggguga

SEQ ID NO: 2948077 - RNA, 21 nt, Mycobacterium avium subsp. paratuberculosis
gaugcgcugugcgggugaggc

SEQ ID NO: 2948078 - RNA, 17 nt, Mycobacterium avium subsp. paratuberculosis
gaugcggaucucggugc

SEQ ID NO: 2948079 - RNA, 16 nt, Mycobacterium avium subsp. paratuberculosis
gaugcggcaccagccc

SEQ ID NO: 2948080 - RNA, 17 nt, Mycobacterium avium subsp. paratuberculosis
gaugcggcaccagcccg

SEQ ID NO: 2948081 - RNA, 21 nt, Mycobacterium avium subsp. paratuberculosis
gaugcggcacgcgucaccgga

SEQ ID NO: 2948082 - RNA, 23 nt, Mycobacterium avium subsp. paratuberculosis
gaugcggcagcuugaugcuggca

SEQ ID NO: 2948083 - RNA, 21 nt, Mycobacterium avium subsp. paratuberculosis
gaugcggcccagcccggccag

SEQ ID NO: 2948084 - RNA, 23 nt, Mycobacterium avium subsp. paratuberculosis
gaugcggcccagcccggccagca

SEQ ID NO: 2948085 - RNA, 15 nt, Mycobacterium avium subsp. paratuberculosis
gaugcggcccgaccc

SEQ ID NO: 2948086 - RNA, 23 nt, Mycobacterium avium subsp. paratuberculosis
gaugcggcccggccacucgccgc

SEQ ID NO: 2948087 - RNA, 21 nt, Mycobacterium avium subsp. paratuberculosis
gaugcggcccuggcgggcggc

SEQ ID NO: 2948088 - RNA, 23 nt, Mycobacterium avium subsp. paratuberculosis
gaugcggcccuggcgggcggccc

SEQ ID NO: 2948089 - RNA, 12 nt, Mycobacterium avium subsp. paratuberculosis
gaugcggccgga

SEQ ID NO: 2948090 - RNA, 23 nt, Mycobacterium avium subsp. paratuberculosis
gaugcggccguuggccuugauuc

SEQ ID NO: 2948091 - RNA, 15 nt, Mycobacterium avium subsp. paratuberculosis
gaugcggcgcccaca

SEQ ID NO: 2948092 - RNA, 14 nt, Mycobacterium avium subsp. paratuberculosis
gaugcgggcccgca

SEQ ID NO: 2948093 - RNA, 18 nt, Mycobacterium avium subsp. paratuberculosis
gaugcgggcgccgaacgu

SEQ ID NO: 2948094 - RNA, 12 nt, Mycobacterium avium subsp. paratuberculosis
gaugcgggcgcu

SEQ ID NO: 2948095 - RNA, 14 nt, Mycobacterium avium subsp. paratuberculosis
gaugcggggccggc

SEQ ID NO: 2948096 - RNA, 23 nt, Mycobacterium avium subsp. paratuberculosis
gaugcggggccggcggcggccag

SEQ ID NO: 2948097 - RNA, 12 nt, Mycobacterium avium subsp. paratuberculosis
gaugcggggcgg

SEQ ID NO: 2948098 - RNA, 16 nt, Mycobacterium avium subsp. paratuberculosis
gaugcggggcggcggg

SEQ ID NO: 2948099 - RNA, 14 nt, Mycobacterium avium subsp. paratuberculosis
gaugcggguguuga

SEQ ID NO: 2948100 - RNA, 14 nt, Mycobacterium avium subsp. paratuberculosis
gaugcggucgauca

SEQ ID NO: 2948101 - RNA, 21 nt, Mycobacterium avium subsp. paratuberculosis
gaugcggucgaugagcuggug

SEQ ID NO: 2948102 - RNA, 22 nt, Mycobacterium avium subsp. paratuberculosis
gaugcggucgaugagcuggugc

SEQ ID NO: 2948103 - RNA, 21 nt, Mycobacterium avium subsp. paratuberculosis
gaugcggucgucgcccaccga

SEQ ID NO: 2948104 - RNA, 22 nt, Mycobacterium avium subsp. paratuberculosis
gaugcggucgucgcccaccgac

SEQ ID NO: 2948105 - RNA, 16 nt, Mycobacterium avium subsp. paratuberculosis
gaugcggugccgggcc

SEQ ID NO: 2948106 - RNA, 15 nt, Mycobacterium avium subsp. paratuberculosis
gaugcgucccguugg

SEQ ID NO: 2948107 - RNA, 19 nt, Mycobacterium avium subsp. paratuberculosis
gaugcguuccaggugugcc

SEQ ID NO: 2948108 - RNA, 15 nt, Mycobacterium avium subsp. paratuberculosis
gaugcguucggccgc

SEQ ID NO: 2948109 - RNA, 22 nt, Mycobacterium avium subsp. paratuberculosis
gaugcguucggccgcagcggga

SEQ ID NO: 2948110 - RNA, 23 nt, Mycobacterium avium subsp. paratuberculosis
gaugcguugcgccagcaccgaca

SEQ ID NO: 2948111 - RNA, 18 nt, Mycobacterium avium subsp. paratuberculosis
gaugcguuggccgagcag

SEQ ID NO: 2948112 - RNA, 23 nt, Mycobacterium avium subsp. paratuberculosis
gaugcguuggccgagcagccggg

SEQ ID NO: 2948113 - RNA, 23 nt, Mycobacterium avium subsp. paratuberculosis
gaugcguugguguagccgaacgu

SEQ ID NO: 2948114 - RNA, 14 nt, Mycobacterium avium subsp. paratuberculosis
gaugcucaccgguc

SEQ ID NO: 2948115 - RNA, 15 nt, Mycobacterium avium subsp. paratuberculosis
gaugcucgaugcgca

SEQ ID NO: 2948116 - RNA, 23 nt, Mycobacterium avium subsp. paratuberculosis
gaugcucgaugcgcaccugcggc

SEQ ID NO: 2948117 - RNA, 22 nt, Mycobacterium avium subsp. paratuberculosis
gaugcugauacccgcgcggcgc

SEQ ID NO: 2948118 - RNA, 14 nt, Mycobacterium avium subsp. paratuberculosis
gaugcugauccgca

SEQ ID NO: 2948119 - RNA, 15 nt, Mycobacterium avium subsp. paratuberculosis
gaugcugcccggcgc

SEQ ID NO: 2948120 - RNA, 22 nt, Mycobacterium avium subsp. paratuberculosis
gaugcugcccggcgccacgcac

SEQ ID NO: 2948121 - RNA, 20 nt, Mycobacterium avium subsp. paratuberculosis
gaugcugcgggucagcagcu

SEQ ID NO: 2948122 - RNA, 17 nt, Mycobacterium avium subsp. paratuberculosis
gaugcuggccaucgccg

SEQ ID NO: 2948123 - RNA, 19 nt, Mycobacterium avium subsp. paratuberculosis
gaugcuggggucggccagc

SEQ ID NO: 2948124 - RNA, 20 nt, Mycobacterium avium subsp. paratuberculosis
gaugcuggggucggccagcg

SEQ ID NO: 2948125 - RNA, 22 nt, Mycobacterium avium subsp. paratuberculosis
gaugcuggggucggccagcgaa

SEQ ID NO: 2948126 - RNA, 13 nt, Mycobacterium avium subsp. paratuberculosis
gaugcugugcgcu

SEQ ID NO: 2948127 - RNA, 22 nt, Mycobacterium avium subsp. paratuberculosis
gaugcuguggaagggccccggc

SEQ ID NO: 2948128 - RNA, 21 nt, Mycobacterium avium subsp. paratuberculosis
gaugcuucccauuucggcgaa

SEQ ID NO: 2948129 - RNA, 21 nt, Mycobacterium avium subsp. paratuberculosis
gauggaagcgcccgcgcgcuc

SEQ ID NO: 2948130 - RNA, 21 nt, Mycobacterium avium subsp. paratuberculosis
gauggaagcggugauggcgau

SEQ ID NO: 2948131 - RNA, 14 nt, Mycobacterium avium subsp. paratuberculosis
gauggaaggugcug

SEQ ID NO: 2948132 - RNA, 16 nt, Mycobacterium avium subsp. paratuberculosis
gauggaaggugcugaa

SEQ ID NO: 2948133 - RNA, 20 nt, Mycobacterium avium subsp. paratuberculosis
gauggacacgcugccgaggu

SEQ ID NO: 2948134 - RNA, 14 nt, Mycobacterium avium subsp. paratuberculosis
gauggacagcagcc

SEQ ID NO: 2948135 - RNA, 15 nt, Mycobacterium avium subsp. paratuberculosis
gauggacagggcgac

SEQ ID NO: 2948136 - RNA, 17 nt, Mycobacterium avium subsp. paratuberculosis
gauggacaucuccggca

SEQ ID NO: 2948137 - RNA, 19 nt, Mycobacterium avium subsp. paratuberculosis
gauggacaucuccggcacg

SEQ ID NO: 2948138 - RNA, 16 nt, Mycobacterium avium subsp. paratuberculosis
gauggacgcccaacua

SEQ ID NO: 2948139 - RNA, 16 nt, Mycobacterium avium subsp. paratuberculosis
gauggacgcgguggug

SEQ ID NO: 2948140 - RNA, 15 nt, Mycobacterium avium subsp. paratuberculosis
gauggacggggcgau

SEQ ID NO: 2948141 - RNA, 15 nt, Mycobacterium avium subsp. paratuberculosis
gauggagccgcccau

SEQ ID NO: 2948142 - RNA, 16 nt, Mycobacterium avium subsp. paratuberculosis
gauggagccgcccaug

SEQ ID NO: 2948143 - RNA, 19 nt, Mycobacterium avium subsp. paratuberculosis
gauggagcgcgacgggcug

SEQ ID NO: 2948144 - RNA, 20 nt, Mycobacterium avium subsp. paratuberculosis
gauggagcgcgacgggcugc

SEQ ID NO: 2948145 - RNA, 12 nt, Mycobacterium avium subsp. paratuberculosis
gauggagcugac

SEQ ID NO: 2948146 - RNA, 15 nt, Mycobacterium avium subsp. paratuberculosis
gauggcgugccggcg

SEQ ID NO: 2948147 - RNA, 18 nt, Mycobacterium avium subsp. paratuberculosis
gauggcguucaucgucca

SEQ ID NO: 2948148 - RNA, 16 nt, Mycobacterium avium subsp. paratuberculosis
gauggcguucugcacc

SEQ ID NO: 2948149 - RNA, 17 nt, Mycobacterium avium subsp. paratuberculosis
gauggcguucugcaccg

SEQ ID NO: 2948150 - RNA, 20 nt, Mycobacterium avium subsp. paratuberculosis
gauggcguucugcaccgacu

SEQ ID NO: 2948151 - RNA, 15 nt, Mycobacterium avium subsp. paratuberculosis
gauggcucagcgcac

SEQ ID NO: 2948152 - RNA, 20 nt, Mycobacterium avium subsp. paratuberculosis
gauggcucgcgggggccgcg

SEQ ID NO: 2948153 - RNA, 22 nt, Mycobacterium avium subsp. paratuberculosis
gauggcucgcgggggccgcgau

SEQ ID NO: 2948154 - RNA, 14 nt, Mycobacterium avium subsp. paratuberculosis
gaugggagcggggu

SEQ ID NO: 2948155 - RNA, 14 nt, Mycobacterium avium subsp. paratuberculosis
gaugggcagcgccc

SEQ ID NO: 2948156 - RNA, 18 nt, Mycobacterium avium subsp. paratuberculosis
gaugggcagcgccccggu

SEQ ID NO: 2948157 - RNA, 22 nt, Mycobacterium avium subsp. paratuberculosis
gaugggcagcgccccgguccgg

SEQ ID NO: 2948158 - RNA, 22 nt, Mycobacterium avium subsp. paratuberculosis
gaugggcauugcccaucgccac

SEQ ID NO: 2948159 - RNA, 15 nt, Mycobacterium avium subsp. paratuberculosis
gaugggccgcccgcu

SEQ ID NO: 2948160 - RNA, 18 nt, Mycobacterium avium subsp. paratuberculosis
gaugggccgcccgcuggg

SEQ ID NO: 2948161 - RNA, 19 nt, Mycobacterium avium subsp. paratuberculosis
gaugggcucgaccacgccg

SEQ ID NO: 2948162 - RNA, 12 nt, Mycobacterium avium subsp. paratuberculosis
gaugggucaggu

SEQ ID NO: 2948163 - RNA, 12 nt, Mycobacterium avium subsp. paratuberculosis
gaugggugagcg

SEQ ID NO: 2948164 - RNA, 19 nt, Mycobacterium avium subsp. paratuberculosis
gauggguucuucgaccacg

SEQ ID NO: 2948165 - RNA, 17 nt, Mycobacterium avium subsp. paratuberculosis
gaugguacgcgagaagc

SEQ ID NO: 2948166 - RNA, 18 nt, Mycobacterium avium subsp. paratuberculosis
gaugguauccgaucgcgg

SEQ ID NO: 2948167 - RNA, 14 nt, Mycobacterium avium subsp. paratuberculosis
gauggucagccgca

SEQ ID NO: 2948168 - RNA, 19 nt, Mycobacterium avium subsp. paratuberculosis
gauggucagccgcaccagg

SEQ ID NO: 2948169 - RNA, 21 nt, Mycobacterium avium subsp. paratuberculosis
gaugguccagcaccggcgccc

SEQ ID NO: 2948170 - RNA, 17 nt, Mycobacterium avium subsp. paratuberculosis
gaugguccgcaugucga

SEQ ID NO: 2948171 - RNA, 18 nt, Mycobacterium avium subsp. paratuberculosis
gauggucgagggcguucg

SEQ ID NO: 2948172 - RNA, 21 nt, Mycobacterium avium subsp. paratuberculosis
gauggucgccuuguuggccca

SEQ ID NO: 2948173 - RNA, 16 nt, Mycobacterium avium subsp. paratuberculosis
gauggucgcgccgcgg

SEQ ID NO: 2948174 - RNA, 17 nt, Mycobacterium avium subsp. paratuberculosis
gauggucgcgccgcggc

SEQ ID NO: 2948175 - RNA, 12 nt, Mycobacterium avium subsp. paratuberculosis
gauggucgucgg

SEQ ID NO: 2948176 - RNA, 15 nt, Mycobacterium avium subsp. paratuberculosis
gauggucgucggguu

SEQ ID NO: 2948177 - RNA, 14 nt, Mycobacterium avium subsp. paratuberculosis
gauggucgucgugg

SEQ ID NO: 2948178 - RNA, 16 nt, Mycobacterium avium subsp. paratuberculosis
gauggucucccgggcg

SEQ ID NO: 2948179 - RNA, 22 nt, Mycobacterium avium subsp. paratuberculosis
gauggucucccgggcggucgcg

SEQ ID NO: 2948180 - RNA, 22 nt, Mycobacterium avium subsp. paratuberculosis
gauggucucgaucuccaucccg

SEQ ID NO: 2948181 - RNA, 23 nt, Mycobacterium avium subsp. paratuberculosis
gauggucuggaugaucgucucgg

SEQ ID NO: 2948182 - RNA, 21 nt, Mycobacterium avium subsp. paratuberculosis
gauggugaaaucguccaucgu

SEQ ID NO: 2948183 - RNA, 17 nt, Mycobacterium avium subsp. paratuberculosis
gauggugaccaaccaca

SEQ ID NO: 2948184 - RNA, 17 nt, Mycobacterium avium subsp. paratuberculosis
gauggugaccucggucg

SEQ ID NO: 2948185 - RNA, 13 nt, Mycobacterium avium subsp. paratuberculosis
gauggugacggcc

SEQ ID NO: 2948186 - RNA, 19 nt, Mycobacterium avium subsp. paratuberculosis
gauggugaucgaccggacg

SEQ ID NO: 2948187 - RNA, 23 nt, Mycobacterium avium subsp. paratuberculosis
gauggugaucucgccgcgguggu

SEQ ID NO: 2948188 - RNA, 13 nt, Mycobacterium avium subsp. paratuberculosis
gauggugcccggg

SEQ ID NO: 2948189 - RNA, 14 nt, Mycobacterium avium subsp. paratuberculosis
gauggugccgaagc

SEQ ID NO: 2948190 - RNA, 17 nt, Mycobacterium avium subsp. paratuberculosis
gauggugccgucggcgg

SEQ ID NO: 2948191 - RNA, 17 nt, Mycobacterium avium subsp. paratuberculosis
gauggugcgccgggucg

SEQ ID NO: 2948192 - RNA, 18 nt, Mycobacterium avium subsp. paratuberculosis
gauggugcgccgggucgc

SEQ ID NO: 2948193 - RNA, 20 nt, Mycobacterium avium subsp. paratuberculosis
gauggugcgccgggucgcgg

SEQ ID NO: 2948194 - RNA, 22 nt, Mycobacterium avium subsp. paratuberculosis
gauggugcgccgggucgcggug

SEQ ID NO: 2948195 - RNA, 16 nt, Mycobacterium avium subsp. paratuberculosis
gaugguggccgucggc

SEQ ID NO: 2948196 - RNA, 18 nt, Mycobacterium avium subsp. paratuberculosis
gaugguggccgucggccu

SEQ ID NO: 2948197 - RNA, 19 nt, Mycobacterium avium subsp. paratuberculosis
gaugguggccgucggccug

SEQ ID NO: 2948198 - RNA, 22 nt, Mycobacterium avium subsp. paratuberculosis
gaugguggccgucggccugcgc

SEQ ID NO: 2948199 - RNA, 16 nt, Mycobacterium avium subsp. paratuberculosis
gaugguggcgcgcauc

SEQ ID NO: 2948200 - RNA, 21 nt, Mycobacterium avium subsp. paratuberculosis
gaugguggcgcugccgagcac

SEQ ID NO: 2948201 - RNA, 16 nt, Mycobacterium avium subsp. paratuberculosis
gaugguggcguagcgg

SEQ ID NO: 2948202 - RNA, 17 nt, Mycobacterium avium subsp. paratuberculosis
gauggugggcaccgcga

SEQ ID NO: 2948203 - RNA, 18 nt, Mycobacterium avium subsp. paratuberculosis
gauggugggcaccgcgaa

SEQ ID NO: 2948204 - RNA, 17 nt, Mycobacterium avium subsp. paratuberculosis
gauggugguaccgaccu

SEQ ID NO: 2948205 - RNA, 17 nt, Mycobacterium avium subsp. paratuberculosis
gaugguguacacgucgc

SEQ ID NO: 2948206 - RNA, 21 nt, Mycobacterium avium subsp. paratuberculosis
gaugguguggaucgcuucggc

SEQ ID NO: 2948207 - RNA, 20 nt, Mycobacterium avium subsp. paratuberculosis
gaugguguucugcucgucgg

SEQ ID NO: 2948208 - RNA, 21 nt, Mycobacterium avium subsp. paratuberculosis
gauguagagcgggauccccac

SEQ ID NO: 2948209 - RNA, 20 nt, Mycobacterium avium subsp. paratuberculosis
gauguagcggacgggccgca

SEQ ID NO: 2948210 - RNA, 20 nt, Mycobacterium avium subsp. paratuberculosis
gauguagcggcggucggcgc

SEQ ID NO: 2948211 - RNA, 20 nt, Mycobacterium avium subsp. paratuberculosis
gaugucacccguuugaggcg

SEQ ID NO: 2948212 - RNA, 18 nt, Mycobacterium avium subsp. paratuberculosis
gaugucacccucgaggcc

SEQ ID NO: 2948213 - RNA, 16 nt, Mycobacterium avium subsp. paratuberculosis
gaugucacguugauga

SEQ ID NO: 2948214 - RNA, 16 nt, Mycobacterium avium subsp. paratuberculosis
gauguccccgcgggug

SEQ ID NO: 2948215 - RNA, 19 nt, Mycobacterium avium subsp. paratuberculosis
gauguccgacagcccgccc

SEQ ID NO: 2948216 - RNA, 14 nt, Mycobacterium avium subsp. paratuberculosis
gauguccgccggcc

SEQ ID NO: 2948217 - RNA, 15 nt, Mycobacterium avium subsp. paratuberculosis
gauguccgccggccg

SEQ ID NO: 2948218 - RNA, 17 nt, Mycobacterium avium subsp. paratuberculosis
gauguccgccggccggu

SEQ ID NO: 2948219 - RNA, 17 nt, Mycobacterium avium subsp. paratuberculosis
gaugucgaaacccagga

SEQ ID NO: 2948220 - RNA, 19 nt, Mycobacterium avium subsp. paratuberculosis
gaugucgaaacccaggaac

SEQ ID NO: 2948221 - RNA, 17 nt, Mycobacterium avium subsp. paratuberculosis
gaugucgacccgcggcg

SEQ ID NO: 2948222 - RNA, 19 nt, Mycobacterium avium subsp. paratuberculosis
gaugucgacgaugcgcugc

SEQ ID NO: 2948223 - RNA, 21 nt, Mycobacterium avium subsp. paratuberculosis
gaugucgacgaugcgcugcug

SEQ ID NO: 2948224 - RNA, 16 nt, Mycobacterium avium subsp. paratuberculosis
gaugucgacgccgugc

SEQ ID NO: 2948225 - RNA, 17 nt, Mycobacterium avium subsp. paratuberculosis
gaugucgcccggcgcgg

SEQ ID NO: 2948226 - RNA, 15 nt, Mycobacterium avium subsp. paratuberculosis
gaugucgcccggcgg

SEQ ID NO: 2948227 - RNA, 18 nt, Mycobacterium avium subsp. paratuberculosis
gaugucgcccggcggcac

SEQ ID NO: 2948228 - RNA, 20 nt, Mycobacterium avium subsp. paratuberculosis
gaugucgcccggcggcaccg

SEQ ID NO: 2948229 - RNA, 14 nt, Mycobacterium avium subsp. paratuberculosis
gaugucgccgcaga

SEQ ID NO: 2948230 - RNA, 19 nt, Mycobacterium avium subsp. paratuberculosis
gauucgcggcggcgccgca

SEQ ID NO: 2948231 - RNA, 22 nt, Mycobacterium avium subsp. paratuberculosis
gauucgcggcggcgccgcagca

SEQ ID NO: 2948232 - RNA, 13 nt, Mycobacterium avium subsp. paratuberculosis
gauucgcgguggc

SEQ ID NO: 2948233 - RNA, 18 nt, Mycobacterium avium subsp. paratuberculosis
gauucgcgguggcgaacu

SEQ ID NO: 2948234 - RNA, 16 nt, Mycobacterium avium subsp. paratuberculosis
gauucggccaugccgc

SEQ ID NO: 2948235 - RNA, 17 nt, Mycobacterium avium subsp. paratuberculosis
gauucggcgccgcgacc

SEQ ID NO: 2948236 - RNA, 18 nt, Mycobacterium avium subsp. paratuberculosis
gauucgggucagaccgcg

SEQ ID NO: 2948237 - RNA, 19 nt, Mycobacterium avium subsp. paratuberculosis
gauucgggucagaccgcgg

SEQ ID NO: 2948238 - RNA, 20 nt, Mycobacterium avium subsp. paratuberculosis
gauucgggucagaccgcggc

SEQ ID NO: 2948239 - RNA, 22 nt, Mycobacterium avium subsp. paratuberculosis
gauucggguggcgucgccgccg

SEQ ID NO: 2948240 - RNA, 23 nt, Mycobacterium avium subsp. paratuberculosis
gauucucgcucugccgggccgca

SEQ ID NO: 2948241 - RNA, 16 nt, Mycobacterium avium subsp. paratuberculosis
gauucugcagccgcac

SEQ ID NO: 2948242 - RNA, 19 nt, Mycobacterium avium subsp. paratuberculosis
gauugaccauccgguccag

SEQ ID NO: 2948243 - RNA, 23 nt, Mycobacterium avium subsp. paratuberculosis
gauugaccauccgguccagaucg

SEQ ID NO: 2948244 - RNA, 16 nt, Mycobacterium avium subsp. paratuberculosis
gauugcccgacuccuc

SEQ ID NO: 2948245 - RNA, 20 nt, Mycobacterium avium subsp. paratuberculosis
gauugccgggcaccagcgac

SEQ ID NO: 2948246 - RNA, 12 nt, Mycobacterium avium subsp. paratuberculosis
gauugcgcccgc

SEQ ID NO: 2948247 - RNA, 13 nt, Mycobacterium avium subsp. paratuberculosis
gauugcgcggcgc

SEQ ID NO: 2948248 - RNA, 24 nt, Mycobacterium avium subsp. paratuberculosis
gauugcggccgccggccagcuccg

SEQ ID NO: 2948249 - RNA, 19 nt, Mycobacterium avium subsp. paratuberculosis
gauugcgugcccggccagc

SEQ ID NO: 2948250 - RNA, 15 nt, Mycobacterium avium subsp. paratuberculosis
gauuggaagagggcc

SEQ ID NO: 2948251 - RNA, 19 nt, Mycobacterium avium subsp. paratuberculosis
gauuggccucgagugccug

SEQ ID NO: 2948252 - RNA, 18 nt, Mycobacterium avium subsp. paratuberculosis
gauuggucagagcccgaa

SEQ ID NO: 2948253 - RNA, 17 nt, Mycobacterium avium subsp. paratuberculosis
gauugguggcccggucg

SEQ ID NO: 2948254 - RNA, 19 nt, Mycobacterium avium subsp. paratuberculosis
gauugucgcuguuagccuc

SEQ ID NO: 2948255 - RNA, 16 nt, Mycobacterium avium subsp. paratuberculosis
gauugucggggccgca

SEQ ID NO: 2948256 - RNA, 18 nt, Mycobacterium avium subsp. paratuberculosis
gauuucaaggggccgggc

SEQ ID NO: 2948257 - RNA, 18 nt, Mycobacterium avium subsp. paratuberculosis
gauuucacgucugcucgg

SEQ ID NO: 2948258 - RNA, 22 nt, Mycobacterium avium subsp. paratuberculosis
gauuucaucgcggcgacccgcu

SEQ ID NO: 2948259 - RNA, 21 nt, Mycobacterium avium subsp. paratuberculosis
gauuuccgguuccucggcgug

SEQ ID NO: 2948260 - RNA, 17 nt, Mycobacterium avium subsp. paratuberculosis
gauuucgaagcugucgc

SEQ ID NO: 2948261 - RNA, 17 nt, Mycobacterium avium subsp. paratuberculosis
gauuucgcgcaccaccu

SEQ ID NO: 2948262 - RNA, 15 nt, Mycobacterium avium subsp. paratuberculosis
gauuucggccagccg

SEQ ID NO: 2948263 - RNA, 15 nt, Mycobacterium avium subsp. paratuberculosis
gauuuggccgucauc

SEQ ID NO: 2948264 - RNA, 19 nt, Mycobacterium avium subsp. paratuberculosis
gauuuugaaauagccgcgc

SEQ ID NO: 2948265 - RNA, 18 nt, Mycobacterium avium subsp. paratuberculosis
gcaaaaacgcgcgaucgg

SEQ ID NO: 2948266 - RNA, 13 nt, Mycobacterium avium subsp. paratuberculosis
gcaaaagcauccg

SEQ ID NO: 2948267 - RNA, 18 nt, Mycobacterium avium subsp. paratuberculosis
gcaaaagcauccggccgu

SEQ ID NO: 2948268 - RNA, 22 nt, Mycobacterium avium subsp. paratuberculosis
gcaaacacgagcagacccgccg

SEQ ID NO: 2948269 - RNA, 13 nt, Mycobacterium avium subsp. paratuberculosis
gcaaacccagcac

SEQ ID NO: 2948270 - RNA, 13 nt, Mycobacterium avium subsp. paratuberculosis
gcaaaccgaccgc

SEQ ID NO: 2948271 - RNA, 17 nt, Mycobacterium avium subsp. paratuberculosis
gcaaaccgaccgccgcg

SEQ ID NO: 2948272 - RNA, 17 nt, Mycobacterium avium subsp. paratuberculosis
gcaaaccggaccgccgc

SEQ ID NO: 2948273 - RNA, 18 nt, Mycobacterium avium subsp. paratuberculosis
gcaaaccggaccgccgcg

SEQ ID NO: 2948274 - RNA, 19 nt, Mycobacterium avium subsp. paratuberculosis
gcaaacgaaucgagccgcc

SEQ ID NO: 2948275 - RNA, 18 nt, Mycobacterium avium subsp. paratuberculosis
gcaaagcguugccgcgcg

SEQ ID NO: 2948276 - RNA, 13 nt, Mycobacterium avium subsp. paratuberculosis
gcaaagggcuagg

SEQ ID NO: 2948277 - RNA, 16 nt, Mycobacterium avium subsp. paratuberculosis
gcaaaucagccgagcc

SEQ ID NO: 2948278 - RNA, 14 nt, Mycobacterium avium subsp. paratuberculosis
gcaaauccggcagc

SEQ ID NO: 2948279 - RNA, 17 nt, Mycobacterium avium subsp. paratuberculosis
gcaacacaugguccugc

SEQ ID NO: 2948280 - RNA, 16 nt, Mycobacterium avium subsp. paratuberculosis
gcaacaccacgucggu

SEQ ID NO: 2948281 - RNA, 19 nt, Mycobacterium avium subsp. paratuberculosis
gcaacaccacgucggugcc

SEQ ID NO: 2948282 - RNA, 12 nt, Mycobacterium avium subsp. paratuberculosis
gcaacaccagcu

SEQ ID NO: 2948283 - RNA, 15 nt, Mycobacterium avium subsp. paratuberculosis
gcaacaccagggugc

SEQ ID NO: 2948284 - RNA, 20 nt, Mycobacterium avium subsp. paratuberculosis
gcaacaccagggugcgcagc

SEQ ID NO: 2948285 - RNA, 13 nt, Mycobacterium avium subsp. paratuberculosis
gcaacacccagcc

SEQ ID NO: 2948286 - RNA, 17 nt, Mycobacterium avium subsp. paratuberculosis
gcaacaccgaacgccga

SEQ ID NO: 2948287 - RNA, 19 nt, Mycobacterium avium subsp. paratuberculosis
gcaacaccgaacgccgagg

SEQ ID NO: 2948288 - RNA, 14 nt, Mycobacterium avium subsp. paratuberculosis
gcaacaccggcggc

SEQ ID NO: 2948289 - RNA, 20 nt, Mycobacterium avium subsp. paratuberculosis
gcaacaccggcggcgacggc

SEQ ID NO: 2948290 - RNA, 14 nt, Mycobacterium avium subsp. paratuberculosis
gcaacaccucggcg

SEQ ID NO: 2948291 - RNA, 15 nt, Mycobacterium avium subsp. paratuberculosis
gcaacaccucggcga

SEQ ID NO: 2948292 - RNA, 23 nt, Mycobacterium avium subsp. paratuberculosis
gcaacaccucgggcacguccagc

SEQ ID NO: 2948293 - RNA, 17 nt, Mycobacterium avium subsp. paratuberculosis
gcaacaccuuucggccg

SEQ ID NO: 2948294 - RNA, 13 nt, Mycobacterium avium subsp. paratuberculosis
gcaacacgccggc

SEQ ID NO: 2948295 - RNA, 16 nt, Mycobacterium avium subsp. paratuberculosis
gcaacacgccggcggc

SEQ ID NO: 2948296 - RNA, 18 nt, Mycobacterium avium subsp. paratuberculosis
gcaacacgccggcggcca

SEQ ID NO: 2948297 - RNA, 18 nt, Mycobacterium avium subsp. paratuberculosis
gcaacacguagucgccga

SEQ ID NO: 2948298 - RNA, 17 nt, Mycobacterium avium subsp. paratuberculosis
gcaacacgucguccggc

SEQ ID NO: 2948299 - RNA, 17 nt, Mycobacterium avium subsp. paratuberculosis
gcaacacguugaguccc

SEQ ID NO: 2948300 - RNA, 19 nt, Mycobacterium avium subsp. paratuberculosis
gcaacacguugagucccuc

SEQ ID NO: 2948301 - RNA, 23 nt, Mycobacterium avium subsp. paratuberculosis
gcaacacguugagucccucggcg

SEQ ID NO: 2948302 - RNA, 19 nt, Mycobacterium avium subsp. paratuberculosis
gcaacacucgagcgcgcuc

SEQ ID NO: 2948303 - RNA, 23 nt, Mycobacterium avium subsp. paratuberculosis
gcaacacucgagcgcgcucaacc

SEQ ID NO: 2948304 - RNA, 17 nt, Mycobacterium avium subsp. paratuberculosis
gcaacagcaccagcacc

SEQ ID NO: 2948305 - RNA, 23 nt, Mycobacterium avium subsp. paratuberculosis
gcaacagcaccucgucgcccggc

SEQ ID NO: 2948306 - RNA, 12 nt, Mycobacterium avium subsp. paratuberculosis
gcaacagcagcg

SEQ ID NO: 2948307 - RNA, 15 nt, Mycobacterium avium subsp. paratuberculosis
gcaacagcagcggca

SEQ ID NO: 2948308 - RNA, 21 nt, Mycobacterium avium subsp. paratuberculosis
gcaacagcauuucgcgcggca

SEQ ID NO: 2948309 - RNA, 17 nt, Mycobacterium avium subsp. paratuberculosis
gcaacagcccgaccguc

SEQ ID NO: 2948310 - RNA, 19 nt, Mycobacterium avium subsp. paratuberculosis
gcaacagccggcccgagcc

SEQ ID NO: 2948311 - RNA, 18 nt, Mycobacterium avium subsp. paratuberculosis
gcaacagcgagucggucg

SEQ ID NO: 2948312 - RNA, 19 nt, Mycobacterium avium subsp. paratuberculosis
gcaacagcgagucggucga

SEQ ID NO: 2948313 - RNA, 13 nt, Mycobacterium avium subsp. paratuberculosis
gcaacagcgcgcc

SEQ ID NO: 2948314 - RNA, 17 nt, Mycobacterium avium subsp. paratuberculosis
gcaacagcgcgccggcc

SEQ ID NO: 2948315 - RNA, 21 nt, Mycobacterium avium subsp. paratuberculosis
gcaacgguacgugcgccggcg

SEQ ID NO: 2948316 - RNA, 13 nt, Mycobacterium avium subsp. paratuberculosis
gcaacggucggga

SEQ ID NO: 2948317 - RNA, 15 nt, Mycobacterium avium subsp. paratuberculosis
gcaacggucgggauc

SEQ ID NO: 2948318 - RNA, 13 nt, Mycobacterium avium subsp. paratuberculosis
gcaacguccucga

SEQ ID NO: 2948319 - RNA, 18 nt, Mycobacterium avium subsp. paratuberculosis
gcaacgugaugccguggu

SEQ ID NO: 2948320 - RNA, 16 nt, Mycobacterium avium subsp. paratuberculosis
gcaacgugcgccggcc

SEQ ID NO: 2948321 - RNA, 21 nt, Mycobacterium avium subsp. paratuberculosis
gcaacguguacucggcgucgc

SEQ ID NO: 2948322 - RNA, 12 nt, Mycobacterium avium subsp. paratuberculosis
gcaacguuguuc

SEQ ID NO: 2948323 - RNA, 22 nt, Mycobacterium avium subsp. paratuberculosis
gcaacguuguuccacgugucgg

SEQ ID NO: 2948324 - RNA, 16 nt, Mycobacterium avium subsp. paratuberculosis
gcaacuacgcacccga

SEQ ID NO: 2948325 - RNA, 17 nt, Mycobacterium avium subsp. paratuberculosis
gcaacucaguccucgcc

SEQ ID NO: 2948326 - RNA, 20 nt, Mycobacterium avium subsp. paratuberculosis
gcaacuccacaaccagcgau

SEQ ID NO: 2948327 - RNA, 15 nt, Mycobacterium avium subsp. paratuberculosis
gcaacuccaccucgg

SEQ ID NO: 2948328 - RNA, 23 nt, Mycobacterium avium subsp. paratuberculosis
gcaacuccaccucgggcauuggc

SEQ ID NO: 2948329 - RNA, 22 nt, Mycobacterium avium subsp. paratuberculosis
gcaacucguccagcgucgcggc

SEQ ID NO: 2948330 - RNA, 13 nt, Mycobacterium avium subsp. paratuberculosis
gcaacugaccgau

SEQ ID NO: 2948331 - RNA, 19 nt, Mycobacterium avium subsp. paratuberculosis
gcaacugaccgaucuggcg

SEQ ID NO: 2948332 - RNA, 14 nt, Mycobacterium avium subsp. paratuberculosis
gcaacugccgacgg

SEQ ID NO: 2948333 - RNA, 14 nt, Mycobacterium avium subsp. paratuberculosis
gcaacugcguggcc

SEQ ID NO: 2948334 - RNA, 22 nt, Mycobacterium avium subsp. paratuberculosis
gcaacugcucgaccagcccccg

SEQ ID NO: 2948335 - RNA, 23 nt, Mycobacterium avium subsp. paratuberculosis
gcaacugcucgaccagcccccgc

SEQ ID NO: 2948336 - RNA, 15 nt, Mycobacterium avium subsp. paratuberculosis
gcaacugggcggccu

SEQ ID NO: 2948337 - RNA, 20 nt, Mycobacterium avium subsp. paratuberculosis
gcaacugggugagcaacagc

SEQ ID NO: 2948338 - RNA, 23 nt, Mycobacterium avium subsp. paratuberculosis
gcaacugggugagcaacagcgcu

SEQ ID NO: 2948339 - RNA, 14 nt, Mycobacterium avium subsp. paratuberculosis
gcaacuggucgugc

SEQ ID NO: 2948340 - RNA, 20 nt, Mycobacterium avium subsp. paratuberculosis
gcaacuggucgugcagcacc

SEQ ID NO: 2948341 - RNA, 21 nt, Mycobacterium avium subsp. paratuberculosis
gcaacuggucgugcagcaccg

SEQ ID NO: 2948342 - RNA, 16 nt, Mycobacterium avium subsp. paratuberculosis
gcaacuguucgcggcu

SEQ ID NO: 2948343 - RNA, 19 nt, Mycobacterium avium subsp. paratuberculosis
gcaacuguucgcggcuggc

SEQ ID NO: 2948344 - RNA, 20 nt, Mycobacterium avium subsp. paratuberculosis
gcaacuguucgcggcuggcc

SEQ ID NO: 2948345 - RNA, 21 nt, Mycobacterium avium subsp. paratuberculosis
gcaacuugcccgacggcgucu

SEQ ID NO: 2948346 - RNA, 20 nt, Mycobacterium avium subsp. paratuberculosis
gcaagaacccgaacgcgucg

SEQ ID NO: 2948347 - RNA, 15 nt, Mycobacterium avium subsp. paratuberculosis
gcaagaagucggugu

SEQ ID NO: 2948348 - RNA, 12 nt, Mycobacterium avium subsp. paratuberculosis
gcaagagcaggc

SEQ ID NO: 2948349 - RNA, 14 nt, Mycobacterium avium subsp. paratuberculosis
gcaagaugugggcg

SEQ ID NO: 2948350 - RNA, 16 nt, Mycobacterium avium subsp. paratuberculosis
gcaagcaccggcuggc

SEQ ID NO: 2948351 - RNA, 23 nt, Mycobacterium avium subsp. paratuberculosis
gcaagcaccggcuggccgagcgg

SEQ ID NO: 2948352 - RNA, 15 nt, Mycobacterium avium subsp. paratuberculosis
gcaagcagcggcagc

SEQ ID NO: 2948353 - RNA, 19 nt, Mycobacterium avium subsp. paratuberculosis
gcaagcccuuuggcggcca

SEQ ID NO: 2948354 - RNA, 20 nt, Mycobacterium avium subsp. paratuberculosis
gcaagccgaguuugcgguga

SEQ ID NO: 2948355 - RNA, 13 nt, Mycobacterium avium subsp. paratuberculosis
gcaagcugauucg

SEQ ID NO: 2948356 - RNA, 15 nt, Mycobacterium avium subsp. paratuberculosis
gcaagcugauucggg

SEQ ID NO: 2948357 - RNA, 19 nt, Mycobacterium avium subsp. paratuberculosis
gcaagcugauucgggauca

SEQ ID NO: 2948358 - RNA, 14 nt, Mycobacterium avium subsp. paratuberculosis
gcaaggccagcaac

SEQ ID NO: 2948359 - RNA, 15 nt, Mycobacterium avium subsp. paratuberculosis
gcaaggccagcaacc

SEQ ID NO: 2948360 - RNA, 16 nt, Mycobacterium avium subsp. paratuberculosis
gcaaggcccccgccuc

SEQ ID NO: 2948361 - RNA, 17 nt, Mycobacterium avium subsp. paratuberculosis
gcaaggcccccgccucg

SEQ ID NO: 2948362 - RNA, 23 nt, Mycobacterium avium subsp. paratuberculosis
gcaaggcccccgccucgccgguc

SEQ ID NO: 2948363 - RNA, 23 nt, Mycobacterium avium subsp. paratuberculosis
gcaaggccgccagccgcgucuug

SEQ ID NO: 2948364 - RNA, 18 nt, Mycobacterium avium subsp. paratuberculosis
gcaaggccugcgccuugg

SEQ ID NO: 2948365 - RNA, 19 nt, Mycobacterium avium subsp. paratuberculosis
gcaagggcaaagacgacgg

SEQ ID NO: 2948366 - RNA, 20 nt, Mycobacterium avium subsp. paratuberculosis
gcaagggccgacaucgucgg

SEQ ID NO: 2948367 - RNA, 21 nt, Mycobacterium avium subsp. paratuberculosis
gcaagggccgacaucgucggc

SEQ ID NO: 2948368 - RNA, 21 nt, Mycobacterium avium subsp. paratuberculosis
gcaagggcgacauguccggga

SEQ ID NO: 2948369 - RNA, 23 nt, Mycobacterium avium subsp. paratuberculosis
gcaaguccggguccuaucaggac

SEQ ID NO: 2948370 - RNA, 13 nt, Mycobacterium avium subsp. paratuberculosis
gcaagucgaacgg

SEQ ID NO: 2948371 - RNA, 14 nt, Mycobacterium avium subsp. paratuberculosis
gcaagucgaacgga

SEQ ID NO: 2948372 - RNA, 22 nt, Mycobacterium avium subsp. paratuberculosis
gcaagucggcggugaugcgcgc

SEQ ID NO: 2948373 - RNA, 22 nt, Mycobacterium avium subsp. paratuberculosis
gcaagucgucggugggccgccg

SEQ ID NO: 2948374 - RNA, 22 nt, Mycobacterium avium subsp. paratuberculosis
gcaauacaccgcgaacucgucg

SEQ ID NO: 2948375 - RNA, 19 nt, Mycobacterium avium subsp. paratuberculosis
gcaauaccggcagcaggug

SEQ ID NO: 2948376 - RNA, 19 nt, Mycobacterium avium subsp. paratuberculosis
gcaauacggugcccgccgc

SEQ ID NO: 2948377 - RNA, 22 nt, Mycobacterium avium subsp. paratuberculosis
gcaauacggugcccgccgcgac

SEQ ID NO: 2948378 - RNA, 15 nt, Mycobacterium avium subsp. paratuberculosis
gcaaucaggcggucg

SEQ ID NO: 2948379 - RNA, 20 nt, Mycobacterium avium subsp. paratuberculosis
gcaaucaggcggucgaacgc

SEQ ID NO: 2948380 - RNA, 19 nt, Mycobacterium avium subsp. paratuberculosis
gcaauccggccccgcugcc

SEQ ID NO: 2948381 - RNA, 20 nt, Mycobacterium avium subsp. paratuberculosis
gcaauccugcccggucugcg

SEQ ID NO: 2948382 - RNA, 20 nt, Mycobacterium avium subsp. paratuberculosis
gcaauccuguuccccggcgg

SEQ ID NO: 2948383 - RNA, 14 nt, Mycobacterium avium subsp. paratuberculosis
gcaaucgagcgggc

SEQ ID NO: 2948384 - RNA, 15 nt, Mycobacterium avium subsp. paratuberculosis
gcaaucgagcgggcg

SEQ ID NO: 2948385 - RNA, 16 nt, Mycobacterium avium subsp. paratuberculosis
gcaaucgagcgggcgg

SEQ ID NO: 2948386 - RNA, 19 nt, Mycobacterium avium subsp. paratuberculosis
gcaaucgagcgggcgggcu

SEQ ID NO: 2948387 - RNA, 17 nt, Mycobacterium avium subsp. paratuberculosis
gcaaucgcugcgcccgc

SEQ ID NO: 2948388 - RNA, 23 nt, Mycobacterium avium subsp. paratuberculosis
gcaaucgcugcgcccgccgccac

SEQ ID NO: 2948389 - RNA, 16 nt, Mycobacterium avium subsp. paratuberculosis
gcaaucggacccagcc

SEQ ID NO: 2948390 - RNA, 15 nt, Mycobacterium avium subsp. paratuberculosis
gcaaucggcgccggc

SEQ ID NO: 2948391 - RNA, 16 nt, Mycobacterium avium subsp. paratuberculosis
gcaaucggcgccggcu

SEQ ID NO: 2948392 - RNA, 16 nt, Mycobacterium avium subsp. paratuberculosis
gcaaucggggccgacc

SEQ ID NO: 2948393 - RNA, 18 nt, Mycobacterium avium subsp. paratuberculosis
gcaaucggggccgacccg

SEQ ID NO: 2948394 - RNA, 13 nt, Mycobacterium avium subsp. paratuberculosis
gcaaucucgucgg

SEQ ID NO: 2948395 - RNA, 14 nt, Mycobacterium avium subsp. paratuberculosis
gcaaugcgucgcgg

SEQ ID NO: 2948396 - RNA, 19 nt, Mycobacterium avium subsp. paratuberculosis
gcaaugcgucgcggcggcg

SEQ ID NO: 2948397 - RNA, 20 nt, Mycobacterium avium subsp. paratuberculosis
gcaaugcgucgcggcggcgc

SEQ ID NO: 2948398 - RNA, 17 nt, Mycobacterium avium subsp. paratuberculosis
gcaaugguugcggcggg

SEQ ID NO: 2948399 - RNA, 18 nt, Mycobacterium avium subsp. paratuberculosis
gcacagcuuucgggcggc

SEQ ID NO: 2948400 - RNA, 20 nt, Mycobacterium avium subsp. paratuberculosis
gcacagcuuucgggcggccu

SEQ ID NO: 2948401 - RNA, 17 nt, Mycobacterium avium subsp. paratuberculosis
gcacaggaacgcgacgg

SEQ ID NO: 2948402 - RNA, 18 nt, Mycobacterium avium subsp. paratuberculosis
gcacaggaacgcgacggu

SEQ ID NO: 2948403 - RNA, 19 nt, Mycobacterium avium subsp. paratuberculosis
gcacaggaacgcgacggug

SEQ ID NO: 2948404 - RNA, 20 nt, Mycobacterium avium subsp. paratuberculosis
gcacaggaacgcgacggugg

SEQ ID NO: 2948405 - RNA, 20 nt, Mycobacterium avium subsp. paratuberculosis
gcacaggaugcccaacagcu

SEQ ID NO: 2948406 - RNA, 12 nt, Mycobacterium avium subsp. paratuberculosis
gcacaggccgcc

SEQ ID NO: 2948407 - RNA, 13 nt, Mycobacterium avium subsp. paratuberculosis
gcacaggccgccg

SEQ ID NO: 2948408 - RNA, 14 nt, Mycobacterium avium subsp. paratuberculosis
gcacaggccgccgc

SEQ ID NO: 2948409 - RNA, 20 nt, Mycobacterium avium subsp. paratuberculosis
gcacaggcgaaucggcgcac

SEQ ID NO: 2948410 - RNA, 14 nt, Mycobacterium avium subsp. paratuberculosis
gcacauagcgcagc

SEQ ID NO: 2948411 - RNA, 16 nt, Mycobacterium avium subsp. paratuberculosis
gcacauagcgcagcuc

SEQ ID NO: 2948412 - RNA, 16 nt, Mycobacterium avium subsp. paratuberculosis
gcacaucacgguggcc

SEQ ID NO: 2948413 - RNA, 19 nt, Mycobacterium avium subsp. paratuberculosis
gcacaucacgguggccgcc

SEQ ID NO: 2948414 - RNA, 20 nt, Mycobacterium avium subsp. paratuberculosis
gcacaucacgguggccgcca

SEQ ID NO: 2948415 - RNA, 21 nt, Mycobacterium avium subsp. paratuberculosis
gcacaucacgguggccgccac

SEQ ID NO: 2948416 - RNA, 22 nt, Mycobacterium avium subsp. paratuberculosis
gcacaucacgguggccgccacc

SEQ ID NO: 2948417 - RNA, 22 nt, Mycobacterium avium subsp. paratuberculosis
gcacaucguggcgacgacgccg

SEQ ID NO: 2948418 - RNA, 17 nt, Mycobacterium avium subsp. paratuberculosis
gcacaugcccgucgggc

SEQ ID NO: 2948419 - RNA, 22 nt, Mycobacterium avium subsp. paratuberculosis
gcacaugcccgucgggcggggu

SEQ ID NO: 2948420 - RNA, 16 nt, Mycobacterium avium subsp. paratuberculosis
gcaccaacacgucgag

SEQ ID NO: 2948421 - RNA, 17 nt, Mycobacterium avium subsp. paratuberculosis
gcaccaacacgucgagu

SEQ ID NO: 2948422 - RNA, 14 nt, Mycobacterium avium subsp. paratuberculosis
gcaccaacagcggc

SEQ ID NO: 2948423 - RNA, 17 nt, Mycobacterium avium subsp. paratuberculosis
gcaccaacagcggcccg

SEQ ID NO: 2948424 - RNA, 21 nt, Mycobacterium avium subsp. paratuberculosis
gcaccaacccgaucggcccgg

SEQ ID NO: 2948425 - RNA, 22 nt, Mycobacterium avium subsp. paratuberculosis
gcaccaacccgaucggcccggc

SEQ ID NO: 2948426 - RNA, 23 nt, Mycobacterium avium subsp. paratuberculosis
gcaccaaggcaaucaggcggucg

SEQ ID NO: 2948427 - RNA, 12 nt, Mycobacterium avium subsp. paratuberculosis
gcaccacaucgg

SEQ ID NO: 2948428 - RNA, 20 nt, Mycobacterium avium subsp. paratuberculosis
gcaccacaucggauucgucg

SEQ ID NO: 2948429 - RNA, 17 nt, Mycobacterium avium subsp. paratuberculosis
gcaccaccaacagcagc

SEQ ID NO: 2948430 - RNA, 20 nt, Mycobacterium avium subsp. paratuberculosis
gcaccaccaacagcagcgag

SEQ ID NO: 2948431 - RNA, 14 nt, Mycobacterium avium subsp. paratuberculosis
gcaccaccaacggc

SEQ ID NO: 2948432 - RNA, 21 nt, Mycobacterium avium subsp. paratuberculosis
gcaccaccaacggcucgccgc

SEQ ID NO: 2948433 - RNA, 22 nt, Mycobacterium avium subsp. paratuberculosis
gcaccaccaacggcucgccgcg

SEQ ID NO: 2948434 - RNA, 16 nt, Mycobacterium avium subsp. paratuberculosis
gcaccaccacacccag

SEQ ID NO: 2948435 - RNA, 19 nt, Mycobacterium avium subsp. paratuberculosis
gcaccaccacacccagcgc

SEQ ID NO: 2948436 - RNA, 20 nt, Mycobacterium avium subsp. paratuberculosis
gcaccaccacacccagcgcc

SEQ ID NO: 2948437 - RNA, 21 nt, Mycobacterium avium subsp. paratuberculosis
gcaccaccacacccagcgcca

SEQ ID NO: 2948438 - RNA, 20 nt, Mycobacterium avium subsp. paratuberculosis
gcaccaccacccccgacccg

SEQ ID NO: 2948439 - RNA, 18 nt, Mycobacterium avium subsp. paratuberculosis
gcaccaccaccgacaccc

SEQ ID NO: 2948440 - RNA, 20 nt, Mycobacterium avium subsp. paratuberculosis
gcaccaccaccgacaccccg

SEQ ID NO: 2948441 - RNA, 20 nt, Mycobacterium avium subsp. paratuberculosis
gcaccaccacgguggcgccg

SEQ ID NO: 2948442 - RNA, 22 nt, Mycobacterium avium subsp. paratuberculosis
gcaccaccacgguggcgccggc

SEQ ID NO: 2948443 - RNA, 21 nt, Mycobacterium avium subsp. paratuberculosis
gcaccaccacguugcgcggcc

SEQ ID NO: 2948444 - RNA, 22 nt, Mycobacterium avium subsp. paratuberculosis
gcaccaccacguugcgcggccg

SEQ ID NO: 2948445 - RNA, 21 nt, Mycobacterium avium subsp. paratuberculosis
gcaccaccagcucgucgccga

SEQ ID NO: 2948446 - RNA, 13 nt, Mycobacterium avium subsp. paratuberculosis
gcaccaccaggcc

SEQ ID NO: 2948447 - RNA, 19 nt, Mycobacterium avium subsp. paratuberculosis
gcaccaccaggcccaccac

SEQ ID NO: 2948448 - RNA, 18 nt, Mycobacterium avium subsp. paratuberculosis
gcaccacccagcccuugg

SEQ ID NO: 2948449 - RNA, 14 nt, Mycobacterium avium subsp. paratuberculosis
gcaccacccaggcc

SEQ ID NO: 2948450 - RNA, 15 nt, Mycobacterium avium subsp. paratuberculosis
gcaccacccaggcca

SEQ ID NO: 2948451 - RNA, 16 nt, Mycobacterium avium subsp. paratuberculosis
gcaccacccaggccac

SEQ ID NO: 2948452 - RNA, 17 nt, Mycobacterium avium subsp. paratuberculosis
gcaccacccaggccacc

SEQ ID NO: 2948453 - RNA, 20 nt, Mycobacterium avium subsp. paratuberculosis
gcaccacccaggccacccgg

SEQ ID NO: 2948454 - RNA, 21 nt, Mycobacterium avium subsp. paratuberculosis
gcaccacccgcaccucgcccg

SEQ ID NO: 2948455 - RNA, 22 nt, Mycobacterium avium subsp. paratuberculosis
gcaccacccgcaccucgcccgg

SEQ ID NO: 2948456 - RNA, 23 nt, Mycobacterium avium subsp. paratuberculosis
gcaccacccgcaccucgcccggc

SEQ ID NO: 2948457 - RNA, 12 nt, Mycobacterium avium subsp. paratuberculosis
gcaccacccgcg

SEQ ID NO: 2948458 - RNA, 16 nt, Mycobacterium avium subsp. paratuberculosis
gcaccacccgcggccg

SEQ ID NO: 2948459 - RNA, 23 nt, Mycobacterium avium subsp. paratuberculosis
gcaccacccgcggccggcccagc

SEQ ID NO: 2948460 - RNA, 15 nt, Mycobacterium avium subsp. paratuberculosis
gcaccacccgggugu

SEQ ID NO: 2948461 - RNA, 13 nt, Mycobacterium avium subsp. paratuberculosis
gcaccaccgcgag

SEQ ID NO: 2948462 - RNA, 19 nt, Mycobacterium avium subsp. paratuberculosis
gcaccaccgcgagcgggug

SEQ ID NO: 2948463 - RNA, 23 nt, Mycobacterium avium subsp. paratuberculosis
gcaccaccgcggugagcggccgc

SEQ ID NO: 2948464 - RNA, 18 nt, Mycobacterium avium subsp. paratuberculosis
gcaccaccgucaccgccg

SEQ ID NO: 2948465 - RNA, 20 nt, Mycobacterium avium subsp. paratuberculosis
gcaccaccgucaccgccgca

SEQ ID NO: 2948466 - RNA, 21 nt, Mycobacterium avium subsp. paratuberculosis
gcaccaccgucaccgccgcac

SEQ ID NO: 2948467 - RNA, 18 nt, Mycobacterium avium subsp. paratuberculosis
gcaccaccgugccgucgc

SEQ ID NO: 2948468 - RNA, 16 nt, Mycobacterium avium subsp. paratuberculosis
gcaccaccguggcgau

SEQ ID NO: 2948469 - RNA, 18 nt, Mycobacterium avium subsp. paratuberculosis
gcaccaccguggcgaugg

SEQ ID NO: 2948470 - RNA, 14 nt, Mycobacterium avium subsp. paratuberculosis
gcaccaccucgcgc

SEQ ID NO: 2948471 - RNA, 17 nt, Mycobacterium avium subsp. paratuberculosis
gcaccaccucgcgcggg

SEQ ID NO: 2948472 - RNA, 20 nt, Mycobacterium avium subsp. paratuberculosis
gcaccaccucgcgcggggcg

SEQ ID NO: 2948473 - RNA, 14 nt, Mycobacterium avium subsp. paratuberculosis
gcaccaccucggcg

SEQ ID NO: 2948474 - RNA, 21 nt, Mycobacterium avium subsp. paratuberculosis
gcaccaccucgugcacaugcc

SEQ ID NO: 2948475 - RNA, 14 nt, Mycobacterium avium subsp. paratuberculosis
gcaccaccuuguca

SEQ ID NO: 2948476 - RNA, 13 nt, Mycobacterium avium subsp. paratuberculosis
gcaccacgaagcg

SEQ ID NO: 2948477 - RNA, 19 nt, Mycobacterium avium subsp. paratuberculosis
gcaccacgacgucgagcca

SEQ ID NO: 2948478 - RNA, 14 nt, Mycobacterium avium subsp. paratuberculosis
gcaccacgagcagc

SEQ ID NO: 2948479 - RNA, 15 nt, Mycobacterium avium subsp. paratuberculosis
gcaccacgagcagcc

SEQ ID NO: 2948480 - RNA, 18 nt, Mycobacterium avium subsp. paratuberculosis
gcaccacgcccgacgacg

SEQ ID NO: 2948481 - RNA, 14 nt, Mycobacterium avium subsp. paratuberculosis
gcaccacgccgacg

SEQ ID NO: 2948482 - RNA, 22 nt, Mycobacterium avium subsp. paratuberculosis
gcaccacgcugugcucgacgaa

SEQ ID NO: 2948483 - RNA, 22 nt, Mycobacterium avium subsp. paratuberculosis
gcaccagcugauucgcgguggc

SEQ ID NO: 2948484 - RNA, 14 nt, Mycobacterium avium subsp. paratuberculosis
gcaccaggaaggcg

SEQ ID NO: 2948485 - RNA, 20 nt, Mycobacterium avium subsp. paratuberculosis
gcaccaggacgcgaccggcc

SEQ ID NO: 2948486 - RNA, 22 nt, Mycobacterium avium subsp. paratuberculosis
gcaccaggacgcgaccggccau

SEQ ID NO: 2948487 - RNA, 14 nt, Mycobacterium avium subsp. paratuberculosis
gcaccaggcccucc

SEQ ID NO: 2948488 - RNA, 19 nt, Mycobacterium avium subsp. paratuberculosis
gcaccaggcccucgccgcg

SEQ ID NO: 2948489 - RNA, 20 nt, Mycobacterium avium subsp. paratuberculosis
gcaccaggcccucgccgcgg

SEQ ID NO: 2948490 - RNA, 21 nt, Mycobacterium avium subsp. paratuberculosis
gcaccaggcccucgccgcggu

SEQ ID NO: 2948491 - RNA, 15 nt, Mycobacterium avium subsp. paratuberculosis
gcaccaggccgacgc

SEQ ID NO: 2948492 - RNA, 21 nt, Mycobacterium avium subsp. paratuberculosis
gcaccaggccgacgcuggccg

SEQ ID NO: 2948493 - RNA, 16 nt, Mycobacterium avium subsp. paratuberculosis
gcaccaggcgcaccag

SEQ ID NO: 2948494 - RNA, 20 nt, Mycobacterium avium subsp. paratuberculosis
gcaccaggcgcaccagcuga

SEQ ID NO: 2948495 - RNA, 19 nt, Mycobacterium avium subsp. paratuberculosis
gcaccaggcgccacagcag

SEQ ID NO: 2948496 - RNA, 20 nt, Mycobacterium avium subsp. paratuberculosis
gcaccaggcgccacagcagc

SEQ ID NO: 2948497 - RNA, 23 nt, Mycobacterium avium subsp. paratuberculosis
gcaccaggcgccacagcagcacc

SEQ ID NO: 2948498 - RNA, 11 nt, Mycobacterium avium subsp. paratuberculosis
gcaccaggcug

SEQ ID NO: 2948499 - RNA, 18 nt, Mycobacterium avium subsp. paratuberculosis
gcaccaggcugaccagcg

SEQ ID NO: 2948500 - RNA, 20 nt, Mycobacterium avium subsp. paratuberculosis
gcaccaggcugaccagcgcc

SEQ ID NO: 2948501 - RNA, 21 nt, Mycobacterium avium subsp. paratuberculosis
gcaccaggcugaccagcgccu

SEQ ID NO: 2948502 - RNA, 16 nt, Mycobacterium avium subsp. paratuberculosis
gcaccagggccgcgag

SEQ ID NO: 2948503 - RNA, 17 nt, Mycobacterium avium subsp. paratuberculosis
gcaccagggccgcgagc

SEQ ID NO: 2948504 - RNA, 17 nt, Mycobacterium avium subsp. paratuberculosis
gcaccagggccugcagc

SEQ ID NO: 2948505 - RNA, 18 nt, Mycobacterium avium subsp. paratuberculosis
gcaccagggccugcagca

SEQ ID NO: 2948506 - RNA, 21 nt, Mycobacterium avium subsp. paratuberculosis
gcaccagggccugcagcacca

SEQ ID NO: 2948507 - RNA, 22 nt, Mycobacterium avium subsp. paratuberculosis
gcaccagggccugcagcaccag

SEQ ID NO: 2948508 - RNA, 23 nt, Mycobacterium avium subsp. paratuberculosis
gcaccagggccugcagcaccagg

SEQ ID NO: 2948509 - RNA, 24 nt, Mycobacterium avium subsp. paratuberculosis
gcaccagggccugcagcaccaggc

SEQ ID NO: 2948510 - RNA, 14 nt, Mycobacterium avium subsp. paratuberculosis
gcaccagggcgucg

SEQ ID NO: 2948511 - RNA, 13 nt, Mycobacterium avium subsp. paratuberculosis
gcaccagggcgug

SEQ ID NO: 2948512 - RNA, 22 nt, Mycobacterium avium subsp. paratuberculosis
gcaccagggugucgucgcgcac

SEQ ID NO: 2948513 - RNA, 17 nt, Mycobacterium avium subsp. paratuberculosis
gcaccagguaccggcgg

SEQ ID NO: 2948514 - RNA, 19 nt, Mycobacterium avium subsp. paratuberculosis
gcaccagguaccggcgggc

SEQ ID NO: 2948515 - RNA, 20 nt, Mycobacterium avium subsp. paratuberculosis
gcaccagguaccggcgggcg

SEQ ID NO: 2948516 - RNA, 21 nt, Mycobacterium avium subsp. paratuberculosis
gcaccagguaccggcgggcga

SEQ ID NO: 2948517 - RNA, 15 nt, Mycobacterium avium subsp. paratuberculosis
gcaccagguaggugg

SEQ ID NO: 2948518 - RNA, 18 nt, Mycobacterium avium subsp. paratuberculosis
gcaccagguagguggccg

SEQ ID NO: 2948519 - RNA, 20 nt, Mycobacterium avium subsp. paratuberculosis
gcaccagguagguggccguc

SEQ ID NO: 2948520 - RNA, 19 nt, Mycobacterium avium subsp. paratuberculosis
gcaccaggucguugccggu

SEQ ID NO: 2948521 - RNA, 20 nt, Mycobacterium avium subsp. paratuberculosis
gcaccagguggcccgacccg

SEQ ID NO: 2948522 - RNA, 22 nt, Mycobacterium avium subsp. paratuberculosis
gcaccagguucacgucggggau

SEQ ID NO: 2948523 - RNA, 18 nt, Mycobacterium avium subsp. paratuberculosis
gcaccagguugucgccgc

SEQ ID NO: 2948524 - RNA, 19 nt, Mycobacterium avium subsp. paratuberculosis
gcaccagguugucgccgcg

SEQ ID NO: 2948525 - RNA, 20 nt, Mycobacterium avium subsp. paratuberculosis
gcaccagguugucgccgcgc

SEQ ID NO: 2948526 - RNA, 24 nt, Mycobacterium avium subsp. paratuberculosis
gcaccagguugucgccgcgccagc

SEQ ID NO: 2948527 - RNA, 23 nt, Mycobacterium avium subsp. paratuberculosis
gcaccaguaggucacccgguccc

SEQ ID NO: 2948528 - RNA, 16 nt, Mycobacterium avium subsp. paratuberculosis
gcaccagucgcgcagc

SEQ ID NO: 2948529 - RNA, 17 nt, Mycobacterium avium subsp. paratuberculosis
gcaccagucgcgcagcg

SEQ ID NO: 2948530 - RNA, 22 nt, Mycobacterium avium subsp. paratuberculosis
gcaccagucggccaucagcacc

SEQ ID NO: 2948531 - RNA, 23 nt, Mycobacterium avium subsp. paratuberculosis
gcaccaguuccugcaugccgggc

SEQ ID NO: 2948532 - RNA, 22 nt, Mycobacterium avium subsp. paratuberculosis
gcaccaguucgcguacccgcgc

SEQ ID NO: 2948533 - RNA, 17 nt, Mycobacterium avium subsp. paratuberculosis
gcaccaguugcaccggc

SEQ ID NO: 2948534 - RNA, 18 nt, Mycobacterium avium subsp. paratuberculosis
gcaccaguugcaccggca

SEQ ID NO: 2948535 - RNA, 21 nt, Mycobacterium avium subsp. paratuberculosis
gcaccaguugcaccggcaccg

SEQ ID NO: 2948536 - RNA, 23 nt, Mycobacterium avium subsp. paratuberculosis
gcaccaguuugguguucgggcag

SEQ ID NO: 2948537 - RNA, 15 nt, Mycobacterium avium subsp. paratuberculosis
gcaccauccagugca

SEQ ID NO: 2948538 - RNA, 16 nt, Mycobacterium avium subsp. paratuberculosis
gcaccauccgcgacgc

SEQ ID NO: 2948539 - RNA, 19 nt, Mycobacterium avium subsp. paratuberculosis
gcaccauccgcgacgccag

SEQ ID NO: 2948540 - RNA, 20 nt, Mycobacterium avium subsp. paratuberculosis
gcaccauccgcgacgccagc

SEQ ID NO: 2948541 - RNA, 15 nt, Mycobacterium avium subsp. paratuberculosis
gcaccauccgcgcga

SEQ ID NO: 2948542 - RNA, 23 nt, Mycobacterium avium subsp. paratuberculosis
gcaccauccgcgcgagcgcgcug

SEQ ID NO: 2948543 - RNA, 16 nt, Mycobacterium avium subsp. paratuberculosis
gcaccaucgcgaugga

SEQ ID NO: 2948544 - RNA, 18 nt, Mycobacterium avium subsp. paratuberculosis
gcaccaugaucaggcccc

SEQ ID NO: 2948545 - RNA, 21 nt, Mycobacterium avium subsp. paratuberculosis
gcaccaugaucaggccccacc

SEQ ID NO: 2948546 - RNA, 22 nt, Mycobacterium avium subsp. paratuberculosis
gcaccaugaucaggccccaccc

SEQ ID NO: 2948547 - RNA, 23 nt, Mycobacterium avium subsp. paratuberculosis
gcaccaugaucaggccccacccg

SEQ ID NO: 2948548 - RNA, 16 nt, Mycobacterium avium subsp. paratuberculosis
gcaccauugcgggaag

SEQ ID NO: 2948549 - RNA, 13 nt, Mycobacterium avium subsp. paratuberculosis
gcacccaccggcc

SEQ ID NO: 2948550 - RNA, 16 nt, Mycobacterium avium subsp. paratuberculosis
gcacccaccggcgcag

SEQ ID NO: 2948551 - RNA, 17 nt, Mycobacterium avium subsp. paratuberculosis
gcacccaccggcgcagc

SEQ ID NO: 2948552 - RNA, 18 nt, Mycobacterium avium subsp. paratuberculosis
gcacccaccggcgcagcg

SEQ ID NO: 2948553 - RNA, 22 nt, Mycobacterium avium subsp. paratuberculosis
gcacccagacguguggcacccg

SEQ ID NO: 2948554 - RNA, 14 nt, Mycobacterium avium subsp. paratuberculosis
gcacccagcacagc

SEQ ID NO: 2948555 - RNA, 15 nt, Mycobacterium avium subsp. paratuberculosis
gcacccagcacagcg

SEQ ID NO: 2948556 - RNA, 12 nt, Mycobacterium avium subsp. paratuberculosis
gcacccagccgc

SEQ ID NO: 2948557 - RNA, 13 nt, Mycobacterium avium subsp. paratuberculosis
gcacccagccgca

SEQ ID NO: 2948558 - RNA, 16 nt, Mycobacterium avium subsp. paratuberculosis
gcacccagcggaaccg

SEQ ID NO: 2948559 - RNA, 22 nt, Mycobacterium avium subsp. paratuberculosis
gcacccagcggaaccgggggcc

SEQ ID NO: 2948560 - RNA, 23 nt, Mycobacterium avium subsp. paratuberculosis
gcacccagcggaaccgggggccg

SEQ ID NO: 2948561 - RNA, 16 nt, Mycobacterium avium subsp. paratuberculosis
gcacccauccccagga

SEQ ID NO: 2948562 - RNA, 22 nt, Mycobacterium avium subsp. paratuberculosis
gcacccauccccaggauggccg

SEQ ID NO: 2948563 - RNA, 14 nt, Mycobacterium avium subsp. paratuberculosis
gcaccccacccgcg

SEQ ID NO: 2948564 - RNA, 17 nt, Mycobacterium avium subsp. paratuberculosis
gcaccccacccgcgcga

SEQ ID NO: 2948565 - RNA, 20 nt, Mycobacterium avium subsp. paratuberculosis
gcacccccaauugccgggcc

SEQ ID NO: 2948566 - RNA, 18 nt, Mycobacterium avium subsp. paratuberculosis
gcacccggguggacaccg

SEQ ID NO: 2948567 - RNA, 19 nt, Mycobacterium avium subsp. paratuberculosis
gcacccggguggacaccgc

SEQ ID NO: 2948568 - RNA, 20 nt, Mycobacterium avium subsp. paratuberculosis
gcacccggguggacaccgcg

SEQ ID NO: 2948569 - RNA, 21 nt, Mycobacterium avium subsp. paratuberculosis
gcacccggguggacaccgcga

SEQ ID NO: 2948570 - RNA, 22 nt, Mycobacterium avium subsp. paratuberculosis
gcacccggguggacaccgcgau

SEQ ID NO: 2948571 - RNA, 18 nt, Mycobacterium avium subsp. paratuberculosis
gcacccgguccggcccgg

SEQ ID NO: 2948572 - RNA, 13 nt, Mycobacterium avium subsp. paratuberculosis
gcacccggucgcc

SEQ ID NO: 2948573 - RNA, 14 nt, Mycobacterium avium subsp. paratuberculosis
gcacccggucgccg

SEQ ID NO: 2948574 - RNA, 17 nt, Mycobacterium avium subsp. paratuberculosis
gcacccggucgccggug

SEQ ID NO: 2948575 - RNA, 20 nt, Mycobacterium avium subsp. paratuberculosis
gcacccggucggugagcugg

SEQ ID NO: 2948576 - RNA, 18 nt, Mycobacterium avium subsp. paratuberculosis
gcacccgguuccaccggg

SEQ ID NO: 2948577 - RNA, 20 nt, Mycobacterium avium subsp. paratuberculosis
gcacccgguuccaccgggcc

SEQ ID NO: 2948578 - RNA, 21 nt, Mycobacterium avium subsp. paratuberculosis
gcacccgguuccaccgggccg

SEQ ID NO: 2948579 - RNA, 21 nt, Mycobacterium avium subsp. paratuberculosis
gcacccgguucugggcgggcu

SEQ ID NO: 2948580 - RNA, 13 nt, Mycobacterium avium subsp. paratuberculosis
gcacccguucggc

SEQ ID NO: 2948581 - RNA, 13 nt, Mycobacterium avium subsp. paratuberculosis
gcacccucggugc

SEQ ID NO: 2948582 - RNA, 13 nt, Mycobacterium avium subsp. paratuberculosis
gcacccucugcca

SEQ ID NO: 2948583 - RNA, 18 nt, Mycobacterium avium subsp. paratuberculosis
gcacccucugccacggcg

SEQ ID NO: 2948584 - RNA, 19 nt, Mycobacterium avium subsp. paratuberculosis
gcacccuugacuaccgcgc

SEQ ID NO: 2948585 - RNA, 15 nt, Mycobacterium avium subsp. paratuberculosis
gcaccgaaccggcgg

SEQ ID NO: 2948586 - RNA, 16 nt, Mycobacterium avium subsp. paratuberculosis
gcaccgaaccggcggg

SEQ ID NO: 2948587 - RNA, 15 nt, Mycobacterium avium subsp. paratuberculosis
gcaccgaacgccagc

SEQ ID NO: 2948588 - RNA, 16 nt, Mycobacterium avium subsp. paratuberculosis
gcaccgaacgccagca

SEQ ID NO: 2948589 - RNA, 18 nt, Mycobacterium avium subsp. paratuberculosis
gcaccgaacgccagcagc

SEQ ID NO: 2948590 - RNA, 22 nt, Mycobacterium avium subsp. paratuberculosis
gcaccgaacgccagcagcugcg

SEQ ID NO: 2948591 - RNA, 17 nt, Mycobacterium avium subsp. paratuberculosis
gcaccgaaucgccgagc

SEQ ID NO: 2948592 - RNA, 18 nt, Mycobacterium avium subsp. paratuberculosis
gcaccgaaucgccgagcu

SEQ ID NO: 2948593 - RNA, 22 nt, Mycobacterium avium subsp. paratuberculosis
gcaccgaaucgccgagcucgau

SEQ ID NO: 2948594 - RNA, 22 nt, Mycobacterium avium subsp. paratuberculosis
gcaccgacagcuugauguugcc

SEQ ID NO: 2948595 - RNA, 15 nt, Mycobacterium avium subsp. paratuberculosis
gcaccgacagggcca

SEQ ID NO: 2948596 - RNA, 17 nt, Mycobacterium avium subsp. paratuberculosis
gcaccgacagggccagc

SEQ ID NO: 2948597 - RNA, 20 nt, Mycobacterium avium subsp. paratuberculosis
gcaccgacagggccagcgcc

SEQ ID NO: 2948598 - RNA, 21 nt, Mycobacterium avium subsp. paratuberculosis
gcaccgacagggccagcgcca

SEQ ID NO: 2948599 - RNA, 23 nt, Mycobacterium avium subsp. paratuberculosis
gcaccgacaucagaucgccgacg

SEQ ID NO: 2948600 - RNA, 16 nt, Mycobacterium avium subsp. paratuberculosis
gcaccgaccagcggga

SEQ ID NO: 2948601 - RNA, 14 nt, Mycobacterium avium subsp. paratuberculosis
gcaccgacgaggag

SEQ ID NO: 2948602 - RNA, 16 nt, Mycobacterium avium subsp. paratuberculosis
gcaccgacgcggcgac

SEQ ID NO: 2948603 - RNA, 16 nt, Mycobacterium avium subsp. paratuberculosis
gcaccgacggagccga

SEQ ID NO: 2948604 - RNA, 15 nt, Mycobacterium avium subsp. paratuberculosis
gcaccgacggccgca

SEQ ID NO: 2948605 - RNA, 20 nt, Mycobacterium avium subsp. paratuberculosis
gcaccgacggccgcacccca

SEQ ID NO: 2948606 - RNA, 21 nt, Mycobacterium avium subsp. paratuberculosis
gcaccgacggccgcaccccac

SEQ ID NO: 2948607 - RNA, 22 nt, Mycobacterium avium subsp. paratuberculosis
gcaccgacggccgcaccccacc

SEQ ID NO: 2948608 - RNA, 13 nt, Mycobacterium avium subsp. paratuberculosis
gcaccgacuccuc

SEQ ID NO: 2948609 - RNA, 18 nt, Mycobacterium avium subsp. paratuberculosis
gcaccgacuccuccggcc

SEQ ID NO: 2948610 - RNA, 19 nt, Mycobacterium avium subsp. paratuberculosis
gcaccgacuccuccggccc

SEQ ID NO: 2948611 - RNA, 21 nt, Mycobacterium avium subsp. paratuberculosis
gcaccgacuccuccggcccga

SEQ ID NO: 2948612 - RNA, 14 nt, Mycobacterium avium subsp. paratuberculosis
gcaccgacugcggc

SEQ ID NO: 2948613 - RNA, 16 nt, Mycobacterium avium subsp. paratuberculosis
gcaccgacugcggcgc

SEQ ID NO: 2948614 - RNA, 17 nt, Mycobacterium avium subsp. paratuberculosis
gcaccgacugcggcgcu

SEQ ID NO: 2948615 - RNA, 19 nt, Mycobacterium avium subsp. paratuberculosis
gcaccgagaacagaugccg

SEQ ID NO: 2948616 - RNA, 22 nt, Mycobacterium avium subsp. paratuberculosis
gcaccgagaacagaugccggug

SEQ ID NO: 2948617 - RNA, 18 nt, Mycobacterium avium subsp. paratuberculosis
gcaccgagaccaugccgc

SEQ ID NO: 2948618 - RNA, 19 nt, Mycobacterium avium subsp. paratuberculosis
gcaccgagaccaugccgcc

SEQ ID NO: 2948619 - RNA, 21 nt, Mycobacterium avium subsp. paratuberculosis
gcaccgagaccaugccgccga

SEQ ID NO: 2948620 - RNA, 13 nt, Mycobacterium avium subsp. paratuberculosis
gcaccgagccugg

SEQ ID NO: 2948621 - RNA, 23 nt, Mycobacterium avium subsp. paratuberculosis
gcaccgaguagaacuucgccagc

SEQ ID NO: 2948622 - RNA, 18 nt, Mycobacterium avium subsp. paratuberculosis
gcaccgaguugaacgcgu

SEQ ID NO: 2948623 - RNA, 21 nt, Mycobacterium avium subsp. paratuberculosis
gcaccgauaguagccagcauc

SEQ ID NO: 2948624 - RNA, 20 nt, Mycobacterium avium subsp. paratuberculosis
gcaccgaucggcacgucgag

SEQ ID NO: 2948625 - RNA, 18 nt, Mycobacterium avium subsp. paratuberculosis
gcaccgauggguuggccg

SEQ ID NO: 2948626 - RNA, 22 nt, Mycobacterium avium subsp. paratuberculosis
gcaccgauggguuggccgucgc

SEQ ID NO: 2948627 - RNA, 18 nt, Mycobacterium avium subsp. paratuberculosis
gcaccgcaaagcaccgcg

SEQ ID NO: 2948628 - RNA, 15 nt, Mycobacterium avium subsp. paratuberculosis
gcaccgcaacguugu

SEQ ID NO: 2948629 - RNA, 17 nt, Mycobacterium avium subsp. paratuberculosis
gcaccgcauagcgggag

SEQ ID NO: 2948630 - RNA, 23 nt, Mycobacterium avium subsp. paratuberculosis
gcaccgcauagcgggagccggcc

SEQ ID NO: 2948631 - RNA, 20 nt, Mycobacterium avium subsp. paratuberculosis
gcaccgcauaggaccggaug

SEQ ID NO: 2948632 - RNA, 20 nt, Mycobacterium avium subsp. paratuberculosis
gcaccgcaucccccucggcg

SEQ ID NO: 2948633 - RNA, 21 nt, Mycobacterium avium subsp. paratuberculosis
gcaccgcaucccccucggcgg

SEQ ID NO: 2948634 - RNA, 16 nt, Mycobacterium avium subsp. paratuberculosis
gcaccgcauggggcag

SEQ ID NO: 2948635 - RNA, 18 nt, Mycobacterium avium subsp. paratuberculosis
gcaccgccaccgcccgcu

SEQ ID NO: 2948636 - RNA, 14 nt, Mycobacterium avium subsp. paratuberculosis
gcaccgccaccgcg

SEQ ID NO: 2948637 - RNA, 16 nt, Mycobacterium avium subsp. paratuberculosis
gcaccgccaccgcgca

SEQ ID NO: 2948638 - RNA, 17 nt, Mycobacterium avium subsp. paratuberculosis
gcaccgccaccgcgcaa

SEQ ID NO: 2948639 - RNA, 15 nt, Mycobacterium avium subsp. paratuberculosis
gcaccgccacgccgu

SEQ ID NO: 2948640 - RNA, 20 nt, Mycobacterium avium subsp. paratuberculosis
gcaccgccacgucgaacccg

SEQ ID NO: 2948641 - RNA, 21 nt, Mycobacterium avium subsp. paratuberculosis
gcaccgccacgucugcuugca

SEQ ID NO: 2948642 - RNA, 11 nt, Mycobacterium avium subsp. paratuberculosis
gcaccgccagc

SEQ ID NO: 2948643 - RNA, 13 nt, Mycobacterium avium subsp. paratuberculosis
gcaccgccagcac

SEQ ID NO: 2948644 - RNA, 15 nt, Mycobacterium avium subsp. paratuberculosis
gcaccgccagcaccg

SEQ ID NO: 2948645 - RNA, 18 nt, Mycobacterium avium subsp. paratuberculosis
gcaccgccagcaccgacg

SEQ ID NO: 2948646 - RNA, 21 nt, Mycobacterium avium subsp. paratuberculosis
gcaccgccagcaccgacgcgc

SEQ ID NO: 2948647 - RNA, 14 nt, Mycobacterium avium subsp. paratuberculosis
gcaccgccagcgcc

SEQ ID NO: 2948648 - RNA, 18 nt, Mycobacterium avium subsp. paratuberculosis
gcaccgccagcgccggca

SEQ ID NO: 2948649 - RNA, 19 nt, Mycobacterium avium subsp. paratuberculosis
gcaccgccagcgccggcag

SEQ ID NO: 2948650 - RNA, 19 nt, Mycobacterium avium subsp. paratuberculosis
gcaccgggcccgcccgcag

SEQ ID NO: 2948651 - RNA, 23 nt, Mycobacterium avium subsp. paratuberculosis
gcaccgggcccgcccgcagcggc

SEQ ID NO: 2948652 - RNA, 16 nt, Mycobacterium avium subsp. paratuberculosis
gcaccgggccgaaggc

SEQ ID NO: 2948653 - RNA, 20 nt, Mycobacterium avium subsp. paratuberculosis
gcaccgggccgaaggcggcg

SEQ ID NO: 2948654 - RNA, 14 nt, Mycobacterium avium subsp. paratuberculosis
gcaccgggcgucgg

SEQ ID NO: 2948655 - RNA, 17 nt, Mycobacterium avium subsp. paratuberculosis
gcaccgggcgucggggc

SEQ ID NO: 2948656 - RNA, 15 nt, Mycobacterium avium subsp. paratuberculosis
gcaccgggcugucgg

SEQ ID NO: 2948657 - RNA, 17 nt, Mycobacterium avium subsp. paratuberculosis
gcaccgggcugucgggc

SEQ ID NO: 2948658 - RNA, 12 nt, Mycobacterium avium subsp. paratuberculosis
gcaccggggcca

SEQ ID NO: 2948659 - RNA, 18 nt, Mycobacterium avium subsp. paratuberculosis
gcaccggggccaacuccg

SEQ ID NO: 2948660 - RNA, 22 nt, Mycobacterium avium subsp. paratuberculosis
gcaccggggccaacuccggcgg

SEQ ID NO: 2948661 - RNA, 23 nt, Mycobacterium avium subsp. paratuberculosis
gcaccggggccaacuccggcggc

SEQ ID NO: 2948662 - RNA, 14 nt, Mycobacterium avium subsp. paratuberculosis
gcaccggggccggc

SEQ ID NO: 2948663 - RNA, 15 nt, Mycobacterium avium subsp. paratuberculosis
gcaccggggccggcg

SEQ ID NO: 2948664 - RNA, 16 nt, Mycobacterium avium subsp. paratuberculosis
gcaccggggccggcgg

SEQ ID NO: 2948665 - RNA, 17 nt, Mycobacterium avium subsp. paratuberculosis
gcaccggggccggcggg

SEQ ID NO: 2948666 - RNA, 17 nt, Mycobacterium avium subsp. paratuberculosis
gcaccggguacaccggc

SEQ ID NO: 2948667 - RNA, 18 nt, Mycobacterium avium subsp. paratuberculosis
gcaccggguacaccggcu

SEQ ID NO: 2948668 - RNA, 20 nt, Mycobacterium avium subsp. paratuberculosis
gcaccggguacaccggcucg

SEQ ID NO: 2948669 - RNA, 20 nt, Mycobacterium avium subsp. paratuberculosis
gcaccgggugauaccggccc

SEQ ID NO: 2948670 - RNA, 21 nt, Mycobacterium avium subsp. paratuberculosis
gcaccgggugauaccggccca

SEQ ID NO: 2948671 - RNA, 13 nt, Mycobacterium avium subsp. paratuberculosis
gcaccgggugggc

SEQ ID NO: 2948672 - RNA, 15 nt, Mycobacterium avium subsp. paratuberculosis
gcaccgggugggccg

SEQ ID NO: 2948673 - RNA, 16 nt, Mycobacterium avium subsp. paratuberculosis
gcaccgggugggccga

SEQ ID NO: 2948674 - RNA, 18 nt, Mycobacterium avium subsp. paratuberculosis
gcaccgggugggccgacc

SEQ ID NO: 2948675 - RNA, 14 nt, Mycobacterium avium subsp. paratuberculosis
gcaccggugcaccg

SEQ ID NO: 2948676 - RNA, 15 nt, Mycobacterium avium subsp. paratuberculosis
gcaccggugcggcgg

SEQ ID NO: 2948677 - RNA, 21 nt, Mycobacterium avium subsp. paratuberculosis
gcaccggugcggcggugacga

SEQ ID NO: 2948678 - RNA, 20 nt, Mycobacterium avium subsp. paratuberculosis
gcaccgguuccaacggaagc

SEQ ID NO: 2948679 - RNA, 18 nt, Mycobacterium avium subsp. paratuberculosis
gcaccgguuugucggcgc

SEQ ID NO: 2948680 - RNA, 19 nt, Mycobacterium avium subsp. paratuberculosis
gcaccgguuugucggcgcc

SEQ ID NO: 2948681 - RNA, 21 nt, Mycobacterium avium subsp. paratuberculosis
gcaccgguuugucggcgcccu

SEQ ID NO: 2948682 - RNA, 18 nt, Mycobacterium avium subsp. paratuberculosis
gcaccgucaccgacggcu

SEQ ID NO: 2948683 - RNA, 13 nt, Mycobacterium avium subsp. paratuberculosis
gcaccgucaccgc

SEQ ID NO: 2948684 - RNA, 15 nt, Mycobacterium avium subsp. paratuberculosis
gcaccgucaccgccu

SEQ ID NO: 2948685 - RNA, 16 nt, Mycobacterium avium subsp. paratuberculosis
gcaccgucaccgccuc

SEQ ID NO: 2948686 - RNA, 20 nt, Mycobacterium avium subsp. paratuberculosis
gcaccgucaccuucaccccc

SEQ ID NO: 2948687 - RNA, 13 nt, Mycobacterium avium subsp. paratuberculosis
gcaccgucagcca

SEQ ID NO: 2948688 - RNA, 18 nt, Mycobacterium avium subsp. paratuberculosis
gcaccguccacagccggc

SEQ ID NO: 2948689 - RNA, 19 nt, Mycobacterium avium subsp. paratuberculosis
gcaccguccacagccggcg

SEQ ID NO: 2948690 - RNA, 14 nt, Mycobacterium avium subsp. paratuberculosis
gcaccgucgccggc

SEQ ID NO: 2948691 - RNA, 13 nt, Mycobacterium avium subsp. paratuberculosis
gcaccgucggcgu

SEQ ID NO: 2948692 - RNA, 13 nt, Mycobacterium avium subsp. paratuberculosis
gcaccgucgucgc

SEQ ID NO: 2948693 - RNA, 20 nt, Mycobacterium avium subsp. paratuberculosis
gcaccgucgucgcaccggca

SEQ ID NO: 2948694 - RNA, 13 nt, Mycobacterium avium subsp. paratuberculosis
gcaccgucgugcc

SEQ ID NO: 2948695 - RNA, 19 nt, Mycobacterium avium subsp. paratuberculosis
gcaccgucgugccagcgca

SEQ ID NO: 2948696 - RNA, 20 nt, Mycobacterium avium subsp. paratuberculosis
gcaccgucgugccagcgcag

SEQ ID NO: 2948697 - RNA, 19 nt, Mycobacterium avium subsp. paratuberculosis
gcaccgucugcgccgucac

SEQ ID NO: 2948698 - RNA, 16 nt, Mycobacterium avium subsp. paratuberculosis
gcaccgugccgcccgu

SEQ ID NO: 2948699 - RNA, 22 nt, Mycobacterium avium subsp. paratuberculosis
gcaccgugccgcccgucgccuc

SEQ ID NO: 2948700 - RNA, 16 nt, Mycobacterium avium subsp. paratuberculosis
gcaccgugccgcgcgg

SEQ ID NO: 2948701 - RNA, 18 nt, Mycobacterium avium subsp. paratuberculosis
gcaccgugccgcgcggcg

SEQ ID NO: 2948702 - RNA, 22 nt, Mycobacterium avium subsp. paratuberculosis
gcaccgugccgcgcggcgguga

SEQ ID NO: 2948703 - RNA, 15 nt, Mycobacterium avium subsp. paratuberculosis
gcaccgugccgucgg

SEQ ID NO: 2948704 - RNA, 16 nt, Mycobacterium avium subsp. paratuberculosis
gcaccgugccgucggc

SEQ ID NO: 2948705 - RNA, 18 nt, Mycobacterium avium subsp. paratuberculosis
gcaccgugccgucggcgu

SEQ ID NO: 2948706 - RNA, 20 nt, Mycobacterium avium subsp. paratuberculosis
gcaccgugccgucggcgucg

SEQ ID NO: 2948707 - RNA, 19 nt, Mycobacterium avium subsp. paratuberculosis
gcaccgugcugauccacgc

SEQ ID NO: 2948708 - RNA, 21 nt, Mycobacterium avium subsp. paratuberculosis
gcaccguggugacccggaccg

SEQ ID NO: 2948709 - RNA, 18 nt, Mycobacterium avium subsp. paratuberculosis
gcaccguguagccgaccg

SEQ ID NO: 2948710 - RNA, 18 nt, Mycobacterium avium subsp. paratuberculosis
gcaccguugugacccgcu

SEQ ID NO: 2948711 - RNA, 21 nt, Mycobacterium avium subsp. paratuberculosis
gcaccguugugacccgcucgg

SEQ ID NO: 2948712 - RNA, 22 nt, Mycobacterium avium subsp. paratuberculosis
gcaccguugugacccgcucggg

SEQ ID NO: 2948713 - RNA, 16 nt, Mycobacterium avium subsp. paratuberculosis
gcaccuccagcccggc

SEQ ID NO: 2948714 - RNA, 14 nt, Mycobacterium avium subsp. paratuberculosis
gcaccuccugcacc

SEQ ID NO: 2948715 - RNA, 16 nt, Mycobacterium avium subsp. paratuberculosis
gcaccuccugcacccg

SEQ ID NO: 2948716 - RNA, 17 nt, Mycobacterium avium subsp. paratuberculosis
gcaccuccugcacccgu

SEQ ID NO: 2948717 - RNA, 18 nt, Mycobacterium avium subsp. paratuberculosis
gcaccuccugggugagcg

SEQ ID NO: 2948718 - RNA, 20 nt, Mycobacterium avium subsp. paratuberculosis
gcaccuccugggugagcggc

SEQ ID NO: 2948719 - RNA, 15 nt, Mycobacterium avium subsp. paratuberculosis
gcaccucgaaaccca

SEQ ID NO: 2948720 - RNA, 16 nt, Mycobacterium avium subsp. paratuberculosis
gcaccucgaaacccag

SEQ ID NO: 2948721 - RNA, 16 nt, Mycobacterium avium subsp. paratuberculosis
gcaccucgaacgccgg

SEQ ID NO: 2948722 - RNA, 17 nt, Mycobacterium avium subsp. paratuberculosis
gcaccucgaacgccggu

SEQ ID NO: 2948723 - RNA, 19 nt, Mycobacterium avium subsp. paratuberculosis
gcaccucgaacgccgguuu

SEQ ID NO: 2948724 - RNA, 20 nt, Mycobacterium avium subsp. paratuberculosis
gcaccucgaagccgacgucc

SEQ ID NO: 2948725 - RNA, 17 nt, Mycobacterium avium subsp. paratuberculosis
gcaccucgaagggcgcc

SEQ ID NO: 2948726 - RNA, 20 nt, Mycobacterium avium subsp. paratuberculosis
gcaccucgaagggcgccagc

SEQ ID NO: 2948727 - RNA, 21 nt, Mycobacterium avium subsp. paratuberculosis
gcaccucgaagggcgccagcc

SEQ ID NO: 2948728 - RNA, 16 nt, Mycobacterium avium subsp. paratuberculosis
gcaccucgaucaccgg

SEQ ID NO: 2948729 - RNA, 17 nt, Mycobacterium avium subsp. paratuberculosis
gcaccucgaucaccggg

SEQ ID NO: 2948730 - RNA, 15 nt, Mycobacterium avium subsp. paratuberculosis
gcaccucgaucuugu

SEQ ID NO: 2948731 - RNA, 13 nt, Mycobacterium avium subsp. paratuberculosis
gcaccucgaugcc

SEQ ID NO: 2948732 - RNA, 22 nt, Mycobacterium avium subsp. paratuberculosis
gcaccucgaugccgugccggug

SEQ ID NO: 2948733 - RNA, 23 nt, Mycobacterium avium subsp. paratuberculosis
gcaccucgaugccgugccggugg

SEQ ID NO: 2948734 - RNA, 16 nt, Mycobacterium avium subsp. paratuberculosis
gcacgaacgcggccgc

SEQ ID NO: 2948735 - RNA, 17 nt, Mycobacterium avium subsp. paratuberculosis
gcacgaacgcggccgcc

SEQ ID NO: 2948736 - RNA, 20 nt, Mycobacterium avium subsp. paratuberculosis
gcacgaacgcggccgccauc

SEQ ID NO: 2948737 - RNA, 11 nt, Mycobacterium avium subsp. paratuberculosis
gcacgaacggc

SEQ ID NO: 2948738 - RNA, 14 nt, Mycobacterium avium subsp. paratuberculosis
gcacgaacggcacg

SEQ ID NO: 2948739 - RNA, 21 nt, Mycobacterium avium subsp. paratuberculosis
gcacgaagaaggcuccgccga

SEQ ID NO: 2948740 - RNA, 23 nt, Mycobacterium avium subsp. paratuberculosis
gcacgaagaaggcuccgccgaug

SEQ ID NO: 2948741 - RNA, 17 nt, Mycobacterium avium subsp. paratuberculosis
gcacgaagccgaacgac

SEQ ID NO: 2948742 - RNA, 15 nt, Mycobacterium avium subsp. paratuberculosis
gcacgaaggccgccg

SEQ ID NO: 2948743 - RNA, 16 nt, Mycobacterium avium subsp. paratuberculosis
gcacgaaggccgccgg

SEQ ID NO: 2948744 - RNA, 18 nt, Mycobacterium avium subsp. paratuberculosis
gcacgaaggccgccgggu

SEQ ID NO: 2948745 - RNA, 17 nt, Mycobacterium avium subsp. paratuberculosis
gcacgaauucgguggcg

SEQ ID NO: 2948746 - RNA, 17 nt, Mycobacterium avium subsp. paratuberculosis
gcacgaauugccggugg

SEQ ID NO: 2948747 - RNA, 23 nt, Mycobacterium avium subsp. paratuberculosis
gcacgaauugccgguggugcggc

SEQ ID NO: 2948748 - RNA, 15 nt, Mycobacterium avium subsp. paratuberculosis
gcacgaccacacccg

SEQ ID NO: 2948749 - RNA, 21 nt, Mycobacterium avium subsp. paratuberculosis
gcacgaccacacccgcacgcu

SEQ ID NO: 2948750 - RNA, 18 nt, Mycobacterium avium subsp. paratuberculosis
gcacgaccaugucggcga

SEQ ID NO: 2948751 - RNA, 23 nt, Mycobacterium avium subsp. paratuberculosis
gcacgaccaugucggcgacccgc

SEQ ID NO: 2948752 - RNA, 16 nt, Mycobacterium avium subsp. paratuberculosis
gcacgaccccgcccac

SEQ ID NO: 2948753 - RNA, 15 nt, Mycobacterium avium subsp. paratuberculosis
gcacgaccgccagca

SEQ ID NO: 2948754 - RNA, 21 nt, Mycobacterium avium subsp. paratuberculosis
gcacgaccgccagcagcagcc

SEQ ID NO: 2948755 - RNA, 22 nt, Mycobacterium avium subsp. paratuberculosis
gcacgaccgccagcagcagccg

SEQ ID NO: 2948756 - RNA, 16 nt, Mycobacterium avium subsp. paratuberculosis
gcacgacgaacaccac

SEQ ID NO: 2948757 - RNA, 19 nt, Mycobacterium avium subsp. paratuberculosis
gcacgacgaacaccaccgg

SEQ ID NO: 2948758 - RNA, 17 nt, Mycobacterium avium subsp. paratuberculosis
gcacgacgaccgcgacg

SEQ ID NO: 2948759 - RNA, 17 nt, Mycobacterium avium subsp. paratuberculosis
gcacgacgaccgcgucc

SEQ ID NO: 2948760 - RNA, 13 nt, Mycobacterium avium subsp. paratuberculosis
gcacgacgccgcc

SEQ ID NO: 2948761 - RNA, 20 nt, Mycobacterium avium subsp. paratuberculosis
gcacgacgccgcugggcgug

SEQ ID NO: 2948762 - RNA, 14 nt, Mycobacterium avium subsp. paratuberculosis
gcacgacggucagc

SEQ ID NO: 2948763 - RNA, 23 nt, Mycobacterium avium subsp. paratuberculosis
gcacgacggucagcacgcugauc

SEQ ID NO: 2948764 - RNA, 16 nt, Mycobacterium avium subsp. paratuberculosis
gcacgacgucgacguu

SEQ ID NO: 2948765 - RNA, 18 nt, Mycobacterium avium subsp. paratuberculosis
gcacgagcacccagaaac

SEQ ID NO: 2948766 - RNA, 15 nt, Mycobacterium avium subsp. paratuberculosis
gcacgagcgucgugc

SEQ ID NO: 2948767 - RNA, 15 nt, Mycobacterium avium subsp. paratuberculosis
gcacgaucagggugu

SEQ ID NO: 2948768 - RNA, 14 nt, Mycobacterium avium subsp. paratuberculosis
gcacgaucccgccg

SEQ ID NO: 2948769 - RNA, 15 nt, Mycobacterium avium subsp. paratuberculosis
gcacgaucccgccgc

SEQ ID NO: 2948770 - RNA, 16 nt, Mycobacterium avium subsp. paratuberculosis
gcacgaucccgccgcc

SEQ ID NO: 2948771 - RNA, 17 nt, Mycobacterium avium subsp. paratuberculosis
gcacgaucccgccgccc

SEQ ID NO: 2948772 - RNA, 16 nt, Mycobacterium avium subsp. paratuberculosis
gcacgaucgagccggu

SEQ ID NO: 2948773 - RNA, 13 nt, Mycobacterium avium subsp. paratuberculosis
gcacgaucgcggu

SEQ ID NO: 2948774 - RNA, 20 nt, Mycobacterium avium subsp. paratuberculosis
gcacgaucgcggugacgcgc

SEQ ID NO: 2948775 - RNA, 18 nt, Mycobacterium avium subsp. paratuberculosis
gcacgaucggcagcgcca

SEQ ID NO: 2948776 - RNA, 23 nt, Mycobacterium avium subsp. paratuberculosis
gcacgaucggcagcgccaacaug

SEQ ID NO: 2948777 - RNA, 13 nt, Mycobacterium avium subsp. paratuberculosis
gcacgaucgucgc

SEQ ID NO: 2948778 - RNA, 17 nt, Mycobacterium avium subsp. paratuberculosis
gcacgaucgucgccgcc

SEQ ID NO: 2948779 - RNA, 19 nt, Mycobacterium avium subsp. paratuberculosis
gcacgaucgucgccgccaa

SEQ ID NO: 2948780 - RNA, 20 nt, Mycobacterium avium subsp. paratuberculosis
gcacgaucgucgccgccaac

SEQ ID NO: 2948781 - RNA, 21 nt, Mycobacterium avium subsp. paratuberculosis
gcacgaucucgaccaggccgu

SEQ ID NO: 2948782 - RNA, 13 nt, Mycobacterium avium subsp. paratuberculosis
gcacgaucucggc

SEQ ID NO: 2948783 - RNA, 15 nt, Mycobacterium avium subsp. paratuberculosis
gcacgaucugcaggc

SEQ ID NO: 2948784 - RNA, 18 nt, Mycobacterium avium subsp. paratuberculosis
gcacgaucugcaggccga

SEQ ID NO: 2948785 - RNA, 21 nt, Mycobacterium avium subsp. paratuberculosis
gcacgaugaacuccucgaucg

SEQ ID NO: 2948786 - RNA, 21 nt, Mycobacterium avium subsp. paratuberculosis
gcacgaugacgaccggguccg

SEQ ID NO: 2948787 - RNA, 18 nt, Mycobacterium avium subsp. paratuberculosis
gcacgaugaucccgagga

SEQ ID NO: 2948788 - RNA, 15 nt, Mycobacterium avium subsp. paratuberculosis
gcacgaugccgcgcu

SEQ ID NO: 2948789 - RNA, 16 nt, Mycobacterium avium subsp. paratuberculosis
gcacgauggcgcggcg

SEQ ID NO: 2948790 - RNA, 18 nt, Mycobacterium avium subsp. paratuberculosis
gcacgauggcgcggcgca

SEQ ID NO: 2948791 - RNA, 19 nt, Mycobacterium avium subsp. paratuberculosis
gcacgauggcgcggcgcac

SEQ ID NO: 2948792 - RNA, 21 nt, Mycobacterium avium subsp. paratuberculosis
gcacgauggcgcggcgcaccg

SEQ ID NO: 2948793 - RNA, 13 nt, Mycobacterium avium subsp. paratuberculosis
gcacgcagcggcg

SEQ ID NO: 2948794 - RNA, 19 nt, Mycobacterium avium subsp. paratuberculosis
gcacgcaggcguggcccag

SEQ ID NO: 2948795 - RNA, 13 nt, Mycobacterium avium subsp. paratuberculosis
gcacgcagugccg

SEQ ID NO: 2948796 - RNA, 14 nt, Mycobacterium avium subsp. paratuberculosis
gcacgcagugccgc

SEQ ID NO: 2948797 - RNA, 16 nt, Mycobacterium avium subsp. paratuberculosis
gcacgcagugccgcac

SEQ ID NO: 2948798 - RNA, 18 nt, Mycobacterium avium subsp. paratuberculosis
gcacgcagugccgcacca

SEQ ID NO: 2948799 - RNA, 15 nt, Mycobacterium avium subsp. paratuberculosis
gcacgccacucgucg

SEQ ID NO: 2948800 - RNA, 16 nt, Mycobacterium avium subsp. paratuberculosis
gcacgccacucgucga

SEQ ID NO: 2948801 - RNA, 17 nt, Mycobacterium avium subsp. paratuberculosis
gcacgccaucgccucgg

SEQ ID NO: 2948802 - RNA, 21 nt, Mycobacterium avium subsp. paratuberculosis
gcacgccaucgccucggccac

SEQ ID NO: 2948803 - RNA, 22 nt, Mycobacterium avium subsp. paratuberculosis
gcacgccaucgccucggccacc

SEQ ID NO: 2948804 - RNA, 14 nt, Mycobacterium avium subsp. paratuberculosis
gcacgcccagaucg

SEQ ID NO: 2948805 - RNA, 19 nt, Mycobacterium avium subsp. paratuberculosis
gcacgcccagaucgacgcc

SEQ ID NO: 2948806 - RNA, 23 nt, Mycobacterium avium subsp. paratuberculosis
gcacgcccagaucgacgccgacc

SEQ ID NO: 2948807 - RNA, 18 nt, Mycobacterium avium subsp. paratuberculosis
gcacgcccagaucgccga

SEQ ID NO: 2948808 - RNA, 20 nt, Mycobacterium avium subsp. paratuberculosis
gcacgcccagaucgccgacc

SEQ ID NO: 2948809 - RNA, 13 nt, Mycobacterium avium subsp. paratuberculosis
gcacgcccagccc

SEQ ID NO: 2948810 - RNA, 14 nt, Mycobacterium avium subsp. paratuberculosis
gcacgcccagcccg

SEQ ID NO: 2948811 - RNA, 15 nt, Mycobacterium avium subsp. paratuberculosis
gcacgcccagcccgc

SEQ ID NO: 2948812 - RNA, 19 nt, Mycobacterium avium subsp. paratuberculosis
gcacgcccagcccgcgggc

SEQ ID NO: 2948813 - RNA, 20 nt, Mycobacterium avium subsp. paratuberculosis
gcacgcccaugaucacaccg

SEQ ID NO: 2948814 - RNA, 12 nt, Mycobacterium avium subsp. paratuberculosis
gcacgcccccgc

SEQ ID NO: 2948815 - RNA, 21 nt, Mycobacterium avium subsp. paratuberculosis
gcacgcccccgcuggcccggc

SEQ ID NO: 2948816 - RNA, 21 nt, Mycobacterium avium subsp. paratuberculosis
gcacgcccgcgaucggcgcca

SEQ ID NO: 2948817 - RNA, 16 nt, Mycobacterium avium subsp. paratuberculosis
gcacgcccguucgagc

SEQ ID NO: 2948818 - RNA, 20 nt, Mycobacterium avium subsp. paratuberculosis
gcacgcccguucgagcgccg

SEQ ID NO: 2948819 - RNA, 21 nt, Mycobacterium avium subsp. paratuberculosis
gcacggccacugccccggcga

SEQ ID NO: 2948820 - RNA, 21 nt, Mycobacterium avium subsp. paratuberculosis
gcacggccagccagccgccca

SEQ ID NO: 2948821 - RNA, 12 nt, Mycobacterium avium subsp. paratuberculosis
gcacggcccauc

SEQ ID NO: 2948822 - RNA, 18 nt, Mycobacterium avium subsp. paratuberculosis
gcacggcccaucaccagc

SEQ ID NO: 2948823 - RNA, 21 nt, Mycobacterium avium subsp. paratuberculosis
gcacggcccaucaccagcggc

SEQ ID NO: 2948824 - RNA, 19 nt, Mycobacterium avium subsp. paratuberculosis
gcacggcccgcucgggcca

SEQ ID NO: 2948825 - RNA, 22 nt, Mycobacterium avium subsp. paratuberculosis
gcacggcccgcucgggccauga

SEQ ID NO: 2948826 - RNA, 14 nt, Mycobacterium avium subsp. paratuberculosis
gcacggcccgugca

SEQ ID NO: 2948827 - RNA, 13 nt, Mycobacterium avium subsp. paratuberculosis
gcacggccgccag

SEQ ID NO: 2948828 - RNA, 15 nt, Mycobacterium avium subsp. paratuberculosis
gcacggccgccagga

SEQ ID NO: 2948829 - RNA, 16 nt, Mycobacterium avium subsp. paratuberculosis
gcacggccgccaggau

SEQ ID NO: 2948830 - RNA, 11 nt, Mycobacterium avium subsp. paratuberculosis
gcacggccgcg

SEQ ID NO: 2948831 - RNA, 17 nt, Mycobacterium avium subsp. paratuberculosis
gcacggccgcggccagc

SEQ ID NO: 2948832 - RNA, 20 nt, Mycobacterium avium subsp. paratuberculosis
gcacggccgcggccagcgag

SEQ ID NO: 2948833 - RNA, 18 nt, Mycobacterium avium subsp. paratuberculosis
gcacggcgaacggccgcg

SEQ ID NO: 2948834 - RNA, 19 nt, Mycobacterium avium subsp. paratuberculosis
gcacggcgaacggccgcga

SEQ ID NO: 2948835 - RNA, 20 nt, Mycobacterium avium subsp. paratuberculosis
gcacggcgaacggccgcgau

SEQ ID NO: 2948836 - RNA, 13 nt, Mycobacterium avium subsp. paratuberculosis
gcacggcgaccag

SEQ ID NO: 2948837 - RNA, 14 nt, Mycobacterium avium subsp. paratuberculosis
gcacggcgaccagc

SEQ ID NO: 2948838 - RNA, 17 nt, Mycobacterium avium subsp. paratuberculosis
gcacggcgaccagcgag

SEQ ID NO: 2948839 - RNA, 16 nt, Mycobacterium avium subsp. paratuberculosis
gcacggcgaggucggg

SEQ ID NO: 2948840 - RNA, 20 nt, Mycobacterium avium subsp. paratuberculosis
gcacggcgauguaggacgcc

SEQ ID NO: 2948841 - RNA, 14 nt, Mycobacterium avium subsp. paratuberculosis
gcacggcgccacca

SEQ ID NO: 2948842 - RNA, 19 nt, Mycobacterium avium subsp. paratuberculosis
gcacggcgccaccagccac

SEQ ID NO: 2948843 - RNA, 14 nt, Mycobacterium avium subsp. paratuberculosis
gcacggcgcccagg

SEQ ID NO: 2948844 - RNA, 15 nt, Mycobacterium avium subsp. paratuberculosis
gcacggcgcccaggu

SEQ ID NO: 2948845 - RNA, 13 nt, Mycobacterium avium subsp. paratuberculosis
gcacggcgccgug

SEQ ID NO: 2948846 - RNA, 15 nt, Mycobacterium avium subsp. paratuberculosis
gcacggcgccgugcc

SEQ ID NO: 2948847 - RNA, 22 nt, Mycobacterium avium subsp. paratuberculosis
gcacggcgccgugccgcgcggc

SEQ ID NO: 2948848 - RNA, 18 nt, Mycobacterium avium subsp. paratuberculosis
gcacggcgcgcaccgcgg

SEQ ID NO: 2948849 - RNA, 20 nt, Mycobacterium avium subsp. paratuberculosis
gcacggcgcgcaccgcgggc

SEQ ID NO: 2948850 - RNA, 12 nt, Mycobacterium avium subsp. paratuberculosis
gcacggcgcugg

SEQ ID NO: 2948851 - RNA, 15 nt, Mycobacterium avium subsp. paratuberculosis
gcacggcggcgaacg

SEQ ID NO: 2948852 - RNA, 18 nt, Mycobacterium avium subsp. paratuberculosis
gcacggcggcgaacgccg

SEQ ID NO: 2948853 - RNA, 21 nt, Mycobacterium avium subsp. paratuberculosis
gcacggcggcgaacgccgccg

SEQ ID NO: 2948854 - RNA, 22 nt, Mycobacterium avium subsp. paratuberculosis
gcacggcggcgaacgccgccgu

SEQ ID NO: 2948855 - RNA, 13 nt, Mycobacterium avium subsp. paratuberculosis
gcacggcggcgcu

SEQ ID NO: 2948856 - RNA, 14 nt, Mycobacterium avium subsp. paratuberculosis
gcacggcggcgcug

SEQ ID NO: 2948857 - RNA, 13 nt, Mycobacterium avium subsp. paratuberculosis
gcacggcggcgug

SEQ ID NO: 2948858 - RNA, 22 nt, Mycobacterium avium subsp. paratuberculosis
gcacggcggcgugcaccgcccg

SEQ ID NO: 2948859 - RNA, 21 nt, Mycobacterium avium subsp. paratuberculosis
gcacggcuaccuaggcgucgu

SEQ ID NO: 2948860 - RNA, 19 nt, Mycobacterium avium subsp. paratuberculosis
gcacggcugcucccgaaag

SEQ ID NO: 2948861 - RNA, 16 nt, Mycobacterium avium subsp. paratuberculosis
gcacgggaugaucggc

SEQ ID NO: 2948862 - RNA, 17 nt, Mycobacterium avium subsp. paratuberculosis
gcacgggaugaucggcg

SEQ ID NO: 2948863 - RNA, 17 nt, Mycobacterium avium subsp. paratuberculosis
gcacgggcaccgacgag

SEQ ID NO: 2948864 - RNA, 14 nt, Mycobacterium avium subsp. paratuberculosis
gcacgggcccgcgg

SEQ ID NO: 2948865 - RNA, 16 nt, Mycobacterium avium subsp. paratuberculosis
gcacgggcccgcggga

SEQ ID NO: 2948866 - RNA, 12 nt, Mycobacterium avium subsp. paratuberculosis
gcacgggcggcg

SEQ ID NO: 2948867 - RNA, 13 nt, Mycobacterium avium subsp. paratuberculosis
gcacgggcggcgg

SEQ ID NO: 2948868 - RNA, 20 nt, Mycobacterium avium subsp. paratuberculosis
gcacgggcggcgggggcgag

SEQ ID NO: 2948869 - RNA, 13 nt, Mycobacterium avium subsp. paratuberculosis
gcacgggcgggca

SEQ ID NO: 2948870 - RNA, 14 nt, Mycobacterium avium subsp. paratuberculosis
gcacgggcgggcag

SEQ ID NO: 2948871 - RNA, 19 nt, Mycobacterium avium subsp. paratuberculosis
gcacgggcgggcagauggu

SEQ ID NO: 2948872 - RNA, 21 nt, Mycobacterium avium subsp. paratuberculosis
gcacgggcguguaguccaggu

SEQ ID NO: 2948873 - RNA, 23 nt, Mycobacterium avium subsp. paratuberculosis
gcacggggacgcugaacagcccg

SEQ ID NO: 2948874 - RNA, 14 nt, Mycobacterium avium subsp. paratuberculosis
gcacggggacgucg

SEQ ID NO: 2948875 - RNA, 16 nt, Mycobacterium avium subsp. paratuberculosis
gcacggggacgucguc

SEQ ID NO: 2948876 - RNA, 21 nt, Mycobacterium avium subsp. paratuberculosis
gcacgggggaguagcgcgcga

SEQ ID NO: 2948877 - RNA, 15 nt, Mycobacterium avium subsp. paratuberculosis
gcacggucagcggcc

SEQ ID NO: 2948878 - RNA, 16 nt, Mycobacterium avium subsp. paratuberculosis
gcacggucagcggcca

SEQ ID NO: 2948879 - RNA, 18 nt, Mycobacterium avium subsp. paratuberculosis
gcacggucagcggccagc

SEQ ID NO: 2948880 - RNA, 18 nt, Mycobacterium avium subsp. paratuberculosis
gcacggucagcucgcgcc

SEQ ID NO: 2948881 - RNA, 14 nt, Mycobacterium avium subsp. paratuberculosis
gcacggucgcggug

SEQ ID NO: 2948882 - RNA, 16 nt, Mycobacterium avium subsp. paratuberculosis
gcacggucgcgguguc

SEQ ID NO: 2948883 - RNA, 20 nt, Mycobacterium avium subsp. paratuberculosis
gcacggucgcggugucggcg

SEQ ID NO: 2948884 - RNA, 19 nt, Mycobacterium avium subsp. paratuberculosis
gcacggucggccccgcgca

SEQ ID NO: 2948885 - RNA, 21 nt, Mycobacterium avium subsp. paratuberculosis
gcacggucggccccgcgcauc

SEQ ID NO: 2948886 - RNA, 23 nt, Mycobacterium avium subsp. paratuberculosis
gcacggucggccccgcgcaucgg

SEQ ID NO: 2948887 - RNA, 18 nt, Mycobacterium avium subsp. paratuberculosis
gcacggucugguggcagc

SEQ ID NO: 2948888 - RNA, 21 nt, Mycobacterium avium subsp. paratuberculosis
gcacggucugguggcagcgga

SEQ ID NO: 2948889 - RNA, 21 nt, Mycobacterium avium subsp. paratuberculosis
gcacggugaacuccgggccca

SEQ ID NO: 2948890 - RNA, 15 nt, Mycobacterium avium subsp. paratuberculosis
gcacggugaucagca

SEQ ID NO: 2948891 - RNA, 18 nt, Mycobacterium avium subsp. paratuberculosis
gcacggugaucagcagca

SEQ ID NO: 2948892 - RNA, 22 nt, Mycobacterium avium subsp. paratuberculosis
gcacggugaucagcagcagguc

SEQ ID NO: 2948893 - RNA, 17 nt, Mycobacterium avium subsp. paratuberculosis
gcacggugcacacgccg

SEQ ID NO: 2948894 - RNA, 22 nt, Mycobacterium avium subsp. paratuberculosis
gcacggugcacacgccgaggcg

SEQ ID NO: 2948895 - RNA, 19 nt, Mycobacterium avium subsp. paratuberculosis
gcacggugcagcagcgccg

SEQ ID NO: 2948896 - RNA, 22 nt, Mycobacterium avium subsp. paratuberculosis
gcacggugcagcagcgccgcga

SEQ ID NO: 2948897 - RNA, 15 nt, Mycobacterium avium subsp. paratuberculosis
gcacggugccgccgu

SEQ ID NO: 2948898 - RNA, 20 nt, Mycobacterium avium subsp. paratuberculosis
gcacggugccgccguccaug

SEQ ID NO: 2948899 - RNA, 14 nt, Mycobacterium avium subsp. paratuberculosis
gcacggugcgccgg

SEQ ID NO: 2948900 - RNA, 15 nt, Mycobacterium avium subsp. paratuberculosis
gcacggugcgccggc

SEQ ID NO: 2948901 - RNA, 16 nt, Mycobacterium avium subsp. paratuberculosis
gcacggugcgccggca

SEQ ID NO: 2948902 - RNA, 18 nt, Mycobacterium avium subsp. paratuberculosis
gcacggugcgccggcagc

SEQ ID NO: 2948903 - RNA, 13 nt, Mycobacterium avium subsp. paratuberculosis
gcacggugcgggu

SEQ ID NO: 2948904 - RNA, 19 nt, Mycobacterium avium subsp. paratuberculosis
gcacguggcugaccgacgg

SEQ ID NO: 2948905 - RNA, 16 nt, Mycobacterium avium subsp. paratuberculosis
gcacguggugaccgua

SEQ ID NO: 2948906 - RNA, 22 nt, Mycobacterium avium subsp. paratuberculosis
gcacguguccgacgccgucgag

SEQ ID NO: 2948907 - RNA, 17 nt, Mycobacterium avium subsp. paratuberculosis
gcacguguucgggaucg

SEQ ID NO: 2948908 - RNA, 19 nt, Mycobacterium avium subsp. paratuberculosis
gcacguguucgggaucggc

SEQ ID NO: 2948909 - RNA, 20 nt, Mycobacterium avium subsp. paratuberculosis
gcacguguucgggaucggcg

SEQ ID NO: 2948910 - RNA, 17 nt, Mycobacterium avium subsp. paratuberculosis
gcacguguucucacggc

SEQ ID NO: 2948911 - RNA, 21 nt, Mycobacterium avium subsp. paratuberculosis
gcacguugacguagacgacgg

SEQ ID NO: 2948912 - RNA, 15 nt, Mycobacterium avium subsp. paratuberculosis
gcacguuggcggcca

SEQ ID NO: 2948913 - RNA, 19 nt, Mycobacterium avium subsp. paratuberculosis
gcacguuggcggccagcgc

SEQ ID NO: 2948914 - RNA, 20 nt, Mycobacterium avium subsp. paratuberculosis
gcacguuggcggccagcgcg

SEQ ID NO: 2948915 - RNA, 21 nt, Mycobacterium avium subsp. paratuberculosis
gcacguuggcggccagcgcgc

SEQ ID NO: 2948916 - RNA, 15 nt, Mycobacterium avium subsp. paratuberculosis
gcacguugugcucgu

SEQ ID NO: 2948917 - RNA, 19 nt, Mycobacterium avium subsp. paratuberculosis
gcacguugugcucgucgau

SEQ ID NO: 2948918 - RNA, 21 nt, Mycobacterium avium subsp. paratuberculosis
gcacguugugggcgggcgcgu

SEQ ID NO: 2948919 - RNA, 17 nt, Mycobacterium avium subsp. paratuberculosis
gcacguuguucaggucg

SEQ ID NO: 2948920 - RNA, 21 nt, Mycobacterium avium subsp. paratuberculosis
gcacguuguucaggucgaugg

SEQ ID NO: 2948921 - RNA, 22 nt, Mycobacterium avium subsp. paratuberculosis
gcacguuguucaggucgauggu

SEQ ID NO: 2948922 - RNA, 18 nt, Mycobacterium avium subsp. paratuberculosis
gcacuaccgccucgccag

SEQ ID NO: 2948923 - RNA, 20 nt, Mycobacterium avium subsp. paratuberculosis
gcacuaccgccucgccagcc

SEQ ID NO: 2948924 - RNA, 20 nt, Mycobacterium avium subsp. paratuberculosis
gcacuagguccggcgcgacc

SEQ ID NO: 2948925 - RNA, 24 nt, Mycobacterium avium subsp. paratuberculosis
gcacucagagcagcgccugcugcc

SEQ ID NO: 2948926 - RNA, 22 nt, Mycobacterium avium subsp. paratuberculosis
gcacucccgcguauugcacggc

SEQ ID NO: 2948927 - RNA, 18 nt, Mycobacterium avium subsp. paratuberculosis
gcacuccuugcugucggu

SEQ ID NO: 2948928 - RNA, 16 nt, Mycobacterium avium subsp. paratuberculosis
gcacucgaacggcccg

SEQ ID NO: 2948929 - RNA, 17 nt, Mycobacterium avium subsp. paratuberculosis
gcacucgaacggcccgg

SEQ ID NO: 2948930 - RNA, 18 nt, Mycobacterium avium subsp. paratuberculosis
gcacucgaacggcccgga

SEQ ID NO: 2948931 - RNA, 22 nt, Mycobacterium avium subsp. paratuberculosis
gcacucgaacggcccggacgga

SEQ ID NO: 2948932 - RNA, 16 nt, Mycobacterium avium subsp. paratuberculosis
gcacucgaucagcacc

SEQ ID NO: 2948933 - RNA, 20 nt, Mycobacterium avium subsp. paratuberculosis
gcacucgaucagcaccgcca

SEQ ID NO: 2948934 - RNA, 21 nt, Mycobacterium avium subsp. paratuberculosis
gcacucgaucagcaccgccac

SEQ ID NO: 2948935 - RNA, 23 nt, Mycobacterium avium subsp. paratuberculosis
gcacucgaucagcaccgccacgc

SEQ ID NO: 2948936 - RNA, 19 nt, Mycobacterium avium subsp. paratuberculosis
gcacucgauggcggcgaug

SEQ ID NO: 2948937 - RNA, 21 nt, Mycobacterium avium subsp. paratuberculosis
gcacucgccucggaggccacc

SEQ ID NO: 2948938 - RNA, 17 nt, Mycobacterium avium subsp. paratuberculosis
gcacucgcgcaggguca

SEQ ID NO: 2948939 - RNA, 18 nt, Mycobacterium avium subsp. paratuberculosis
gcacucgcgggacggcgg

SEQ ID NO: 2948940 - RNA, 19 nt, Mycobacterium avium subsp. paratuberculosis
gcacucgcgggacggcggc

SEQ ID NO: 2948941 - RNA, 20 nt, Mycobacterium avium subsp. paratuberculosis
gcacucgcgggacggcggcg

SEQ ID NO: 2948942 - RNA, 14 nt, Mycobacterium avium subsp. paratuberculosis
gcacucggcgaugc

SEQ ID NO: 2948943 - RNA, 14 nt, Mycobacterium avium subsp. paratuberculosis
gcacucgucguggc

SEQ ID NO: 2948944 - RNA, 20 nt, Mycobacterium avium subsp. paratuberculosis
gcacucucgcggcaaggcgc

SEQ ID NO: 2948945 - RNA, 19 nt, Mycobacterium avium subsp. paratuberculosis
gcacucuugcgugcggguc

SEQ ID NO: 2948946 - RNA, 16 nt, Mycobacterium avium subsp. paratuberculosis
gcacugaacgggauga

SEQ ID NO: 2948947 - RNA, 16 nt, Mycobacterium avium subsp. paratuberculosis
gcacugcccgcaucgc

SEQ ID NO: 2948948 - RNA, 13 nt, Mycobacterium avium subsp. paratuberculosis
gcacugcgguuca

SEQ ID NO: 2948949 - RNA, 21 nt, Mycobacterium avium subsp. paratuberculosis
gcacugcgguucacaaaggcc

SEQ ID NO: 2948950 - RNA, 18 nt, Mycobacterium avium subsp. paratuberculosis
gcacugcugcccgcgacg

SEQ ID NO: 2948951 - RNA, 19 nt, Mycobacterium avium subsp. paratuberculosis
gcacugcugcccgcgacgg

SEQ ID NO: 2948952 - RNA, 20 nt, Mycobacterium avium subsp. paratuberculosis
gcacugcuucgggucgccgg

SEQ ID NO: 2948953 - RNA, 23 nt, Mycobacterium avium subsp. paratuberculosis
gcacuggagugcugcagaccgaa

SEQ ID NO: 2948954 - RNA, 16 nt, Mycobacterium avium subsp. paratuberculosis
gcacuggucgugcugg

SEQ ID NO: 2948955 - RNA, 13 nt, Mycobacterium avium subsp. paratuberculosis
gcacuuaacaccu

SEQ ID NO: 2948956 - RNA, 17 nt, Mycobacterium avium subsp. paratuberculosis
gcacuuaacaccucgcc

SEQ ID NO: 2948957 - RNA, 18 nt, Mycobacterium avium subsp. paratuberculosis
gcacuuaacaccucgccu

SEQ ID NO: 2948958 - RNA, 18 nt, Mycobacterium avium subsp. paratuberculosis
gcacuucauggucgucgu

SEQ ID NO: 2948959 - RNA, 16 nt, Mycobacterium avium subsp. paratuberculosis
gcacuucgcgggcggc

SEQ ID NO: 2948960 - RNA, 17 nt, Mycobacterium avium subsp. paratuberculosis
gcacuucgcgggcggcg

SEQ ID NO: 2948961 - RNA, 19 nt, Mycobacterium avium subsp. paratuberculosis
gcacuuucgcggucagccg

SEQ ID NO: 2948962 - RNA, 21 nt, Mycobacterium avium subsp. paratuberculosis
gcacuuucgcggucagccggc

SEQ ID NO: 2948963 - RNA, 14 nt, Mycobacterium avium subsp. paratuberculosis
gcacuuucggcagc

SEQ ID NO: 2948964 - RNA, 13 nt, Mycobacterium avium subsp. paratuberculosis
gcagaaaaaggcc

SEQ ID NO: 2948965 - RNA, 17 nt, Mycobacterium avium subsp. paratuberculosis
gcagaaaauagcccagc

SEQ ID NO: 2948966 - RNA, 16 nt, Mycobacterium avium subsp. paratuberculosis
gcagaaauccgucgaa

SEQ ID NO: 2948967 - RNA, 17 nt, Mycobacterium avium subsp. paratuberculosis
gcagaaaugggccaugc

SEQ ID NO: 2948968 - RNA, 22 nt, Mycobacterium avium subsp. paratuberculosis
gcagaacaauguuuuucugcuc

SEQ ID NO: 2948969 - RNA, 18 nt, Mycobacterium avium subsp. paratuberculosis
gcagaacaccaccgccag

SEQ ID NO: 2948970 - RNA, 12 nt, Mycobacterium avium subsp. paratuberculosis
gcagaacaccag

SEQ ID NO: 2948971 - RNA, 13 nt, Mycobacterium avium subsp. paratuberculosis
gcagaacaccagc

SEQ ID NO: 2948972 - RNA, 16 nt, Mycobacterium avium subsp. paratuberculosis
gcagaacagccggucc

SEQ ID NO: 2948973 - RNA, 15 nt, Mycobacterium avium subsp. paratuberculosis
gcagaaccagcaccg

SEQ ID NO: 2948974 - RNA, 21 nt, Mycobacterium avium subsp. paratuberculosis
gcagaaccagcaccgccgcgg

SEQ ID NO: 2948975 - RNA, 16 nt, Mycobacterium avium subsp. paratuberculosis
gcagaacgccaucacc

SEQ ID NO: 2948976 - RNA, 19 nt, Mycobacterium avium subsp. paratuberculosis
gcagaacgccaucaccagc

SEQ ID NO: 2948977 - RNA, 21 nt, Mycobacterium avium subsp. paratuberculosis
gcagaacgccaucaccagcgc

SEQ ID NO: 2948978 - RNA, 22 nt, Mycobacterium avium subsp. paratuberculosis
gcagaacuccauggaguugucg

SEQ ID NO: 2948979 - RNA, 16 nt, Mycobacterium avium subsp. paratuberculosis
gcagaacucgucgcca

SEQ ID NO: 2948980 - RNA, 17 nt, Mycobacterium avium subsp. paratuberculosis
gcagaacuucuccgccg

SEQ ID NO: 2948981 - RNA, 20 nt, Mycobacterium avium subsp. paratuberculosis
gcagaacuucuccgccggca

SEQ ID NO: 2948982 - RNA, 21 nt, Mycobacterium avium subsp. paratuberculosis
gcagaacuucuccgccggcag

SEQ ID NO: 2948983 - RNA, 19 nt, Mycobacterium avium subsp. paratuberculosis
gcagaagcuaacgccagcu

SEQ ID NO: 2948984 - RNA, 21 nt, Mycobacterium avium subsp. paratuberculosis
gcagaagcuccacgccgccgg

SEQ ID NO: 2948985 - RNA, 17 nt, Mycobacterium avium subsp. paratuberculosis
gcagaaguugacggucu

SEQ ID NO: 2948986 - RNA, 20 nt, Mycobacterium avium subsp. paratuberculosis
gcagacacaaaagcgcccga

SEQ ID NO: 2948987 - RNA, 13 nt, Mycobacterium avium subsp. paratuberculosis
gcagaccagcccg

SEQ ID NO: 2948988 - RNA, 19 nt, Mycobacterium avium subsp. paratuberculosis
gcagauggugaaguugccg

SEQ ID NO: 2948989 - RNA, 21 nt, Mycobacterium avium subsp. paratuberculosis
gcagauggugaaguugccggu

SEQ ID NO: 2948990 - RNA, 22 nt, Mycobacterium avium subsp. paratuberculosis
gcagauggugaaguugccgguc

SEQ ID NO: 2948991 - RNA, 17 nt, Mycobacterium avium subsp. paratuberculosis
gcagaugucgguggccu

SEQ ID NO: 2948992 - RNA, 20 nt, Mycobacterium avium subsp. paratuberculosis
gcagaugucgguggccuugg

SEQ ID NO: 2948993 - RNA, 21 nt, Mycobacterium avium subsp. paratuberculosis
gcagauucgaggucaucgagc

SEQ ID NO: 2948994 - RNA, 17 nt, Mycobacterium avium subsp. paratuberculosis
gcagauugguucggccg

SEQ ID NO: 2948995 - RNA, 20 nt, Mycobacterium avium subsp. paratuberculosis
gcagcaacaugaacgacccu

SEQ ID NO: 2948996 - RNA, 16 nt, Mycobacterium avium subsp. paratuberculosis
gcagcaacggcggcgg

SEQ ID NO: 2948997 - RNA, 17 nt, Mycobacterium avium subsp. paratuberculosis
gcagcaacggcggcggc

SEQ ID NO: 2948998 - RNA, 23 nt, Mycobacterium avium subsp. paratuberculosis
gcagcaacgguacgugcgccggc

SEQ ID NO: 2948999 - RNA, 22 nt, Mycobacterium avium subsp. paratuberculosis
gcagcaacucgcgcucccggcg

SEQ ID NO: 2949000 - RNA, 24 nt, Mycobacterium avium subsp. paratuberculosis
gcagcaacugaccgaucuggcgau

SEQ ID NO: 2949001 - RNA, 14 nt, Mycobacterium avium subsp. paratuberculosis
gcagcaagagcagg

SEQ ID NO: 2949002 - RNA, 23 nt, Mycobacterium avium subsp. paratuberculosis
gcagcacaccuuccaccaccgcg

SEQ ID NO: 2949003 - RNA, 16 nt, Mycobacterium avium subsp. paratuberculosis
gcagcacagcgggauc

SEQ ID NO: 2949004 - RNA, 14 nt, Mycobacterium avium subsp. paratuberculosis
gcagcacauccagc

SEQ ID NO: 2949005 - RNA, 15 nt, Mycobacterium avium subsp. paratuberculosis
gcagcacauccagcc

SEQ ID NO: 2949006 - RNA, 19 nt, Mycobacterium avium subsp. paratuberculosis
gcagcacauccagcccugc

SEQ ID NO: 2949007 - RNA, 22 nt, Mycobacterium avium subsp. paratuberculosis
gcagcacauccgguugcaccgc

SEQ ID NO: 2949008 - RNA, 13 nt, Mycobacterium avium subsp. paratuberculosis
gcagcaccacccg

SEQ ID NO: 2949009 - RNA, 15 nt, Mycobacterium avium subsp. paratuberculosis
gcagcaccacccgca

SEQ ID NO: 2949010 - RNA, 16 nt, Mycobacterium avium subsp. paratuberculosis
gcagcaccacccgcac

SEQ ID NO: 2949011 - RNA, 23 nt, Mycobacterium avium subsp. paratuberculosis
gcagcaccacgaacgcugccagg

SEQ ID NO: 2949012 - RNA, 21 nt, Mycobacterium avium subsp. paratuberculosis
gcagcaccagaugcaccucgc

SEQ ID NO: 2949013 - RNA, 19 nt, Mycobacterium avium subsp. paratuberculosis
gcagcaccagcgccgcgau

SEQ ID NO: 2949014 - RNA, 22 nt, Mycobacterium avium subsp. paratuberculosis
gcagcaccagcgccgcgaugau

SEQ ID NO: 2949015 - RNA, 13 nt, Mycobacterium avium subsp. paratuberculosis
gcagcaccagcgg

SEQ ID NO: 2949016 - RNA, 17 nt, Mycobacterium avium subsp. paratuberculosis
gcagcaccagcggcacc

SEQ ID NO: 2949017 - RNA, 20 nt, Mycobacterium avium subsp. paratuberculosis
gcagcaccagcggcaccagg

SEQ ID NO: 2949018 - RNA, 22 nt, Mycobacterium avium subsp. paratuberculosis
gcagcaccagcguggccggcag

SEQ ID NO: 2949019 - RNA, 18 nt, Mycobacterium avium subsp. paratuberculosis
gcagcaccaggcccuccu

SEQ ID NO: 2949020 - RNA, 20 nt, Mycobacterium avium subsp. paratuberculosis
gcagcaccaggcugaccagc

SEQ ID NO: 2949021 - RNA, 23 nt, Mycobacterium avium subsp. paratuberculosis
gcagcaccaggcugaccagcgcc

SEQ ID NO: 2949022 - RNA, 15 nt, Mycobacterium avium subsp. paratuberculosis
gcagcaccagggcgu

SEQ ID NO: 2949023 - RNA, 15 nt, Mycobacterium avium subsp. paratuberculosis
gcagcaccauccgcg

SEQ ID NO: 2949024 - RNA, 15 nt, Mycobacterium avium subsp. paratuberculosis
gcagcacccgacuuc

SEQ ID NO: 2949025 - RNA, 18 nt, Mycobacterium avium subsp. paratuberculosis
gcagcacccgacuucggc

SEQ ID NO: 2949026 - RNA, 12 nt, Mycobacterium avium subsp. paratuberculosis
gcagcacccgca

SEQ ID NO: 2949027 - RNA, 13 nt, Mycobacterium avium subsp. paratuberculosis
gcagcacccgcac

SEQ ID NO: 2949028 - RNA, 14 nt, Mycobacterium avium subsp. paratuberculosis
gcagcacccgcacc

SEQ ID NO: 2949029 - RNA, 17 nt, Mycobacterium avium subsp. paratuberculosis
gcagcacccgcaccgug

SEQ ID NO: 2949030 - RNA, 15 nt, Mycobacterium avium subsp. paratuberculosis
gcagcacccgggccu

SEQ ID NO: 2949031 - RNA, 19 nt, Mycobacterium avium subsp. paratuberculosis
gcagcacccgggccugcgg

SEQ ID NO: 2949032 - RNA, 22 nt, Mycobacterium avium subsp. paratuberculosis
gcagcacccgggccugcggcgg

SEQ ID NO: 2949033 - RNA, 17 nt, Mycobacterium avium subsp. paratuberculosis
gcagcacccgggugauc

SEQ ID NO: 2949034 - RNA, 15 nt, Mycobacterium avium subsp. paratuberculosis
gcagcacccggucgc

SEQ ID NO: 2949035 - RNA, 16 nt, Mycobacterium avium subsp. paratuberculosis
gcagcacccggucgcc

SEQ ID NO: 2949036 - RNA, 17 nt, Mycobacterium avium subsp. paratuberculosis
gcagcacccggucgccg

SEQ ID NO: 2949037 - RNA, 19 nt, Mycobacterium avium subsp. paratuberculosis
gcagcaccgaaccggcggg

SEQ ID NO: 2949038 - RNA, 23 nt, Mycobacterium avium subsp. paratuberculosis
gcagcaccgaaccggcggggucg

SEQ ID NO: 2949039 - RNA, 13 nt, Mycobacterium avium subsp. paratuberculosis
gcagcaccgacuc

SEQ ID NO: 2949040 - RNA, 18 nt, Mycobacterium avium subsp. paratuberculosis
gcagcaccgacuccuccg

SEQ ID NO: 2949041 - RNA, 13 nt, Mycobacterium avium subsp. paratuberculosis
gcagcaccgccag

SEQ ID NO: 2949042 - RNA, 15 nt, Mycobacterium avium subsp. paratuberculosis
gcagcaccgccagca

SEQ ID NO: 2949043 - RNA, 17 nt, Mycobacterium avium subsp. paratuberculosis
gcagcaccgccagcauc

SEQ ID NO: 2949044 - RNA, 15 nt, Mycobacterium avium subsp. paratuberculosis
gcagcaccgccgaca

SEQ ID NO: 2949045 - RNA, 22 nt, Mycobacterium avium subsp. paratuberculosis
gcagcaccgccgacaucgcccg

SEQ ID NO: 2949046 - RNA, 13 nt, Mycobacterium avium subsp. paratuberculosis
gcagcaccgcgac

SEQ ID NO: 2949047 - RNA, 17 nt, Mycobacterium avium subsp. paratuberculosis
gcagcaccgcgacccag

SEQ ID NO: 2949048 - RNA, 20 nt, Mycobacterium avium subsp. paratuberculosis
gcagcaccgcgacccaggcc

SEQ ID NO: 2949049 - RNA, 15 nt, Mycobacterium avium subsp. paratuberculosis
gcagcaccgcgaccg

SEQ ID NO: 2949050 - RNA, 16 nt, Mycobacterium avium subsp. paratuberculosis
gcagcaccgcgucggc

SEQ ID NO: 2949051 - RNA, 23 nt, Mycobacterium avium subsp. paratuberculosis
gcagcaccgcguuguccggggug

SEQ ID NO: 2949052 - RNA, 14 nt, Mycobacterium avium subsp. paratuberculosis
gcagcaccggcacc

SEQ ID NO: 2949053 - RNA, 15 nt, Mycobacterium avium subsp. paratuberculosis
gcagcaccggcaccg

SEQ ID NO: 2949054 - RNA, 20 nt, Mycobacterium avium subsp. paratuberculosis
gcagcaccggcaccgcggcg

SEQ ID NO: 2949055 - RNA, 23 nt, Mycobacterium avium subsp. paratuberculosis
gcagcaccggcaccgcggcgaug

SEQ ID NO: 2949056 - RNA, 14 nt, Mycobacterium avium subsp. paratuberculosis
gcagcaccggcagc

SEQ ID NO: 2949057 - RNA, 14 nt, Mycobacterium avium subsp. paratuberculosis
gcagcaccggcaug

SEQ ID NO: 2949058 - RNA, 15 nt, Mycobacterium avium subsp. paratuberculosis
gcagcaccggccgga

SEQ ID NO: 2949059 - RNA, 12 nt, Mycobacterium avium subsp. paratuberculosis
gcagcaccggcg

SEQ ID NO: 2949060 - RNA, 22 nt, Mycobacterium avium subsp. paratuberculosis
gcagcaccucgaagccgacguc

SEQ ID NO: 2949061 - RNA, 18 nt, Mycobacterium avium subsp. paratuberculosis
gcagcaccucgcgcagca

SEQ ID NO: 2949062 - RNA, 21 nt, Mycobacterium avium subsp. paratuberculosis
gcagcaccucgcgcgcgagcc

SEQ ID NO: 2949063 - RNA, 18 nt, Mycobacterium avium subsp. paratuberculosis
gcagcaccuugccggucg

SEQ ID NO: 2949064 - RNA, 19 nt, Mycobacterium avium subsp. paratuberculosis
gcagcaccuugccggucgg

SEQ ID NO: 2949065 - RNA, 21 nt, Mycobacterium avium subsp. paratuberculosis
gcagcacgaucgagccggugg

SEQ ID NO: 2949066 - RNA, 20 nt, Mycobacterium avium subsp. paratuberculosis
gcagcacgaugaucccgagg

SEQ ID NO: 2949067 - RNA, 16 nt, Mycobacterium avium subsp. paratuberculosis
gcagcacgcccagauc

SEQ ID NO: 2949068 - RNA, 14 nt, Mycobacterium avium subsp. paratuberculosis
gcagcacgcccagc

SEQ ID NO: 2949069 - RNA, 15 nt, Mycobacterium avium subsp. paratuberculosis
gcagcacgcccagcc

SEQ ID NO: 2949070 - RNA, 16 nt, Mycobacterium avium subsp. paratuberculosis
gcagcacgcccagccc

SEQ ID NO: 2949071 - RNA, 17 nt, Mycobacterium avium subsp. paratuberculosis
gcagcacgcccagcccg

SEQ ID NO: 2949072 - RNA, 19 nt, Mycobacterium avium subsp. paratuberculosis
gcagcagguaaaccagcag

SEQ ID NO: 2949073 - RNA, 22 nt, Mycobacterium avium subsp. paratuberculosis
gcagcagguaaaccagcagcgc

SEQ ID NO: 2949074 - RNA, 14 nt, Mycobacterium avium subsp. paratuberculosis
gcagcaggucggcc

SEQ ID NO: 2949075 - RNA, 17 nt, Mycobacterium avium subsp. paratuberculosis
gcagcaggucggccagc

SEQ ID NO: 2949076 - RNA, 23 nt, Mycobacterium avium subsp. paratuberculosis
gcagcaggucggcgugcucgucg

SEQ ID NO: 2949077 - RNA, 18 nt, Mycobacterium avium subsp. paratuberculosis
gcagcaggugcaccaccc

SEQ ID NO: 2949078 - RNA, 21 nt, Mycobacterium avium subsp. paratuberculosis
gcagcaggugcaucgaccggc

SEQ ID NO: 2949079 - RNA, 23 nt, Mycobacterium avium subsp. paratuberculosis
gcagcaggugcaucgaccggcgg

SEQ ID NO: 2949080 - RNA, 20 nt, Mycobacterium avium subsp. paratuberculosis
gcagcaggugcaucgccacc

SEQ ID NO: 2949081 - RNA, 24 nt, Mycobacterium avium subsp. paratuberculosis
gcagcaggugcaucgccaccgucg

SEQ ID NO: 2949082 - RNA, 14 nt, Mycobacterium avium subsp. paratuberculosis
gcagcaggugcgcc

SEQ ID NO: 2949083 - RNA, 14 nt, Mycobacterium avium subsp. paratuberculosis
gcagcagguugcgg

SEQ ID NO: 2949084 - RNA, 16 nt, Mycobacterium avium subsp. paratuberculosis
gcagcaucacgucggc

SEQ ID NO: 2949085 - RNA, 18 nt, Mycobacterium avium subsp. paratuberculosis
gcagcaucacgucggcga

SEQ ID NO: 2949086 - RNA, 17 nt, Mycobacterium avium subsp. paratuberculosis
gcagcauccagguggcg

SEQ ID NO: 2949087 - RNA, 13 nt, Mycobacterium avium subsp. paratuberculosis
gcagcauccgcac

SEQ ID NO: 2949088 - RNA, 14 nt, Mycobacterium avium subsp. paratuberculosis
gcagcauccgcacc

SEQ ID NO: 2949089 - RNA, 16 nt, Mycobacterium avium subsp. paratuberculosis
gcagcauccgccgacg

SEQ ID NO: 2949090 - RNA, 23 nt, Mycobacterium avium subsp. paratuberculosis
gcagcaucggcagaucguugggc

SEQ ID NO: 2949091 - RNA, 20 nt, Mycobacterium avium subsp. paratuberculosis
gcagcaucgggacgccugcc

SEQ ID NO: 2949092 - RNA, 23 nt, Mycobacterium avium subsp. paratuberculosis
gcagcaucgggacgccugccgcc

SEQ ID NO: 2949093 - RNA, 14 nt, Mycobacterium avium subsp. paratuberculosis
gcagcaucuccgag

SEQ ID NO: 2949094 - RNA, 18 nt, Mycobacterium avium subsp. paratuberculosis
gcagcaucuccgagucgg

SEQ ID NO: 2949095 - RNA, 16 nt, Mycobacterium avium subsp. paratuberculosis
gcagcaucucuugaug

SEQ ID NO: 2949096 - RNA, 18 nt, Mycobacterium avium subsp. paratuberculosis
gcagcaucuuggccacgg

SEQ ID NO: 2949097 - RNA, 18 nt, Mycobacterium avium subsp. paratuberculosis
gcagcauggcccacagga

SEQ ID NO: 2949098 - RNA, 14 nt, Mycobacterium avium subsp. paratuberculosis
gcagcauguuggcg

SEQ ID NO: 2949099 - RNA, 23 nt, Mycobacterium avium subsp. paratuberculosis
gcagcauguuggcguaguggguc

SEQ ID NO: 2949100 - RNA, 16 nt, Mycobacterium avium subsp. paratuberculosis
gcagcauucgccgggg

SEQ ID NO: 2949101 - RNA, 19 nt, Mycobacterium avium subsp. paratuberculosis
gcagcauucgccggggucg

SEQ ID NO: 2949102 - RNA, 17 nt, Mycobacterium avium subsp. paratuberculosis
gcagcauuuccgagcga

SEQ ID NO: 2949103 - RNA, 15 nt, Mycobacterium avium subsp. paratuberculosis
gcagccaaccgccgg

SEQ ID NO: 2949104 - RNA, 18 nt, Mycobacterium avium subsp. paratuberculosis
gcagccaaccgccgggga

SEQ ID NO: 2949105 - RNA, 20 nt, Mycobacterium avium subsp. paratuberculosis
gcagccacaucugguugcgg

SEQ ID NO: 2949106 - RNA, 16 nt, Mycobacterium avium subsp. paratuberculosis
gcagccacccgucggu

SEQ ID NO: 2949107 - RNA, 17 nt, Mycobacterium avium subsp. paratuberculosis
gcagccacccgucggug

SEQ ID NO: 2949108 - RNA, 16 nt, Mycobacterium avium subsp. paratuberculosis
gcagccaccgcccgaa

SEQ ID NO: 2949109 - RNA, 16 nt, Mycobacterium avium subsp. paratuberculosis
gcagccacgacaccag

SEQ ID NO: 2949110 - RNA, 16 nt, Mycobacterium avium subsp. paratuberculosis
gcagccacgagcccag

SEQ ID NO: 2949111 - RNA, 17 nt, Mycobacterium avium subsp. paratuberculosis
gcagccacgagcccagc

SEQ ID NO: 2949112 - RNA, 21 nt, Mycobacterium avium subsp. paratuberculosis
gcagccacgagcccagccguc

SEQ ID NO: 2949113 - RNA, 14 nt, Mycobacterium avium subsp. paratuberculosis
gcagccacgccagc

SEQ ID NO: 2949114 - RNA, 19 nt, Mycobacterium avium subsp. paratuberculosis
gcagccacgccagccaggc

SEQ ID NO: 2949115 - RNA, 12 nt, Mycobacterium avium subsp. paratuberculosis
gcagccacgcgc

SEQ ID NO: 2949116 - RNA, 13 nt, Mycobacterium avium subsp. paratuberculosis
gcagccacgcgca

SEQ ID NO: 2949117 - RNA, 15 nt, Mycobacterium avium subsp. paratuberculosis
gcagccagaccucgc

SEQ ID NO: 2949118 - RNA, 17 nt, Mycobacterium avium subsp. paratuberculosis
gcagccagaccucgccg

SEQ ID NO: 2949119 - RNA, 20 nt, Mycobacterium avium subsp. paratuberculosis
gcagccagaccucgccgacg

SEQ ID NO: 2949120 - RNA, 21 nt, Mycobacterium avium subsp. paratuberculosis
gcagccagaccucgccgacgg

SEQ ID NO: 2949121 - RNA, 15 nt, Mycobacterium avium subsp. paratuberculosis
gcagccagaugucgc

SEQ ID NO: 2949122 - RNA, 16 nt, Mycobacterium avium subsp. paratuberculosis
gcagccagcccagccg

SEQ ID NO: 2949123 - RNA, 17 nt, Mycobacterium avium subsp. paratuberculosis
gcagccagcccagccgc

SEQ ID NO: 2949124 - RNA, 18 nt, Mycobacterium avium subsp. paratuberculosis
gcagccagcccagccgcc

SEQ ID NO: 2949125 - RNA, 21 nt, Mycobacterium avium subsp. paratuberculosis
gcagccagcccagccgccagc

SEQ ID NO: 2949126 - RNA, 13 nt, Mycobacterium avium subsp. paratuberculosis
gcagccagcccgc

SEQ ID NO: 2949127 - RNA, 13 nt, Mycobacterium avium subsp. paratuberculosis
gcagccagccugg

SEQ ID NO: 2949128 - RNA, 14 nt, Mycobacterium avium subsp. paratuberculosis
gcagccagccuggc

SEQ ID NO: 2949129 - RNA, 16 nt, Mycobacterium avium subsp. paratuberculosis
gcagccagccuggcgg

SEQ ID NO: 2949130 - RNA, 20 nt, Mycobacterium avium subsp. paratuberculosis
gcagccagccuggcggcgac

SEQ ID NO: 2949131 - RNA, 22 nt, Mycobacterium avium subsp. paratuberculosis
gcagccagccuggcggcgaccc

SEQ ID NO: 2949132 - RNA, 23 nt, Mycobacterium avium subsp. paratuberculosis
gcagccagccuggcggcgacccg

SEQ ID NO: 2949133 - RNA, 15 nt, Mycobacterium avium subsp. paratuberculosis
gcagccagcgccgca

SEQ ID NO: 2949134 - RNA, 14 nt, Mycobacterium avium subsp. paratuberculosis
gcagccagcucggc

SEQ ID NO: 2949135 - RNA, 16 nt, Mycobacterium avium subsp. paratuberculosis
gcagccagcucggcgu

SEQ ID NO: 2949136 - RNA, 16 nt, Mycobacterium avium subsp. paratuberculosis
gcagccaggcguuggu

SEQ ID NO: 2949137 - RNA, 16 nt, Mycobacterium avium subsp. paratuberculosis
gcagccagguccgggc

SEQ ID NO: 2949138 - RNA, 21 nt, Mycobacterium avium subsp. paratuberculosis
gcagccagguccgggcacucg

SEQ ID NO: 2949139 - RNA, 15 nt, Mycobacterium avium subsp. paratuberculosis
gcagccaggugguga

SEQ ID NO: 2949140 - RNA, 24 nt, Mycobacterium avium subsp. paratuberculosis
gcagccagguggugaacucuucgc

SEQ ID NO: 2949141 - RNA, 14 nt, Mycobacterium avium subsp. paratuberculosis
gcagccagucgccg

SEQ ID NO: 2949142 - RNA, 17 nt, Mycobacterium avium subsp. paratuberculosis
gcagccagucgccggcc

SEQ ID NO: 2949143 - RNA, 19 nt, Mycobacterium avium subsp. paratuberculosis
gcagccagucgccggccag

SEQ ID NO: 2949144 - RNA, 20 nt, Mycobacterium avium subsp. paratuberculosis
gcagccagucgccggccagg

SEQ ID NO: 2949145 - RNA, 15 nt, Mycobacterium avium subsp. paratuberculosis
gcagccagucgguca

SEQ ID NO: 2949146 - RNA, 13 nt, Mycobacterium avium subsp. paratuberculosis
gcagcccagccag

SEQ ID NO: 2949147 - RNA, 15 nt, Mycobacterium avium subsp. paratuberculosis
gcagcccagccagcg

SEQ ID NO: 2949148 - RNA, 17 nt, Mycobacterium avium subsp. paratuberculosis
gcagcccagccagcgac

SEQ ID NO: 2949149 - RNA, 13 nt, Mycobacterium avium subsp. paratuberculosis
gcagcccaggccc

SEQ ID NO: 2949150 - RNA, 18 nt, Mycobacterium avium subsp. paratuberculosis
gcagcccaggcccagcag

SEQ ID NO: 2949151 - RNA, 22 nt, Mycobacterium avium subsp. paratuberculosis
gcagcccaggcccagcagcacc

SEQ ID NO: 2949152 - RNA, 22 nt, Mycobacterium avium subsp. paratuberculosis
gcagcccagguaaucgaaggcc

SEQ ID NO: 2949153 - RNA, 17 nt, Mycobacterium avium subsp. paratuberculosis
gcagcccccggaccacg

SEQ ID NO: 2949154 - RNA, 20 nt, Mycobacterium avium subsp. paratuberculosis
gcagcccccggaccacgucc

SEQ ID NO: 2949155 - RNA, 15 nt, Mycobacterium avium subsp. paratuberculosis
gcagccccgcacuga

SEQ ID NO: 2949156 - RNA, 19 nt, Mycobacterium avium subsp. paratuberculosis
gcagccccgucggucccga

SEQ ID NO: 2949157 - RNA, 20 nt, Mycobacterium avium subsp. paratuberculosis
gcagccgcugcagcgccgcc

SEQ ID NO: 2949158 - RNA, 21 nt, Mycobacterium avium subsp. paratuberculosis
gcagccgcugcugggugccgc

SEQ ID NO: 2949159 - RNA, 22 nt, Mycobacterium avium subsp. paratuberculosis
gcagccgcugcugggugccgcg

SEQ ID NO: 2949160 - RNA, 15 nt, Mycobacterium avium subsp. paratuberculosis
gcagccgcuggccgc

SEQ ID NO: 2949161 - RNA, 19 nt, Mycobacterium avium subsp. paratuberculosis
gcagccgcuggccgcgcca

SEQ ID NO: 2949162 - RNA, 23 nt, Mycobacterium avium subsp. paratuberculosis
gcagccgcuggccgcgccacagc

SEQ ID NO: 2949163 - RNA, 16 nt, Mycobacterium avium subsp. paratuberculosis
gcagccggaaggccaa

SEQ ID NO: 2949164 - RNA, 20 nt, Mycobacterium avium subsp. paratuberculosis
gcagccggaucaccuggugc

SEQ ID NO: 2949165 - RNA, 12 nt, Mycobacterium avium subsp. paratuberculosis
gcagccggcagc

SEQ ID NO: 2949166 - RNA, 23 nt, Mycobacterium avium subsp. paratuberculosis
gcagccggcagcauucgccgggg

SEQ ID NO: 2949167 - RNA, 13 nt, Mycobacterium avium subsp. paratuberculosis
gcagccggccacc

SEQ ID NO: 2949168 - RNA, 15 nt, Mycobacterium avium subsp. paratuberculosis
gcagccggccaccuc

SEQ ID NO: 2949169 - RNA, 17 nt, Mycobacterium avium subsp. paratuberculosis
gcagccggccaucucgg

SEQ ID NO: 2949170 - RNA, 18 nt, Mycobacterium avium subsp. paratuberculosis
gcagccggccaucucggc

SEQ ID NO: 2949171 - RNA, 19 nt, Mycobacterium avium subsp. paratuberculosis
gcagccggccaucucggcg

SEQ ID NO: 2949172 - RNA, 22 nt, Mycobacterium avium subsp. paratuberculosis
gcagccggccgaccgccucgau

SEQ ID NO: 2949173 - RNA, 15 nt, Mycobacterium avium subsp. paratuberculosis
gcagccggccggcag

SEQ ID NO: 2949174 - RNA, 16 nt, Mycobacterium avium subsp. paratuberculosis
gcagccggccggcgga

SEQ ID NO: 2949175 - RNA, 13 nt, Mycobacterium avium subsp. paratuberculosis
gcagccggccguc

SEQ ID NO: 2949176 - RNA, 19 nt, Mycobacterium avium subsp. paratuberculosis
gcagccggccguccacggc

SEQ ID NO: 2949177 - RNA, 20 nt, Mycobacterium avium subsp. paratuberculosis
gcagccggccguccacggcg

SEQ ID NO: 2949178 - RNA, 23 nt, Mycobacterium avium subsp. paratuberculosis
gcagccggccguccacggcggug

SEQ ID NO: 2949179 - RNA, 16 nt, Mycobacterium avium subsp. paratuberculosis
gcagccggcgcggcag

SEQ ID NO: 2949180 - RNA, 15 nt, Mycobacterium avium subsp. paratuberculosis
gcagccggcgcggug

SEQ ID NO: 2949181 - RNA, 20 nt, Mycobacterium avium subsp. paratuberculosis
gcagccggcggcgccuugcc

SEQ ID NO: 2949182 - RNA, 14 nt, Mycobacterium avium subsp. paratuberculosis
gcagccggcguacu

SEQ ID NO: 2949183 - RNA, 22 nt, Mycobacterium avium subsp. paratuberculosis
gcagccggcguacucgcacagc

SEQ ID NO: 2949184 - RNA, 15 nt, Mycobacterium avium subsp. paratuberculosis
gcagccggcugagca

SEQ ID NO: 2949185 - RNA, 18 nt, Mycobacterium avium subsp. paratuberculosis
gcagccggcugagcagcc

SEQ ID NO: 2949186 - RNA, 13 nt, Mycobacterium avium subsp. paratuberculosis
gcagccgggccag

SEQ ID NO: 2949187 - RNA, 17 nt, Mycobacterium avium subsp. paratuberculosis
gcagccgggccagcaac

SEQ ID NO: 2949188 - RNA, 17 nt, Mycobacterium avium subsp. paratuberculosis
gcagccgggccugcggc

SEQ ID NO: 2949189 - RNA, 14 nt, Mycobacterium avium subsp. paratuberculosis
gcagccgggcgauc

SEQ ID NO: 2949190 - RNA, 21 nt, Mycobacterium avium subsp. paratuberculosis
gcagccgggcgaucauccagg

SEQ ID NO: 2949191 - RNA, 17 nt, Mycobacterium avium subsp. paratuberculosis
gcagccgggcggcgccg

SEQ ID NO: 2949192 - RNA, 20 nt, Mycobacterium avium subsp. paratuberculosis
gcagccgggcggcgccgaac

SEQ ID NO: 2949193 - RNA, 16 nt, Mycobacterium avium subsp. paratuberculosis
gcagccgggcggcgcu

SEQ ID NO: 2949194 - RNA, 16 nt, Mycobacterium avium subsp. paratuberculosis
gcagccgggcggcggc

SEQ ID NO: 2949195 - RNA, 20 nt, Mycobacterium avium subsp. paratuberculosis
gcagccgggcggcggccucc

SEQ ID NO: 2949196 - RNA, 21 nt, Mycobacterium avium subsp. paratuberculosis
gcagccgggcggcggccuccg

SEQ ID NO: 2949197 - RNA, 20 nt, Mycobacterium avium subsp. paratuberculosis
gcagccgggcggugaugguc

SEQ ID NO: 2949198 - RNA, 17 nt, Mycobacterium avium subsp. paratuberculosis
gcagccgggggcggugc

SEQ ID NO: 2949199 - RNA, 21 nt, Mycobacterium avium subsp. paratuberculosis
gcagccgggggcggugcagcc

SEQ ID NO: 2949200 - RNA, 16 nt, Mycobacterium avium subsp. paratuberculosis
gcagccgggggucggc

SEQ ID NO: 2949201 - RNA, 20 nt, Mycobacterium avium subsp. paratuberculosis
gcagccgggggucggcuucc

SEQ ID NO: 2949202 - RNA, 21 nt, Mycobacterium avium subsp. paratuberculosis
gcagccggggugcccgggccg

SEQ ID NO: 2949203 - RNA, 15 nt, Mycobacterium avium subsp. paratuberculosis
gcagccgggugccca

SEQ ID NO: 2949204 - RNA, 16 nt, Mycobacterium avium subsp. paratuberculosis
gcagccgggugcgggc

SEQ ID NO: 2949205 - RNA, 22 nt, Mycobacterium avium subsp. paratuberculosis
gcagccgggugcgggccagcag

SEQ ID NO: 2949206 - RNA, 21 nt, Mycobacterium avium subsp. paratuberculosis
gcagccgggugcggugcagcc

SEQ ID NO: 2949207 - RNA, 13 nt, Mycobacterium avium subsp. paratuberculosis
gcagccggguggc

SEQ ID NO: 2949208 - RNA, 21 nt, Mycobacterium avium subsp. paratuberculosis
gcagccggguggcccgcccgg

SEQ ID NO: 2949209 - RNA, 19 nt, Mycobacterium avium subsp. paratuberculosis
gcagccgggugggcggcac

SEQ ID NO: 2949210 - RNA, 17 nt, Mycobacterium avium subsp. paratuberculosis
gcagccgguccggcggc

SEQ ID NO: 2949211 - RNA, 17 nt, Mycobacterium avium subsp. paratuberculosis
gcagccggucgaggucg

SEQ ID NO: 2949212 - RNA, 18 nt, Mycobacterium avium subsp. paratuberculosis
gcagccggucgaggucgc

SEQ ID NO: 2949213 - RNA, 20 nt, Mycobacterium avium subsp. paratuberculosis
gcagccggucgaggucgccg

SEQ ID NO: 2949214 - RNA, 21 nt, Mycobacterium avium subsp. paratuberculosis
gcagccggucgaggucgccga

SEQ ID NO: 2949215 - RNA, 23 nt, Mycobacterium avium subsp. paratuberculosis
gcagccggucgaggucgccgaca

SEQ ID NO: 2949216 - RNA, 14 nt, Mycobacterium avium subsp. paratuberculosis
gcagccggucggag

SEQ ID NO: 2949217 - RNA, 21 nt, Mycobacterium avium subsp. paratuberculosis
gcagccgucccuguucgcgcc

SEQ ID NO: 2949218 - RNA, 23 nt, Mycobacterium avium subsp. paratuberculosis
gcagccgucccuguucgcgccgg

SEQ ID NO: 2949219 - RNA, 21 nt, Mycobacterium avium subsp. paratuberculosis
gcagccgucgaucuugacgug

SEQ ID NO: 2949220 - RNA, 13 nt, Mycobacterium avium subsp. paratuberculosis
gcagccgucgaug

SEQ ID NO: 2949221 - RNA, 15 nt, Mycobacterium avium subsp. paratuberculosis
gcagccgucgaugcc

SEQ ID NO: 2949222 - RNA, 18 nt, Mycobacterium avium subsp. paratuberculosis
gcagccgucgaugccggc

SEQ ID NO: 2949223 - RNA, 21 nt, Mycobacterium avium subsp. paratuberculosis
gcagccgucgaugccggcgac

SEQ ID NO: 2949224 - RNA, 21 nt, Mycobacterium avium subsp. paratuberculosis
gcagccguuccaucgggccca

SEQ ID NO: 2949225 - RNA, 12 nt, Mycobacterium avium subsp. paratuberculosis
gcagccuucuuc

SEQ ID NO: 2949226 - RNA, 14 nt, Mycobacterium avium subsp. paratuberculosis
gcagccuucuucgc

SEQ ID NO: 2949227 - RNA, 19 nt, Mycobacterium avium subsp. paratuberculosis
gcagccuucuucgccgggg

SEQ ID NO: 2949228 - RNA, 20 nt, Mycobacterium avium subsp. paratuberculosis
gcagccuucuucgccggggc

SEQ ID NO: 2949229 - RNA, 18 nt, Mycobacterium avium subsp. paratuberculosis
gcagccuucuuggcgggc

SEQ ID NO: 2949230 - RNA, 20 nt, Mycobacterium avium subsp. paratuberculosis
gcagccuucuuggcgggcgc

SEQ ID NO: 2949231 - RNA, 21 nt, Mycobacterium avium subsp. paratuberculosis
gcagccuucuuggcgggcgcc

SEQ ID NO: 2949232 - RNA, 16 nt, Mycobacterium avium subsp. paratuberculosis
gcagccuuuccacauc

SEQ ID NO: 2949233 - RNA, 18 nt, Mycobacterium avium subsp. paratuberculosis
gcagccuuuccacaucug

SEQ ID NO: 2949234 - RNA, 16 nt, Mycobacterium avium subsp. paratuberculosis
gcagcgaaaccuccgg

SEQ ID NO: 2949235 - RNA, 21 nt, Mycobacterium avium subsp. paratuberculosis
gcagcgaaacucguugccagc

SEQ ID NO: 2949236 - RNA, 16 nt, Mycobacterium avium subsp. paratuberculosis
gcagcgaacccgccag

SEQ ID NO: 2949237 - RNA, 15 nt, Mycobacterium avium subsp. paratuberculosis
gcagcgaacgcggcu

SEQ ID NO: 2949238 - RNA, 16 nt, Mycobacterium avium subsp. paratuberculosis
gcagcgaacgcggcug

SEQ ID NO: 2949239 - RNA, 15 nt, Mycobacterium avium subsp. paratuberculosis
gcagcgaacgucagg

SEQ ID NO: 2949240 - RNA, 15 nt, Mycobacterium avium subsp. paratuberculosis
gcagcgaacugccgg

SEQ ID NO: 2949241 - RNA, 11 nt, Mycobacterium avium subsp. paratuberculosis
gcagcgcccgg

SEQ ID NO: 2949242 - RNA, 16 nt, Mycobacterium avium subsp. paratuberculosis
gcagcgcccgggccag

SEQ ID NO: 2949243 - RNA, 20 nt, Mycobacterium avium subsp. paratuberculosis
gcagcgcccgggccaggacc

SEQ ID NO: 2949244 - RNA, 14 nt, Mycobacterium avium subsp. paratuberculosis
gcagcgcccgggug

SEQ ID NO: 2949245 - RNA, 21 nt, Mycobacterium avium subsp. paratuberculosis
gcagcgccgaggccagcacgc

SEQ ID NO: 2949246 - RNA, 19 nt, Mycobacterium avium subsp. paratuberculosis
gcagcgccgccaccggccg

SEQ ID NO: 2949247 - RNA, 13 nt, Mycobacterium avium subsp. paratuberculosis
gcagcgccgcccg

SEQ ID NO: 2949248 - RNA, 16 nt, Mycobacterium avium subsp. paratuberculosis
gcagcgccgcccgcac

SEQ ID NO: 2949249 - RNA, 21 nt, Mycobacterium avium subsp. paratuberculosis
gcagcgccgcccgcaccugcg

SEQ ID NO: 2949250 - RNA, 13 nt, Mycobacterium avium subsp. paratuberculosis
gcagcgccgcgac

SEQ ID NO: 2949251 - RNA, 15 nt, Mycobacterium avium subsp. paratuberculosis
gcagcgccgcgacga

SEQ ID NO: 2949252 - RNA, 13 nt, Mycobacterium avium subsp. paratuberculosis
gcagcgccgcgcc

SEQ ID NO: 2949253 - RNA, 16 nt, Mycobacterium avium subsp. paratuberculosis
gcagcgccgcgccgac

SEQ ID NO: 2949254 - RNA, 18 nt, Mycobacterium avium subsp. paratuberculosis
gcagcgccgcggccggug

SEQ ID NO: 2949255 - RNA, 20 nt, Mycobacterium avium subsp. paratuberculosis
gcagcgccgcggccggugcc

SEQ ID NO: 2949256 - RNA, 14 nt, Mycobacterium avium subsp. paratuberculosis
gcagcgccgcggcg

SEQ ID NO: 2949257 - RNA, 15 nt, Mycobacterium avium subsp. paratuberculosis
gcagcgccgcggcgc

SEQ ID NO: 2949258 - RNA, 16 nt, Mycobacterium avium subsp. paratuberculosis
gcagcgccgcggcgcc

SEQ ID NO: 2949259 - RNA, 18 nt, Mycobacterium avium subsp. paratuberculosis
gcagcgccgcggcgcccu

SEQ ID NO: 2949260 - RNA, 22 nt, Mycobacterium avium subsp. paratuberculosis
gcagcgccgcuucgucgccggc

SEQ ID NO: 2949261 - RNA, 14 nt, Mycobacterium avium subsp. paratuberculosis
gcagcgccguccgc

SEQ ID NO: 2949262 - RNA, 12 nt, Mycobacterium avium subsp. paratuberculosis
gcagcgccgucu

SEQ ID NO: 2949263 - RNA, 21 nt, Mycobacterium avium subsp. paratuberculosis
gcagcgccucccggaccacca

SEQ ID NO: 2949264 - RNA, 15 nt, Mycobacterium avium subsp. paratuberculosis
gcagcgccucgagca

SEQ ID NO: 2949265 - RNA, 20 nt, Mycobacterium avium subsp. paratuberculosis
gcagcgccucgccgggcccg

SEQ ID NO: 2949266 - RNA, 16 nt, Mycobacterium avium subsp. paratuberculosis
gcagcgccucggcgau

SEQ ID NO: 2949267 - RNA, 15 nt, Mycobacterium avium subsp. paratuberculosis
gcagcgccucggcgg

SEQ ID NO: 2949268 - RNA, 16 nt, Mycobacterium avium subsp. paratuberculosis
gcagcgccucggcggg

SEQ ID NO: 2949269 - RNA, 18 nt, Mycobacterium avium subsp. paratuberculosis
gcagcgccucggcgggcc

SEQ ID NO: 2949270 - RNA, 19 nt, Mycobacterium avium subsp. paratuberculosis
gcagcgccucggcgggccg

SEQ ID NO: 2949271 - RNA, 21 nt, Mycobacterium avium subsp. paratuberculosis
gcagcgccucggcguggcagg

SEQ ID NO: 2949272 - RNA, 18 nt, Mycobacterium avium subsp. paratuberculosis
gcagcgccugcugccagg

SEQ ID NO: 2949273 - RNA, 22 nt, Mycobacterium avium subsp. paratuberculosis
gcagcgccugcugccaggacag

SEQ ID NO: 2949274 - RNA, 18 nt, Mycobacterium avium subsp. paratuberculosis
gcagcgccuugccgacga

SEQ ID NO: 2949275 - RNA, 22 nt, Mycobacterium avium subsp. paratuberculosis
gcagcgccuugccgacgacguc

SEQ ID NO: 2949276 - RNA, 12 nt, Mycobacterium avium subsp. paratuberculosis
gcagcgccuugg

SEQ ID NO: 2949277 - RNA, 13 nt, Mycobacterium avium subsp. paratuberculosis
gcagcgccuuggg

SEQ ID NO: 2949278 - RNA, 14 nt, Mycobacterium avium subsp. paratuberculosis
gcagcgcgaccagc

SEQ ID NO: 2949279 - RNA, 15 nt, Mycobacterium avium subsp. paratuberculosis
gcagcgcgaccagcc

SEQ ID NO: 2949280 - RNA, 16 nt, Mycobacterium avium subsp. paratuberculosis
gcagcgcgaccagccc

SEQ ID NO: 2949281 - RNA, 19 nt, Mycobacterium avium subsp. paratuberculosis
gcagcgcgaccagcccggc

SEQ ID NO: 2949282 - RNA, 20 nt, Mycobacterium avium subsp. paratuberculosis
gcagcgcgacgaacagcacc

SEQ ID NO: 2949283 - RNA, 14 nt, Mycobacterium avium subsp. paratuberculosis
gcagcgcgacgccg

SEQ ID NO: 2949284 - RNA, 16 nt, Mycobacterium avium subsp. paratuberculosis
gcagcgcgacgccgac

SEQ ID NO: 2949285 - RNA, 23 nt, Mycobacterium avium subsp. paratuberculosis
gcagcgcgacgccgacgcccagc

SEQ ID NO: 2949286 - RNA, 14 nt, Mycobacterium avium subsp. paratuberculosis
gcagcgcgacuggg

SEQ ID NO: 2949287 - RNA, 15 nt, Mycobacterium avium subsp. paratuberculosis
gcagcgcgauccgcg

SEQ ID NO: 2949288 - RNA, 21 nt, Mycobacterium avium subsp. paratuberculosis
gcagcgcgauccggggggcgg

SEQ ID NO: 2949289 - RNA, 17 nt, Mycobacterium avium subsp. paratuberculosis
gcagcgcgaugccggcc

SEQ ID NO: 2949290 - RNA, 20 nt, Mycobacterium avium subsp. paratuberculosis
gcagcgcgauguccgacagc

SEQ ID NO: 2949291 - RNA, 22 nt, Mycobacterium avium subsp. paratuberculosis
gcagcgcgcccugaggcccggu

SEQ ID NO: 2949292 - RNA, 13 nt, Mycobacterium avium subsp. paratuberculosis
gcagcgcgccgac

SEQ ID NO: 2949293 - RNA, 15 nt, Mycobacterium avium subsp. paratuberculosis
gcagcgcgccgacca

SEQ ID NO: 2949294 - RNA, 14 nt, Mycobacterium avium subsp. paratuberculosis
gcagcgcgccgcgc

SEQ ID NO: 2949295 - RNA, 20 nt, Mycobacterium avium subsp. paratuberculosis
gcagcgcgccgcgcuggccg

SEQ ID NO: 2949296 - RNA, 18 nt, Mycobacterium avium subsp. paratuberculosis
gcagcgcgcgaccgcgau

SEQ ID NO: 2949297 - RNA, 18 nt, Mycobacterium avium subsp. paratuberculosis
gcagcgcggauuccagcg

SEQ ID NO: 2949298 - RNA, 20 nt, Mycobacterium avium subsp. paratuberculosis
gcagcgcggauuccagcgcg

SEQ ID NO: 2949299 - RNA, 21 nt, Mycobacterium avium subsp. paratuberculosis
gcagcgcggauuccagcgcga

SEQ ID NO: 2949300 - RNA, 22 nt, Mycobacterium avium subsp. paratuberculosis
gcagcgcggauuccagcgcgac

SEQ ID NO: 2949301 - RNA, 15 nt, Mycobacterium avium subsp. paratuberculosis
gcagcgcggcauggc

SEQ ID NO: 2949302 - RNA, 11 nt, Mycobacterium avium subsp. paratuberculosis
gcagcgcggcc

SEQ ID NO: 2949303 - RNA, 13 nt, Mycobacterium avium subsp. paratuberculosis
gcagcgcggccag

SEQ ID NO: 2949304 - RNA, 14 nt, Mycobacterium avium subsp. paratuberculosis
gcagcgcggccagc

SEQ ID NO: 2949305 - RNA, 14 nt, Mycobacterium avium subsp. paratuberculosis
gcagcgcggcgauc

SEQ ID NO: 2949306 - RNA, 19 nt, Mycobacterium avium subsp. paratuberculosis
gcagcgcggcgaucucggc

SEQ ID NO: 2949307 - RNA, 20 nt, Mycobacterium avium subsp. paratuberculosis
gcagcgcggcguucagcagc

SEQ ID NO: 2949308 - RNA, 11 nt, Mycobacterium avium subsp. paratuberculosis
gcagcgcggcu

SEQ ID NO: 2949309 - RNA, 20 nt, Mycobacterium avium subsp. paratuberculosis
gcagcgcggucaacaccggg

SEQ ID NO: 2949310 - RNA, 13 nt, Mycobacterium avium subsp. paratuberculosis
gcagcgcggugcc

SEQ ID NO: 2949311 - RNA, 14 nt, Mycobacterium avium subsp. paratuberculosis
gcagcgcggugccg

SEQ ID NO: 2949312 - RNA, 17 nt, Mycobacterium avium subsp. paratuberculosis
gcagcgcggugccgacc

SEQ ID NO: 2949313 - RNA, 19 nt, Mycobacterium avium subsp. paratuberculosis
gcagcgcgguuuccggcga

SEQ ID NO: 2949314 - RNA, 19 nt, Mycobacterium avium subsp. paratuberculosis
gcagcgcguaggugcgguc

SEQ ID NO: 2949315 - RNA, 14 nt, Mycobacterium avium subsp. paratuberculosis
gcagcgcgucgcgg

SEQ ID NO: 2949316 - RNA, 19 nt, Mycobacterium avium subsp. paratuberculosis
gcagcgcgucgcgggcccg

SEQ ID NO: 2949317 - RNA, 14 nt, Mycobacterium avium subsp. paratuberculosis
gcagcgcgucgggc

SEQ ID NO: 2949318 - RNA, 20 nt, Mycobacterium avium subsp. paratuberculosis
gcagcgcgucgggcucggcc

SEQ ID NO: 2949319 - RNA, 12 nt, Mycobacterium avium subsp. paratuberculosis
gcagcgcgucgu

SEQ ID NO: 2949320 - RNA, 16 nt, Mycobacterium avium subsp. paratuberculosis
gcagcgcgucgucggu

SEQ ID NO: 2949321 - RNA, 22 nt, Mycobacterium avium subsp. paratuberculosis
gcagcgcgucgucggucaggcc

SEQ ID NO: 2949322 - RNA, 20 nt, Mycobacterium avium subsp. paratuberculosis
gcagcgcgucgugcaacucc

SEQ ID NO: 2949323 - RNA, 18 nt, Mycobacterium avium subsp. paratuberculosis
gcagcgcuaaccgcgggc

SEQ ID NO: 2949324 - RNA, 22 nt, Mycobacterium avium subsp. paratuberculosis
gcagcgcuaaccgcgggcaucg

SEQ ID NO: 2949325 - RNA, 14 nt, Mycobacterium avium subsp. paratuberculosis
gcagcgcuccugca

SEQ ID NO: 2949326 - RNA, 17 nt, Mycobacterium avium subsp. paratuberculosis
gcagcgugggcaccggc

SEQ ID NO: 2949327 - RNA, 17 nt, Mycobacterium avium subsp. paratuberculosis
gcagcgugguccagcac

SEQ ID NO: 2949328 - RNA, 22 nt, Mycobacterium avium subsp. paratuberculosis
gcagcgugguccagcacgugcc

SEQ ID NO: 2949329 - RNA, 19 nt, Mycobacterium avium subsp. paratuberculosis
gcagcguggucuccuggcc

SEQ ID NO: 2949330 - RNA, 18 nt, Mycobacterium avium subsp. paratuberculosis
gcagcgugucggggucgg

SEQ ID NO: 2949331 - RNA, 16 nt, Mycobacterium avium subsp. paratuberculosis
gcagcgugugcaccug

SEQ ID NO: 2949332 - RNA, 16 nt, Mycobacterium avium subsp. paratuberculosis
gcagcguuccgucggc

SEQ ID NO: 2949333 - RNA, 17 nt, Mycobacterium avium subsp. paratuberculosis
gcagcguucggucagca

SEQ ID NO: 2949334 - RNA, 19 nt, Mycobacterium avium subsp. paratuberculosis
gcagcucagccgccuggcg

SEQ ID NO: 2949335 - RNA, 16 nt, Mycobacterium avium subsp. paratuberculosis
gcagcucauacagcgg

SEQ ID NO: 2949336 - RNA, 21 nt, Mycobacterium avium subsp. paratuberculosis
gcagcucauacagcggcgcgc

SEQ ID NO: 2949337 - RNA, 22 nt, Mycobacterium avium subsp. paratuberculosis
gcagcucauacagcggcgcgcg

SEQ ID NO: 2949338 - RNA, 17 nt, Mycobacterium avium subsp. paratuberculosis
gcagcuccaucgacgga

SEQ ID NO: 2949339 - RNA, 18 nt, Mycobacterium avium subsp. paratuberculosis
gcagcucccacucguagu

SEQ ID NO: 2949340 - RNA, 16 nt, Mycobacterium avium subsp. paratuberculosis
gcagcuccggucggcg

SEQ ID NO: 2949341 - RNA, 19 nt, Mycobacterium avium subsp. paratuberculosis
gcagcuccggucggcgcuc

SEQ ID NO: 2949342 - RNA, 17 nt, Mycobacterium avium subsp. paratuberculosis
gcagcuccucggcggcc

SEQ ID NO: 2949343 - RNA, 20 nt, Mycobacterium avium subsp. paratuberculosis
gcagcuccucggcggccucg

SEQ ID NO: 2949344 - RNA, 14 nt, Mycobacterium avium subsp. paratuberculosis
gcagcuccuugagc

SEQ ID NO: 2949345 - RNA, 21 nt, Mycobacterium avium subsp. paratuberculosis
gcagcuccuugagccgccgcg

SEQ ID NO: 2949346 - RNA, 22 nt, Mycobacterium avium subsp. paratuberculosis
gcagcuccuugagccgccgcgg

SEQ ID NO: 2949347 - RNA, 18 nt, Mycobacterium avium subsp. paratuberculosis
gcagcucgacgaccucgc

SEQ ID NO: 2949348 - RNA, 19 nt, Mycobacterium avium subsp. paratuberculosis
gcagcucgacgaccucgcc

SEQ ID NO: 2949349 - RNA, 22 nt, Mycobacterium avium subsp. paratuberculosis
gcagcucgacgaccucgccgac

SEQ ID NO: 2949350 - RNA, 23 nt, Mycobacterium avium subsp. paratuberculosis
gcagcucgacgaccucgccgacg

SEQ ID NO: 2949351 - RNA, 17 nt, Mycobacterium avium subsp. paratuberculosis
gcagcucgaucacccag

SEQ ID NO: 2949352 - RNA, 14 nt, Mycobacterium avium subsp. paratuberculosis
gcagcucgcaaacg

SEQ ID NO: 2949353 - RNA, 13 nt, Mycobacterium avium subsp. paratuberculosis
gcagcucgccggc

SEQ ID NO: 2949354 - RNA, 14 nt, Mycobacterium avium subsp. paratuberculosis
gcagcucgccggcg

SEQ ID NO: 2949355 - RNA, 21 nt, Mycobacterium avium subsp. paratuberculosis
gcagcucgccggcgcgcagcc

SEQ ID NO: 2949356 - RNA, 22 nt, Mycobacterium avium subsp. paratuberculosis
gcagcucgccggcgcgcagcca

SEQ ID NO: 2949357 - RNA, 15 nt, Mycobacterium avium subsp. paratuberculosis
gcagcucgccggugg

SEQ ID NO: 2949358 - RNA, 16 nt, Mycobacterium avium subsp. paratuberculosis
gcagcucgccgguggc

SEQ ID NO: 2949359 - RNA, 20 nt, Mycobacterium avium subsp. paratuberculosis
gcagcucgccgguggcggcg

SEQ ID NO: 2949360 - RNA, 17 nt, Mycobacterium avium subsp. paratuberculosis
gcagcucgcgcagccgg

SEQ ID NO: 2949361 - RNA, 18 nt, Mycobacterium avium subsp. paratuberculosis
gcagcucgcgcagccggc

SEQ ID NO: 2949362 - RNA, 18 nt, Mycobacterium avium subsp. paratuberculosis
gcagcucgcgcagcuggc

SEQ ID NO: 2949363 - RNA, 22 nt, Mycobacterium avium subsp. paratuberculosis
gcagcucgcgcagcuggccgug

SEQ ID NO: 2949364 - RNA, 16 nt, Mycobacterium avium subsp. paratuberculosis
gcagcucgcggauccg

SEQ ID NO: 2949365 - RNA, 14 nt, Mycobacterium avium subsp. paratuberculosis
gcagcucgcguagc

SEQ ID NO: 2949366 - RNA, 20 nt, Mycobacterium avium subsp. paratuberculosis
gcagcucgcugagcgggacg

SEQ ID NO: 2949367 - RNA, 13 nt, Mycobacterium avium subsp. paratuberculosis
gcagcucggcggc

SEQ ID NO: 2949368 - RNA, 15 nt, Mycobacterium avium subsp. paratuberculosis
gcagcucggcggccu

SEQ ID NO: 2949369 - RNA, 13 nt, Mycobacterium avium subsp. paratuberculosis
gcagcucggcggg

SEQ ID NO: 2949370 - RNA, 15 nt, Mycobacterium avium subsp. paratuberculosis
gcagcucgggcagcc

SEQ ID NO: 2949371 - RNA, 18 nt, Mycobacterium avium subsp. paratuberculosis
gcagcucgggcagcccgc

SEQ ID NO: 2949372 - RNA, 22 nt, Mycobacterium avium subsp. paratuberculosis
gcagcucggggucggcgucggg

SEQ ID NO: 2949373 - RNA, 23 nt, Mycobacterium avium subsp. paratuberculosis
gcagcucggggucggcgucgggc

SEQ ID NO: 2949374 - RNA, 20 nt, Mycobacterium avium subsp. paratuberculosis
gcagcucggucaccagcggc

SEQ ID NO: 2949375 - RNA, 22 nt, Mycobacterium avium subsp. paratuberculosis
gcagcucggugcagaccccggc

SEQ ID NO: 2949376 - RNA, 15 nt, Mycobacterium avium subsp. paratuberculosis
gcagcucggugcgca

SEQ ID NO: 2949377 - RNA, 17 nt, Mycobacterium avium subsp. paratuberculosis
gcagcucggugcgcacc

SEQ ID NO: 2949378 - RNA, 18 nt, Mycobacterium avium subsp. paratuberculosis
gcagcucggugcgcaccc

SEQ ID NO: 2949379 - RNA, 12 nt, Mycobacterium avium subsp. paratuberculosis
gcagcucggugg

SEQ ID NO: 2949380 - RNA, 14 nt, Mycobacterium avium subsp. paratuberculosis
gcagcucgguggcg

SEQ ID NO: 2949381 - RNA, 14 nt, Mycobacterium avium subsp. paratuberculosis
gcagcucgucgacg

SEQ ID NO: 2949382 - RNA, 15 nt, Mycobacterium avium subsp. paratuberculosis
gcagcucgucgacgu

SEQ ID NO: 2949383 - RNA, 16 nt, Mycobacterium avium subsp. paratuberculosis
gcagcucgucgacguc

SEQ ID NO: 2949384 - RNA, 23 nt, Mycobacterium avium subsp. paratuberculosis
gcagcucgucggcgcgccacccg

SEQ ID NO: 2949385 - RNA, 13 nt, Mycobacterium avium subsp. paratuberculosis
gcagcucgucgug

SEQ ID NO: 2949386 - RNA, 21 nt, Mycobacterium avium subsp. paratuberculosis
gcagcucgugguagaugucgc

SEQ ID NO: 2949387 - RNA, 22 nt, Mycobacterium avium subsp. paratuberculosis
gcagcucguugugaauccagcc

SEQ ID NO: 2949388 - RNA, 20 nt, Mycobacterium avium subsp. paratuberculosis
gcagcugaagugcacucggc

SEQ ID NO: 2949389 - RNA, 21 nt, Mycobacterium avium subsp. paratuberculosis
gcagcugaagugcacucggcg

SEQ ID NO: 2949390 - RNA, 20 nt, Mycobacterium avium subsp. paratuberculosis
gcagcugauagcccgccgcg

SEQ ID NO: 2949391 - RNA, 21 nt, Mycobacterium avium subsp. paratuberculosis
gcagcugauagcccgccgcgg

SEQ ID NO: 2949392 - RNA, 20 nt, Mycobacterium avium subsp. paratuberculosis
gcagcugaucggggcccacc

SEQ ID NO: 2949393 - RNA, 19 nt, Mycobacterium avium subsp. paratuberculosis
gcagcugcagcuccucggc

SEQ ID NO: 2949394 - RNA, 19 nt, Mycobacterium avium subsp. paratuberculosis
gcagcugcccgucggagga

SEQ ID NO: 2949395 - RNA, 16 nt, Mycobacterium avium subsp. paratuberculosis
gcagcugccgaacugg

SEQ ID NO: 2949396 - RNA, 15 nt, Mycobacterium avium subsp. paratuberculosis
gcagcugcgccgcgu

SEQ ID NO: 2949397 - RNA, 20 nt, Mycobacterium avium subsp. paratuberculosis
gcagcugcgccgcgucgacg

SEQ ID NO: 2949398 - RNA, 17 nt, Mycobacterium avium subsp. paratuberculosis
gcagcugcgcgucgaag

SEQ ID NO: 2949399 - RNA, 14 nt, Mycobacterium avium subsp. paratuberculosis
gcagcugcgggacc

SEQ ID NO: 2949400 - RNA, 16 nt, Mycobacterium avium subsp. paratuberculosis
gcagcugcgucaugcc

SEQ ID NO: 2949401 - RNA, 19 nt, Mycobacterium avium subsp. paratuberculosis
gcagcugcgucaugccgua

SEQ ID NO: 2949402 - RNA, 20 nt, Mycobacterium avium subsp. paratuberculosis
gcagcugcgucggcaccagc

SEQ ID NO: 2949403 - RNA, 23 nt, Mycobacterium avium subsp. paratuberculosis
gcagcugcgucggcaccagcggc

SEQ ID NO: 2949404 - RNA, 20 nt, Mycobacterium avium subsp. paratuberculosis
gcagcuggaaauaggccggg

SEQ ID NO: 2949405 - RNA, 21 nt, Mycobacterium avium subsp. paratuberculosis
gcagcuggaaauaggccgggc

SEQ ID NO: 2949406 - RNA, 22 nt, Mycobacterium avium subsp. paratuberculosis
gcagcuggaaauaggccgggca

SEQ ID NO: 2949407 - RNA, 19 nt, Mycobacterium avium subsp. paratuberculosis
gcagcuggaacaccacggc

SEQ ID NO: 2949408 - RNA, 23 nt, Mycobacterium avium subsp. paratuberculosis
gcagcuggaacaccacggccggc

SEQ ID NO: 2949409 - RNA, 12 nt, Mycobacterium avium subsp. paratuberculosis
gcagcuggcgaa

SEQ ID NO: 2949410 - RNA, 23 nt, Mycobacterium avium subsp. paratuberculosis
gcaggcccucggccagccaggcc

SEQ ID NO: 2949411 - RNA, 13 nt, Mycobacterium avium subsp. paratuberculosis
gcaggcccugccc

SEQ ID NO: 2949412 - RNA, 19 nt, Mycobacterium avium subsp. paratuberculosis
gcaggccgaacaccgucau

SEQ ID NO: 2949413 - RNA, 19 nt, Mycobacterium avium subsp. paratuberculosis
gcaggccgaagaacucagc

SEQ ID NO: 2949414 - RNA, 13 nt, Mycobacterium avium subsp. paratuberculosis
gcaggccgagccg

SEQ ID NO: 2949415 - RNA, 17 nt, Mycobacterium avium subsp. paratuberculosis
gcaggccgagccgccgg

SEQ ID NO: 2949416 - RNA, 19 nt, Mycobacterium avium subsp. paratuberculosis
gcaggccgagccgccggau

SEQ ID NO: 2949417 - RNA, 20 nt, Mycobacterium avium subsp. paratuberculosis
gcaggccgagccgccggauc

SEQ ID NO: 2949418 - RNA, 18 nt, Mycobacterium avium subsp. paratuberculosis
gcaggccgaggcugucgg

SEQ ID NO: 2949419 - RNA, 14 nt, Mycobacterium avium subsp. paratuberculosis
gcaggccgcccggc

SEQ ID NO: 2949420 - RNA, 18 nt, Mycobacterium avium subsp. paratuberculosis
gcaggccgcccggcccaa

SEQ ID NO: 2949421 - RNA, 13 nt, Mycobacterium avium subsp. paratuberculosis
gcaggccgccgac

SEQ ID NO: 2949422 - RNA, 17 nt, Mycobacterium avium subsp. paratuberculosis
gcaggccgccgacgacg

SEQ ID NO: 2949423 - RNA, 13 nt, Mycobacterium avium subsp. paratuberculosis
gcaggccgcgacg

SEQ ID NO: 2949424 - RNA, 14 nt, Mycobacterium avium subsp. paratuberculosis
gcaggccgcgacgg

SEQ ID NO: 2949425 - RNA, 13 nt, Mycobacterium avium subsp. paratuberculosis
gcaggccgcgagc

SEQ ID NO: 2949426 - RNA, 14 nt, Mycobacterium avium subsp. paratuberculosis
gcaggccgcggccg

SEQ ID NO: 2949427 - RNA, 17 nt, Mycobacterium avium subsp. paratuberculosis
gcaggccgcggguggcg

SEQ ID NO: 2949428 - RNA, 20 nt, Mycobacterium avium subsp. paratuberculosis
gcaggccgcggguggcgcca

SEQ ID NO: 2949429 - RNA, 23 nt, Mycobacterium avium subsp. paratuberculosis
gcaggccgcggguggcgccacag

SEQ ID NO: 2949430 - RNA, 13 nt, Mycobacterium avium subsp. paratuberculosis
gcaggccggcagc

SEQ ID NO: 2949431 - RNA, 19 nt, Mycobacterium avium subsp. paratuberculosis
gcaggccggcagccggcgc

SEQ ID NO: 2949432 - RNA, 17 nt, Mycobacterium avium subsp. paratuberculosis
gcaggccggucacccag

SEQ ID NO: 2949433 - RNA, 14 nt, Mycobacterium avium subsp. paratuberculosis
gcaggccggugcug

SEQ ID NO: 2949434 - RNA, 14 nt, Mycobacterium avium subsp. paratuberculosis
gcaggccguccagc

SEQ ID NO: 2949435 - RNA, 16 nt, Mycobacterium avium subsp. paratuberculosis
gcaggccguccagcag

SEQ ID NO: 2949436 - RNA, 17 nt, Mycobacterium avium subsp. paratuberculosis
gcaggccguccagcagc

SEQ ID NO: 2949437 - RNA, 18 nt, Mycobacterium avium subsp. paratuberculosis
gcaggccguuguggccac

SEQ ID NO: 2949438 - RNA, 16 nt, Mycobacterium avium subsp. paratuberculosis
gcaggcgaacaccucg

SEQ ID NO: 2949439 - RNA, 16 nt, Mycobacterium avium subsp. paratuberculosis
gcaggcgaaggugggc

SEQ ID NO: 2949440 - RNA, 22 nt, Mycobacterium avium subsp. paratuberculosis
gcaggcgaaggugggcagcgcc

SEQ ID NO: 2949441 - RNA, 23 nt, Mycobacterium avium subsp. paratuberculosis
gcaggcgaaggugggcagcgcca

SEQ ID NO: 2949442 - RNA, 13 nt, Mycobacterium avium subsp. paratuberculosis
gcaggcgacccgc

SEQ ID NO: 2949443 - RNA, 16 nt, Mycobacterium avium subsp. paratuberculosis
gcaggcgacccgcacc

SEQ ID NO: 2949444 - RNA, 22 nt, Mycobacterium avium subsp. paratuberculosis
gcaggcgacccgcaccgaaauc

SEQ ID NO: 2949445 - RNA, 21 nt, Mycobacterium avium subsp. paratuberculosis
gcaggcgagccgacagucgcg

SEQ ID NO: 2949446 - RNA, 22 nt, Mycobacterium avium subsp. paratuberculosis
gcaggcgagccgacagucgcgg

SEQ ID NO: 2949447 - RNA, 17 nt, Mycobacterium avium subsp. paratuberculosis
gcaggcgaucucgccga

SEQ ID NO: 2949448 - RNA, 13 nt, Mycobacterium avium subsp. paratuberculosis
gcaggcgauggcg

SEQ ID NO: 2949449 - RNA, 19 nt, Mycobacterium avium subsp. paratuberculosis
gcaggcgauggcgucggcc

SEQ ID NO: 2949450 - RNA, 22 nt, Mycobacterium avium subsp. paratuberculosis
gcaggcgauggcgucggccagc

SEQ ID NO: 2949451 - RNA, 16 nt, Mycobacterium avium subsp. paratuberculosis
gcaggcgauggugccg

SEQ ID NO: 2949452 - RNA, 19 nt, Mycobacterium avium subsp. paratuberculosis
gcaggcgauggugccggcc

SEQ ID NO: 2949453 - RNA, 20 nt, Mycobacterium avium subsp. paratuberculosis
gcaggcgauggugccggcca

SEQ ID NO: 2949454 - RNA, 23 nt, Mycobacterium avium subsp. paratuberculosis
gcaggcgcaccaccagcucgucg

SEQ ID NO: 2949455 - RNA, 16 nt, Mycobacterium avium subsp. paratuberculosis
gcaggcgcccaggauc

SEQ ID NO: 2949456 - RNA, 13 nt, Mycobacterium avium subsp. paratuberculosis
gcaggcgccgguc

SEQ ID NO: 2949457 - RNA, 13 nt, Mycobacterium avium subsp. paratuberculosis
gcaggcgcgcagc

SEQ ID NO: 2949458 - RNA, 16 nt, Mycobacterium avium subsp. paratuberculosis
gcaggcgcgccgagcg

SEQ ID NO: 2949459 - RNA, 17 nt, Mycobacterium avium subsp. paratuberculosis
gcaggcgcgccgagcgc

SEQ ID NO: 2949460 - RNA, 19 nt, Mycobacterium avium subsp. paratuberculosis
gcaggcgcgccgagcgcug

SEQ ID NO: 2949461 - RNA, 21 nt, Mycobacterium avium subsp. paratuberculosis
gcaggcgcgccgagcgcuggu

SEQ ID NO: 2949462 - RNA, 22 nt, Mycobacterium avium subsp. paratuberculosis
gcaggcgcgccgagcgcugguu

SEQ ID NO: 2949463 - RNA, 14 nt, Mycobacterium avium subsp. paratuberculosis
gcaggcgcgcggcc

SEQ ID NO: 2949464 - RNA, 17 nt, Mycobacterium avium subsp. paratuberculosis
gcaggcgcgcggccagc

SEQ ID NO: 2949465 - RNA, 21 nt, Mycobacterium avium subsp. paratuberculosis
gcaggcgcgcggccagccccg

SEQ ID NO: 2949466 - RNA, 16 nt, Mycobacterium avium subsp. paratuberculosis
gcaggcgcugagcggg

SEQ ID NO: 2949467 - RNA, 17 nt, Mycobacterium avium subsp. paratuberculosis
gcaggcgcugagcgggu

SEQ ID NO: 2949468 - RNA, 14 nt, Mycobacterium avium subsp. paratuberculosis
gcaggcggacggcg

SEQ ID NO: 2949469 - RNA, 15 nt, Mycobacterium avium subsp. paratuberculosis
gcaggcggaucggcc

SEQ ID NO: 2949470 - RNA, 16 nt, Mycobacterium avium subsp. paratuberculosis
gcaggcggaucggccc

SEQ ID NO: 2949471 - RNA, 15 nt, Mycobacterium avium subsp. paratuberculosis
gcaggcggccagcac

SEQ ID NO: 2949472 - RNA, 16 nt, Mycobacterium avium subsp. paratuberculosis
gcaggcggccagcacc

SEQ ID NO: 2949473 - RNA, 19 nt, Mycobacterium avium subsp. paratuberculosis
gcaggcggccagcaccagu

SEQ ID NO: 2949474 - RNA, 16 nt, Mycobacterium avium subsp. paratuberculosis
gcaggcggccagggcg

SEQ ID NO: 2949475 - RNA, 19 nt, Mycobacterium avium subsp. paratuberculosis
gcaggcggccagggcggcg

SEQ ID NO: 2949476 - RNA, 17 nt, Mycobacterium avium subsp. paratuberculosis
gcaggcggcccgcucga

SEQ ID NO: 2949477 - RNA, 16 nt, Mycobacterium avium subsp. paratuberculosis
gcaggcggcgcgcagc

SEQ ID NO: 2949478 - RNA, 17 nt, Mycobacterium avium subsp. paratuberculosis
gcaggcggcgcgcagcc

SEQ ID NO: 2949479 - RNA, 14 nt, Mycobacterium avium subsp. paratuberculosis
gcaggcggcgcgcc

SEQ ID NO: 2949480 - RNA, 16 nt, Mycobacterium avium subsp. paratuberculosis
gcaggcgguagcggca

SEQ ID NO: 2949481 - RNA, 14 nt, Mycobacterium avium subsp. paratuberculosis
gcaggcgguggugg

SEQ ID NO: 2949482 - RNA, 21 nt, Mycobacterium avium subsp. paratuberculosis
gcaggcgguuucaccgaggcg

SEQ ID NO: 2949483 - RNA, 22 nt, Mycobacterium avium subsp. paratuberculosis
gcaggcguccagggccaccgcg

SEQ ID NO: 2949484 - RNA, 22 nt, Mycobacterium avium subsp. paratuberculosis
gcaggcguccuugauccgggcg

SEQ ID NO: 2949485 - RNA, 19 nt, Mycobacterium avium subsp. paratuberculosis
gcaggcguggcccagccgg

SEQ ID NO: 2949486 - RNA, 20 nt, Mycobacterium avium subsp. paratuberculosis
gcaggcguggcccagccggu

SEQ ID NO: 2949487 - RNA, 21 nt, Mycobacterium avium subsp. paratuberculosis
gcaggcguggcccagccggug

SEQ ID NO: 2949488 - RNA, 22 nt, Mycobacterium avium subsp. paratuberculosis
gcaggcguggcccagccggugc

SEQ ID NO: 2949489 - RNA, 15 nt, Mycobacterium avium subsp. paratuberculosis
gcaggcucagcagca

SEQ ID NO: 2949490 - RNA, 18 nt, Mycobacterium avium subsp. paratuberculosis
gcaggcucagcagcaccg

SEQ ID NO: 2949491 - RNA, 17 nt, Mycobacterium avium subsp. paratuberculosis
gcaggcucagguaggcg

SEQ ID NO: 2949492 - RNA, 20 nt, Mycobacterium avium subsp. paratuberculosis
gcaggcucucguugaugcug

SEQ ID NO: 2949493 - RNA, 23 nt, Mycobacterium avium subsp. paratuberculosis
gcaggcucucguugaugcugugc

SEQ ID NO: 2949494 - RNA, 14 nt, Mycobacterium avium subsp. paratuberculosis
gcaggcugacgcga

SEQ ID NO: 2949495 - RNA, 18 nt, Mycobacterium avium subsp. paratuberculosis
gcaggucgucgacgucgc

SEQ ID NO: 2949496 - RNA, 20 nt, Mycobacterium avium subsp. paratuberculosis
gcaggucgucgaucagggcg

SEQ ID NO: 2949497 - RNA, 19 nt, Mycobacterium avium subsp. paratuberculosis
gcaggucgucgucgccgcg

SEQ ID NO: 2949498 - RNA, 20 nt, Mycobacterium avium subsp. paratuberculosis
gcaggucgucgucgccgcgc

SEQ ID NO: 2949499 - RNA, 21 nt, Mycobacterium avium subsp. paratuberculosis
gcaggucgucgucgccgcgcg

SEQ ID NO: 2949500 - RNA, 22 nt, Mycobacterium avium subsp. paratuberculosis
gcaggucgucgucgccgcgcgc

SEQ ID NO: 2949501 - RNA, 18 nt, Mycobacterium avium subsp. paratuberculosis
gcaggugaaggugcccca

SEQ ID NO: 2949502 - RNA, 15 nt, Mycobacterium avium subsp. paratuberculosis
gcaggugagccgggu

SEQ ID NO: 2949503 - RNA, 16 nt, Mycobacterium avium subsp. paratuberculosis
gcaggugagccgggug

SEQ ID NO: 2949504 - RNA, 20 nt, Mycobacterium avium subsp. paratuberculosis
gcaggugagccgggugcccg

SEQ ID NO: 2949505 - RNA, 21 nt, Mycobacterium avium subsp. paratuberculosis
gcaggugaucaaagccggugg

SEQ ID NO: 2949506 - RNA, 19 nt, Mycobacterium avium subsp. paratuberculosis
gcaggugaucuugcccagc

SEQ ID NO: 2949507 - RNA, 20 nt, Mycobacterium avium subsp. paratuberculosis
gcaggugaucuugcccagcc

SEQ ID NO: 2949508 - RNA, 22 nt, Mycobacterium avium subsp. paratuberculosis
gcaggugcaccacccaggccac

SEQ ID NO: 2949509 - RNA, 18 nt, Mycobacterium avium subsp. paratuberculosis
gcaggugcaucgaccggc

SEQ ID NO: 2949510 - RNA, 19 nt, Mycobacterium avium subsp. paratuberculosis
gcaggugcaucgaccggcg

SEQ ID NO: 2949511 - RNA, 19 nt, Mycobacterium avium subsp. paratuberculosis
gcaggugcaucgccaccgu

SEQ ID NO: 2949512 - RNA, 21 nt, Mycobacterium avium subsp. paratuberculosis
gcaggugcaucgccaccgucg

SEQ ID NO: 2949513 - RNA, 16 nt, Mycobacterium avium subsp. paratuberculosis
gcaggugcccgucggc

SEQ ID NO: 2949514 - RNA, 20 nt, Mycobacterium avium subsp. paratuberculosis
gcaggugcccgucggccucg

SEQ ID NO: 2949515 - RNA, 12 nt, Mycobacterium avium subsp. paratuberculosis
gcaggugccggu

SEQ ID NO: 2949516 - RNA, 15 nt, Mycobacterium avium subsp. paratuberculosis
gcaggugcgccgcuc

SEQ ID NO: 2949517 - RNA, 14 nt, Mycobacterium avium subsp. paratuberculosis
gcaggugcgcgguc

SEQ ID NO: 2949518 - RNA, 18 nt, Mycobacterium avium subsp. paratuberculosis
gcaggugcgcggucagcg

SEQ ID NO: 2949519 - RNA, 20 nt, Mycobacterium avium subsp. paratuberculosis
gcaggugcgcggucagcgcg

SEQ ID NO: 2949520 - RNA, 12 nt, Mycobacterium avium subsp. paratuberculosis
gcaggugcucgc

SEQ ID NO: 2949521 - RNA, 17 nt, Mycobacterium avium subsp. paratuberculosis
gcaggugcucgccggcg

SEQ ID NO: 2949522 - RNA, 21 nt, Mycobacterium avium subsp. paratuberculosis
gcaggugcucgccggcgcgga

SEQ ID NO: 2949523 - RNA, 23 nt, Mycobacterium avium subsp. paratuberculosis
gcaggugcucgccggcgcggaac

SEQ ID NO: 2949524 - RNA, 13 nt, Mycobacterium avium subsp. paratuberculosis
gcaggugggcggu

SEQ ID NO: 2949525 - RNA, 17 nt, Mycobacterium avium subsp. paratuberculosis
gcagguggggcagcacc

SEQ ID NO: 2949526 - RNA, 19 nt, Mycobacterium avium subsp. paratuberculosis
gcagguguccagcccuacc

SEQ ID NO: 2949527 - RNA, 22 nt, Mycobacterium avium subsp. paratuberculosis
gcagguucaucaccacgaacuc

SEQ ID NO: 2949528 - RNA, 19 nt, Mycobacterium avium subsp. paratuberculosis
gcagguucauccccgcggc

SEQ ID NO: 2949529 - RNA, 23 nt, Mycobacterium avium subsp. paratuberculosis
gcagguucauccccgcggccacc

SEQ ID NO: 2949530 - RNA, 19 nt, Mycobacterium avium subsp. paratuberculosis
gcagguucaugugaccggg

SEQ ID NO: 2949531 - RNA, 20 nt, Mycobacterium avium subsp. paratuberculosis
gcagguucgacacgccccga

SEQ ID NO: 2949532 - RNA, 16 nt, Mycobacterium avium subsp. paratuberculosis
gcagguucuccuccca

SEQ ID NO: 2949533 - RNA, 15 nt, Mycobacterium avium subsp. paratuberculosis
gcagguucugcacgu

SEQ ID NO: 2949534 - RNA, 15 nt, Mycobacterium avium subsp. paratuberculosis
gcagguugcgcugga

SEQ ID NO: 2949535 - RNA, 17 nt, Mycobacterium avium subsp. paratuberculosis
gcagguugcgcuggaug

SEQ ID NO: 2949536 - RNA, 19 nt, Mycobacterium avium subsp. paratuberculosis
gcagguuggggacggcgag

SEQ ID NO: 2949537 - RNA, 20 nt, Mycobacterium avium subsp. paratuberculosis
gcagguuguccagccggugc

SEQ ID NO: 2949538 - RNA, 21 nt, Mycobacterium avium subsp. paratuberculosis
gcagguuguccagccggugca

SEQ ID NO: 2949539 - RNA, 17 nt, Mycobacterium avium subsp. paratuberculosis
gcagguugucggccaac

SEQ ID NO: 2949540 - RNA, 18 nt, Mycobacterium avium subsp. paratuberculosis
gcaguacgcaucggcgcc

SEQ ID NO: 2949541 - RNA, 19 nt, Mycobacterium avium subsp. paratuberculosis
gcaguacgcaucggcgccg

SEQ ID NO: 2949542 - RNA, 15 nt, Mycobacterium avium subsp. paratuberculosis
gcaguacgcgccggc

SEQ ID NO: 2949543 - RNA, 20 nt, Mycobacterium avium subsp. paratuberculosis
gcaguagacgccgccgugga

SEQ ID NO: 2949544 - RNA, 17 nt, Mycobacterium avium subsp. paratuberculosis
gcaguagcaucggggau

SEQ ID NO: 2949545 - RNA, 21 nt, Mycobacterium avium subsp. paratuberculosis
gcaguagccgaucuccaccga

SEQ ID NO: 2949546 - RNA, 13 nt, Mycobacterium avium subsp. paratuberculosis
gcaguagccggcc

SEQ ID NO: 2949547 - RNA, 13 nt, Mycobacterium avium subsp. paratuberculosis
gcaguagcgacgc

SEQ ID NO: 2949548 - RNA, 20 nt, Mycobacterium avium subsp. paratuberculosis
gcaguagcgacgcgacgcgc

SEQ ID NO: 2949549 - RNA, 15 nt, Mycobacterium avium subsp. paratuberculosis
gcaguagcgcaccgg

SEQ ID NO: 2949550 - RNA, 23 nt, Mycobacterium avium subsp. paratuberculosis
gcaguagcgcaccggucagcgcu

SEQ ID NO: 2949551 - RNA, 21 nt, Mycobacterium avium subsp. paratuberculosis
gcaguagcgcauaggccgcga

SEQ ID NO: 2949552 - RNA, 21 nt, Mycobacterium avium subsp. paratuberculosis
gcaguaucuuguucgccgaca

SEQ ID NO: 2949553 - RNA, 22 nt, Mycobacterium avium subsp. paratuberculosis
gcaguaucuuguucgccgacac

SEQ ID NO: 2949554 - RNA, 21 nt, Mycobacterium avium subsp. paratuberculosis
gcaguccaaaaacugcgcguc

SEQ ID NO: 2949555 - RNA, 18 nt, Mycobacterium avium subsp. paratuberculosis
gcaguccagggugguggu

SEQ ID NO: 2949556 - RNA, 14 nt, Mycobacterium avium subsp. paratuberculosis
gcaguccccgccuu

SEQ ID NO: 2949557 - RNA, 20 nt, Mycobacterium avium subsp. paratuberculosis
gcaguccccgccuucgaugc

SEQ ID NO: 2949558 - RNA, 22 nt, Mycobacterium avium subsp. paratuberculosis
gcagucccucgaucagccacac

SEQ ID NO: 2949559 - RNA, 23 nt, Mycobacterium avium subsp. paratuberculosis
gcagucccucgaucagccacacc

SEQ ID NO: 2949560 - RNA, 13 nt, Mycobacterium avium subsp. paratuberculosis
gcaguccgccgga

SEQ ID NO: 2949561 - RNA, 12 nt, Mycobacterium avium subsp. paratuberculosis
gcaguccgcgcc

SEQ ID NO: 2949562 - RNA, 14 nt, Mycobacterium avium subsp. paratuberculosis
gcaguccgcgccgg

SEQ ID NO: 2949563 - RNA, 15 nt, Mycobacterium avium subsp. paratuberculosis
gcaguccgcgccggu

SEQ ID NO: 2949564 - RNA, 16 nt, Mycobacterium avium subsp. paratuberculosis
gcaguccgcgccgguc

SEQ ID NO: 2949565 - RNA, 17 nt, Mycobacterium avium subsp. paratuberculosis
gcaguccgcgccggucc

SEQ ID NO: 2949566 - RNA, 19 nt, Mycobacterium avium subsp. paratuberculosis
gcaguccgcgccggucccg

SEQ ID NO: 2949567 - RNA, 21 nt, Mycobacterium avium subsp. paratuberculosis
gcaguccgcgccggucccgcg

SEQ ID NO: 2949568 - RNA, 22 nt, Mycobacterium avium subsp. paratuberculosis
gcaguccggacacggccagcgc

SEQ ID NO: 2949569 - RNA, 19 nt, Mycobacterium avium subsp. paratuberculosis
gcaguccggcgaguacccg

SEQ ID NO: 2949570 - RNA, 15 nt, Mycobacterium avium subsp. paratuberculosis
gcaguccggcgguca

SEQ ID NO: 2949571 - RNA, 16 nt, Mycobacterium avium subsp. paratuberculosis
gcaguccggcggucag

SEQ ID NO: 2949572 - RNA, 12 nt, Mycobacterium avium subsp. paratuberculosis
gcagucgaucac

SEQ ID NO: 2949573 - RNA, 17 nt, Mycobacterium avium subsp. paratuberculosis
gcagucgaucagcgacg

SEQ ID NO: 2949574 - RNA, 19 nt, Mycobacterium avium subsp. paratuberculosis
gcagucgaucucgucgcac

SEQ ID NO: 2949575 - RNA, 14 nt, Mycobacterium avium subsp. paratuberculosis
gcagucgcagcagc

SEQ ID NO: 2949576 - RNA, 21 nt, Mycobacterium avium subsp. paratuberculosis
gcagucgcagcagcagcccga

SEQ ID NO: 2949577 - RNA, 14 nt, Mycobacterium avium subsp. paratuberculosis
gcagucgcaggccc

SEQ ID NO: 2949578 - RNA, 22 nt, Mycobacterium avium subsp. paratuberculosis
gcagucgcaggccccggauccg

SEQ ID NO: 2949579 - RNA, 21 nt, Mycobacterium avium subsp. paratuberculosis
gcaucaccuucugcgcgccgu

SEQ ID NO: 2949580 - RNA, 20 nt, Mycobacterium avium subsp. paratuberculosis
gcaucaccuucugcgucggc

SEQ ID NO: 2949581 - RNA, 13 nt, Mycobacterium avium subsp. paratuberculosis
gcaucacgucggc

SEQ ID NO: 2949582 - RNA, 15 nt, Mycobacterium avium subsp. paratuberculosis
gcaucacgucggcga

SEQ ID NO: 2949583 - RNA, 20 nt, Mycobacterium avium subsp. paratuberculosis
gcaucagcaccuccggcagc

SEQ ID NO: 2949584 - RNA, 13 nt, Mycobacterium avium subsp. paratuberculosis
gcaucagcgccac

SEQ ID NO: 2949585 - RNA, 14 nt, Mycobacterium avium subsp. paratuberculosis
gcaucagcgccacc

SEQ ID NO: 2949586 - RNA, 18 nt, Mycobacterium avium subsp. paratuberculosis
gcaucagcgccaccagca

SEQ ID NO: 2949587 - RNA, 20 nt, Mycobacterium avium subsp. paratuberculosis
gcaucagcgccaccagcacc

SEQ ID NO: 2949588 - RNA, 22 nt, Mycobacterium avium subsp. paratuberculosis
gcaucagcggagugaccgccag

SEQ ID NO: 2949589 - RNA, 21 nt, Mycobacterium avium subsp. paratuberculosis
gcaucagcggggcguccagcg

SEQ ID NO: 2949590 - RNA, 14 nt, Mycobacterium avium subsp. paratuberculosis
gcaucagcgugaug

SEQ ID NO: 2949591 - RNA, 17 nt, Mycobacterium avium subsp. paratuberculosis
gcaucagcucggcagcc

SEQ ID NO: 2949592 - RNA, 18 nt, Mycobacterium avium subsp. paratuberculosis
gcaucagcucuucgacga

SEQ ID NO: 2949593 - RNA, 19 nt, Mycobacterium avium subsp. paratuberculosis
gcaucagcucuucgacgau

SEQ ID NO: 2949594 - RNA, 20 nt, Mycobacterium avium subsp. paratuberculosis
gcaucagggccagccgaugc

SEQ ID NO: 2949595 - RNA, 12 nt, Mycobacterium avium subsp. paratuberculosis
gcaucagggcgu

SEQ ID NO: 2949596 - RNA, 15 nt, Mycobacterium avium subsp. paratuberculosis
gcaucagggcguuga

SEQ ID NO: 2949597 - RNA, 16 nt, Mycobacterium avium subsp. paratuberculosis
gcaucaggucggugcc

SEQ ID NO: 2949598 - RNA, 18 nt, Mycobacterium avium subsp. paratuberculosis
gcaucaggucggugccgc

SEQ ID NO: 2949599 - RNA, 22 nt, Mycobacterium avium subsp. paratuberculosis
gcaucaucggcacgccggggcc

SEQ ID NO: 2949600 - RNA, 12 nt, Mycobacterium avium subsp. paratuberculosis
gcaucaugccgc

SEQ ID NO: 2949601 - RNA, 14 nt, Mycobacterium avium subsp. paratuberculosis
gcaucaugccgccc

SEQ ID NO: 2949602 - RNA, 23 nt, Mycobacterium avium subsp. paratuberculosis
gcaucaugucgaagaagcggccg

SEQ ID NO: 2949603 - RNA, 15 nt, Mycobacterium avium subsp. paratuberculosis
gcaucauugagccgc

SEQ ID NO: 2949604 - RNA, 16 nt, Mycobacterium avium subsp. paratuberculosis
gcauccacggccgguu

SEQ ID NO: 2949605 - RNA, 17 nt, Mycobacterium avium subsp. paratuberculosis
gcauccacggccgguuc

SEQ ID NO: 2949606 - RNA, 15 nt, Mycobacterium avium subsp. paratuberculosis
gcauccagcacggcc

SEQ ID NO: 2949607 - RNA, 16 nt, Mycobacterium avium subsp. paratuberculosis
gcauccagccguccag

SEQ ID NO: 2949608 - RNA, 17 nt, Mycobacterium avium subsp. paratuberculosis
gcauccagccguccagc

SEQ ID NO: 2949609 - RNA, 23 nt, Mycobacterium avium subsp. paratuberculosis
gcauccagcgccgccaaccaggu

SEQ ID NO: 2949610 - RNA, 16 nt, Mycobacterium avium subsp. paratuberculosis
gcauccagguggcgcc

SEQ ID NO: 2949611 - RNA, 22 nt, Mycobacterium avium subsp. paratuberculosis
gcauccagguggcgccuccgcc

SEQ ID NO: 2949612 - RNA, 16 nt, Mycobacterium avium subsp. paratuberculosis
gcauccagucggcgcc

SEQ ID NO: 2949613 - RNA, 17 nt, Mycobacterium avium subsp. paratuberculosis
gcauccagucggcgccg

SEQ ID NO: 2949614 - RNA, 18 nt, Mycobacterium avium subsp. paratuberculosis
gcauccagucggcgccga

SEQ ID NO: 2949615 - RNA, 17 nt, Mycobacterium avium subsp. paratuberculosis
gcaucccacccggguug

SEQ ID NO: 2949616 - RNA, 19 nt, Mycobacterium avium subsp. paratuberculosis
gcauccccagcugggccgc

SEQ ID NO: 2949617 - RNA, 21 nt, Mycobacterium avium subsp. paratuberculosis
gcauccccagcugggccgcca

SEQ ID NO: 2949618 - RNA, 20 nt, Mycobacterium avium subsp. paratuberculosis
gcauccccuuggugcggucg

SEQ ID NO: 2949619 - RNA, 21 nt, Mycobacterium avium subsp. paratuberculosis
gcauccccuuggugcggucga

SEQ ID NO: 2949620 - RNA, 13 nt, Mycobacterium avium subsp. paratuberculosis
gcaucccgccgaa

SEQ ID NO: 2949621 - RNA, 18 nt, Mycobacterium avium subsp. paratuberculosis
gcaucccgccgaacccgc

SEQ ID NO: 2949622 - RNA, 14 nt, Mycobacterium avium subsp. paratuberculosis
gcaucccgucgacc

SEQ ID NO: 2949623 - RNA, 20 nt, Mycobacterium avium subsp. paratuberculosis
gcaucccgucgaccaggacg

SEQ ID NO: 2949624 - RNA, 20 nt, Mycobacterium avium subsp. paratuberculosis
gcaucccuuccugggacagc

SEQ ID NO: 2949625 - RNA, 17 nt, Mycobacterium avium subsp. paratuberculosis
gcauccgacaccgccuu

SEQ ID NO: 2949626 - RNA, 16 nt, Mycobacterium avium subsp. paratuberculosis
gcauccgcaacgugcg

SEQ ID NO: 2949627 - RNA, 12 nt, Mycobacterium avium subsp. paratuberculosis
gcauccgcaccg

SEQ ID NO: 2949628 - RNA, 13 nt, Mycobacterium avium subsp. paratuberculosis
gcauccgcaccga

SEQ ID NO: 2949629 - RNA, 16 nt, Mycobacterium avium subsp. paratuberculosis
gcauccgcagcaccag

SEQ ID NO: 2949630 - RNA, 18 nt, Mycobacterium avium subsp. paratuberculosis
gcauccgcagcaccaggg

SEQ ID NO: 2949631 - RNA, 19 nt, Mycobacterium avium subsp. paratuberculosis
gcauccgcagcaccagggu

SEQ ID NO: 2949632 - RNA, 15 nt, Mycobacterium avium subsp. paratuberculosis
gcauccgccgggcgg

SEQ ID NO: 2949633 - RNA, 19 nt, Mycobacterium avium subsp. paratuberculosis
gcauccgccgggcggcguc

SEQ ID NO: 2949634 - RNA, 23 nt, Mycobacterium avium subsp. paratuberculosis
gcauccgcgagccgagccggucc

SEQ ID NO: 2949635 - RNA, 15 nt, Mycobacterium avium subsp. paratuberculosis
gcauccgcucgccgc

SEQ ID NO: 2949636 - RNA, 16 nt, Mycobacterium avium subsp. paratuberculosis
gcauccgcucgccgcg

SEQ ID NO: 2949637 - RNA, 12 nt, Mycobacterium avium subsp. paratuberculosis
gcauccgcuggu

SEQ ID NO: 2949638 - RNA, 16 nt, Mycobacterium avium subsp. paratuberculosis
gcauccggaaccgggc

SEQ ID NO: 2949639 - RNA, 19 nt, Mycobacterium avium subsp. paratuberculosis
gcauccggaaccgggcacc

SEQ ID NO: 2949640 - RNA, 21 nt, Mycobacterium avium subsp. paratuberculosis
gcauccggaaccgggcacccg

SEQ ID NO: 2949641 - RNA, 18 nt, Mycobacterium avium subsp. paratuberculosis
gcauccggccgucgucgg

SEQ ID NO: 2949642 - RNA, 17 nt, Mycobacterium avium subsp. paratuberculosis
gcauccggcgcacggcg

SEQ ID NO: 2949643 - RNA, 20 nt, Mycobacterium avium subsp. paratuberculosis
gcauccggcgcacggcgccc

SEQ ID NO: 2949644 - RNA, 13 nt, Mycobacterium avium subsp. paratuberculosis
gcauccggcucag

SEQ ID NO: 2949645 - RNA, 18 nt, Mycobacterium avium subsp. paratuberculosis
gcauccggcucagaaggc

SEQ ID NO: 2949646 - RNA, 19 nt, Mycobacterium avium subsp. paratuberculosis
gcauccggcucagaaggcg

SEQ ID NO: 2949647 - RNA, 20 nt, Mycobacterium avium subsp. paratuberculosis
gcauccgggaggccagcacc

SEQ ID NO: 2949648 - RNA, 13 nt, Mycobacterium avium subsp. paratuberculosis
gcauccgggccgc

SEQ ID NO: 2949649 - RNA, 16 nt, Mycobacterium avium subsp. paratuberculosis
gcauccgggccgccgc

SEQ ID NO: 2949650 - RNA, 17 nt, Mycobacterium avium subsp. paratuberculosis
gcauccgggccgccgcg

SEQ ID NO: 2949651 - RNA, 18 nt, Mycobacterium avium subsp. paratuberculosis
gcauccggugccgagcgc

SEQ ID NO: 2949652 - RNA, 14 nt, Mycobacterium avium subsp. paratuberculosis
gcauccgucggccu

SEQ ID NO: 2949653 - RNA, 17 nt, Mycobacterium avium subsp. paratuberculosis
gcauccgucggccuugc

SEQ ID NO: 2949654 - RNA, 20 nt, Mycobacterium avium subsp. paratuberculosis
gcauccgucggccuugcgcc

SEQ ID NO: 2949655 - RNA, 18 nt, Mycobacterium avium subsp. paratuberculosis
gcauccucauagccggcc

SEQ ID NO: 2949656 - RNA, 22 nt, Mycobacterium avium subsp. paratuberculosis
gcauccucauagccggccgcgu

SEQ ID NO: 2949657 - RNA, 14 nt, Mycobacterium avium subsp. paratuberculosis
gcauccucggcgcg

SEQ ID NO: 2949658 - RNA, 18 nt, Mycobacterium avium subsp. paratuberculosis
gcauccucggcgcgucgg

SEQ ID NO: 2949659 - RNA, 16 nt, Mycobacterium avium subsp. paratuberculosis
gcauccugcuggccgg

SEQ ID NO: 2949660 - RNA, 18 nt, Mycobacterium avium subsp. paratuberculosis
gcauccugcuggccgggc

SEQ ID NO: 2949661 - RNA, 17 nt, Mycobacterium avium subsp. paratuberculosis
gcaucgaaccgccgcgc

SEQ ID NO: 2949662 - RNA, 16 nt, Mycobacterium avium subsp. paratuberculosis
gcaucgaauccacgaa

SEQ ID NO: 2949663 - RNA, 19 nt, Mycobacterium avium subsp. paratuberculosis
gcaucgacaugcccggcga

SEQ ID NO: 2949664 - RNA, 15 nt, Mycobacterium avium subsp. paratuberculosis
gcaucgucggcgccg

SEQ ID NO: 2949665 - RNA, 17 nt, Mycobacterium avium subsp. paratuberculosis
gcaucgucggcgccggc

SEQ ID NO: 2949666 - RNA, 18 nt, Mycobacterium avium subsp. paratuberculosis
gcaucgucggcgccggcg

SEQ ID NO: 2949667 - RNA, 19 nt, Mycobacterium avium subsp. paratuberculosis
gcaucgucggcgccggcgc

SEQ ID NO: 2949668 - RNA, 16 nt, Mycobacterium avium subsp. paratuberculosis
gcaucguugccggcgg

SEQ ID NO: 2949669 - RNA, 18 nt, Mycobacterium avium subsp. paratuberculosis
gcaucguugccggcggcg

SEQ ID NO: 2949670 - RNA, 19 nt, Mycobacterium avium subsp. paratuberculosis
gcaucguugccggcggcga

SEQ ID NO: 2949671 - RNA, 14 nt, Mycobacterium avium subsp. paratuberculosis
gcaucuccagccgc

SEQ ID NO: 2949672 - RNA, 15 nt, Mycobacterium avium subsp. paratuberculosis
gcaucuccagccgcg

SEQ ID NO: 2949673 - RNA, 17 nt, Mycobacterium avium subsp. paratuberculosis
gcaucuccagccggcga

SEQ ID NO: 2949674 - RNA, 14 nt, Mycobacterium avium subsp. paratuberculosis
gcaucucccgcgcg

SEQ ID NO: 2949675 - RNA, 15 nt, Mycobacterium avium subsp. paratuberculosis
gcaucuccgagucgg

SEQ ID NO: 2949676 - RNA, 15 nt, Mycobacterium avium subsp. paratuberculosis
gcaucucgacccggg

SEQ ID NO: 2949677 - RNA, 17 nt, Mycobacterium avium subsp. paratuberculosis
gcaucucggcgaagguc

SEQ ID NO: 2949678 - RNA, 18 nt, Mycobacterium avium subsp. paratuberculosis
gcaucucguugucgucgg

SEQ ID NO: 2949679 - RNA, 17 nt, Mycobacterium avium subsp. paratuberculosis
gcaucucuugaugcagc

SEQ ID NO: 2949680 - RNA, 20 nt, Mycobacterium avium subsp. paratuberculosis
gcaucucuugaugcagcgcc

SEQ ID NO: 2949681 - RNA, 13 nt, Mycobacterium avium subsp. paratuberculosis
gcaucugcucggc

SEQ ID NO: 2949682 - RNA, 14 nt, Mycobacterium avium subsp. paratuberculosis
gcaucuuggccacg

SEQ ID NO: 2949683 - RNA, 18 nt, Mycobacterium avium subsp. paratuberculosis
gcaugaaccaggccgcgc

SEQ ID NO: 2949684 - RNA, 15 nt, Mycobacterium avium subsp. paratuberculosis
gcaugaagaucagca

SEQ ID NO: 2949685 - RNA, 20 nt, Mycobacterium avium subsp. paratuberculosis
gcaugaagaucagcaccguc

SEQ ID NO: 2949686 - RNA, 21 nt, Mycobacterium avium subsp. paratuberculosis
gcaugaccgauccgccggcga

SEQ ID NO: 2949687 - RNA, 14 nt, Mycobacterium avium subsp. paratuberculosis
gcaugaccggccag

SEQ ID NO: 2949688 - RNA, 15 nt, Mycobacterium avium subsp. paratuberculosis
gcaugaccggccagc

SEQ ID NO: 2949689 - RNA, 20 nt, Mycobacterium avium subsp. paratuberculosis
gcaugacgaacucguuggcg

SEQ ID NO: 2949690 - RNA, 15 nt, Mycobacterium avium subsp. paratuberculosis
gcaugacgcccagcu

SEQ ID NO: 2949691 - RNA, 20 nt, Mycobacterium avium subsp. paratuberculosis
gcaugaucaccgccagcgcg

SEQ ID NO: 2949692 - RNA, 21 nt, Mycobacterium avium subsp. paratuberculosis
gcaugaucaccgccagcgcgc

SEQ ID NO: 2949693 - RNA, 13 nt, Mycobacterium avium subsp. paratuberculosis
gcaugaugaacug

SEQ ID NO: 2949694 - RNA, 17 nt, Mycobacterium avium subsp. paratuberculosis
gcaugaugcggccauga

SEQ ID NO: 2949695 - RNA, 12 nt, Mycobacterium avium subsp. paratuberculosis
gcaugcaccggu

SEQ ID NO: 2949696 - RNA, 13 nt, Mycobacterium avium subsp. paratuberculosis
gcaugcaccggug

SEQ ID NO: 2949697 - RNA, 14 nt, Mycobacterium avium subsp. paratuberculosis
gcaugcaccggugc

SEQ ID NO: 2949698 - RNA, 15 nt, Mycobacterium avium subsp. paratuberculosis
gcaugcaccggugca

SEQ ID NO: 2949699 - RNA, 19 nt, Mycobacterium avium subsp. paratuberculosis
gcaugcccacgccgucgac

SEQ ID NO: 2949700 - RNA, 15 nt, Mycobacterium avium subsp. paratuberculosis
gcaugcccgggcgac

SEQ ID NO: 2949701 - RNA, 19 nt, Mycobacterium avium subsp. paratuberculosis
gcaugcccguagaugccgg

SEQ ID NO: 2949702 - RNA, 12 nt, Mycobacterium avium subsp. paratuberculosis
gcaugcccugga

SEQ ID NO: 2949703 - RNA, 14 nt, Mycobacterium avium subsp. paratuberculosis
gcaugccgagcacc

SEQ ID NO: 2949704 - RNA, 18 nt, Mycobacterium avium subsp. paratuberculosis
gcaugccgcccgggccgu

SEQ ID NO: 2949705 - RNA, 15 nt, Mycobacterium avium subsp. paratuberculosis
gcaugccggaacacc

SEQ ID NO: 2949706 - RNA, 20 nt, Mycobacterium avium subsp. paratuberculosis
gcaugccggaacaccucgaa

SEQ ID NO: 2949707 - RNA, 12 nt, Mycobacterium avium subsp. paratuberculosis
gcaugccggccg

SEQ ID NO: 2949708 - RNA, 15 nt, Mycobacterium avium subsp. paratuberculosis
gcaugccggccggca

SEQ ID NO: 2949709 - RNA, 16 nt, Mycobacterium avium subsp. paratuberculosis
gcaugccggccggcac

SEQ ID NO: 2949710 - RNA, 12 nt, Mycobacterium avium subsp. paratuberculosis
gcaugccgggca

SEQ ID NO: 2949711 - RNA, 14 nt, Mycobacterium avium subsp. paratuberculosis
gcaugccgggcagg

SEQ ID NO: 2949712 - RNA, 19 nt, Mycobacterium avium subsp. paratuberculosis
gcaugccgggccagccggc

SEQ ID NO: 2949713 - RNA, 20 nt, Mycobacterium avium subsp. paratuberculosis
gcaugccggucauccgggcc

SEQ ID NO: 2949714 - RNA, 19 nt, Mycobacterium avium subsp. paratuberculosis
gcaugccggugucggugcg

SEQ ID NO: 2949715 - RNA, 13 nt, Mycobacterium avium subsp. paratuberculosis
gcaugccgucggc

SEQ ID NO: 2949716 - RNA, 14 nt, Mycobacterium avium subsp. paratuberculosis
gcaugccgucggcg

SEQ ID NO: 2949717 - RNA, 15 nt, Mycobacterium avium subsp. paratuberculosis
gcaugccgucggcgc

SEQ ID NO: 2949718 - RNA, 18 nt, Mycobacterium avium subsp. paratuberculosis
gcaugccgucggcgcccg

SEQ ID NO: 2949719 - RNA, 22 nt, Mycobacterium avium subsp. paratuberculosis
gcaugccgucggcgcccggcac

SEQ ID NO: 2949720 - RNA, 23 nt, Mycobacterium avium subsp. paratuberculosis
gcaugccgucggcgcccggcacc

SEQ ID NO: 2949721 - RNA, 18 nt, Mycobacterium avium subsp. paratuberculosis
gcaugccguucagcgcgg

SEQ ID NO: 2949722 - RNA, 20 nt, Mycobacterium avium subsp. paratuberculosis
gcaugccguucagcgcggcc

SEQ ID NO: 2949723 - RNA, 16 nt, Mycobacterium avium subsp. paratuberculosis
gcaugcgccagagcgc

SEQ ID NO: 2949724 - RNA, 18 nt, Mycobacterium avium subsp. paratuberculosis
gcaugcgccagagcgcga

SEQ ID NO: 2949725 - RNA, 13 nt, Mycobacterium avium subsp. paratuberculosis
gcaugcguccggu

SEQ ID NO: 2949726 - RNA, 17 nt, Mycobacterium avium subsp. paratuberculosis
gcauggacacgcccugg

SEQ ID NO: 2949727 - RNA, 18 nt, Mycobacterium avium subsp. paratuberculosis
gcauggacccgaagucga

SEQ ID NO: 2949728 - RNA, 13 nt, Mycobacterium avium subsp. paratuberculosis
gcauggccggcga

SEQ ID NO: 2949729 - RNA, 14 nt, Mycobacterium avium subsp. paratuberculosis
gcauggccggcgaa

SEQ ID NO: 2949730 - RNA, 18 nt, Mycobacterium avium subsp. paratuberculosis
gcauggccggcgaaccgc

SEQ ID NO: 2949731 - RNA, 18 nt, Mycobacterium avium subsp. paratuberculosis
gcauggcgaacacgucgg

SEQ ID NO: 2949732 - RNA, 23 nt, Mycobacterium avium subsp. paratuberculosis
gcauggcgaacacgucggccagc

SEQ ID NO: 2949733 - RNA, 16 nt, Mycobacterium avium subsp. paratuberculosis
gcauggcgaucacccc

SEQ ID NO: 2949734 - RNA, 19 nt, Mycobacterium avium subsp. paratuberculosis
gcauggcgaucaccccggc

SEQ ID NO: 2949735 - RNA, 20 nt, Mycobacterium avium subsp. paratuberculosis
gcauggcgaucaccccggcg

SEQ ID NO: 2949736 - RNA, 23 nt, Mycobacterium avium subsp. paratuberculosis
gcauggcgaugaccagcgcgaac

SEQ ID NO: 2949737 - RNA, 22 nt, Mycobacterium avium subsp. paratuberculosis
gcauggcgaugacgucgucgcg

SEQ ID NO: 2949738 - RNA, 15 nt, Mycobacterium avium subsp. paratuberculosis
gcaugggaucagcag

SEQ ID NO: 2949739 - RNA, 22 nt, Mycobacterium avium subsp. paratuberculosis
gcaugggaucagcagcaccggc

SEQ ID NO: 2949740 - RNA, 21 nt, Mycobacterium avium subsp. paratuberculosis
gcaugggcggcaagccgaguu

SEQ ID NO: 2949741 - RNA, 19 nt, Mycobacterium avium subsp. paratuberculosis
gcaugggcgugccggcccg

SEQ ID NO: 2949742 - RNA, 23 nt, Mycobacterium avium subsp. paratuberculosis
gcauggucaccggagagcaacac

SEQ ID NO: 2949743 - RNA, 17 nt, Mycobacterium avium subsp. paratuberculosis
gcauggucagguaggcg

SEQ ID NO: 2949744 - RNA, 21 nt, Mycobacterium avium subsp. paratuberculosis
gcauggucagguaggcgucga

SEQ ID NO: 2949745 - RNA, 22 nt, Mycobacterium avium subsp. paratuberculosis
gcauguaggacaccccggcgau

SEQ ID NO: 2949746 - RNA, 14 nt, Mycobacterium avium subsp. paratuberculosis
gcauguagguggcg

SEQ ID NO: 2949747 - RNA, 17 nt, Mycobacterium avium subsp. paratuberculosis
gcauguagguggcgacc

SEQ ID NO: 2949748 - RNA, 21 nt, Mycobacterium avium subsp. paratuberculosis
gcauguccggggugagcaggg

SEQ ID NO: 2949749 - RNA, 17 nt, Mycobacterium avium subsp. paratuberculosis
gccaacugcaucgccag

SEQ ID NO: 2949750 - RNA, 22 nt, Mycobacterium avium subsp. paratuberculosis
gccaacugggugggugcggugc

SEQ ID NO: 2949751 - RNA, 21 nt, Mycobacterium avium subsp. paratuberculosis
gccaagacguccgcgucggcg

SEQ ID NO: 2949752 - RNA, 15 nt, Mycobacterium avium subsp. paratuberculosis
gccaagauugggcca

SEQ ID NO: 2949753 - RNA, 19 nt, Mycobacterium avium subsp. paratuberculosis
gccaagauugggccacaga

SEQ ID NO: 2949754 - RNA, 20 nt, Mycobacterium avium subsp. paratuberculosis
gccaagccauuucagcagcg

SEQ ID NO: 2949755 - RNA, 22 nt, Mycobacterium avium subsp. paratuberculosis
gccaagcgguuccagaccggcg

SEQ ID NO: 2949756 - RNA, 23 nt, Mycobacterium avium subsp. paratuberculosis
gccaagcgguuccagaccggcgg

SEQ ID NO: 2949757 - RNA, 18 nt, Mycobacterium avium subsp. paratuberculosis
gccaagcguauccggcca

SEQ ID NO: 2949758 - RNA, 20 nt, Mycobacterium avium subsp. paratuberculosis
gccaagcguauccggccagc

SEQ ID NO: 2949759 - RNA, 20 nt, Mycobacterium avium subsp. paratuberculosis
gccaaggcaagucgucggug

SEQ ID NO: 2949760 - RNA, 12 nt, Mycobacterium avium subsp. paratuberculosis
gccaaggccagc

SEQ ID NO: 2949761 - RNA, 16 nt, Mycobacterium avium subsp. paratuberculosis
gccaaggccagcaacc

SEQ ID NO: 2949762 - RNA, 23 nt, Mycobacterium avium subsp. paratuberculosis
gccaaggggaacaacgcgcacaa

SEQ ID NO: 2949763 - RNA, 23 nt, Mycobacterium avium subsp. paratuberculosis
gccaaggucgccggugugcagcc

SEQ ID NO: 2949764 - RNA, 15 nt, Mycobacterium avium subsp. paratuberculosis
gccaauaaagcgggc

SEQ ID NO: 2949765 - RNA, 16 nt, Mycobacterium avium subsp. paratuberculosis
gccaauaaagcgggcc

SEQ ID NO: 2949766 - RNA, 23 nt, Mycobacterium avium subsp. paratuberculosis
gccaauaagaucgugcuugagca

SEQ ID NO: 2949767 - RNA, 13 nt, Mycobacterium avium subsp. paratuberculosis
gccaaucaccgcg

SEQ ID NO: 2949768 - RNA, 14 nt, Mycobacterium avium subsp. paratuberculosis
gccaauccggcggg

SEQ ID NO: 2949769 - RNA, 15 nt, Mycobacterium avium subsp. paratuberculosis
gccaauccggcgggc

SEQ ID NO: 2949770 - RNA, 18 nt, Mycobacterium avium subsp. paratuberculosis
gccaaugggguauggugu

SEQ ID NO: 2949771 - RNA, 22 nt, Mycobacterium avium subsp. paratuberculosis
gccaaugguuuucgucgaucag

SEQ ID NO: 2949772 - RNA, 14 nt, Mycobacterium avium subsp. paratuberculosis
gccaauuacgcugc

SEQ ID NO: 2949773 - RNA, 17 nt, Mycobacterium avium subsp. paratuberculosis
gccaauuacgcugcggc

SEQ ID NO: 2949774 - RNA, 19 nt, Mycobacterium avium subsp. paratuberculosis
gccaauuacgcugcggcgc

SEQ ID NO: 2949775 - RNA, 19 nt, Mycobacterium avium subsp. paratuberculosis
gccaauuccucagcccggc

SEQ ID NO: 2949776 - RNA, 20 nt, Mycobacterium avium subsp. paratuberculosis
gccaauuccucagcccggca

SEQ ID NO: 2949777 - RNA, 16 nt, Mycobacterium avium subsp. paratuberculosis
gccacaaacagcgcgg

SEQ ID NO: 2949778 - RNA, 18 nt, Mycobacterium avium subsp. paratuberculosis
gccacaaacagcgcggcc

SEQ ID NO: 2949779 - RNA, 19 nt, Mycobacterium avium subsp. paratuberculosis
gccacaaacagcgcggccg

SEQ ID NO: 2949780 - RNA, 15 nt, Mycobacterium avium subsp. paratuberculosis
gccacaacauguccc

SEQ ID NO: 2949781 - RNA, 13 nt, Mycobacterium avium subsp. paratuberculosis
gccacaacuggcc

SEQ ID NO: 2949782 - RNA, 18 nt, Mycobacterium avium subsp. paratuberculosis
gccacaacuggucgugcu

SEQ ID NO: 2949783 - RNA, 23 nt, Mycobacterium avium subsp. paratuberculosis
gccacaacuggucgugcucgucg

SEQ ID NO: 2949784 - RNA, 13 nt, Mycobacterium avium subsp. paratuberculosis
gccacacccgucg

SEQ ID NO: 2949785 - RNA, 21 nt, Mycobacterium avium subsp. paratuberculosis
gccacacccgucgacucggcg

SEQ ID NO: 2949786 - RNA, 14 nt, Mycobacterium avium subsp. paratuberculosis
gccacaccgaucag

SEQ ID NO: 2949787 - RNA, 20 nt, Mycobacterium avium subsp. paratuberculosis
gccacaccgaucagcaugcc

SEQ ID NO: 2949788 - RNA, 12 nt, Mycobacterium avium subsp. paratuberculosis
gccacaccgccg

SEQ ID NO: 2949789 - RNA, 16 nt, Mycobacterium avium subsp. paratuberculosis
gccacaccgccgcggc

SEQ ID NO: 2949790 - RNA, 17 nt, Mycobacterium avium subsp. paratuberculosis
gccacaccgccgcggcg

SEQ ID NO: 2949791 - RNA, 21 nt, Mycobacterium avium subsp. paratuberculosis
gccacaccgccgcggcggugg

SEQ ID NO: 2949792 - RNA, 23 nt, Mycobacterium avium subsp. paratuberculosis
gccacaccgccgcggcgguggcc

SEQ ID NO: 2949793 - RNA, 13 nt, Mycobacterium avium subsp. paratuberculosis
gccacaccgccgg

SEQ ID NO: 2949794 - RNA, 16 nt, Mycobacterium avium subsp. paratuberculosis
gccacaccgccggcgc

SEQ ID NO: 2949795 - RNA, 18 nt, Mycobacterium avium subsp. paratuberculosis
gccacaccgccggcgcgg

SEQ ID NO: 2949796 - RNA, 16 nt, Mycobacterium avium subsp. paratuberculosis
gccacaccggggccag

SEQ ID NO: 2949797 - RNA, 13 nt, Mycobacterium avium subsp. paratuberculosis
gccacacuggcca

SEQ ID NO: 2949798 - RNA, 12 nt, Mycobacterium avium subsp. paratuberculosis
gccacacuggcg

SEQ ID NO: 2949799 - RNA, 20 nt, Mycobacterium avium subsp. paratuberculosis
gccacacuggcgugacgcuc

SEQ ID NO: 2949800 - RNA, 23 nt, Mycobacterium avium subsp. paratuberculosis
gccacacuggcgugacgcucggc

SEQ ID NO: 2949801 - RNA, 24 nt, Mycobacterium avium subsp. paratuberculosis
gccacacuggcgugacgcucggcc

SEQ ID NO: 2949802 - RNA, 15 nt, Mycobacterium avium subsp. paratuberculosis
gccacagcagcacca

SEQ ID NO: 2949803 - RNA, 16 nt, Mycobacterium avium subsp. paratuberculosis
gccacagcagcaccag

SEQ ID NO: 2949804 - RNA, 18 nt, Mycobacterium avium subsp. paratuberculosis
gccacagcagcaccagcg

SEQ ID NO: 2949805 - RNA, 20 nt, Mycobacterium avium subsp. paratuberculosis
gccacagcagcaccagcgcg

SEQ ID NO: 2949806 - RNA, 22 nt, Mycobacterium avium subsp. paratuberculosis
gccacagcaugaagaucagcac

SEQ ID NO: 2949807 - RNA, 15 nt, Mycobacterium avium subsp. paratuberculosis
gccacagccgcaugu

SEQ ID NO: 2949808 - RNA, 22 nt, Mycobacterium avium subsp. paratuberculosis
gccacagccggggaucgcgcag

SEQ ID NO: 2949809 - RNA, 12 nt, Mycobacterium avium subsp. paratuberculosis
gccacagccggu

SEQ ID NO: 2949810 - RNA, 18 nt, Mycobacterium avium subsp. paratuberculosis
gccacagcgacagggugc

SEQ ID NO: 2949811 - RNA, 12 nt, Mycobacterium avium subsp. paratuberculosis
gccacagcgccu

SEQ ID NO: 2949812 - RNA, 18 nt, Mycobacterium avium subsp. paratuberculosis
gccacagcgccucgcggu

SEQ ID NO: 2949813 - RNA, 21 nt, Mycobacterium avium subsp. paratuberculosis
gccacagcggcgacagcggcc

SEQ ID NO: 2949814 - RNA, 14 nt, Mycobacterium avium subsp. paratuberculosis
gccacagcucgggc

SEQ ID NO: 2949815 - RNA, 18 nt, Mycobacterium avium subsp. paratuberculosis
gccacaugggccacggcg

SEQ ID NO: 2949816 - RNA, 19 nt, Mycobacterium avium subsp. paratuberculosis
gccacaugggccacggcgc

SEQ ID NO: 2949817 - RNA, 13 nt, Mycobacterium avium subsp. paratuberculosis
gccacauguucuc

SEQ ID NO: 2949818 - RNA, 14 nt, Mycobacterium avium subsp. paratuberculosis
gccacauguucucc

SEQ ID NO: 2949819 - RNA, 15 nt, Mycobacterium avium subsp. paratuberculosis
gccacauguucuccu

SEQ ID NO: 2949820 - RNA, 22 nt, Mycobacterium avium subsp. paratuberculosis
gccacauguucuccucgucgcg

SEQ ID NO: 2949821 - RNA, 19 nt, Mycobacterium avium subsp. paratuberculosis
gccaccaacaggucggcgu

SEQ ID NO: 2949822 - RNA, 19 nt, Mycobacterium avium subsp. paratuberculosis
gccaccaacggcagcagca

SEQ ID NO: 2949823 - RNA, 14 nt, Mycobacterium avium subsp. paratuberculosis
gccaccacaguggc

SEQ ID NO: 2949824 - RNA, 16 nt, Mycobacterium avium subsp. paratuberculosis
gccaccacaguggccg

SEQ ID NO: 2949825 - RNA, 19 nt, Mycobacterium avium subsp. paratuberculosis
gccaccacaguggccgcca

SEQ ID NO: 2949826 - RNA, 21 nt, Mycobacterium avium subsp. paratuberculosis
gccaccacaucgcuggggugc

SEQ ID NO: 2949827 - RNA, 17 nt, Mycobacterium avium subsp. paratuberculosis
gccaccacauuggcgac

SEQ ID NO: 2949828 - RNA, 20 nt, Mycobacterium avium subsp. paratuberculosis
gccaccacauuggcgaccgc

SEQ ID NO: 2949829 - RNA, 21 nt, Mycobacterium avium subsp. paratuberculosis
gccaccacauuggcgaccgcg

SEQ ID NO: 2949830 - RNA, 22 nt, Mycobacterium avium subsp. paratuberculosis
gccaccacauuggcgaccgcgg

SEQ ID NO: 2949831 - RNA, 12 nt, Mycobacterium avium subsp. paratuberculosis
gccaccaccacg

SEQ ID NO: 2949832 - RNA, 16 nt, Mycobacterium avium subsp. paratuberculosis
gccaccaccacggagc

SEQ ID NO: 2949833 - RNA, 17 nt, Mycobacterium avium subsp. paratuberculosis
gccaccaugucggcguc

SEQ ID NO: 2949834 - RNA, 19 nt, Mycobacterium avium subsp. paratuberculosis
gccaccaugucggcgucgc

SEQ ID NO: 2949835 - RNA, 22 nt, Mycobacterium avium subsp. paratuberculosis
gccaccaugucggcgucgccga

SEQ ID NO: 2949836 - RNA, 14 nt, Mycobacterium avium subsp. paratuberculosis
gccaccccaggcga

SEQ ID NO: 2949837 - RNA, 23 nt, Mycobacterium avium subsp. paratuberculosis
gccaccccaggcgaugccgccga

SEQ ID NO: 2949838 - RNA, 21 nt, Mycobacterium avium subsp. paratuberculosis
gccaccccccaguuucccguc

SEQ ID NO: 2949839 - RNA, 22 nt, Mycobacterium avium subsp. paratuberculosis
gccaccccgaacccggccagcg

SEQ ID NO: 2949840 - RNA, 16 nt, Mycobacterium avium subsp. paratuberculosis
gccaccccgagcucgg

SEQ ID NO: 2949841 - RNA, 12 nt, Mycobacterium avium subsp. paratuberculosis
gccaccccgcgc

SEQ ID NO: 2949842 - RNA, 14 nt, Mycobacterium avium subsp. paratuberculosis
gccaccccgcgcca

SEQ ID NO: 2949843 - RNA, 15 nt, Mycobacterium avium subsp. paratuberculosis
gccaccccgcgccac

SEQ ID NO: 2949844 - RNA, 17 nt, Mycobacterium avium subsp. paratuberculosis
gccaccccggugaccuc

SEQ ID NO: 2949845 - RNA, 20 nt, Mycobacterium avium subsp. paratuberculosis
gccacccgaggccguucagg

SEQ ID NO: 2949846 - RNA, 21 nt, Mycobacterium avium subsp. paratuberculosis
gccacccgcaccucgcuggcg

SEQ ID NO: 2949847 - RNA, 16 nt, Mycobacterium avium subsp. paratuberculosis
gccacccgcaugcuga

SEQ ID NO: 2949848 - RNA, 12 nt, Mycobacterium avium subsp. paratuberculosis
gccacccgcgau

SEQ ID NO: 2949849 - RNA, 14 nt, Mycobacterium avium subsp. paratuberculosis
gccacccgcgaucg

SEQ ID NO: 2949850 - RNA, 13 nt, Mycobacterium avium subsp. paratuberculosis
gccacccgcgccu

SEQ ID NO: 2949851 - RNA, 19 nt, Mycobacterium avium subsp. paratuberculosis
gccacccgcugcucgaccu

SEQ ID NO: 2949852 - RNA, 12 nt, Mycobacterium avium subsp. paratuberculosis
gccacccgggcg

SEQ ID NO: 2949853 - RNA, 15 nt, Mycobacterium avium subsp. paratuberculosis
gccacccgggcgccg

SEQ ID NO: 2949854 - RNA, 16 nt, Mycobacterium avium subsp. paratuberculosis
gccacccgggcgccgg

SEQ ID NO: 2949855 - RNA, 18 nt, Mycobacterium avium subsp. paratuberculosis
gccacccgggcgccggcg

SEQ ID NO: 2949856 - RNA, 19 nt, Mycobacterium avium subsp. paratuberculosis
gccacccgggcgccggcga

SEQ ID NO: 2949857 - RNA, 20 nt, Mycobacterium avium subsp. paratuberculosis
gccacccgggcgccggcgau

SEQ ID NO: 2949858 - RNA, 13 nt, Mycobacterium avium subsp. paratuberculosis
gccacccgucggu

SEQ ID NO: 2949859 - RNA, 14 nt, Mycobacterium avium subsp. paratuberculosis
gccacccucgccgc

SEQ ID NO: 2949860 - RNA, 17 nt, Mycobacterium avium subsp. paratuberculosis
gccacccucgccgccgc

SEQ ID NO: 2949861 - RNA, 18 nt, Mycobacterium avium subsp. paratuberculosis
gccacccucgccgccgcc

SEQ ID NO: 2949862 - RNA, 18 nt, Mycobacterium avium subsp. paratuberculosis
gccacccugcgcaccgcg

SEQ ID NO: 2949863 - RNA, 19 nt, Mycobacterium avium subsp. paratuberculosis
gccacccugcgcaccgcgg

SEQ ID NO: 2949864 - RNA, 16 nt, Mycobacterium avium subsp. paratuberculosis
gccaccgacaccaccg

SEQ ID NO: 2949865 - RNA, 17 nt, Mycobacterium avium subsp. paratuberculosis
gccaccgacaccaccgg

SEQ ID NO: 2949866 - RNA, 22 nt, Mycobacterium avium subsp. paratuberculosis
gccaccgaggugacgucgcgcc

SEQ ID NO: 2949867 - RNA, 23 nt, Mycobacterium avium subsp. paratuberculosis
gccaccgaggugacgucgcgccg

SEQ ID NO: 2949868 - RNA, 14 nt, Mycobacterium avium subsp. paratuberculosis
gccaccgagucgcg

SEQ ID NO: 2949869 - RNA, 16 nt, Mycobacterium avium subsp. paratuberculosis
gccaccgagucgcgcg

SEQ ID NO: 2949870 - RNA, 17 nt, Mycobacterium avium subsp. paratuberculosis
gccaccgagucgcgcga

SEQ ID NO: 2949871 - RNA, 13 nt, Mycobacterium avium subsp. paratuberculosis
gccaccgaugcgg

SEQ ID NO: 2949872 - RNA, 17 nt, Mycobacterium avium subsp. paratuberculosis
gccaccgaugcgggcca

SEQ ID NO: 2949873 - RNA, 18 nt, Mycobacterium avium subsp. paratuberculosis
gccaccgaugcgggccag

SEQ ID NO: 2949874 - RNA, 21 nt, Mycobacterium avium subsp. paratuberculosis
gccaccgcaucgccgagggcg

SEQ ID NO: 2949875 - RNA, 12 nt, Mycobacterium avium subsp. paratuberculosis
gccaccgcccca

SEQ ID NO: 2949876 - RNA, 20 nt, Mycobacterium avium subsp. paratuberculosis
gccaccgcccgaaccgcguc

SEQ ID NO: 2949877 - RNA, 22 nt, Mycobacterium avium subsp. paratuberculosis
gccaccgcccgaaccgcgucca

SEQ ID NO: 2949878 - RNA, 19 nt, Mycobacterium avium subsp. paratuberculosis
gccaccgccgauggcgacg

SEQ ID NO: 2949879 - RNA, 22 nt, Mycobacterium avium subsp. paratuberculosis
gccaccgccgauggcgacgguc

SEQ ID NO: 2949880 - RNA, 12 nt, Mycobacterium avium subsp. paratuberculosis
gccaccgccgcc

SEQ ID NO: 2949881 - RNA, 13 nt, Mycobacterium avium subsp. paratuberculosis
gccaccgccgcca

SEQ ID NO: 2949882 - RNA, 16 nt, Mycobacterium avium subsp. paratuberculosis
gccaccgccgccagca

SEQ ID NO: 2949883 - RNA, 18 nt, Mycobacterium avium subsp. paratuberculosis
gccaccgccgccagcagc

SEQ ID NO: 2949884 - RNA, 19 nt, Mycobacterium avium subsp. paratuberculosis
gccaccgccgccagcagca

SEQ ID NO: 2949885 - RNA, 13 nt, Mycobacterium avium subsp. paratuberculosis
gccaccgccugcg

SEQ ID NO: 2949886 - RNA, 17 nt, Mycobacterium avium subsp. paratuberculosis
gccaccgccugcgcgau

SEQ ID NO: 2949887 - RNA, 18 nt, Mycobacterium avium subsp. paratuberculosis
gccaccgcgaaagcgucg

SEQ ID NO: 2949888 - RNA, 20 nt, Mycobacterium avium subsp. paratuberculosis
gccaccgcgaaagcgucggc

SEQ ID NO: 2949889 - RNA, 21 nt, Mycobacterium avium subsp. paratuberculosis
gccaccgcgaaagcgucggcu

SEQ ID NO: 2949890 - RNA, 15 nt, Mycobacterium avium subsp. paratuberculosis
gccaccgcgaacguc

SEQ ID NO: 2949891 - RNA, 13 nt, Mycobacterium avium subsp. paratuberculosis
gccaccgcgacgc

SEQ ID NO: 2949892 - RNA, 15 nt, Mycobacterium avium subsp. paratuberculosis
gccaccgcgacgccc

SEQ ID NO: 2949893 - RNA, 17 nt, Mycobacterium avium subsp. paratuberculosis
gccaccgcgacgcugcc

SEQ ID NO: 2949894 - RNA, 18 nt, Mycobacterium avium subsp. paratuberculosis
gccaccgcgacgcugccg

SEQ ID NO: 2949895 - RNA, 22 nt, Mycobacterium avium subsp. paratuberculosis
gccaccgcgcaaccgggccgca

SEQ ID NO: 2949896 - RNA, 16 nt, Mycobacterium avium subsp. paratuberculosis
gccaccgcgccccggc

SEQ ID NO: 2949897 - RNA, 21 nt, Mycobacterium avium subsp. paratuberculosis
gccaccgcgccccggcgcagc

SEQ ID NO: 2949898 - RNA, 16 nt, Mycobacterium avium subsp. paratuberculosis
gccaccgcgccguggg

SEQ ID NO: 2949899 - RNA, 18 nt, Mycobacterium avium subsp. paratuberculosis
gccaccgcgccgugggcg

SEQ ID NO: 2949900 - RNA, 13 nt, Mycobacterium avium subsp. paratuberculosis
gccaccgcgccuu

SEQ ID NO: 2949901 - RNA, 13 nt, Mycobacterium avium subsp. paratuberculosis
gccaccgcgcggu

SEQ ID NO: 2949902 - RNA, 15 nt, Mycobacterium avium subsp. paratuberculosis
gccaccgcgcggugc

SEQ ID NO: 2949903 - RNA, 13 nt, Mycobacterium avium subsp. paratuberculosis
gccaccgcggcca

SEQ ID NO: 2949904 - RNA, 15 nt, Mycobacterium avium subsp. paratuberculosis
gccaccgcggccagc

SEQ ID NO: 2949905 - RNA, 19 nt, Mycobacterium avium subsp. paratuberculosis
gccaccgcggccagcugcg

SEQ ID NO: 2949906 - RNA, 12 nt, Mycobacterium avium subsp. paratuberculosis
gccaccgcggcg

SEQ ID NO: 2949907 - RNA, 14 nt, Mycobacterium avium subsp. paratuberculosis
gccaccgcggcguu

SEQ ID NO: 2949908 - RNA, 17 nt, Mycobacterium avium subsp. paratuberculosis
gccaccgcggggcuggg

SEQ ID NO: 2949909 - RNA, 22 nt, Mycobacterium avium subsp. paratuberculosis
gccaccgcggggcugggcgcca

SEQ ID NO: 2949910 - RNA, 15 nt, Mycobacterium avium subsp. paratuberculosis
gccaccgcggucgac

SEQ ID NO: 2949911 - RNA, 14 nt, Mycobacterium avium subsp. paratuberculosis
gccaccgcguccgc

SEQ ID NO: 2949912 - RNA, 13 nt, Mycobacterium avium subsp. paratuberculosis
gccaccgcgucgc

SEQ ID NO: 2949913 - RNA, 17 nt, Mycobacterium avium subsp. paratuberculosis
gccaccgcgucgcugcc

SEQ ID NO: 2949914 - RNA, 18 nt, Mycobacterium avium subsp. paratuberculosis
gccaccgcgucgcugccc

SEQ ID NO: 2949915 - RNA, 19 nt, Mycobacterium avium subsp. paratuberculosis
gccaccgcgucgcugccca

SEQ ID NO: 2949916 - RNA, 14 nt, Mycobacterium avium subsp. paratuberculosis
gccaccgcugggcg

SEQ ID NO: 2949917 - RNA, 21 nt, Mycobacterium avium subsp. paratuberculosis
gccaccgcugggcggcgcggc

SEQ ID NO: 2949918 - RNA, 14 nt, Mycobacterium avium subsp. paratuberculosis
gccacgauccgcgc

SEQ ID NO: 2949919 - RNA, 15 nt, Mycobacterium avium subsp. paratuberculosis
gccacgauccgcgcg

SEQ ID NO: 2949920 - RNA, 16 nt, Mycobacterium avium subsp. paratuberculosis
gccacgauccgcgcgg

SEQ ID NO: 2949921 - RNA, 17 nt, Mycobacterium avium subsp. paratuberculosis
gccacgauccgcgcggc

SEQ ID NO: 2949922 - RNA, 18 nt, Mycobacterium avium subsp. paratuberculosis
gccacgauccgcgcggcc

SEQ ID NO: 2949923 - RNA, 21 nt, Mycobacterium avium subsp. paratuberculosis
gccacgauccgcgcggccacc

SEQ ID NO: 2949924 - RNA, 19 nt, Mycobacterium avium subsp. paratuberculosis
gccacgauccggggcagca

SEQ ID NO: 2949925 - RNA, 21 nt, Mycobacterium avium subsp. paratuberculosis
gccacgauccggggcagcagc

SEQ ID NO: 2949926 - RNA, 21 nt, Mycobacterium avium subsp. paratuberculosis
gccacgaucgcggccagcgug

SEQ ID NO: 2949927 - RNA, 18 nt, Mycobacterium avium subsp. paratuberculosis
gccacgauggggacgucg

SEQ ID NO: 2949928 - RNA, 19 nt, Mycobacterium avium subsp. paratuberculosis
gccacgauggggacgucga

SEQ ID NO: 2949929 - RNA, 15 nt, Mycobacterium avium subsp. paratuberculosis
gccacgcacaccgcg

SEQ ID NO: 2949930 - RNA, 19 nt, Mycobacterium avium subsp. paratuberculosis
gccacgcacaccgcgcgca

SEQ ID NO: 2949931 - RNA, 23 nt, Mycobacterium avium subsp. paratuberculosis
gccacgcaggcguccagggccac

SEQ ID NO: 2949932 - RNA, 16 nt, Mycobacterium avium subsp. paratuberculosis
gccacgcagucgucga

SEQ ID NO: 2949933 - RNA, 20 nt, Mycobacterium avium subsp. paratuberculosis
gccacgccaacugguccugc

SEQ ID NO: 2949934 - RNA, 14 nt, Mycobacterium avium subsp. paratuberculosis
gccacgccagccag

SEQ ID NO: 2949935 - RNA, 14 nt, Mycobacterium avium subsp. paratuberculosis
gccacgcccaccgg

SEQ ID NO: 2949936 - RNA, 15 nt, Mycobacterium avium subsp. paratuberculosis
gccacgcccaccggu

SEQ ID NO: 2949937 - RNA, 19 nt, Mycobacterium avium subsp. paratuberculosis
gccacgcccaccgguggcc

SEQ ID NO: 2949938 - RNA, 20 nt, Mycobacterium avium subsp. paratuberculosis
gccacgcccaccgguggccg

SEQ ID NO: 2949939 - RNA, 18 nt, Mycobacterium avium subsp. paratuberculosis
gccacgcccagggcgcca

SEQ ID NO: 2949940 - RNA, 20 nt, Mycobacterium avium subsp. paratuberculosis
gccacgccccauugccgcgc

SEQ ID NO: 2949941 - RNA, 21 nt, Mycobacterium avium subsp. paratuberculosis
gccacgccccauugccgcgcc

SEQ ID NO: 2949942 - RNA, 22 nt, Mycobacterium avium subsp. paratuberculosis
gccacgccccauugccgcgccg

SEQ ID NO: 2949943 - RNA, 13 nt, Mycobacterium avium subsp. paratuberculosis
gccacgccccggc

SEQ ID NO: 2949944 - RNA, 15 nt, Mycobacterium avium subsp. paratuberculosis
gccacgccccggcgc

SEQ ID NO: 2949945 - RNA, 17 nt, Mycobacterium avium subsp. paratuberculosis
gccacgccccggcgccg

SEQ ID NO: 2949946 - RNA, 17 nt, Mycobacterium avium subsp. paratuberculosis
gccacgcccgcagcgca

SEQ ID NO: 2949947 - RNA, 21 nt, Mycobacterium avium subsp. paratuberculosis
gccacgcccgcagcgcaucgg

SEQ ID NO: 2949948 - RNA, 16 nt, Mycobacterium avium subsp. paratuberculosis
gccacgcccuggccgc

SEQ ID NO: 2949949 - RNA, 19 nt, Mycobacterium avium subsp. paratuberculosis
gccacgcccuggccgccgg

SEQ ID NO: 2949950 - RNA, 22 nt, Mycobacterium avium subsp. paratuberculosis
gccacgcccuggccgccggccg

SEQ ID NO: 2949951 - RNA, 12 nt, Mycobacterium avium subsp. paratuberculosis
gccacgccgaca

SEQ ID NO: 2949952 - RNA, 15 nt, Mycobacterium avium subsp. paratuberculosis
gccacgccgacaccg

SEQ ID NO: 2949953 - RNA, 21 nt, Mycobacterium avium subsp. paratuberculosis
gccacgccgacaccgucgccg

SEQ ID NO: 2949954 - RNA, 13 nt, Mycobacterium avium subsp. paratuberculosis
gccacgccgacca

SEQ ID NO: 2949955 - RNA, 17 nt, Mycobacterium avium subsp. paratuberculosis
gccacgccgacuagcgc

SEQ ID NO: 2949956 - RNA, 19 nt, Mycobacterium avium subsp. paratuberculosis
gccacgccgacuagcgcgg

SEQ ID NO: 2949957 - RNA, 16 nt, Mycobacterium avium subsp. paratuberculosis
gccacgccgauggccu

SEQ ID NO: 2949958 - RNA, 13 nt, Mycobacterium avium subsp. paratuberculosis
gccacgccgcccc

SEQ ID NO: 2949959 - RNA, 16 nt, Mycobacterium avium subsp. paratuberculosis
gccacgccgcccccgc

SEQ ID NO: 2949960 - RNA, 16 nt, Mycobacterium avium subsp. paratuberculosis
gccacgccgcgauccg

SEQ ID NO: 2949961 - RNA, 17 nt, Mycobacterium avium subsp. paratuberculosis
gccacgccggcacaccg

SEQ ID NO: 2949962 - RNA, 20 nt, Mycobacterium avium subsp. paratuberculosis
gccacgccggcacaccgagc

SEQ ID NO: 2949963 - RNA, 17 nt, Mycobacterium avium subsp. paratuberculosis
gccacgccgggcauccg

SEQ ID NO: 2949964 - RNA, 23 nt, Mycobacterium avium subsp. paratuberculosis
gccacgccgggcauccgcccgua

SEQ ID NO: 2949965 - RNA, 21 nt, Mycobacterium avium subsp. paratuberculosis
gccacgccggguuuguccggc

SEQ ID NO: 2949966 - RNA, 22 nt, Mycobacterium avium subsp. paratuberculosis
gccacgccggguuuguccggcc

SEQ ID NO: 2949967 - RNA, 19 nt, Mycobacterium avium subsp. paratuberculosis
gccacgccguggcccgccc

SEQ ID NO: 2949968 - RNA, 13 nt, Mycobacterium avium subsp. paratuberculosis
gccacgccguugg

SEQ ID NO: 2949969 - RNA, 15 nt, Mycobacterium avium subsp. paratuberculosis
gccacgcgcagggcg

SEQ ID NO: 2949970 - RNA, 13 nt, Mycobacterium avium subsp. paratuberculosis
gccacgcggcgcg

SEQ ID NO: 2949971 - RNA, 14 nt, Mycobacterium avium subsp. paratuberculosis
gccacgcggcgcgc

SEQ ID NO: 2949972 - RNA, 18 nt, Mycobacterium avium subsp. paratuberculosis
gccacgcuagcgugacgc

SEQ ID NO: 2949973 - RNA, 20 nt, Mycobacterium avium subsp. paratuberculosis
gccacgcuagcgugacgcuc

SEQ ID NO: 2949974 - RNA, 16 nt, Mycobacterium avium subsp. paratuberculosis
gccacgcucggcggcg

SEQ ID NO: 2949975 - RNA, 19 nt, Mycobacterium avium subsp. paratuberculosis
gccacgcucggcggcgcgc

SEQ ID NO: 2949976 - RNA, 21 nt, Mycobacterium avium subsp. paratuberculosis
gccacgcucgggccggcgccg

SEQ ID NO: 2949977 - RNA, 22 nt, Mycobacterium avium subsp. paratuberculosis
gccacgcucgggccggcgccga

SEQ ID NO: 2949978 - RNA, 16 nt, Mycobacterium avium subsp. paratuberculosis
gccacgcucucgccgg

SEQ ID NO: 2949979 - RNA, 18 nt, Mycobacterium avium subsp. paratuberculosis
gccacgcucucgccgguc

SEQ ID NO: 2949980 - RNA, 14 nt, Mycobacterium avium subsp. paratuberculosis
gccacgcuggcguc

SEQ ID NO: 2949981 - RNA, 16 nt, Mycobacterium avium subsp. paratuberculosis
gccacgcuggcgucca

SEQ ID NO: 2949982 - RNA, 17 nt, Mycobacterium avium subsp. paratuberculosis
gccacgcuggcguccag

SEQ ID NO: 2949983 - RNA, 20 nt, Mycobacterium avium subsp. paratuberculosis
gccacgcuggcguccagguc

SEQ ID NO: 2949984 - RNA, 20 nt, Mycobacterium avium subsp. paratuberculosis
gccacgcuggcgugacgcuc

SEQ ID NO: 2949985 - RNA, 13 nt, Mycobacterium avium subsp. paratuberculosis
gccacggcacguc

SEQ ID NO: 2949986 - RNA, 16 nt, Mycobacterium avium subsp. paratuberculosis
gccacggcacgucgag

SEQ ID NO: 2949987 - RNA, 14 nt, Mycobacterium avium subsp. paratuberculosis
gccacggccaccgc

SEQ ID NO: 2949988 - RNA, 15 nt, Mycobacterium avium subsp. paratuberculosis
gccacggccaccgcc

SEQ ID NO: 2949989 - RNA, 16 nt, Mycobacterium avium subsp. paratuberculosis
gccacggccaccgccg

SEQ ID NO: 2949990 - RNA, 12 nt, Mycobacterium avium subsp. paratuberculosis
gccacggccagc

SEQ ID NO: 2949991 - RNA, 15 nt, Mycobacterium avium subsp. paratuberculosis
gccacggccagcacc

SEQ ID NO: 2949992 - RNA, 19 nt, Mycobacterium avium subsp. paratuberculosis
gccacggccagcaccgcca

SEQ ID NO: 2949993 - RNA, 23 nt, Mycobacterium avium subsp. paratuberculosis
gccacggccagcaccgccagcgc

SEQ ID NO: 2949994 - RNA, 17 nt, Mycobacterium avium subsp. paratuberculosis
gccacggccgcggcccg

SEQ ID NO: 2949995 - RNA, 19 nt, Mycobacterium avium subsp. paratuberculosis
gccacggccgcggcccggc

SEQ ID NO: 2949996 - RNA, 22 nt, Mycobacterium avium subsp. paratuberculosis
gccacggccgcggcccggccac

SEQ ID NO: 2949997 - RNA, 15 nt, Mycobacterium avium subsp. paratuberculosis
gccacggccggcagc

SEQ ID NO: 2949998 - RNA, 16 nt, Mycobacterium avium subsp. paratuberculosis
gccacggccggcagca

SEQ ID NO: 2949999 - RNA, 13 nt, Mycobacterium avium subsp. paratuberculosis
gccacggcgacga

SEQ ID NO: 2950000 - RNA, 17 nt, Mycobacterium avium subsp. paratuberculosis
gccacggcgccaugcgc

SEQ ID NO: 2950001 - RNA, 19 nt, Mycobacterium avium subsp. paratuberculosis
gccacggcgccaugcgccg

SEQ ID NO: 2950002 - RNA, 20 nt, Mycobacterium avium subsp. paratuberculosis
gccacggcgccaugcgccgc

SEQ ID NO: 2950003 - RNA, 18 nt, Mycobacterium avium subsp. paratuberculosis
gccagaccguucuccgag

SEQ ID NO: 2950004 - RNA, 22 nt, Mycobacterium avium subsp. paratuberculosis
gccagaccguucuccgaggcgu

SEQ ID NO: 2950005 - RNA, 16 nt, Mycobacterium avium subsp. paratuberculosis
gccagaccucgccgac

SEQ ID NO: 2950006 - RNA, 17 nt, Mycobacterium avium subsp. paratuberculosis
gccagaccucgccgacg

SEQ ID NO: 2950007 - RNA, 22 nt, Mycobacterium avium subsp. paratuberculosis
gccagaccucgccgacgguguc

SEQ ID NO: 2950008 - RNA, 15 nt, Mycobacterium avium subsp. paratuberculosis
gccagacgaacgcgg

SEQ ID NO: 2950009 - RNA, 18 nt, Mycobacterium avium subsp. paratuberculosis
gccagacgaacgcggccg

SEQ ID NO: 2950010 - RNA, 18 nt, Mycobacterium avium subsp. paratuberculosis
gccagacgcgcaccgcca

SEQ ID NO: 2950011 - RNA, 21 nt, Mycobacterium avium subsp. paratuberculosis
gccagacgguggggcuggccg

SEQ ID NO: 2950012 - RNA, 22 nt, Mycobacterium avium subsp. paratuberculosis
gccagacgguggggcuggccgc

SEQ ID NO: 2950013 - RNA, 18 nt, Mycobacterium avium subsp. paratuberculosis
gccagacguccagcgccg

SEQ ID NO: 2950014 - RNA, 20 nt, Mycobacterium avium subsp. paratuberculosis
gccagacguccagcgccgcc

SEQ ID NO: 2950015 - RNA, 17 nt, Mycobacterium avium subsp. paratuberculosis
gccagacucacggcggc

SEQ ID NO: 2950016 - RNA, 18 nt, Mycobacterium avium subsp. paratuberculosis
gccagacucacggcggca

SEQ ID NO: 2950017 - RNA, 19 nt, Mycobacterium avium subsp. paratuberculosis
gccagacucacggcggcag

SEQ ID NO: 2950018 - RNA, 23 nt, Mycobacterium avium subsp. paratuberculosis
gccagacugaugcccucgccggu

SEQ ID NO: 2950019 - RNA, 16 nt, Mycobacterium avium subsp. paratuberculosis
gccagacugcgcaccg

SEQ ID NO: 2950020 - RNA, 20 nt, Mycobacterium avium subsp. paratuberculosis
gccagacugcgcaccgccag

SEQ ID NO: 2950021 - RNA, 23 nt, Mycobacterium avium subsp. paratuberculosis
gccagacugcgcaccgccagcac

SEQ ID NO: 2950022 - RNA, 20 nt, Mycobacterium avium subsp. paratuberculosis
gccagagcgcgaaaaccagc

SEQ ID NO: 2950023 - RNA, 21 nt, Mycobacterium avium subsp. paratuberculosis
gccagaucagcguggucagcg

SEQ ID NO: 2950024 - RNA, 14 nt, Mycobacterium avium subsp. paratuberculosis
gccagaucgacccc

SEQ ID NO: 2950025 - RNA, 17 nt, Mycobacterium avium subsp. paratuberculosis
gccagaucgacgccgcg

SEQ ID NO: 2950026 - RNA, 18 nt, Mycobacterium avium subsp. paratuberculosis
gccagaucgacgccgcgg

SEQ ID NO: 2950027 - RNA, 17 nt, Mycobacterium avium subsp. paratuberculosis
gccagaucgaggccagc

SEQ ID NO: 2950028 - RNA, 18 nt, Mycobacterium avium subsp. paratuberculosis
gccagaucgaggccagcg

SEQ ID NO: 2950029 - RNA, 19 nt, Mycobacterium avium subsp. paratuberculosis
gccagaucgaggccagcgc

SEQ ID NO: 2950030 - RNA, 21 nt, Mycobacterium avium subsp. paratuberculosis
gccagaucgaggccagcgcga

SEQ ID NO: 2950031 - RNA, 14 nt, Mycobacterium avium subsp. paratuberculosis
gccagaucgccugg

SEQ ID NO: 2950032 - RNA, 23 nt, Mycobacterium avium subsp. paratuberculosis
gccagaucgccuggcagcugccg

SEQ ID NO: 2950033 - RNA, 18 nt, Mycobacterium avium subsp. paratuberculosis
gccagaucuccgccuucg

SEQ ID NO: 2950034 - RNA, 23 nt, Mycobacterium avium subsp. paratuberculosis
gccagaucuccgccuucgacgau

SEQ ID NO: 2950035 - RNA, 21 nt, Mycobacterium avium subsp. paratuberculosis
gccagaucuguauuaagcugg

SEQ ID NO: 2950036 - RNA, 18 nt, Mycobacterium avium subsp. paratuberculosis
gccagaugcccgccccgc

SEQ ID NO: 2950037 - RNA, 17 nt, Mycobacterium avium subsp. paratuberculosis
gccagaugcgccgcgga

SEQ ID NO: 2950038 - RNA, 12 nt, Mycobacterium avium subsp. paratuberculosis
gccagcaacacc

SEQ ID NO: 2950039 - RNA, 13 nt, Mycobacterium avium subsp. paratuberculosis
gccagcaacacca

SEQ ID NO: 2950040 - RNA, 17 nt, Mycobacterium avium subsp. paratuberculosis
gccagcaacaccagcug

SEQ ID NO: 2950041 - RNA, 23 nt, Mycobacterium avium subsp. paratuberculosis
gccagcaacaccagcuggauggc

SEQ ID NO: 2950042 - RNA, 15 nt, Mycobacterium avium subsp. paratuberculosis
gccagcaacacccag

SEQ ID NO: 2950043 - RNA, 19 nt, Mycobacterium avium subsp. paratuberculosis
gccagcaacacccagccgc

SEQ ID NO: 2950044 - RNA, 20 nt, Mycobacterium avium subsp. paratuberculosis
gccagcaacacccagccgcu

SEQ ID NO: 2950045 - RNA, 14 nt, Mycobacterium avium subsp. paratuberculosis
gccagcaacagcag

SEQ ID NO: 2950046 - RNA, 16 nt, Mycobacterium avium subsp. paratuberculosis
gccagcaacagcagcg

SEQ ID NO: 2950047 - RNA, 17 nt, Mycobacterium avium subsp. paratuberculosis
gccagcaacagcagcgg

SEQ ID NO: 2950048 - RNA, 19 nt, Mycobacterium avium subsp. paratuberculosis
gccagcaacagcagcggca

SEQ ID NO: 2950049 - RNA, 16 nt, Mycobacterium avium subsp. paratuberculosis
gccagcaaccccgcgg

SEQ ID NO: 2950050 - RNA, 18 nt, Mycobacterium avium subsp. paratuberculosis
gccagcaaccccgcggug

SEQ ID NO: 2950051 - RNA, 21 nt, Mycobacterium avium subsp. paratuberculosis
gccagcaaccccgcggugcac

SEQ ID NO: 2950052 - RNA, 16 nt, Mycobacterium avium subsp. paratuberculosis
gccagcaaccgccgug

SEQ ID NO: 2950053 - RNA, 14 nt, Mycobacterium avium subsp. paratuberculosis
gccagcaaccggaa

SEQ ID NO: 2950054 - RNA, 18 nt, Mycobacterium avium subsp. paratuberculosis
gccagcacauagcgcagc

SEQ ID NO: 2950055 - RNA, 21 nt, Mycobacterium avium subsp. paratuberculosis
gccagcaccaccaacggcucg

SEQ ID NO: 2950056 - RNA, 15 nt, Mycobacterium avium subsp. paratuberculosis
gccagcaccaccgcg

SEQ ID NO: 2950057 - RNA, 19 nt, Mycobacterium avium subsp. paratuberculosis
gccagcaccaccgcgagcg

SEQ ID NO: 2950058 - RNA, 20 nt, Mycobacterium avium subsp. paratuberculosis
gccagcaccaccgucaccgc

SEQ ID NO: 2950059 - RNA, 21 nt, Mycobacterium avium subsp. paratuberculosis
gccagcaccaccgucaccgcc

SEQ ID NO: 2950060 - RNA, 22 nt, Mycobacterium avium subsp. paratuberculosis
gccagcaccaccgucaccgccg

SEQ ID NO: 2950061 - RNA, 15 nt, Mycobacterium avium subsp. paratuberculosis
gccagcaccaccucg

SEQ ID NO: 2950062 - RNA, 14 nt, Mycobacterium avium subsp. paratuberculosis
gccagcaccacguc

SEQ ID NO: 2950063 - RNA, 21 nt, Mycobacterium avium subsp. paratuberculosis
gccagcaccacguccgcggug

SEQ ID NO: 2950064 - RNA, 14 nt, Mycobacterium avium subsp. paratuberculosis
gccagcaccagcag

SEQ ID NO: 2950065 - RNA, 21 nt, Mycobacterium avium subsp. paratuberculosis
gccagcaccagcagccggucg

SEQ ID NO: 2950066 - RNA, 22 nt, Mycobacterium avium subsp. paratuberculosis
gccagcaccagcagccggucga

SEQ ID NO: 2950067 - RNA, 13 nt, Mycobacterium avium subsp. paratuberculosis
gccagcaccagcc

SEQ ID NO: 2950068 - RNA, 14 nt, Mycobacterium avium subsp. paratuberculosis
gccagcaccagccc

SEQ ID NO: 2950069 - RNA, 21 nt, Mycobacterium avium subsp. paratuberculosis
gccagcaccagcccgaugccg

SEQ ID NO: 2950070 - RNA, 14 nt, Mycobacterium avium subsp. paratuberculosis
gccagcaccagcgc

SEQ ID NO: 2950071 - RNA, 15 nt, Mycobacterium avium subsp. paratuberculosis
gccagcaccagcgcg

SEQ ID NO: 2950072 - RNA, 16 nt, Mycobacterium avium subsp. paratuberculosis
gccagcaccagcgcgc

SEQ ID NO: 2950073 - RNA, 15 nt, Mycobacterium avium subsp. paratuberculosis
gccagcaccagcgug

SEQ ID NO: 2950074 - RNA, 15 nt, Mycobacterium avium subsp. paratuberculosis
gccagcaccaggaag

SEQ ID NO: 2950075 - RNA, 19 nt, Mycobacterium avium subsp. paratuberculosis
gccagcaccaguucgcgua

SEQ ID NO: 2950076 - RNA, 20 nt, Mycobacterium avium subsp. paratuberculosis
gccagcaccaugaucaggcc

SEQ ID NO: 2950077 - RNA, 13 nt, Mycobacterium avium subsp. paratuberculosis
gccagcacccgcu

SEQ ID NO: 2950078 - RNA, 15 nt, Mycobacterium avium subsp. paratuberculosis
gccagcacccgcucg

SEQ ID NO: 2950079 - RNA, 18 nt, Mycobacterium avium subsp. paratuberculosis
gccagcacccgcucgcgg

SEQ ID NO: 2950080 - RNA, 22 nt, Mycobacterium avium subsp. paratuberculosis
gccagcacccgcucgcgggccc

SEQ ID NO: 2950081 - RNA, 14 nt, Mycobacterium avium subsp. paratuberculosis
gccagcacccgcug

SEQ ID NO: 2950082 - RNA, 17 nt, Mycobacterium avium subsp. paratuberculosis
gccagcacccgcugauc

SEQ ID NO: 2950083 - RNA, 21 nt, Mycobacterium avium subsp. paratuberculosis
gccagcacccgcugauccagc

SEQ ID NO: 2950084 - RNA, 23 nt, Mycobacterium avium subsp. paratuberculosis
gccagcacccgcugauccagcag

SEQ ID NO: 2950085 - RNA, 12 nt, Mycobacterium avium subsp. paratuberculosis
gccagcacccgg

SEQ ID NO: 2950086 - RNA, 16 nt, Mycobacterium avium subsp. paratuberculosis
gccagcacccggucgg

SEQ ID NO: 2950087 - RNA, 22 nt, Mycobacterium avium subsp. paratuberculosis
gccagcagcagcaggucgucga

SEQ ID NO: 2950088 - RNA, 13 nt, Mycobacterium avium subsp. paratuberculosis
gccagcagcagcc

SEQ ID NO: 2950089 - RNA, 15 nt, Mycobacterium avium subsp. paratuberculosis
gccagcagcagcccg

SEQ ID NO: 2950090 - RNA, 21 nt, Mycobacterium avium subsp. paratuberculosis
gccagcagcagcccgccgaug

SEQ ID NO: 2950091 - RNA, 22 nt, Mycobacterium avium subsp. paratuberculosis
gccagcagcagcccgccgaugg

SEQ ID NO: 2950092 - RNA, 14 nt, Mycobacterium avium subsp. paratuberculosis
gccagcagcagccg

SEQ ID NO: 2950093 - RNA, 15 nt, Mycobacterium avium subsp. paratuberculosis
gccagcagcagccgc

SEQ ID NO: 2950094 - RNA, 16 nt, Mycobacterium avium subsp. paratuberculosis
gccagcagcagccgcg

SEQ ID NO: 2950095 - RNA, 17 nt, Mycobacterium avium subsp. paratuberculosis
gccagcagcagccgcgc

SEQ ID NO: 2950096 - RNA, 19 nt, Mycobacterium avium subsp. paratuberculosis
gccagcagcagccgcgccg

SEQ ID NO: 2950097 - RNA, 21 nt, Mycobacterium avium subsp. paratuberculosis
gccagcagcagccgcgccgcc

SEQ ID NO: 2950098 - RNA, 16 nt, Mycobacterium avium subsp. paratuberculosis
gccagcagcagcgccg

SEQ ID NO: 2950099 - RNA, 23 nt, Mycobacterium avium subsp. paratuberculosis
gccagcagcagcgccgccaccgg

SEQ ID NO: 2950100 - RNA, 16 nt, Mycobacterium avium subsp. paratuberculosis
gccagcagcagcgcgg

SEQ ID NO: 2950101 - RNA, 17 nt, Mycobacterium avium subsp. paratuberculosis
gccagcagcagcgcggc

SEQ ID NO: 2950102 - RNA, 12 nt, Mycobacterium avium subsp. paratuberculosis
gccagcagcagg

SEQ ID NO: 2950103 - RNA, 13 nt, Mycobacterium avium subsp. paratuberculosis
gccagcagcaggu

SEQ ID NO: 2950104 - RNA, 14 nt, Mycobacterium avium subsp. paratuberculosis
gccagcagcaggua

SEQ ID NO: 2950105 - RNA, 14 nt, Mycobacterium avium subsp. paratuberculosis
gccagcagccagcu

SEQ ID NO: 2950106 - RNA, 15 nt, Mycobacterium avium subsp. paratuberculosis
gccagcagccagcug

SEQ ID NO: 2950107 - RNA, 16 nt, Mycobacterium avium subsp. paratuberculosis
gccagcagccagcugg

SEQ ID NO: 2950108 - RNA, 14 nt, Mycobacterium avium subsp. paratuberculosis
gccagcagcccggg

SEQ ID NO: 2950109 - RNA, 13 nt, Mycobacterium avium subsp. paratuberculosis
gccagcagccgca

SEQ ID NO: 2950110 - RNA, 15 nt, Mycobacterium avium subsp. paratuberculosis
gccagcagccgcagc

SEQ ID NO: 2950111 - RNA, 14 nt, Mycobacterium avium subsp. paratuberculosis
gccagcagccgcgc

SEQ ID NO: 2950112 - RNA, 16 nt, Mycobacterium avium subsp. paratuberculosis
gccagcagccgcgcga

SEQ ID NO: 2950113 - RNA, 23 nt, Mycobacterium avium subsp. paratuberculosis
gccagcagccgcgcgagcaucac

SEQ ID NO: 2950114 - RNA, 12 nt, Mycobacterium avium subsp. paratuberculosis
gccagcagccgg

SEQ ID NO: 2950115 - RNA, 21 nt, Mycobacterium avium subsp. paratuberculosis
gccagcagccgggucaguucg

SEQ ID NO: 2950116 - RNA, 13 nt, Mycobacterium avium subsp. paratuberculosis
gccagcagcgcaa

SEQ ID NO: 2950117 - RNA, 14 nt, Mycobacterium avium subsp. paratuberculosis
gccagcagcgcaag

SEQ ID NO: 2950118 - RNA, 12 nt, Mycobacterium avium subsp. paratuberculosis
gccagcagcgcg

SEQ ID NO: 2950119 - RNA, 15 nt, Mycobacterium avium subsp. paratuberculosis
gccagcagcgcgccg

SEQ ID NO: 2950120 - RNA, 21 nt, Mycobacterium avium subsp. paratuberculosis
gccagcagcgcgccgcgcugg

SEQ ID NO: 2950121 - RNA, 13 nt, Mycobacterium avium subsp. paratuberculosis
gccagcagcgcgu

SEQ ID NO: 2950122 - RNA, 17 nt, Mycobacterium avium subsp. paratuberculosis
gccagcagcgcgucgcg

SEQ ID NO: 2950123 - RNA, 21 nt, Mycobacterium avium subsp. paratuberculosis
gccagcagcgcgucgcgggcc

SEQ ID NO: 2950124 - RNA, 22 nt, Mycobacterium avium subsp. paratuberculosis
gccagcagcgcgucgcgggccc

SEQ ID NO: 2950125 - RNA, 18 nt, Mycobacterium avium subsp. paratuberculosis
gccagcagcggcacccgg

SEQ ID NO: 2950126 - RNA, 14 nt, Mycobacterium avium subsp. paratuberculosis
gccagcagcggcuu

SEQ ID NO: 2950127 - RNA, 19 nt, Mycobacterium avium subsp. paratuberculosis
gccagcagcucgugguaga

SEQ ID NO: 2950128 - RNA, 13 nt, Mycobacterium avium subsp. paratuberculosis
gccagcagcugcg

SEQ ID NO: 2950129 - RNA, 18 nt, Mycobacterium avium subsp. paratuberculosis
gccagcagcugcgggacc

SEQ ID NO: 2950130 - RNA, 20 nt, Mycobacterium avium subsp. paratuberculosis
gccagcagcuugacgucggu

SEQ ID NO: 2950131 - RNA, 17 nt, Mycobacterium avium subsp. paratuberculosis
gccagcaggaugaugac

SEQ ID NO: 2950132 - RNA, 21 nt, Mycobacterium avium subsp. paratuberculosis
gccagcaggaugaugaccgac

SEQ ID NO: 2950133 - RNA, 16 nt, Mycobacterium avium subsp. paratuberculosis
gccagcagggcgccga

SEQ ID NO: 2950134 - RNA, 18 nt, Mycobacterium avium subsp. paratuberculosis
gccagcagggcgccgacg

SEQ ID NO: 2950135 - RNA, 19 nt, Mycobacterium avium subsp. paratuberculosis
gccagcagggcgccgacga

SEQ ID NO: 2950136 - RNA, 21 nt, Mycobacterium avium subsp. paratuberculosis
gccagcagggcgccgacgauc

SEQ ID NO: 2950137 - RNA, 22 nt, Mycobacterium avium subsp. paratuberculosis
gccagcagggucagcgacaacg

SEQ ID NO: 2950138 - RNA, 21 nt, Mycobacterium avium subsp. paratuberculosis
gccagcagguagaagccgcga

SEQ ID NO: 2950139 - RNA, 22 nt, Mycobacterium avium subsp. paratuberculosis
gccagcagguagaagccgcgac

SEQ ID NO: 2950140 - RNA, 20 nt, Mycobacterium avium subsp. paratuberculosis
gccagcagguagaucgccag

SEQ ID NO: 2950141 - RNA, 22 nt, Mycobacterium avium subsp. paratuberculosis
gccagcagguagaucgccagcg

SEQ ID NO: 2950142 - RNA, 22 nt, Mycobacterium avium subsp. paratuberculosis
gccagcagguccgccggugcca

SEQ ID NO: 2950143 - RNA, 17 nt, Mycobacterium avium subsp. paratuberculosis
gccagcaggucgaaggc

SEQ ID NO: 2950144 - RNA, 22 nt, Mycobacterium avium subsp. paratuberculosis
gccagcaggucgaaggcggccg

SEQ ID NO: 2950145 - RNA, 14 nt, Mycobacterium avium subsp. paratuberculosis
gccagcagucguga

SEQ ID NO: 2950146 - RNA, 16 nt, Mycobacterium avium subsp. paratuberculosis
gccagcagucgugacg

SEQ ID NO: 2950147 - RNA, 19 nt, Mycobacterium avium subsp. paratuberculosis
gccagcagucgugacgcgg

SEQ ID NO: 2950148 - RNA, 20 nt, Mycobacterium avium subsp. paratuberculosis
gccagcagucgugacgcggc

SEQ ID NO: 2950149 - RNA, 21 nt, Mycobacterium avium subsp. paratuberculosis
gccagcagucgugacgcggcg

SEQ ID NO: 2950150 - RNA, 22 nt, Mycobacterium avium subsp. paratuberculosis
gccagcagucgugacgcggcgu

SEQ ID NO: 2950151 - RNA, 12 nt, Mycobacterium avium subsp. paratuberculosis
gccagcagugcc

SEQ ID NO: 2950152 - RNA, 14 nt, Mycobacterium avium subsp. paratuberculosis
gccagcagugccac

SEQ ID NO: 2950153 - RNA, 15 nt, Mycobacterium avium subsp. paratuberculosis
gccagcagugccacc

SEQ ID NO: 2950154 - RNA, 19 nt, Mycobacterium avium subsp. paratuberculosis
gccagcagugccaccacca

SEQ ID NO: 2950155 - RNA, 24 nt, Mycobacterium avium subsp. paratuberculosis
gccagcagugccaccaccacggcc

SEQ ID NO: 2950156 - RNA, 23 nt, Mycobacterium avium subsp. paratuberculosis
gccagcaguguccagucggccgu

SEQ ID NO: 2950157 - RNA, 18 nt, Mycobacterium avium subsp. paratuberculosis
gccagcaguucguccacg

SEQ ID NO: 2950158 - RNA, 13 nt, Mycobacterium avium subsp. paratuberculosis
gccagcauccgcu

SEQ ID NO: 2950159 - RNA, 19 nt, Mycobacterium avium subsp. paratuberculosis
gccagcauccgcuggugcg

SEQ ID NO: 2950160 - RNA, 21 nt, Mycobacterium avium subsp. paratuberculosis
gccagcauccgcuggugcgcg

SEQ ID NO: 2950161 - RNA, 22 nt, Mycobacterium avium subsp. paratuberculosis
gccagcauccgcuggugcgcgc

SEQ ID NO: 2950162 - RNA, 17 nt, Mycobacterium avium subsp. paratuberculosis
gccagcaucggaugccg

SEQ ID NO: 2950163 - RNA, 22 nt, Mycobacterium avium subsp. paratuberculosis
gccagcaucggaugccggggca

SEQ ID NO: 2950164 - RNA, 16 nt, Mycobacterium avium subsp. paratuberculosis
gccagcaucucggcga

SEQ ID NO: 2950165 - RNA, 21 nt, Mycobacterium avium subsp. paratuberculosis
gccagcaucucggcgaagguc

SEQ ID NO: 2950166 - RNA, 18 nt, Mycobacterium avium subsp. paratuberculosis
gccagcaugaucaccgcc

SEQ ID NO: 2950167 - RNA, 20 nt, Mycobacterium avium subsp. paratuberculosis
gccagcaugaucaccgccag

SEQ ID NO: 2950168 - RNA, 21 nt, Mycobacterium avium subsp. paratuberculosis
gccagcaugaucaccgccagc

SEQ ID NO: 2950169 - RNA, 23 nt, Mycobacterium avium subsp. paratuberculosis
gccagcaugaucaccgccagcgc

SEQ ID NO: 2950170 - RNA, 17 nt, Mycobacterium avium subsp. paratuberculosis
gccagcaugcgaugacc

SEQ ID NO: 2950171 - RNA, 12 nt, Mycobacterium avium subsp. paratuberculosis
gccagccguugu

SEQ ID NO: 2950172 - RNA, 16 nt, Mycobacterium avium subsp. paratuberculosis
gccagccuggcggcga

SEQ ID NO: 2950173 - RNA, 21 nt, Mycobacterium avium subsp. paratuberculosis
gccagccuggcggcgacccgg

SEQ ID NO: 2950174 - RNA, 22 nt, Mycobacterium avium subsp. paratuberculosis
gccagcgaauuguucugcuugg

SEQ ID NO: 2950175 - RNA, 13 nt, Mycobacterium avium subsp. paratuberculosis
gccagcgacaacg

SEQ ID NO: 2950176 - RNA, 22 nt, Mycobacterium avium subsp. paratuberculosis
gccagcgacaacguggugugca

SEQ ID NO: 2950177 - RNA, 16 nt, Mycobacterium avium subsp. paratuberculosis
gccagcgacggccggg

SEQ ID NO: 2950178 - RNA, 20 nt, Mycobacterium avium subsp. paratuberculosis
gccagcgagaagucgcucag

SEQ ID NO: 2950179 - RNA, 16 nt, Mycobacterium avium subsp. paratuberculosis
gccagcgaguccagcc

SEQ ID NO: 2950180 - RNA, 19 nt, Mycobacterium avium subsp. paratuberculosis
gccagcgaguccagccagc

SEQ ID NO: 2950181 - RNA, 20 nt, Mycobacterium avium subsp. paratuberculosis
gccagcgaguccagccagcc

SEQ ID NO: 2950182 - RNA, 23 nt, Mycobacterium avium subsp. paratuberculosis
gccagcgaguccagccagccgcg

SEQ ID NO: 2950183 - RNA, 18 nt, Mycobacterium avium subsp. paratuberculosis
gccagcgagucgaugacc

SEQ ID NO: 2950184 - RNA, 21 nt, Mycobacterium avium subsp. paratuberculosis
gccagcgagucgaugaccucg

SEQ ID NO: 2950185 - RNA, 23 nt, Mycobacterium avium subsp. paratuberculosis
gccagcgagucgaugaccucgcg

SEQ ID NO: 2950186 - RNA, 19 nt, Mycobacterium avium subsp. paratuberculosis
gccagcgagugggugaagg

SEQ ID NO: 2950187 - RNA, 15 nt, Mycobacterium avium subsp. paratuberculosis
gccagcgcaccgagc

SEQ ID NO: 2950188 - RNA, 19 nt, Mycobacterium avium subsp. paratuberculosis
gccagcgcaccgggcccgc

SEQ ID NO: 2950189 - RNA, 20 nt, Mycobacterium avium subsp. paratuberculosis
gccagcgcaccgggcccgcc

SEQ ID NO: 2950190 - RNA, 14 nt, Mycobacterium avium subsp. paratuberculosis
gccagcgcagcacu

SEQ ID NO: 2950191 - RNA, 15 nt, Mycobacterium avium subsp. paratuberculosis
gccagcgcagcacug

SEQ ID NO: 2950192 - RNA, 13 nt, Mycobacterium avium subsp. paratuberculosis
gccagcgcagcga

SEQ ID NO: 2950193 - RNA, 20 nt, Mycobacterium avium subsp. paratuberculosis
gccagcgcagguacgcggcg

SEQ ID NO: 2950194 - RNA, 21 nt, Mycobacterium avium subsp. paratuberculosis
gccagcgcaucggucaccagc

SEQ ID NO: 2950195 - RNA, 17 nt, Mycobacterium avium subsp. paratuberculosis
gccagcgccacccccca

SEQ ID NO: 2950196 - RNA, 15 nt, Mycobacterium avium subsp. paratuberculosis
gccagcgccacgcuc

SEQ ID NO: 2950197 - RNA, 15 nt, Mycobacterium avium subsp. paratuberculosis
gccagcgccagcgcc

SEQ ID NO: 2950198 - RNA, 20 nt, Mycobacterium avium subsp. paratuberculosis
gccagcgccaugccgccgac

SEQ ID NO: 2950199 - RNA, 21 nt, Mycobacterium avium subsp. paratuberculosis
gccagcgccaugccgccgacc

SEQ ID NO: 2950200 - RNA, 13 nt, Mycobacterium avium subsp. paratuberculosis
gccagcgccccca

SEQ ID NO: 2950201 - RNA, 16 nt, Mycobacterium avium subsp. paratuberculosis
gccagcgcccccagcg

SEQ ID NO: 2950202 - RNA, 18 nt, Mycobacterium avium subsp. paratuberculosis
gccagcgccccgccgggg

SEQ ID NO: 2950203 - RNA, 19 nt, Mycobacterium avium subsp. paratuberculosis
gccagcgccccgccggggg

SEQ ID NO: 2950204 - RNA, 16 nt, Mycobacterium avium subsp. paratuberculosis
gccagcgcccgauucg

SEQ ID NO: 2950205 - RNA, 17 nt, Mycobacterium avium subsp. paratuberculosis
gccagcgcccgcgcgau

SEQ ID NO: 2950206 - RNA, 20 nt, Mycobacterium avium subsp. paratuberculosis
gccagcgcccgcgcgaucgg

SEQ ID NO: 2950207 - RNA, 17 nt, Mycobacterium avium subsp. paratuberculosis
gccagcgcccgcgcgug

SEQ ID NO: 2950208 - RNA, 22 nt, Mycobacterium avium subsp. paratuberculosis
gccagcgcccgcgcgugggcca

SEQ ID NO: 2950209 - RNA, 14 nt, Mycobacterium avium subsp. paratuberculosis
gccagcgcccgcgg

SEQ ID NO: 2950210 - RNA, 18 nt, Mycobacterium avium subsp. paratuberculosis
gccagcgcccgcgggugc

SEQ ID NO: 2950211 - RNA, 13 nt, Mycobacterium avium subsp. paratuberculosis
gccagcgcccgcu

SEQ ID NO: 2950212 - RNA, 14 nt, Mycobacterium avium subsp. paratuberculosis
gccagcgcccggcg

SEQ ID NO: 2950213 - RNA, 13 nt, Mycobacterium avium subsp. paratuberculosis
gccagcgccgaga

SEQ ID NO: 2950214 - RNA, 14 nt, Mycobacterium avium subsp. paratuberculosis
gccagcgccgagau

SEQ ID NO: 2950215 - RNA, 13 nt, Mycobacterium avium subsp. paratuberculosis
gccagcgccgagc

SEQ ID NO: 2950216 - RNA, 17 nt, Mycobacterium avium subsp. paratuberculosis
gccagcgccgcaacggc

SEQ ID NO: 2950217 - RNA, 15 nt, Mycobacterium avium subsp. paratuberculosis
gccagcgccgccagc

SEQ ID NO: 2950218 - RNA, 18 nt, Mycobacterium avium subsp. paratuberculosis
gccagcgccgccagccgc

SEQ ID NO: 2950219 - RNA, 19 nt, Mycobacterium avium subsp. paratuberculosis
gccagcgccgccagccgca

SEQ ID NO: 2950220 - RNA, 17 nt, Mycobacterium avium subsp. paratuberculosis
gccagcgccgcccgggc
